United States Patent 9,624,556 (VIRAL AND VIRAL ASSOCIATED MIRNAS AND USES THEREOF) - sequence listing, part 18

SEQ ID NO: 526303 - RNA, 64 nt, Human; identical to SEQ ID NO: 305239

SEQ ID NO: 526304 - RNA, 64 nt, Human; identical to SEQ ID NO: 384034

SEQ ID NO: 526305 - RNA, 64 nt, Human; identical to SEQ ID NO: 384035

SEQ ID NO: 526306 - RNA, 64 nt, Human; identical to SEQ ID NO: 384036

SEQ ID NO: 526307 - RNA, 64 nt, Human; identical to SEQ ID NO: 303201

SEQ ID NO: 526308 - RNA, 64 nt, Human; identical to SEQ ID NO: 305183

SEQ ID NO: 526309 - RNA, 64 nt, Human; identical to SEQ ID NO: 305517

SEQ ID NO: 526310 - RNA, 50 nt, Human; identical to SEQ ID NO: 305518

SEQ ID NO: 526311 - RNA, 64 nt, Human; identical to SEQ ID NO: 303202

SEQ ID NO: 526312 - RNA, 64 nt, Human; identical to SEQ ID NO: 305202

SEQ ID NO: 526313 - RNA, 64 nt, Human; identical to SEQ ID NO: 305162

SEQ ID NO: 526314 - RNA, 64 nt, Human; identical to SEQ ID NO: 305163

SEQ ID NO: 526315 - RNA, 64 nt, Human; identical to SEQ ID NO: 303203

SEQ ID NO: 526316 - RNA, 64 nt, Human; identical to SEQ ID NO: 305240

SEQ ID NO: 526317 - RNA, 64 nt, Human; identical to SEQ ID NO: 304972

SEQ ID NO: 526318 - RNA, 64 nt, Human; identical to SEQ ID NO: 304973

SEQ ID NO: 526319 - RNA, 64 nt, Human; identical to SEQ ID NO: 303286

SEQ ID NO: 526320 - RNA, 64 nt, Human; identical to SEQ ID NO: 305278

SEQ ID NO: 526321 - RNA, 64 nt, Human; identical to SEQ ID NO: 305314

SEQ ID NO: 526322 - RNA, 64 nt, Human; identical to SEQ ID NO: 384038

SEQ ID NO: 526323 - RNA, 64 nt, Human; identical to SEQ ID NO: 384039

SEQ ID NO: 526324 - RNA, 64 nt, Human; identical to SEQ ID NO: 384040

SEQ ID NO: 526325 - RNA, 64 nt, Human; identical to SEQ ID NO: 305315

SEQ ID NO: 526326 - RNA, 64 nt, Human; identical to SEQ ID NO: 303287

SEQ ID NO: 526327 - RNA, 64 nt, Human; identical to SEQ ID NO: 305366

SEQ ID NO: 526328 - RNA, 64 nt, Human; identical to SEQ ID NO: 305449

SEQ ID NO: 526329 - RNA, 64 nt, Human; identical to SEQ ID NO: 305450

SEQ ID NO: 526330 - RNA, 64 nt, Human; identical to SEQ ID NO: 303288

SEQ ID NO: 526331 - RNA, 64 nt, Human; identical to SEQ ID NO: 305451

SEQ ID NO: 526332 - RNA, 64 nt, Human; identical to SEQ ID NO: 305164

SEQ ID NO: 526333 - RNA, 64 nt, Human; identical to SEQ ID NO: 303809

SEQ ID NO: 526334 - RNA, 64 nt, Human; identical to SEQ ID NO: 304877

SEQ ID NO: 526335 - RNA, 64 nt, Human; identical to SEQ ID NO: 304878

SEQ ID NO: 526336 - RNA, 64 nt, Human; identical to SEQ ID NO: 304879

SEQ ID NO: 526337 - RNA, 64 nt, Human; identical to SEQ ID NO: 304896

SEQ ID NO: 526338 - RNA, 64 nt, Human; identical to SEQ ID NO: 304897

SEQ ID NO: 526339 - RNA, 64 nt, Human; identical to SEQ ID NO: 303810

SEQ ID NO: 526340 - RNA, 64 nt, Human; identical to SEQ ID NO: 384041

SEQ ID NO: 526341 - RNA, 64 nt, Human; identical to SEQ ID NO: 384042

SEQ ID NO: 526342 - RNA, 64 nt, Human; identical to SEQ ID NO: 384043

SEQ ID NO: 526343 - RNA, 64 nt, Human; identical to SEQ ID NO: 304898

SEQ ID NO: 526344 - RNA, 64 nt, Human; identical to SEQ ID NO: 304934

SEQ ID NO: 526345 - RNA, 64 nt, Human; identical to SEQ ID NO: 304935

SEQ ID NO: 526346 - RNA, 64 nt, Human; identical to SEQ ID NO: 303811

SEQ ID NO: 526347 - RNA, 64 nt, Human; identical to SEQ ID NO: 304915

SEQ ID NO: 526348 - RNA, 64 nt, Human; identical to SEQ ID NO: 304916

SEQ ID NO: 526349 - RNA, 64 nt, Human; identical to SEQ ID NO: 304917

SEQ ID NO: 526350 - RNA, 64 nt, Human; identical to SEQ ID NO: 304991

SEQ ID NO: 526351 - RNA, 64 nt, Human; identical to SEQ ID NO: 304992

SEQ ID NO: 526352 - RNA, 64 nt, Human; identical to SEQ ID NO: 303828

SEQ ID NO: 526353 - RNA, 64 nt, Human; identical to SEQ ID NO: 304953

SEQ ID NO: 526354 - RNA, 64 nt, Human; identical to SEQ ID NO: 304954

SEQ ID NO: 526355 - RNA, 64 nt, Human; identical to SEQ ID NO: 304955

SEQ ID NO: 526356 - RNA, 64 nt, Human; identical to SEQ ID NO: 305086

SEQ ID NO: 526357 - RNA, 64 nt, Human; identical to SEQ ID NO: 305087

SEQ ID NO: 526358 - RNA, 62 nt, Human
ugacucaggccacaccauggaaucacugcauccaaggccauuccugcccucucugagucuca

SEQ ID NO: 526359 - RNA, 62 nt, Human
cucggcugacugagaugcaaggucugaccccacaaggccaggccaauguugcucagugauca

SEQ ID NO: 526360 - RNA, 62 nt, Human
uuugucuccacuuuagagaugagaaacugagccaaggccacauagcuaccuacagugacaga

SEQ ID NO: 526361 - RNA, 64 nt, Human; identical to SEQ ID NO: 303843

SEQ ID NO: 526362 - RNA, 64 nt, Human; identical to SEQ ID NO: 304993

SEQ ID NO: 526363 - RNA, 64 nt, Human; identical to SEQ ID NO: 304858

SEQ ID NO: 526364 - RNA, 64 nt, Human; identical to SEQ ID NO: 304859

SEQ ID NO: 526365 - RNA, 64 nt, Human; identical to SEQ ID NO: 303844

SEQ ID NO: 526366 - RNA, 57 nt, Human; identical to SEQ ID NO: 305010

SEQ ID NO: 526367 - RNA, 64 nt, Human; identical to SEQ ID NO: 305011

SEQ ID NO: 526368 - RNA, 64 nt, Human; identical to SEQ ID NO: 305012

SEQ ID NO: 526369 - RNA, 64 nt, Human; identical to SEQ ID NO: 305257

SEQ ID NO: 526370 - RNA, 61 nt, Human; identical to SEQ ID NO: 305258

SEQ ID NO: 526371 - RNA, 64 nt, Human; identical to SEQ ID NO: 303845

SEQ ID NO: 526372 - RNA, 64 nt, Human; identical to SEQ ID NO: 305029

SEQ ID NO: 526373 - RNA, 64 nt, Human; identical to SEQ ID NO: 305030

SEQ ID NO: 526374 - RNA, 64 nt, Human; identical to SEQ ID NO: 305031

SEQ ID NO: 526375 - RNA, 64 nt, Human; identical to SEQ ID NO: 304936

SEQ ID NO: 526376 - RNA, 62 nt, Human
ugcuuguucagauuccaagacagaaggcuucacaaggccaacgccuggaaaaugggcaucuc

SEQ ID NO: 526377 - RNA, 62 nt, Human
ggcuuugacaaccaggcguuccucccugaccacaaggccaacugggcgcccguccccagccc

SEQ ID NO: 526378 - RNA, 62 nt, Human
gcccaaggaacacccauggugcaguccucaggcaaggccaggacggggcugaggcccugcgu

SEQ ID NO: 526379 - RNA, 64 nt, Human; identical to SEQ ID NO: 303860

SEQ ID NO: 526380 - RNA, 64 nt, Human; identical to SEQ ID NO: 305088

SEQ ID NO: 526381 - RNA, 64 nt, Human; identical to SEQ ID NO: 305259

SEQ ID NO: 526382 - RNA, 64 nt, Human; identical to SEQ ID NO: 303861

SEQ ID NO: 526383 - RNA, 64 nt, Human; identical to SEQ ID NO: 305519

SEQ ID NO: 526384 - RNA, 64 nt, Human; identical to SEQ ID NO: 304668

SEQ ID NO: 526385 - RNA, 64 nt, Human; identical to SEQ ID NO: 304669

SEQ ID NO: 526386 - RNA, 57 nt, Human; identical to SEQ ID NO: 303862

SEQ ID NO: 526387 - RNA, 64 nt, Human; identical to SEQ ID NO: 304649

SEQ ID NO: 526388 - RNA, 64 nt, Human; identical to SEQ ID NO: 304650

SEQ ID NO: 526389 - RNA, 64 nt, Human; identical to SEQ ID NO: 304651

SEQ ID NO: 526390 - RNA, 64 nt, Human; identical to SEQ ID NO: 304670

SEQ ID NO: 526391 - RNA, 64 nt, Human; identical to SEQ ID NO: 303877

SEQ ID NO: 526392 - RNA, 64 nt, Human; identical to SEQ ID NO: 304706

SEQ ID NO: 526393 - RNA, 64 nt, Human; identical to SEQ ID NO: 304707

SEQ ID NO: 526394 - RNA, 62 nt, Human
ccaucacacacagauuguccugguguucauuucaaggccaguguucagcagcagcguuugga

SEQ ID NO: 526395 - RNA, 62 nt, Human
uugaugaccacacggggcagagagaaaccaaccaaggccagcaccuccgucggaagcauuug

SEQ ID NO: 526396 - RNA, 62 nt, Human
gagccagagagcaccgccgggaggcgcucgcgcaaggccacggucagcacaggcacgguccc

SEQ ID NO: 526397 - RNA, 64 nt, Human; identical to SEQ ID NO: 304708

SEQ ID NO: 526398 - RNA, 64 nt, Human; identical to SEQ ID NO: 304725

SEQ ID NO: 526399 - RNA, 64 nt, Human; identical to SEQ ID NO: 304726

SEQ ID NO: 526400 - RNA, 64 nt, Human; identical to SEQ ID NO: 303878

SEQ ID NO: 526401 - RNA, 64 nt, Human; identical to SEQ ID NO: 304727

SEQ ID NO: 526402 - RNA, 64 nt, Human; identical to SEQ ID NO: 304801

SEQ ID NO: 526403 - RNA, 63 nt, Human; identical to SEQ ID NO: 304802

SEQ ID NO: 526404 - RNA, 64 nt, Human; identical to SEQ ID NO: 303879

SEQ ID NO: 526405 - RNA, 64 nt, Human; identical to SEQ ID NO: 304744

SEQ ID NO: 526406 - RNA, 64 nt, Human; identical to SEQ ID NO: 304745

SEQ ID NO: 526407 - RNA, 64 nt, Human; identical to SEQ ID NO: 304746

SEQ ID NO: 526408 - RNA, 64 nt, Human; identical to SEQ ID NO: 305048

SEQ ID NO: 526409 - RNA, 64 nt, Human; identical to SEQ ID NO: 305049

SEQ ID NO: 526410 - RNA, 64 nt, Human; identical to SEQ ID NO: 303894

SEQ ID NO: 526411 - RNA, 64 nt, Human; identical to SEQ ID NO: 304782

SEQ ID NO: 526412 - RNA, 62 nt, Human
aacacuggagugguaacaagaggagcaggaagcaaggccagcccugguucuccauccccaug

SEQ ID NO: 526413 - RNA, 62 nt, Human
cagugacguuguacucuccucauucugcacugcaaggccacucuucuucauugugagaugca

SEQ ID NO: 526414 - RNA, 58 nt, Human
aaagagaaggggcuuugugaacauggugcaaggccaggaauuuugggagcaaaaacca

SEQ ID NO: 526415 - RNA, 64 nt, Human; identical to SEQ ID NO: 304783

SEQ ID NO: 526416 - RNA, 64 nt, Human; identical to SEQ ID NO: 304784

SEQ ID NO: 526417 - RNA, 64 nt, Human; identical to SEQ ID NO: 304687

SEQ ID NO: 526418 - RNA, 64 nt, Human; identical to SEQ ID NO: 304688

SEQ ID NO: 526419 - RNA, 64 nt, Human; identical to SEQ ID NO: 303895

SEQ ID NO: 526420 - RNA, 64 nt, Human; identical to SEQ ID NO: 304803

SEQ ID NO: 526421 - RNA, 64 nt, Human; identical to SEQ ID NO: 305067

SEQ ID NO: 526422 - RNA, 64 nt, Human; identical to SEQ ID NO: 305068

SEQ ID NO: 526423 - RNA, 64 nt, Human; identical to SEQ ID NO: 303896

SEQ ID NO: 526424 - RNA, 64 nt, Human; identical to SEQ ID NO: 304820

SEQ ID NO: 526425 - RNA, 64 nt, Human; identical to SEQ ID NO: 304821

SEQ ID NO: 526426 - RNA, 64 nt, Human; identical to SEQ ID NO: 304822

SEQ ID NO: 526427 - RNA, 64 nt, Human; identical to SEQ ID NO: 304763

SEQ ID NO: 526428 - RNA, 64 nt, Human; identical to SEQ ID NO: 304764

SEQ ID NO: 526429 - RNA, 64 nt, Human; identical to SEQ ID NO: 303911

SEQ ID NO: 526430 - RNA, 61 nt, Human
aauguguggcccuguccccaagcucagcaccaccggccaugaccagagguugcucggccca

SEQ ID NO: 526431 - RNA, 62 nt, Human
gcgugccaaccucagaugccaacucaggucaucaaggccaaggaccaguggcgaaagugagu

SEQ ID NO: 526432 - RNA, 62 nt, Human
uuucugcuucccagagagggucuggccuugcccaaggccacucagugauuuaggaagaaggc

SEQ ID NO: 526433 - RNA, 64 nt, Human; identical to SEQ ID NO: 304860

SEQ ID NO: 526434 - RNA, 64 nt, Human; identical to SEQ ID NO: 304592

SEQ ID NO: 526435 - RNA, 64 nt, Human; identical to SEQ ID NO: 304593

SEQ ID NO: 526436 - RNA, 64 nt, Human; identical to SEQ ID NO: 303912

SEQ ID NO: 526437 - RNA, 64 nt, Human; identical to SEQ ID NO: 304974

SEQ ID NO: 526438 - RNA, 64 nt, Human; identical to SEQ ID NO: 304543

SEQ ID NO: 526439 - RNA, 64 nt, Human; identical to SEQ ID NO: 304544

SEQ ID NO: 526440 - RNA, 64 nt, Human; identical to SEQ ID NO: 303913

SEQ ID NO: 526441 - RNA, 64 nt, Human; identical to SEQ ID NO: 305050

SEQ ID NO: 526442 - RNA, 64 nt, Human; identical to SEQ ID NO: 304509

SEQ ID NO: 526443 - RNA, 64 nt, Human; identical to SEQ ID NO: 304510

SEQ ID NO: 526444 - RNA, 64 nt, Human; identical to SEQ ID NO: 303928

SEQ ID NO: 526445 - RNA, 64 nt, Human; identical to SEQ ID NO: 304458

SEQ ID NO: 526446 - RNA, 64 nt, Human; identical to SEQ ID NO: 304459

SEQ ID NO: 526447 - RNA, 63 nt, Human; identical to SEQ ID NO: 304460

SEQ ID NO: 526448 - RNA, 61 nt, Human
cagggaaaugggcucugggcuggcugccugcaccggccaugucgacccaggacccggacac

SEQ ID NO: 526449 - RNA, 61 nt, Human
uggggcuacaguaguggguaaacaaaugcccaccggccaagaggccauuaacaaaucgucc

SEQ ID NO: 526450 - RNA, 61 nt, Human
uugugguuauagcuucccauaugccacauucaccggccaccuccucgccguggaacccugc

SEQ ID NO: 526451 - RNA, 64 nt, Human; identical to SEQ ID NO: 304511

SEQ ID NO: 526452 - RNA, 64 nt, Human; identical to SEQ ID NO: 303929

SEQ ID NO: 526453 - RNA, 64 nt, Human; identical to SEQ ID NO: 304475

SEQ ID NO: 526454 - RNA, 64 nt, Human; identical to SEQ ID NO: 304476

SEQ ID NO: 526455 - RNA, 64 nt, Human; identical to SEQ ID NO: 304477

SEQ ID NO: 526456 - RNA, 64 nt, Human; identical to SEQ ID NO: 304492

SEQ ID NO: 526457 - RNA, 64 nt, Human; identical to SEQ ID NO: 304493

SEQ ID NO: 526458 - RNA, 64 nt, Human; identical to SEQ ID NO: 303930

SEQ ID NO: 526459 - RNA, 64 nt, Human; identical to SEQ ID NO: 304494

SEQ ID NO: 526460 - RNA, 64 nt, Human; identical to SEQ ID NO: 304560

SEQ ID NO: 526461 - RNA, 64 nt, Human; identical to SEQ ID NO: 304561

SEQ ID NO: 526462 - RNA, 64 nt, Human; identical to SEQ ID NO: 303932

SEQ ID NO: 526463 - RNA, 64 nt, Human; identical to SEQ ID NO: 304545

SEQ ID NO: 526464 - RNA, 64 nt, Human; identical to SEQ ID NO: 304689

SEQ ID NO: 526465 - RNA, 64 nt, Human; identical to SEQ ID NO: 303933

SEQ ID NO: 526466 - RNA, 62 nt, Human
accuggccucagcccuggcagggcucucucuucaaggccauauccaccugugcccuggggcu

SEQ ID NO: 526467 - RNA, 62 nt, Human
ugaugggcuugcccauccauuacugcuacaaucaaggccaggcuuggaguuuggccagucuu

SEQ ID NO: 526468 - RNA, 62 nt, Human
acccggcucuacccaagaguggaaaggaacaccaaggccauuucaauuuugcagcaccaucc

SEQ ID NO: 526469 - RNA, 64 nt, Human; identical to SEQ ID NO: 304562

SEQ ID NO: 526470 - RNA, 64 nt, Human; identical to SEQ ID NO: 304574

SEQ ID NO: 526471 - RNA, 64 nt, Human; identical to SEQ ID NO: 304575

SEQ ID NO: 526472 - RNA, 64 nt, Human; identical to SEQ ID NO: 303934

SEQ ID NO: 526473 - RNA, 64 nt, Human; identical to SEQ ID NO: 304576

SEQ ID NO: 526474 - RNA, 64 nt, Human; identical to SEQ ID NO: 304356

SEQ ID NO: 526475 - RNA, 64 nt, Human; identical to SEQ ID NO: 304357

SEQ ID NO: 526476 - RNA, 64 nt, Human; identical to SEQ ID NO: 303935

SEQ ID NO: 526477 - RNA, 64 nt, Human; identical to SEQ ID NO: 304594

SEQ ID NO: 526478 - RNA, 64 nt, Human; identical to SEQ ID NO: 304630

SEQ ID NO: 526479 - RNA, 64 nt, Human; identical to SEQ ID NO: 304631

SEQ ID NO: 526480 - RNA, 64 nt, Human; identical to SEQ ID NO: 303936

SEQ ID NO: 526481 - RNA, 64 nt, Human; identical to SEQ ID NO: 304611

SEQ ID NO: 526482 - RNA, 64 nt, Human; identical to SEQ ID NO: 304612

SEQ ID NO: 526483 - RNA, 64 nt, Human; identical to SEQ ID NO: 304613

SEQ ID NO: 526484 - RNA, 61 nt, Human
ucuggggaggacuuugugcucagcacucugcaccggccacucuuagcccccgaggcguuga

SEQ ID NO: 526485 - RNA, 61 nt, Human
ccuuggaagucacaguuuggggucacuugagaccggccaggaauguuugcaugaccuaccu

SEQ ID NO: 526486 - RNA, 61 nt, Human
guguuaccaccagcacccagaccgaacccccaccggccaaauguggugaugccgaagaugu

SEQ ID NO: 526487 - RNA, 64 nt, Human; identical to SEQ ID NO: 304407

SEQ ID NO: 526488 - RNA, 64 nt, Human; identical to SEQ ID NO: 304408

SEQ ID NO: 526489 - RNA, 61 nt, Human; identical to SEQ ID NO: 303937

SEQ ID NO: 526490 - RNA, 64 nt, Human; identical to SEQ ID NO: 304632

SEQ ID NO: 526491 - RNA, 64 nt, Human; identical to SEQ ID NO: 304339

SEQ ID NO: 526492 - RNA, 64 nt, Human; identical to SEQ ID NO: 304340

SEQ ID NO: 526493 - RNA, 64 nt, Human; identical to SEQ ID NO: 303938

SEQ ID NO: 526494 - RNA, 64 nt, Human; identical to SEQ ID NO: 304765

SEQ ID NO: 526495 - RNA, 64 nt, Human; identical to SEQ ID NO: 304288

SEQ ID NO: 526496 - RNA, 64 nt, Human; identical to SEQ ID NO: 304289

SEQ ID NO: 526497 - RNA, 64 nt, Human; identical to SEQ ID NO: 303939

SEQ ID NO: 526498 - RNA, 64 nt, Human; identical to SEQ ID NO: 304839

SEQ ID NO: 526499 - RNA, 64 nt, Human; identical to SEQ ID NO: 304840

SEQ ID NO: 526500 - RNA, 64 nt, Human; identical to SEQ ID NO: 304841

SEQ ID NO: 526501 - RNA, 64 nt, Human; identical to SEQ ID NO: 304254

SEQ ID NO: 526502 - RNA, 51 nt, Human; identical to SEQ ID NO: 437528

SEQ ID NO: 526503 - RNA, 61 nt, Human; identical to SEQ ID NO: 525492

SEQ ID NO: 526504 - RNA, 61 nt, Human; identical to SEQ ID NO: 525493

SEQ ID NO: 526505 - RNA, 64 nt, Human; identical to SEQ ID NO: 304255

SEQ ID NO: 526506 - RNA, 64 nt, Human; identical to SEQ ID NO: 303940

SEQ ID NO: 526507 - RNA, 64 nt, Human; identical to SEQ ID NO: 305069

SEQ ID NO: 526508 - RNA, 64 nt, Human; identical to SEQ ID NO: 304237

SEQ ID NO: 526509 - RNA, 64 nt, Human; identical to SEQ ID NO: 304238

SEQ ID NO: 526510 - RNA, 64 nt, Human; identical to SEQ ID NO: 303941

SEQ ID NO: 526511 - RNA, 64 nt, Human; identical to SEQ ID NO: 304220

SEQ ID NO: 526512 - RNA, 64 nt, Human; identical to SEQ ID NO: 304221

SEQ ID NO: 526513 - RNA, 64 nt, Human; identical to SEQ ID NO: 304222

SEQ ID NO: 526514 - RNA, 64 nt, Human; identical to SEQ ID NO: 304239

SEQ ID NO: 526515 - RNA, 64 nt, Human; identical to SEQ ID NO: 303942

SEQ ID NO: 526516 - RNA, 64 nt, Human; identical to SEQ ID NO: 304256

SEQ ID NO: 526517 - RNA, 64 nt, Human; identical to SEQ ID NO: 304271

SEQ ID NO: 526518 - RNA, 64 nt, Human; identical to SEQ ID NO: 304272

SEQ ID NO: 526519 - RNA, 64 nt, Human; identical to SEQ ID NO: 303943

SEQ ID NO: 526520 - RNA, 61 nt, Human; identical to SEQ ID NO: 522360

SEQ ID NO: 526521 - RNA, 61 nt, Human; identical to SEQ ID NO: 526430

SEQ ID NO: 526522 - RNA, 62 nt, Human
uuucauuccuguuuuucuuggcaggagagaagcaaggccacuaaaagaggagaugguggaga

SEQ ID NO: 526523 - RNA, 63 nt, Human; identical to SEQ ID NO: 304273

SEQ ID NO: 526524 - RNA, 64 nt, Human; identical to SEQ ID NO: 304322

SEQ ID NO: 526525 - RNA, 64 nt, Human; identical to SEQ ID NO: 304323

SEQ ID NO: 526526 - RNA, 64 nt, Human; identical to SEQ ID NO: 303944

SEQ ID NO: 526527 - RNA, 64 nt, Human; identical to SEQ ID NO: 304290

SEQ ID NO: 526528 - RNA, 64 nt, Human; identical to SEQ ID NO: 304390

SEQ ID NO: 526529 - RNA, 64 nt, Human; identical to SEQ ID NO: 304391

SEQ ID NO: 526530 - RNA, 64 nt, Human; identical to SEQ ID NO: 303945

SEQ ID NO: 526531 - RNA, 64 nt, Human; identical to SEQ ID NO: 304305

SEQ ID NO: 526532 - RNA, 64 nt, Human; identical to SEQ ID NO: 304306

SEQ ID NO: 526533 - RNA, 64 nt, Human; identical to SEQ ID NO: 304307

SEQ ID NO: 526534 - RNA, 64 nt, Human; identical to SEQ ID NO: 304135

SEQ ID NO: 526535 - RNA, 64 nt, Human; identical to SEQ ID NO: 304136

SEQ ID NO: 526536 - RNA, 64 nt, Human; identical to SEQ ID NO: 303946

SEQ ID NO: 526537 - RNA, 64 nt, Human; identical to SEQ ID NO: 304324

SEQ ID NO: 526538 - RNA, 61 nt, Human; identical to SEQ ID NO: 526448

SEQ ID NO: 526539 - RNA, 61 nt, Human; identical to SEQ ID NO: 526449

SEQ ID NO: 526540 - RNA, 58 nt, Human; identical to SEQ ID NO: 266988

SEQ ID NO: 526541 - RNA, 64 nt, Human; identical to SEQ ID NO: 304341

SEQ ID NO: 526542 - RNA, 64 nt, Human; identical to SEQ ID NO: 303947

SEQ ID NO: 526543 - RNA, 64 nt, Human; identical to SEQ ID NO: 304358

SEQ ID NO: 526544 - RNA, 64 nt, Human; identical to SEQ ID NO: 304373

SEQ ID NO: 526545 - RNA, 64 nt, Human; identical to SEQ ID NO: 304374

SEQ ID NO: 526546 - RNA, 64 nt, Human; identical to SEQ ID NO: 303948

SEQ ID NO: 526547 - RNA, 64 nt, Human; identical to SEQ ID NO: 304392

SEQ ID NO: 526548 - RNA, 64 nt, Human; identical to SEQ ID NO: 304118

SEQ ID NO: 526549 - RNA, 64 nt, Human; identical to SEQ ID NO: 304119

SEQ ID NO: 526550 - RNA, 64 nt, Human; identical to SEQ ID NO: 303949

SEQ ID NO: 526551 - RNA, 64 nt, Human; identical to SEQ ID NO: 304375

SEQ ID NO: 526552 - RNA, 64 nt, Human; identical to SEQ ID NO: 304033

SEQ ID NO: 526553 - RNA, 64 nt, Human; identical to SEQ ID NO: 304034

SEQ ID NO: 526554 - RNA, 64 nt, Human; identical to SEQ ID NO: 303950

SEQ ID NO: 526555 - RNA, 64 nt, Human; identical to SEQ ID NO: 304409

SEQ ID NO: 526556 - RNA, 61 nt, Human
auucaaucaguguaacuugcaaaaugcauaaacauccgacaguuugaauuuauaguguuga

SEQ ID NO: 526557 - RNA, 61 nt, Human
ccaugugcagcuuucuuuuuuguuagaugccacauccgaagacucaucgcaguguguuaua

SEQ ID NO: 526558 - RNA, 61 nt, Human
cucguaccugucacugggaugcagacucucgacauccgaguccaagcgcaggccccucggg

SEQ ID NO: 526559 - RNA, 64 nt, Human; identical to SEQ ID NO: 304424

SEQ ID NO: 526560 - RNA, 64 nt, Human; identical to SEQ ID NO: 304425

SEQ ID NO: 526561 - RNA, 64 nt, Human; identical to SEQ ID NO: 303965

SEQ ID NO: 526562 - RNA, 64 nt, Human; identical to SEQ ID NO: 304441

SEQ ID NO: 526563 - RNA, 64 nt, Human; identical to SEQ ID NO: 304442

SEQ ID NO: 526564 - RNA, 64 nt, Human; identical to SEQ ID NO: 304443

SEQ ID NO: 526565 - RNA, 64 nt, Human; identical to SEQ ID NO: 304186

SEQ ID NO: 526566 - RNA, 64 nt, Human; identical to SEQ ID NO: 304187

SEQ ID NO: 526567 - RNA, 64 nt, Human; identical to SEQ ID NO: 303966

SEQ ID NO: 526568 - RNA, 60 nt, Human; identical to SEQ ID NO: 304526

SEQ ID NO: 526569 - RNA, 64 nt, Human; identical to SEQ ID NO: 304527

SEQ ID NO: 526570 - RNA, 55 nt, Human; identical to SEQ ID NO: 304528

SEQ ID NO: 526571 - RNA, 64 nt, Human; identical to SEQ ID NO: 304169

SEQ ID NO: 526572 - RNA, 64 nt, Human; identical to SEQ ID NO: 304170

SEQ ID NO: 526573 - RNA, 64 nt, Human; identical to SEQ ID NO: 303967

SEQ ID NO: 526574 - RNA, 61 nt, Human
uuggguuucucauaaguauccuaguucauguacauccgaaugcuaaauaauacuguguuuu

SEQ ID NO: 526575 - RNA, 61 nt, Human
acggccgcucaccggaaggcugugugcggggacauccgagguggugguggacaggaaggac

SEQ ID NO: 526576 - RNA, 61 nt, Human
gagcccuugggggacgugaggggagccucucacauccgauuucuccuccugccccagccuc

SEQ ID NO: 526577 - RNA, 64 nt, Human; identical to SEQ ID NO: 304171

SEQ ID NO: 526578 - RNA, 64 nt, Human; identical to SEQ ID NO: 303982

SEQ ID NO: 526579 - RNA, 64 nt, Human; identical to SEQ ID NO: 303983

SEQ ID NO: 526580 - RNA, 64 nt, Human; identical to SEQ ID NO: 303984

SEQ ID NO: 526581 - RNA, 64 nt, Human; identical to SEQ ID NO: 303999

SEQ ID NO: 526582 - RNA, 64 nt, Human; identical to SEQ ID NO: 304000

SEQ ID NO: 526583 - RNA, 64 nt, Human; identical to SEQ ID NO: 304001

SEQ ID NO: 526584 - RNA, 64 nt, Human; identical to SEQ ID NO: 304035

SEQ ID NO: 526585 - RNA, 64 nt, Human; identical to SEQ ID NO: 304050

SEQ ID NO: 526586 - RNA, 64 nt, Human; identical to SEQ ID NO: 304051

SEQ ID NO: 526587 - RNA, 64 nt, Human; identical to SEQ ID NO: 304052

SEQ ID NO: 526588 - RNA, 64 nt, Human; identical to SEQ ID NO: 304067

SEQ ID NO: 526589 - RNA, 64 nt, Human; identical to SEQ ID NO: 304068

SEQ ID NO: 526590 - RNA, 64 nt, Human; identical to SEQ ID NO: 304069

SEQ ID NO: 526591 - RNA, 64 nt, Human; identical to SEQ ID NO: 304084

SEQ ID NO: 526592 - RNA, 61 nt, Human
cucagugucuacuuucugccuguugcucgauacauccgagcugcccucaguguuccccaag

SEQ ID NO: 526593 - RNA, 61 nt, Human
ucaggcccuugagggaaagcuacuugaucaaacauccgauagucacaaauuugaaaccgug

SEQ ID NO: 526594 - RNA, 61 nt, Human
uuggagggaggugguguguucacgugagccuacauccgagggugcucuucguaagggguag

SEQ ID NO: 526595 - RNA, 64 nt, Human; identical to SEQ ID NO: 304085

SEQ ID NO: 526596 - RNA, 64 nt, Human; identical to SEQ ID NO: 304086

SEQ ID NO: 526597 - RNA, 64 nt, Human; identical to SEQ ID NO: 305587

SEQ ID NO: 526598 - RNA, 64 nt, Human; identical to SEQ ID NO: 305588

SEQ ID NO: 526599 - RNA, 64 nt, Human; identical to SEQ ID NO: 305589

SEQ ID NO: 526600 - RNA, 64 nt, Human; identical to SEQ ID NO: 305590

SEQ ID NO: 526601 - RNA, 64 nt, Human; identical to SEQ ID NO: 305591

SEQ ID NO: 526602 - RNA, 64 nt, Human; identical to SEQ ID NO: 305592

SEQ ID NO: 526603 - RNA, 64 nt, Human; identical to SEQ ID NO: 305593

SEQ ID NO: 526604 - RNA, 53 nt, Human; identical to SEQ ID NO: 305594

SEQ ID NO: 526605 - RNA, 64 nt, Human; identical to SEQ ID NO: 305595

SEQ ID NO: 526606 - RNA, 64 nt, Human; identical to SEQ ID NO: 305596

SEQ ID NO: 526607 - RNA, 64 nt, Human; identical to SEQ ID NO: 305597

SEQ ID NO: 526608 - RNA, 64 nt, Human; identical to SEQ ID NO: 305598

SEQ ID NO: 526609 - RNA, 64 nt, Human; identical to SEQ ID NO: 305599

SEQ ID NO: 526610 - RNA, 61 nt, Human
agcggcuccuaccagacaaucaagaucugggacauccgaacccuugacugcauccacgucc

SEQ ID NO: 526611 - RNA, 61 nt, Human
ccauuuguucacuuuuuaaacuaaaauaggaacauccgacacacaccguuugcaucgucuu

SEQ ID NO: 526612 - RNA, 61 nt, Human
cugacucaucggagagggaaauaccaaauaaacauccgagguugcauuuauuuauuuauuu

SEQ ID NO: 526613 - RNA, 64 nt, Human; identical to SEQ ID NO: 305600

SEQ ID NO: 526614 - RNA, 64 nt, Human; identical to SEQ ID NO: 305601

SEQ ID NO: 526615 - RNA, 64 nt, Human; identical to SEQ ID NO: 305602

SEQ ID NO: 526616 - RNA, 64 nt, Human; identical to SEQ ID NO: 305603

SEQ ID NO: 526617 - RNA, 64 nt, Human; identical to SEQ ID NO: 305604

SEQ ID NO: 526618 - RNA, 64 nt, Human; identical to SEQ ID NO: 305605

SEQ ID NO: 526619 - RNA, 57 nt, Human; identical to SEQ ID NO: 305606

SEQ ID NO: 526620 - RNA, 64 nt, Human; identical to SEQ ID NO: 305607

SEQ ID NO: 526621 - RNA, 64 nt, Human; identical to SEQ ID NO: 305608

SEQ ID NO: 526622 - RNA, 64 nt, Human; identical to SEQ ID NO: 305609

SEQ ID NO: 526623 - RNA, 59 nt, Human; identical to SEQ ID NO: 305610

SEQ ID NO: 526624 - RNA, 64 nt, Human; identical to SEQ ID NO: 305611

SEQ ID NO: 526625 - RNA, 64 nt, Human; identical to SEQ ID NO: 305612

SEQ ID NO: 526626 - RNA, 64 nt, Human; identical to SEQ ID NO: 305613

SEQ ID NO: 526627 - RNA, 64 nt, Human; identical to SEQ ID NO: 305614

SEQ ID NO: 526628 - RNA, 61 nt, Human
uuuugauaaaauguauuuucagcauuaauacacauccgauuaugccuuauuuauauaugaa

SEQ ID NO: 526629 - RNA, 61 nt, Human
uguauaaagaguauguagcaacaacuguuuaacauccgagaugaaguggaccugaugcugu

SEQ ID NO: 526630 - RNA, 61 nt, Human
uuaauuuaacucuauguuguccgccguguagacauccgaggucauuuguugcguugaauua

SEQ ID NO: 526631 - RNA, 64 nt, Human; identical to SEQ ID NO: 305615

SEQ ID NO: 526632 - RNA, 64 nt, Human; identical to SEQ ID NO: 305616

SEQ ID NO: 526633 - RNA, 64 nt, Human; identical to SEQ ID NO: 305617

SEQ ID NO: 526634 - RNA, 64 nt, Human; identical to SEQ ID NO: 305618

SEQ ID NO: 526635 - RNA, 64 nt, Human; identical to SEQ ID NO: 305619

SEQ ID NO: 526636 - RNA, 64 nt, Human; identical to SEQ ID NO: 305620

SEQ ID NO: 526637 - RNA, 61 nt, Human
augaagcugggauggaggcucugaccccaccaccggccacccaucugucacccuuggacag

SEQ ID NO: 526638 - RNA, 61 nt, Human
aaagggauugcugaggcaccguccaggccccaccggccaggccgcgcccagcagaggcgua

SEQ ID NO: 526639 - RNA, 61 nt, Human
uggucugucacggcugaugaggacucccacaaccggccaaguuaugucuuauuauacaccc

SEQ ID NO: 526640 - RNA, 61 nt, Human
cagugugaaccgaggggcucaggaaaacgggaccggccaggccaccuccagaaacggccau

SEQ ID NO: 526641 - RNA, 61 nt, Human
ccugcacucucagcccccgcccgucaccaccaccggccaccugaguguccgugagcgggcc

SEQ ID NO: 526642 - RNA, 61 nt, Human
ggugggaggguuugcugggacugauggggacaccggccagcuugucugguguccagcagcc

SEQ ID NO: 526643 - RNA, 61 nt, Human
ugaagcaggccuaguuucuucaucuauguuuaccggccaccaaacaccuuagggucuuaga

SEQ ID NO: 526644 - RNA, 61 nt, Human; identical to SEQ ID NO: 526450

SEQ ID NO: 526645 - RNA, 61 nt, Human; identical to SEQ ID NO: 522361

SEQ ID NO: 526646 - RNA, 61 nt, Human; identical to SEQ ID NO: 526484

SEQ ID NO: 526647 - RNA, 61 nt, Human; identical to SEQ ID NO: 526485

SEQ ID NO: 526648 - RNA, 61 nt, Human; identical to SEQ ID NO: 526486

SEQ ID NO: 526649 - RNA, 51 nt, Human; identical to SEQ ID NO: 437528

SEQ ID NO: 526650 - RNA, 61 nt, Human
aaguccagccagcgugcagcugcauccagaaaccggccacuacccagcccaucucugccug

SEQ ID NO: 526651 - RNA, 61 nt, Human
ccaucccccgucuguccacuaacuguaccgcaccggccauuaaaagaugaaggcagaccgc

SEQ ID NO: 526652 - RNA, 61 nt, Human
aguacaugcuccucuguaagcagcugaacucaccggccacuucucuguuugccuauagaca

SEQ ID NO: 526653 - RNA, 61 nt, Human
uguagccggaaggggcgcuccucccagcuguaccggccacugcaacccaugagugaguugg

SEQ ID NO: 526654 - RNA, 61 nt, Human
acaguucuacucacuuccuuuuacagaauucaccggccauuuuccuguuaccugauccuuc

SEQ ID NO: 526655 - RNA, 61 nt, Human
uccuccucauugucgcugccaaacaggaggcaccggccacaggcccauucaucugcucgua

SEQ ID NO: 526656 - RNA, 61 nt, Human
cuuuccaagugucaaauaggacacccaucuuaccggccaauguccaaaauuacgguuugaa

SEQ ID NO: 526657 - RNA, 61 nt, Human
uccagcucgccuuguugacucgccuguguccaccggccaugaggagcccacgccuguccuc

SEQ ID NO: 526658 - RNA, 61 nt, Human
cugccugcccagugccaucaggaugagcaguaccggccaagcauaaugacagagagaggca

SEQ ID NO: 526659 - RNA, 61 nt, Human
ggcccucauguucaccagggaacaggaccacaccggccacuggaggagggcaggagcaguc

SEQ ID NO: 526660 - RNA, 61 nt, Human
agggcagguaucagggugaacugaucuuagcaccggccaaauaaauggaaccugcugagag

SEQ ID NO: 526661 - RNA, 61 nt, Human
agaccaagagaccaggcccgggcagcagccuaccggccacguggaacacuggcuccggagu

SEQ ID NO: 526662 - RNA, 61 nt, Human
uugcacagaaaccaaccccugacccagcgguaccggccaagcacaaacguccuuuuugcug

SEQ ID NO: 526663 - RNA, 61 nt, Human
ccgagagcuacagcgugugauggaaucagugaccggccagguuagccucuccccucuuggc

SEQ ID NO: 526664 - RNA, 61 nt, Human
ccuuuggaugcaaaugucgaugcuuaagaaaaccggccacuucagcaacagcccuuucccc

SEQ ID NO: 526665 - RNA, 61 nt, Human
aaacucugcaccucuuccucagcugcuccagaccggccaggguaaccagcuaaccaugccu

SEQ ID NO: 526666 - RNA, 61 nt, Human
gaagaccuuugcaaguuugccaccaguagauaccggccacaggcucgacaaauaguggucu

SEQ ID NO: 526667 - RNA, 61 nt, Human
agaauuucucccaucuuggccucuuccagaaaccggccaggcaaggaaagaggccggucac

SEQ ID NO: 526668 - RNA, 61 nt, Human
uaaucgauuccuuuauguuuuauaagaguuuaccggccaaagcauauugucaucuuugguc

SEQ ID NO: 526669 - RNA, 61 nt, Human
gguuagaguccauuuacaaagcugccaggaaaccggccacuucuaguaaaccacgucgugc

SEQ ID NO: 526670 - RNA, 61 nt, Human
gggcuuguugcagauggugguggccuggggcaccggccaggugggccucgguggcgaggug

SEQ ID NO: 526671 - RNA, 61 nt, Human
guuugucucugacaagaucagcuguaggcucaccggccagagaagaccacugugagcauuu

SEQ ID NO: 526672 - RNA, 61 nt, Human
aagcaggggaaacccaaggcuuugccugcagaccggccacucugugacaacucuaccaaaa

SEQ ID NO: 526673 - RNA, 61 nt, Human
auccacuaguccuaaaccggaagaggaugacaccggccauggguuaacguggcuccucagg

SEQ ID NO: 526674 - RNA, 61 nt, Human
cccuguugcccacugcacugaucaugaagccaccggccacugccacgcauguugcaccugu

SEQ ID NO: 526675 - RNA, 61 nt, Human
ugagauggggcccucaccaaaugccuuggccaccggccagcagcccucugugaugugugug

SEQ ID NO: 526676 - RNA, 61 nt, Human
cuugacugggcucagccacugagcugccucaaccggccaaggaacgggauuaugaugacua

SEQ ID NO: 526677 - RNA, 61 nt, Human
uagggcuguauuguuguccacugcaguaggcaccggccacaugugacugcuggcaugaaau

SEQ ID NO: 526678 - RNA, 61 nt, Human
guggcuggugguggaccuggagaguggaggcaccggccaggcaggggggcaggggagcuca

SEQ ID NO: 526679 - RNA, 61 nt, Human
agggugggcaguuaucacuggggaagagaggaccggccaccuguccagcaugggcuccaga

SEQ ID NO: 526680 - RNA, 61 nt, Human
gcuuccuuccucucugcaaugaccuucaacaaccggccaccagaugucgcccuacucaccu

SEQ ID NO: 526681 - RNA, 61 nt, Human
ucagagcgggucugauggggagcuccgucucaccggccacccgccgucaccauggcagaug

SEQ ID NO: 526682 - RNA, 61 nt, Human
ggaagacaccgugcccgccccaagagcaagcaccggccaugcugcagaggcaagaccucaa

SEQ ID NO: 526683 - RNA, 61 nt, Human
gugaacugguuacuuucugucucugugcucuaccggccaaacaagggguuuggaccagacc

SEQ ID NO: 526684 - RNA, 61 nt, Human
ugcccaggagaggggccgacccuccucgggaaccggccagccgcguggcucccagcaucca

SEQ ID NO: 526685 - RNA, 61 nt, Human
cagggacccaaucaauucacaaugagaaauuaccggccaggcguggugacucacgucugua

SEQ ID NO: 526686 - RNA, 61 nt, Human
ggacucuagccccugaccccagacucccgagaccggccaaagccaagccagccccacccuu

SEQ ID NO: 526687 - RNA, 61 nt, Human
ccuggcugcacagucccuuugacgauaguccaccggccacccaggccugucuggggacaug

SEQ ID NO: 526688 - RNA, 61 nt, Human
guccccucucaguccccuucccuacacccugaccggccacugccgcacacccacccagagc

SEQ ID NO: 526689 - RNA, 61 nt, Human
cgccggccagcccggccuacgcccaguacccaccggccaccuaugaccaguacccauacgc

SEQ ID NO: 526690 - RNA, 61 nt, Human; identical to SEQ ID NO: 437585

SEQ ID NO: 526691 - RNA, 61 nt, Human
cuuagggucucagggugucccagaccccgacaccggccaguggcggaagugaccgcaccuc

SEQ ID NO: 526692 - RNA, 61 nt, Human
gcgccucccuauguugccugccacucugggcaccggccagcacccucuggugagaagaggu

SEQ ID NO: 526693 - RNA, 61 nt, Human
ucuccagccccaguccagaguugggcaccacaccggccagcaucuuccgcacaccccugca

SEQ ID NO: 526694 - RNA, 61 nt, Human
cuccagccccgcccucuccucauugcccagaaccggccacaccgcugaaggccaaagaggc

SEQ ID NO: 526695 - RNA, 61 nt, Human
cucuuuuguacucugugccuuuauuucucaaaccggccaacacuuagggaaaauagaaaag

SEQ ID NO: 526696 - RNA, 61 nt, Human
ccacagacgcccgagacccacgccgggcgggaccggccagggaucacccccgccgacggcc

SEQ ID NO: 526697 - RNA, 61 nt, Human
gagaugcgugcccccggcggcuacccgcuggaccggccacucuccccagcccccuugcuuc

SEQ ID NO: 526698 - RNA, 61 nt, Human; identical to SEQ ID NO: 526637

SEQ ID NO: 526699 - RNA, 61 nt, Human; identical to SEQ ID NO: 526638

SEQ ID NO: 526700 - RNA, 61 nt, Human; identical to SEQ ID NO: 526639

SEQ ID NO: 526701 - RNA, 61 nt, Human; identical to SEQ ID NO: 526640

SEQ ID NO: 526702 - RNA, 61 nt, Human; identical to SEQ ID NO: 526641

SEQ ID NO: 526703 - RNA, 61 nt, Human; identical to SEQ ID NO: 526642

SEQ ID NO: 526704 - RNA, 61 nt, Human; identical to SEQ ID NO: 526643

SEQ ID NO: 526705 - RNA, 61 nt, Human; identical to SEQ ID NO: 526650

SEQ ID NO: 526706 - RNA, 61 nt, Human; identical to SEQ ID NO: 526651

SEQ ID NO: 526707 - RNA, 61 nt, Human; identical to SEQ ID NO: 526652

SEQ ID NO: 526708 - RNA, 61 nt, Human; identical to SEQ ID NO: 526653

SEQ ID NO: 526709 - RNA, 61 nt, Human; identical to SEQ ID NO: 526654

SEQ ID NO: 526710 - RNA, 61 nt, Human; identical to SEQ ID NO: 526655

SEQ ID NO: 526711 - RNA, 61 nt, Human; identical to SEQ ID NO: 526656

SEQ ID NO: 526712 - RNA, 61 nt, Human; identical to SEQ ID NO: 526657

SEQ ID NO: 526713 - RNA, 61 nt, Human; identical to SEQ ID NO: 526658

SEQ ID NO: 526714 - RNA, 61 nt, Human; identical to SEQ ID NO: 526659

SEQ ID NO: 526715 - RNA, 61 nt, Human; identical to SEQ ID NO: 526660

SEQ ID NO: 526716 - RNA, 61 nt, Human; identical to SEQ ID NO: 526661

SEQ ID NO: 526717 - RNA, 61 nt, Human; identical to SEQ ID NO: 526662

SEQ ID NO: 526718 - RNA, 61 nt, Human; identical to SEQ ID NO: 526663

SEQ ID NO: 526719 - RNA, 61 nt, Human; identical to SEQ ID NO: 526664

SEQ ID NO: 526720 - RNA, 61 nt, Human; identical to SEQ ID NO: 526665

SEQ ID NO: 526721 - RNA, 61 nt, Human; identical to SEQ ID NO: 526666

SEQ ID NO: 526722 - RNA, 61 nt, Human; identical to SEQ ID NO: 526667

SEQ ID NO: 526723 - RNA, 61 nt, Human; identical to SEQ ID NO: 526668

SEQ ID NO: 526724 - RNA, 61 nt, Human; identical to SEQ ID NO: 526669

SEQ ID NO: 526725 - RNA, 61 nt, Human; identical to SEQ ID NO: 526670

SEQ ID NO: 526726 - RNA, 61 nt, Human; identical to SEQ ID NO: 526671

SEQ ID NO: 526727 - RNA, 61 nt, Human; identical to SEQ ID NO: 526672

SEQ ID NO: 526728 - RNA, 61 nt, Human; identical to SEQ ID NO: 526673

SEQ ID NO: 526729 - RNA, 61 nt, Human; identical to SEQ ID NO: 526674

SEQ ID NO: 526730 - RNA, 61 nt, Human; identical to SEQ ID NO: 526675

SEQ ID NO: 526731 - RNA, 61 nt, Human; identical to SEQ ID NO: 526676

SEQ ID NO: 526732 - RNA, 61 nt, Human; identical to SEQ ID NO: 526677

SEQ ID NO: 526733 - RNA, 61 nt, Human; identical to SEQ ID NO: 526678

SEQ ID NO: 526734 - RNA, 61 nt, Human; identical to SEQ ID NO: 526679

SEQ ID NO: 526735 - RNA, 61 nt, Human; identical to SEQ ID NO: 526680

SEQ ID NO: 526736 - RNA, 61 nt, Human; identical to SEQ ID NO: 526681

SEQ ID NO: 526737 - RNA, 61 nt, Human; identical to SEQ ID NO: 526682

SEQ ID NO: 526738 - RNA, 61 nt, Human; identical to SEQ ID NO: 526683

SEQ ID NO: 526739 - RNA, 61 nt, Human; identical to SEQ ID NO: 526684

SEQ ID NO: 526740 - RNA, 61 nt, Human; identical to SEQ ID NO: 526685

SEQ ID NO: 526741 - RNA, 61 nt, Human; identical to SEQ ID NO: 526686

SEQ ID NO: 526742 - RNA, 61 nt, Human; identical to SEQ ID NO: 526687

SEQ ID NO: 526743 - RNA, 61 nt, Human; identical to SEQ ID NO: 526688

SEQ ID NO: 526744 - RNA, 61 nt, Human; identical to SEQ ID NO: 526689

SEQ ID NO: 526745 - RNA, 61 nt, Human; identical to SEQ ID NO: 437585

SEQ ID NO: 526746 - RNA, 61 nt, Human; identical to SEQ ID NO: 526691

SEQ ID NO: 526747 - RNA, 61 nt, Human; identical to SEQ ID NO: 526692

SEQ ID NO: 526748 - RNA, 61 nt, Human; identical to SEQ ID NO: 526693

SEQ ID NO: 526749 - RNA, 61 nt, Human; identical to SEQ ID NO: 526694

SEQ ID NO: 526750 - RNA, 61 nt, Human; identical to SEQ ID NO: 526695

SEQ ID NO: 526751 - RNA, 61 nt, Human; identical to SEQ ID NO: 526696

SEQ ID NO: 526752 - RNA, 61 nt, Human; identical to SEQ ID NO: 526697

SEQ ID NO: 526753 - RNA, 61 nt, Human
aacuaagccauauuuaucacccguggacagcacauccgagucaagacuguuaauuucugac

SEQ ID NO: 526754 - RNA, 61 nt, Human
caugugagacuucccugccccaccccacaugacauccgaggaucugagauuuccguguuug

SEQ ID NO: 526755 - RNA, 61 nt, Human
cuaggggaauuaggccacaacacccccugggacauccgaaagcuacaccacagaugccagu

SEQ ID NO: 526756 - RNA, 61 nt, Human
gaccugaaauuuuacauccgaacaaaauuuuacauccgaaaagcaaccaacuucuucaugg

SEQ ID NO: 526757 - RNA, 61 nt, Human
uggcauaauuuuuaugaugaccugaaauuuuacauccgaacaaaauuuuacauccgaaaag

SEQ ID NO: 526758 - RNA, 61 nt, Human
ucagaagccuuuacaauuacuuuuagcuguaacauccgauucuguauaagccacauagaaa

SEQ ID NO: 526759 - RNA, 61 nt, Human
uccauccucugacaaggaagaaggugaggccacauccgauucugaaucagagguuagugaa

SEQ ID NO: 526760 - RNA, 61 nt, Human
gugcagugggagauugggcuuuggaacagacacauccgacauaaaauuccugcucugccac

SEQ ID NO: 526761 - RNA, 64 nt, Human; identical to SEQ ID NO: 388109

SEQ ID NO: 526762 - RNA, 64 nt, Human; identical to SEQ ID NO: 388113

SEQ ID NO: 526763 - RNA, 64 nt, Human; identical to SEQ ID NO: 388114

SEQ ID NO: 526764 - RNA, 64 nt, Human; identical to SEQ ID NO: 388115

SEQ ID NO: 526765 - RNA, 64 nt, Human; identical to SEQ ID NO: 388116

SEQ ID NO: 526766 - RNA, 64 nt, Human; identical to SEQ ID NO: 388117

SEQ ID NO: 526767 - RNA, 64 nt, Human; identical to SEQ ID NO: 388118

SEQ ID NO: 526768 - RNA, 64 nt, Human; identical to SEQ ID NO: 388119

SEQ ID NO: 526769 - RNA, 64 nt, Human; identical to SEQ ID NO: 388120

SEQ ID NO: 526770 - RNA, 62 nt, Human
gaaaagcugugggacaaaauguauggaauagacaaggccacuuucuuugugauuucugcuuu

SEQ ID NO: 526771 - RNA, 62 nt, Human
caucugaucacuggauugggcugagcagagaacaaggccaaccauggaaauggauaaauggu

SEQ ID NO: 526772 - RNA, 55 nt, Human
guggcuacaccaucuggugaggaaccaaggccaccucugugccgggaaagacauc

SEQ ID NO: 526773 - RNA, 64 nt, Human; identical to SEQ ID NO: 388121

SEQ ID NO: 526774 - RNA, 64 nt, Human; identical to SEQ ID NO: 388122

SEQ ID NO: 526775 - RNA, 64 nt, Human; identical to SEQ ID NO: 388123

SEQ ID NO: 526776 - RNA, 64 nt, Human; identical to SEQ ID NO: 388124

SEQ ID NO: 526777 - RNA, 64 nt, Human; identical to SEQ ID NO: 388125

SEQ ID NO: 526778 - RNA, 64 nt, Human; identical to SEQ ID NO: 388126

SEQ ID NO: 526779 - RNA, 57 nt, Human; identical to SEQ ID NO: 388127

SEQ ID NO: 526780 - RNA, 64 nt, Human; identical to SEQ ID NO: 388131

SEQ ID NO: 526781 - RNA, 64 nt, Human; identical to SEQ ID NO: 388132

SEQ ID NO: 526782 - RNA, 64 nt, Human; identical to SEQ ID NO: 388133

SEQ ID NO: 526783 - RNA, 64 nt, Human; identical to SEQ ID NO: 388134

SEQ ID NO: 526784 - RNA, 64 nt, Human; identical to SEQ ID NO: 388135

SEQ ID NO: 526785 - RNA, 64 nt, Human; identical to SEQ ID NO: 388136

SEQ ID NO: 526786 - RNA, 64 nt, Human; identical to SEQ ID NO: 388137

SEQ ID NO: 526787 - RNA, 62 nt, Human
ugcugaagcugacagacaguauuaacucuuaucaaggccaucuuuuagaccugauuuucauu

SEQ ID NO: 526788 - RNA, 62 nt, Human
aagagcccucagauggaacgaaaggcgaugugcaaggccaucccagagagacggaagcaggu

SEQ ID NO: 526789 - RNA, 62 nt, Human
aacauuccucuucuggggcuucagaaagcuggcaaggccacuagcagagcuuuuguuaaugc

SEQ ID NO: 526790 - RNA, 64 nt, Human; identical to SEQ ID NO: 388138

SEQ ID NO: 526791 - RNA, 64 nt, Human; identical to SEQ ID NO: 388139

SEQ ID NO: 526792 - RNA, 64 nt, Human; identical to SEQ ID NO: 388140

SEQ ID NO: 526793 - RNA, 64 nt, Human; identical to SEQ ID NO: 388141

SEQ ID NO: 526794 - RNA, 64 nt, Human; identical to SEQ ID NO: 388142

SEQ ID NO: 526795 - RNA, 64 nt, Human; identical to SEQ ID NO: 388143

SEQ ID NO: 526796 - RNA, 64 nt, Human; identical to SEQ ID NO: 388144

SEQ ID NO: 526797 - RNA, 64 nt, Human; identical to SEQ ID NO: 388145

SEQ ID NO: 526798 - RNA, 64 nt, Human; identical to SEQ ID NO: 388149

SEQ ID NO: 526799 - RNA, 64 nt, Human; identical to SEQ ID NO: 388150

SEQ ID NO: 526800 - RNA, 64 nt, Human; identical to SEQ ID NO: 388151

SEQ ID NO: 526801 - RNA, 64 nt, Human; identical to SEQ ID NO: 388152

SEQ ID NO: 526802 - RNA, 58 nt, Human; identical to SEQ ID NO: 388153

SEQ ID NO: 526803 - RNA, 64 nt, Human; identical to SEQ ID NO: 388154

SEQ ID NO: 526804 - RNA, 62 nt, Human
uacguacaauuguguuggguguggguggucuccaaggccacgcugcucucugaauugauuuu

SEQ ID NO: 526805 - RNA, 62 nt, Human
caggauaccaguucaggccccaccauuccugccaaggccauuacaucccacaaacccaaaua

SEQ ID NO: 526806 - RNA, 62 nt, Human
cuccaauacuuauuaaggcuguugcugccagucaaggccacccaggagucugaaggcuggga

SEQ ID NO: 526807 - RNA, 64 nt, Human; identical to SEQ ID NO: 388155

SEQ ID NO: 526808 - RNA, 64 nt, Human; identical to SEQ ID NO: 388156

SEQ ID NO: 526809 - RNA, 59 nt, Human; identical to SEQ ID NO: 388157

SEQ ID NO: 526810 - RNA, 64 nt, Human; identical to SEQ ID NO: 388158

SEQ ID NO: 526811 - RNA, 64 nt, Human; identical to SEQ ID NO: 388159

SEQ ID NO: 526812 - RNA, 64 nt, Human; identical to SEQ ID NO: 388160

SEQ ID NO: 526813 - RNA, 64 nt, Human; identical to SEQ ID NO: 388161

SEQ ID NO: 526814 - RNA, 64 nt, Human; identical to SEQ ID NO: 388162

SEQ ID NO: 526815 - RNA, 64 nt, Human; identical to SEQ ID NO: 388163

SEQ ID NO: 526816 - RNA, 64 nt, Human; identical to SEQ ID NO: 388167

SEQ ID NO: 526817 - RNA, 64 nt, Human; identical to SEQ ID NO: 388168

SEQ ID NO: 526818 - RNA, 64 nt, Human; identical to SEQ ID NO: 388169

SEQ ID NO: 526819 - RNA, 64 nt, Human; identical to SEQ ID NO: 388170

SEQ ID NO: 526820 - RNA, 64 nt, Human; identical to SEQ ID NO: 388171

SEQ ID NO: 526821 - RNA, 62 nt, Human
guucacuugcccagaugucuucauaugaugagcaaggccagaagcaaggcuagauucgaagu

SEQ ID NO: 526822 - RNA, 62 nt, Human
guuuggcaguuccuguuucucugggcuuaagucaaggccacagaauucuuuuucuucccuga

SEQ ID NO: 526823 - RNA, 62 nt, Human
ggauucaugggcuauuauagaugaaaacugcacaaggccagaaccagcaggcacucaauaaa

SEQ ID NO: 526824 - RNA, 64 nt, Human; identical to SEQ ID NO: 388172

SEQ ID NO: 526825 - RNA, 64 nt, Human; identical to SEQ ID NO: 388173

SEQ ID NO: 526826 - RNA, 64 nt, Human; identical to SEQ ID NO: 388174

SEQ ID NO: 526827 - RNA, 64 nt, Human; identical to SEQ ID NO: 388175

SEQ ID NO: 526828 - RNA, 64 nt, Human; identical to SEQ ID NO: 388176

SEQ ID NO: 526829 - RNA, 64 nt, Human; identical to SEQ ID NO: 388177

SEQ ID NO: 526830 - RNA, 64 nt, Human; identical to SEQ ID NO: 388178

SEQ ID NO: 526831 - RNA, 64 nt, Human; identical to SEQ ID NO: 388179

SEQ ID NO: 526832 - RNA, 64 nt, Human; identical to SEQ ID NO: 388180

SEQ ID NO: 526833 - RNA, 64 nt, Human; identical to SEQ ID NO: 388181

SEQ ID NO: 526834 - RNA, 64 nt, Human; identical to SEQ ID NO: 388184

SEQ ID NO: 526835 - RNA, 64 nt, Human; identical to SEQ ID NO: 388185

SEQ ID NO: 526836 - RNA, 64 nt, Human; identical to SEQ ID NO: 388186

SEQ ID NO: 526837 - RNA, 64 nt, Human; identical to SEQ ID NO: 388187

SEQ ID NO: 526838 - RNA, 62 nt, Human
aucccgcagcugcagagacuggaaacugccuucaaggccacggcuggucaucugcugaccac

SEQ ID NO: 526839 - RNA, 62 nt, Human
ucaagaagcuuuuaaaggucaacacaaaaaaccaaggccaggagugaggggcucuuucuuac

SEQ ID NO: 526840 - RNA, 62 nt, Human
cuaugcagccaagcaaccucagcaguucccaucaaggccaccuccaccacaaccgaaaguau

SEQ ID NO: 526841 - RNA, 64 nt, Human; identical to SEQ ID NO: 388188

SEQ ID NO: 526842 - RNA, 64 nt, Human; identical to SEQ ID NO: 388189

SEQ ID NO: 526843 - RNA, 64 nt, Human; identical to SEQ ID NO: 388190

SEQ ID NO: 526844 - RNA, 64 nt, Human; identical to SEQ ID NO: 388191

SEQ ID NO: 526845 - RNA, 64 nt, Human; identical to SEQ ID NO: 388192

SEQ ID NO: 526846 - RNA, 64 nt, Human; identical to SEQ ID NO: 388193

SEQ ID NO: 526847 - RNA, 64 nt, Human; identical to SEQ ID NO: 388194

SEQ ID NO: 526848 - RNA, 64 nt, Human; identical to SEQ ID NO: 388195

SEQ ID NO: 526849 - RNA, 64 nt, Human; identical to SEQ ID NO: 388196

SEQ ID NO: 526850 - RNA, 64 nt, Human; identical to SEQ ID NO: 388197

SEQ ID NO: 526851 - RNA, 64 nt, Human; identical to SEQ ID NO: 388198

SEQ ID NO: 526852 - RNA, 64 nt, Human; identical to SEQ ID NO: 388202

SEQ ID NO: 526853 - RNA, 64 nt, Human; identical to SEQ ID NO: 388203

SEQ ID NO: 526854 - RNA, 64 nt, Human; identical to SEQ ID NO: 388204

SEQ ID NO: 526855 - RNA, 62 nt, Human
cuaggcagcucuaacaucaucugauauggacacaaggccaacaguuuccuuauuuacauccu

SEQ ID NO: 526856 - RNA, 62 nt, Human
cuggcagccauugcagcuccaaacugcagaggcaaggccaauuuuaacuuuucaauuuacag

SEQ ID NO: 526857 - RNA, 62 nt, Human
ccuuuaguccucccgcccccgccaaggggcaccaaggccacguuuccgugccaccuccuguc

SEQ ID NO: 526858 - RNA, 64 nt, Human; identical to SEQ ID NO: 388205

SEQ ID NO: 526859 - RNA, 64 nt, Human; identical to SEQ ID NO: 388206

SEQ ID NO: 526860 - RNA, 64 nt, Human; identical to SEQ ID NO: 388207

SEQ ID NO: 526861 - RNA, 64 nt, Human; identical to SEQ ID NO: 388208

SEQ ID NO: 526862 - RNA, 64 nt, Human; identical to SEQ ID NO: 388209

SEQ ID NO: 526863 - RNA, 64 nt, Human; identical to SEQ ID NO: 388210

SEQ ID NO: 526864 - RNA, 64 nt, Human; identical to SEQ ID NO: 388211

SEQ ID NO: 526865 - RNA, 64 nt, Human; identical to SEQ ID NO: 388212

SEQ ID NO: 526866 - RNA, 64 nt, Human; identical to SEQ ID NO: 388213

SEQ ID NO: 526867 - RNA, 64 nt, Human; identical to SEQ ID NO: 388214

SEQ ID NO: 526868 - RNA, 64 nt, Human; identical to SEQ ID NO: 388215

SEQ ID NO: 526869 - RNA, 64 nt, Human; identical to SEQ ID NO: 388216

SEQ ID NO: 526870 - RNA, 64 nt, Human; identical to SEQ ID NO: 388220

SEQ ID NO: 526871 - RNA, 64 nt, Human; identical to SEQ ID NO: 388221

SEQ ID NO: 526872 - RNA, 62 nt, Human
gacccuggcgcugccacaguccuggcacugcccaaggccauaccugccuagcccuuuggcuc

SEQ ID NO: 526873 - RNA, 62 nt, Human
ugagacugcugcccaacaugagcagugaucuccaaggccagcugcagggccugcucguacac

SEQ ID NO: 526874 - RNA, 62 nt, Human
ugcugaaggaaaaaucggacugcaaaucauuccaaggccaaacugcaacugagccacccacu

SEQ ID NO: 526875 - RNA, 64 nt, Human; identical to SEQ ID NO: 388222

SEQ ID NO: 526876 - RNA, 64 nt, Human; identical to SEQ ID NO: 388223

SEQ ID NO: 526877 - RNA, 64 nt, Human; identical to SEQ ID NO: 388224

SEQ ID NO: 526878 - RNA, 64 nt, Human; identical to SEQ ID NO: 388225

SEQ ID NO: 526879 - RNA, 64 nt, Human; identical to SEQ ID NO: 388226

SEQ ID NO: 526880 - RNA, 64 nt, Human; identical to SEQ ID NO: 388227

SEQ ID NO: 526881 - RNA, 59 nt, Human; identical to SEQ ID NO: 388228

SEQ ID NO: 526882 - RNA, 64 nt, Human; identical to SEQ ID NO: 388229

SEQ ID NO: 526883 - RNA, 64 nt, Human; identical to SEQ ID NO: 388230

SEQ ID NO: 526884 - RNA, 64 nt, Human; identical to SEQ ID NO: 388231

SEQ ID NO: 526885 - RNA, 64 nt, Human; identical to SEQ ID NO: 388232

SEQ ID NO: 526886 - RNA, 64 nt, Human; identical to SEQ ID NO: 388233

SEQ ID NO: 526887 - RNA, 64 nt, Human; identical to SEQ ID NO: 388234

SEQ ID NO: 526888 - RNA, 64 nt, Human; identical to SEQ ID NO: 388238

SEQ ID NO: 526889 - RNA, 62 nt, Human
guggagguuucuuucuacaagaguuuucugcccaaggccacagccaucccacucucugcuuc

SEQ ID NO: 526890 - RNA, 62 nt, Human
ucaaggauggcacucagaucuccauggcccagcaaggccaagauaaaucuaccaccccaggc

SEQ ID NO: 526891 - RNA, 62 nt, Human
acaagucaugcacaauguaaaaaccagccaagcaaggccauaaagggaggugacuuaaaaaa

SEQ ID NO: 526892 - RNA, 64 nt, Human; identical to SEQ ID NO: 388239

SEQ ID NO: 526893 - RNA, 64 nt, Human; identical to SEQ ID NO: 388240

SEQ ID NO: 526894 - RNA, 64 nt, Human; identical to SEQ ID NO: 388241

SEQ ID NO: 526895 - RNA, 64 nt, Human; identical to SEQ ID NO: 388242

SEQ ID NO: 526896 - RNA, 64 nt, Human; identical to SEQ ID NO: 388243

SEQ ID NO: 526897 - RNA, 64 nt, Human; identical to SEQ ID NO: 388244

SEQ ID NO: 526898 - RNA, 64 nt, Human; identical to SEQ ID NO: 388245

SEQ ID NO: 526899 - RNA, 64 nt, Human; identical to SEQ ID NO: 388246

SEQ ID NO: 526900 - RNA, 64 nt, Human; identical to SEQ ID NO: 388247

SEQ ID NO: 526901 - RNA, 64 nt, Human; identical to SEQ ID NO: 388248

SEQ ID NO: 526902 - RNA, 64 nt, Human; identical to SEQ ID NO: 388249

SEQ ID NO: 526903 - RNA, 64 nt, Human; identical to SEQ ID NO: 388250

SEQ ID NO: 526904 - RNA, 64 nt, Human; identical to SEQ ID NO: 388251

SEQ ID NO: 526905 - RNA, 64 nt, Human; identical to SEQ ID NO: 388252

SEQ ID NO: 526906 - RNA, 62 nt, Human
ugaggaggggagcgucugggaacuugcgaguccaaggccaguccccauuucugccucgcuca

SEQ ID NO: 526907 - RNA, 62 nt, Human
gcugaugguuaagggccgggagcagaugcugccaaggccacaugcagggaugcacccacaau

SEQ ID NO: 526908 - RNA, 62 nt, Human
cgugaugaaggacggaagcagcagcgggccggcaaggccauaccucggugagggacaggugg

SEQ ID NO: 526909 - RNA, 64 nt, Human; identical to SEQ ID NO: 388256

SEQ ID NO: 526910 - RNA, 64 nt, Human; identical to SEQ ID NO: 388257

SEQ ID NO: 526911 - RNA, 64 nt, Human; identical to SEQ ID NO: 388258

SEQ ID NO: 526912 - RNA, 64 nt, Human; identical to SEQ ID NO: 388259

SEQ ID NO: 526913 - RNA, 64 nt, Human; identical to SEQ ID NO: 388260

SEQ ID NO: 526914 - RNA, 64 nt, Human; identical to SEQ ID NO: 388261

SEQ ID NO: 526915 - RNA, 64 nt, Human; identical to SEQ ID NO: 388262

SEQ ID NO: 526916 - RNA, 64 nt, Human; identical to SEQ ID NO: 388263

SEQ ID NO: 526917 - RNA, 64 nt, Human; identical to SEQ ID NO: 388264

SEQ ID NO: 526918 - RNA, 64 nt, Human; identical to SEQ ID NO: 388265

SEQ ID NO: 526919 - RNA, 64 nt, Human; identical to SEQ ID NO: 388266

SEQ ID NO: 526920 - RNA, 64 nt, Human; identical to SEQ ID NO: 388267

SEQ ID NO: 526921 - RNA, 64 nt, Human; identical to SEQ ID NO: 388268

SEQ ID NO: 526922 - RNA, 64 nt, Human; identical to SEQ ID NO: 388269

SEQ ID NO: 526923 - RNA, 62 nt, Human
gcacuucggcucuggaguuacagaucuggguucaaggccaaauuccaccacuuacuagguuu

SEQ ID NO: 526924 - RNA, 62 nt, Human
accccacgugggacuuccauggcuucugaguacaaggccagccccccggcccaccagcuuuc

SEQ ID NO: 526925 - RNA, 62 nt, Human
uuagauguuaggcaucuccuguauguaagacacaaggccaaccacaacacagaacgauguug

SEQ ID NO: 526926 - RNA, 64 nt, Human; identical to SEQ ID NO: 388270

SEQ ID NO: 526927 - RNA, 64 nt, Human; identical to SEQ ID NO: 388274

SEQ ID NO: 526928 - RNA, 64 nt, Human; identical to SEQ ID NO: 388275

SEQ ID NO: 526929 - RNA, 64 nt, Human; identical to SEQ ID NO: 388276

SEQ ID NO: 526930 - RNA, 64 nt, Human; identical to SEQ ID NO: 388277

SEQ ID NO: 526931 - RNA, 64 nt, Human; identical to SEQ ID NO: 388278

SEQ ID NO: 526932 - RNA, 64 nt, Human; identical to SEQ ID NO: 388279

SEQ ID NO: 526933 - RNA, 64 nt, Human; identical to SEQ ID NO: 388280

SEQ ID NO: 526934 - RNA, 64 nt, Human; identical to SEQ ID NO: 388281

SEQ ID NO: 526935 - RNA, 64 nt, Human; identical to SEQ ID NO: 388282

SEQ ID NO: 526936 - RNA, 64 nt, Human; identical to SEQ ID NO: 388283

SEQ ID NO: 526937 - RNA, 64 nt, Human; identical to SEQ ID NO: 388284

SEQ ID NO: 526938 - RNA, 64 nt, Human; identical to SEQ ID NO: 388285

SEQ ID NO: 526939 - RNA, 64 nt, Human; identical to SEQ ID NO: 388286

SEQ ID NO: 526940 - RNA, 62 nt, Human
gaagaaugaauaaauuuacgugaugagcucuacaaggccaaaaauuuuuuuucuuaucuacc

SEQ ID NO: 526941 - RNA, 62 nt, Human
cgacgcaggaggauugcuugaggccaggaguucaaggccagccuggacaacauaguaagacc

SEQ ID NO: 526942 - RNA, 62 nt, Human
agcagaggaucagagaugggaaaggacuagcccaaggccaacauuaacaagcccucuaacaa

SEQ ID NO: 526943 - RNA, 64 nt, Human; identical to SEQ ID NO: 388287

SEQ ID NO: 526944 - RNA, 64 nt, Human; identical to SEQ ID NO: 388288

SEQ ID NO: 526945 - RNA, 64 nt, Human; identical to SEQ ID NO: 388292

SEQ ID NO: 526946 - RNA, 64 nt, Human; identical to SEQ ID NO: 388293

SEQ ID NO: 526947 - RNA, 64 nt, Human; identical to SEQ ID NO: 388294

SEQ ID NO: 526948 - RNA, 64 nt, Human; identical to SEQ ID NO: 388295

SEQ ID NO: 526949 - RNA, 64 nt, Human; identical to SEQ ID NO: 388296

SEQ ID NO: 526950 - RNA, 64 nt, Human; identical to SEQ ID NO: 388297

SEQ ID NO: 526951 - RNA, 64 nt, Human; identical to SEQ ID NO: 388298

SEQ ID NO: 526952 - RNA, 64 nt, Human; identical to SEQ ID NO: 388299

SEQ ID NO: 526953 - RNA, 64 nt, Human; identical to SEQ ID NO: 388300

SEQ ID NO: 526954 - RNA, 64 nt, Human; identical to SEQ ID NO: 388301

SEQ ID NO: 526955 - RNA, 64 nt, Human; identical to SEQ ID NO: 388302

SEQ ID NO: 526956 - RNA, 64 nt, Human; identical to SEQ ID NO: 388303

SEQ ID NO: 526957 - RNA, 62 nt, Human
agcaagacccugucucagaaaaaaagaaaauucaaggccaguuaagacaaaaugcuaugacu

SEQ ID NO: 526958 - RNA, 62 nt, Human
augcuggugaaacuggccaaacagaacaccaacaaggccaaagacucuuuacggaagguucg

SEQ ID NO: 526959 - RNA, 62 nt, Human
agccccagguuccgccccagagcgguccuggacaaggccagaccaaagcaagcagggccugg

SEQ ID NO: 526960 - RNA, 64 nt, Human; identical to SEQ ID NO: 388304

SEQ ID NO: 526961 - RNA, 64 nt, Human; identical to SEQ ID NO: 388305

SEQ ID NO: 526962 - RNA, 64 nt, Human; identical to SEQ ID NO: 388306

SEQ ID NO: 526963 - RNA, 64 nt, Human; identical to SEQ ID NO: 388310

SEQ ID NO: 526964 - RNA, 64 nt, Human; identical to SEQ ID NO: 388311

SEQ ID NO: 526965 - RNA, 64 nt, Human; identical to SEQ ID NO: 388312

SEQ ID NO: 526966 - RNA, 64 nt, Human; identical to SEQ ID NO: 388313

SEQ ID NO: 526967 - RNA, 64 nt, Human; identical to SEQ ID NO: 388314

SEQ ID NO: 526968 - RNA, 64 nt, Human; identical to SEQ ID NO: 388315

SEQ ID NO: 526969 - RNA, 64 nt, Human; identical to SEQ ID NO: 388316

SEQ ID NO: 526970 - RNA, 64 nt, Human; identical to SEQ ID NO: 388317

SEQ ID NO: 526971 - RNA, 64 nt, Human; identical to SEQ ID NO: 388318

SEQ ID NO: 526972 - RNA, 64 nt, Human; identical to SEQ ID NO: 388319

SEQ ID NO: 526973 - RNA, 64 nt, Human; identical to SEQ ID NO: 388320

SEQ ID NO: 526974 - RNA, 62 nt, Human
ggcaucccagcccacacacccuggaugcccagcaaggccacagaaagagccugauguccaug

SEQ ID NO: 526975 - RNA, 62 nt, Human
agucaccugucuacauagaccaaauggagcaccaaggccaagcggacagaggggccaugggu

SEQ ID NO: 526976 - RNA, 62 nt, Human
ugagcaacuccuuacuucgguuccucugauuucaaggccauauuuuaaaaaaucaaaaggca

SEQ ID NO: 526977 - RNA, 64 nt, Human; identical to SEQ ID NO: 388321

SEQ ID NO: 526978 - RNA, 64 nt, Human; identical to SEQ ID NO: 388322

SEQ ID NO: 526979 - RNA, 64 nt, Human; identical to SEQ ID NO: 388323

SEQ ID NO: 526980 - RNA, 64 nt, Human; identical to SEQ ID NO: 388324

SEQ ID NO: 526981 - RNA, 64 nt, Human; identical to SEQ ID NO: 388328

SEQ ID NO: 526982 - RNA, 64 nt, Human; identical to SEQ ID NO: 388329

SEQ ID NO: 526983 - RNA, 64 nt, Human; identical to SEQ ID NO: 388330

SEQ ID NO: 526984 - RNA, 64 nt, Human; identical to SEQ ID NO: 388331

SEQ ID NO: 526985 - RNA, 64 nt, Human; identical to SEQ ID NO: 388332

SEQ ID NO: 526986 - RNA, 64 nt, Human; identical to SEQ ID NO: 388333

SEQ ID NO: 526987 - RNA, 64 nt, Human; identical to SEQ ID NO: 388334

SEQ ID NO: 526988 - RNA, 64 nt, Human; identical to SEQ ID NO: 388335

SEQ ID NO: 526989 - RNA, 64 nt, Human; identical to SEQ ID NO: 388336

SEQ ID NO: 526990 - RNA, 64 nt, Human; identical to SEQ ID NO: 388337

SEQ ID NO: 526991 - RNA, 62 nt, Human
ugaggaugggccuagcagaugaagcuugccagcaaggccaaagcaaacgguuucuccugugg

SEQ ID NO: 526992 - RNA, 62 nt, Human
guccccacaaaggcuucugagaccacaaaauacaaggccagaccuagaguguccacagcagg

SEQ ID NO: 526993 - RNA, 62 nt, Human
gcacuuugggaggccaaagcagguggauuacccaaggccaggaguucaagaccagccuggcc

SEQ ID NO: 526994 - RNA, 64 nt, Human; identical to SEQ ID NO: 388338

SEQ ID NO: 526995 - RNA, 64 nt, Human; identical to SEQ ID NO: 388339

SEQ ID NO: 526996 - RNA, 64 nt, Human; identical to SEQ ID NO: 388340

SEQ ID NO: 526997 - RNA, 64 nt, Human; identical to SEQ ID NO: 388341

SEQ ID NO: 526998 - RNA, 64 nt, Human; identical to SEQ ID NO: 388342

SEQ ID NO: 526999 - RNA, 64 nt, Human; identical to SEQ ID NO: 388345

SEQ ID NO: 527000 - RNA, 64 nt, Human; identical to SEQ ID NO: 388346

SEQ ID NO: 527001 - RNA, 64 nt, Human; identical to SEQ ID NO: 388347

SEQ ID NO: 527002 - RNA, 64 nt, Human; identical to SEQ ID NO: 388348

SEQ ID NO: 527003 - RNA, 64 nt, Human; identical to SEQ ID NO: 388349

SEQ ID NO: 527004 - RNA, 64 nt, Human; identical to SEQ ID NO: 388350

SEQ ID NO: 527005 - RNA, 64 nt, Human; identical to SEQ ID NO: 388351

SEQ ID NO: 527006 - RNA, 64 nt, Human; identical to SEQ ID NO: 388352

SEQ ID NO: 527007 - RNA, 64 nt, Human; identical to SEQ ID NO: 388353

SEQ ID NO: 527008 - RNA, 54 nt, Human
caugcaagauugaacuguaaaaaccaaggccagccacaccacaggaucugaacu

SEQ ID NO: 527009 - RNA, 62 nt, Human
uuuuaaaauuuuuguuguauugaaaagcuaaacaaggccaaaagguuaaauuuuuugaauau

SEQ ID NO: 527010 - RNA, 62 nt, Human
uucauuugucuagugaaucagaaaggcuuagccaaggccacaucugggaagaguggagaaau

SEQ ID NO: 527011 - RNA, 64 nt, Human; identical to SEQ ID NO: 388354

SEQ ID NO: 527012 - RNA, 64 nt, Human; identical to SEQ ID NO: 388355

SEQ ID NO: 527013 - RNA, 64 nt, Human; identical to SEQ ID NO: 388356

SEQ ID NO: 527014 - RNA, 64 nt, Human; identical to SEQ ID NO: 388357

SEQ ID NO: 527015 - RNA, 64 nt, Human; identical to SEQ ID NO: 388358

SEQ ID NO: 527016 - RNA, 64 nt, Human; identical to SEQ ID NO: 388359

SEQ ID NO: 527017 - RNA, 64 nt, Human; identical to SEQ ID NO: 388363

SEQ ID NO: 527018 - RNA, 64 nt, Human; identical to SEQ ID NO: 388364

SEQ ID NO: 527019 - RNA, 64 nt, Human; identical to SEQ ID NO: 388365

SEQ ID NO: 527020 - RNA, 64 nt, Human; identical to SEQ ID NO: 388366

SEQ ID NO: 527021 - RNA, 64 nt, Human; identical to SEQ ID NO: 388367

SEQ ID NO: 527022 - RNA, 64 nt, Human; identical to SEQ ID NO: 388368

SEQ ID NO: 527023 - RNA, 64 nt, Human; identical to SEQ ID NO: 388369

SEQ ID NO: 527024 - RNA, 64 nt, Human; identical to SEQ ID NO: 388370

SEQ ID NO: 527025 - RNA, 62 nt, Human
aacguuacuuagacugcaagcuagaaagccaccaaggccaggcuuuguuaaaagaaguguau

SEQ ID NO: 527026 - RNA, 62 nt, Human
ggccccacccccacaguuccacgccccccccccaaggccacacccucccucccuagagcagc

SEQ ID NO: 527027 - RNA, 62 nt, Human
gaaggugugaccucuccuuugccugcauaccucaaggccaggggaauaugccucagugaugc

SEQ ID NO: 527028 - RNA, 64 nt, Human; identical to SEQ ID NO: 388371

SEQ ID NO: 527029 - RNA, 64 nt, Human; identical to SEQ ID NO: 388372

SEQ ID NO: 527030 - RNA, 64 nt, Human; identical to SEQ ID NO: 388373

SEQ ID NO: 527031 - RNA, 64 nt, Human; identical to SEQ ID NO: 388374

SEQ ID NO: 527032 - RNA, 64 nt, Human; identical to SEQ ID NO: 388375

SEQ ID NO: 527033 - RNA, 63 nt, Human; identical to SEQ ID NO: 388376

SEQ ID NO: 527034 - RNA, 64 nt, Human; identical to SEQ ID NO: 388377

SEQ ID NO: 527035 - RNA, 64 nt, Human; identical to SEQ ID NO: 388381

SEQ ID NO: 527036 - RNA, 64 nt, Human; identical to SEQ ID NO: 388382

SEQ ID NO: 527037 - RNA, 64 nt, Human; identical to SEQ ID NO: 388383

SEQ ID NO: 527038 - RNA, 64 nt, Human; identical to SEQ ID NO: 388384

SEQ ID NO: 527039 - RNA, 64 nt, Human; identical to SEQ ID NO: 388385

SEQ ID NO: 527040 - RNA, 64 nt, Human; identical to SEQ ID NO: 388386

SEQ ID NO: 527041 - RNA, 64 nt, Human; identical to SEQ ID NO: 388387

SEQ ID NO: 527042 - RNA, 62 nt, Human
gugccugucuuuaccauguaacuuaauguuugcaaggccagaguguuugaaaguuuuguauu

SEQ ID NO: 527043 - RNA, 62 nt, Human
ucagggcuaacccccagaauacugguaggggccaaggccaugcuccccuugggaaacagaaa

SEQ ID NO: 527044 - RNA, 62 nt, Human
ggaaggucccuuuuccucuguuuuguguuugccaaggccaaacucccacucucugccccccu

SEQ ID NO: 527045 - RNA, 64 nt, Human; identical to SEQ ID NO: 388388

SEQ ID NO: 527046 - RNA, 64 nt, Human; identical to SEQ ID NO: 388389

SEQ ID NO: 527047 - RNA, 64 nt, Human; identical to SEQ ID NO: 388390

SEQ ID NO: 527048 - RNA, 64 nt, Human; identical to SEQ ID NO: 388391

SEQ ID NO: 527049 - RNA, 64 nt, Human; identical to SEQ ID NO: 388392

SEQ ID NO: 527050 - RNA, 64 nt, Human; identical to SEQ ID NO: 388393

SEQ ID NO: 527051 - RNA, 64 nt, Human; identical to SEQ ID NO: 388394

SEQ ID NO: 527052 - RNA, 64 nt, Human; identical to SEQ ID NO: 388395

SEQ ID NO: 527053 - RNA, 64 nt, Human; identical to SEQ ID NO: 388399

SEQ ID NO: 527054 - RNA, 64 nt, Human; identical to SEQ ID NO: 388400

SEQ ID NO: 527055 - RNA, 64 nt, Human; identical to SEQ ID NO: 388401

SEQ ID NO: 527056 - RNA, 64 nt, Human; identical to SEQ ID NO: 388402

SEQ ID NO: 527057 - RNA, 64 nt, Human; identical to SEQ ID NO: 388403

SEQ ID NO: 527058 - RNA, 64 nt, Human; identical to SEQ ID NO: 388404

SEQ ID NO: 527059 - RNA, 62 nt, Human
ccgugacacccuucauccuacccuuggaaccccaaggccaaguugguucaaacuguuggaga

SEQ ID NO: 527060 - RNA, 62 nt, Human
gaucaucaucuucuagccaggggcauaguugccaaggccauuuaccucuuucuaagaagaaa

SEQ ID NO: 527061 - RNA, 62 nt, Human
cccuccuuugccuuucaagagcagggccugggcaaggccaagaaccaugcagaagccuuccu

SEQ ID NO: 527062 - RNA, 64 nt, Human; identical to SEQ ID NO: 388405

SEQ ID NO: 527063 - RNA, 64 nt, Human; identical to SEQ ID NO: 388406

SEQ ID NO: 527064 - RNA, 57 nt, Human; identical to SEQ ID NO: 388407

SEQ ID NO: 527065 - RNA, 64 nt, Human; identical to SEQ ID NO: 388408

SEQ ID NO: 527066 - RNA, 64 nt, Human; identical to SEQ ID NO: 388409

SEQ ID NO: 527067 - RNA, 64 nt, Human; identical to SEQ ID NO: 388410

SEQ ID NO: 527068 - RNA, 64 nt, Human; identical to SEQ ID NO: 388411

SEQ ID NO: 527069 - RNA, 64 nt, Human; identical to SEQ ID NO: 388412

SEQ ID NO: 527070 - RNA, 64 nt, Human; identical to SEQ ID NO: 388413

SEQ ID NO: 527071 - RNA, 64 nt, Human; identical to SEQ ID NO: 388417

SEQ ID NO: 527072 - RNA, 64 nt, Human; identical to SEQ ID NO: 388418

SEQ ID NO: 527073 - RNA, 64 nt, Human; identical to SEQ ID NO: 388419

SEQ ID NO: 527074 - RNA, 64 nt, Human; identical to SEQ ID NO: 388420

SEQ ID NO: 527075 - RNA, 64 nt, Human; identical to SEQ ID NO: 388421

SEQ ID NO: 527076 - RNA, 62 nt, Human
cuauuguucuuccacuucguuuucugcugucccaaggccagaugaguggaaucaccaucuga

SEQ ID NO: 527077 - RNA, 62 nt, Human
aauugagcaguugugaaaauugcuaauggugccaaggccaagcaaagaguuucagaaaauga

SEQ ID NO: 527078 - RNA, 62 nt, Human
auauuuggggcaucucuauagaaagugaccaccaaggccaguaaguacgggaaaaaauguuu

SEQ ID NO: 527079 - RNA, 55 nt, Human; identical to SEQ ID NO: 388422

SEQ ID NO: 527080 - RNA, 64 nt, Human; identical to SEQ ID NO: 388423

SEQ ID NO: 527081 - RNA, 64 nt, Human; identical to SEQ ID NO: 388424

SEQ ID NO: 527082 - RNA, 64 nt, Human; identical to SEQ ID NO: 388425

SEQ ID NO: 527083 - RNA, 64 nt, Human; identical to SEQ ID NO: 388426

SEQ ID NO: 527084 - RNA, 64 nt, Human; identical to SEQ ID NO: 388427

SEQ ID NO: 527085 - RNA, 64 nt, Human; identical to SEQ ID NO: 388428

SEQ ID NO: 527086 - RNA, 64 nt, Human; identical to SEQ ID NO: 388429

SEQ ID NO: 527087 - RNA, 64 nt, Human; identical to SEQ ID NO: 388430

SEQ ID NO: 527088 - RNA, 64 nt, Human; identical to SEQ ID NO: 388431

SEQ ID NO: 527089 - RNA, 64 nt, Human; identical to SEQ ID NO: 388435

SEQ ID NO: 527090 - RNA, 64 nt, Human; identical to SEQ ID NO: 388436

SEQ ID NO: 527091 - RNA, 64 nt, Human; identical to SEQ ID NO: 388437

SEQ ID NO: 527092 - RNA, 64 nt, Human; identical to SEQ ID NO: 388438

SEQ ID NO: 527093 - RNA, 62 nt, Human
acaccaucuguuaaccucugaguuugcccacucaaggccacucauaggggcauccaucccca

SEQ ID NO: 527094 - RNA, 62 nt, Human
ccaguuaggugcuagauccuaagaggcacucacaaggccagcaggugcuuccuuggcuccca

SEQ ID NO: 527095 - RNA, 62 nt, Human
aaagacuuuuuuuuuuuuuuuuuuuuuuuugccaaggccaguguugcugccuaaaaaaaaaa

SEQ ID NO: 527096 - RNA, 64 nt, Human; identical to SEQ ID NO: 388439

SEQ ID NO: 527097 - RNA, 64 nt, Human; identical to SEQ ID NO: 388440

SEQ ID NO: 527098 - RNA, 64 nt, Human; identical to SEQ ID NO: 388441

SEQ ID NO: 527099 - RNA, 64 nt, Human; identical to SEQ ID NO: 388442

SEQ ID NO: 527100 - RNA, 64 nt, Human; identical to SEQ ID NO: 388443

SEQ ID NO: 527101 - RNA, 64 nt, Human; identical to SEQ ID NO: 388444

SEQ ID NO: 527102 - RNA, 64 nt, Human; identical to SEQ ID NO: 388445

SEQ ID NO: 527103 - RNA, 64 nt, Human; identical to SEQ ID NO: 388446

SEQ ID NO: 527104 - RNA, 64 nt, Human; identical to SEQ ID NO: 388447

SEQ ID NO: 527105 - RNA, 64 nt, Human; identical to SEQ ID NO: 388448

SEQ ID NO: 527106 - RNA, 64 nt, Human; identical to SEQ ID NO: 388449

SEQ ID NO: 527107 - RNA, 64 nt, Human; identical to SEQ ID NO: 388453

SEQ ID NO: 527108 - RNA, 64 nt, Human; identical to SEQ ID NO: 388454

SEQ ID NO: 527109 - RNA, 64 nt, Human; identical to SEQ ID NO: 388455

SEQ ID NO: 527110 - RNA, 62 nt, Human
agcuucucuucuuucugaagaucaauuucucccaaggccaagauuguccuuuucucccauuu

SEQ ID NO: 527111 - RNA, 62 nt, Human
gcacugggagaaauucaggacaggagugaacucaaggccaugaacucacuggauuuccauuu

SEQ ID NO: 527112 - RNA, 62 nt, Human
cacauucaucagacaucugcuuaugcuguggucaaggccagucauuuuuaauuuauaucaga

SEQ ID NO: 527113 - RNA, 64 nt, Human; identical to SEQ ID NO: 388456

SEQ ID NO: 527114 - RNA, 64 nt, Human; identical to SEQ ID NO: 388457

SEQ ID NO: 527115 - RNA, 64 nt, Human; identical to SEQ ID NO: 388458

SEQ ID NO: 527116 - RNA, 64 nt, Human; identical to SEQ ID NO: 388459

SEQ ID NO: 527117 - RNA, 64 nt, Human; identical to SEQ ID NO: 388460

SEQ ID NO: 527118 - RNA, 64 nt, Human; identical to SEQ ID NO: 388461

SEQ ID NO: 527119 - RNA, 64 nt, Human; identical to SEQ ID NO: 388462

SEQ ID NO: 527120 - RNA, 64 nt, Human; identical to SEQ ID NO: 388463

SEQ ID NO: 527121 - RNA, 64 nt, Human; identical to SEQ ID NO: 388464

SEQ ID NO: 527122 - RNA, 57 nt, Human; identical to SEQ ID NO: 388465

SEQ ID NO: 527123 - RNA, 64 nt, Human; identical to SEQ ID NO: 388466

SEQ ID NO: 527124 - RNA, 64 nt, Human; identical to SEQ ID NO: 388467

SEQ ID NO: 527125 - RNA, 64 nt, Human; identical to SEQ ID NO: 388471

SEQ ID NO: 527126 - RNA, 64 nt, Human; identical to SEQ ID NO: 388472

SEQ ID NO: 527127 - RNA, 50 nt, Human
cccuguguggcuaucacuagcaaggccaagccccggguacccucagugau

SEQ ID NO: 527128 - RNA, 62 nt, Human
cuacaaagcacugccucuacugggcgugcugccaaggccaugugcacuccauccucauguau

SEQ ID NO: 527129 - RNA, 62 nt, Human
gaggcacuguauauggggacacugccagucaccaaggccaugggugaggacugagggggcug

SEQ ID NO: 527130 - RNA, 64 nt, Human; identical to SEQ ID NO: 388473

SEQ ID NO: 527131 - RNA, 64 nt, Human; identical to SEQ ID NO: 388474

SEQ ID NO: 527132 - RNA, 64 nt, Human; identical to SEQ ID NO: 388475

SEQ ID NO: 527133 - RNA, 64 nt, Human; identical to SEQ ID NO: 388476

SEQ ID NO: 527134 - RNA, 64 nt, Human; identical to SEQ ID NO: 388477

SEQ ID NO: 527135 - RNA, 64 nt, Human; identical to SEQ ID NO: 388478

SEQ ID NO: 527136 - RNA, 64 nt, Human; identical to SEQ ID NO: 388479

SEQ ID NO: 527137 - RNA, 64 nt, Human; identical to SEQ ID NO: 388480

SEQ ID NO: 527138 - RNA, 64 nt, Human; identical to SEQ ID NO: 388481

SEQ ID NO: 527139 - RNA, 64 nt, Human; identical to SEQ ID NO: 388482

SEQ ID NO: 527140 - RNA, 64 nt, Human; identical to SEQ ID NO: 388483

SEQ ID NO: 527141 - RNA, 64 nt, Human; identical to SEQ ID NO: 388484

SEQ ID NO: 527142 - RNA, 64 nt, Human; identical to SEQ ID NO: 388485

SEQ ID NO: 527143 - RNA, 64 nt, Human; identical to SEQ ID NO: 388489

SEQ ID NO: 527144 - RNA, 62 nt, Human
uuccaggugguugcacauuuguccagaugaagcaaggccauauacccuaaacuuccauccug

SEQ ID NO: 527145 - RNA, 62 nt, Human
acuccuagccccgaggugcugauggagaugcucaaggccagcaagccccucaggccagcacu

SEQ ID NO: 527146 - RNA, 62 nt, Human
ugauuuccacacacuaagacuaaauuauguaucaaggccaucaguaucccuggguuacacua

SEQ ID NO: 527147 - RNA, 64 nt, Human; identical to SEQ ID NO: 388490

SEQ ID NO: 527148 - RNA, 64 nt, Human; identical to SEQ ID NO: 388491

SEQ ID NO: 527149 - RNA, 64 nt, Human; identical to SEQ ID NO: 388492

SEQ ID NO: 527150 - RNA, 64 nt, Human; identical to SEQ ID NO: 388493

SEQ ID NO: 527151 - RNA, 64 nt, Human; identical to SEQ ID NO: 388494

SEQ ID NO: 527152 - RNA, 64 nt, Human; identical to SEQ ID NO: 388495

SEQ ID NO: 527153 - RNA, 64 nt, Human; identical to SEQ ID NO: 388496

SEQ ID NO: 527154 - RNA, 64 nt, Human; identical to SEQ ID NO: 388497

SEQ ID NO: 527155 - RNA, 64 nt, Human; identical to SEQ ID NO: 388498

SEQ ID NO: 527156 - RNA, 64 nt, Human; identical to SEQ ID NO: 388499

SEQ ID NO: 527157 - RNA, 64 nt, Human; identical to SEQ ID NO: 388500

SEQ ID NO: 527158 - RNA, 64 nt, Human; identical to SEQ ID NO: 388501

SEQ ID NO: 527159 - RNA, 64 nt, Human; identical to SEQ ID NO: 388502

SEQ ID NO: 527160 - RNA, 64 nt, Human; identical to SEQ ID NO: 388503

SEQ ID NO: 527161 - RNA, 62 nt, Human
aauaugccguguagaauauuugucuuaaaauucaaggccacaaaaacaauguuugggggaaa

SEQ ID NO: 527162 - RNA, 62 nt, Human
uccuuggcugccgcuuucucuccccacagccucaaggccacccuaccgucauauauaucacu

SEQ ID NO: 527163 - RNA, 62 nt, Human
cuccacagacccccuaugggggacccccaacucaaggccaaggacugggcguaucggaugcu

SEQ ID NO: 527164 - RNA, 64 nt, Human; identical to SEQ ID NO: 388505

SEQ ID NO: 527165 - RNA, 64 nt, Human; identical to SEQ ID NO: 388506

SEQ ID NO: 527166 - RNA, 64 nt, Human; identical to SEQ ID NO: 388507

SEQ ID NO: 527167 - RNA, 64 nt, Human; identical to SEQ ID NO: 388508

SEQ ID NO: 527168 - RNA, 64 nt, Human; identical to SEQ ID NO: 388509

SEQ ID NO: 527169 - RNA, 59 nt, Human; identical to SEQ ID NO: 388510

SEQ ID NO: 527170 - RNA, 64 nt, Human; identical to SEQ ID NO: 388511

SEQ ID NO: 527171 - RNA, 64 nt, Human; identical to SEQ ID NO: 388512

SEQ ID NO: 527172 - RNA, 64 nt, Human; identical to SEQ ID NO: 388513

SEQ ID NO: 527173 - RNA, 64 nt, Human; identical to SEQ ID NO: 388514

SEQ ID NO: 527174 - RNA, 64 nt, Human; identical to SEQ ID NO: 388515

SEQ ID NO: 527175 - RNA, 64 nt, Human; identical to SEQ ID NO: 388516

SEQ ID NO: 527176 - RNA, 64 nt, Human; identical to SEQ ID NO: 388517

SEQ ID NO: 527177 - RNA, 64 nt, Human; identical to SEQ ID NO: 388518

SEQ ID NO: 527178 - RNA, 62 nt, Human
uuuuuguccaaaagugaucuggucggaucucacaaggccauccaaugagaccccgcacagca

SEQ ID NO: 527179 - RNA, 62 nt, Human
uuaauagcugaaguccuaucuguaccaacaagcaaggccacuuuucagaagauaagaguuca

SEQ ID NO: 527180 - RNA, 62 nt, Human
aauuaaagaugaauaaauaaaauaaaaugacacaaggccaaaaacaaauggguuuaacugac

SEQ ID NO: 527181 - RNA, 64 nt, Human; identical to SEQ ID NO: 388519

SEQ ID NO: 527182 - RNA, 64 nt, Human; identical to SEQ ID NO: 388523

SEQ ID NO: 527183 - RNA, 64 nt, Human; identical to SEQ ID NO: 388524

SEQ ID NO: 527184 - RNA, 64 nt, Human; identical to SEQ ID NO: 388525

SEQ ID NO: 527185 - RNA, 64 nt, Human; identical to SEQ ID NO: 388526

SEQ ID NO: 527186 - RNA, 64 nt, Human; identical to SEQ ID NO: 388527

SEQ ID NO: 527187 - RNA, 64 nt, Human; identical to SEQ ID NO: 388528

SEQ ID NO: 527188 - RNA, 58 nt, Human; identical to SEQ ID NO: 388529

SEQ ID NO: 527189 - RNA, 64 nt, Human; identical to SEQ ID NO: 388530

SEQ ID NO: 527190 - RNA, 64 nt, Human; identical to SEQ ID NO: 388531

SEQ ID NO: 527191 - RNA, 64 nt, Human; identical to SEQ ID NO: 388532

SEQ ID NO: 527192 - RNA, 64 nt, Human; identical to SEQ ID NO: 388533

SEQ ID NO: 527193 - RNA, 64 nt, Human; identical to SEQ ID NO: 388534

SEQ ID NO: 527194 - RNA, 62 nt, Human
aacucaauugggccuuuuucggugaccucauccaaggccaugaugucaagggccaugucccc

SEQ ID NO: 527195 - RNA, 62 nt, Human
cugugguugcuggagcugcuggcagggccaggcaaggccagagugcuaggggcagggugaag

SEQ ID NO: 527196 - RNA, 62 nt, Human
uccuugaugccugucggcacuucugaaaggcacaaggccaagaacuccuggccaggacugca

SEQ ID NO: 527197 - RNA, 64 nt, Human; identical to SEQ ID NO: 388109

SEQ ID NO: 527198 - RNA, 64 nt, Human; identical to SEQ ID NO: 388113

SEQ ID NO: 527199 - RNA, 64 nt, Human; identical to SEQ ID NO: 388114

SEQ ID NO: 527200 - RNA, 64 nt, Human; identical to SEQ ID NO: 388115

SEQ ID NO: 527201 - RNA, 64 nt, Human; identical to SEQ ID NO: 388116

SEQ ID NO: 527202 - RNA, 64 nt, Human; identical to SEQ ID NO: 388117

SEQ ID NO: 527203 - RNA, 64 nt, Human; identical to SEQ ID NO: 388118

SEQ ID NO: 527204 - RNA, 64 nt, Human; identical to SEQ ID NO: 388119

SEQ ID NO: 527205 - RNA, 64 nt, Human; identical to SEQ ID NO: 388120

SEQ ID NO: 527206 - RNA, 64 nt, Human; identical to SEQ ID NO: 388121

SEQ ID NO: 527207 - RNA, 64 nt, Human; identical to SEQ ID NO: 388122

SEQ ID NO: 527208 - RNA, 62 nt, Human
uaaauaaaccaaagcaguaauuaauaaccuuccaaggccagguacagugguucaugccugua

SEQ ID NO: 527209 - RNA, 62 nt, Human
ggcagggacagggccggucgggggggacccuccaaggccaggccuuggggacaaccuuggcu

SEQ ID NO: 527210 - RNA, 62 nt, Human
ccagcuuuauuuuuuaacaugaaagcugaugccaaggccaaaagaaguuuaaagcaucugua

SEQ ID NO: 527211 - RNA, 64 nt, Human; identical to SEQ ID NO: 388123

SEQ ID NO: 527212 - RNA, 64 nt, Human; identical to SEQ ID NO: 388124

SEQ ID NO: 527213 - RNA, 64 nt, Human; identical to SEQ ID NO: 388125

SEQ ID NO: 527214 - RNA, 64 nt, Human; identical to SEQ ID NO: 388126

SEQ ID NO: 527215 - RNA, 57 nt, Human; identical to SEQ ID NO: 388127

SEQ ID NO: 527216 - RNA, 64 nt, Human; identical to SEQ ID NO: 388131

SEQ ID NO: 527217 - RNA, 64 nt, Human; identical to SEQ ID NO: 388132

SEQ ID NO: 527218 - RNA, 64 nt, Human; identical to SEQ ID NO: 388133

SEQ ID NO: 527219 - RNA, 64 nt, Human; identical to SEQ ID NO: 388134

SEQ ID NO: 527220 - RNA, 64 nt, Human; identical to SEQ ID NO: 388135

SEQ ID NO: 527221 - RNA, 64 nt, Human; identical to SEQ ID NO: 388136

SEQ ID NO: 527222 - RNA, 64 nt, Human; identical to SEQ ID NO: 388137

SEQ ID NO: 527223 - RNA, 64 nt, Human; identical to SEQ ID NO: 388138

SEQ ID NO: 527224 - RNA, 64 nt, Human; identical to SEQ ID NO: 388139

SEQ ID NO: 527225 - RNA, 62 nt, Human
uaaugaaccaugaaagacaggaugaccuuggacaaggccaaacuguccuccaagacuccuua

SEQ ID NO: 527226 - RNA, 62 nt, Human
cugucaucacuguacccaagugaugucacuaccaaggccaaaugauggugggcuaaauuuua

SEQ ID NO: 527227 - RNA, 62 nt, Human
aaaguucacccccaugucuguguaaccggagucaaggccaggcuggcagagucaguccuuag

SEQ ID NO: 527228 - RNA, 64 nt, Human; identical to SEQ ID NO: 388140

SEQ ID NO: 527229 - RNA, 64 nt, Human; identical to SEQ ID NO: 388141

SEQ ID NO: 527230 - RNA, 64 nt, Human; identical to SEQ ID NO: 388142

SEQ ID NO: 527231 - RNA, 64 nt, Human; identical to SEQ ID NO: 388143

SEQ ID NO: 527232 - RNA, 64 nt, Human; identical to SEQ ID NO: 388144

SEQ ID NO: 527233 - RNA, 64 nt, Human; identical to SEQ ID NO: 388145

SEQ ID NO: 527234 - RNA, 64 nt, Human; identical to SEQ ID NO: 388149

SEQ ID NO: 527235 - RNA, 64 nt, Human; identical to SEQ ID NO: 388150

SEQ ID NO: 527236 - RNA, 64 nt, Human; identical to SEQ ID NO: 388151

SEQ ID NO: 527237 - RNA, 64 nt, Human; identical to SEQ ID NO: 388152

SEQ ID NO: 527238 - RNA, 58 nt, Human; identical to SEQ ID NO: 388153

SEQ ID NO: 527239 - RNA, 64 nt, Human; identical to SEQ ID NO: 388154

SEQ ID NO: 527240 - RNA, 64 nt, Human; identical to SEQ ID NO: 388155

SEQ ID NO: 527241 - RNA, 64 nt, Human; identical to SEQ ID NO: 388156

SEQ ID NO: 527242 - RNA, 62 nt, Human
auaaauaaagcacaaaaaccucucuuauucuacaaggccauaaaagguuuuuuuuuuuuuuu

SEQ ID NO: 527243 - RNA, 62 nt, Human
gacugaagccuagguauauuaaauagcuugcccaaggccacacagcaaaagucaccaacuca

SEQ ID NO: 527244 - RNA, 62 nt, Human
ccucucuuucucugguggucuuccuucuaccccaaggccaguaguuuugacacuucccagug

SEQ ID NO: 527245 - RNA, 59 nt, Human; identical to SEQ ID NO: 388157

SEQ ID NO: 527246 - RNA, 64 nt, Human; identical to SEQ ID NO: 388158

SEQ ID NO: 527247 - RNA, 64 nt, Human; identical to SEQ ID NO: 388159

SEQ ID NO: 527248 - RNA, 64 nt, Human; identical to SEQ ID NO: 388160

SEQ ID NO: 527249 - RNA, 64 nt, Human; identical to SEQ ID NO: 388161

SEQ ID NO: 527250 - RNA, 64 nt, Human; identical to SEQ ID NO: 388162

SEQ ID NO: 527251 - RNA, 64 nt, Human; identical to SEQ ID NO: 388163

SEQ ID NO: 527252 - RNA, 64 nt, Human; identical to SEQ ID NO: 388167

SEQ ID NO: 527253 - RNA, 64 nt, Human; identical to SEQ ID NO: 388168

SEQ ID NO: 527254 - RNA, 64 nt, Human; identical to SEQ ID NO: 388169

SEQ ID NO: 527255 - RNA, 64 nt, Human; identical to SEQ ID NO: 388170

SEQ ID NO: 527256 - RNA, 64 nt, Human; identical to SEQ ID NO: 388171

SEQ ID NO: 527257 - RNA, 64 nt, Human; identical to SEQ ID NO: 388172

SEQ ID NO: 527258 - RNA, 64 nt, Human; identical to SEQ ID NO: 388173

SEQ ID NO: 527259 - RNA, 62 nt, Human
gucggaacaauuccuagcaccugucggaaggucaaggccaaaggcaaauucaaggccagacu

SEQ ID NO: 527260 - RNA, 62 nt, Human
accugucggaaggucaaggccaaaggcaaauucaaggccagacugugacaaacccagggcug

SEQ ID NO: 527261 - RNA, 62 nt, Human
ggccaagcacagucggaugcccaaagauccaacaaggccauggcucuguguccuugaguggg

SEQ ID NO: 527262 - RNA, 64 nt, Human; identical to SEQ ID NO: 388174

SEQ ID NO: 527263 - RNA, 64 nt, Human; identical to SEQ ID NO: 388175

SEQ ID NO: 527264 - RNA, 64 nt, Human; identical to SEQ ID NO: 388176

SEQ ID NO: 527265 - RNA, 64 nt, Human; identical to SEQ ID NO: 388177

SEQ ID NO: 527266 - RNA, 64 nt, Human; identical to SEQ ID NO: 388178

SEQ ID NO: 527267 - RNA, 64 nt, Human; identical to SEQ ID NO: 388179

SEQ ID NO: 527268 - RNA, 64 nt, Human; identical to SEQ ID NO: 388180

SEQ ID NO: 527269 - RNA, 64 nt, Human; identical to SEQ ID NO: 388181

SEQ ID NO: 527270 - RNA, 64 nt, Human; identical to SEQ ID NO: 388184

SEQ ID NO: 527271 - RNA, 64 nt, Human; identical to SEQ ID NO: 388185

SEQ ID NO: 527272 - RNA, 64 nt, Human; identical to SEQ ID NO: 388186

SEQ ID NO: 527273 - RNA, 64 nt, Human; identical to SEQ ID NO: 388187

SEQ ID NO: 527274 - RNA, 64 nt, Human; identical to SEQ ID NO: 388188

SEQ ID NO: 527275 - RNA, 64 nt, Human; identical to SEQ ID NO: 388189

SEQ ID NO: 527276 - RNA, 62 nt, Human
uuguuggugggggcuccuuuccggccagaccacaaggccagaagcaauaauggcaccucagc

SEQ ID NO: 527277 - RNA, 62 nt, Human
aaggccaacacaaccauaagcagccagacccacaaggccagguccugugcuaucacaggguc

SEQ ID NO: 527278 - RNA, 62 nt, Human
ucagagggauaccauccuagggucugggaauccaaggccacgagacuccuugguuugugguc

SEQ ID NO: 527279 - RNA, 64 nt, Human; identical to SEQ ID NO: 388190

SEQ ID NO: 527280 - RNA, 64 nt, Human; identical to SEQ ID NO: 388191

SEQ ID NO: 527281 - RNA, 64 nt, Human; identical to SEQ ID NO: 388192

SEQ ID NO: 527282 - RNA, 64 nt, Human; identical to SEQ ID NO: 388193

SEQ ID NO: 527283 - RNA, 64 nt, Human; identical to SEQ ID NO: 388194

SEQ ID NO: 527284 - RNA, 64 nt, Human; identical to SEQ ID NO: 388195

SEQ ID NO: 527285 - RNA, 64 nt, Human; identical to SEQ ID NO: 388196

SEQ ID NO: 527286 - RNA, 64 nt, Human; identical to SEQ ID NO: 388197

SEQ ID NO: 527287 - RNA, 64 nt, Human; identical to SEQ ID NO: 388198

SEQ ID NO: 527288 - RNA, 64 nt, Human; identical to SEQ ID NO: 388202

SEQ ID NO: 527289 - RNA, 64 nt, Human; identical to SEQ ID NO: 388203

SEQ ID NO: 527290 - RNA, 64 nt, Human; identical to SEQ ID NO: 388204

SEQ ID NO: 527291 - RNA, 64 nt, Human; identical to SEQ ID NO: 388205

SEQ ID NO: 527292 - RNA, 64 nt, Human; identical to SEQ ID NO: 388206

SEQ ID NO: 527293 - RNA, 62 nt, Human
cuuacagccagugacacaggacuuucagagaccaaggccagggucugcugcacugcuguucu

SEQ ID NO: 527294 - RNA, 62 nt, Human
caagaccuacugaucuggagucccacguuccccaaggccagcgggaugugugccccuccucc

SEQ ID NO: 527295 - RNA, 62 nt, Human
uuggggcagguuuuuaaaaauuagcuaggcaucaaggccagaccagggcuggggguugggcu

SEQ ID NO: 527296 - RNA, 64 nt, Human; identical to SEQ ID NO: 388207

SEQ ID NO: 527297 - RNA, 64 nt, Human; identical to SEQ ID NO: 388208

SEQ ID NO: 527298 - RNA, 64 nt, Human; identical to SEQ ID NO: 388209

SEQ ID NO: 527299 - RNA, 64 nt, Human; identical to SEQ ID NO: 388210

SEQ ID NO: 527300 - RNA, 64 nt, Human; identical to SEQ ID NO: 388211

SEQ ID NO: 527301 - RNA, 64 nt, Human; identical to SEQ ID NO: 388212

SEQ ID NO: 527302 - RNA, 64 nt, Human; identical to SEQ ID NO: 388213

SEQ ID NO: 527303 - RNA, 64 nt, Human; identical to SEQ ID NO: 388214

SEQ ID NO: 527304 - RNA, 64 nt, Human; identical to SEQ ID NO: 388215

SEQ ID NO: 527305 - RNA, 64 nt, Human; identical to SEQ ID NO: 388216

SEQ ID NO: 527306 - RNA, 64 nt, Human; identical to SEQ ID NO: 388220

SEQ ID NO: 527307 - RNA, 64 nt, Human; identical to SEQ ID NO: 388221

SEQ ID NO: 527308 - RNA, 64 nt, Human; identical to SEQ ID NO: 388222

SEQ ID NO: 527309 - RNA, 64 nt, Human; identical to SEQ ID NO: 388223

SEQ ID NO: 527310 - RNA, 62 nt, Human
ucagcauccuuggugaacaagaggaguggccacaaggccaguggcaccugccagaggggaaa

SEQ ID NO: 527311 - RNA, 62 nt, Human
aggcauuccucccugcccaaucccagugcagucaaggccaaccuaggcagcagccaccuucu

SEQ ID NO: 527312 - RNA, 62 nt, Human
caucucuaagugccgaacucaucccuguuccucaaggccaccuggccaggagcuucucugau

SEQ ID NO: 527313 - RNA, 64 nt, Human; identical to SEQ ID NO: 388224

SEQ ID NO: 527314 - RNA, 64 nt, Human; identical to SEQ ID NO: 388225

SEQ ID NO: 527315 - RNA, 64 nt, Human; identical to SEQ ID NO: 388226

SEQ ID NO: 527316 - RNA, 64 nt, Human; identical to SEQ ID NO: 388227

SEQ ID NO: 527317 - RNA, 59 nt, Human; identical to SEQ ID NO: 388228

SEQ ID NO: 527318 - RNA, 64 nt, Human; identical to SEQ ID NO: 388229

SEQ ID NO: 527319 - RNA, 64 nt, Human; identical to SEQ ID NO: 388230

SEQ ID NO: 527320 - RNA, 64 nt, Human; identical to SEQ ID NO: 388231

SEQ ID NO: 527321 - RNA, 64 nt, Human; identical to SEQ ID NO: 388232

SEQ ID NO: 527322 - RNA, 64 nt, Human; identical to SEQ ID NO: 388233

SEQ ID NO: 527323 - RNA, 64 nt, Human; identical to SEQ ID NO: 388234

SEQ ID NO: 527324 - RNA, 64 nt, Human; identical to SEQ ID NO: 388238

SEQ ID NO: 527325 - RNA, 64 nt, Human; identical to SEQ ID NO: 388239

SEQ ID NO: 527326 - RNA, 64 nt, Human; identical to SEQ ID NO: 388240

SEQ ID NO: 527327 - RNA, 62 nt, Human
uccuuuucuacccuccucuccguccauaccuacaaggccaaggacaaacgccaucuucaucc

SEQ ID NO: 527328 - RNA, 62 nt, Human
ccagcccagcccucgaggcucgaugccugugccaaggccaggggcagccagagggcagcugg

SEQ ID NO: 527329 - RNA, 62 nt, Human
accguggcgucgcgcacagugggucugcuugucaaggccaguucugcagugacaggcccagg

SEQ ID NO: 527330 - RNA, 64 nt, Human; identical to SEQ ID NO: 388241

SEQ ID NO: 527331 - RNA, 64 nt, Human; identical to SEQ ID NO: 388242

SEQ ID NO: 527332 - RNA, 64 nt, Human; identical to SEQ ID NO: 388243

SEQ ID NO: 527333 - RNA, 64 nt, Human; identical to SEQ ID NO: 388244

SEQ ID NO: 527334 - RNA, 64 nt, Human; identical to SEQ ID NO: 388245

SEQ ID NO: 527335 - RNA, 64 nt, Human; identical to SEQ ID NO: 388246

SEQ ID NO: 527336 - RNA, 64 nt, Human; identical to SEQ ID NO: 388247

SEQ ID NO: 527337 - RNA, 64 nt, Human; identical to SEQ ID NO: 388248

SEQ ID NO: 527338 - RNA, 64 nt, Human; identical to SEQ ID NO: 388249

SEQ ID NO: 527339 - RNA, 64 nt, Human; identical to SEQ ID NO: 388250

SEQ ID NO: 527340 - RNA, 64 nt, Human; identical to SEQ ID NO: 388251

SEQ ID NO: 527341 - RNA, 64 nt, Human; identical to SEQ ID NO: 388252

SEQ ID NO: 527342 - RNA, 64 nt, Human; identical to SEQ ID NO: 388256

SEQ ID NO: 527343 - RNA, 64 nt, Human; identical to SEQ ID NO: 388257

SEQ ID NO: 527344 - RNA, 62 nt, Human
caagauaaaagcagccugggucacccaggccacaaggccaugguuaauucuuaaggcaaggc

SEQ ID NO: 527345 - RNA, 62 nt, Human
gguucuagagacuuaaggggaaaagcugcuuucaaggccaccacaugucugugcuccccaac

SEQ ID NO: 527346 - RNA, 62 nt, Human
cucuuccuaaguagauccaggccuguggcagccaaggccaagcaggcccaucucacaacccu

SEQ ID NO: 527347 - RNA, 64 nt, Human; identical to SEQ ID NO: 388258

SEQ ID NO: 527348 - RNA, 64 nt, Human; identical to SEQ ID NO: 388259

SEQ ID NO: 527349 - RNA, 64 nt, Human; identical to SEQ ID NO: 388260

SEQ ID NO: 527350 - RNA, 64 nt, Human; identical to SEQ ID NO: 388261

SEQ ID NO: 527351 - RNA, 64 nt, Human; identical to SEQ ID NO: 388262

SEQ ID NO: 527352 - RNA, 64 nt, Human; identical to SEQ ID NO: 388263

SEQ ID NO: 527353 - RNA, 64 nt, Human; identical to SEQ ID NO: 388264

SEQ ID NO: 527354 - RNA, 64 nt, Human; identical to SEQ ID NO: 388265

SEQ ID NO: 527355 - RNA, 64 nt, Human; identical to SEQ ID NO: 388266

SEQ ID NO: 527356 - RNA, 64 nt, Human; identical to SEQ ID NO: 388267

SEQ ID NO: 527357 - RNA, 64 nt, Human; identical to SEQ ID NO: 388268

SEQ ID NO: 527358 - RNA, 64 nt, Human; identical to SEQ ID NO: 388269

SEQ ID NO: 527359 - RNA, 64 nt, Human; identical to SEQ ID NO: 388270

SEQ ID NO: 527360 - RNA, 64 nt, Human; identical to SEQ ID NO: 388274

SEQ ID NO: 527361 - RNA, 62 nt, Human
cauuguggugcugccccaguaugacaugggaccaaggccagcgcagguuauccaccucugcc

SEQ ID NO: 527362 - RNA, 62 nt, Human
cccuucucccacugggcucccccauccugggccaaggccagaacuuuagugcuaggggaaga

SEQ ID NO: 527363 - RNA, 62 nt, Human
ugcagugacggcagccucggccugggcaggcccaaggccacggucuaggacacaccuucccu

SEQ ID NO: 527364 - RNA, 64 nt, Human; identical to SEQ ID NO: 388275

SEQ ID NO: 527365 - RNA, 64 nt, Human; identical to SEQ ID NO: 388276

SEQ ID NO: 527366 - RNA, 64 nt, Human; identical to SEQ ID NO: 388277

SEQ ID NO: 527367 - RNA, 64 nt, Human; identical to SEQ ID NO: 388278

SEQ ID NO: 527368 - RNA, 64 nt, Human; identical to SEQ ID NO: 388279

SEQ ID NO: 527369 - RNA, 64 nt, Human; identical to SEQ ID NO: 388280

SEQ ID NO: 527370 - RNA, 64 nt, Human; identical to SEQ ID NO: 388281

SEQ ID NO: 527371 - RNA, 64 nt, Human; identical to SEQ ID NO: 388282

SEQ ID NO: 527372 - RNA, 64 nt, Human; identical to SEQ ID NO: 388283

SEQ ID NO: 527373 - RNA, 64 nt, Human; identical to SEQ ID NO: 388284

SEQ ID NO: 527374 - RNA, 64 nt, Human; identical to SEQ ID NO: 388285

SEQ ID NO: 527375 - RNA, 64 nt, Human; identical to SEQ ID NO: 388286

SEQ ID NO: 527376 - RNA, 64 nt, Human; identical to SEQ ID NO: 388287

SEQ ID NO: 527377 - RNA, 64 nt, Human; identical to SEQ ID NO: 388288

SEQ ID NO: 527378 - RNA, 62 nt, Human
ggcugugccccggucuuacccucccaaagggccaaggccagaccuccccagggagggcucga

SEQ ID NO: 527379 - RNA, 62 nt, Human
cuggacuaguccuagaugcaaacucaagagcccaaggccaaggggauguggggaagauggca

SEQ ID NO: 527380 - RNA, 62 nt, Human
cccugagccucacccugaacucccucaucuugcaaggccauaaguguuuuccaagcaaaaug

SEQ ID NO: 527381 - RNA, 64 nt, Human; identical to SEQ ID NO: 388292

SEQ ID NO: 527382 - RNA, 64 nt, Human; identical to SEQ ID NO: 388293

SEQ ID NO: 527383 - RNA, 64 nt, Human; identical to SEQ ID NO: 388294

SEQ ID NO: 527384 - RNA, 64 nt, Human; identical to SEQ ID NO: 388295

SEQ ID NO: 527385 - RNA, 64 nt, Human; identical to SEQ ID NO: 388296

SEQ ID NO: 527386 - RNA, 64 nt, Human; identical to SEQ ID NO: 388297

SEQ ID NO: 527387 - RNA, 64 nt, Human; identical to SEQ ID NO: 388298

SEQ ID NO: 527388 - RNA, 64 nt, Human; identical to SEQ ID NO: 388299

SEQ ID NO: 527389 - RNA, 64 nt, Human; identical to SEQ ID NO: 388300

SEQ ID NO: 527390 - RNA, 64 nt, Human; identical to SEQ ID NO: 388301

SEQ ID NO: 527391 - RNA, 64 nt, Human; identical to SEQ ID NO: 388302

SEQ ID NO: 527392 - RNA, 64 nt, Human; identical to SEQ ID NO: 388303

SEQ ID NO: 527393 - RNA, 64 nt, Human; identical to SEQ ID NO: 388304

SEQ ID NO: 527394 - RNA, 64 nt, Human; identical to SEQ ID NO: 388305

SEQ ID NO: 527395 - RNA, 62 nt, Human
cuucaucgcuucuccuggagugugcggccuaacaaggccauccuuaugcuuugcaaagcacc

SEQ ID NO: 527396 - RNA, 62 nt, Human
accaguccugcccugugaauuacugcuacaaucaaggccacugcuacaucucccagacucug

SEQ ID NO: 527397 - RNA, 62 nt, Human
acccgcugcuccugcugcucccggggauggagcaaggccaaggcugcgggaggcugggagcc

SEQ ID NO: 527398 - RNA, 64 nt, Human; identical to SEQ ID NO: 388306

SEQ ID NO: 527399 - RNA, 64 nt, Human; identical to SEQ ID NO: 388310

SEQ ID NO: 527400 - RNA, 64 nt, Human; identical to SEQ ID NO: 388311

SEQ ID NO: 527401 - RNA, 64 nt, Human; identical to SEQ ID NO: 388312

SEQ ID NO: 527402 - RNA, 64 nt, Human; identical to SEQ ID NO: 388313

SEQ ID NO: 527403 - RNA, 64 nt, Human; identical to SEQ ID NO: 388314

SEQ ID NO: 527404 - RNA, 64 nt, Human; identical to SEQ ID NO: 388315

SEQ ID NO: 527405 - RNA, 64 nt, Human; identical to SEQ ID NO: 388316

SEQ ID NO: 527406 - RNA, 64 nt, Human; identical to SEQ ID NO: 388317

SEQ ID NO: 527407 - RNA, 64 nt, Human; identical to SEQ ID NO: 388318

SEQ ID NO: 527408 - RNA, 64 nt, Human; identical to SEQ ID NO: 388319

SEQ ID NO: 527409 - RNA, 64 nt, Human; identical to SEQ ID NO: 388320

SEQ ID NO: 527410 - RNA, 64 nt, Human; identical to SEQ ID NO: 388321

SEQ ID NO: 527411 - RNA, 64 nt, Human; identical to SEQ ID NO: 388322

SEQ ID NO: 527412 - RNA, 62 nt, Human
cggcagccagcugcuuccaggaaccagguguccaaggccaccucugcagggguuuccucuuc

SEQ ID NO: 527413 - RNA, 62 nt, Human
uggaaccucaucucccugggucgggggguguucaaggccacaggacaaggggagcacccugg

SEQ ID NO: 527414 - RNA, 62 nt, Human
aaugcauaaaugcauaauuuauggucuucaaccaaggccacauaauaacccaguuaacuuac

SEQ ID NO: 527415 - RNA, 64 nt, Human; identical to SEQ ID NO: 388323

SEQ ID NO: 527416 - RNA, 64 nt, Human; identical to SEQ ID NO: 388324

SEQ ID NO: 527417 - RNA, 64 nt, Human; identical to SEQ ID NO: 388328

SEQ ID NO: 527418 - RNA, 64 nt, Human; identical to SEQ ID NO: 388329

SEQ ID NO: 527419 - RNA, 64 nt, Human; identical to SEQ ID NO: 388330

SEQ ID NO: 527420 - RNA, 64 nt, Human; identical to SEQ ID NO: 388331

SEQ ID NO: 527421 - RNA, 64 nt, Human; identical to SEQ ID NO: 388332

SEQ ID NO: 527422 - RNA, 64 nt, Human; identical to SEQ ID NO: 388333

SEQ ID NO: 527423 - RNA, 64 nt, Human; identical to SEQ ID NO: 388334

SEQ ID NO: 527424 - RNA, 64 nt, Human; identical to SEQ ID NO: 388335

SEQ ID NO: 527425 - RNA, 64 nt, Human; identical to SEQ ID NO: 388336

SEQ ID NO: 527426 - RNA, 64 nt, Human; identical to SEQ ID NO: 388337

SEQ ID NO: 527427 - RNA, 64 nt, Human; identical to SEQ ID NO: 388338

SEQ ID NO: 527428 - RNA, 64 nt, Human; identical to SEQ ID NO: 388339

SEQ ID NO: 527429 - RNA, 62 nt, Human
caggcaauuauuuuuaccauaucagcacaugacaaggccaugaacacauggcucuaaaauaa

SEQ ID NO: 527430 - RNA, 62 nt, Human
cacaguaaaauaacagcucuauuauuauucagcaaggccaaagacuuuugagaauguguaug

SEQ ID NO: 527431 - RNA, 62 nt, Human
ucaacagugaaaguagcagggaaagagcugggcaaggccaagaccaucuuuuguaccguugg

SEQ ID NO: 527432 - RNA, 64 nt, Human; identical to SEQ ID NO: 388340

SEQ ID NO: 527433 - RNA, 64 nt, Human; identical to SEQ ID NO: 388341

SEQ ID NO: 527434 - RNA, 64 nt, Human; identical to SEQ ID NO: 388342

SEQ ID NO: 527435 - RNA, 64 nt, Human; identical to SEQ ID NO: 388345

SEQ ID NO: 527436 - RNA, 64 nt, Human; identical to SEQ ID NO: 388346

SEQ ID NO: 527437 - RNA, 64 nt, Human; identical to SEQ ID NO: 388347

SEQ ID NO: 527438 - RNA, 64 nt, Human; identical to SEQ ID NO: 388348

SEQ ID NO: 527439 - RNA, 64 nt, Human; identical to SEQ ID NO: 388349

SEQ ID NO: 527440 - RNA, 64 nt, Human; identical to SEQ ID NO: 388350

SEQ ID NO: 527441 - RNA, 64 nt, Human; identical to SEQ ID NO: 388351

SEQ ID NO: 527442 - RNA, 64 nt, Human; identical to SEQ ID NO: 388352

SEQ ID NO: 527443 - RNA, 64 nt, Human; identical to SEQ ID NO: 388353

SEQ ID NO: 527444 - RNA, 64 nt, Human; identical to SEQ ID NO: 388354

SEQ ID NO: 527445 - RNA, 64 nt, Human; identical to SEQ ID NO: 388355

SEQ ID NO: 527446 - RNA, 62 nt, Human
aaugagguaaaggcuuucuggguauuugcugccaaggccacaucaccaauuuucucgauuua

SEQ ID NO: 527447 - RNA, 62 nt, Human
ccugccguccugcgccugcuggggccuccaggcaaggccaagugggguuggggguggggcug

SEQ ID NO: 527448 - RNA, 62 nt, Human
aucuaaguggaacuaauugcccgagggcucagcaaggccaagaggagacagccgugacggua

SEQ ID NO: 527449 - RNA, 64 nt, Human; identical to SEQ ID NO: 388356

SEQ ID NO: 527450 - RNA, 64 nt, Human; identical to SEQ ID NO: 388357

SEQ ID NO: 527451 - RNA, 64 nt, Human; identical to SEQ ID NO: 388358

SEQ ID NO: 527452 - RNA, 64 nt, Human; identical to SEQ ID NO: 388359

SEQ ID NO: 527453 - RNA, 64 nt, Human; identical to SEQ ID NO: 388363

SEQ ID NO: 527454 - RNA, 64 nt, Human; identical to SEQ ID NO: 388364

SEQ ID NO: 527455 - RNA, 64 nt, Human; identical to SEQ ID NO: 388365

SEQ ID NO: 527456 - RNA, 64 nt, Human; identical to SEQ ID NO: 388366

SEQ ID NO: 527457 - RNA, 64 nt, Human; identical to SEQ ID NO: 388367

SEQ ID NO: 527458 - RNA, 64 nt, Human; identical to SEQ ID NO: 388368

SEQ ID NO: 527459 - RNA, 64 nt, Human; identical to SEQ ID NO: 388369

SEQ ID NO: 527460 - RNA, 64 nt, Human; identical to SEQ ID NO: 388370

SEQ ID NO: 527461 - RNA, 64 nt, Human; identical to SEQ ID NO: 388371

SEQ ID NO: 527462 - RNA, 64 nt, Human; identical to SEQ ID NO: 388372

SEQ ID NO: 527463 - RNA, 62 nt, Human
cuccguccucaugcuccucaguguccacacuucaaggccaaggauaguuucuuccucugaca

SEQ ID NO: 527464 - RNA, 62 nt, Human
aaaguuucacgucuucgccaaucacagugcagcaaggccaauucucgcagaaacccccacgu

SEQ ID NO: 527465 - RNA, 62 nt, Human
agcucuuccaccguccugccccacgaaggauccaaggccaguuaaccaggcaagacacaagc

SEQ ID NO: 527466 - RNA, 64 nt, Human; identical to SEQ ID NO: 388373

SEQ ID NO: 527467 - RNA, 64 nt, Human; identical to SEQ ID NO: 388374

SEQ ID NO: 527468 - RNA, 64 nt, Human; identical to SEQ ID NO: 388375

SEQ ID NO: 527469 - RNA, 63 nt, Human; identical to SEQ ID NO: 388376

SEQ ID NO: 527470 - RNA, 64 nt, Human; identical to SEQ ID NO: 388377

SEQ ID NO: 527471 - RNA, 64 nt, Human; identical to SEQ ID NO: 388381

SEQ ID NO: 527472 - RNA, 64 nt, Human; identical to SEQ ID NO: 388382

SEQ ID NO: 527473 - RNA, 64 nt, Human; identical to SEQ ID NO: 388383

SEQ ID NO: 527474 - RNA, 64 nt, Human; identical to SEQ ID NO: 388384

SEQ ID NO: 527475 - RNA, 64 nt, Human; identical to SEQ ID NO: 388385

SEQ ID NO: 527476 - RNA, 64 nt, Human; identical to SEQ ID NO: 388386

SEQ ID NO: 527477 - RNA, 64 nt, Human; identical to SEQ ID NO: 388387

SEQ ID NO: 527478 - RNA, 64 nt, Human; identical to SEQ ID NO: 388388

SEQ ID NO: 527479 - RNA, 64 nt, Human; identical to SEQ ID NO: 388389

SEQ ID NO: 527480 - RNA, 62 nt, Human
cauagggugcucugaggucaauaaagcagagccaaggccacccaguugccuuuuugccuuug

SEQ ID NO: 527481 - RNA, 62 nt, Human
cuugugacuuccaucccugcugaauggggcugcaaggccaaggcuccuuaggggagaggucc

SEQ ID NO: 527482 - RNA, 62 nt, Human
uguggguuucuaaagcugccagccgagauagccaaggccaaaggaagcacaugccucucuca

SEQ ID NO: 527483 - RNA, 64 nt, Human; identical to SEQ ID NO: 388390

SEQ ID NO: 527484 - RNA, 64 nt, Human; identical to SEQ ID NO: 388391

SEQ ID NO: 527485 - RNA, 64 nt, Human; identical to SEQ ID NO: 388392

SEQ ID NO: 527486 - RNA, 64 nt, Human; identical to SEQ ID NO: 388393

SEQ ID NO: 527487 - RNA, 64 nt, Human; identical to SEQ ID NO: 388394

SEQ ID NO: 527488 - RNA, 64 nt, Human; identical to SEQ ID NO: 388395

SEQ ID NO: 527489 - RNA, 64 nt, Human; identical to SEQ ID NO: 388399

SEQ ID NO: 527490 - RNA, 64 nt, Human; identical to SEQ ID NO: 388400

SEQ ID NO: 527491 - RNA, 64 nt, Human; identical to SEQ ID NO: 388401

SEQ ID NO: 527492 - RNA, 64 nt, Human; identical to SEQ ID NO: 388402

SEQ ID NO: 527493 - RNA, 64 nt, Human; identical to SEQ ID NO: 388403

SEQ ID NO: 527494 - RNA, 64 nt, Human; identical to SEQ ID NO: 388404

SEQ ID NO: 527495 - RNA, 64 nt, Human; identical to SEQ ID NO: 388405

SEQ ID NO: 527496 - RNA, 64 nt, Human; identical to SEQ ID NO: 388406

SEQ ID NO: 527497 - RNA, 62 nt, Human
ggucccaagcucuacugggcccuuggagguagcaaggccacuggguugcuauccucuugcug

SEQ ID NO: 527498 - RNA, 62 nt, Human
aggaauguaaggaaaccagcccagaucagucccaaggccagaguccuuuguccuacaucucc

SEQ ID NO: 527499 - RNA, 62 nt, Human
cagcccagauugucuuaauuucuaucuuguuccaaggccagggacaguaauaagaauggaaa

SEQ ID NO: 527500 - RNA, 57 nt, Human; identical to SEQ ID NO: 388407

SEQ ID NO: 527501 - RNA, 64 nt, Human; identical to SEQ ID NO: 388408

SEQ ID NO: 527502 - RNA, 64 nt, Human; identical to SEQ ID NO: 388409

SEQ ID NO: 527503 - RNA, 64 nt, Human; identical to SEQ ID NO: 388410

SEQ ID NO: 527504 - RNA, 64 nt, Human; identical to SEQ ID NO: 388411

SEQ ID NO: 527505 - RNA, 64 nt, Human; identical to SEQ ID NO: 388412

SEQ ID NO: 527506 - RNA, 64 nt, Human; identical to SEQ ID NO: 388413

SEQ ID NO: 527507 - RNA, 64 nt, Human; identical to SEQ ID NO: 388417

SEQ ID NO: 527508 - RNA, 64 nt, Human; identical to SEQ ID NO: 388418

SEQ ID NO: 527509 - RNA, 64 nt, Human; identical to SEQ ID NO: 388419

SEQ ID NO: 527510 - RNA, 64 nt, Human; identical to SEQ ID NO: 388420

SEQ ID NO: 527511 - RNA, 64 nt, Human; identical to SEQ ID NO: 388421

SEQ ID NO: 527512 - RNA, 55 nt, Human; identical to SEQ ID NO: 388422

SEQ ID NO: 527513 - RNA, 64 nt, Human; identical to SEQ ID NO: 388423

SEQ ID NO: 527514 - RNA, 62 nt, Human
cacaccucuaagcugcuggccgaagaugucaccaaggccaaagacacaguauuaugaagguu

SEQ ID NO: 527515 - RNA, 62 nt, Human
cuugauuucuaagacaccugugaagggucccacaaggccaggcacaguggcucuugucugua

SEQ ID NO: 527516 - RNA, 62 nt, Human
caaggcaggaggaccgcuugaguccagggauucaaggccaaccugggcaauagagcgagacc

SEQ ID NO: 527517 - RNA, 64 nt, Human; identical to SEQ ID NO: 388424

SEQ ID NO: 527518 - RNA, 64 nt, Human; identical to SEQ ID NO: 388425

SEQ ID NO: 527519 - RNA, 64 nt, Human; identical to SEQ ID NO: 388426

SEQ ID NO: 527520 - RNA, 64 nt, Human; identical to SEQ ID NO: 388427

SEQ ID NO: 527521 - RNA, 64 nt, Human; identical to SEQ ID NO: 388428

SEQ ID NO: 527522 - RNA, 64 nt, Human; identical to SEQ ID NO: 388429

SEQ ID NO: 527523 - RNA, 64 nt, Human; identical to SEQ ID NO: 388430

SEQ ID NO: 527524 - RNA, 64 nt, Human; identical to SEQ ID NO: 388431

SEQ ID NO: 527525 - RNA, 64 nt, Human; identical to SEQ ID NO: 388435

SEQ ID NO: 527526 - RNA, 64 nt, Human; identical to SEQ ID NO: 388436

SEQ ID NO: 527527 - RNA, 64 nt, Human; identical to SEQ ID NO: 388437

SEQ ID NO: 527528 - RNA, 64 nt, Human; identical to SEQ ID NO: 388438

SEQ ID NO: 527529 - RNA, 64 nt, Human; identical to SEQ ID NO: 388439

SEQ ID NO: 527530 - RNA, 64 nt, Human; identical to SEQ ID NO: 388440

SEQ ID NO: 527531 - RNA, 62 nt, Human
aauugcuaagaguaaauacuacuuuagccauccaaggccaccuucugcagcaaaaggcuuuu

SEQ ID NO: 527532 - RNA, 62 nt, Human
cuucugggcucugacucuccuggaaaucucuccaaggccagagcuaugcuuuaggucucaau

SEQ ID NO: 527533 - RNA, 62 nt, Human
cuagcuguccuuuuuccucuccacacagugcucaaggccagcuuauagucauauauaucacc

SEQ ID NO: 527534 - RNA, 64 nt, Human; identical to SEQ ID NO: 388441

SEQ ID NO: 527535 - RNA, 64 nt, Human; identical to SEQ ID NO: 388442

SEQ ID NO: 527536 - RNA, 64 nt, Human; identical to SEQ ID NO: 388443

SEQ ID NO: 527537 - RNA, 64 nt, Human; identical to SEQ ID NO: 388444

SEQ ID NO: 527538 - RNA, 64 nt, Human; identical to SEQ ID NO: 388445

SEQ ID NO: 527539 - RNA, 64 nt, Human; identical to SEQ ID NO: 388446

SEQ ID NO: 527540 - RNA, 64 nt, Human; identical to SEQ ID NO: 388447

SEQ ID NO: 527541 - RNA, 64 nt, Human; identical to SEQ ID NO: 388448

SEQ ID NO: 527542 - RNA, 64 nt, Human; identical to SEQ ID NO: 388449

SEQ ID NO: 527543 - RNA, 64 nt, Human; identical to SEQ ID NO: 388453

SEQ ID NO: 527544 - RNA, 64 nt, Human; identical to SEQ ID NO: 388454

SEQ ID NO: 527545 - RNA, 64 nt, Human; identical to SEQ ID NO: 388455

SEQ ID NO: 527546 - RNA, 64 nt, Human; identical to SEQ ID NO: 388456

SEQ ID NO: 527547 - RNA, 64 nt, Human; identical to SEQ ID NO: 388457

SEQ ID NO: 527548 - RNA, 62 nt, Human
cuucccauccuaacagaaguaacccagcaagucaaggccaggaggaccaggggugcagacag

SEQ ID NO: 527549 - RNA, 62 nt, Human
ugagaugagcucuuuuaacucaagcgaaacuucaaggccagaagaucuugccuguuggugau

SEQ ID NO: 527550 - RNA, 62 nt, Human
uccugugugucuguccagccuugcagucaugucaaggccagcaagcugaugugacucuugcc

SEQ ID NO: 527551 - RNA, 64 nt, Human; identical to SEQ ID NO: 388458

SEQ ID NO: 527552 - RNA, 64 nt, Human; identical to SEQ ID NO: 388459

SEQ ID NO: 527553 - RNA, 64 nt, Human; identical to SEQ ID NO: 388460

SEQ ID NO: 527554 - RNA, 64 nt, Human; identical to SEQ ID NO: 388461

SEQ ID NO: 527555 - RNA, 64 nt, Human; identical to SEQ ID NO: 388462

SEQ ID NO: 527556 - RNA, 64 nt, Human; identical to SEQ ID NO: 388463

SEQ ID NO: 527557 - RNA, 64 nt, Human; identical to SEQ ID NO: 388464

SEQ ID NO: 527558 - RNA, 57 nt, Human; identical to SEQ ID NO: 388465

SEQ ID NO: 527559 - RNA, 64 nt, Human; identical to SEQ ID NO: 388466

SEQ ID NO: 527560 - RNA, 64 nt, Human; identical to SEQ ID NO: 388467

SEQ ID NO: 527561 - RNA, 64 nt, Human; identical to SEQ ID NO: 388471

SEQ ID NO: 527562 - RNA, 64 nt, Human; identical to SEQ ID NO: 388472

SEQ ID NO: 527563 - RNA, 64 nt, Human; identical to SEQ ID NO: 388473

SEQ ID NO: 527564 - RNA, 64 nt, Human; identical to SEQ ID NO: 388474

SEQ ID NO: 527565 - RNA, 62 nt, Human
uguuuuuuuaucuugcccaaagagcucccucucaaggccaacuauaggcuccucuugcccug

SEQ ID NO: 527566 - RNA, 62 nt, Human
ucuauuccaguauauccagaguggugaaauaacaaggccagccacguagccaaaggucgcuc

SEQ ID NO: 527567 - RNA, 62 nt, Human
gucuuucaggagugacuggcugcaggcaagaccaaggccaccacugugggcccuccuuccag

SEQ ID NO: 527568 - RNA, 64 nt, Human; identical to SEQ ID NO: 388475

SEQ ID NO: 527569 - RNA, 64 nt, Human; identical to SEQ ID NO: 388476

SEQ ID NO: 527570 - RNA, 64 nt, Human; identical to SEQ ID NO: 388477

SEQ ID NO: 527571 - RNA, 64 nt, Human; identical to SEQ ID NO: 388478

SEQ ID NO: 527572 - RNA, 64 nt, Human; identical to SEQ ID NO: 388479

SEQ ID NO: 527573 - RNA, 64 nt, Human; identical to SEQ ID NO: 388480

SEQ ID NO: 527574 - RNA, 64 nt, Human; identical to SEQ ID NO: 388481

SEQ ID NO: 527575 - RNA, 64 nt, Human; identical to SEQ ID NO: 388482

SEQ ID NO: 527576 - RNA, 64 nt, Human; identical to SEQ ID NO: 388483

SEQ ID NO: 527577 - RNA, 64 nt, Human; identical to SEQ ID NO: 388484

SEQ ID NO: 527578 - RNA, 64 nt, Human; identical to SEQ ID NO: 388485

SEQ ID NO: 527579 - RNA, 64 nt, Human; identical to SEQ ID NO: 388489

SEQ ID NO: 527580 - RNA, 64 nt, Human; identical to SEQ ID NO: 388490

SEQ ID NO: 527581 - RNA, 64 nt, Human; identical to SEQ ID NO: 388491

SEQ ID NO: 527582 - RNA, 62 nt, Human; identical to SEQ ID NO: 524645

SEQ ID NO: 527583 - RNA, 62 nt, Human
uuucccuuuauaugaagacgacgaaggaagagcaaggccaucugaguaugaccuacucuggg

SEQ ID NO: 527584 - RNA, 62 nt, Human
gaggagugugggcuggcagagagcuucgagggcaaggccacccgcgggggcguguguguggu

SEQ ID NO: 527585 - RNA, 64 nt, Human; identical to SEQ ID NO: 388492

SEQ ID NO: 527586 - RNA, 64 nt, Human; identical to SEQ ID NO: 388493

SEQ ID NO: 527587 - RNA, 64 nt, Human; identical to SEQ ID NO: 388494

SEQ ID NO: 527588 - RNA, 64 nt, Human; identical to SEQ ID NO: 388495

SEQ ID NO: 527589 - RNA, 64 nt, Human; identical to SEQ ID NO: 388496

SEQ ID NO: 527590 - RNA, 64 nt, Human; identical to SEQ ID NO: 388497

SEQ ID NO: 527591 - RNA, 64 nt, Human; identical to SEQ ID NO: 388498

SEQ ID NO: 527592 - RNA, 64 nt, Human; identical to SEQ ID NO: 388499

SEQ ID NO: 527593 - RNA, 64 nt, Human; identical to SEQ ID NO: 388500

SEQ ID NO: 527594 - RNA, 64 nt, Human; identical to SEQ ID NO: 388501

SEQ ID NO: 527595 - RNA, 64 nt, Human; identical to SEQ ID NO: 388502

SEQ ID NO: 527596 - RNA, 64 nt, Human; identical to SEQ ID NO: 388503

SEQ ID NO: 527597 - RNA, 64 nt, Human; identical to SEQ ID NO: 388505

SEQ ID NO: 527598 - RNA, 64 nt, Human; identical to SEQ ID NO: 388506

SEQ ID NO: 527599 - RNA, 62 nt, Human
cagggacaagggcaagaggacugaggccagagcaaggccaaugucagagacccccgggaugg

SEQ ID NO: 527600 - RNA, 62 nt, Human
cuagugauguagaaagauacacugacuuggugcaaggccaucugcuuaccacaucacaccac

SEQ ID NO: 527601 - RNA, 62 nt, Human
cuugggcagagcuggcucugagcgccuccauccaaggccagguucuccguuagcuccugugg

SEQ ID NO: 527602 - RNA, 64 nt, Human; identical to SEQ ID NO: 388507

SEQ ID NO: 527603 - RNA, 64 nt, Human; identical to SEQ ID NO: 388508

SEQ ID NO: 527604 - RNA, 64 nt, Human; identical to SEQ ID NO: 388509

SEQ ID NO: 527605 - RNA, 59 nt, Human; identical to SEQ ID NO: 388510

SEQ ID NO: 527606 - RNA, 64 nt, Human; identical to SEQ ID NO: 388511

SEQ ID NO: 527607 - RNA, 64 nt, Human; identical to SEQ ID NO: 388512

SEQ ID NO: 527608 - RNA, 64 nt, Human; identical to SEQ ID NO: 388513

SEQ ID NO: 527609 - RNA, 64 nt, Human; identical to SEQ ID NO: 388514

SEQ ID NO: 527610 - RNA, 64 nt, Human; identical to SEQ ID NO: 388515

SEQ ID NO: 527611 - RNA, 64 nt, Human; identical to SEQ ID NO: 388516

SEQ ID NO: 527612 - RNA, 64 nt, Human; identical to SEQ ID NO: 388517

SEQ ID NO: 527613 - RNA, 64 nt, Human; identical to SEQ ID NO: 388518

SEQ ID NO: 527614 - RNA, 64 nt, Human; identical to SEQ ID NO: 388519

SEQ ID NO: 527615 - RNA, 64 nt, Human; identical to SEQ ID NO: 388523

SEQ ID NO: 527616 - RNA, 62 nt, Human
uuucacuuuucacuucuggcuuuuuuguggcccaaggccaauauaggauuaauaucuguguu

SEQ ID NO: 527617 - RNA, 62 nt, Human
gguaagggcugccgcgcucuggccuggagggacaaggccagcacacggugccucaaccaacu

SEQ ID NO: 527618 - RNA, 62 nt, Human
accaaauuccucauuuauacuuggggaaaaaacaaggccauauguaaaaacccuuccaaugc

SEQ ID NO: 527619 - RNA, 64 nt, Human; identical to SEQ ID NO: 388524

SEQ ID NO: 527620 - RNA, 64 nt, Human; identical to SEQ ID NO: 388525

SEQ ID NO: 527621 - RNA, 64 nt, Human; identical to SEQ ID NO: 388526

SEQ ID NO: 527622 - RNA, 64 nt, Human; identical to SEQ ID NO: 388527

SEQ ID NO: 527623 - RNA, 64 nt, Human; identical to SEQ ID NO: 388528

SEQ ID NO: 527624 - RNA, 58 nt, Human; identical to SEQ ID NO: 388529

SEQ ID NO: 527625 - RNA, 64 nt, Human; identical to SEQ ID NO: 388530

SEQ ID NO: 527626 - RNA, 64 nt, Human; identical to SEQ ID NO: 388531

SEQ ID NO: 527627 - RNA, 64 nt, Human; identical to SEQ ID NO: 388532

SEQ ID NO: 527628 - RNA, 64 nt, Human; identical to SEQ ID NO: 388533

SEQ ID NO: 527629 - RNA, 64 nt, Human; identical to SEQ ID NO: 388534

SEQ ID NO: 527630 - RNA, 62 nt, Human
cuguggagugaucccauggcucaagagggcugcaaggccaacacuauucgaggaggaggcug

SEQ ID NO: 527631 - RNA, 62 nt, Human
guggggguucccagcauugugggugcuacuugcaaggccauagaaucuagauggcccugucu

SEQ ID NO: 527632 - RNA, 62 nt, Human
aagggcaguggaggugcugcauugccugcggucaaggccagcaagguggaguggaugccuca

SEQ ID NO: 527633 - RNA, 62 nt, Human
agagacugcccagcuggagaggccuuccuuuacaaggccacgcgugcagcugucccauccag

SEQ ID NO: 527634 - RNA, 62 nt, Human
caaggcccaaagauuuccaagguucccaaagucaaggccaggccaaggccugguuggguccu

SEQ ID NO: 527635 - RNA, 62 nt, Human
cguuccgccgcccacccucugcuagacacagccaaggccaacgaggcaagcagaagcagcgg

SEQ ID NO: 527636 - RNA, 62 nt, Human
agcucuccccugcccugcagcccugggccagacaaggccagaagguuucaggggcauuugac

SEQ ID NO: 527637 - RNA, 62 nt, Human
cuccccucagagggcacagcugcaggccugaccaaggccacgcccggcucucgugcucuagg

SEQ ID NO: 527638 - RNA, 62 nt, Human
gaggaggggaagaaggaaagggaagagucuuccaaggccagaaggagggggacaacccccca

SEQ ID NO: 527639 - RNA, 62 nt, Human
augcugcugagugaaugaguaaauaaacucuucaaggccaagggacaguggucuaauucaac

SEQ ID NO: 527640 - RNA, 62 nt, Human
ccaggugaccggcgacugagggccugagcuggcaaggccaaggacacccaacacaauuuuug

SEQ ID NO: 527641 - RNA, 62 nt, Human
ugcaagaggccaaggcuggagaggcgugccagcaaggccagggauggccggagggcugcggg

SEQ ID NO: 527642 - RNA, 62 nt, Human
agaugccuacuuuuggccucaucucugccugacaaggccagcacccaaaggguuaauauuua

SEQ ID NO: 527643 - RNA, 62 nt, Human
aaggucagcccacacucugguccaugaggcagcaaggccagugcugugccaagcccgguaag

SEQ ID NO: 527644 - RNA, 62 nt, Human
caacaaaugauacaaauggugccagggaguggcaaggccauggggguaggugggggugucuu

SEQ ID NO: 527645 - RNA, 62 nt, Human
gaacccugaccccacaggcucucaagucuucccaaggccagaaucgaaagaaaauuaaaauu

SEQ ID NO: 527646 - RNA, 62 nt, Human
ugacugagccuaaaguugagaaaauggguggccaaggccagugccagugucuuggggccccu

SEQ ID NO: 527647 - RNA, 62 nt, Human
caggaagugaacaauggcggcggugugggagacaaggccaggagagcccgcguucaguaugg

SEQ ID NO: 527648 - RNA, 62 nt, Human
uuguccccgcuggcucacgcguucugggagcucaaggccaccuuggaggaggaugccacgca

SEQ ID NO: 527649 - RNA, 62 nt, Human
cacaggauaguguacccacagauggguguuaucaaggccagucaugaggaugguguccugga

SEQ ID NO: 527650 - RNA, 62 nt, Human
ggugcuugcuaaggaacagaaugacccagagucaaggccaagucugcagggaccuguugaaa

SEQ ID NO: 527651 - RNA, 62 nt, Human
caugcaacaggugaagguuuauacguuauacacaaggccagguaagcgcucauaauucacac

SEQ ID NO: 527652 - RNA, 62 nt, Human
caccuucaaauauauuaaguuguauaaacuaucaaggccacaaaauacuaaugucauuuggu

SEQ ID NO: 527653 - RNA, 62 nt, Human
ggccccacccuccuggcagcagaugccuggggcaaggccaggggaaacugggggggccucag

SEQ ID NO: 527654 - RNA, 62 nt, Human
gaaauuggaagagcacaagaggagauccagggcaaggccauugggauauucugaaacuugaa

SEQ ID NO: 527655 - RNA, 54 nt, Human
gcucccuugauggaacuuagacagcaaggccagaugcacaucccuggaaggaca

SEQ ID NO: 527656 - RNA, 62 nt, Human
cggaggccucugcugucaauggauuccaggagcaaggccauuugucgcgcuuuccaaauuuc

SEQ ID NO: 527657 - RNA, 62 nt, Human
gucggaggcugcugggggcaagagcagcugcacaaggccagggcaagugcuagggccccucc

SEQ ID NO: 527658 - RNA, 62 nt, Human
gaguucauuuaacucaaaacggaaacacugagcaaggccaucaggacucagcuuuuauaaaa

SEQ ID NO: 527659 - RNA, 62 nt, Human
uuuuucugacacagcgaaucgagggcuuuggccaaggccaggucucucaaacuuguccgcca

SEQ ID NO: 527660 - RNA, 62 nt, Human
cagcuggcgaggaguugguugaggcacuucuucaaggccaagggggaacacaguguuuuguu

SEQ ID NO: 527661 - RNA, 62 nt, Human
acuagcauaaggagacuuaacaggaacccagucaaggccauucauggccaugggaccacgca

SEQ ID NO: 527662 - RNA, 62 nt, Human
ggccuuucacguauuccgucugcacaggcaaccaaggccaguagaaagcuauggcugcaaaa

SEQ ID NO: 527663 - RNA, 62 nt, Human
gucgguuuaccacuggacgggugcugcaucggcaaggccaaguugaacaccggauggugcca

SEQ ID NO: 527664 - RNA, 62 nt, Human
aggcugagccacugggcugugggggaaggggucaaggccauaucccaauacguguagggcga

SEQ ID NO: 527665 - RNA, 62 nt, Human
ccggccggagggcaggacccucaccucucccccaaggccacugcgcucuugggaccccagag

SEQ ID NO: 527666 - RNA, 62 nt, Human
caccaucccucccgucccauccccagcaugggcaaggccagccuuucuggcagaaggagcug

SEQ ID NO: 527667 - RNA, 62 nt, Human
cugugcccagggccgacaggcgcgacacccagcaaggccaccucuccccgggcccccgcgcc

SEQ ID NO: 527668 - RNA, 62 nt, Human
gcaccccaccaugucaaacccaagaccagccccaaggccagaccaaggcauguaggccuggg

SEQ ID NO: 527669 - RNA, 62 nt, Human
agccuggagaagggcuaacaucagcucauugucaaggccacccccaccccagaacagaaccg

SEQ ID NO: 527670 - RNA, 62 nt, Human
gacugagguucagagaggauaagaggcgugaccaaggccacagagcuaugggugucagcacc

SEQ ID NO: 527671 - RNA, 62 nt, Human
agcacuggggcuggaaugaucuuuaaugggcccaaggccaacaggcauaugccucacuacug

SEQ ID NO: 527672 - RNA, 62 nt, Human
cggcucacccuggacacugugaugcgcaugggcaaggccagcgcccggggcuucugaaccga

SEQ ID NO: 527673 - RNA, 62 nt, Human
acagaauuuaaaccaacaaagaucaaaagagacaaggccauuauauaaugguaaauggauca

SEQ ID NO: 527674 - RNA, 62 nt, Human
cucugggagccucacaccugagaccagcaggacaaggccauugggggcuguggggccgauga

SEQ ID NO: 527675 - RNA, 62 nt, Human
caggaccuucagacaucuguaucuccuguggccaaggccacugucagaggaaauaaucuaaa

SEQ ID NO: 527676 - RNA, 62 nt, Human
ggaaauucucuugcccaggcuuuuugcuccuucaaggccagagaguucacaccagaucaagg

SEQ ID NO: 527677 - RNA, 62 nt, Human
gucucucaugagguugcaguuaagacaucagccaaggccacuucgucugaggaaggcucaac

SEQ ID NO: 527678 - RNA, 62 nt, Human
ccugggccccaugguagaugcaagggaaaccucaaggccagcucaaugccugguaucugccc

SEQ ID NO: 527679 - RNA, 62 nt, Human
uuucucgcugaaaccauguuucucagacaggccaaggccaccugacuccuaucacgacgcac

SEQ ID NO: 527680 - RNA, 62 nt, Human
ggaguuuucccgcaguucaguuccugacugugcaaggccaacagggcaggggaggggaagac

SEQ ID NO: 527681 - RNA, 62 nt, Human
cacccccgccucacacacgcacuccuucuccucaaggccagggcagagggccucaccgccuc

SEQ ID NO: 527682 - RNA, 62 nt, Human
acguaaccuaugucagacacuacaugaugacucaaggccaauaauaaagacauuuccuaccu

SEQ ID NO: 527683 - RNA, 62 nt, Human
ugacaggcagcuggggggacaugauccauggacaaggccaucccggccgugggagaccccag

SEQ ID NO: 527684 - RNA, 62 nt, Human
uaccgacagaagcuggaggaguuccggaaagccaaggccagcuccacaggcagcuucacagc

SEQ ID NO: 527685 - RNA, 62 nt, Human
cauuagaaacccuaugaauauugugaauauggcaaggccaucugaaggaauuaacaccucau

SEQ ID NO: 527686 - RNA, 62 nt, Human
auccggguguggaaaucucacugggucucucucaaggccacucggcuacucaggacagggcu

SEQ ID NO: 527687 - RNA, 62 nt, Human
ccuguguguuuccacgucaacugccugcucugcaaggccauccaugagcagaugaacugcaa

SEQ ID NO: 527688 - RNA, 62 nt, Human
auaaacuggggcagaggaaaagaaugaugguucaaggccauacuucccuugaaccuugugug

SEQ ID NO: 527689 - RNA, 62 nt, Human
cugcugcccaccuugggacucaggagcucagucaaggccacaggcuggaggagagacggggc

SEQ ID NO: 527690 - RNA, 62 nt, Human
guaggcgcccugcagccucccugcucccagcccaaggccagucggccugggaaguucacugc

SEQ ID NO: 527691 - RNA, 62 nt, Human
acuggccccuuaauucccacaggcccccccagcaaggccaaagggaggccccuggguauugu

SEQ ID NO: 527692 - RNA, 62 nt, Human
uggauguagugcuuuuuagaggagccacugggcaaggccaccaagaacaaaugcaugacauu

SEQ ID NO: 527693 - RNA, 62 nt, Human
cacaugucucucagaccccuggauucagaacccaaggccacaaaucauaggcaugaagcacu

SEQ ID NO: 527694 - RNA, 62 nt, Human
gggguuuccuggguauaacccauugggcugcccaaggccagccagccugagcucuccugcaa

SEQ ID NO: 527695 - RNA, 62 nt, Human
ggagacaguugagagcggggaugugacaugcccaaggccacggagcaguucagaguggaggc

SEQ ID NO: 527696 - RNA, 62 nt, Human
guuccacuuccaggucugccugguucccuccccaaggccacagggagcuccgucagcuucuc

SEQ ID NO: 527697 - RNA, 62 nt, Human
guuuagaaguagacguugccaaugcugugacucaaggccacggcucuacuaaaagagagaga

SEQ ID NO: 527698 - RNA, 51 nt, Human
gacggcaacaaaacuucugagcaaggccaggcugugagggccccagcucca

SEQ ID NO: 527699 - RNA, 62 nt, Human
uuuggcauuccuugggagccucaguuguuguucaaggccaaaguuaucuccgugcugcaagg

SEQ ID NO: 527700 - RNA, 62 nt, Human
uaaugcuuuuuaaaaauaaacuucugaaaacccaaggccagguacugcauucugaaucagaa

SEQ ID NO: 527701 - RNA, 62 nt, Human
ggggaagugggcugcggucacugucggccuugcaaggccaccuggaggccugucuguuagcc

SEQ ID NO: 527702 - RNA, 62 nt, Human
ccaugccuguccagccugggcagccaggcugccaaggccagaguggccuggccaggagcucu

SEQ ID NO: 527703 - RNA, 62 nt, Human
aagggcggcgaggcauagucccgagaagucaccaaggccaucuggagacuccuggcuuucug

SEQ ID NO: 527704 - RNA, 62 nt, Human
cccgaccgcgcccuccagggucgucccuggcccaaggccaggggccacaaguuaguuggaag

SEQ ID NO: 527705 - RNA, 62 nt, Human
uccaaggcccggaguacuggggauugauguuucaaggccaaucaaugggaugcuucguuuuc

SEQ ID NO: 527706 - RNA, 62 nt, Human
ugaggcaaugggagcugaggccacacucagcacaaggccaucugggcuccuccagggugugu

SEQ ID NO: 527707 - RNA, 62 nt, Human
uuuuuuguggagaugggguuucaccauguugccaaggccagucugaaauccugggcucaagu

SEQ ID NO: 527708 - RNA, 62 nt, Human
cuguucacggaggugcgguguggaugcaccuacaaggccaacucucugaucagggugaggga

SEQ ID NO: 527709 - RNA, 62 nt, Human
uuuguugggggucugaugguuaaaaucaugggcaaggccauucucuacaucauugcuuaaua

SEQ ID NO: 527710 - RNA, 62 nt, Human
acacuuggaggcugcugucaccacugugcguccaaggccaugcucucugcgggucagugccu

SEQ ID NO: 527711 - RNA, 62 nt, Human
gccgcagaggcugagcaggaaaugcagcgcaucaaggccacagcgauucgcacggaggagga

SEQ ID NO: 527712 - RNA, 62 nt, Human
ccuucuggcccucccaccagaggcccagcuaccaaggccacauuguccaccaccccagccua

SEQ ID NO: 527713 - RNA, 62 nt, Human
ugaguacagacuggucaaaauguuuaugcagucaaggccaaagccugcccugagcccagaca

SEQ ID NO: 527714 - RNA, 62 nt, Human
uuuguuagaacucugcccuuuugucugaaacucaaggccaaggagaaugauaggagacuuag

SEQ ID NO: 527715 - RNA, 62 nt, Human
cugugcaagcuggccaggagguagguggagggcaaggccaccagaccuggcuucgcgcuguc

SEQ ID NO: 527716 - RNA, 62 nt, Human
acacugggacucugaguuccugagccccacaacaaggccagggaugguggggacaggccuca

SEQ ID NO: 527717 - RNA, 62 nt, Human; identical to SEQ ID NO: 527716

SEQ ID NO: 527718 - RNA, 62 nt, Human
ggucagggugaugggccgcacagcgaggcagucaaggccagcucccugggagaagcacuggg

SEQ ID NO: 527719 - RNA, 62 nt, Human
auauuuuaagggugcaggaggacagcagcuaacaaggccaggaaauacucacuucccuccac

SEQ ID NO: 527720 - RNA, 62 nt, Human
uccuuggaccuagaggauuguccaccuucugccaaggccagcccacacagcccgagccccuu

SEQ ID NO: 527721 - RNA, 62 nt, Human
ggccuucauuuaucuucuaaaauuccucaucucaaggccaccaguccccaguuaucacccuu

SEQ ID NO: 527722 - RNA, 62 nt, Human
ggaagcugaagcccggggaggggagcgacccucaaggccacccagcuggacacgggagacuu

SEQ ID NO: 527723 - RNA, 62 nt, Human
aaggagauagugucucgagcuggacagugaggcaaggccaggagugcccaccagcuugcccc

SEQ ID NO: 527724 - RNA, 62 nt, Human
ucuaucucccaggacauuuauucccuucuauucaaggccaguuaggaaugcaauuauuuuuu

SEQ ID NO: 527725 - RNA, 62 nt, Human
ggcagaacagcacccgugacccacccagagagcaaggccaggggucuuggugcuccccgacg

SEQ ID NO: 527726 - RNA, 62 nt, Human
gaggcaggaacugcucugucuuuguaacuacucaaggccaacugucacaugaaggaaugaau

SEQ ID NO: 527727 - RNA, 62 nt, Human
ugugauguggugcgugugaaucugugggcgcccaaggccagcagccauaucuggcaagaagc

SEQ ID NO: 527728 - RNA, 62 nt, Human
aagcaggcagauaaguuggagcagggguuggucaaggccaccucugccucuaguccccaagg

SEQ ID NO: 527729 - RNA, 62 nt, Human
cuggggcaugguuggccuccaaugauuucauucaaggccaaaguccugagcccccuccgcug

SEQ ID NO: 527730 - RNA, 62 nt, Human
agacugagagcagaacagguuugucaucuccgcaaggccagaaagugaucacaaaaagaggc

SEQ ID NO: 527731 - RNA, 62 nt, Human
gaugcagacauccagagaguccuaugaaaagacaaggccauuaugcacagguugaauucuga

SEQ ID NO: 527732 - RNA, 62 nt, Human
auacaguacaggaucuuuggucuacucuaucacaaggccaguaccacacucaugaagaaaga

SEQ ID NO: 527733 - RNA, 62 nt, Human
agugcuuccuugggcagccaguaauucccaggcaaggccagagacuucaagucuaucugaaa

SEQ ID NO: 527734 - RNA, 62 nt, Human
agucucucuucggacagccaguaauucccgggcaaggccagagacuucaagucuaucugaaa

SEQ ID NO: 527735 - RNA, 62 nt, Human
uugaguggggcagagggacagggcagccagaccaaggccaagccuucucacccuuggccagc

SEQ ID NO: 527736 - RNA, 62 nt, Human
caaagcaacucaacagaugccaaugccaauuccaaggccagccacaacccugccaccuuggg

SEQ ID NO: 527737 - RNA, 62 nt, Human
ucauggagugcauugaguagggccggccagugcaaggccacugccugccgaggacgugcccg

SEQ ID NO: 527738 - RNA, 62 nt, Human
uggcuggggcugggccaucaccauuccagagacaaggccaguguauaugcaaacugggggac

SEQ ID NO: 527739 - RNA, 62 nt, Human
ccuggcacagccaacccccccagugcaaaccccaaggccaagccaagccggaucagcaccgu

SEQ ID NO: 527740 - RNA, 62 nt, Human
caacuaccugugaugucugaccagaacauuagcaaggccaaggaacuuuaaccacaguauaa

SEQ ID NO: 527741 - RNA, 62 nt, Human
guagggcauguugaggaaggaggagggcugaucaaggccaagcuggucuagccugacauccu

SEQ ID NO: 527742 - RNA, 62 nt, Human
gaggaagagggagucugagcaugaguugcagccaaggccagugggagggggacugggccagu

SEQ ID NO: 527743 - RNA, 64 nt, Human
gagaaaucuuacagaaaacaggggugggaaucucuuccgauagagucgcuauuucugguuaaua

SEQ ID NO: 527744 - RNA, 64 nt, Human
ugguuuuuggguguuuuucuuguuguguccuggauuccgauaaaauuaaagaaauugcuuccuc

SEQ ID NO: 527745 - RNA, 64 nt, Human
aguauuaaaccuuuuuuaugccauuucauaagaauuccgauauauacuugaugauugccaaggg

SEQ ID NO: 527746 - RNA, 64 nt, Human
aaaacauaauuauauacuuuagaaauacaagggauuccgauaugucaggaccuaaauggccuaa

SEQ ID NO: 527747 - RNA, 64 nt, Human
auagaauaauggaaauugaaaauuuaacccuuuauuccgauaaucucaugaagcaaaccuaacu

SEQ ID NO: 527748 - RNA, 64 nt, Human
acauuuauauuuuuaaucuucuguuaaauacacuuuccgauauugccuugccuuuugagcucuu

SEQ ID NO: 527749 - RNA, 64 nt, Human; identical to SEQ ID NO: 334243

SEQ ID NO: 527750 - RNA, 64 nt, Human; identical to SEQ ID NO: 340798

SEQ ID NO: 527751 - RNA, 64 nt, Human; identical to SEQ ID NO: 340799

SEQ ID NO: 527752 - RNA, 64 nt, Human
uaugcacugugggauguguucuucuuucucuguauuccgauacaaaguguuguaucaaagugug

SEQ ID NO: 527753 - RNA, 64 nt, Human
cuccucaucaauucucaggcugcagggacaaacuuuccgauagggcucaguaggaucaagccga

SEQ ID NO: 527754 - RNA, 64 nt, Human
agaccuugguuugguuuaugugucaguuucacuuuuccgauagaaauuucuuaccucauuuuuu

SEQ ID NO: 527755 - RNA, 64 nt, Human
cugccccagauagguggugccaguggcuuauuaauuccgauacuaguuugcuuugcugaccaaa

SEQ ID NO: 527756 - RNA, 64 nt, Human
gcaaacacuuuucccccacaacaagccuuguuuguuccgauaggaauacguguacgucagugca

SEQ ID NO: 527757 - RNA, 64 nt, Human
gccugguggggcccaguguacugaaauaaagucguuccgauagacacgucagcugggccucuau

SEQ ID NO: 527758 - RNA, 64 nt, Human
ugggagccgguccagguggccuucagccccaccuuuccgauagucuguuagaauuuuauuagcg

SEQ ID NO: 527759 - RNA, 64 nt, Human
cgaguuuaguaacagugcagauuccacguucuuguuccgauacucugagaagugccugauguug

SEQ ID NO: 527760 - RNA, 64 nt, Human
ccacucucccuggggccucuggggugagagcagcuuccgauaggaccugcccagauuucugcau

SEQ ID NO: 527761 - RNA, 64 nt, Human
ugugguccagcagcagggaggaguucugcccaaauuccgauaucaccccuucccccauccaagc

SEQ ID NO: 527762 - RNA, 64 nt, Human
acaagagauauguagaaagacucuuugguucacauuccgauauuaaaauagugacaugaacugg

SEQ ID NO: 527763 - RNA, 64 nt, Human
uacuuucuugaauuauaauacugaauguuuucuguuccgauagagaaaagugaagcaaauaugu

SEQ ID NO: 527764 - RNA, 64 nt, Human
uaaacccuuuaaguguaaagaauguggaaaagcauuccgauaccaccaaucugcucaaaaacau

SEQ ID NO: 527765 - RNA, 64 nt, Human
agauuuuugcagcucauccuuguauucucaguaguuccgauauguacccucgaaaugugaaugu

SEQ ID NO: 527766 - RNA, 64 nt, Human
ugauaccuacauucuaaagaguuaauucuaauuauuccgauaugaccuuaaggaaaaguaaagg

SEQ ID NO: 527767 - RNA, 64 nt, Human; identical to SEQ ID NO: 527766

SEQ ID NO: 527768 - RNA, 64 nt, Human; identical to SEQ ID NO: 340800

SEQ ID NO: 527769 - RNA, 64 nt, Human; identical to SEQ ID NO: 340817

SEQ ID NO: 527770 - RNA, 64 nt, Human; identical to SEQ ID NO: 340818

SEQ ID NO: 527771 - RNA, 64 nt, Human; identical to SEQ ID NO: 334244

SEQ ID NO: 527772 - RNA, 64 nt, Human; identical to SEQ ID NO: 340819

SEQ ID NO: 527773 - RNA, 64 nt, Human; identical to SEQ ID NO: 340572

SEQ ID NO: 527774 - RNA, 64 nt, Human; identical to SEQ ID NO: 340573

SEQ ID NO: 527775 - RNA, 64 nt, Human; identical to SEQ ID NO: 334245

SEQ ID NO: 527776 - RNA, 64 nt, Human; identical to SEQ ID NO: 340838

SEQ ID NO: 527777 - RNA, 64 nt, Human; identical to SEQ ID NO: 340496

SEQ ID NO: 527778 - RNA, 64 nt, Human; identical to SEQ ID NO: 340497

SEQ ID NO: 527779 - RNA, 64 nt, Human; identical to SEQ ID NO: 334261

SEQ ID NO: 527780 - RNA, 64 nt, Human; identical to SEQ ID NO: 341026

SEQ ID NO: 527781 - RNA, 64 nt, Human; identical to SEQ ID NO: 341027

SEQ ID NO: 527782 - RNA, 64 nt, Human; identical to SEQ ID NO: 341028

SEQ ID NO: 527783 - RNA, 64 nt, Human; identical to SEQ ID NO: 340458

SEQ ID NO: 527784 - RNA, 64 nt, Human; identical to SEQ ID NO: 340459

SEQ ID NO: 527785 - RNA, 64 nt, Human; identical to SEQ ID NO: 334262

SEQ ID NO: 527786 - RNA, 64 nt, Human; identical to SEQ ID NO: 341121

SEQ ID NO: 527787 - RNA, 64 nt, Human; identical to SEQ ID NO: 341122

SEQ ID NO: 527788 - RNA, 64 nt, Human; identical to SEQ ID NO: 341123

SEQ ID NO: 527789 - RNA, 64 nt, Human; identical to SEQ ID NO: 340439

SEQ ID NO: 527790 - RNA, 64 nt, Human; identical to SEQ ID NO: 340440

SEQ ID NO: 527791 - RNA, 64 nt, Human; identical to SEQ ID NO: 334263

SEQ ID NO: 527792 - RNA, 64 nt, Human; identical to SEQ ID NO: 340381

SEQ ID NO: 527793 - RNA, 64 nt, Human; identical to SEQ ID NO: 340382

SEQ ID NO: 527794 - RNA, 64 nt, Human; identical to SEQ ID NO: 340383

SEQ ID NO: 527795 - RNA, 64 nt, Human; identical to SEQ ID NO: 340441

SEQ ID NO: 527796 - RNA, 64 nt, Human; identical to SEQ ID NO: 334279

SEQ ID NO: 527797 - RNA, 64 nt, Human; identical to SEQ ID NO: 340420

SEQ ID NO: 527798 - RNA, 64 nt, Human; identical to SEQ ID NO: 340421

SEQ ID NO: 527799 - RNA, 64 nt, Human; identical to SEQ ID NO: 340422

SEQ ID NO: 527800 - RNA, 64 nt, Human; identical to SEQ ID NO: 340460

SEQ ID NO: 527801 - RNA, 64 nt, Human; identical to SEQ ID NO: 334280

SEQ ID NO: 527802 - RNA, 64 nt, Human; identical to SEQ ID NO: 340477

SEQ ID NO: 527803 - RNA, 64 nt, Human; identical to SEQ ID NO: 340478

SEQ ID NO: 527804 - RNA, 64 nt, Human; identical to SEQ ID NO: 340479

SEQ ID NO: 527805 - RNA, 64 nt, Human; identical to SEQ ID NO: 340498

SEQ ID NO: 527806 - RNA, 64 nt, Human; identical to SEQ ID NO: 334281

SEQ ID NO: 527807 - RNA, 64 nt, Human; identical to SEQ ID NO: 340515

SEQ ID NO: 527808 - RNA, 64 nt, Human; identical to SEQ ID NO: 340516

SEQ ID NO: 527809 - RNA, 64 nt, Human; identical to SEQ ID NO: 340517

SEQ ID NO: 527810 - RNA, 64 nt, Human; identical to SEQ ID NO: 340534

SEQ ID NO: 527811 - RNA, 64 nt, Human; identical to SEQ ID NO: 340535

SEQ ID NO: 527812 - RNA, 64 nt, Human; identical to SEQ ID NO: 334297

SEQ ID NO: 527813 - RNA, 64 nt, Human; identical to SEQ ID NO: 340553

SEQ ID NO: 527814 - RNA, 64 nt, Human; identical to SEQ ID NO: 340554

SEQ ID NO: 527815 - RNA, 64 nt, Human; identical to SEQ ID NO: 340555

SEQ ID NO: 527816 - RNA, 64 nt, Human; identical to SEQ ID NO: 340266

SEQ ID NO: 527817 - RNA, 64 nt, Human; identical to SEQ ID NO: 340267

SEQ ID NO: 527818 - RNA, 64 nt, Human; identical to SEQ ID NO: 334298

SEQ ID NO: 527819 - RNA, 64 nt, Human; identical to SEQ ID NO: 340574

SEQ ID NO: 527820 - RNA, 64 nt, Human; identical to SEQ ID NO: 340610

SEQ ID NO: 527821 - RNA, 64 nt, Human; identical to SEQ ID NO: 340611

SEQ ID NO: 527822 - RNA, 64 nt, Human; identical to SEQ ID NO: 334299

SEQ ID NO: 527823 - RNA, 64 nt, Human; identical to SEQ ID NO: 340591

SEQ ID NO: 527824 - RNA, 64 nt, Human; identical to SEQ ID NO: 340592

SEQ ID NO: 527825 - RNA, 64 nt, Human; identical to SEQ ID NO: 340593

SEQ ID NO: 527826 - RNA, 64 nt, Human; identical to SEQ ID NO: 340342

SEQ ID NO: 527827 - RNA, 64 nt, Human; identical to SEQ ID NO: 340343

SEQ ID NO: 527828 - RNA, 64 nt, Human; identical to SEQ ID NO: 334315

SEQ ID NO: 527829 - RNA, 64 nt, Human; identical to SEQ ID NO: 340669

SEQ ID NO: 527830 - RNA, 64 nt, Human; identical to SEQ ID NO: 340285

SEQ ID NO: 527831 - RNA, 64 nt, Human; identical to SEQ ID NO: 340286

SEQ ID NO: 527832 - RNA, 64 nt, Human; identical to SEQ ID NO: 334316

SEQ ID NO: 527833 - RNA, 64 nt, Human; identical to SEQ ID NO: 340781

SEQ ID NO: 527834 - RNA, 64 nt, Human; identical to SEQ ID NO: 340247

SEQ ID NO: 527835 - RNA, 64 nt, Human; identical to SEQ ID NO: 340248

SEQ ID NO: 527836 - RNA, 64 nt, Human; identical to SEQ ID NO: 147284

SEQ ID NO: 527837 - RNA, 64 nt, Human; identical to SEQ ID NO: 147285

SEQ ID NO: 527838 - RNA, 64 nt, Human; identical to SEQ ID NO: 147286

SEQ ID NO: 527839 - RNA, 64 nt, Human; identical to SEQ ID NO: 147287

SEQ ID NO: 527840 - RNA, 64 nt, Human; identical to SEQ ID NO: 147288

SEQ ID NO: 527841 - RNA, 64 nt, Human; identical to SEQ ID NO: 147289

SEQ ID NO: 527842 - RNA, 64 nt, Human; identical to SEQ ID NO: 147290

SEQ ID NO: 527843 - RNA, 64 nt, Human; identical to SEQ ID NO: 147291

SEQ ID NO: 527844 - RNA, 64 nt, Human; identical to SEQ ID NO: 147292

SEQ ID NO: 527845 - RNA, 64 nt, Human; identical to SEQ ID NO: 147293

SEQ ID NO: 527846 - RNA, 64 nt, Human; identical to SEQ ID NO: 147294

SEQ ID NO: 527847 - RNA, 64 nt, Human; identical to SEQ ID NO: 147295

SEQ ID NO: 527848 - RNA, 64 nt, Human; identical to SEQ ID NO: 147296

SEQ ID NO: 527849 - RNA, 64 nt, Human; identical to SEQ ID NO: 147297

SEQ ID NO: 527850 - RNA, 64 nt, Human; identical to SEQ ID NO: 147298

SEQ ID NO: 527851 - RNA, 64 nt, Human; identical to SEQ ID NO: 147299

SEQ ID NO: 527852 - RNA, 64 nt, Human; identical to SEQ ID NO: 147300

SEQ ID NO: 527853 - RNA, 64 nt, Human; identical to SEQ ID NO: 147301

SEQ ID NO: 527854 - RNA, 59 nt, Human; identical to SEQ ID NO: 147302

SEQ ID NO: 527855 - RNA, 64 nt, Human; identical to SEQ ID NO: 147303

SEQ ID NO: 527856 - RNA, 64 nt, Human; identical to SEQ ID NO: 147304

SEQ ID NO: 527857 - RNA, 64 nt, Human; identical to SEQ ID NO: 147305

SEQ ID NO: 527858 - RNA, 64 nt, Human; identical to SEQ ID NO: 147306

SEQ ID NO: 527859 - RNA, 64 nt, Human; identical to SEQ ID NO: 147307

SEQ ID NO: 527860 - RNA, 64 nt, Human; identical to SEQ ID NO: 147308

SEQ ID NO: 527861 - RNA, 64 nt, Human; identical to SEQ ID NO: 147309

SEQ ID NO: 527862 - RNA, 64 nt, Human; identical to SEQ ID NO: 147310

SEQ ID NO: 527863 - RNA, 64 nt, Human; identical to SEQ ID NO: 147311

SEQ ID NO: 527864 - RNA, 64 nt, Human; identical to SEQ ID NO: 147312

SEQ ID NO: 527865 - RNA, 64 nt, Human; identical to SEQ ID NO: 147313

SEQ ID NO: 527866 - RNA, 64 nt, Human; identical to SEQ ID NO: 147314

SEQ ID NO: 527867 - RNA, 64 nt, Human; identical to SEQ ID NO: 147315

SEQ ID NO: 527868 - RNA, 64 nt, Human; identical to SEQ ID NO: 147316

SEQ ID NO: 527869 - RNA, 64 nt, Human; identical to SEQ ID NO: 147317

SEQ ID NO: 527870 - RNA, 64 nt, Human; identical to SEQ ID NO: 147318

SEQ ID NO: 527871 - RNA, 64 nt, Human; identical to SEQ ID NO: 147319

SEQ ID NO: 527872 - RNA, 64 nt, Human; identical to SEQ ID NO: 147320

SEQ ID NO: 527873 - RNA, 64 nt, Human; identical to SEQ ID NO: 147321

SEQ ID NO: 527874 - RNA, 64 nt, Human; identical to SEQ ID NO: 147322

SEQ ID NO: 527875 - RNA, 64 nt, Human; identical to SEQ ID NO: 147323

SEQ ID NO: 527876 - RNA, 64 nt, Human; identical to SEQ ID NO: 147324

SEQ ID NO: 527877 - RNA, 64 nt, Human; identical to SEQ ID NO: 147325

SEQ ID NO: 527878 - RNA, 64 nt, Human; identical to SEQ ID NO: 147326

SEQ ID NO: 527879 - RNA, 64 nt, Human; identical to SEQ ID NO: 147327

SEQ ID NO: 527880 - RNA, 64 nt, Human; identical to SEQ ID NO: 147328

SEQ ID NO: 527881 - RNA, 64 nt, Human; identical to SEQ ID NO: 147329

SEQ ID NO: 527882 - RNA, 64 nt, Human; identical to SEQ ID NO: 147330

SEQ ID NO: 527883 - RNA, 64 nt, Human; identical to SEQ ID NO: 147331

SEQ ID NO: 527884 - RNA, 64 nt, Human; identical to SEQ ID NO: 147332

SEQ ID NO: 527885 - RNA, 64 nt, Human; identical to SEQ ID NO: 147333

SEQ ID NO: 527886 - RNA, 64 nt, Human; identical to SEQ ID NO: 147334

SEQ ID NO: 527887 - RNA, 64 nt, Human; identical to SEQ ID NO: 147335

SEQ ID NO: 527888 - RNA, 64 nt, Human; identical to SEQ ID NO: 147336

SEQ ID NO: 527889 - RNA, 64 nt, Human; identical to SEQ ID NO: 147337

SEQ ID NO: 527890 - RNA, 64 nt, Human; identical to SEQ ID NO: 147338

SEQ ID NO: 527891 - RNA, 64 nt, Human; identical to SEQ ID NO: 147339

SEQ ID NO: 527892 - RNA, 64 nt, Human; identical to SEQ ID NO: 147340

SEQ ID NO: 527893 - RNA, 64 nt, Human; identical to SEQ ID NO: 147341

SEQ ID NO: 527894 - RNA, 64 nt, Human; identical to SEQ ID NO: 147342

SEQ ID NO: 527895 - RNA, 64 nt, Human; identical to SEQ ID NO: 147343

SEQ ID NO: 527896 - RNA, 64 nt, Human; identical to SEQ ID NO: 147344

SEQ ID NO: 527897 - RNA, 64 nt, Human; identical to SEQ ID NO: 147345

SEQ ID NO: 527898 - RNA, 64 nt, Human; identical to SEQ ID NO: 147346

SEQ ID NO: 527899 - RNA, 64 nt, Human; identical to SEQ ID NO: 147347

SEQ ID NO: 527900 - RNA, 60 nt, Human; identical to SEQ ID NO: 147348

SEQ ID NO: 527901 - RNA, 64 nt, Human; identical to SEQ ID NO: 147349

SEQ ID NO: 527902 - RNA, 64 nt, Human; identical to SEQ ID NO: 147350

SEQ ID NO: 527903 - RNA, 64 nt, Human; identical to SEQ ID NO: 147351

SEQ ID NO: 527904 - RNA, 64 nt, Human; identical to SEQ ID NO: 147352

SEQ ID NO: 527905 - RNA, 64 nt, Human; identical to SEQ ID NO: 147353

SEQ ID NO: 527906 - RNA, 64 nt, Human; identical to SEQ ID NO: 147354

SEQ ID NO: 527907 - RNA, 64 nt, Human; identical to SEQ ID NO: 147355

SEQ ID NO: 527908 - RNA, 64 nt, Human; identical to SEQ ID NO: 147356

SEQ ID NO: 527909 - RNA, 64 nt, Human; identical to SEQ ID NO: 147357

SEQ ID NO: 527910 - RNA, 64 nt, Human; identical to SEQ ID NO: 147358

SEQ ID NO: 527911 - RNA, 64 nt, Human; identical to SEQ ID NO: 147359

SEQ ID NO: 527912 - RNA, 64 nt, Human; identical to SEQ ID NO: 147360

SEQ ID NO: 527913 - RNA, 64 nt, Human; identical to SEQ ID NO: 147361

SEQ ID NO: 527914 - RNA, 64 nt, Human; identical to SEQ ID NO: 147362

SEQ ID NO: 527915 - RNA, 64 nt, Human; identical to SEQ ID NO: 147363

SEQ ID NO: 527916 - RNA, 64 nt, Human; identical to SEQ ID NO: 147364

SEQ ID NO: 527917 - RNA, 64 nt, Human; identical to SEQ ID NO: 147365

SEQ ID NO: 527918 - RNA, 64 nt, Human; identical to SEQ ID NO: 147366

SEQ ID NO: 527919 - RNA, 64 nt, Human; identical to SEQ ID NO: 147367

SEQ ID NO: 527920 - RNA, 64 nt, Human; identical to SEQ ID NO: 147368

SEQ ID NO: 527921 - RNA, 64 nt, Human; identical to SEQ ID NO: 147369

SEQ ID NO: 527922 - RNA, 64 nt, Human; identical to SEQ ID NO: 147370

SEQ ID NO: 527923 - RNA, 64 nt, Human; identical to SEQ ID NO: 147371

SEQ ID NO: 527924 - RNA, 64 nt, Human; identical to SEQ ID NO: 147372

SEQ ID NO: 527925 - RNA, 64 nt, Human; identical to SEQ ID NO: 147373

SEQ ID NO: 527926 - RNA, 64 nt, Human; identical to SEQ ID NO: 147374

SEQ ID NO: 527927 - RNA, 64 nt, Human; identical to SEQ ID NO: 147375

SEQ ID NO: 527928 - RNA, 64 nt, Human; identical to SEQ ID NO: 147376

SEQ ID NO: 527929 - RNA, 64 nt, Human; identical to SEQ ID NO: 147377

SEQ ID NO: 527930 - RNA, 64 nt, Human; identical to SEQ ID NO: 147378

SEQ ID NO: 527931 - RNA, 64 nt, Human; identical to SEQ ID NO: 147379

SEQ ID NO: 527932 - RNA, 64 nt, Human; identical to SEQ ID NO: 147380

SEQ ID NO: 527933 - RNA, 64 nt, Human; identical to SEQ ID NO: 147381

SEQ ID NO: 527934 - RNA, 64 nt, Human; identical to SEQ ID NO: 147382

SEQ ID NO: 527935 - RNA, 64 nt, Human; identical to SEQ ID NO: 147383

SEQ ID NO: 527936 - RNA, 64 nt, Human; identical to SEQ ID NO: 147384

SEQ ID NO: 527937 - RNA, 64 nt, Human; identical to SEQ ID NO: 147385

SEQ ID NO: 527938 - RNA, 64 nt, Human; identical to SEQ ID NO: 147386

SEQ ID NO: 527939 - RNA, 64 nt, Human; identical to SEQ ID NO: 147387

SEQ ID NO: 527940 - RNA, 64 nt, Human; identical to SEQ ID NO: 147388

SEQ ID NO: 527941 - RNA, 64 nt, Human; identical to SEQ ID NO: 147389

SEQ ID NO: 527942 - RNA, 64 nt, Human; identical to SEQ ID NO: 147390

SEQ ID NO: 527943 - RNA, 64 nt, Human; identical to SEQ ID NO: 147391

SEQ ID NO: 527944 - RNA, 64 nt, Human; identical to SEQ ID NO: 147392

SEQ ID NO: 527945 - RNA, 64 nt, Human; identical to SEQ ID NO: 147393

SEQ ID NO: 527946 - RNA, 64 nt, Human; identical to SEQ ID NO: 147394

SEQ ID NO: 527947 - RNA, 64 nt, Human; identical to SEQ ID NO: 147395

SEQ ID NO: 527948 - RNA, 64 nt, Human; identical to SEQ ID NO: 147396

SEQ ID NO: 527949 - RNA, 64 nt, Human; identical to SEQ ID NO: 147397

SEQ ID NO: 527950 - RNA, 64 nt, Human; identical to SEQ ID NO: 147398

SEQ ID NO: 527951 - RNA, 64 nt, Human; identical to SEQ ID NO: 147399

SEQ ID NO: 527952 - RNA, 64 nt, Human; identical to SEQ ID NO: 147400

SEQ ID NO: 527953 - RNA, 64 nt, Human; identical to SEQ ID NO: 147401

SEQ ID NO: 527954 - RNA, 64 nt, Human; identical to SEQ ID NO: 147402

SEQ ID NO: 527955 - RNA, 64 nt, Human; identical to SEQ ID NO: 147403

SEQ ID NO: 527956 - RNA, 64 nt, Human; identical to SEQ ID NO: 147404

SEQ ID NO: 527957 - RNA, 64 nt, Human; identical to SEQ ID NO: 147405

SEQ ID NO: 527958 - RNA, 64 nt, Human; identical to SEQ ID NO: 147406

SEQ ID NO: 527959 - RNA, 64 nt, Human; identical to SEQ ID NO: 147407

SEQ ID NO: 527960 - RNA, 64 nt, Human; identical to SEQ ID NO: 147408

SEQ ID NO: 527961 - RNA, 64 nt, Human; identical to SEQ ID NO: 147409

SEQ ID NO: 527962 - RNA, 54 nt, Human; identical to SEQ ID NO: 147410

SEQ ID NO: 527963 - RNA, 64 nt, Human; identical to SEQ ID NO: 147411

SEQ ID NO: 527964 - RNA, 64 nt, Human; identical to SEQ ID NO: 147412

SEQ ID NO: 527965 - RNA, 64 nt, Human; identical to SEQ ID NO: 147413

SEQ ID NO: 527966 - RNA, 64 nt, Human; identical to SEQ ID NO: 147414

SEQ ID NO: 527967 - RNA, 64 nt, Human; identical to SEQ ID NO: 147415

SEQ ID NO: 527968 - RNA, 64 nt, Human; identical to SEQ ID NO: 147416

SEQ ID NO: 527969 - RNA, 64 nt, Human; identical to SEQ ID NO: 147417

SEQ ID NO: 527970 - RNA, 64 nt, Human; identical to SEQ ID NO: 147418

SEQ ID NO: 527971 - RNA, 64 nt, Human; identical to SEQ ID NO: 147419

SEQ ID NO: 527972 - RNA, 64 nt, Human; identical to SEQ ID NO: 147420

SEQ ID NO: 527973 - RNA, 64 nt, Human; identical to SEQ ID NO: 147421

SEQ ID NO: 527974 - RNA, 64 nt, Human; identical to SEQ ID NO: 147422

SEQ ID NO: 527975 - RNA, 64 nt, Human; identical to SEQ ID NO: 147423

SEQ ID NO: 527976 - RNA, 64 nt, Human; identical to SEQ ID NO: 147424

SEQ ID NO: 527977 - RNA, 64 nt, Human; identical to SEQ ID NO: 147425

SEQ ID NO: 527978 - RNA, 64 nt, Human; identical to SEQ ID NO: 147426

SEQ ID NO: 527979 - RNA, 64 nt, Human; identical to SEQ ID NO: 147427

SEQ ID NO: 527980 - RNA, 64 nt, Human; identical to SEQ ID NO: 147428

SEQ ID NO: 527981 - RNA, 64 nt, Human; identical to SEQ ID NO: 147429

SEQ ID NO: 527982 - RNA, 64 nt, Human; identical to SEQ ID NO: 147430

SEQ ID NO: 527983 - RNA, 64 nt, Human; identical to SEQ ID NO: 147431

SEQ ID NO: 527984 - RNA, 64 nt, Human; identical to SEQ ID NO: 147432

SEQ ID NO: 527985 - RNA, 64 nt, Human; identical to SEQ ID NO: 147433

SEQ ID NO: 527986 - RNA, 64 nt, Human; identical to SEQ ID NO: 147434

SEQ ID NO: 527987 - RNA, 64 nt, Human; identical to SEQ ID NO: 147435

SEQ ID NO: 527988 - RNA, 64 nt, Human; identical to SEQ ID NO: 147436

SEQ ID NO: 527989 - RNA, 58 nt, Human; identical to SEQ ID NO: 147437

SEQ ID NO: 527990 - RNA, 54 nt, Human; identical to SEQ ID NO: 147438

SEQ ID NO: 527991 - RNA, 64 nt, Human; identical to SEQ ID NO: 147439

SEQ ID NO: 527992 - RNA, 64 nt, Human; identical to SEQ ID NO: 147440

SEQ ID NO: 527993 - RNA, 64 nt, Human; identical to SEQ ID NO: 147441

SEQ ID NO: 527994 - RNA, 64 nt, Human; identical to SEQ ID NO: 147442

SEQ ID NO: 527995 - RNA, 64 nt, Human; identical to SEQ ID NO: 147443

SEQ ID NO: 527996 - RNA, 64 nt, Human; identical to SEQ ID NO: 147444

SEQ ID NO: 527997 - RNA, 64 nt, Human; identical to SEQ ID NO: 147445

SEQ ID NO: 527998 - RNA, 64 nt, Human; identical to SEQ ID NO: 147446

SEQ ID NO: 527999 - RNA, 64 nt, Human; identical to SEQ ID NO: 147447

SEQ ID NO: 528000 - RNA, 64 nt, Human; identical to SEQ ID NO: 147448

SEQ ID NO: 528001 - RNA, 64 nt, Human; identical to SEQ ID NO: 147449

SEQ ID NO: 528002 - RNA, 64 nt, Human; identical to SEQ ID NO: 147450

SEQ ID NO: 528003 - RNA, 64 nt, Human; identical to SEQ ID NO: 147451

SEQ ID NO: 528004 - RNA, 64 nt, Human; identical to SEQ ID NO: 147452

SEQ ID NO: 528005 - RNA, 64 nt, Human; identical to SEQ ID NO: 147453

SEQ ID NO: 528006 - RNA, 64 nt, Human; identical to SEQ ID NO: 147454

SEQ ID NO: 528007 - RNA, 64 nt, Human; identical to SEQ ID NO: 147455

SEQ ID NO: 528008 - RNA, 64 nt, Human; identical to SEQ ID NO: 147456

SEQ ID NO: 528009 - RNA, 64 nt, Human; identical to SEQ ID NO: 147457

SEQ ID NO: 528010 - RNA, 64 nt, Human; identical to SEQ ID NO: 147458

SEQ ID NO: 528011 - RNA, 64 nt, Human; identical to SEQ ID NO: 147459

SEQ ID NO: 528012 - RNA, 64 nt, Human; identical to SEQ ID NO: 147460

SEQ ID NO: 528013 - RNA, 64 nt, Human; identical to SEQ ID NO: 147461

SEQ ID NO: 528014 - RNA, 64 nt, Human; identical to SEQ ID NO: 147462

SEQ ID NO: 528015 - RNA, 64 nt, Human; identical to SEQ ID NO: 147463

SEQ ID NO: 528016 - RNA, 64 nt, Human; identical to SEQ ID NO: 147464

SEQ ID NO: 528017 - RNA, 64 nt, Human; identical to SEQ ID NO: 147465

SEQ ID NO: 528018 - RNA, 64 nt, Human; identical to SEQ ID NO: 147466

SEQ ID NO: 528019 - RNA, 64 nt, Human; identical to SEQ ID NO: 147467

SEQ ID NO: 528020 - RNA, 64 nt, Human; identical to SEQ ID NO: 147468

SEQ ID NO: 528021 - RNA, 64 nt, Human; identical to SEQ ID NO: 147469

SEQ ID NO: 528022 - RNA, 64 nt, Human; identical to SEQ ID NO: 147470

SEQ ID NO: 528023 - RNA, 64 nt, Human; identical to SEQ ID NO: 147471

SEQ ID NO: 528024 - RNA, 64 nt, Human; identical to SEQ ID NO: 147472

SEQ ID NO: 528025 - RNA, 64 nt, Human; identical to SEQ ID NO: 147473

SEQ ID NO: 528026 - RNA, 64 nt, Human; identical to SEQ ID NO: 147474

SEQ ID NO: 528027 - RNA, 64 nt, Human; identical to SEQ ID NO: 147475

SEQ ID NO: 528028 - RNA, 64 nt, Human; identical to SEQ ID NO: 147476

SEQ ID NO: 528029 - RNA, 64 nt, Human; identical to SEQ ID NO: 147477

SEQ ID NO: 528030 - RNA, 64 nt, Human; identical to SEQ ID NO: 147478

SEQ ID NO: 528031 - RNA, 64 nt, Human; identical to SEQ ID NO: 147479

SEQ ID NO: 528032 - RNA, 64 nt, Human; identical to SEQ ID NO: 147480

SEQ ID NO: 528033 - RNA, 64 nt, Human; identical to SEQ ID NO: 147481

SEQ ID NO: 528034 - RNA, 64 nt, Human; identical to SEQ ID NO: 147482

SEQ ID NO: 528035 - RNA, 64 nt, Human; identical to SEQ ID NO: 147483

SEQ ID NO: 528036 - RNA, 64 nt, Human; identical to SEQ ID NO: 147484

SEQ ID NO: 528037 - RNA, 64 nt, Human; identical to SEQ ID NO: 147485

SEQ ID NO: 528038 - RNA, 64 nt, Human; identical to SEQ ID NO: 147486

SEQ ID NO: 528039 - RNA, 64 nt, Human; identical to SEQ ID NO: 147487

SEQ ID NO: 528040 - RNA, 64 nt, Human; identical to SEQ ID NO: 147488

SEQ ID NO: 528041 - RNA, 64 nt, Human; identical to SEQ ID NO: 147489

SEQ ID NO: 528042 - RNA, 64 nt, Human; identical to SEQ ID NO: 147490

SEQ ID NO: 528043 - RNA, 64 nt, Human; identical to SEQ ID NO: 147491

SEQ ID NO: 528044 - RNA, 64 nt, Human; identical to SEQ ID NO: 147492

SEQ ID NO: 528045 - RNA, 64 nt, Human; identical to SEQ ID NO: 147493

SEQ ID NO: 528046 - RNA, 51 nt, Human; identical to SEQ ID NO: 147494

SEQ ID NO: 528047 - RNA, 64 nt, Human; identical to SEQ ID NO: 147495

SEQ ID NO: 528048 - RNA, 64 nt, Human; identical to SEQ ID NO: 147496

SEQ ID NO: 528049 - RNA, 64 nt, Human; identical to SEQ ID NO: 147497

SEQ ID NO: 528050 - RNA, 64 nt, Human; identical to SEQ ID NO: 147498

SEQ ID NO: 528051 - RNA, 52 nt, Human; identical to SEQ ID NO: 147499

SEQ ID NO: 528052 - RNA, 64 nt, Human; identical to SEQ ID NO: 147500

SEQ ID NO: 528053 - RNA, 64 nt, Human; identical to SEQ ID NO: 147501

SEQ ID NO: 528054 - RNA, 64 nt, Human; identical to SEQ ID NO: 147502

SEQ ID NO: 528055 - RNA, 64 nt, Human; identical to SEQ ID NO: 147503

SEQ ID NO: 528056 - RNA, 64 nt, Human; identical to SEQ ID NO: 147504

SEQ ID NO: 528057 - RNA, 64 nt, Human; identical to SEQ ID NO: 147505

SEQ ID NO: 528058 - RNA, 64 nt, Human; identical to SEQ ID NO: 147506

SEQ ID NO: 528059 - RNA, 64 nt, Human; identical to SEQ ID NO: 147507

SEQ ID NO: 528060 - RNA, 64 nt, Human; identical to SEQ ID NO: 147508

SEQ ID NO: 528061 - RNA, 64 nt, Human; identical to SEQ ID NO: 147509

SEQ ID NO: 528062 - RNA, 64 nt, Human; identical to SEQ ID NO: 147510

SEQ ID NO: 528063 - RNA, 64 nt, Human; identical to SEQ ID NO: 147511

SEQ ID NO: 528064 - RNA, 64 nt, Human; identical to SEQ ID NO: 147512

SEQ ID NO: 528065 - RNA, 64 nt, Human; identical to SEQ ID NO: 147513

SEQ ID NO: 528066 - RNA, 64 nt, Human; identical to SEQ ID NO: 147514

SEQ ID NO: 528067 - RNA, 64 nt, Human; identical to SEQ ID NO: 147515

SEQ ID NO: 528068 - RNA, 57 nt, Human; identical to SEQ ID NO: 147516

SEQ ID NO: 528069 - RNA, 64 nt, Human; identical to SEQ ID NO: 147517

SEQ ID NO: 528070 - RNA, 64 nt, Human; identical to SEQ ID NO: 147518

SEQ ID NO: 528071 - RNA, 64 nt, Human; identical to SEQ ID NO: 147519

SEQ ID NO: 528072 - RNA, 64 nt, Human; identical to SEQ ID NO: 147520

SEQ ID NO: 528073 - RNA, 64 nt, Human; identical to SEQ ID NO: 37059

SEQ ID NO: 528074 - RNA, 64 nt, Human; identical to SEQ ID NO: 37060

SEQ ID NO: 528075 - RNA, 64 nt, Human; identical to SEQ ID NO: 37061

SEQ ID NO: 528076 - RNA, 64 nt, Human; identical to SEQ ID NO: 37062

SEQ ID NO: 528077 - RNA, 64 nt, Human; identical to SEQ ID NO: 37063

SEQ ID NO: 528078 - RNA, 64 nt, Human; identical to SEQ ID NO: 37064

SEQ ID NO: 528079 - RNA, 64 nt, Human; identical to SEQ ID NO: 37065

SEQ ID NO: 528080 - RNA, 64 nt, Human; identical to SEQ ID NO: 37066

SEQ ID NO: 528081 - RNA, 64 nt, Human; identical to SEQ ID NO: 37067

SEQ ID NO: 528082 - RNA, 64 nt, Human; identical to SEQ ID NO: 37068

SEQ ID NO: 528083 - RNA, 64 nt, Human; identical to SEQ ID NO: 37069

SEQ ID NO: 528084 - RNA, 64 nt, Human; identical to SEQ ID NO: 37070

SEQ ID NO: 528085 - RNA, 64 nt, Human
uacaggagccgcggcuuucugaugggggaaaaugccgccuuaggcuggagccaacaugacuguc

SEQ ID NO: 528086 - RNA, 64 nt, Human
guauggacaguauauggcaaauggguggcaaguaccgccuuauggaguauacgggcaaccaugg

SEQ ID NO: 528087 - RNA, 64 nt, Human
ccccugacagggccagugcaguuugguguguccuccgccuuaccaggagaagaaccugaagaac

SEQ ID NO: 528088 - RNA, 64 nt, Human; identical to SEQ ID NO: 37071

SEQ ID NO: 528089 - RNA, 64 nt, Human; identical to SEQ ID NO: 37072

SEQ ID NO: 528090 - RNA, 64 nt, Human; identical to SEQ ID NO: 37073

SEQ ID NO: 528091 - RNA, 64 nt, Human; identical to SEQ ID NO: 37074

SEQ ID NO: 528092 - RNA, 64 nt, Human; identical to SEQ ID NO: 37075

SEQ ID NO: 528093 - RNA, 64 nt, Human; identical to SEQ ID NO: 37076

SEQ ID NO: 528094 - RNA, 64 nt, Human; identical to SEQ ID NO: 37077

SEQ ID NO: 528095 - RNA, 64 nt, Human; identical to SEQ ID NO: 37078

SEQ ID NO: 528096 - RNA, 64 nt, Human; identical to SEQ ID NO: 37079

SEQ ID NO: 528097 - RNA, 64 nt, Human; identical to SEQ ID NO: 37080

SEQ ID NO: 528098 - RNA, 64 nt, Human; identical to SEQ ID NO: 37081

SEQ ID NO: 528099 - RNA, 64 nt, Human; identical to SEQ ID NO: 37082

SEQ ID NO: 528100 - RNA, 64 nt, Human; identical to SEQ ID NO: 37083

SEQ ID NO: 528101 - RNA, 64 nt, Human; identical to SEQ ID NO: 37084

SEQ ID NO: 528102 - RNA, 64 nt, Human; identical to SEQ ID NO: 37085

SEQ ID NO: 528103 - RNA, 64 nt, Human; identical to SEQ ID NO: 37086

SEQ ID NO: 528104 - RNA, 64 nt, Human; identical to SEQ ID NO: 143560

SEQ ID NO: 528105 - RNA, 64 nt, Human; identical to SEQ ID NO: 3867

SEQ ID NO: 528106 - RNA, 52 nt, Human; identical to SEQ ID NO: 14036

SEQ ID NO: 528107 - RNA, 64 nt, Human; identical to SEQ ID NO: 37087

SEQ ID NO: 528108 - RNA, 64 nt, Human; identical to SEQ ID NO: 37088

SEQ ID NO: 528109 - RNA, 58 nt, Human; identical to SEQ ID NO: 37090

SEQ ID NO: 528110 - RNA, 64 nt, Human; identical to SEQ ID NO: 37091

SEQ ID NO: 528111 - RNA, 64 nt, Human; identical to SEQ ID NO: 37092

SEQ ID NO: 528112 - RNA, 64 nt, Human; identical to SEQ ID NO: 37093

SEQ ID NO: 528113 - RNA, 64 nt, Human; identical to SEQ ID NO: 37094

SEQ ID NO: 528114 - RNA, 64 nt, Human; identical to SEQ ID NO: 37095

SEQ ID NO: 528115 - RNA, 64 nt, Human; identical to SEQ ID NO: 37096

SEQ ID NO: 528116 - RNA, 64 nt, Human; identical to SEQ ID NO: 37097

SEQ ID NO: 528117 - RNA, 64 nt, Human; identical to SEQ ID NO: 37098

SEQ ID NO: 528118 - RNA, 64 nt, Human; identical to SEQ ID NO: 37099

SEQ ID NO: 528119 - RNA, 64 nt, Human; identical to SEQ ID NO: 37100

SEQ ID NO: 528120 - RNA, 64 nt, Human; identical to SEQ ID NO: 37101

SEQ ID NO: 528121 - RNA, 64 nt, Human; identical to SEQ ID NO: 37102

SEQ ID NO: 528122 - RNA, 64 nt, Human; identical to SEQ ID NO: 37103

SEQ ID NO: 528123 - RNA, 64 nt, Human
gcugggcaggugccuggacagugaugaggucuugccgccuuaacugucccccccagucacuucu

SEQ ID NO: 528124 - RNA, 64 nt, Human
ugcuugaaccggggaggcagaaguugcagugagccgagauuaugccacuguacuccagccuggg

SEQ ID NO: 528125 - RNA, 64 nt, Human
uggcugcugacugacuccagccaaggugcaaagacgagauuaugagacagguccucaggccugu

SEQ ID NO: 528126 - RNA, 64 nt, Human; identical to SEQ ID NO: 37104

SEQ ID NO: 528127 - RNA, 62 nt, Human; identical to SEQ ID NO: 37105

SEQ ID NO: 528128 - RNA, 64 nt, Human; identical to SEQ ID NO: 37106

SEQ ID NO: 528129 - RNA, 64 nt, Human; identical to SEQ ID NO: 37108

SEQ ID NO: 528130 - RNA, 64 nt, Human; identical to SEQ ID NO: 37109

SEQ ID NO: 528131 - RNA, 64 nt, Human; identical to SEQ ID NO: 37110

SEQ ID NO: 528132 - RNA, 64 nt, Human; identical to SEQ ID NO: 37111

SEQ ID NO: 528133 - RNA, 64 nt, Human; identical to SEQ ID NO: 37112

SEQ ID NO: 528134 - RNA, 64 nt, Human; identical to SEQ ID NO: 37113

SEQ ID NO: 528135 - RNA, 64 nt, Human; identical to SEQ ID NO: 37114

SEQ ID NO: 528136 - RNA, 64 nt, Human; identical to SEQ ID NO: 37115

SEQ ID NO: 528137 - RNA, 64 nt, Human; identical to SEQ ID NO: 37116

SEQ ID NO: 528138 - RNA, 64 nt, Human; identical to SEQ ID NO: 37117

SEQ ID NO: 528139 - RNA, 64 nt, Human; identical to SEQ ID NO: 37118

SEQ ID NO: 528140 - RNA, 64 nt, Human; identical to SEQ ID NO: 37119

SEQ ID NO: 528141 - RNA, 64 nt, Human; identical to SEQ ID NO: 37120

SEQ ID NO: 528142 - RNA, 64 nt, Human
acagaaacacuggaugugauuaauagggaguaggcgagauuauagcaaaccagcagaaauggaa

SEQ ID NO: 528143 - RNA, 64 nt, Human
ggacaaauggauagagaagaaaagggucaaacaucgagauuacauggauguuaaauuauaugga

SEQ ID NO: 528144 - RNA, 64 nt, Human
uacucgcaggggcgcuggcugcacucaagacccucgagauuaacggugcuaaccccgucugcuc

SEQ ID NO: 528145 - RNA, 64 nt, Human; identical to SEQ ID NO: 37121

SEQ ID NO: 528146 - RNA, 64 nt, Human; identical to SEQ ID NO: 37122

SEQ ID NO: 528147 - RNA, 64 nt, Human; identical to SEQ ID NO: 37123

SEQ ID NO: 528148 - RNA, 64 nt, Human; identical to SEQ ID NO: 37124

SEQ ID NO: 528149 - RNA, 64 nt, Human; identical to SEQ ID NO: 37125

SEQ ID NO: 528150 - RNA, 64 nt, Human; identical to SEQ ID NO: 37126

SEQ ID NO: 528151 - RNA, 56 nt, Human; identical to SEQ ID NO: 37127

SEQ ID NO: 528152 - RNA, 64 nt, Human; identical to SEQ ID NO: 37128

SEQ ID NO: 528153 - RNA, 64 nt, Human; identical to SEQ ID NO: 37129

SEQ ID NO: 528154 - RNA, 64 nt, Human; identical to SEQ ID NO: 37130

SEQ ID NO: 528155 - RNA, 64 nt, Human; identical to SEQ ID NO: 37131

SEQ ID NO: 528156 - RNA, 64 nt, Human; identical to SEQ ID NO: 37132

SEQ ID NO: 528157 - RNA, 64 nt, Human; identical to SEQ ID NO: 37133

SEQ ID NO: 528158 - RNA, 64 nt, Human; identical to SEQ ID NO: 37134

SEQ ID NO: 528159 - RNA, 64 nt, Human; identical to SEQ ID NO: 37135

SEQ ID NO: 528160 - RNA, 64 nt, Human; identical to SEQ ID NO: 37136

SEQ ID NO: 528161 - RNA, 61 nt, Human
ggcucggccgcagagccggggcccagcgaaucacgcagagaaaucuuacagaaaacagggg

SEQ ID NO: 528162 - RNA, 61 nt, Human
cgcgugccccgugugcuggugcgguucccaucacgcagacaggaaggguguuugcgcacuc

SEQ ID NO: 528163 - RNA, 61 nt, Human
auacauacuugcacauguguguucauguacacacgcagacacagacaccacacacacacau

SEQ ID NO: 528164 - RNA, 64 nt, Human; identical to SEQ ID NO: 37137

SEQ ID NO: 528165 - RNA, 64 nt, Human; identical to SEQ ID NO: 37138

SEQ ID NO: 528166 - RNA, 64 nt, Human; identical to SEQ ID NO: 37139

SEQ ID NO: 528167 - RNA, 64 nt, Human; identical to SEQ ID NO: 37140

SEQ ID NO: 528168 - RNA, 64 nt, Human; identical to SEQ ID NO: 37141

SEQ ID NO: 528169 - RNA, 64 nt, Human; identical to SEQ ID NO: 37143

SEQ ID NO: 528170 - RNA, 64 nt, Human; identical to SEQ ID NO: 37144

SEQ ID NO: 528171 - RNA, 64 nt, Human; identical to SEQ ID NO: 37145

SEQ ID NO: 528172 - RNA, 52 nt, Human; identical to SEQ ID NO: 37146

SEQ ID NO: 528173 - RNA, 64 nt, Human; identical to SEQ ID NO: 37147

SEQ ID NO: 528174 - RNA, 64 nt, Human; identical to SEQ ID NO: 37148

SEQ ID NO: 528175 - RNA, 64 nt, Human; identical to SEQ ID NO: 37149

SEQ ID NO: 528176 - RNA, 64 nt, Human; identical to SEQ ID NO: 37150

SEQ ID NO: 528177 - RNA, 64 nt, Human; identical to SEQ ID NO: 37151

SEQ ID NO: 528178 - RNA, 64 nt, Human; identical to SEQ ID NO: 37152

SEQ ID NO: 528179 - RNA, 64 nt, Human; identical to SEQ ID NO: 37153

SEQ ID NO: 528180 - RNA, 64 nt, Human
aucaccccuuccccauuuccucuuccuucucuacucaugccagauuuugggauuacaaauagaa

SEQ ID NO: 528181 - RNA, 64 nt, Human
caaggaggugggaggugcccuggaaauagcugccucaugccacuuaggccaugacuggauuuaa

SEQ ID NO: 528182 - RNA, 64 nt, Human
ccuccuucucuuccuuguugcuuaacuuuuuaauucaugccauaugcagauauccaauuaugug

SEQ ID NO: 528183 - RNA, 64 nt, Human; identical to SEQ ID NO: 37154

SEQ ID NO: 528184 - RNA, 64 nt, Human; identical to SEQ ID NO: 37155

SEQ ID NO: 528185 - RNA, 64 nt, Human; identical to SEQ ID NO: 37156

SEQ ID NO: 528186 - RNA, 64 nt, Human; identical to SEQ ID NO: 37157

SEQ ID NO: 528187 - RNA, 64 nt, Human; identical to SEQ ID NO: 37158

SEQ ID NO: 528188 - RNA, 64 nt, Human; identical to SEQ ID NO: 37159

SEQ ID NO: 528189 - RNA, 64 nt, Human; identical to SEQ ID NO: 37161

SEQ ID NO: 528190 - RNA, 64 nt, Human; identical to SEQ ID NO: 37162

SEQ ID NO: 528191 - RNA, 64 nt, Human; identical to SEQ ID NO: 37163

SEQ ID NO: 528192 - RNA, 64 nt, Human; identical to SEQ ID NO: 37164

SEQ ID NO: 528193 - RNA, 64 nt, Human; identical to SEQ ID NO: 37165

SEQ ID NO: 528194 - RNA, 64 nt, Human; identical to SEQ ID NO: 37166

SEQ ID NO: 528195 - RNA, 64 nt, Human; identical to SEQ ID NO: 37167

SEQ ID NO: 528196 - RNA, 64 nt, Human; identical to SEQ ID NO: 37168

SEQ ID NO: 528197 - RNA, 64 nt, Human; identical to SEQ ID NO: 37169

SEQ ID NO: 528198 - RNA, 64 nt, Human; identical to SEQ ID NO: 37170

SEQ ID NO: 528199 - RNA, 64 nt, Human
gaaaacuguuuguaugugguggcuuugaugguucucaugccaucaguuguguggaaauguauga

SEQ ID NO: 528200 - RNA, 64 nt, Human
gcucaagguagauggaaaucugaaaggagugugcucaugccauuuccagaccaagaaaauacau

SEQ ID NO: 528201 - RNA, 64 nt, Human
cugugcaucuaaauacuucuggagggcgacagauucaugccacggauaaaugaggcaaauccga

SEQ ID NO: 528202 - RNA, 64 nt, Human; identical to SEQ ID NO: 37171

SEQ ID NO: 528203 - RNA, 64 nt, Human; identical to SEQ ID NO: 37172

SEQ ID NO: 528204 - RNA, 64 nt, Human; identical to SEQ ID NO: 37173

SEQ ID NO: 528205 - RNA, 64 nt, Human; identical to SEQ ID NO: 37174

SEQ ID NO: 528206 - RNA, 64 nt, Human; identical to SEQ ID NO: 37175

SEQ ID NO: 528207 - RNA, 64 nt, Human; identical to SEQ ID NO: 37176

SEQ ID NO: 528208 - RNA, 64 nt, Human; identical to SEQ ID NO: 37177

SEQ ID NO: 528209 - RNA, 64 nt, Human; identical to SEQ ID NO: 37179

SEQ ID NO: 528210 - RNA, 64 nt, Human; identical to SEQ ID NO: 37180

SEQ ID NO: 528211 - RNA, 64 nt, Human; identical to SEQ ID NO: 37181

SEQ ID NO: 528212 - RNA, 64 nt, Human; identical to SEQ ID NO: 37182

SEQ ID NO: 528213 - RNA, 64 nt, Human; identical to SEQ ID NO: 37183

SEQ ID NO: 528214 - RNA, 64 nt, Human; identical to SEQ ID NO: 37184

SEQ ID NO: 528215 - RNA, 64 nt, Human; identical to SEQ ID NO: 37185

SEQ ID NO: 528216 - RNA, 64 nt, Human; identical to SEQ ID NO: 37186

SEQ ID NO: 528217 - RNA, 64 nt, Human; identical to SEQ ID NO: 37187

SEQ ID NO: 528218 - RNA, 64 nt, Human
ucauguuuuacaucuuuucuuucugccgcucggcuccggccauuuuguuuuauacaaaaauggg

SEQ ID NO: 528219 - RNA, 64 nt, Human
gccacagugaacacccacguuuauuccugccugcuccggccaggacugaaccccuucuccacac

SEQ ID NO: 528220 - RNA, 64 nt, Human
agccacgucgugcugcugcuggaagccaacagccuccggccagcagcccuacccggggcucaac

SEQ ID NO: 528221 - RNA, 51 nt, Human; identical to SEQ ID NO: 37201

SEQ ID NO: 528222 - RNA, 64 nt, Human; identical to SEQ ID NO: 115717

SEQ ID NO: 528223 - RNA, 63 nt, Human; identical to SEQ ID NO: 115718

SEQ ID NO: 528224 - RNA, 64 nt, Human; identical to SEQ ID NO: 115719

SEQ ID NO: 528225 - RNA, 64 nt, Human; identical to SEQ ID NO: 115720

SEQ ID NO: 528226 - RNA, 64 nt, Human; identical to SEQ ID NO: 115721

SEQ ID NO: 528227 - RNA, 64 nt, Human; identical to SEQ ID NO: 115722

SEQ ID NO: 528228 - RNA, 64 nt, Human; identical to SEQ ID NO: 115723

SEQ ID NO: 528229 - RNA, 64 nt, Human; identical to SEQ ID NO: 115724

SEQ ID NO: 528230 - RNA, 64 nt, Human; identical to SEQ ID NO: 115725

SEQ ID NO: 528231 - RNA, 64 nt, Human; identical to SEQ ID NO: 115726

SEQ ID NO: 528232 - RNA, 64 nt, Human; identical to SEQ ID NO: 115727

SEQ ID NO: 528233 - RNA, 64 nt, Human; identical to SEQ ID NO: 115728

SEQ ID NO: 528234 - RNA, 64 nt, Human; identical to SEQ ID NO: 115729

SEQ ID NO: 528235 - RNA, 64 nt, Human; identical to SEQ ID NO: 115730

SEQ ID NO: 528236 - RNA, 64 nt, Human; identical to SEQ ID NO: 115731

SEQ ID NO: 528237 - RNA, 64 nt, Human
acugaagggagggagaggaggggagccaagacacucaugccacucuggcucugaagggacaaag

SEQ ID NO: 528238 - RNA, 64 nt, Human
gcguaaaacaggccaucccaccaccucuaccugcucaugccaggagaauccauaacugccuaga

SEQ ID NO: 528239 - RNA, 64 nt, Human
ccaccuugcccaggcuggucuugaacuccugagcucaugccaucugccugccuuagucucccaa

SEQ ID NO: 528240 - RNA, 64 nt, Human
uuuccuguucuuaccuauuauuguauagagcuauucaugccauuuuuugggaaaacuuuaaaaa

SEQ ID NO: 528241 - RNA, 64 nt, Human; identical to SEQ ID NO: 37202

SEQ ID NO: 528242 - RNA, 64 nt, Human; identical to SEQ ID NO: 37203

SEQ ID NO: 528243 - RNA, 64 nt, Human; identical to SEQ ID NO: 37204

SEQ ID NO: 528244 - RNA, 64 nt, Human; identical to SEQ ID NO: 37205

SEQ ID NO: 528245 - RNA, 64 nt, Human; identical to SEQ ID NO: 37206

SEQ ID NO: 528246 - RNA, 64 nt, Human; identical to SEQ ID NO: 37207

SEQ ID NO: 528247 - RNA, 64 nt, Human; identical to SEQ ID NO: 37208

SEQ ID NO: 528248 - RNA, 64 nt, Human; identical to SEQ ID NO: 37209

SEQ ID NO: 528249 - RNA, 64 nt, Human; identical to SEQ ID NO: 37210

SEQ ID NO: 528250 - RNA, 64 nt, Human; identical to SEQ ID NO: 37211

SEQ ID NO: 528251 - RNA, 64 nt, Human; identical to SEQ ID NO: 37212

SEQ ID NO: 528252 - RNA, 64 nt, Human; identical to SEQ ID NO: 37213

SEQ ID NO: 528253 - RNA, 64 nt, Human; identical to SEQ ID NO: 37215

SEQ ID NO: 528254 - RNA, 64 nt, Human; identical to SEQ ID NO: 37216

SEQ ID NO: 528255 - RNA, 64 nt, Human; identical to SEQ ID NO: 37217

SEQ ID NO: 528256 - RNA, 64 nt, Human; identical to SEQ ID NO: 37218

SEQ ID NO: 528257 - RNA, 64 nt, Human; identical to SEQ ID NO: 143571

SEQ ID NO: 528258 - RNA, 64 nt, Human; identical to SEQ ID NO: 143572

SEQ ID NO: 528259 - RNA, 64 nt, Human; identical to SEQ ID NO: 3869

SEQ ID NO: 528260 - RNA, 64 nt, Human; identical to SEQ ID NO: 37219

SEQ ID NO: 528261 - RNA, 64 nt, Human; identical to SEQ ID NO: 37220

SEQ ID NO: 528262 - RNA, 64 nt, Human; identical to SEQ ID NO: 37221

SEQ ID NO: 528263 - RNA, 64 nt, Human; identical to SEQ ID NO: 37222

SEQ ID NO: 528264 - RNA, 64 nt, Human; identical to SEQ ID NO: 37223

SEQ ID NO: 528265 - RNA, 64 nt, Human; identical to SEQ ID NO: 37224

SEQ ID NO: 528266 - RNA, 64 nt, Human; identical to SEQ ID NO: 37225

SEQ ID NO: 528267 - RNA, 64 nt, Human; identical to SEQ ID NO: 37226

SEQ ID NO: 528268 - RNA, 64 nt, Human; identical to SEQ ID NO: 37227

SEQ ID NO: 528269 - RNA, 64 nt, Human; identical to SEQ ID NO: 37228

SEQ ID NO: 528270 - RNA, 64 nt, Human; identical to SEQ ID NO: 37229

SEQ ID NO: 528271 - RNA, 64 nt, Human; identical to SEQ ID NO: 37230

SEQ ID NO: 528272 - RNA, 64 nt, Human; identical to SEQ ID NO: 37231

SEQ ID NO: 528273 - RNA, 64 nt, Human; identical to SEQ ID NO: 37233

SEQ ID NO: 528274 - RNA, 64 nt, Human; identical to SEQ ID NO: 37234

SEQ ID NO: 528275 - RNA, 64 nt, Human; identical to SEQ ID NO: 37235

SEQ ID NO: 528276 - RNA, 64 nt, Human; identical to SEQ ID NO: 116105

SEQ ID NO: 528277 - RNA, 64 nt, Human; identical to SEQ ID NO: 122007

SEQ ID NO: 528278 - RNA, 64 nt, Human; identical to SEQ ID NO: 143576

SEQ ID NO: 528279 - RNA, 64 nt, Human; identical to SEQ ID NO: 37236

SEQ ID NO: 528280 - RNA, 64 nt, Human; identical to SEQ ID NO: 37237

SEQ ID NO: 528281 - RNA, 64 nt, Human; identical to SEQ ID NO: 37238

SEQ ID NO: 528282 - RNA, 64 nt, Human; identical to SEQ ID NO: 37239

SEQ ID NO: 528283 - RNA, 64 nt, Human; identical to SEQ ID NO: 37240

SEQ ID NO: 528284 - RNA, 64 nt, Human; identical to SEQ ID NO: 37241

SEQ ID NO: 528285 - RNA, 64 nt, Human; identical to SEQ ID NO: 37242

SEQ ID NO: 528286 - RNA, 64 nt, Human; identical to SEQ ID NO: 37243

SEQ ID NO: 528287 - RNA, 64 nt, Human; identical to SEQ ID NO: 37244

SEQ ID NO: 528288 - RNA, 64 nt, Human; identical to SEQ ID NO: 37245

SEQ ID NO: 528289 - RNA, 64 nt, Human; identical to SEQ ID NO: 37246

SEQ ID NO: 528290 - RNA, 64 nt, Human; identical to SEQ ID NO: 37247

SEQ ID NO: 528291 - RNA, 64 nt, Human; identical to SEQ ID NO: 37248

SEQ ID NO: 528292 - RNA, 64 nt, Human; identical to SEQ ID NO: 37249

SEQ ID NO: 528293 - RNA, 64 nt, Human; identical to SEQ ID NO: 37250

SEQ ID NO: 528294 - RNA, 64 nt, Human; identical to SEQ ID NO: 37251

SEQ ID NO: 528295 - RNA, 64 nt, Human; identical to SEQ ID NO: 143578

SEQ ID NO: 528296 - RNA, 64 nt, Human; identical to SEQ ID NO: 3883

SEQ ID NO: 528297 - RNA, 64 nt, Human; identical to SEQ ID NO: 116531

SEQ ID NO: 528298 - RNA, 64 nt, Human; identical to SEQ ID NO: 37252

SEQ ID NO: 528299 - RNA, 64 nt, Human; identical to SEQ ID NO: 37253

SEQ ID NO: 528300 - RNA, 64 nt, Human; identical to SEQ ID NO: 37254

SEQ ID NO: 528301 - RNA, 64 nt, Human; identical to SEQ ID NO: 37255

SEQ ID NO: 528302 - RNA, 64 nt, Human; identical to SEQ ID NO: 37256

SEQ ID NO: 528303 - RNA, 64 nt, Human; identical to SEQ ID NO: 37257

SEQ ID NO: 528304 - RNA, 64 nt, Human; identical to SEQ ID NO: 37258

SEQ ID NO: 528305 - RNA, 64 nt, Human; identical to SEQ ID NO: 37259

SEQ ID NO: 528306 - RNA, 64 nt, Human; identical to SEQ ID NO: 37260

SEQ ID NO: 528307 - RNA, 64 nt, Human; identical to SEQ ID NO: 37261

SEQ ID NO: 528308 - RNA, 63 nt, Human; identical to SEQ ID NO: 37262

SEQ ID NO: 528309 - RNA, 64 nt, Human; identical to SEQ ID NO: 37263

SEQ ID NO: 528310 - RNA, 64 nt, Human; identical to SEQ ID NO: 37264

SEQ ID NO: 528311 - RNA, 64 nt, Human; identical to SEQ ID NO: 37265

SEQ ID NO: 528312 - RNA, 64 nt, Human; identical to SEQ ID NO: 37266

SEQ ID NO: 528313 - RNA, 64 nt, Human; identical to SEQ ID NO: 37268

SEQ ID NO: 528314 - RNA, 64 nt, Human; identical to SEQ ID NO: 122428

SEQ ID NO: 528315 - RNA, 64 nt, Human; identical to SEQ ID NO: 143582

SEQ ID NO: 528316 - RNA, 64 nt, Human; identical to SEQ ID NO: 143583

SEQ ID NO: 528317 - RNA, 64 nt, Human; identical to SEQ ID NO: 37269

SEQ ID NO: 528318 - RNA, 64 nt, Human; identical to SEQ ID NO: 37270

SEQ ID NO: 528319 - RNA, 64 nt, Human; identical to SEQ ID NO: 37271

SEQ ID NO: 528320 - RNA, 64 nt, Human; identical to SEQ ID NO: 37272

SEQ ID NO: 528321 - RNA, 64 nt, Human; identical to SEQ ID NO: 37273

SEQ ID NO: 528322 - RNA, 64 nt, Human; identical to SEQ ID NO: 37274

SEQ ID NO: 528323 - RNA, 64 nt, Human; identical to SEQ ID NO: 37275

SEQ ID NO: 528324 - RNA, 64 nt, Human; identical to SEQ ID NO: 37276

SEQ ID NO: 528325 - RNA, 64 nt, Human; identical to SEQ ID NO: 37277

SEQ ID NO: 528326 - RNA, 64 nt, Human; identical to SEQ ID NO: 37278

SEQ ID NO: 528327 - RNA, 64 nt, Human; identical to SEQ ID NO: 37279

SEQ ID NO: 528328 - RNA, 64 nt, Human; identical to SEQ ID NO: 37280

SEQ ID NO: 528329 - RNA, 64 nt, Human; identical to SEQ ID NO: 37281

SEQ ID NO: 528330 - RNA, 64 nt, Human; identical to SEQ ID NO: 37282

SEQ ID NO: 528331 - RNA, 64 nt, Human; identical to SEQ ID NO: 37283

SEQ ID NO: 528332 - RNA, 64 nt, Human; identical to SEQ ID NO: 37284

SEQ ID NO: 528333 - RNA, 61 nt, Human
gcuucaugugguacacguaggcccugugcccuccggccaccuggaucccugccccucccca

SEQ ID NO: 528334 - RNA, 64 nt, Human
cccgcaggcgguagaaacaccuggagcgauggaauccggccaggacuccccuggcaccugacau

SEQ ID NO: 528335 - RNA, 64 nt, Human
acccccaggugcugggggcacagccccuccccacuccggccacgcccccacccaccccgcgugu

SEQ ID NO: 528336 - RNA, 64 nt, Human; identical to SEQ ID NO: 37286

SEQ ID NO: 528337 - RNA, 64 nt, Human; identical to SEQ ID NO: 37287

SEQ ID NO: 528338 - RNA, 64 nt, Human; identical to SEQ ID NO: 37288

SEQ ID NO: 528339 - RNA, 64 nt, Human; identical to SEQ ID NO: 37289

SEQ ID NO: 528340 - RNA, 64 nt, Human; identical to SEQ ID NO: 37290

SEQ ID NO: 528341 - RNA, 64 nt, Human; identical to SEQ ID NO: 37291

SEQ ID NO: 528342 - RNA, 63 nt, Human; identical to SEQ ID NO: 37292

SEQ ID NO: 528343 - RNA, 64 nt, Human; identical to SEQ ID NO: 37293

SEQ ID NO: 528344 - RNA, 64 nt, Human; identical to SEQ ID NO: 37294

SEQ ID NO: 528345 - RNA, 64 nt, Human; identical to SEQ ID NO: 37295

SEQ ID NO: 528346 - RNA, 64 nt, Human; identical to SEQ ID NO: 37296

SEQ ID NO: 528347 - RNA, 64 nt, Human; identical to SEQ ID NO: 37297

SEQ ID NO: 528348 - RNA, 64 nt, Human; identical to SEQ ID NO: 37298

SEQ ID NO: 528349 - RNA, 64 nt, Human; identical to SEQ ID NO: 37299

SEQ ID NO: 528350 - RNA, 64 nt, Human; identical to SEQ ID NO: 37300

SEQ ID NO: 528351 - RNA, 64 nt, Human; identical to SEQ ID NO: 37301

SEQ ID NO: 528352 - RNA, 64 nt, Human; identical to SEQ ID NO: 3884

SEQ ID NO: 528353 - RNA, 64 nt, Human; identical to SEQ ID NO: 117553

SEQ ID NO: 528354 - RNA, 64 nt, Human; identical to SEQ ID NO: 122445

SEQ ID NO: 528355 - RNA, 64 nt, Human; identical to SEQ ID NO: 37302

SEQ ID NO: 528356 - RNA, 64 nt, Human; identical to SEQ ID NO: 37304

SEQ ID NO: 528357 - RNA, 64 nt, Human; identical to SEQ ID NO: 37305

SEQ ID NO: 528358 - RNA, 64 nt, Human; identical to SEQ ID NO: 37306

SEQ ID NO: 528359 - RNA, 64 nt, Human; identical to SEQ ID NO: 37307

SEQ ID NO: 528360 - RNA, 64 nt, Human; identical to SEQ ID NO: 37308

SEQ ID NO: 528361 - RNA, 64 nt, Human; identical to SEQ ID NO: 37309

SEQ ID NO: 528362 - RNA, 64 nt, Human; identical to SEQ ID NO: 37310

SEQ ID NO: 528363 - RNA, 64 nt, Human; identical to SEQ ID NO: 37311

SEQ ID NO: 528364 - RNA, 64 nt, Human; identical to SEQ ID NO: 37312

SEQ ID NO: 528365 - RNA, 64 nt, Human; identical to SEQ ID NO: 37313

SEQ ID NO: 528366 - RNA, 64 nt, Human; identical to SEQ ID NO: 37314

SEQ ID NO: 528367 - RNA, 64 nt, Human; identical to SEQ ID NO: 37315

SEQ ID NO: 528368 - RNA, 64 nt, Human; identical to SEQ ID NO: 37316

SEQ ID NO: 528369 - RNA, 64 nt, Human; identical to SEQ ID NO: 37317

SEQ ID NO: 528370 - RNA, 64 nt, Human; identical to SEQ ID NO: 37318

SEQ ID NO: 528371 - RNA, 64 nt, Human; identical to SEQ ID NO: 143588

SEQ ID NO: 528372 - RNA, 64 nt, Human; identical to SEQ ID NO: 143589

SEQ ID NO: 528373 - RNA, 64 nt, Human; identical to SEQ ID NO: 143590

SEQ ID NO: 528374 - RNA, 64 nt, Human; identical to SEQ ID NO: 37319

SEQ ID NO: 528375 - RNA, 64 nt, Human; identical to SEQ ID NO: 37320

SEQ ID NO: 528376 - RNA, 64 nt, Human; identical to SEQ ID NO: 37321

SEQ ID NO: 528377 - RNA, 64 nt, Human; identical to SEQ ID NO: 37322

SEQ ID NO: 528378 - RNA, 64 nt, Human; identical to SEQ ID NO: 37323

SEQ ID NO: 528379 - RNA, 64 nt, Human; identical to SEQ ID NO: 37324

SEQ ID NO: 528380 - RNA, 64 nt, Human; identical to SEQ ID NO: 37325

SEQ ID NO: 528381 - RNA, 64 nt, Human; identical to SEQ ID NO: 37326

SEQ ID NO: 528382 - RNA, 64 nt, Human; identical to SEQ ID NO: 37327

SEQ ID NO: 528383 - RNA, 64 nt, Human; identical to SEQ ID NO: 37328

SEQ ID NO: 528384 - RNA, 64 nt, Human; identical to SEQ ID NO: 37329

SEQ ID NO: 528385 - RNA, 64 nt, Human; identical to SEQ ID NO: 37330

SEQ ID NO: 528386 - RNA, 64 nt, Human; identical to SEQ ID NO: 37331

SEQ ID NO: 528387 - RNA, 64 nt, Human; identical to SEQ ID NO: 37332

SEQ ID NO: 528388 - RNA, 64 nt, Human; identical to SEQ ID NO: 37333

SEQ ID NO: 528389 - RNA, 64 nt, Human; identical to SEQ ID NO: 37334

SEQ ID NO: 528390 - RNA, 64 nt, Human
ugaugcagccggaagggaagggacaccaaggaucuccggccaccagcagaagccagcagagagg

SEQ ID NO: 528391 - RNA, 64 nt, Human
ccagcccccucagcccagcccaccccacccgcuguccggccacauuccaaaccucuaccgucac

SEQ ID NO: 528392 - RNA, 64 nt, Human
cggggccccagcccacuccacccugccagcagcuuccggccaguccccacagccucaucagcuc

SEQ ID NO: 528393 - RNA, 64 nt, Human; identical to SEQ ID NO: 37335

SEQ ID NO: 528394 - RNA, 64 nt, Human; identical to SEQ ID NO: 37336

SEQ ID NO: 528395 - RNA, 64 nt, Human; identical to SEQ ID NO: 37337

SEQ ID NO: 528396 - RNA, 64 nt, Human; identical to SEQ ID NO: 37339

SEQ ID NO: 528397 - RNA, 64 nt, Human; identical to SEQ ID NO: 37340

SEQ ID NO: 528398 - RNA, 64 nt, Human; identical to SEQ ID NO: 37341

SEQ ID NO: 528399 - RNA, 64 nt, Human; identical to SEQ ID NO: 37342

SEQ ID NO: 528400 - RNA, 64 nt, Human; identical to SEQ ID NO: 37343

SEQ ID NO: 528401 - RNA, 64 nt, Human; identical to SEQ ID NO: 37344

SEQ ID NO: 528402 - RNA, 64 nt, Human; identical to SEQ ID NO: 37345

SEQ ID NO: 528403 - RNA, 64 nt, Human; identical to SEQ ID NO: 37346

SEQ ID NO: 528404 - RNA, 64 nt, Human; identical to SEQ ID NO: 37347

SEQ ID NO: 528405 - RNA, 64 nt, Human; identical to SEQ ID NO: 37348

SEQ ID NO: 528406 - RNA, 64 nt, Human; identical to SEQ ID NO: 37349

SEQ ID NO: 528407 - RNA, 64 nt, Human; identical to SEQ ID NO: 37350

SEQ ID NO: 528408 - RNA, 64 nt, Human; identical to SEQ ID NO: 37351

SEQ ID NO: 528409 - RNA, 64 nt, Human
caaaguucuaggauuacaggugugagccaccacguccggccaauuuuucucauuucuaugccuc

SEQ ID NO: 528410 - RNA, 64 nt, Human
agaaacgugagaaggagggucucuugcccaucucuccggccaccccgccaggaaacgacgagaa

SEQ ID NO: 528411 - RNA, 64 nt, Human
gccuggcuggaccaguacugcucucugcccgcucuccggccaacuguccugaacucccuacgcc

SEQ ID NO: 528412 - RNA, 64 nt, Human; identical to SEQ ID NO: 37352

SEQ ID NO: 528413 - RNA, 64 nt, Human; identical to SEQ ID NO: 37353

SEQ ID NO: 528414 - RNA, 64 nt, Human; identical to SEQ ID NO: 37354

SEQ ID NO: 528415 - RNA, 64 nt, Human; identical to SEQ ID NO: 37355

SEQ ID NO: 528416 - RNA, 64 nt, Human; identical to SEQ ID NO: 37357

SEQ ID NO: 528417 - RNA, 64 nt, Human; identical to SEQ ID NO: 37358

SEQ ID NO: 528418 - RNA, 64 nt, Human; identical to SEQ ID NO: 37359

SEQ ID NO: 528419 - RNA, 64 nt, Human; identical to SEQ ID NO: 37360

SEQ ID NO: 528420 - RNA, 64 nt, Human; identical to SEQ ID NO: 37361

SEQ ID NO: 528421 - RNA, 64 nt, Human; identical to SEQ ID NO: 37362

SEQ ID NO: 528422 - RNA, 64 nt, Human; identical to SEQ ID NO: 37363

SEQ ID NO: 528423 - RNA, 64 nt, Human; identical to SEQ ID NO: 37364

SEQ ID NO: 528424 - RNA, 64 nt, Human; identical to SEQ ID NO: 37365

SEQ ID NO: 528425 - RNA, 64 nt, Human; identical to SEQ ID NO: 37366

SEQ ID NO: 528426 - RNA, 64 nt, Human; identical to SEQ ID NO: 37367

SEQ ID NO: 528427 - RNA, 64 nt, Human; identical to SEQ ID NO: 37368

SEQ ID NO: 528428 - RNA, 64 nt, Human
uacauacacagacacgcaaucgcagauacgcccuuccggccacagaaacacaccauuacacaca

SEQ ID NO: 528429 - RNA, 64 nt, Human
cagaacccuaaagggagggaagguccuacaggucuccggccacccacacaaggaggaggaagag

SEQ ID NO: 528430 - RNA, 64 nt, Human
acaggaagcgccucggccucagcgucuggaccuauccggccacugcagagcacccgcuucuccc

SEQ ID NO: 528431 - RNA, 64 nt, Human; identical to SEQ ID NO: 37369

SEQ ID NO: 528432 - RNA, 64 nt, Human; identical to SEQ ID NO: 37370

SEQ ID NO: 528433 - RNA, 64 nt, Human; identical to SEQ ID NO: 37371

SEQ ID NO: 528434 - RNA, 64 nt, Human; identical to SEQ ID NO: 37372

SEQ ID NO: 528435 - RNA, 64 nt, Human; identical to SEQ ID NO: 37373

SEQ ID NO: 528436 - RNA, 64 nt, Human; identical to SEQ ID NO: 37375

SEQ ID NO: 528437 - RNA, 64 nt, Human; identical to SEQ ID NO: 37376

SEQ ID NO: 528438 - RNA, 64 nt, Human; identical to SEQ ID NO: 37377

SEQ ID NO: 528439 - RNA, 64 nt, Human; identical to SEQ ID NO: 37378

SEQ ID NO: 528440 - RNA, 64 nt, Human; identical to SEQ ID NO: 37379

SEQ ID NO: 528441 - RNA, 64 nt, Human; identical to SEQ ID NO: 37380

SEQ ID NO: 528442 - RNA, 64 nt, Human; identical to SEQ ID NO: 37381

SEQ ID NO: 528443 - RNA, 64 nt, Human; identical to SEQ ID NO: 37382

SEQ ID NO: 528444 - RNA, 64 nt, Human; identical to SEQ ID NO: 37383

SEQ ID NO: 528445 - RNA, 64 nt, Human; identical to SEQ ID NO: 37384

SEQ ID NO: 528446 - RNA, 64 nt, Human; identical to SEQ ID NO: 37385

SEQ ID NO: 528447 - RNA, 60 nt, Human
cucaagcucucaaguggugaccaccguccuuccggccagcugcagguggagcuggagcaa

SEQ ID NO: 528448 - RNA, 64 nt, Human
ucuuccccagcgucccccgacccacuucauccuuuccggccaucccucggaccuugaccccccu

SEQ ID NO: 528449 - RNA, 64 nt, Human
uccauggaaacauuuagacacaaaccuccccagcuccggccaagccaucauuugcuaccuggag

SEQ ID NO: 528450 - RNA, 64 nt, Human; identical to SEQ ID NO: 37386

SEQ ID NO: 528451 - RNA, 64 nt, Human; identical to SEQ ID NO: 37387

SEQ ID NO: 528452 - RNA, 64 nt, Human; identical to SEQ ID NO: 37388

SEQ ID NO: 528453 - RNA, 64 nt, Human; identical to SEQ ID NO: 37389

SEQ ID NO: 528454 - RNA, 64 nt, Human; identical to SEQ ID NO: 37390

SEQ ID NO: 528455 - RNA, 64 nt, Human; identical to SEQ ID NO: 37391

SEQ ID NO: 528456 - RNA, 64 nt, Human; identical to SEQ ID NO: 37393

SEQ ID NO: 528457 - RNA, 64 nt, Human; identical to SEQ ID NO: 37394

SEQ ID NO: 528458 - RNA, 64 nt, Human; identical to SEQ ID NO: 37395

SEQ ID NO: 528459 - RNA, 64 nt, Human; identical to SEQ ID NO: 37396

SEQ ID NO: 528460 - RNA, 64 nt, Human; identical to SEQ ID NO: 37397

SEQ ID NO: 528461 - RNA, 64 nt, Human; identical to SEQ ID NO: 37398

SEQ ID NO: 528462 - RNA, 64 nt, Human; identical to SEQ ID NO: 37399

SEQ ID NO: 528463 - RNA, 64 nt, Human; identical to SEQ ID NO: 37400

SEQ ID NO: 528464 - RNA, 64 nt, Human; identical to SEQ ID NO: 37401

SEQ ID NO: 528465 - RNA, 64 nt, Human; identical to SEQ ID NO: 37402

SEQ ID NO: 528466 - RNA, 64 nt, Human
ugggguccauucuuugucccucagcuucucagaguccggccagcccuuguguucccgugcccca

SEQ ID NO: 528467 - RNA, 64 nt, Human
ccuccuggacugcuucuuuuggcucuccgacaacuccggccaauaaacacuuucugaauugagu

SEQ ID NO: 528468 - RNA, 64 nt, Human
cuuccacuccuccccgcaggccccaaggcaucacuccggccacccugucccgcuacugcuuaca

SEQ ID NO: 528469 - RNA, 64 nt, Human; identical to SEQ ID NO: 37403

SEQ ID NO: 528470 - RNA, 64 nt, Human; identical to SEQ ID NO: 37404

SEQ ID NO: 528471 - RNA, 64 nt, Human; identical to SEQ ID NO: 37405

SEQ ID NO: 528472 - RNA, 64 nt, Human; identical to SEQ ID NO: 37406

SEQ ID NO: 528473 - RNA, 64 nt, Human; identical to SEQ ID NO: 37407

SEQ ID NO: 528474 - RNA, 64 nt, Human; identical to SEQ ID NO: 37408

SEQ ID NO: 528475 - RNA, 64 nt, Human; identical to SEQ ID NO: 37409

SEQ ID NO: 528476 - RNA, 64 nt, Human; identical to SEQ ID NO: 37410

SEQ ID NO: 528477 - RNA, 56 nt, Human; identical to SEQ ID NO: 37411

SEQ ID NO: 528478 - RNA, 64 nt, Human; identical to SEQ ID NO: 37412

SEQ ID NO: 528479 - RNA, 64 nt, Human; identical to SEQ ID NO: 37413

SEQ ID NO: 528480 - RNA, 64 nt, Human; identical to SEQ ID NO: 37414

SEQ ID NO: 528481 - RNA, 64 nt, Human; identical to SEQ ID NO: 37415

SEQ ID NO: 528482 - RNA, 64 nt, Human; identical to SEQ ID NO: 37416

SEQ ID NO: 528483 - RNA, 57 nt, Human; identical to SEQ ID NO: 37417

SEQ ID NO: 528484 - RNA, 64 nt, Human; identical to SEQ ID NO: 37418

SEQ ID NO: 528485 - RNA, 64 nt, Human
gggccaccgcgcuaggcucgggacagcuggucuuuccggccaucuuucuugcuggcaagucagc

SEQ ID NO: 528486 - RNA, 64 nt, Human
ggggagauuuccacuguggaaaccgccugggaauuccggccagcagcuuccuccuucagccacc

SEQ ID NO: 528487 - RNA, 64 nt, Human
cuuugccauuugcuuguacugggacauuguucuuuccggccaaggugccaccacccugcccccc

SEQ ID NO: 528488 - RNA, 64 nt, Human; identical to SEQ ID NO: 37419

SEQ ID NO: 528489 - RNA, 64 nt, Human; identical to SEQ ID NO: 37420

SEQ ID NO: 528490 - RNA, 64 nt, Human; identical to SEQ ID NO: 37421

SEQ ID NO: 528491 - RNA, 64 nt, Human; identical to SEQ ID NO: 37422

SEQ ID NO: 528492 - RNA, 64 nt, Human; identical to SEQ ID NO: 37423

SEQ ID NO: 528493 - RNA, 64 nt, Human; identical to SEQ ID NO: 37424

SEQ ID NO: 528494 - RNA, 64 nt, Human; identical to SEQ ID NO: 37425

SEQ ID NO: 528495 - RNA, 64 nt, Human; identical to SEQ ID NO: 37426

SEQ ID NO: 528496 - RNA, 64 nt, Human; identical to SEQ ID NO: 37428

SEQ ID NO: 528497 - RNA, 64 nt, Human; identical to SEQ ID NO: 37429

SEQ ID NO: 528498 - RNA, 64 nt, Human; identical to SEQ ID NO: 37430

SEQ ID NO: 528499 - RNA, 64 nt, Human; identical to SEQ ID NO: 478046

SEQ ID NO: 528500 - RNA, 64 nt, Human; identical to SEQ ID NO: 478047

SEQ ID NO: 528501 - RNA, 64 nt, Human; identical to SEQ ID NO: 478048

SEQ ID NO: 528502 - RNA, 64 nt, Human; identical to SEQ ID NO: 478049

SEQ ID NO: 528503 - RNA, 64 nt, Human; identical to SEQ ID NO: 143564

SEQ ID NO: 528504 - RNA, 64 nt, Human; identical to SEQ ID NO: 143565

SEQ ID NO: 528505 - RNA, 64 nt, Human; identical to SEQ ID NO: 143566

SEQ ID NO: 528506 - RNA, 64 nt, Human; identical to SEQ ID NO: 478050

SEQ ID NO: 528507 - RNA, 64 nt, Human; identical to SEQ ID NO: 478051

SEQ ID NO: 528508 - RNA, 64 nt, Human; identical to SEQ ID NO: 478052

SEQ ID NO: 528509 - RNA, 64 nt, Human; identical to SEQ ID NO: 478053

SEQ ID NO: 528510 - RNA, 64 nt, Human; identical to SEQ ID NO: 478054

SEQ ID NO: 528511 - RNA, 64 nt, Human; identical to SEQ ID NO: 478055

SEQ ID NO: 528512 - RNA, 64 nt, Human; identical to SEQ ID NO: 478059

SEQ ID NO: 528513 - RNA, 64 nt, Human; identical to SEQ ID NO: 478060

SEQ ID NO: 528514 - RNA, 64 nt, Human; identical to SEQ ID NO: 478061

SEQ ID NO: 528515 - RNA, 64 nt, Human; identical to SEQ ID NO: 478062

SEQ ID NO: 528516 - RNA, 64 nt, Human; identical to SEQ ID NO: 478063

SEQ ID NO: 528517 - RNA, 64 nt, Human; identical to SEQ ID NO: 478064

SEQ ID NO: 528518 - RNA, 64 nt, Human; identical to SEQ ID NO: 478065

SEQ ID NO: 528519 - RNA, 64 nt, Human; identical to SEQ ID NO: 478066

SEQ ID NO: 528520 - RNA, 64 nt, Human; identical to SEQ ID NO: 478067

SEQ ID NO: 528521 - RNA, 64 nt, Human; identical to SEQ ID NO: 478068

SEQ ID NO: 528522 - RNA, 64 nt, Human; identical to SEQ ID NO: 3868

SEQ ID NO: 528523 - RNA, 64 nt, Human; identical to SEQ ID NO: 116087

SEQ ID NO: 528524 - RNA, 64 nt, Human; identical to SEQ ID NO: 121900

SEQ ID NO: 528525 - RNA, 64 nt, Human; identical to SEQ ID NO: 478069

SEQ ID NO: 528526 - RNA, 64 nt, Human; identical to SEQ ID NO: 478070

SEQ ID NO: 528527 - RNA, 64 nt, Human; identical to SEQ ID NO: 478071

SEQ ID NO: 528528 - RNA, 64 nt, Human; identical to SEQ ID NO: 478072

SEQ ID NO: 528529 - RNA, 64 nt, Human; identical to SEQ ID NO: 478073

SEQ ID NO: 528530 - RNA, 64 nt, Human; identical to SEQ ID NO: 478074

SEQ ID NO: 528531 - RNA, 64 nt, Human; identical to SEQ ID NO: 478078

SEQ ID NO: 528532 - RNA, 64 nt, Human; identical to SEQ ID NO: 478079

SEQ ID NO: 528533 - RNA, 64 nt, Human; identical to SEQ ID NO: 478080

SEQ ID NO: 528534 - RNA, 64 nt, Human; identical to SEQ ID NO: 478081

SEQ ID NO: 528535 - RNA, 64 nt, Human; identical to SEQ ID NO: 478082

SEQ ID NO: 528536 - RNA, 64 nt, Human; identical to SEQ ID NO: 478083

SEQ ID NO: 528537 - RNA, 64 nt, Human; identical to SEQ ID NO: 478084

SEQ ID NO: 528538 - RNA, 64 nt, Human; identical to SEQ ID NO: 478085

SEQ ID NO: 528539 - RNA, 64 nt, Human; identical to SEQ ID NO: 478086

SEQ ID NO: 528540 - RNA, 64 nt, Human; identical to SEQ ID NO: 478087

SEQ ID NO: 528541 - RNA, 64 nt, Human
ugcagucucacuugggacaggccacagccagggguccggccacuacccgcccgugggauaaaag

SEQ ID NO: 528542 - RNA, 64 nt, Human
caauucauugagagauugcaaagcugaaagcaccuccggccacuccugggagacagacccuuug

SEQ ID NO: 528543 - RNA, 64 nt, Human
ggagggggcugcagguuggaacuaugcagugugcuccggccacacauccugcugggcccccuac

SEQ ID NO: 528544 - RNA, 64 nt, Human; identical to SEQ ID NO: 478088

SEQ ID NO: 528545 - RNA, 64 nt, Human; identical to SEQ ID NO: 478089

SEQ ID NO: 528546 - RNA, 64 nt, Human; identical to SEQ ID NO: 478090

SEQ ID NO: 528547 - RNA, 64 nt, Human; identical to SEQ ID NO: 478091

SEQ ID NO: 528548 - RNA, 64 nt, Human; identical to SEQ ID NO: 143547

SEQ ID NO: 528549 - RNA, 64 nt, Human; identical to SEQ ID NO: 143548

SEQ ID NO: 528550 - RNA, 64 nt, Human; identical to SEQ ID NO: 143549

SEQ ID NO: 528551 - RNA, 64 nt, Human; identical to SEQ ID NO: 143550

SEQ ID NO: 528552 - RNA, 64 nt, Human; identical to SEQ ID NO: 122462

SEQ ID NO: 528553 - RNA, 64 nt, Human; identical to SEQ ID NO: 143552

SEQ ID NO: 528554 - RNA, 64 nt, Human; identical to SEQ ID NO: 143553

SEQ ID NO: 528555 - RNA, 64 nt, Human; identical to SEQ ID NO: 143554

SEQ ID NO: 528556 - RNA, 64 nt, Human; identical to SEQ ID NO: 3902

SEQ ID NO: 528557 - RNA, 64 nt, Human; identical to SEQ ID NO: 117960

SEQ ID NO: 528558 - RNA, 64 nt, Human; identical to SEQ ID NO: 122479

SEQ ID NO: 528559 - RNA, 64 nt, Human; identical to SEQ ID NO: 143558

SEQ ID NO: 528560 - RNA, 50 nt, Human; identical to SEQ ID NO: 14033

SEQ ID NO: 528561 - RNA, 64 nt, Human
agguauuuccugaaaguguauacaaauuauuuccucgcccaaaauaaagcaccacuucaaggug

SEQ ID NO: 528562 - RNA, 64 nt, Human
ccacccuacagauauaagagguuaaaauaacaguucgcccaauuuaagcccaguagugucaguu

SEQ ID NO: 528563 - RNA, 64 nt, Human
ccacccuauuuauuuccguugucucucugcugugucgcccaacacuucccagggugcugcugcc

SEQ ID NO: 528564 - RNA, 64 nt, Human
gcugaaccugcagauaugcgcccagagauauggaucgcccaagaguugcggcguauuggagacg

SEQ ID NO: 528565 - RNA, 64 nt, Human
aaggaaccacccccauuccuaaauaugugaaaagucgcccaaaaugcaaccuugaaaggcacua

SEQ ID NO: 528566 - RNA, 64 nt, Human
cccacacaggaauucugcugagguccccccuccuuccggccaauggcagaagugggggaaaauu

SEQ ID NO: 528567 - RNA, 64 nt, Human
uuagaggcccaggcugucugccugcgguccuuccuccggccagaguggaggccccaggcugcua

SEQ ID NO: 528568 - RNA, 64 nt, Human; identical to SEQ ID NO: 528541

SEQ ID NO: 528569 - RNA, 64 nt, Human
uuuuguuuuuuuuuggagauggagucucgcucugucgcccaagcuggaguacaguggugcaauc

SEQ ID NO: 528570 - RNA, 64 nt, Human
uacaccuacuacucaauuguucuuuuccuuucucucgcccaacacgaucuuguaagauggauuu

SEQ ID NO: 528571 - RNA, 64 nt, Human
uccuuccuaccugccuccccucugcuggugcaccucgcccaacucauucuuacugcacaguuca

SEQ ID NO: 528572 - RNA, 64 nt, Human
gaaucgcccgaucacagacgagcggccaccggaaucgcccaaucacagacaagcagucaucgga

SEQ ID NO: 528573 - RNA, 64 nt, Human
cuugguauuucccugacagagagaaccagcaguuucgcccaaauccuacucugcugggaaaucu

SEQ ID NO: 528574 - RNA, 64 nt, Human
gauagaaaaaaaugcauuauauuugagagcuacuucgcccaaauuacaaaaugaguguuuuuag

SEQ ID NO: 528575 - RNA, 64 nt, Human
uuuuuuuuuuuuuugagacggagucccacucuugucgcccaacuagaguguaguggcacaaucu

SEQ ID NO: 528576 - RNA, 64 nt, Human
uaccuuugguagucagguuuggcuacuuugcagcucgcccaaagagauacaaccuaauccccaa

SEQ ID NO: 528577 - RNA, 64 nt, Human
gggugaugugaaaaaggacuauggccacauucaaucgcccaacuacccagacgauuaccggccc

SEQ ID NO: 528578 - RNA, 64 nt, Human
acuuaacugacgcccucuuccuccaacugaaggaucgcccaacguuuuuggauuauagaauuau

SEQ ID NO: 528579 - RNA, 64 nt, Human
cguaaacgacacucucuggaagcccuggagacccucgcccaacuccaccagauagcagaggggu

SEQ ID NO: 528580 - RNA, 64 nt, Human
cgugcacccccgcuagcgccccaccccgcgucugucgcccaauaaaggcaucuuugucgggagu

SEQ ID NO: 528581 - RNA, 64 nt, Human
gaaagccaggauuuggggcuaggcgggaagauguucgcccaauugcuugggggguuggggggau

SEQ ID NO: 528582 - RNA, 64 nt, Human
cuaguccggguuccauucuuuucaccagcacccaucgcccaagggguaccgaggggggcaaggg

SEQ ID NO: 528583 - RNA, 64 nt, Human
acagccacacagccacgcccccugauucuggaacucgcccaacuucccuacuggcugcuccccu

SEQ ID NO: 528584 - RNA, 64 nt, Human
guacugcuagcuguagaacuccagcuucggccugucgcccaaucaaacuguccuguuacugaac

SEQ ID NO: 528585 - RNA, 64 nt, Human
ccuucuggcccuccagcagcaugauggcacgcugucgcccaaagacagcuugcaccacagcgcu

SEQ ID NO: 528586 - RNA, 64 nt, Human
aaaccugaguaucaguacaugccuagaccugggcuccggccagcgcccaacagcguggaugucg

SEQ ID NO: 528587 - RNA, 64 nt, Human
caucgauucucauugaggagaaaccuugggcagcuccggccaggccuuguaggaaaaggccccg

SEQ ID NO: 528588 - RNA, 64 nt, Human
gcugcucucccggcucggcccggccgccucugucuccggccaccggguggcgcugccgagccag

SEQ ID NO: 528589 - RNA, 64 nt, Human
uagcugugugcggggccugaaggggaguggguucucgcccaaagagcaucugcccauuucccac

SEQ ID NO: 528590 - RNA, 64 nt, Human
cauguguagccccaccagcccuccaaggcauugcucgcccaagcagcugguaauuccauuucau

SEQ ID NO: 528591 - RNA, 64 nt, Human
ggcacuggggccucagccugcuuuccugcagcagucgcccaagcagacagcccuggcaaaugcc

SEQ ID NO: 528592 - RNA, 64 nt, Human
uauaggucagugaggcccagggagaggccaugauucgcccaaagccagacagcaacggggaggc

SEQ ID NO: 528593 - RNA, 64 nt, Human
cacgaguuauuuaaaacaguuacacugcaggguuucgcccaauaaagguggacugacauucccu

SEQ ID NO: 528594 - RNA, 64 nt, Human
ccaggauggcugagggcggagucuauuuuacgcgucgcccaaugacaggaccuggaauguacug

SEQ ID NO: 528595 - RNA, 64 nt, Human
ugguggagcuguucuguagccgggaugacagcucucgcccaagccgagcaugccccgggccccc

SEQ ID NO: 528596 - RNA, 64 nt, Human
gugauagcugugacuuacuugucuuacugccaaaucgcccaaauuuggaacugcuugucccaug

SEQ ID NO: 528597 - RNA, 64 nt, Human
ccaaggcaggcagccccgacaucugcuuccucuaucgcccaaugcaaaaucgaugaaaugggga

SEQ ID NO: 528598 - RNA, 64 nt, Human
uggaacuauggaccacauuagacugggcagagauucgcccaaccccuagcacuccggcucuggg

SEQ ID NO: 528599 - RNA, 64 nt, Human
ugggggagggagggagggaguuggcaguuucaaaucgcccaagugaugaauaaaguaucuggcu

SEQ ID NO: 528600 - RNA, 64 nt, Human
cgcaaguauucugcccgccucccaccaucagccuucgcccaaggggcccuucugccucugcuuc

SEQ ID NO: 528601 - RNA, 64 nt, Human
uuuuuuuuuuuuuuugagacagagucucguucugucgcccaagcuggagcgcaauggugugauc

SEQ ID NO: 528602 - RNA, 64 nt, Human
auauuuuuaauuuuuuuaacagggucuuccucucucgcccaaguucucaugccucagccuccca

SEQ ID NO: 528603 - RNA, 64 nt, Human
gacugggacaaucagggaccuggauuggacgggaucgcccaacuucacugggacuggacaggga

SEQ ID NO: 528604 - RNA, 64 nt, Human
uggcuuuguggccguccaagugccaauuggcuuuucgcccaaauaagggcugguauuucuccuc

SEQ ID NO: 528605 - RNA, 64 nt, Human
uuuuugcuuuggcuauauuuacacgugacuuuaaucgcccaacugugacuagucauugcagcua

SEQ ID NO: 528606 - RNA, 64 nt, Human
ugcacacauugcagacuagcugccuagaccucgcuccggccacguccaacacgacgcauccuug

SEQ ID NO: 528607 - RNA, 64 nt, Human
aaaagugcugggauuacaggcgugagccaccacauccggccagugcacucuuaauacacagaaa

SEQ ID NO: 528608 - RNA, 64 nt, Human
gcguggcaacccucacuguguuggaggauggcacuccggccaccuccuccaucucuggccauau

SEQ ID NO: 528609 - RNA, 64 nt, Human
aaacaaagcaccaauuagcagucucuucccauuuucgcccaacuuaucccccaccuccaucccu

SEQ ID NO: 528610 - RNA, 64 nt, Human
ggcagccccgacgguuuccacagcgagcgccagcuccggccagccugggacagcucaucccagc

SEQ ID NO: 528611 - RNA, 64 nt, Human
uuuccuuucccuuggcuggcuggguccagccaucuccggccagcaacccugucaguguuccacc

SEQ ID NO: 528612 - RNA, 64 nt, Human
augauccucagauuuggggacugaguuuggauaguccggccagugcacagaugauaaccggcac

SEQ ID NO: 528613 - RNA, 64 nt, Human
aguaagguuggcccuuggaggccauguuugggucuccggccagggccuagggcuaggccaugca

SEQ ID NO: 528614 - RNA, 64 nt, Human
aguccgggagggaggugggggggucagucccccguccggccagccgccccguccgggaggugag

SEQ ID NO: 528615 - RNA, 64 nt, Human
cggcugcccuccucacacucggcuccgcgccgccuccggccaccgugcgcucccgcguggggcg

SEQ ID NO: 528616 - RNA, 64 nt, Human
aggugacaugucuacuuuuuaauuuuuaagagcauccggccaaaugcaaaauuaguaccucaaa

SEQ ID NO: 528617 - RNA, 64 nt, Human
gguuuagaugcaggagaacaguaagauggaugguuccggccagagucgauguggggaggaacag

SEQ ID NO: 528618 - RNA, 64 nt, Human
cucccuggggaaccuacuuucugcucagugaggcuccggccagaaaccuggaguccuuauccuc

SEQ ID NO: 528619 - RNA, 64 nt, Human
cucagucauccugcaggcacaugagggggugcccuccggccaccuguacuguaucagccccaag

SEQ ID NO: 528620 - RNA, 64 nt, Human
ucuucacuugggccauuguuggugggggcuccuuuccggccagaccacaaggccagaagcaaua

SEQ ID NO: 528621 - RNA, 64 nt, Human
ugcaccaaaugucagaagcuuggcaugaccucauuccggccacaucauucugugucucugcauc

SEQ ID NO: 528622 - RNA, 64 nt, Human
gucaccuguguucucugacaggucacucaguuccuccggccacagcugccccucugugagauga

SEQ ID NO: 528623 - RNA, 64 nt, Human
uccguuaggaauaacacugcagcccucuccacccuccggccagcgaguggucaaggauuuuuau

SEQ ID NO: 528624 - RNA, 64 nt, Human
caguggggcccuucucugcagucaagcccugugcuccggccauggccgcuguguccgccgcacc

SEQ ID NO: 528625 - RNA, 64 nt, Human
gcaucugcuggagcaaagggaaaccgugggcuuuuccggccagauacucuugagcucugugacc

SEQ ID NO: 528626 - RNA, 64 nt, Human
accagagagguuucucuaccauuagcuucccucuuccggccauucuucacaaagucauuuuucu

SEQ ID NO: 528627 - RNA, 64 nt, Human
agcuucuggaguuugucaguggaggcagaggggauccggccaggccccucuguccagaaggagc

SEQ ID NO: 528628 - RNA, 64 nt, Human
uccugcccgucagggcaccuuuuccucagagcaauccggccacacgaauagaaggcugucguga

SEQ ID NO: 528629 - RNA, 64 nt, Human
gcaagggaugccaguaagucugcaggugcggggugccaccuacaggcccaggccugugucccaa

SEQ ID NO: 528630 - RNA, 64 nt, Human
auucuaaggaaucaugaaccuugccuggacauuugccaccuaaacgaucaguguggugcugcgu

SEQ ID NO: 528631 - RNA, 64 nt, Human
uaagucauuuuccccuuagagugcuugaagaaaugccaccuacagguuguguacuuuucauaau

SEQ ID NO: 528632 - RNA, 64 nt, Human
cgccgcuuggaaagugcagccuucuacagguagagccaccuagaaaugcauauggcugcaaagg

SEQ ID NO: 528633 - RNA, 64 nt, Human
gagaauauauuagaguuguggguaauuuuucacagccaccuauguacauacuaauuacccauug

SEQ ID NO: 528634 - RNA, 64 nt, Human
uuuccagauggcgaggucacagcagagagauguggccaccuagccuuuccuuauccccuucccu

SEQ ID NO: 528635 - RNA, 64 nt, Human
ccacucaaccugucagcuugcaccauccccaccugccaccuacagucaggccacaugccugguc

SEQ ID NO: 528636 - RNA, 64 nt, Human
ggggaacccugaggguguggguagaguagcaggggccaccuaagagauuaaaaacagucuguuu

SEQ ID NO: 528637 - RNA, 64 nt, Human
aaugcgccuccuccucggagacagacgcaucggugccaccuaguggcuggugggaguaacagcu

SEQ ID NO: 528638 - RNA, 64 nt, Human
aucuccuguccuggccucucugaagcagacaagggccaccuaucccggggguggaugcugaguc

SEQ ID NO: 528639 - RNA, 64 nt, Human
gccugcagcgcggcccgugacacggcgcccacuugccaccuaggcgcucugguggcccuugcag

SEQ ID NO: 528640 - RNA, 64 nt, Human
cuguaaagacacagaagaugcugaccucaccccugccaccuaucccaagaccucacuggucugu

SEQ ID NO: 528641 - RNA, 64 nt, Human
uuuugauacuggaggaacacuugauggagugugagccaccuaagaucucgguuugccaaaauuc

SEQ ID NO: 528642 - RNA, 64 nt, Human
auguuuuccuaacuuuuuguauuuuucuuguauagccaccuagagaauucuucauagauuaaga

SEQ ID NO: 528643 - RNA, 62 nt, Human
ggccccuuugauggacauaaaggcucuuuucagagccaccuacuaucucgagaaaagagccg

SEQ ID NO: 528644 - RNA, 64 nt, Human
acagauauuuuuguuucucaucuuaacuauccaagccaccuauuuuauuuguucuuucaucugu

SEQ ID NO: 528645 - RNA, 64 nt, Human
cccguugagguuggagagggaaaauaaagaagcugccaccuaacaggagucacccaggaaagca

SEQ ID NO: 528646 - RNA, 64 nt, Human
uuucuuucacgguuacuguuccugaaaagaaaaagccaccuagcccuaucaagccaaagauucc

SEQ ID NO: 528647 - RNA, 64 nt, Human
augucuucuuuccaccucccacugccccuccccugccaccuaucaaugaugccuugguucaguc

SEQ ID NO: 528648 - RNA, 64 nt, Human
ucauaucaggaugaccucgagagcugaggcucuagccaccuaaaaccacgugcccaaacccacc

SEQ ID NO: 528649 - RNA, 64 nt, Human
aaacaaaaaacaagaccucuuuucuuuagauggugccaccuaugcccaccacaacagagauuuu

SEQ ID NO: 528650 - RNA, 64 nt, Human
uauagcaaaacuuuuaaacuacagguaguuaagggccaccuacaauacaucugagguccuguga

SEQ ID NO: 528651 - RNA, 64 nt, Human
ggcagggacuaggcugaagaugugucuucuccccgccaccuacuguaugacaccacauucuucc

SEQ ID NO: 528652 - RNA, 64 nt, Human
gcugccugccaaucguccagcacccuccaccuuugccaccuauuucuuguuguaaaacagaugu

SEQ ID NO: 528653 - RNA, 64 nt, Human
uaauauugcccuaaguacaacuaggcaagugauugccaccuaaaucagaagacguucuaaaguc

SEQ ID NO: 528654 - RNA, 64 nt, Human
uguuuugcguuuuauacaugaggucagugcuacagccaccuagcaugaacuaacccagcuucca

SEQ ID NO: 528655 - RNA, 64 nt, Human
ugcaagccuggauacaauuaaccauuuuauauuugccaccuacaaaaaaacacccaauaucuuc

SEQ ID NO: 528656 - RNA, 64 nt, Human
gagaaauuacaaagcccgagcucuuucuuauaaugccaccuaucccuguaagcuaaacaaacaa

SEQ ID NO: 528657 - RNA, 64 nt, Human
auacaacuacaaggaaaaaaaugcauuuaaccaugccaccuaugagugccagugacuuauuuua

SEQ ID NO: 528658 - RNA, 64 nt, Human
aaaaaucuaaaaauucuugcaaugaguaguauaagccaccuauuuuuacuuccuucucugaaau

SEQ ID NO: 528659 - RNA, 64 nt, Human
gcaaguauuccauuugcauuugguaauuuuucaugccaccuauuuaugaauauauaaaucuuua

SEQ ID NO: 528660 - RNA, 64 nt, Human
uagcuuugcugcuauauagguguuauguguaaaugccaccuauuaauacgggacugaaaacguu

SEQ ID NO: 528661 - RNA, 64 nt, Human
caaauuauacuggguucggauugugaaaacauuggccaccuaguagcaguggugaggaguggga

SEQ ID NO: 528662 - RNA, 64 nt, Human
cuggcuauuuauuauaaaguacugaagucacauagccaccuauaaaacagcauagaaaugucug

SEQ ID NO: 528663 - RNA, 64 nt, Human
caacaaauuauguggucaaauaauauagucauuagccaccuaaacauuuuaauuccagauauua

SEQ ID NO: 528664 - RNA, 64 nt, Human
agugcggcuuucugggcacaggugucacugcucugccaccuaucacuauucuuuuucuguucag

SEQ ID NO: 528665 - RNA, 64 nt, Human
aaaaucuauuaugguuaauuucauuucuugcuuugccaccuaagcaguaaaacaugauauugac

SEQ ID NO: 528666 - RNA, 64 nt, Human
uuuguuggcaaaagaaucucaggaacggcccugggccaccuacuauauuaaucaugcuaguaac

SEQ ID NO: 528667 - RNA, 64 nt, Human
caguucccuucagaggcugcauuugccuucuucugccaccuaaauauuacuucccuucaaaucu

SEQ ID NO: 528668 - RNA, 64 nt, Human
cagccauacugggaaaacuuacuuuucauggagugccaccuaacagugaauguauuagaguaua

SEQ ID NO: 528669 - RNA, 62 nt, Human
cucaaucccaaaggaaccaaaggcucuuuucagagccaccuacaauuuuguggaagaacuga

SEQ ID NO: 528670 - RNA, 62 nt, Human
agaaucacuuuccaauacaacggcucuuuucagagccaccuacuauuucugcgggagagcug

SEQ ID NO: 528671 - RNA, 64 nt, Human
accaaagaggaccccacucugaagccagccuggagccaccuaccucuggccucaggcugugggc

SEQ ID NO: 528672 - RNA, 64 nt, Human
cuggagcaucugaucugucucuaugccaccacuggccaccuagagcccuuggcugugguaaucc

SEQ ID NO: 528673 - RNA, 64 nt, Human
cugcccuccccuuccccuuuacucagcccagcuggccaccuagaagucucccugcacagccucu

SEQ ID NO: 528674 - RNA, 64 nt, Human
ggagcagggaguugcccuuccccucccucgggaagccaccuaagaauguuuacaugccaaacag

SEQ ID NO: 528675 - RNA, 64 nt, Human
cuuguuccaguaugaaaguugggggagagcaccagccaccuaggaaaacuguauguuaccuuuu

SEQ ID NO: 528676 - RNA, 64 nt, Human
ugaaauuugcacauuuaauugucccuaauagaaagccaccuauucuuuguuggauuucuucaag

SEQ ID NO: 528677 - RNA, 62 nt, Human
ucugugucagaaaaaacaaaaggcucuuuucagagccaccuaccgucucagaaaaaggcugu

SEQ ID NO: 528678 - RNA, 62 nt, Human
aguuucuucuaguaacccaacggcucuuuuaagagccaccuacgcauuucaggaaaagagcu

SEQ ID NO: 528679 - RNA, 63 nt, Human
caaaaucagccuaacagcaaaggcucuuuucagagccaccuacgacuuccauuaaaugagcug

SEQ ID NO: 528680 - RNA, 62 nt, Human
guaagcacuuccaaacccaaaggcucuuuucagagccaccuacuuugucacaaggagagcua

SEQ ID NO: 528681 - RNA, 62 nt, Human
guacacuaccgcaaaaccaacggcccuuuucagggccaccuauccacucaggagaaagagua

SEQ ID NO: 528682 - RNA, 62 nt, Human
uaccucgguccaaaccaaaaagguucuuuucagagccaccuacuuuuucaccaaguagagcu

SEQ ID NO: 528683 - RNA, 64 nt, Human
agugaggccaagauugaaauuugauacuaaaaaggccaccuagcuuuuugcagauaacaaacaa

SEQ ID NO: 528684 - RNA, 64 nt, Human
ccgccucccaacgugcugggauuacaggcaugagccgccuuaccaagaaauugcuucucuuuua

SEQ ID NO: 528685 - RNA, 61 nt, Human
gccaggaccagcaccuguagucaccccaccacacgcagacucaugcacgcacacaggaggg

SEQ ID NO: 528686 - RNA, 61 nt, Human
ccuuucaccuccgcuggcucaccugggaaaucacgcagacccaguacauccuggagggcua

SEQ ID NO: 528687 - RNA, 60 nt, Human
cgggucuucaguacuuuuauuaaaaaauagucacgcagacagugcccugguggcucugcc

SEQ ID NO: 528688 - RNA, 64 nt, Human
aauuuugccauuuugauccuuuuacuuuguuuuagccaccuauaguguuaccaaccaucuuuau

SEQ ID NO: 528689 - RNA, 64 nt, Human
uaaccaguuacuuacuucuuuuguuguuuugcaggccaccuagaaauacaaaaugccaauucac

SEQ ID NO: 528690 - RNA, 64 nt, Human
ucaucuucucuaguucucauaagacuaucuccccgccaccuauaguuaguacccucaaguccuc

SEQ ID NO: 528691 - RNA, 64 nt, Human
caauguaacccuaaacacaucauguauuuuaaaugccaccuacauaaauaaaacauaagcauau

SEQ ID NO: 528692 - RNA, 64 nt, Human
uaaaugaaauggauccaucaucaaagucuuuauugccaccuacugacacucgauuuaggccaga

SEQ ID NO: 528693 - RNA, 64 nt, Human
acaagggccagauguauuuaagggguauucagaugccaccuacaugcuuauuuugucuagaaca

SEQ ID NO: 528694 - RNA, 64 nt, Human
ugcacugggcauggggugguggugggagcuuaccgccaccuauucaagcucucagcuacuccug

SEQ ID NO: 528695 - RNA, 64 nt, Human
aggcgcuggucagaaacgggguagucucuuuggcgccaccuaguguccaguuuggcccauggcg

SEQ ID NO: 528696 - RNA, 64 nt, Human
ucugcuuaagugguugcuauacaaacuuugaauagccaccuaauaaauaaaccuugcaugacaa

SEQ ID NO: 528697 - RNA, 64 nt, Human
ugcaguggcgcgaucuuggcucacugcaacccccgccaccuagguucaagugauucucaugccu

SEQ ID NO: 528698 - RNA, 64 nt, Human
cugauucuggaauauaacuuuguguaaauuaacagccaccuauagaagaguccaucugcuguga

SEQ ID NO: 528699 - RNA, 64 nt, Human
agggacugauuccugugguuggaaaacugaggcagccaccuaagguggaggugggggaauagug

SEQ ID NO: 528700 - RNA, 64 nt, Human
uggaugguccugaaaccagacaagaccucugccagccaccuaagcccugcguacauucacaugc

SEQ ID NO: 528701 - RNA, 64 nt, Human
agccauagaaggaagcugucagcccggagugccugccaccuagacacugaugccauugugugcu

SEQ ID NO: 528702 - RNA, 64 nt, Human
ucagucauccugaaccugaguucaaccaaccgcagccaccuacguuugaccccagcgagaucaa

SEQ ID NO: 528703 - RNA, 64 nt, Human
aauugcagcuaaggaacaauggaaagagcugaaggccaccuacagggagcacguagaggccauc

SEQ ID NO: 528704 - RNA, 64 nt, Human
aaucaccagcaacacccgggacaauaauacgggggccaccuacccccaccugaacuucagcauu

SEQ ID NO: 528705 - RNA, 54 nt, Human; identical to SEQ ID NO: 201896

SEQ ID NO: 528706 - RNA, 64 nt, Human
auaaaaauaaaaacaaauacuguguuucagaagcgccaccuauuggggaaaauuguaaaagaaa

SEQ ID NO: 528707 - RNA, 64 nt, Human
cugaggcacagcucugagcacagaggucccuucugccaccuaccaugcaccauguuccuugcca

SEQ ID NO: 528708 - RNA, 64 nt, Human
ugguguucucuguugcuaagugacagugggcccagccaccuauuuuaacaagcccucccaguga

SEQ ID NO: 528709 - RNA, 64 nt, Human
uuucauuugcagugguuagucaucagauauuuuagccaccuacacaaaagcaaacugcauuuuu

SEQ ID NO: 528710 - RNA, 64 nt, Human
uccaaagcaauagaggcagagugguccccucuuugccaccuaggccaguuuugacccuggcauu

SEQ ID NO: 528711 - RNA, 64 nt, Human
ccagggcuggccacccuggucuugaggguuccuggccaccuagccugcuccucugcucucuggg

SEQ ID NO: 528712 - RNA, 64 nt, Human
aaccuccagggcccugacuuuuccagaggcugcugccaccuacuucuuaucaaagaagggggag

SEQ ID NO: 528713 - RNA, 64 nt, Human
ugugaaugauuuuguuacaucaguguucacuguagccaccuaaguaggacauuauaugauuuca

SEQ ID NO: 528714 - RNA, 64 nt, Human
cccgcaggcgaaagcacguuccagccaccaggaggccaccuauuguuucaaaauaaagacuggg

SEQ ID NO: 528715 - RNA, 64 nt, Human
cacuccgagguaucuaaaggguagaccuggaccugccaccuaugaguugugugauauagaaaaa

SEQ ID NO: 528716 - RNA, 64 nt, Human
cuuguaguagucucauuacuuuugaaguaaucccgccaccuaucucgugggagagccauccaaa

SEQ ID NO: 528717 - RNA, 64 nt, Human
gccucagugaagauuguauuuuauuuuaucaaaagccaccuagcagucaucuguggagcacugg

SEQ ID NO: 528718 - RNA, 64 nt, Human
uuuauuuuuauugcuauuaaaauauccacuagaugccaccuagagcuccaguucuuuauaacaa

SEQ ID NO: 528719 - RNA, 64 nt, Human
uauuuuacuacauuuuugcugguauaauuccuuagccaccuauguacauacugcuuuaagaaau

SEQ ID NO: 528720 - RNA, 64 nt, Human
gugcuuugagaaaacauuucuuaaaacagugugugccaccuaaggcuggaugggaaagugcagu

SEQ ID NO: 528721 - RNA, 64 nt, Human
accuccaccugcugagcccaccccaaguaugccugccaccuacgcccacaggcagggcacacug

SEQ ID NO: 528722 - RNA, 64 nt, Human
accagcagccauggcuggcuggggcuuuagccaagccaccuacugccaggaauuggagccucag

SEQ ID NO: 528723 - RNA, 64 nt, Human
uugccuuccuucagcaggaccgucuaggugcgcagccaccuauggaugcgucccagccagcccc

SEQ ID NO: 528724 - RNA, 64 nt, Human
guccuuagagaaagucacuggggccugccaagcugccaccuaaagacaagagugagagggcuga

SEQ ID NO: 528725 - RNA, 64 nt, Human
cacuucugcauuaucuuuauggcucuuuaaaccagccaccuagccaaucaagggcaauucccau

SEQ ID NO: 528726 - RNA, 64 nt, Human
uccuucagcaugaguucuguuucacaaguuuugggccaccuauuucaauaaaaaauaaaauaua

SEQ ID NO: 528727 - RNA, 64 nt, Human
agcugcgucguuucgauaucacacccucugugugccgccuuacuuccugcuucgagaauguaua

SEQ ID NO: 528728 - RNA, 64 nt, Human
uguuguauuugaauugagauuuuuacuauacaaagccaccuagggccuggggauuugggucagu

SEQ ID NO: 528729 - RNA, 64 nt, Human
cgaggaucagacggccugaaacuccggacugugggccaccuaguccggcaggaucuuccgccag

SEQ ID NO: 528730 - RNA, 64 nt, Human
aacagaaucacuccugcugaaaaauacgcuuucugccaccuacacauuucuauuuaggaaguaa

SEQ ID NO: 528731 - RNA, 64 nt, Human
gcuucagaagugaucuuggcucgcaggcaccagugccaccuaccaagcugugaaacuaaaccuu

SEQ ID NO: 528732 - RNA, 64 nt, Human
cgccucccuaccauggugccaggggucucccuccgccaccuaggaaaggagggagaugugcgug

SEQ ID NO: 528733 - RNA, 64 nt, Human
uggagcacguggagauagugccagguggcucagugccaccuaugccuguggugaaguguggcug

SEQ ID NO: 528734 - RNA, 64 nt, Human
caguaucuccccuuguccccacccagucaccaaagccaccuacaugacaguccaucccuguuga

SEQ ID NO: 528735 - RNA, 64 nt, Human
uuuguugaucccuuuucucaucuuaccccuuuaugccaccuacugaaaagaaaaacaaauagcu

SEQ ID NO: 528736 - RNA, 64 nt, Human
guauagaagaaaaacggguucaaaccccacuucugccaccuaccagcuauauggccuugaauga

SEQ ID NO: 528737 - RNA, 64 nt, Human
uagcuuggcccgccuuccgccagccgcgcccugcgccaccuacccgggguccuccacagcggag

SEQ ID NO: 528738 - RNA, 64 nt, Human
ugcaaaagaugaaguuaaacuccucuacuuaugugccaccuacaaagcacuagagacuguagga

SEQ ID NO: 528739 - RNA, 64 nt, Human; identical to SEQ ID NO: 528738

SEQ ID NO: 528740 - RNA, 64 nt, Human
auggacaccacgagacagaaguggggacugccuggccaccuagcgccuucccacuccuuaagca

SEQ ID NO: 528741 - RNA, 64 nt, Human
cugcaccuggggggaggguagggaggaggggcaugccaccuaaugaucaagcccuauaauuagc

SEQ ID NO: 528742 - RNA, 64 nt, Human
auuguauugcugcguagaaucugaacacacugaggccaccuagcaagguaguaacuagucuaac

SEQ ID NO: 528743 - RNA, 64 nt, Human
gauucacucacucacucauuccuucacucauccagccaccuaaaaacauuuacugaccauguac

SEQ ID NO: 528744 - RNA, 64 nt, Human
ucugccugucggcuggggcagagacugaaauacugccaccuaccuuuggcauuuaauguuccuc

SEQ ID NO: 528745 - RNA, 64 nt, Human
uuuaaggccaucguuuguacccagagucggcauggccaccuaagucuucauuuaauuuauuguc

SEQ ID NO: 528746 - RNA, 59 nt, Human; identical to SEQ ID NO: 199386

SEQ ID NO: 528747 - RNA, 64 nt, Human
ccagccccuccucccucagacccagcgguccaaugccaccuagacucucccuguacacagugcc

SEQ ID NO: 528748 - RNA, 64 nt, Human
uccuucugccuguuucuguaagcaaaugccacaggccaccuauagcuacauacuccuggcauug

SEQ ID NO: 528749 - RNA, 64 nt, Human
ucugcugcgcacgcccccuccccggacagcaccugccaccuagaaacuuucuuagcaaaaaaau

SEQ ID NO: 528750 - RNA, 64 nt, Human
ucuuugccaagguguauuagcggacggcccucuggccaccuacccgagagaucguagggucaca

SEQ ID NO: 528751 - RNA, 64 nt, Human
agcugccugccaggggagaccugggaccuggacggccaccuaggacugaggacagagagugggg

SEQ ID NO: 528752 - RNA, 64 nt, Human
cuuguccuguggguugagggggucugaccaggaggccaccuacagcaggaagugaggcugccau

SEQ ID NO: 528753 - RNA, 64 nt, Human
uggauaggcugaauuggauuaagaaaaguugaaugccaccuaugguaaucuauuugugauuuuc

SEQ ID NO: 528754 - RNA, 64 nt, Human
caaccucgcccucucucaccagccuugaacuguggccaccuagaaaggggcccauucagccucg

SEQ ID NO: 528755 - RNA, 64 nt, Human
uuccagccugccagucaugaaucucagacagccugccaccuauugcccugauuuguguuauaau

SEQ ID NO: 528756 - RNA, 64 nt, Human
uguguuggacagagaagggcuccugcaggccacagccaccuaaacgguucaguuucuucugcgc

SEQ ID NO: 528757 - RNA, 64 nt, Human
cuacugugagggugggcccugaggagaccugugggccaccuauugucuaauaaagugggcaguu

SEQ ID NO: 528758 - RNA, 64 nt, Human
uaaccaaauuuaauuugaauucaacuuaauuuaagccaccuaaaugaccucuaucagggauuuc

SEQ ID NO: 528759 - RNA, 64 nt, Human
cauagcccccuucuacuacuuucccucucgcccugccaccuaguuccacauggaaccaacaagu

SEQ ID NO: 528760 - RNA, 64 nt, Human
aauauguuaauaaaacuucuuguaacggcuaacugccaccuaaaauaugcuggguuuucuguug

SEQ ID NO: 528761 - RNA, 64 nt, Human
gccggccagcccggccuacgcccaguacccaccggccaccuaugaccaguacccauacgccgcc

SEQ ID NO: 528762 - RNA, 64 nt, Human
ggaggauggagcuucuccucagcuccucugagcagccaccuaugugaucuuuaaauccaacccc

SEQ ID NO: 528763 - RNA, 64 nt, Human
uugggcccccccagacucuagccugagcagugcagccaccuacugccccaccucagagaagugc

SEQ ID NO: 528764 - RNA, 64 nt, Human
uuucuccagggcccccuucuuugaugcaguuaugccgccuuagaauucggaaguguuuuggaau

SEQ ID NO: 528765 - RNA, 64 nt, Human
gcugugucaguauuugagccaaacuggcaacuuacgagauuagaguuaaaucagugguccugag

SEQ ID NO: 528766 - RNA, 64 nt, Human
cucgugaucugcccgccucggccucccaaagugccgagauuacaggugugagccaccgcgcucg

SEQ ID NO: 528767 - RNA, 61 nt, Human
caguuucaucccuguaaggcaaaugucuuuucacgcagaaagugccauauagacgagauaa

SEQ ID NO: 528768 - RNA, 64 nt, Human
gcuugaagccaagaacucuucaaugccagcuacugccaccuaaaaaucaucuggcuuuauagug

SEQ ID NO: 528769 - RNA, 64 nt, Human
gccugagcagguguggugccgucccgccauugccgccaccuauuuauuguguuuuaucugaacg

SEQ ID NO: 528770 - RNA, 64 nt, Human
ccuccuuggggcccaagcucugcucccuggaucugccaccuagcagacguggggagccugaccc

SEQ ID NO: 528771 - RNA, 64 nt, Human
ccuuccaaucugaaaccucgugccuggcucgucugccaccuacauuucucuuuccagcugcugu

SEQ ID NO: 528772 - RNA, 64 nt, Human
ucucucacagauagugagggucugacaugcccaugccaccuaugccacagugccuaagggcuag

SEQ ID NO: 528773 - RNA, 64 nt, Human
augcaguguagagcuagauuaaaagcaacucuuugccaccuacucugcccuuuuggcaaaguua

SEQ ID NO: 528774 - RNA, 64 nt, Human
aaacuggguuggaccuagugguguugucgugagugccaccuaaccaggaggccagagcgguuug

SEQ ID NO: 528775 - RNA, 64 nt, Human
ccuuuugaggagcuggagggguggggagcuagaggccaccuaugccagugcucaagguuacugg

SEQ ID NO: 528776 - RNA, 64 nt, Human
guauagugucucaggguccgaagcaaguuuaaaugccaccuaggaggauccaaagucugaaucu

SEQ ID NO: 528777 - RNA, 64 nt, Human
agagucuuccccagccuugaaccuaggaccaagagccaccuacauccagccccaaaacuggggc

SEQ ID NO: 528778 - RNA, 64 nt, Human
acgagagcuggagagccauguauauggcuucaaagccaccuacggcagggacacacucgugagc

SEQ ID NO: 528779 - RNA, 64 nt, Human
agaaggaagaggauuccaggcugagagcacuggacguggcaacuguucagaggagaggcagucu

SEQ ID NO: 528780 - RNA, 64 nt, Human
cagagagcuaacucacccuuccaccauaugaggacguggcaagaagaugacauguaugagaacc

SEQ ID NO: 528781 - RNA, 64 nt, Human
gcuggaaggcaucacaacaugguggaagggaucacguggcaaaagagcauguacaugggaguga

SEQ ID NO: 528782 - RNA, 64 nt, Human
ugaauagacuauguccuagugaagacaucaaccuccgccuuaagcuauguauguauggaggcca

SEQ ID NO: 528783 - RNA, 64 nt, Human
acguggugcuaucucugaaacgagcguuagagugccgccuuagacggaggcaggaguuucguua

SEQ ID NO: 528784 - RNA, 64 nt, Human
uucccucucuaggccuguugccucgggccuggguccgccuuaaucuggaaggccccucccagca

SEQ ID NO: 528785 - RNA, 61 nt, Human
aaauugcacuuguucuccuacaagcaaccuccacgcagacaccucguacugcuacaggugu

SEQ ID NO: 528786 - RNA, 64 nt, Human
cagagcgagacuccgucucaaaaaacaaaaagcccguggcaauuaaugguaaaggaaacccggc

SEQ ID NO: 528787 - RNA, 64 nt, Human
uguaccauggaguccugcagccccuuaaccccugcguggcaacuguguacagcuuaccccugcc

SEQ ID NO: 528788 - RNA, 64 nt, Human
gagcaagcacuguguuauuuucacaguggagacacguggcaaggcaggagggcccucagcuccu

SEQ ID NO: 528789 - RNA, 64 nt, Human
uuacaauaaauuucauuuguaauuuuauauguuccguggcaaugcuuuugugcauuacauccuc

SEQ ID NO: 528790 - RNA, 64 nt, Human
ucagucacuccuuggauggccuccuaaaucuccccguggcaacagguccaggagaggcccaugg

SEQ ID NO: 528791 - RNA, 64 nt, Human
uugagaccugagugaagauaagaaaugaucuuuacguggcaaaaugaacacaucuugaguauuu

SEQ ID NO: 528792 - RNA, 64 nt, Human
ggggaggugacuugcaugguggggacaaggcugucguggcaaccuugggaucgaguuugagacu

SEQ ID NO: 528793 - RNA, 64 nt, Human
uuccugcugcugagaauaaaugucuuguuaaaaacguggcaacgguuacucuuaggugccaugg

SEQ ID NO: 528794 - RNA, 64 nt, Human
guaguauuacgaggggugguguguuuuuccccuccguggcaagggcagggaggguugcuuagga

SEQ ID NO: 528795 - RNA, 64 nt, Human
augagcauuaaaaaaccuuccagaaucaauaauccguggcaacauaucucuguaaaaacaaaca

SEQ ID NO: 528796 - RNA, 64 nt, Human
cugucucacuuuuccaggagacaugacccacuaacguggcaacuuuaacccaaaggccccucag

SEQ ID NO: 528797 - RNA, 64 nt, Human
augagccucuaagggaaaggaggaacaauuaggacguggcaaugagaccuggcagggcagagua

SEQ ID NO: 528798 - RNA, 64 nt, Human
uuauacuguagagaaacccuggaaaugugaagaacguggcaaaguucuuuaccucauucucaaa

SEQ ID NO: 528799 - RNA, 64 nt, Human
ucucugcccaccagaugccagcacucccaccauucguggcaaccaaggaugucuccagacacug

SEQ ID NO: 528800 - RNA, 64 nt, Human
cuugaggucaggaguuugaaacuagccuggccaacguggcaaaacuccaucucuauuaaaaaua

SEQ ID NO: 528801 - RNA, 64 nt, Human
ccguagauauacuuuagguuaguauuucuacauucguggcaagcauuuugguaacaccaguggu

SEQ ID NO: 528802 - RNA, 61 nt, Human
uuuguguggccaacuccaucggaugaaugcacacgcagacagacccucuguauauuucugc

SEQ ID NO: 528803 - RNA, 61 nt, Human
uaccucgaguggcgaguccagacaccaucaccacgcagagaggggaggugggaggacaguu

SEQ ID NO: 528804 - RNA, 61 nt, Human
acauacacacacacacacacacacacacacacacgcagaguugugauucucaguaccaagc

SEQ ID NO: 528805 - RNA, 61 nt, Human
cauaaagaucaaacaugcauggauggguccucacgcagacacacccacagaaggacacuag

SEQ ID NO: 528806 - RNA, 64 nt, Human; identical to SEQ ID NO: 528800

SEQ ID NO: 528807 - RNA, 64 nt, Human
agugaaugucagccuaagaggccaagcugcagaucguggcaacagaugagcucuguuaaccucc

SEQ ID NO: 528808 - RNA, 64 nt, Human
uauuuuaaguguagcagcuuugacuuugcaauaacguggcaaguaucugauuucuccuuugagg

SEQ ID NO: 528809 - RNA, 64 nt, Human
uuauacuggaaagaaacccuacaaauguaaaaaacguggcaaugccuuuaacugguccucacac

SEQ ID NO: 528810 - RNA, 64 nt, Human
auucccuguggucagcuccuuccccaccuuuuaccguggcaaccgucaagcuauucucuguccc

SEQ ID NO: 528811 - RNA, 64 nt, Human
uaauuuucuuaguaaaaagaauaacagaaugcaucguggcaauccuuaagcaacauuaucuaug

SEQ ID NO: 528812 - RNA, 64 nt, Human
ggagauagcguggggagccucgcccauggucucacguggcaagaagugccuuuagcucuggauc

SEQ ID NO: 528813 - RNA, 64 nt, Human
cccagggcaguggcuuuccugaggcagcagccuucguggcaagaacuagcgugagcccagccag

SEQ ID NO: 528814 - RNA, 64 nt, Human
uagcaccacggggaagaauagagguaucaucaaacguggcaaauuuucuuucaggaauaauaaa

SEQ ID NO: 528815 - RNA, 64 nt, Human
cuugagcccaggaguuugagaccagccuggccaacguggcaaaaccucgucucuguuaaaaauu

SEQ ID NO: 528816 - RNA, 64 nt, Human
cuccgaggcuucuccagagcugggagcuggcuggcguggcaagggcaugcucuggggcagugug

SEQ ID NO: 528817 - RNA, 64 nt, Human
guaagagcaccuuccucacuuccauacagcucuacguggcaaauuaacuugaguuuuauuuauu

SEQ ID NO: 528818 - RNA, 64 nt, Human
ugaaagccaacugaaccacguaaagcucgaaccacguggcaagugguggacaaaacuucaacgc

SEQ ID NO: 528819 - RNA, 64 nt, Human
cacguuaauaaagccaaaagcagcgggugcuauucguggcaacacacuucacugaacccacuug

SEQ ID NO: 528820 - RNA, 62 nt, Human
aaaaggugagcugugugugauaggcuaguugccguggcaacuguggaaggcacacugagcaa

SEQ ID NO: 528821 - RNA, 64 nt, Human
aggaacugaaacuucuuuggggcuugucuugagacguggcaaauucuccuuggugaguuuucua

SEQ ID NO: 528822 - RNA, 61 nt, Human
cgugcacaggcgcagauaugcugccuggacacacgcagauaugcugucuagucacacacac

SEQ ID NO: 528823 - RNA, 61 nt, Human
cacacgcagauaugcugucuagucacacacacacgcagacaugcuguccggacacacacac

SEQ ID NO: 528824 - RNA, 61 nt, Human
ugcacagauaugcuguccggacacacacacgcacgcagauaugcugccuggacacacacac

SEQ ID NO: 528825 - RNA, 61 nt, Human
cacacacaggugcagauaugcugccuggacacacgcagacugacgugcuuuugggagggug

SEQ ID NO: 528826 - RNA, 64 nt, Human
cugcugcuaugacgaggacagccggcugcugacccguggcaagggcgccggcaugcccaaccuc

SEQ ID NO: 528827 - RNA, 64 nt, Human
gaccacuccucaccccagcucaagccauggcaggcguggcaagcaaaguggggaggagacaguc

SEQ ID NO: 528828 - RNA, 64 nt, Human
cuguuccagcccaggccaagcacagggucuggcucguggcaaaccuugaauaaauauuuguugg

SEQ ID NO: 528829 - RNA, 64 nt, Human
gcaugggauuuuaauuguuucaucacaccuuccccguggcaaagaaacagucaguccucuucag

SEQ ID NO: 528830 - RNA, 64 nt, Human
cauuggauucacugucaguggagauacuaccucucguggcaaccauagagaucgagcuucagga

SEQ ID NO: 528831 - RNA, 64 nt, Human
cacugaugcagcuuagaaccacaccccugagagucguggcaaaccuuucacaaccuggaaaaug

SEQ ID NO: 528832 - RNA, 64 nt, Human
cuccaaaugauuguuuuagacuagccaaaaaugccguggcaaagagcucagaaauccaauuugg

SEQ ID NO: 528833 - RNA, 64 nt, Human
uuuggucauaaagugaaacccguauuagcaaguacguggcaauguucauuccaaucagaugcag

SEQ ID NO: 528834 - RNA, 64 nt, Human
cagauccaaaccgcaggcaaacgggucgugauggcguggcaacccucacuguguuggaggaugg

SEQ ID NO: 528835 - RNA, 64 nt, Human
uguuuuucacaaaauguauuguucaggaugugagcguggcaaauuuguccguguucuguuuaau

SEQ ID NO: 528836 - RNA, 64 nt, Human
gguggcgauuagcggacuggagucuggggacauccguggcaaagacaccagcucaacuuuagug

SEQ ID NO: 528837 - RNA, 64 nt, Human
ugaguguuacucguuacuguugaggucagugcuucguggcaaauggcuguacuggauaucccag

SEQ ID NO: 528838 - RNA, 63 nt, Human
cuccaaucgaagacuauuaaaagaaguggcugucguggcaagguagaccacaaugcuggauca

SEQ ID NO: 528839 - RNA, 64 nt, Human
cacacaggagagaauauacagccugcagagagugcguggcaauccuuacucccagccgacugug

SEQ ID NO: 528840 - RNA, 64 nt, Human
cgcuacugaguacuuggaauccuguguccugucucguggcaacaaggcuauguucuguuaggag

SEQ ID NO: 528841 - RNA, 64 nt, Human
uggaugggacuuucagaccuaaaucaggaaggcacguggcaauggguggacggcucaccucugu

SEQ ID NO: 528842 - RNA, 61 nt, Human
acucugagggaggggagaagggagcagaggccacgcagaaugaaccgaugggguauucagu

SEQ ID NO: 528843 - RNA, 61 nt, Human
uaaaagugugugaaaccuacagcauauucuucacgcagagauuuucaucuauuauacuuua

SEQ ID NO: 528844 - RNA, 61 nt, Human
cuucaggagaugaugugauggaacacacacacacgcagacacacacacacacacaaaugca

SEQ ID NO: 528845 - RNA, 61 nt, Human
agugcacuacugccucauguaaagacucuugcacgcagagccuuuaagugacuaaggaaca

SEQ ID NO: 528846 - RNA, 64 nt, Human
cauacuggaggaaaagcccuacaaaugugaaaaacguggcaaagcuuuucauuaguucucaacc

SEQ ID NO: 528847 - RNA, 64 nt, Human
caugcccaagcuagggagggcagaguccccaucacguggcaagccaggcgaggcgggugcugag

SEQ ID NO: 528848 - RNA, 64 nt, Human
accaaugccaagauaauucacucuacucagccggcguggcaaauauaaaacuuacagagcgugg

SEQ ID NO: 528849 - RNA, 64 nt, Human
ugggaagggagggagagggggcgcagcucgcaggcguggcaacuugaccuugggggaauauuuc

SEQ ID NO: 528850 - RNA, 64 nt, Human
uacauuuuuaaaaugcauaugugcuguuuggcaccguggcaagaugguaucagagagaaaccca

SEQ ID NO: 528851 - RNA, 64 nt, Human
uggcagccuccagugggaggacagagccgguuuccguggcaacccucagcugccucaucguggc

SEQ ID NO: 528852 - RNA, 64 nt, Human
ccagccaggccacccagccgugggaggaagggggcguggcaaggggugggcacauuggugucug

SEQ ID NO: 528853 - RNA, 64 nt, Human
uuuaugagaaugacccugucaagcuucauuauuacguggcaaaaucccucuggcccacacagau

SEQ ID NO: 528854 - RNA, 64 nt, Human
acuugaauagacacuucaccaaagagcauacacgcguggcaaacaagcacacgaaaagacguuc

SEQ ID NO: 528855 - RNA, 64 nt, Human
cucugagggagagugcguggggagccaugcucaccguggcaaacacaggaaccccaugacucgc

SEQ ID NO: 528856 - RNA, 64 nt, Human; identical to SEQ ID NO: 115711

SEQ ID NO: 528857 - RNA, 64 nt, Human; identical to SEQ ID NO: 115712

SEQ ID NO: 528858 - RNA, 64 nt, Human; identical to SEQ ID NO: 115713

SEQ ID NO: 528859 - RNA, 64 nt, Human; identical to SEQ ID NO: 115714

SEQ ID NO: 528860 - RNA, 64 nt, Human; identical to SEQ ID NO: 115715

SEQ ID NO: 528861 - RNA, 64 nt, Human; identical to SEQ ID NO: 115716

SEQ ID NO: 528862 - RNA, 64 nt, Human
ggaagugguugagggccaggaaagagaaggaaugucaugccaggguguuacuccucaccaaaac

SEQ ID NO: 528863 - RNA, 64 nt, Human
gggcccaggaggucaaggcuucagugagccaugaucaugccacugcacuccagucuggaugaca

SEQ ID NO: 528864 - RNA, 64 nt, Human
gaacccgggagguggaggcugcggugagccaagaucaugccauugcacuccagccugggugaca

SEQ ID NO: 528865 - RNA, 64 nt, Human
auucuucauaaaaaugaauaaguagcccucacuuucaugccauuuccauuguugagugaagcgu

SEQ ID NO: 528866 - RNA, 64 nt, Human; identical to SEQ ID NO: 115732

SEQ ID NO: 528867 - RNA, 64 nt, Human; identical to SEQ ID NO: 57177

SEQ ID NO: 528868 - RNA, 64 nt, Human; identical to SEQ ID NO: 57178

SEQ ID NO: 528869 - RNA, 64 nt, Human; identical to SEQ ID NO: 57179

SEQ ID NO: 528870 - RNA, 64 nt, Human; identical to SEQ ID NO: 57180

SEQ ID NO: 528871 - RNA, 64 nt, Human; identical to SEQ ID NO: 57181

SEQ ID NO: 528872 - RNA, 64 nt, Human; identical to SEQ ID NO: 57182

SEQ ID NO: 528873 - RNA, 64 nt, Human; identical to SEQ ID NO: 57183

SEQ ID NO: 528874 - RNA, 64 nt, Human; identical to SEQ ID NO: 57184

SEQ ID NO: 528875 - RNA, 64 nt, Human; identical to SEQ ID NO: 57185

SEQ ID NO: 528876 - RNA, 64 nt, Human; identical to SEQ ID NO: 57186

SEQ ID NO: 528877 - RNA, 64 nt, Human; identical to SEQ ID NO: 57187

SEQ ID NO: 528878 - RNA, 64 nt, Human; identical to SEQ ID NO: 57188

SEQ ID NO: 528879 - RNA, 64 nt, Human; identical to SEQ ID NO: 57189

SEQ ID NO: 528880 - RNA, 64 nt, Human; identical to SEQ ID NO: 57190

SEQ ID NO: 528881 - RNA, 64 nt, Human; identical to SEQ ID NO: 57191

SEQ ID NO: 528882 - RNA, 64 nt, Human
ugguggauguuccucccacucaugagucuuuucaucaugccacauuaucugauccaguccucac

SEQ ID NO: 528883 - RNA, 64 nt, Human
aaaaaagaaccuauuuuugugcaucauuuaccaaucaugccacacaagcauuuauuuuuaguac

SEQ ID NO: 528884 - RNA, 64 nt, Human
uuuuccucucucccggagguugggugggccggcuucaugccagcuacuuccuccuccccacuug

SEQ ID NO: 528885 - RNA, 64 nt, Human; identical to SEQ ID NO: 115733

SEQ ID NO: 528886 - RNA, 64 nt, Human; identical to SEQ ID NO: 115734

SEQ ID NO: 528887 - RNA, 64 nt, Human; identical to SEQ ID NO: 115735

SEQ ID NO: 528888 - RNA, 64 nt, Human; identical to SEQ ID NO: 115736

SEQ ID NO: 528889 - RNA, 64 nt, Human; identical to SEQ ID NO: 115737

SEQ ID NO: 528890 - RNA, 64 nt, Human; identical to SEQ ID NO: 115738

SEQ ID NO: 528891 - RNA, 64 nt, Human; identical to SEQ ID NO: 115739

SEQ ID NO: 528892 - RNA, 64 nt, Human; identical to SEQ ID NO: 115740

SEQ ID NO: 528893 - RNA, 64 nt, Human; identical to SEQ ID NO: 115741

SEQ ID NO: 528894 - RNA, 64 nt, Human; identical to SEQ ID NO: 115742

SEQ ID NO: 528895 - RNA, 64 nt, Human; identical to SEQ ID NO: 115743

SEQ ID NO: 528896 - RNA, 64 nt, Human; identical to SEQ ID NO: 115744

SEQ ID NO: 528897 - RNA, 64 nt, Human; identical to SEQ ID NO: 115745

SEQ ID NO: 528898 - RNA, 64 nt, Human; identical to SEQ ID NO: 115746

SEQ ID NO: 528899 - RNA, 64 nt, Human; identical to SEQ ID NO: 115747

SEQ ID NO: 528900 - RNA, 64 nt, Human; identical to SEQ ID NO: 115748

SEQ ID NO: 528901 - RNA, 64 nt, Human
gagccaggggcgacaucaugaccuucugucccggccgccuuagccccgggcacagggaaggcag

SEQ ID NO: 528902 - RNA, 64 nt, Human
ggggagaggcaccugagguggcccugaagaugccccgccuuaguuuuccccgauuuggggcucg

SEQ ID NO: 528903 - RNA, 64 nt, Human
ucccuucacccuuucuccauaccagggccuaaguccgccuuacuccucuccuccauguacuuga

SEQ ID NO: 528904 - RNA, 64 nt, Human
auucuaaauccuuaacauccaggcccuggcugcuucaugccagaggcccaaauccauggacuga

SEQ ID NO: 528905 - RNA, 64 nt, Human; identical to SEQ ID NO: 115749

SEQ ID NO: 528906 - RNA, 64 nt, Human; identical to SEQ ID NO: 115750

SEQ ID NO: 528907 - RNA, 64 nt, Human; identical to SEQ ID NO: 115751

SEQ ID NO: 528908 - RNA, 64 nt, Human; identical to SEQ ID NO: 115752

SEQ ID NO: 528909 - RNA, 64 nt, Human; identical to SEQ ID NO: 115753

SEQ ID NO: 528910 - RNA, 64 nt, Human; identical to SEQ ID NO: 115754

SEQ ID NO: 528911 - RNA, 64 nt, Human; identical to SEQ ID NO: 115755

SEQ ID NO: 528912 - RNA, 64 nt, Human; identical to SEQ ID NO: 115756

SEQ ID NO: 528913 - RNA, 64 nt, Human; identical to SEQ ID NO: 115757

SEQ ID NO: 528914 - RNA, 64 nt, Human; identical to SEQ ID NO: 115758

SEQ ID NO: 528915 - RNA, 64 nt, Human; identical to SEQ ID NO: 115759

SEQ ID NO: 528916 - RNA, 64 nt, Human; identical to SEQ ID NO: 115760

SEQ ID NO: 528917 - RNA, 64 nt, Human; identical to SEQ ID NO: 115761

SEQ ID NO: 528918 - RNA, 64 nt, Human; identical to SEQ ID NO: 115762

SEQ ID NO: 528919 - RNA, 64 nt, Human; identical to SEQ ID NO: 115763

SEQ ID NO: 528920 - RNA, 64 nt, Human; identical to SEQ ID NO: 115764

SEQ ID NO: 528921 - RNA, 61 nt, Human
cggagcugaauacagccugaggccucagcagccgccuuaagcugauccugcggagaacacc

SEQ ID NO: 528922 - RNA, 64 nt, Human
cagacucaccucccaagaacgccugcccgcccacccgccuuaggacucccgaugcgcuccugga

SEQ ID NO: 528923 - RNA, 64 nt, Human
gucggaaggacuaguggcaauagugaugaaaggaccgccuuaucaugcuggcaauguuaauuac

SEQ ID NO: 528924 - RNA, 64 nt, Human
uuagaucacucggguccccaccuuagaaggguccccgccuuagaucaaucacguggacacuaag

SEQ ID NO: 528925 - RNA, 64 nt, Human; identical to SEQ ID NO: 115765

SEQ ID NO: 528926 - RNA, 64 nt, Human; identical to SEQ ID NO: 115766

SEQ ID NO: 528927 - RNA, 64 nt, Human; identical to SEQ ID NO: 115767

SEQ ID NO: 528928 - RNA, 64 nt, Human; identical to SEQ ID NO: 115768

SEQ ID NO: 528929 - RNA, 64 nt, Human; identical to SEQ ID NO: 115769

SEQ ID NO: 528930 - RNA, 64 nt, Human; identical to SEQ ID NO: 115770

SEQ ID NO: 528931 - RNA, 64 nt, Human; identical to SEQ ID NO: 115771

SEQ ID NO: 528932 - RNA, 64 nt, Human; identical to SEQ ID NO: 115772

SEQ ID NO: 528933 - RNA, 64 nt, Human; identical to SEQ ID NO: 115773

SEQ ID NO: 528934 - RNA, 64 nt, Human; identical to SEQ ID NO: 115774

SEQ ID NO: 528935 - RNA, 64 nt, Human; identical to SEQ ID NO: 115775

SEQ ID NO: 528936 - RNA, 64 nt, Human; identical to SEQ ID NO: 115776

SEQ ID NO: 528937 - RNA, 64 nt, Human; identical to SEQ ID NO: 115777

SEQ ID NO: 528938 - RNA, 64 nt, Human; identical to SEQ ID NO: 115778

SEQ ID NO: 528939 - RNA, 64 nt, Human; identical to SEQ ID NO: 115779

SEQ ID NO: 528940 - RNA, 64 nt, Human; identical to SEQ ID NO: 115780

SEQ ID NO: 528941 - RNA, 64 nt, Human
ggaccucgugccuucuugcugucaugcaaugaccccgccuuauguugccgaaauaagcaacucu

SEQ ID NO: 528942 - RNA, 64 nt, Human
aggcuggucuugaacuccugaccucgugauccacccgccuuagccucccaaagugcugggauua

SEQ ID NO: 528943 - RNA, 64 nt, Human
ccuggucccacugucccaguguaggaacagagacccgccuuaagagacuggaucgcacaccuuu

SEQ ID NO: 528944 - RNA, 64 nt, Human
gucgaugccauugauucugccagcggcuccuaaaccgccuuacagcugaguuagaagaugagga

SEQ ID NO: 528945 - RNA, 64 nt, Human; identical to SEQ ID NO: 115781

SEQ ID NO: 528946 - RNA, 64 nt, Human; identical to SEQ ID NO: 115782

SEQ ID NO: 528947 - RNA, 64 nt, Human; identical to SEQ ID NO: 115783

SEQ ID NO: 528948 - RNA, 64 nt, Human; identical to SEQ ID NO: 115784

SEQ ID NO: 528949 - RNA, 64 nt, Human; identical to SEQ ID NO: 115785

SEQ ID NO: 528950 - RNA, 64 nt, Human; identical to SEQ ID NO: 115786

SEQ ID NO: 528951 - RNA, 64 nt, Human; identical to SEQ ID NO: 115787

SEQ ID NO: 528952 - RNA, 64 nt, Human; identical to SEQ ID NO: 115788

SEQ ID NO: 528953 - RNA, 64 nt, Human; identical to SEQ ID NO: 115789

SEQ ID NO: 528954 - RNA, 64 nt, Human; identical to SEQ ID NO: 115790

SEQ ID NO: 528955 - RNA, 64 nt, Human; identical to SEQ ID NO: 115791

SEQ ID NO: 528956 - RNA, 64 nt, Human; identical to SEQ ID NO: 115792

SEQ ID NO: 528957 - RNA, 64 nt, Human; identical to SEQ ID NO: 115793

SEQ ID NO: 528958 - RNA, 64 nt, Human; identical to SEQ ID NO: 115794

SEQ ID NO: 528959 - RNA, 64 nt, Human; identical to SEQ ID NO: 115795

SEQ ID NO: 528960 - RNA, 64 nt, Human; identical to SEQ ID NO: 115796

SEQ ID NO: 528961 - RNA, 64 nt, Human
cacaaccuugaacucccaggcucaagcgauccucccgccuuaacugccugaguagcugggacua

SEQ ID NO: 528962 - RNA, 64 nt, Human
ggaauauucaguuccaaaacaagauaucuucuguccgccuuacauauagcagugacacuuguug

SEQ ID NO: 528963 - RNA, 64 nt, Human
uaagcuuccuucaaaaaaaaaagugcuuggaaaaccgccuuaggaacagaaagagcucagacca

SEQ ID NO: 528964 - RNA, 56 nt, Human
uccgauguguucuucugugaggaacaccgccuuacucugagccucgcucagcccag

SEQ ID NO: 528965 - RNA, 64 nt, Human; identical to SEQ ID NO: 115797

SEQ ID NO: 528966 - RNA, 64 nt, Human; identical to SEQ ID NO: 115798

SEQ ID NO: 528967 - RNA, 64 nt, Human; identical to SEQ ID NO: 115799

SEQ ID NO: 528968 - RNA, 64 nt, Human; identical to SEQ ID NO: 115800

SEQ ID NO: 528969 - RNA, 64 nt, Human; identical to SEQ ID NO: 115801

SEQ ID NO: 528970 - RNA, 64 nt, Human; identical to SEQ ID NO: 115802

SEQ ID NO: 528971 - RNA, 64 nt, Human; identical to SEQ ID NO: 115803

SEQ ID NO: 528972 - RNA, 64 nt, Human; identical to SEQ ID NO: 115804

SEQ ID NO: 528973 - RNA, 64 nt, Human; identical to SEQ ID NO: 115805

SEQ ID NO: 528974 - RNA, 64 nt, Human; identical to SEQ ID NO: 115806

SEQ ID NO: 528975 - RNA, 64 nt, Human; identical to SEQ ID NO: 115807

SEQ ID NO: 528976 - RNA, 64 nt, Human; identical to SEQ ID NO: 115808

SEQ ID NO: 528977 - RNA, 64 nt, Human; identical to SEQ ID NO: 115809

SEQ ID NO: 528978 - RNA, 64 nt, Human; identical to SEQ ID NO: 115810

SEQ ID NO: 528979 - RNA, 64 nt, Human; identical to SEQ ID NO: 115811

SEQ ID NO: 528980 - RNA, 64 nt, Human; identical to SEQ ID NO: 115812

SEQ ID NO: 528981 - RNA, 64 nt, Human
guggauucagaacugcagcguucaaagccccugcccgccuuagauucucauggcuaccuccucu

SEQ ID NO: 528982 - RNA, 64 nt, Human
cuaaacugagaagaaaagcauuccuguuugaucaccgccuuaguuaccaguucuggaucaguca

SEQ ID NO: 528983 - RNA, 64 nt, Human
gcuagucucaaauuccuggacugaagcuaucuacccgccuuagucucccaaagugcuaggauua

SEQ ID NO: 528984 - RNA, 64 nt, Human
uuaaaagucacaggaggagacaaauugcucacggucaugccaguugcugguuguacacucgaac

SEQ ID NO: 528985 - RNA, 64 nt, Human; identical to SEQ ID NO: 115813

SEQ ID NO: 528986 - RNA, 64 nt, Human; identical to SEQ ID NO: 115814

SEQ ID NO: 528987 - RNA, 64 nt, Human; identical to SEQ ID NO: 115815

SEQ ID NO: 528988 - RNA, 64 nt, Human; identical to SEQ ID NO: 115816

SEQ ID NO: 528989 - RNA, 64 nt, Human; identical to SEQ ID NO: 115817

SEQ ID NO: 528990 - RNA, 50 nt, Human; identical to SEQ ID NO: 115818

SEQ ID NO: 528991 - RNA, 64 nt, Human; identical to SEQ ID NO: 115819

SEQ ID NO: 528992 - RNA, 64 nt, Human; identical to SEQ ID NO: 115820

SEQ ID NO: 528993 - RNA, 64 nt, Human; identical to SEQ ID NO: 115821

SEQ ID NO: 528994 - RNA, 64 nt, Human; identical to SEQ ID NO: 115822

SEQ ID NO: 528995 - RNA, 64 nt, Human; identical to SEQ ID NO: 115823

SEQ ID NO: 528996 - RNA, 64 nt, Human; identical to SEQ ID NO: 115824

SEQ ID NO: 528997 - RNA, 64 nt, Human; identical to SEQ ID NO: 115825

SEQ ID NO: 528998 - RNA, 64 nt, Human; identical to SEQ ID NO: 115826

SEQ ID NO: 528999 - RNA, 64 nt, Human; identical to SEQ ID NO: 115827

SEQ ID NO: 529000 - RNA, 64 nt, Human; identical to SEQ ID NO: 115828

SEQ ID NO: 529001 - RNA, 64 nt, Human
uggagcuaacuccuaagcgguggggugaauguggccgccuuaguucugaagcuacuccaguuau

SEQ ID NO: 529002 - RNA, 64 nt, Human
uccacaccacaugggagcccagaggaggaggggcccgccuuagccaugugaagguggauugguc

SEQ ID NO: 529003 - RNA, 64 nt, Human
gcagaaugaggcaauaauacggaccaacaagaagccgccuuaucaaugccagcauuagcgacug

SEQ ID NO: 529004 - RNA, 64 nt, Human
aaauaggugagauaaauuaaaagauacuuaauucccgccuuaugccucagucuauucuguaaaa

SEQ ID NO: 529005 - RNA, 64 nt, Human; identical to SEQ ID NO: 115829

SEQ ID NO: 529006 - RNA, 64 nt, Human; identical to SEQ ID NO: 115830

SEQ ID NO: 529007 - RNA, 64 nt, Human; identical to SEQ ID NO: 115831

SEQ ID NO: 529008 - RNA, 64 nt, Human; identical to SEQ ID NO: 115832

SEQ ID NO: 529009 - RNA, 64 nt, Human; identical to SEQ ID NO: 115833

SEQ ID NO: 529010 - RNA, 64 nt, Human; identical to SEQ ID NO: 115834

SEQ ID NO: 529011 - RNA, 64 nt, Human; identical to SEQ ID NO: 115835

SEQ ID NO: 529012 - RNA, 64 nt, Human; identical to SEQ ID NO: 115836

SEQ ID NO: 529013 - RNA, 64 nt, Human; identical to SEQ ID NO: 115837

SEQ ID NO: 529014 - RNA, 64 nt, Human; identical to SEQ ID NO: 115838

SEQ ID NO: 529015 - RNA, 64 nt, Human; identical to SEQ ID NO: 115839

SEQ ID NO: 529016 - RNA, 64 nt, Human; identical to SEQ ID NO: 115840

SEQ ID NO: 529017 - RNA, 64 nt, Human; identical to SEQ ID NO: 115841

SEQ ID NO: 529018 - RNA, 64 nt, Human; identical to SEQ ID NO: 115842

SEQ ID NO: 529019 - RNA, 64 nt, Human; identical to SEQ ID NO: 115843

SEQ ID NO: 529020 - RNA, 64 nt, Human; identical to SEQ ID NO: 115844

SEQ ID NO: 529021 - RNA, 64 nt, Human
gccaaggcaggcggaucaccugaggucaggaguucgagauuagucuggccaacauggugaaacc

SEQ ID NO: 529022 - RNA, 64 nt, Human
ugggggggcgggguucuaaagcuguuuuuaacuccgagauuacaacuuagaggaaccaaggaaa

SEQ ID NO: 529023 - RNA, 64 nt, Human
ggagcaagacuucuaacggcugauugguauggaccgagauuaucuuucaauugaagugacuaau

SEQ ID NO: 529024 - RNA, 64 nt, Human; identical to SEQ ID NO: 115845

SEQ ID NO: 529025 - RNA, 64 nt, Human; identical to SEQ ID NO: 115846

SEQ ID NO: 529026 - RNA, 64 nt, Human; identical to SEQ ID NO: 115847

SEQ ID NO: 529027 - RNA, 64 nt, Human; identical to SEQ ID NO: 115848

SEQ ID NO: 529028 - RNA, 64 nt, Human; identical to SEQ ID NO: 115849

SEQ ID NO: 529029 - RNA, 64 nt, Human; identical to SEQ ID NO: 115850

SEQ ID NO: 529030 - RNA, 64 nt, Human; identical to SEQ ID NO: 115851

SEQ ID NO: 529031 - RNA, 64 nt, Human; identical to SEQ ID NO: 115852

SEQ ID NO: 529032 - RNA, 64 nt, Human; identical to SEQ ID NO: 115853

SEQ ID NO: 529033 - RNA, 64 nt, Human; identical to SEQ ID NO: 115854

SEQ ID NO: 529034 - RNA, 64 nt, Human; identical to SEQ ID NO: 115855

SEQ ID NO: 529035 - RNA, 64 nt, Human; identical to SEQ ID NO: 115856

SEQ ID NO: 529036 - RNA, 64 nt, Human; identical to SEQ ID NO: 115857

SEQ ID NO: 529037 - RNA, 64 nt, Human; identical to SEQ ID NO: 115858

SEQ ID NO: 529038 - RNA, 64 nt, Human; identical to SEQ ID NO: 115859

SEQ ID NO: 529039 - RNA, 64 nt, Human; identical to SEQ ID NO: 115860

SEQ ID NO: 529040 - RNA, 62 nt, Human
cuugccuucccuccucuuaaaucaggguguguuccgagauuacagaacaucacaccuuggcg

SEQ ID NO: 529041 - RNA, 64 nt, Human
cauugucaagugaagaagcuaacaguucaacuaccgagauuauuugauaaccuggguuuucuca

SEQ ID NO: 529042 - RNA, 64 nt, Human
aucuuauuucaaccucacaguugaccugagaaaucgagauuaucacuccacuuuuucagacaag

SEQ ID NO: 529043 - RNA, 64 nt, Human; identical to SEQ ID NO: 115861

SEQ ID NO: 529044 - RNA, 64 nt, Human; identical to SEQ ID NO: 115862

SEQ ID NO: 529045 - RNA, 64 nt, Human; identical to SEQ ID NO: 115863

SEQ ID NO: 529046 - RNA, 64 nt, Human; identical to SEQ ID NO: 115864

SEQ ID NO: 529047 - RNA, 64 nt, Human; identical to SEQ ID NO: 115865

SEQ ID NO: 529048 - RNA, 64 nt, Human; identical to SEQ ID NO: 115866

SEQ ID NO: 529049 - RNA, 64 nt, Human; identical to SEQ ID NO: 115867

SEQ ID NO: 529050 - RNA, 64 nt, Human; identical to SEQ ID NO: 115868

SEQ ID NO: 529051 - RNA, 64 nt, Human; identical to SEQ ID NO: 115869

SEQ ID NO: 529052 - RNA, 64 nt, Human; identical to SEQ ID NO: 115870

SEQ ID NO: 529053 - RNA, 64 nt, Human; identical to SEQ ID NO: 115871

SEQ ID NO: 529054 - RNA, 64 nt, Human; identical to SEQ ID NO: 115872

SEQ ID NO: 529055 - RNA, 64 nt, Human; identical to SEQ ID NO: 115873

SEQ ID NO: 529056 - RNA, 64 nt, Human; identical to SEQ ID NO: 115874

SEQ ID NO: 529057 - RNA, 64 nt, Human; identical to SEQ ID NO: 115875

SEQ ID NO: 529058 - RNA, 64 nt, Human; identical to SEQ ID NO: 115876

SEQ ID NO: 529059 - RNA, 64 nt, Human
guugcaagggcaaagauaacucuuaaaaaaccgucgagauuacaaugcucuagaaucagcauau

SEQ ID NO: 529060 - RNA, 64 nt, Human
uaauuucugcucagauaauugaauaguuugccaucgagauuauuuucauuuauacuauaaaaca

SEQ ID NO: 529061 - RNA, 64 nt, Human
gcgucauauuuuucucacccaaauuacguuuccacgagauuauuuauauauaguuggucuaucu

SEQ ID NO: 529062 - RNA, 64 nt, Human; identical to SEQ ID NO: 115877

SEQ ID NO: 529063 - RNA, 64 nt, Human; identical to SEQ ID NO: 115878

SEQ ID NO: 529064 - RNA, 64 nt, Human; identical to SEQ ID NO: 115879

SEQ ID NO: 529065 - RNA, 64 nt, Human; identical to SEQ ID NO: 115880

SEQ ID NO: 529066 - RNA, 64 nt, Human; identical to SEQ ID NO: 115881

SEQ ID NO: 529067 - RNA, 64 nt, Human; identical to SEQ ID NO: 115882

SEQ ID NO: 529068 - RNA, 64 nt, Human; identical to SEQ ID NO: 115883

SEQ ID NO: 529069 - RNA, 64 nt, Human; identical to SEQ ID NO: 115884

SEQ ID NO: 529070 - RNA, 64 nt, Human; identical to SEQ ID NO: 115885

SEQ ID NO: 529071 - RNA, 64 nt, Human; identical to SEQ ID NO: 115886

SEQ ID NO: 529072 - RNA, 64 nt, Human; identical to SEQ ID NO: 115887

SEQ ID NO: 529073 - RNA, 64 nt, Human; identical to SEQ ID NO: 115888

SEQ ID NO: 529074 - RNA, 64 nt, Human; identical to SEQ ID NO: 115889

SEQ ID NO: 529075 - RNA, 64 nt, Human; identical to SEQ ID NO: 115890

SEQ ID NO: 529076 - RNA, 64 nt, Human; identical to SEQ ID NO: 115891

SEQ ID NO: 529077 - RNA, 64 nt, Human; identical to SEQ ID NO: 115892

SEQ ID NO: 529078 - RNA, 64 nt, Human
aguuuagggaacaauuuggcaauuuugugguuuucgagauuaucguuuucuuaaagugccagua

SEQ ID NO: 529079 - RNA, 64 nt, Human
guuccguaggcaauaacgugcguccgccucagcgcgagauuaggaguucaaacaauggugacuu

SEQ ID NO: 529080 - RNA, 64 nt, Human
aauauuucuuacugugccgagaagccgcaaugagcgagauuaaagcuguuuaacacaccugugu

SEQ ID NO: 529081 - RNA, 64 nt, Human; identical to SEQ ID NO: 115893

SEQ ID NO: 529082 - RNA, 64 nt, Human; identical to SEQ ID NO: 115894

SEQ ID NO: 529083 - RNA, 64 nt, Human; identical to SEQ ID NO: 115895

SEQ ID NO: 529084 - RNA, 64 nt, Human; identical to SEQ ID NO: 115896

SEQ ID NO: 529085 - RNA, 64 nt, Human; identical to SEQ ID NO: 115897

SEQ ID NO: 529086 - RNA, 64 nt, Human; identical to SEQ ID NO: 115898

SEQ ID NO: 529087 - RNA, 64 nt, Human; identical to SEQ ID NO: 115899

SEQ ID NO: 529088 - RNA, 64 nt, Human; identical to SEQ ID NO: 115900

SEQ ID NO: 529089 - RNA, 64 nt, Human; identical to SEQ ID NO: 115901

SEQ ID NO: 529090 - RNA, 64 nt, Human; identical to SEQ ID NO: 115902

SEQ ID NO: 529091 - RNA, 64 nt, Human; identical to SEQ ID NO: 115903

SEQ ID NO: 529092 - RNA, 64 nt, Human; identical to SEQ ID NO: 115904

SEQ ID NO: 529093 - RNA, 64 nt, Human; identical to SEQ ID NO: 115905

SEQ ID NO: 529094 - RNA, 64 nt, Human; identical to SEQ ID NO: 115906

SEQ ID NO: 529095 - RNA, 64 nt, Human; identical to SEQ ID NO: 115907

SEQ ID NO: 529096 - RNA, 64 nt, Human; identical to SEQ ID NO: 115908

SEQ ID NO: 529097 - RNA, 64 nt, Human
gaagcgguugucuguucaccucauccuugccacuccgccuuauaccucaccaucggagaacuua

SEQ ID NO: 529098 - RNA, 64 nt, Human
cguuucacgaggucagugaggacaccccuuccugccgccuuacucuguacauagauuugcacuc

SEQ ID NO: 529099 - RNA, 64 nt, Human
agccacuuccagcuuuugaucuuggggccagaggccgccuuacacacaccccagguguccaugg

SEQ ID NO: 529100 - RNA, 64 nt, Human
aaaugguguucacagcugccauauaaaguucuacucaugccauuauuuuuaugacuucuacguu

SEQ ID NO: 529101 - RNA, 64 nt, Human; identical to SEQ ID NO: 115909

SEQ ID NO: 529102 - RNA, 64 nt, Human; identical to SEQ ID NO: 115910

SEQ ID NO: 529103 - RNA, 64 nt, Human; identical to SEQ ID NO: 115911

SEQ ID NO: 529104 - RNA, 64 nt, Human; identical to SEQ ID NO: 115912

SEQ ID NO: 529105 - RNA, 64 nt, Human; identical to SEQ ID NO: 115913

SEQ ID NO: 529106 - RNA, 64 nt, Human; identical to SEQ ID NO: 115914

SEQ ID NO: 529107 - RNA, 64 nt, Human; identical to SEQ ID NO: 115915

SEQ ID NO: 529108 - RNA, 64 nt, Human
cgaaccccggagugcugacgcgguuccccaacuuccgccuuaagaaaacaggaccagccggcac

SEQ ID NO: 529109 - RNA, 64 nt, Human
acagugccgcgugcgagaugagcucgaacacugcccgccuuacugccgccuaccccgcccgcca

SEQ ID NO: 529110 - RNA, 64 nt, Human
cccaggcccugacuucggcuucccagagaucucuccgccuuaguuaagagcaugugucgggaaa

SEQ ID NO: 529111 - RNA, 64 nt, Human
uuuucucugggacaugucuucugcccagauauggccgccuuaaaagaugcagaugcuguuguga

SEQ ID NO: 529112 - RNA, 64 nt, Human
uuuagacucuucuccaugucagcugcagcgccacccgccuuacaccugcccggccgucugucuc

SEQ ID NO: 529113 - RNA, 64 nt, Human
aaagaauuuccuucuuuuguuucuccaaaucuuuccgccuuauuuagcuugagaucuuugcagc

SEQ ID NO: 529114 - RNA, 64 nt, Human
gcugaucucaaacuccuaggcuuaagugauccucccgccuuagccucccaagugcuaggauuac

SEQ ID NO: 529115 - RNA, 64 nt, Human
ucuucgccuuucccacccuccugccccacacuccccgccuuagagccucgucccucccucacug

SEQ ID NO: 529116 - RNA, 61 nt, Human
ccugagggcaggggagaggugggguggcagacacgcagaagugcuacuagugacagggcug

SEQ ID NO: 529117 - RNA, 61 nt, Human
ugcucaucucacacacaccccccucccgggucacgcagacaccccccaaccacacacaucu

SEQ ID NO: 529118 - RNA, 61 nt, Human
ggcagcccaguccccacagucacggccaagccacgcagaacgaacaugacuccagaggacc

SEQ ID NO: 529119 - RNA, 61 nt, Human
gaacgccuguuccccuuacccgugugggggacacgcagaugagugaauuggaauguccagc

SEQ ID NO: 529120 - RNA, 61 nt, Human
ucgggccccagaggucccacuccucagccuacacgcagaggaacgggcccaccucagaguc

SEQ ID NO: 529121 - RNA, 58 nt, Human
aagaguuuauuuuuguguaaaggucacccacgcagaagucuuccugugcagggugcuu

SEQ ID NO: 529122 - RNA, 61 nt, Human
cccugccuaguuuccuuuuguuccuugaguccacgcagaauuccauucucuggucagcaga

SEQ ID NO: 529123 - RNA, 61 nt, Human
ggauagugugagugccuagcacagugucgggcacgcagaagggccccuuaaaaguuucucu

SEQ ID NO: 529124 - RNA, 61 nt, Human
uuccacucuugcuccucuacaauucauucugcacgcagaagucagaaucaaaaucaaaguu

SEQ ID NO: 529125 - RNA, 61 nt, Human
gaucccgucaguggugcugcucagcggcuugcacgcagacuugcuaggaagaaaugcagag

SEQ ID NO: 529126 - RNA, 61 nt, Human
ggugaggggcuuccuuucugcagcugagaugcacgcagacccaucucccuugucaugcugg

SEQ ID NO: 529127 - RNA, 61 nt, Human
acagacagacggacgggacagcggcccggcccacgcagagccccggagcaccacggggucg

SEQ ID NO: 529128 - RNA, 61 nt, Human
agucccgggaccauggccuccugccacacaacacgcagagaggacucaagacucccgcugg

SEQ ID NO: 529129 - RNA, 61 nt, Human
ccgugcaccagaacuccgucuuccacugccccacgcagagccaggugaagaggggcaggac

SEQ ID NO: 529130 - RNA, 61 nt, Human
cagaagaaaaccccucucucagcgcucaucucacgcagaggaugccaggcagggugaggau

SEQ ID NO: 529131 - RNA, 61 nt, Human
cucuuugucugcgugggucagaagaguugugcacgcagauuagcaggccaaggucugagcc

SEQ ID NO: 529132 - RNA, 57 nt, Human
acuacuacacagcguucugagcagagacacgcagaccagcugaggaggacaaagaua

SEQ ID NO: 529133 - RNA, 61 nt, Human
gcuccaggcuggccaggcugaaccucgcacacacgcagaguucugcucccugaggggggcc

SEQ ID NO: 529134 - RNA, 61 nt, Human
gccuucagccugcuugccucucccuagcccacacgcagacuuugaccaggaguauccagcc

SEQ ID NO: 529135 - RNA, 61 nt, Human
uaucucugaugccugaugcccauggucaacccacgcagaagaaacagaagaacucaugcug

SEQ ID NO: 529136 - RNA, 61 nt, Human
caggccuggggccccggggccugacccacaccacgcagaccccgggcuccaguuuuuaacg

SEQ ID NO: 529137 - RNA, 61 nt, Human
gcuacuugugucuugaaaucuagaauuauuucacgcagaauugucacuguuugucaggaag

SEQ ID NO: 529138 - RNA, 61 nt, Human
ggugagaagaucccaaggugaagccugucaccacgcagacagaacugcccccuauuguaga

SEQ ID NO: 529139 - RNA, 61 nt, Human
ccacaccgcuacuaaggccuacaccucuccccacgcagagggggaauucugcccuggugaa

SEQ ID NO: 529140 - RNA, 61 nt, Human
ccugcacuccacgcuggccaagaaggccuuccacgcagaaugacaagacugcaaaaauccg

SEQ ID NO: 529141 - RNA, 61 nt, Human
ccgggaggcugcgugggcuucugggcaggcucacgcagacgccggccacaccauccaccug

SEQ ID NO: 529142 - RNA, 61 nt, Human
ucugccauggcuggcgugaggcccagaggaccacgcagaggcaaugguaguacagauguca

SEQ ID NO: 529143 - RNA, 61 nt, Human
gcugcuggaaauggcuucuuuaaacugugagcacgcagagcaccccuucuccagcgguggg

SEQ ID NO: 529144 - RNA, 61 nt, Human
gucccgcuacugcuuacacaggccggguucccacgcagaggggaggcugcuccaccccuac

SEQ ID NO: 529145 - RNA, 61 nt, Human
gaagcuaaaaauacagagggugacguagaaacacgcagaaaccauucuaaagaaaguagug

SEQ ID NO: 529146 - RNA, 61 nt, Human
gugcugacagcugggagucuguggccuuccucacgcagaggccuuaaagcuggacacagaa

SEQ ID NO: 529147 - RNA, 52 nt, Human
gaaaugcccacacuuuuuagaacacgcagauccuuugucuacagagagaaaa

SEQ ID NO: 529148 - RNA, 61 nt, Human
uugagaacacacucgugugugcacauaaagacacgcagauuacauuugauaaauguuacac

SEQ ID NO: 529149 - RNA, 61 nt, Human
ggugaagagccgcagugcgcauaugaagagccacgcagagcaggagaagaaggcugcagcg

SEQ ID NO: 529150 - RNA, 61 nt, Human
ucauuguugaucacacuguugccuuggaacccacgcagaaguaaacucagccacuuugcuc

SEQ ID NO: 529151 - RNA, 61 nt, Human
cgagcagagggucauacacagggcuggaccucacgcagacuggcauggccauggguccaga

SEQ ID NO: 529152 - RNA, 61 nt, Human
caguacacacacacaggcacagaugcacacacacgcagacagacacaccgacuuuguccuu

SEQ ID NO: 529153 - RNA, 61 nt, Human
uauauuugagaugguaccuuagaaaaaguuucacgcagauccuugguugaauauaguugag

SEQ ID NO: 529154 - RNA, 61 nt, Human
ccagcuguugggacaccaaggagccugggagcacgcagaggccuguguucacucuuuggaa

SEQ ID NO: 529155 - RNA, 61 nt, Human
cacaguccgccuggccaggccuccuggccgccacgcagaauaccucgaaccaggcgggcug

SEQ ID NO: 529156 - RNA, 61 nt, Human
guccucaggccgugcggcacgacauggccagcacgcagaaggagcccucccgggacccagg

SEQ ID NO: 529157 - RNA, 52 nt, Human
uugggguggggcuguccugaugcacgcagacagcuggaagggucuugguuuu

SEQ ID NO: 529158 - RNA, 61 nt, Human
cccaggucuggaguauggacaacaugaucugcacgcagacccugcugcgucaccagggcag

SEQ ID NO: 529159 - RNA, 61 nt, Human
cucagucugggagguaauaaaagcagaccgacacgcagauguugcucgggaagcagauguc

SEQ ID NO: 529160 - RNA, 61 nt, Human
aggccagccaccccucccgcucgugcacaggcacgcagaugcgcucacacguacacacaca

SEQ ID NO: 529161 - RNA, 61 nt, Human
cacacagaaacccuccuagcagcuguccuugcacgcagagcugggguggugggccgacuug

SEQ ID NO: 529162 - RNA, 61 nt, Human
accgagccccugaacugcuguugggaaccaccacgcagaccaccagcaucgacauguggug

SEQ ID NO: 529163 - RNA, 61 nt, Human
caauguuaauaaguuucuguacaguaauaagcacgcagaauucuuuagagaaaaagaaaac

SEQ ID NO: 529164 - RNA, 61 nt, Human
guagcaggagcucaguguggugcucuucagccacgcagaaagcucacgugccugcagggcc

SEQ ID NO: 529165 - RNA, 61 nt, Human
agcgcccuuccagggcggcagcagcgggagccacgcagaccccgaggcgcaccugcuggcu

SEQ ID NO: 529166 - RNA, 61 nt, Human
ucaguaggauauauuuguuuuggcagccuaucacgcagaggcuagugguauauuuauguaa

SEQ ID NO: 529167 - RNA, 61 nt, Human
ugggauuccucccugcgaugcgugucuuucccacgcagagaagcccagucucuucucugga

SEQ ID NO: 529168 - RNA, 61 nt, Human
cucguuguuccuuuccucugucuucaagcaccacgcagaaauacacuggauguucucucuu

SEQ ID NO: 529169 - RNA, 61 nt, Human
ccuucgcacacugugauuuugcccuccugcccacgcagaccugcagcgggcaaagagcucc

SEQ ID NO: 529170 - RNA, 61 nt, Human
ccggccucggccucccaaaguacugggauuacacgcagaaggcaccaugcccaggcuagau

SEQ ID NO: 529171 - RNA, 56 nt, Human
ccgcuuccggggagaagugaggacgucacgcagacagcacugucaacacugggccu

SEQ ID NO: 529172 - RNA, 61 nt, Human
auguucagagucacacugccgcccggucugccacgcagagguccaacuugccacccgcguc

SEQ ID NO: 529173 - RNA, 61 nt, Human
gugagcucugagggcaagcccugggcccagccacgcagagacccuggcugcccuggcucuu

SEQ ID NO: 529174 - RNA, 61 nt, Human
cguuccuccgaaucccgucggcuucucgacccacgcagagaagccccgggcuuggcggcuc

SEQ ID NO: 529175 - RNA, 61 nt, Human
ggugagggcugggcuuuugcuguccucuucucacgcagaguucugccaggagggugugcug

SEQ ID NO: 529176 - RNA, 61 nt, Human
cuggcuggcugaugagcaaagccuuugcucucacgcagaggaaggcuuggauguacaauga

SEQ ID NO: 529177 - RNA, 61 nt, Human
ugaagggccacagccccucuuggcugccaagcacgcagaucccauggacauuuggggaaag

SEQ ID NO: 529178 - RNA, 61 nt, Human
ccuacaagugugccuacugcgucaugggcuucacgcagaagagcaacaugaagcugcacau

SEQ ID NO: 529179 - RNA, 61 nt, Human
cggccgcacacucgacuuuccuggugcucaccacgcagaggggcacgggccagccucgggc

SEQ ID NO: 529180 - RNA, 61 nt, Human
uccucugcccacgagagcagggaguuggggccacgcagaaauggccucaaggggacucugc

SEQ ID NO: 529181 - RNA, 61 nt, Human
ggaaggcucgacgcuccaggacaggaccagccacgcagacaggucgauuugcccaggcccg

SEQ ID NO: 529182 - RNA, 61 nt, Human
ccuccccacaucuguuacagccgcuuacaaacacgcagauggcaagaagauugauggcagg

SEQ ID NO: 529183 - RNA, 61 nt, Human
gacagcccccuccagugccacaggguacgcacacgcagagccccgccugugcacacgcgug

SEQ ID NO: 529184 - RNA, 61 nt, Human
accuccaugccgaccucauccuaacuccacucacgcagacccaaccuaaccuccacuagcu

SEQ ID NO: 529185 - RNA, 61 nt, Human
gucacggagaaacacaaacaccacccaggaacacgcagacauaugcccauagcaucccaca

SEQ ID NO: 529186 - RNA, 61 nt, Human
agcagcccacggggccacacagagaaacaaccacgcagacagucacaccacggggacacac

SEQ ID NO: 529187 - RNA, 60 nt, Human
cggccagcauccgcgagugagcagucugcccacgcagaggacgcacgcucgcugccauca

SEQ ID NO: 529188 - RNA, 61 nt, Human
aagugcgccaggggcuuggcauggugcccggcacgcagaaagugcucaauaaauguuuuug

SEQ ID NO: 529189 - RNA, 61 nt, Human
gcucacacacaaccucacgcgcacacacacacacgcagauggaggcgccucacugggaggu

SEQ ID NO: 529190 - RNA, 61 nt, Human
uuacuggaaacuuuuuguacaauaaagcaaucacgcagauuaaagaacauccugcaauccu

SEQ ID NO: 529191 - RNA, 61 nt, Human
uuuugugaagaagggaagcuggggcagguaacacgcagagccgccacguggaacggucugu

SEQ ID NO: 529192 - RNA, 61 nt, Human
uucuuggaagcaaggacucaaaggcaaggugcacgcagaggacguuugagucugggaugaa

SEQ ID NO: 529193 - RNA, 61 nt, Human
cguuugaauggaggagguguugagugagcaacacgcagaagcucgccuacaguuucguuuc

SEQ ID NO: 529194 - RNA, 61 nt, Human
ggcuucuguucuuauucuugaguuuugauaccacgcagaccuuggguggggagagcuuccu

SEQ ID NO: 529195 - RNA, 61 nt, Human
agaagcgccucuuccccuggaagcugcacaucacgcagaaggacaacuacagggucuacaa

SEQ ID NO: 529196 - RNA, 61 nt, Human
uggcacaccugcgggaggcagcgacggcccccacgcagacgccgggaacgcaggccgcuuu

SEQ ID NO: 529197 - RNA, 61 nt, Human
acgcggccacgaccacagacacgcaugcacacacgcagaggugcagagcgaggaggccggc

SEQ ID NO: 529198 - RNA, 61 nt, Human
cgugggcgaccuggaggagauccagcgugcgcacgcagaguaccugcacaaggccgucuuc

SEQ ID NO: 529199 - RNA, 61 nt, Human
ccaggaacacaugcacacacacacacacacacacgcagacacacacacacacacacauaua

SEQ ID NO: 529200 - RNA, 61 nt, Human
cuuccaaacaauucugagaaacaaaaacacacacgcagaauuaacaauucuuuucccugug

SEQ ID NO: 529201 - RNA, 61 nt, Human
gaggccaagcagccgagcgagagcagcaggucacgcagaaaaaacugagcagcgccaacuc

SEQ ID NO: 529202 - RNA, 64 nt, Human
uauugauagcuuucauaaucucagcuuuuuugaacuuccacaauuuuuggaauaugucauaauu

SEQ ID NO: 529203 - RNA, 64 nt, Human
gcucuuuacccuuccauuuuagccuuccacccagcuuccacaaaagauuuggcucuaccuugga

SEQ ID NO: 529204 - RNA, 64 nt, Human
ucccccaacccugccaucucccuuacucaucccucuuccacagcuuccccuuucuagcccccuc

SEQ ID NO: 529205 - RNA, 64 nt, Human
acuguaucaggguuuaacuuuuacuauuucagaucuuccacagcuuguaauuucaucaagggaa

SEQ ID NO: 529206 - RNA, 64 nt, Human
ugcucccaucaggaauaggagaguagacagagaucuuccacaucccaggcuucugcugcugcuu

SEQ ID NO: 529207 - RNA, 64 nt, Human
agugauuggagaauguccugggggaaugaaguuccuuccacaaacacagcucaguucuuagcaa

SEQ ID NO: 529208 - RNA, 53 nt, Human
caggaaaccuucgaaucugagaacuuccacaccugaggcaccugagagaggaa

SEQ ID NO: 529209 - RNA, 64 nt, Human
uguaauugaaaaccaaccgauugccuuuauuuugcuuccacauuuucccaauaaauacuugccu

SEQ ID NO: 529210 - RNA, 64 nt, Human
uagauugcacacuauaauuuuacauaagaucugccuuccacacuucccugcuggaaggcauucu

SEQ ID NO: 529211 - RNA, 64 nt, Human
cugucuugaagacccuguuaacuuugugaaauaacuuccacauuucaacacacuucacaguaca

SEQ ID NO: 529212 - RNA, 64 nt, Human
uguauggggcugcaguuggucucccuggaggggacuuccacaccuccugccuuuaggccauggg

SEQ ID NO: 529213 - RNA, 64 nt, Human
aaaaauuucuuuuccaugucauucuugggaaugucuuccacaggauuugagaauaguuucaucu

SEQ ID NO: 529214 - RNA, 64 nt, Human
ugccuugccgcaguaggagggaaaucucaccuuccuuccacauacugucuugagccuuugcuaa

SEQ ID NO: 529215 - RNA, 64 nt, Human
caggcagaagcccacugguaugggccucccgccccuuccacauccauguugugauuggauccau

SEQ ID NO: 529216 - RNA, 64 nt, Human
cccagaagugccaccucaucauaauucaaguguucuuccacacagcguugcccccacaaccacg

SEQ ID NO: 529217 - RNA, 64 nt, Human
ccccgucuugccagugacacuugaagccucccgacuuccacagagugcuucaggacacauuuug

SEQ ID NO: 529218 - RNA, 64 nt, Human
cacugaccaggaggccgaggucucuaacucuuaucuuccacaggguccaagaguucaucaggac

SEQ ID NO: 529219 - RNA, 64 nt, Human
ccguuucuugccccagugugguuugcauugucuccuuccacaaugacugcuuuguuuggaugcc

SEQ ID NO: 529220 - RNA, 64 nt, Human
cagaaaauggaagacagcucuuauauugccauuucuuccacaagagcccaggccuccuacagcu

SEQ ID NO: 529221 - RNA, 64 nt, Human
uugggcauugcuuggcucuuuaaacacaucagugcuuccacauucaccuauguauuuauuauuc

SEQ ID NO: 529222 - RNA, 64 nt, Human
gcuucccgagguauuucaccucuuaagagggaaucuuccacaagcccagcacaagcugccaggc

SEQ ID NO: 529223 - RNA, 64 nt, Human
gcuggccaaucuuaucagaagugagcuaccaaaacuuccacagaugugagauuuaacacuuaau

SEQ ID NO: 529224 - RNA, 64 nt, Human
uaggcgauuuugucauuaaacaucauagcauguacuuccacaaaccuagaugguauagccuacu

SEQ ID NO: 529225 - RNA, 64 nt, Human
accuuuuuuuuccaguugaaauguauuaacacaccuuccacaaucauuuuauaagagucagcau

SEQ ID NO: 529226 - RNA, 64 nt, Human
uuuucccaguaaaugaggcaagcaauucuaagaucuuccacaaaacaucuagccaacuaaaaug

SEQ ID NO: 529227 - RNA, 64 nt, Human
acccacaccugugauguuguguguguugggggagcuuccacaggagccacacuggggaaaagcu

SEQ ID NO: 529228 - RNA, 64 nt, Human
cuuguuacucccuguuauuuuucugcccuggguucuuccacagcacaaacacaccucugccacc

SEQ ID NO: 529229 - RNA, 64 nt, Human
ggaugaugacaguuuauuuucuacacuuccccuccuuccacauuuguaucaccuuugcuaucuu

SEQ ID NO: 529230 - RNA, 64 nt, Human
gcuucuucaaagagauuuucuucucuagucuagccuuccacauucuuagauuaauauggccaac

SEQ ID NO: 529231 - RNA, 64 nt, Human
cagggacuagaagccucaguuuccccauuuuacccuuccacacaauagccucuguagguuaggc

SEQ ID NO: 529232 - RNA, 64 nt, Human
gggcucuaaguuuauuuauuucguuagauugacacuuccacacacucccuguaguccagguagg

SEQ ID NO: 529233 - RNA, 64 nt, Human
gcacuggauaaauuguuugguuuugcuuuucucucuuccacaaaauuggaagcuuuuuuuaaaa

SEQ ID NO: 529234 - RNA, 56 nt, Human
ccaaaacgaagaagaacugauuggggcuuccacagcccuccucucccaagaaaucc

SEQ ID NO: 529235 - RNA, 64 nt, Human
caauauuguaaugcuggguuccaucaacacccaccuuccacaacucagucugcaccucaguugg

SEQ ID NO: 529236 - RNA, 64 nt, Human
guacccuucucagaucaacucccuggugauguuucuuccacauacaucugugaaaugaacaagg

SEQ ID NO: 529237 - RNA, 64 nt, Human
gugccaucaaagcacgguugggucucccuuguaucuuccacaguguguagaaauuugugcugcc

SEQ ID NO: 529238 - RNA, 64 nt, Human
cuagagaacaggaaaagagacuaggauaauacaucuuccacacauuuggcccacugauaauguu

SEQ ID NO: 529239 - RNA, 64 nt, Human
cuucuucagccaccucucuuuuucaguuggcugacuuccacaccuagcaucucaugagugccaa

SEQ ID NO: 529240 - RNA, 64 nt, Human
aaugcagguugcagcguguguguuacaugaggaucuuccacaauuucagaaugcacgccagagc

SEQ ID NO: 529241 - RNA, 64 nt, Human
ucuuuguuggaucaaauacuacuacacuauuacacuuccacacuauuuauuuggggaugggcug

SEQ ID NO: 529242 - RNA, 64 nt, Human
uuaaacuaccuaucucaugcaaugaaagcauuuucuuccacaaagagcuuaauccucaugauag

SEQ ID NO: 529243 - RNA, 64 nt, Human
ucaaccgaugagcccacucacucguacaugccuucuuccacagugggaagcaugaucuggcagg

SEQ ID NO: 529244 - RNA, 52 nt, Human
gacaaaggagcuuggccugaaacuuccacacagaauuuuagucaaugaagaa

SEQ ID NO: 529245 - RNA, 64 nt, Human
uacguagaacaccucagagauuuuucuucaggaacuuccacaaacuuugaauccuuguaucuuu

SEQ ID NO: 529246 - RNA, 64 nt, Human
caauuuuggaucccgaauuuugauguaccuuaaacuuccacaucacugcacccugaaacagagc

SEQ ID NO: 529247 - RNA, 64 nt, Human
cuucaauaauugugacuggccucaggaauucucccuuccacaccugcccaccucaccucacugc

SEQ ID NO: 529248 - RNA, 64 nt, Human
acagauggccaacccaccuccagauuccccagugcuuccacacccgggcucugagcaaauggaa

SEQ ID NO: 529249 - RNA, 64 nt, Human
aaagagaacccuuguucccuuccuaagaaacugccuuccacaauuaaagaauacucauagaaag

SEQ ID NO: 529250 - RNA, 64 nt, Human
uauguguaacauucaaaugugugcauuaaauaugcuuccacaguaaaaucugaaaaacugauuu

SEQ ID NO: 529251 - RNA, 64 nt, Human
acuucugagacggcaaagccaaccacuuagaagccuuccacaucuuugucaccugccuggcucc

SEQ ID NO: 529252 - RNA, 64 nt, Human
uccccacuaaaacaaaacaaaaaacuuuuaaugccuuccacauuaauuagauuuucuugcaguu

SEQ ID NO: 529253 - RNA, 64 nt, Human
ucguggacaaugucuacugcauugggcagcggcgcuuccacaccauggacgagcugguggaaca

SEQ ID NO: 529254 - RNA, 64 nt, Human
cuguauuuucuacuguaauaauguaauuuaaggccuuccacaaugaacaguucacuuuauuccc

SEQ ID NO: 529255 - RNA, 64 nt, Human
cccauuccucugucccugcagacucagugcagcacuuccacaccaagaaggcccucaauaaagg

SEQ ID NO: 529256 - RNA, 64 nt, Human
uccagccucugccuguuacccaguuccaaagucacuuccacauuuuggguauuucuucagcagg

SEQ ID NO: 529257 - RNA, 64 nt, Human
cucggaaaauauaauaacaucccugaauucaggacuuccacaagaugcagaacaaaauggauaa

SEQ ID NO: 529258 - RNA, 64 nt, Human
gauuuccuucauaucccaugcuguuuaacuaucucuuccacaguccuagaaucaaucuuuuuua

SEQ ID NO: 529259 - RNA, 64 nt, Human
acaaacauauguccaaggacucuaaauugagacucuuccacauguacaaucucaucauccugaa

SEQ ID NO: 529260 - RNA, 64 nt, Human
guuagugacccagagcuauaaucauccaucaagucuuccacaauaauucccaacucauaaauug

SEQ ID NO: 529261 - RNA, 64 nt, Human
ggcggacucuggccaucauguugacagccuugcacuuccacaggcuacaagcccugggaccauc

SEQ ID NO: 529262 - RNA, 64 nt, Human
cacugcugugaccacgacacugcuggggcagcuucuuccacagugaugccuacugaugcuucag

SEQ ID NO: 529263 - RNA, 64 nt, Human
caaagccaggcccauagugcuugcugggcucucucuuccacaucauccagaagacacacauuug

SEQ ID NO: 529264 - RNA, 64 nt, Human
uuaauuuuuuuaguuguuucccuucacuuucagucuuccacacacaaaaaauaccucacagagc

SEQ ID NO: 529265 - RNA, 64 nt, Human
gaaggaccaaggagaugaagcaaacacauuaagccuuccacacucaccucuaaaacaguccuuc

SEQ ID NO: 529266 - RNA, 64 nt, Human
cagcaguggaaggcugcacacaggcacauuccuucuuccacaguggggcaccaaggauucuguc

SEQ ID NO: 529267 - RNA, 64 nt, Human
cuaggccacugggaguuguggcugggcuucccaucuuccacagagacaucucccugugggaugg

SEQ ID NO: 529268 - RNA, 64 nt, Human
ccagcagaaaauauucuagcucagcuuuacucuucuuccacacuaggcugggcccagcaauaca

SEQ ID NO: 529269 - RNA, 64 nt, Human
ggcuggaaauaauccaauuauuccugcuuggauucuuccacagggccuguguaagaauggguuc

SEQ ID NO: 529270 - RNA, 64 nt, Human
uguuagacagccacaguccugucuggguuagggucuuccacauuugaggauccuuccuaucucu

SEQ ID NO: 529271 - RNA, 64 nt, Human
ggaguauagugguaaguaagcucugacuuggcuccuuccacaaaccaaaaagcuggaacuuacc

SEQ ID NO: 529272 - RNA, 64 nt, Human
uucuuucaguggucuggggagaauguaaucauuccuuccacaacugcugcaugucccugugggu

SEQ ID NO: 529273 - RNA, 64 nt, Human
gugaaucagucuguuuauuaagcacuuaucagggcuuccacacacuuauuuauuuugcccuagu

SEQ ID NO: 529274 - RNA, 64 nt, Human
uagaccagucagguuuuugaagacauauagguaacuuccacagaaaacacaaacauguauuuaa

SEQ ID NO: 529275 - RNA, 64 nt, Human
auguaggaucuugaugggccuuuguucccaaggacuuccacauuuuugcacagauuaugcucca

SEQ ID NO: 529276 - RNA, 64 nt, Human
cccagccccuucccuucuccaggcccagagaacucuuccacaaacaagaugagagccacucggg

SEQ ID NO: 529277 - RNA, 64 nt, Human
cugcauccugucuuaauccaagguacuggaaaaccuuccacaugcccaaccugagaccuguucc

SEQ ID NO: 529278 - RNA, 64 nt, Human
gcaccauagccugcggcuccccuauucaggucuccuuccacaacucugaagagagagaccacug

SEQ ID NO: 529279 - RNA, 64 nt, Human
uggaacaugcugccacuuuucaauucugucagugcuuccacauggaaacaaaaugcaauaaaau

SEQ ID NO: 529280 - RNA, 64 nt, Human
aacuuggggauggcugagggaacauagacucacucuuccacauucccaaguuggucuagugugc

SEQ ID NO: 529281 - RNA, 64 nt, Human
aauuuuguucuugacaguuaacugacuaaucuuacuuccacaaaauaugugaauuugcugcuuc

SEQ ID NO: 529282 - RNA, 64 nt, Human
gcagcugcuaaaacuacauguggccagcuccauucuuccacacugcguacuacauuuccugccu

SEQ ID NO: 529283 - RNA, 64 nt, Human
ucauguuacucaugacuccuuucucuaaaacugccuuccacaauucacuagaccagaaguggac

SEQ ID NO: 529284 - RNA, 64 nt, Human
uguuguguauacuucagaguacuuuucaugaguucuuccacagugaacccuuggauuaccuggu

SEQ ID NO: 529285 - RNA, 64 nt, Human
auaauuauauauagagauagacuuguguauacaccuuccacaaacacauccucacggagauaca

SEQ ID NO: 529286 - RNA, 64 nt, Human
gccacugcccugcuccagagaguggaccuugacucuuccacaccugccuauacucacuaauguu

SEQ ID NO: 529287 - RNA, 64 nt, Human
agggcauaggacagauuccccaaauugcuuuaugcuuccacauaacuagagcacuucaaucuau

SEQ ID NO: 529288 - RNA, 64 nt, Human
auauauuugugaauuacuucugaggaaaugcuaacuuccacagcauuguauuuaauuauaacaa

SEQ ID NO: 529289 - RNA, 64 nt, Human
ccauuuuagucccauuugacucacuucagaccaucuuccacacacuaugucugugcuuggagag

SEQ ID NO: 529290 - RNA, 64 nt, Human
caggagccuucuccgcaguuggcuuccucgguagcuuccacacggagcaugcccgagagccugg

SEQ ID NO: 529291 - RNA, 64 nt, Human
uuauaaaacaguccuguguaaacugcuggaaguucuuccacagucaggucaauuuugucaaacc

SEQ ID NO: 529292 - RNA, 64 nt, Human
gaggcuugcuaauuggggaugcuucuuagagcaucuuccacaucaacuccccuggcugcuggcu

SEQ ID NO: 529293 - RNA, 64 nt, Human
ugggcagaguccccugcaaggaggcagggcccagcuuccacauccggagcccuggucagcauag

SEQ ID NO: 529294 - RNA, 64 nt, Human
ugccccugagagaucuaguccuguccugugauggcuuccacaaacccuguuggaaguuuggguu

SEQ ID NO: 529295 - RNA, 64 nt, Human
uugagggcaagagccacaguauauuucccuguuucuuccacagugccuaauaauacuguggaac

SEQ ID NO: 529296 - RNA, 64 nt, Human
aaugauuaggcaaacuagaugaaaagauuaggggcuuccacacugcauagauuacacgcacaua

SEQ ID NO: 529297 - RNA, 64 nt, Human
uuuguuguugguuccuuuuagaccacggcugccccuuccacaccccaucuugcucuaaugauca

SEQ ID NO: 529298 - RNA, 64 nt, Human
cuucuguggcugucuuguuucugaaguacuuaaacuuccacaagagugaauuugaccuaggcaa

SEQ ID NO: 529299 - RNA, 64 nt, Human
ugauacuuuuccacaggcaucucugcaugaauuucuuccacaguaaaaauacguuuuuuguaaa

SEQ ID NO: 529300 - RNA, 64 nt, Human
ucacuuggccugcaaacaacagaguuauccguaucuuccacaugugaaugucauugcaagggug

SEQ ID NO: 529301 - RNA, 64 nt, Human
ggucccccagcucuuagcaggaugcaggcuauugcuuccacaccccuggccgugagaacguggu

SEQ ID NO: 529302 - RNA, 64 nt, Human
ccauuggguuaaggggugccgagcacuagcuagacuuccacauagucccaccccaagugggcgg

SEQ ID NO: 529303 - RNA, 64 nt, Human
aagaaaauaggcacuuucucugaaagaccugcuccuuccacaagaagugcauagguccauaaua

SEQ ID NO: 529304 - RNA, 64 nt, Human
ucaugacgcccuguagcauaccccuagguaccaacuuccacagcagucucguaaauucuccugu

SEQ ID NO: 529305 - RNA, 55 nt, Human
cuagaaguuuucgaauguaauaauacuuccacagcaacaggugcuagagaccacu

SEQ ID NO: 529306 - RNA, 64 nt, Human
cuacucacucggaagcuccagcuaacuguaggaucuuccacacccuaaggcuucagcuugagaa

SEQ ID NO: 529307 - RNA, 64 nt, Human
gaccaucuaaaaucaugcuagucuaaaccaugcucuuccacacagcuguuuaaaaaccacuggg

SEQ ID NO: 529308 - RNA, 64 nt, Human
uuuaacauguguggucuugguauucuuaagggaacuuccacauuauacauuugauguauugacc

SEQ ID NO: 529309 - RNA, 64 nt, Human
gugggccuucaggccugguucgcuacaacaaugucuuccacaacucaaacucccaccgcgcuca

SEQ ID NO: 529310 - RNA, 64 nt, Human
cacuacauaauugcuguucugcugaaucaaaucucuuccacaugggugcauuuguagcucugga

SEQ ID NO: 529311 - RNA, 64 nt, Human
acagguaacagcagauuaaucauagaaaauguugcuuccacauuaacaaaacaaucacugaaaa

SEQ ID NO: 529312 - RNA, 58 nt, Human
acaaggaucuugugaucuaaauccacuccuuccacaguaccggauucucucuuuaacc

SEQ ID NO: 529313 - RNA, 64 nt, Human
cugugugcagggacugauuccucagcacacgaggcuuccacaacccagucugcuccauagcacu

SEQ ID NO: 529314 - RNA, 64 nt, Human
cuuccagaauuuucugauguacacaaauaacugacuuccacaagagggcuuuuccacacucggu

SEQ ID NO: 529315 - RNA, 64 nt, Human
ggaaaaggggcagcauguggggaaugccccccgccuuccacaaauccuuuugcugacccaggaa

SEQ ID NO: 529316 - RNA, 64 nt, Human
ucuuuuccuucucuaucucucuuauuuagucuuccuuccacacccuucacucaccaucuuuucc

SEQ ID NO: 529317 - RNA, 64 nt, Human
ccugcuuuagaauguuuuccuucuacuuacacaucuuccacaggucucagaaucuuuccuuccu

SEQ ID NO: 529318 - RNA, 64 nt, Human
uauauaaggaggucagagauggacuguggccaggcuuccacauuccugaagcacacagaucuca

SEQ ID NO: 529319 - RNA, 64 nt, Human
aaaacaaagcuacaauuugcccucauacacacugcuuccacagcuugcuaguucuguguuuacu

SEQ ID NO: 529320 - RNA, 64 nt, Human
uuacuuuuccagccaaauccaguagcagaaucaucuuccacaacaaggaauuaaaguaauuaaa

SEQ ID NO: 529321 - RNA, 64 nt, Human
uuaucuaacuaguguccacaacccuguaaccauacuuccacaucuucagcuuaggcagacaucg

SEQ ID NO: 529322 - RNA, 64 nt, Human
uacaguauaguuuucucuauucuuuuguuucccccuuccacauucuuuuauuauacaugaagua

SEQ ID NO: 529323 - RNA, 64 nt, Human
acuugagcagugggugacacaacacaguguuugucuuccacagggaagcuuaaaacaaaagaua

SEQ ID NO: 529324 - RNA, 64 nt, Human
cagguggaagugauuuuaucuucugcucuuucuucuuccacacaugcaaggugaaagggugugg

SEQ ID NO: 529325 - RNA, 64 nt, Human
gucucuguugcuuuuagcaucucauuccuugugacuuccacagcuuucuuuucuacagcugcua

SEQ ID NO: 529326 - RNA, 64 nt, Human
aguauuugaaugcauuuaggcuuaauuucuucgccuuccacauguuaacaguagagcucuaugc

SEQ ID NO: 529327 - RNA, 64 nt, Human
aaacauacggugaauaauucacgcucacgucguucuuccacaguaucuuguuuugaucauuucc

SEQ ID NO: 529328 - RNA, 64 nt, Human
gugaaauagcagacauucugcuuacucaugucuccuuccacaguuuacuuccucgcucccuuug

SEQ ID NO: 529329 - RNA, 64 nt, Human
gcaugaugaaaagcuuuccugcuuggcucuuauucuuccacaagagaggacuuucucaggcccu

SEQ ID NO: 529330 - RNA, 64 nt, Human
gcaggaugaaaagcuuuccugcuuggcaguuauucuuccacaagagagggcuuucucaggaccu

SEQ ID NO: 529331 - RNA, 64 nt, Human
ggaaggaaguuaauaccuauguaauacauagaaacuuccacaauaaaaugccauugaugguuga

SEQ ID NO: 529332 - RNA, 64 nt, Human
ccgcuggucuucuccuaggacuaaguccaggugccuuccacaaucucauggucuuucagguccc

SEQ ID NO: 529333 - RNA, 64 nt, Human
guuucgcuuuccuucuucuuggcuuccucuuauucuuccacaaaccauucucaauaaagccaaa

SEQ ID NO: 529334 - RNA, 64 nt, Human
gaugcuuuagaucagacuagguuuuaaucauuaacuuccacaaagaagucauacuuugcguuag

SEQ ID NO: 529335 - RNA, 64 nt, Human
uaugaugcguauuuauuuuucugcaccuuccuuucuuccacaaacacauauugauagaugcaag

SEQ ID NO: 529336 - RNA, 64 nt, Human
auuauucuuuuuauugcaaguauuuccuaugauccuuccacacuuuauuuccuuaauaauaaua

SEQ ID NO: 529337 - RNA, 64 nt, Human
aauguggccucaaaugucaugccaauuuucacaucuuccacaaacuccauuuagggagaaaugu

SEQ ID NO: 529338 - RNA, 64 nt, Human
cucccauauccagaacaaaaugauacuugacauccuuccacaaaagucagccuaaagaaguuau

SEQ ID NO: 529339 - RNA, 64 nt, Human
uccgcaccgccaggcucagccccugcccaccccacuuccacauggcccucgucccuuccugccc

SEQ ID NO: 529340 - RNA, 64 nt, Human
uuauaagucuuacauaaaccauuuuuguuacucucuuccacauguuacuggauaaauuguuuag

SEQ ID NO: 529341 - RNA, 64 nt, Human
aaguguauguucaagaaaauuaaaugguaccacucuuccacaguuuggaauaauuuuauaauug

SEQ ID NO: 529342 - RNA, 64 nt, Human
ccccccacccuuccucugggaaacugacagcugucuuccacagccucugauguggaccugguac

SEQ ID NO: 529343 - RNA, 64 nt, Human
auacagauuauucauaaaauuuuucagugcuguccuuccacauuuaauugcauuuugcucaaac

SEQ ID NO: 529344 - RNA, 64 nt, Human
auaaacauuugcaccacuuguggcuuuugaauaucuuccacagagggaaguuuaaaacccaaac

SEQ ID NO: 529345 - RNA, 64 nt, Human
guucugccuuuauguaguaguugggcauauaauccuuccacacagccccugcagggaaaggcua

SEQ ID NO: 529346 - RNA, 64 nt, Human
uuuuguacgaucagccuuacugcuaauaaaagcacuuccacagggcuccugacucucguguguu

SEQ ID NO: 529347 - RNA, 64 nt, Human
ugucuuaugcucaauuauuugguguugagccucucuuccacaagagcuccuccauguuuggaua

SEQ ID NO: 529348 - RNA, 64 nt, Human
uuauuauaaucugaaccuagguauauccuuuggucuuccacagucauguugaggugggcucccu

SEQ ID NO: 529349 - RNA, 64 nt, Human
agaggguuuacacaaagugccacuuauuaaagagcuuccacagugaagauggagaaggugaacu

SEQ ID NO: 529350 - RNA, 64 nt, Human
agaaccuaaaaguauuauucaaaccaauuucuuccuuccacaguuaucuuagcuggauauaaug

SEQ ID NO: 529351 - RNA, 64 nt, Human
cuagcugagcuucuucauucuccuucuucuccuucuuccacaaagacccauaucuggagaaggu

SEQ ID NO: 529352 - RNA, 64 nt, Human
uuuggguuuagguuguaauuccuuauauuucuuucuuccacaguguaucggaucugucguucug

SEQ ID NO: 529353 - RNA, 64 nt, Human
accugcgugucccuuccuccccgagucagggcgacuuccacagcagcagaacaagugccuccug

SEQ ID NO: 529354 - RNA, 64 nt, Human
auuagcaauguuaauucuauucaaccagcaccugcuuccacagaaauucuguccaaacuaucau

SEQ ID NO: 529355 - RNA, 64 nt, Human
ugagggcaggccuguaucuuuuacuucuguguaacuuccacagcuuuugacugcauuggaguca

SEQ ID NO: 529356 - RNA, 64 nt, Human
ccagggcucuuccuccucaccagaaaucccugggcuuccacaaugugaacucacucauugucag

SEQ ID NO: 529357 - RNA, 64 nt, Human
agucucagguugugugccccuaaaucaagauuugcuuccacagaagccauuacuugcaauuuuu

SEQ ID NO: 529358 - RNA, 64 nt, Human
uccuguauguguagccacucgaugccuaaccuaccuuccacaagccagccccgcaucccugcuc

SEQ ID NO: 529359 - RNA, 64 nt, Human
cauauuagaagaaaaaaaaaagcuuuguauuauucuuccacauaugcuggcugcuguuuacaca

SEQ ID NO: 529360 - RNA, 64 nt, Human
auucaugguauuuauuuguuauucuucaaugacccuuccacaucaacaguauuuaucauguguu

SEQ ID NO: 529361 - RNA, 64 nt, Human
aauuuuccgaaccucucaaaguauguuuuccguucuuccacagaaauaugcaaaacaguucauc

SEQ ID NO: 529362 - RNA, 64 nt, Human
aaccauguaccuuaugaagaccuuuguuuuaagacuuccacacaccaaggcuacaaugacuguu

SEQ ID NO: 529363 - RNA, 64 nt, Human
guuuucugcaaguucauguuuugcauuuuauguucuuccacaauugaucugauguucaggaaaa

SEQ ID NO: 529364 - RNA, 64 nt, Human
agaaggugccaguccggucccaggucccuugucccuuccacagaggccuuccuagaagaugcau

SEQ ID NO: 529365 - RNA, 64 nt, Human
ccucagacaagauauugaaccucauucaguuucacuuccacauguauguacaaguuaggucacc

SEQ ID NO: 529366 - RNA, 64 nt, Human
gucuugauuaggugcaucuaucucuucgcucugucuuccacaaacaaaaauucugccuucagac

SEQ ID NO: 529367 - RNA, 64 nt, Human
gcacagugguuuucacagccacugcaggauucaucuuccacaucuucucaccucuucuugaaac

SEQ ID NO: 529368 - RNA, 64 nt, Human
aggagcuaguuuaccagccugugacaacugagugcuuccacaaugucuguaaaguaaguagaau

SEQ ID NO: 529369 - RNA, 64 nt, Human
ucugcggcuguguucuuauuuauugcaugcgucgcuuccacaggggccccucaagagcugugac

SEQ ID NO: 529370 - RNA, 64 nt, Human
ggcagucucagcaaguccucaugcuguucuuggucuuccacaagaaagugaagcugucagcuua

SEQ ID NO: 529371 - RNA, 64 nt, Human
gcauuuaaaaugugugacacagaaacggcacacucuuccacaugcuuuugaaguauuauaaaac

SEQ ID NO: 529372 - RNA, 64 nt, Human
uacuucacaaaugguuauaaagucauauccacuucuuccacaaugaccacagcaaaugaccaag

SEQ ID NO: 529373 - RNA, 64 nt, Human
cagagcuaaaucuggaaaacacauuuggaaugagcuuccacacuucagucuaaaaucucaccca

SEQ ID NO: 529374 - RNA, 64 nt, Human
ucaccuccgccuccaggaagaccagacucccacccuuccacaccuccagagcagugggacuucc

SEQ ID NO: 529375 - RNA, 64 nt, Human
gaugguuggaagacggauuugcuuugguauucugcuuccacaugugccaguugccuggauuggg

SEQ ID NO: 529376 - RNA, 64 nt, Human
gaugcugaaauuguuuuuaaauugaaguuucuuucuuccacaaagcagccguuucuauucaaau

SEQ ID NO: 529377 - RNA, 64 nt, Human
uggcuggggaauuguccacgaggaagccucugcacuuccacacauggcacaguucugccuguga

SEQ ID NO: 529378 - RNA, 64 nt, Human
uuacuuacccagggaugccacccuuucgucaccucuuccacagagcacuuuggcauguaaacaa

SEQ ID NO: 529379 - RNA, 64 nt, Human
cugccuggaguuggaaaagaaacaacacucaguccuuccacacuuccacccccagcuccuuucc

SEQ ID NO: 529380 - RNA, 64 nt, Human
guccugggguguuucagacccuucugggcaucuccuuccacagcuguucaguuugucggucucu

SEQ ID NO: 529381 - RNA, 64 nt, Human
ggaaaguccuuuuugcccuucuccaaaaaauaaccuuccacagagacaaacuguccuucuaucc

SEQ ID NO: 529382 - RNA, 64 nt, Human
gggaaaggacucuguccccuuggggcucaucacccuuccacauccuccuccucguugcccccug

SEQ ID NO: 529383 - RNA, 64 nt, Human
ccaagaugcugcuacacagaugccaaauggaaaucuuccacagggcuuuuucaguaaacacgug

SEQ ID NO: 529384 - RNA, 64 nt, Human
uuguaauauucccugcauucucugucgucugccucuuccacauaauguccuuugcuuucauguu

SEQ ID NO: 529385 - RNA, 64 nt, Human
uuuaagaaccuaaugcuguuuaauuuugguacagcuuccacauugcauguucacuuuaguauuu

SEQ ID NO: 529386 - RNA, 64 nt, Human
cuuguugggaguaagugccuugcgugggaauaaacuuccacagcauucgaauauuuuaaugaag

SEQ ID NO: 529387 - RNA, 64 nt, Human
ccugccauugaugcuguugcucucguccgccucccuuccacagguaagcacgcaagacacaggu

SEQ ID NO: 529388 - RNA, 64 nt, Human
accacucagugcuaccauccccaccccuacaccacuuccacacaggggccucauggcaugguca

SEQ ID NO: 529389 - RNA, 64 nt, Human
uuuuccagugugguuuuuaacagauaauacauuucuuccacauucagauuaguauucggacaug

SEQ ID NO: 529390 - RNA, 64 nt, Human
cuuuaggaaacgaaauauuuccuaaauaaccaggcuuccacauuguacagaaugagcagucaug

SEQ ID NO: 529391 - RNA, 64 nt, Human
acauaauccacauuuguagucaaggacgcaaucucuuccacacaugugcaguugucaguuggua

SEQ ID NO: 529392 - RNA, 64 nt, Human
aaaaauucaccgagaaguguguguguguucgcugcuuccacacauuaauggcaugauuuuuuuu

SEQ ID NO: 529393 - RNA, 64 nt, Human
guuuuuauguugacugcuuuauguugaauauuuucuuccacaacauguaugugcugcuuauuau

SEQ ID NO: 529394 - RNA, 64 nt, Human
uagaacaccuuccagacacuugcuggacagcuaucuuccacauacuucccaguuuacauuuggu

SEQ ID NO: 529395 - RNA, 64 nt, Human
uugugccauuaagcaagcacuguagcaaaagccacuuccacauggcccuggcagggagcacugc

SEQ ID NO: 529396 - RNA, 64 nt, Human
cuuacaaacucgucucucggccuuucucuccugccuuccacagccucucguuucuccuccaucu

SEQ ID NO: 529397 - RNA, 64 nt, Human
augggggaaagcaaagcacagagagucuggauaacuuccacagggucccacagccacguguuua

SEQ ID NO: 529398 - RNA, 64 nt, Human
aagauacauucucauuguuuuccaacagugauggcuuccacauaagguuaaacaaacuaggugc

SEQ ID NO: 529399 - RNA, 64 nt, Human
aggcaucccgggccagcugccugcggaccgcuuccuuccacagcgagaacugcacuaccuucug

SEQ ID NO: 529400 - RNA, 64 nt, Human
uuucuauuugaacaugugccuuuucugaauuaugcuuccacaggcaaaacucaguagagaucua

SEQ ID NO: 529401 - RNA, 64 nt, Human
ggacagcguggccgucugcuguggcugaaggcagcuuccacagcucacuccucuucucccugcc

SEQ ID NO: 529402 - RNA, 64 nt, Human
uacagccucugcucauggcacugggccuccaguucuuccacaugugugcacccccagcuuggcc

SEQ ID NO: 529403 - RNA, 64 nt, Human
uuuacagacagaagagaaggaagccauagugucacuuccacacaauuauuuauuucaugucuuu

SEQ ID NO: 529404 - RNA, 64 nt, Human
cccaacgugcuccccaugggcaagacaauggaaacuuccacaagcagggaaggcaaacccucuu

SEQ ID NO: 529405 - RNA, 60 nt, Human
cuccuugguggucuucuuaagcaacagacucuuccacaagacagucuaccugcagucggc

SEQ ID NO: 529406 - RNA, 64 nt, Human
gguguccgcugcugcuuuccuucggaauccagugcuuccacagagauuagccuguagcuuauau

SEQ ID NO: 529407 - RNA, 64 nt, Human
cacuuugcucacccuuccccuccccuccuccuuccuuccacacagcaagccuaccuuucuccau

SEQ ID NO: 529408 - RNA, 64 nt, Human
uuauguuuccuugccccgucgcauuaaugaggcccuuccacaucauuuuuaaacuaauguuuuu

SEQ ID NO: 529409 - RNA, 64 nt, Human
guauccacccggcguaauacccauggcaacuggucuuccacauaugaugaaauagccucugaga

SEQ ID NO: 529410 - RNA, 64 nt, Human
cuaaccagagcaucuuuuugaccacucagcaaaacuuccacagacauccuucuggacuuaaaca

SEQ ID NO: 529411 - RNA, 64 nt, Human
cagggcuggagacugugucugcuuucugccuccucuuccacacauccugggucagccuuuccca

SEQ ID NO: 529412 - RNA, 64 nt, Human
cugaauuuagcaccaauugcauuaacgcacaucucuuccacaacuaacagacuuaaaauaacag

SEQ ID NO: 529413 - RNA, 64 nt, Human
uagcaaaauggguggauuuucaaauaaaaugcagcuuccacaaaaguuuuguuaugguauucug

SEQ ID NO: 529414 - RNA, 64 nt, Human
gucaucacuuuuuucauaucaaguccucacccuccuuccacauaaugcucuauccucuaagguu

SEQ ID NO: 529415 - RNA, 64 nt, Human
caaccugggacucaauaauacacuugggaauauucuuccacaccguccagauuucauuugaugu

SEQ ID NO: 529416 - RNA, 64 nt, Human
acaucuagcgggcaggggaagacuccacuaaagacuuccacaaagaccuccccuaaaucugaag

SEQ ID NO: 529417 - RNA, 64 nt, Human
aucuguguuccaccuucuucccccaaaucuccuccuuccacaccugcugccagucuccucucaa

SEQ ID NO: 529418 - RNA, 64 nt, Human
uuuugucucccagcaguagugagccacucagucucuuccacaggaaguuuggagccuacauucc

SEQ ID NO: 529419 - RNA, 64 nt, Human
uuaaugaacccucuaagcucucucaguuccuucccuuccacaaaaugcaagagcaaaagcaaac

SEQ ID NO: 529420 - RNA, 64 nt, Human
uugaugaauauuuauguuguaauuacauguguaacuuccacaacuguaaauauugggcuagaua

SEQ ID NO: 529421 - RNA, 64 nt, Human
uggcucuucugcgaggcugauacacaaggccucucuuccacaugaucauuugcaaaccuccccc

SEQ ID NO: 529422 - RNA, 64 nt, Human
ucauuauucuuccuccaucuaucugauuccauuccuuccacacccagcuaaaguuagaggagau

SEQ ID NO: 529423 - RNA, 64 nt, Human
ugguuaaugaaacccaguagcuaaccccacugugcuuccacaugccuggccuaaaaugggugau

SEQ ID NO: 529424 - RNA, 64 nt, Human
gaaacauccugccagguuuaaacaucacuuguaccuuccacaagacucagaauccacagugucc

SEQ ID NO: 529425 - RNA, 64 nt, Human
cgggccccaagcacgggccgggcauagauuuccucuuccacaagcugccgcuuuucugggcacc

SEQ ID NO: 529426 - RNA, 64 nt, Human
ucucuguuuuguuaaaucugguggguaccuggaucuuccacacgagugggauucuggccuucag

SEQ ID NO: 529427 - RNA, 64 nt, Human
gcauacaauggacuuucuaaagauaaggcgugggcuuccacagugucugccagaguuuaguucu

SEQ ID NO: 529428 - RNA, 64 nt, Human
ggcauguauggaauuugcugcuucucuggggucccuuccacaggagguccugugagaaccaacc

SEQ ID NO: 529429 - RNA, 64 nt, Human
uggggccggcccuuauccccgcccuucuuucucacuuccacaucucccccucuauauccucaca

SEQ ID NO: 529430 - RNA, 64 nt, Human
ccuccaucccuguuguccggagccagcucacugucuuccacacuggugcuaacuggcccaggca

SEQ ID NO: 529431 - RNA, 64 nt, Human
aaauagauaagggccuuggauuccaacacaguuucuuccacauccccugacuugggcuaguggg

SEQ ID NO: 529432 - RNA, 64 nt, Human
ccacccuucacccugcagucuguggaaaaauugucuuccacaaaacuggucccuggugccaaaa

SEQ ID NO: 529433 - RNA, 64 nt, Human
cuucuuccauauuagugucaucuugccucccuaccuuccacaugccccaugacuugaugcaguu

SEQ ID NO: 529434 - RNA, 64 nt, Human
ucuauguagaauauaaaggaagccugaaccaauccuuccacauacuguuaagauguagacuugg

SEQ ID NO: 529435 - RNA, 64 nt, Human
caaccugccuuuguuucacccuacuucaaguacacuuccacaccaggaaaacagacccaaauuc

SEQ ID NO: 529436 - RNA, 64 nt, Human
ggccuacagcagccucaccuucagcuucaugccucuuccacacagcguuuccaugcaggucagg

SEQ ID NO: 529437 - RNA, 64 nt, Human
uucuugcuugggcagguagaggaaguucuuucuacuuccacaggugcagcccucccaauccagu

SEQ ID NO: 529438 - RNA, 64 nt, Human
acuggggauuccuggucuguaacuugaauuguuucuuccacauguucuuaaguacuagaguuaa

SEQ ID NO: 529439 - RNA, 64 nt, Human
ugccuuuugucaggacuguggguaugugauuugucuuccacagucucucuggggcuguguccua

SEQ ID NO: 529440 - RNA, 64 nt, Human
uuuuaucagugcuuaaugugaacuaaguuuuuuacuuccacagaauacaagccacuaccuucug

SEQ ID NO: 529441 - RNA, 64 nt, Human
cuuuuucacuuugacucuuaacauuaucagucaacuuccacauuaaugaaaguugaccauaguu

SEQ ID NO: 529442 - RNA, 64 nt, Human
gguauaugcauguuaauucuaccaugcuuaagaacuuccacaaaauauuucauggagaggucug

SEQ ID NO: 529443 - RNA, 64 nt, Human
ugccuuccuuuaaucccaauuuccccugcucacucuuccacagauauaaagaacaaacacuuag

SEQ ID NO: 529444 - RNA, 64 nt, Human
uuguugaacagaacaaucuggguagcaacagcaucuuccacaguuuuccaaacuggauagcugc

SEQ ID NO: 529445 - RNA, 64 nt, Human
aaaugucuacuuaguuaauuaguuagcugauauucuuccacaauuaauauauucaauuucccau

SEQ ID NO: 529446 - RNA, 64 nt, Human
ugaaucggugcugucagcccugcugucagaccuucuuccacagcaaaugagauguaugcccaaa

SEQ ID NO: 529447 - RNA, 64 nt, Human
ccuguuccuuccugcagaccuggcugggccugggcuuccacagugugaagacacugugcaggcc

SEQ ID NO: 529448 - RNA, 64 nt, Human
gucccagcugcuaacuuggggccggggccccucccuuccacauauaccuuggguuugugcaugu

SEQ ID NO: 529449 - RNA, 64 nt, Human
ggguagccgggcagcugguuuggcccagggccuccuuccacauuaguagccccagggccagaug

SEQ ID NO: 529450 - RNA, 64 nt, Human
gguucuggcccaucaauauucauuucauuuaauucuuccacagaaccaguuugggcaguaggaa

SEQ ID NO: 529451 - RNA, 64 nt, Human
cuauauauaucuuuuuuccuugaugucccguucucuuccacagcccugaggucuuacgaauuuu

SEQ ID NO: 529452 - RNA, 64 nt, Human
uguauguugagaagucaguccaaggagguauguucuuccacaacagccuucucagccucugcua

SEQ ID NO: 529453 - RNA, 64 nt, Human
uugggccuggugcugggaaccugcuagcugagcacuuccacaagggcauaccccugggggcagg

SEQ ID NO: 529454 - RNA, 64 nt, Human
gacagacugugaacuugccaagagaugcaauacccuuccacaccuuugggugucugucuggcau

SEQ ID NO: 529455 - RNA, 64 nt, Human
gcaugcccacaggccaggcccagucacagcugggcuuccacaggucagaauaugggacaggaca

SEQ ID NO: 529456 - RNA, 64 nt, Human
aagggugggagucuggagccagacagccaagccccuuccacaucuacagggucacugucauccu

SEQ ID NO: 529457 - RNA, 64 nt, Human
cguugugauuuccuugcuguugguuuuacacugccuuccacauugcaacagcaaguugauuucu

SEQ ID NO: 529458 - RNA, 64 nt, Human
ccuucuuugcuggccugaccccugaggagcgguccuuccacaccagccgcaacccaagcagaug

SEQ ID NO: 529459 - RNA, 64 nt, Human
cugcacaacucucaugguuuuaauuguaccccaucuuccacaucuuuaaagcucaugugaaaaa

SEQ ID NO: 529460 - RNA, 64 nt, Human
uggggcaccauuucaguguaaaagcaguccuacucuuccacacuaggaaggcuuuacuuuuuuu

SEQ ID NO: 529461 - RNA, 64 nt, Human
aacgaugaugguuacccuucauggacgucuuaaucuuccacacacauccccuuuuuuuggaaua

SEQ ID NO: 529462 - RNA, 64 nt, Human
cuacccuccccaacguuaaaugcucgagaggaaucuuccacaaggcagggccaugcacgcaacc

SEQ ID NO: 529463 - RNA, 64 nt, Human
agaguuggaaacccucaccaacuggccucuucaccuuccacauuaucccgcugccaccggcugc

SEQ ID NO: 529464 - RNA, 64 nt, Human
ccucugccccuggcaccauuccagaacugcccaccuuccacacugagguagccgagccucucaa

SEQ ID NO: 529465 - RNA, 64 nt, Human
aauuauacagaacuuugccuucuuuuuuuaaugucuuccacaauguugugacugauuauaaccc

SEQ ID NO: 529466 - RNA, 64 nt, Human
ugccagauauucaguacucgaucucaauuccccucuuccacaagaguugggugaccagcugucc

SEQ ID NO: 529467 - RNA, 64 nt, Human
cuugucuccgauagcuccccacaucucuaauugacuuccacaaaaucgaugcguugcuuuggua

SEQ ID NO: 529468 - RNA, 64 nt, Human
uuuauauaaacuuuuuaaauguagaaacuuuuuacuuccacacucaguuuuggagacccuagaa

SEQ ID NO: 529469 - RNA, 64 nt, Human
ugacccauucccucccagccuccgcucugccucccuuccacagaagcccucuucgggcagcccc

SEQ ID NO: 529470 - RNA, 64 nt, Human
aaaggacacccagaccuccaagguuugugggccccuuccacaaagcuguaagucccagcccacc

SEQ ID NO: 529471 - RNA, 64 nt, Human
gcaagccuggcccccgacccagcucuacuccaggcuuccacacuucugggcccuaggcugcuuc

SEQ ID NO: 529472 - RNA, 64 nt, Human
gggacagccccgcucccagauguaaagaacgcgacuuccacaaaccuggauuuuuuauguacaa

SEQ ID NO: 529473 - RNA, 64 nt, Human
uuccccagcagcuuucccagagaggcagaggggccuuccacagcccggguucuccugcugccuc

SEQ ID NO: 529474 - RNA, 64 nt, Human
gauggugccgcccgauaugcuugauaugcuuuuccuuccacauguuaagcuaggaaaccuaaca

SEQ ID NO: 529475 - RNA, 64 nt, Human
gaaaguaacuaaaacaugaaaaguaaaccuccagcuuccacaguauauuaccugccguugcaug

SEQ ID NO: 529476 - RNA, 64 nt, Human
ggggucugugccggcagcaccggugccaucuuggcuuccacaaauuccagaaguuucuuggcug

SEQ ID NO: 529477 - RNA, 64 nt, Human
augucaccccugcacuccugccuucccgugggcacuuccacauccucugggccucuggcaguuc

SEQ ID NO: 529478 - RNA, 64 nt, Human
cagggaggaggcagcagacacuggagaugacauucuuccacacgagacggggcuucagccgggc

SEQ ID NO: 529479 - RNA, 64 nt, Human
guggucuguggcuacaggaagcugguucugucugcuuccacagucugcuuaaaaaacugucuga

SEQ ID NO: 529480 - RNA, 64 nt, Human
cccagaccugcagcuugcauggggccccucccuucuuccacacccacccuccguaugguccccu

SEQ ID NO: 529481 - RNA, 64 nt, Human
auauuaugagcauuucccuauaauauacaauauucuuccacauuauguuuaaugguuucauugu

SEQ ID NO: 529482 - RNA, 64 nt, Human
caagucuuucuucuuuuuuaaguugucaaagaagcuuccacaaaauuagaaaggacaacaguuc

SEQ ID NO: 529483 - RNA, 64 nt, Human
ugagcaguucccaaggacagucagcauuucuagacuuccacaaaauuaugcugcauuuggcugg

SEQ ID NO: 529484 - RNA, 64 nt, Human
aaaggaaauaguaccuucaauacuuaaaaauagucuuccacaaaaaauacuuuauuucugaucu

SEQ ID NO: 529485 - RNA, 64 nt, Human
gagccccucauccuuccucugggaccagaugugccuuccacaguugaaacuugagaagcagagc

SEQ ID NO: 529486 - RNA, 64 nt, Human
ggcccugggucuaugcacagcuggagcucugagccuuccacagcccgugugacugcuagagggc

SEQ ID NO: 529487 - RNA, 64 nt, Human
aucugucccuggugagaagcaaggcuagcucugccuuccacaugcuucucaggaugccaagagg

SEQ ID NO: 529488 - RNA, 64 nt, Human
ggggccuucauucgauugcauuucccacuccccucuuccacaagugugauuaaaagugaccaga

SEQ ID NO: 529489 - RNA, 64 nt, Human
cuucacauuuguacaauucauugauucucuuuuccuuccacaauaaaaugguauacaagaacag

SEQ ID NO: 529490 - RNA, 64 nt, Human
gcaucaaguuaacaucacacaauaggaaacaccacuuccacaagucucaagccucagugcuaaa

SEQ ID NO: 529491 - RNA, 64 nt, Human
acucccaggcaguaucagguggucacuacagagacuuccacaaaaacuuuugaaugaugugaaa

SEQ ID NO: 529492 - RNA, 64 nt, Human
uuguaaaaauauuugauggccuuuugaugaaugucuuccacaguaaagaaaacuuaguggcuua

SEQ ID NO: 529493 - RNA, 64 nt, Human
gcuccaagugcaauuaauaauaacucauuuauaccuuccacagaauuuaauaaagauucuacuu

SEQ ID NO: 529494 - RNA, 64 nt, Human
cacagggccccgccaggggcugggggcaucccggcuuccacaaugcagcugcucugggccucgg

SEQ ID NO: 529495 - RNA, 64 nt, Human
cuagagcugacagcuuuguucgcgugggcagagccuuccacagugaaugugucuggaccucaug

SEQ ID NO: 529496 - RNA, 64 nt, Human
agcuaaagauacaauguuucccugccccgcaccgcuuccacaaaauagcaaugugguuuugcag

SEQ ID NO: 529497 - RNA, 64 nt, Human
cuccugccugccgccucucuguacaguaacgccacuuccacacucuguccccaucuggcuucug

SEQ ID NO: 529498 - RNA, 64 nt, Human
ccaguguacacaccaccuacgugcacacagcauccuuccacacuguguaugugaacagcuuggg

SEQ ID NO: 529499 - RNA, 64 nt, Human
agcgagggugggcagcccccuccacuccacucugcuuccacaaagucggcucccgagagcucga

SEQ ID NO: 529500 - RNA, 64 nt, Human
ggcccacagguuuaaggcugaggcugcccugacccuuccacagucauuucuucuagguuuucuu

SEQ ID NO: 529501 - RNA, 64 nt, Human
ggcucugcugcccuggaccccucuauuuauuucccuuccacagugugguuucuuccucugcggu

SEQ ID NO: 529502 - RNA, 64 nt, Human
gggagaagcaggggacuccgcagcgggccccugccuuccacaugcccccaccauuuuucuuugc

SEQ ID NO: 529503 - RNA, 64 nt, Human
cugagaggagggagcauuaugggaaagucccugccuuccacaccucucucuagucccuguggga

SEQ ID NO: 529504 - RNA, 64 nt, Human
auuuggucagcuuccccgccacgggcaccucguucuuccacacccuguccugguggggcugucc

SEQ ID NO: 529505 - RNA, 64 nt, Human
ugauauugucauuguguaaacaucauguuguuuacuuccacaaaccuagaugguauagccuacc

SEQ ID NO: 529506 - RNA, 64 nt, Human
ugaauuuccugccuacaaaauggagaaauaggaccuuccacacagggugcaugugaggaugaaa

SEQ ID NO: 529507 - RNA, 64 nt, Human
ccaccacgucugugcccugcacuguccccacagccuuccacacccugugcauaggcagcccucu

SEQ ID NO: 529508 - RNA, 64 nt, Human
cuguggguggggaaggaaggcguguccaggagaccuuccacaaaggguagccuggcuuuucugg

SEQ ID NO: 529509 - RNA, 64 nt, Human
guggacuuuuucacuucuauacuuuguaugcggccuuccacacuuccagagaaugucagugugc

SEQ ID NO: 529510 - RNA, 64 nt, Human
gugaaacuggggucccuuggggcgccccacgcugcuuccacacccaccaccucuggccuugggu

SEQ ID NO: 529511 - RNA, 64 nt, Human
cugggaucucugguaccgucacucuugcuugugccuuccacaccuucucggugcagaucccuau

SEQ ID NO: 529512 - RNA, 64 nt, Human
ccccuggcaugcaugcuggcggcggcaugccucccuuccacaagcccaugcugcugcagaggga

SEQ ID NO: 529513 - RNA, 64 nt, Human
guuagucauuuggucaaaccaaugacaaaaccgccuuccacaaaaguugaaauaagaaacaaga

SEQ ID NO: 529514 - RNA, 64 nt, Human
gcuugucccauuucuuccuguucucuuuuucuagcuuccacaucagcuuccuuuuuugagaaca

SEQ ID NO: 529515 - RNA, 64 nt, Human
cuucuuguugcauuaguucuccuguauguuccuucuuccacaggaauguauuugugcauauguu

SEQ ID NO: 529516 - RNA, 64 nt, Human
ucaaauuguccgggguaguuggcagaaauacagucuuccacaaagaaaauuccuauaaggaaga

SEQ ID NO: 529517 - RNA, 64 nt, Human
acagccccugcaacuguggggccugcacacagcccuuccacaguuggcacugcaggugcaggcc

SEQ ID NO: 529518 - RNA, 64 nt, Human
caguauaauuauuuucagggauaugcuagaauuacuuccacauauuuaucccuuuuuaaaaaag

SEQ ID NO: 529519 - RNA, 64 nt, Human
auaaauggccugugauucuuuuuugaaagaugcucuuccacaagaguuaagccaguuagaauuc

SEQ ID NO: 529520 - RNA, 64 nt, Human
gccaggguuaugcaggaagguggugcggcauugccuuccacauauguaagucucugggcggcgc

SEQ ID NO: 529521 - RNA, 64 nt, Human
gguuuuaaagccccgucauuucaagcgggucgaucuuccacauucacuggagagacucucccca

SEQ ID NO: 529522 - RNA, 64 nt, Human
uuccagaaaagggcccagcucugagccccucacccuuccacacucacgaacucucagccgagga

SEQ ID NO: 529523 - RNA, 64 nt, Human
ccaaagucaccucugucaaagccacagucuguuccuuccacagccacaagauggcgacaugagc

SEQ ID NO: 529524 - RNA, 64 nt, Human
cgcaccccccuuuccaggguccuccggaccccaccuuccacacucugaucacagccccccuacc

SEQ ID NO: 529525 - RNA, 64 nt, Human
acgacuugacuuuaauuuucucggaggugauaggcuuccacacaggucuccagaagcccugcau

SEQ ID NO: 529526 - RNA, 64 nt, Human
gugugugugugcgugugugcaagcuuugaaccuccuuccacagccgcaucuucucaugacacaa

SEQ ID NO: 529527 - RNA, 64 nt, Human
uugcuuuuacagauaucugaauggaagaguguuucuuccacaacagaaguauuucuguggaugg

SEQ ID NO: 529528 - RNA, 64 nt, Human
ugcagagcaaggcugcaccugcugcccuucgauccuuccacacauggccaggacacugccacaa

SEQ ID NO: 529529 - RNA, 64 nt, Human
cagguccaaggacacccucccuccaggguccucucuuccacaguggcgggcccacucagccccg

SEQ ID NO: 529530 - RNA, 64 nt, Human
ccaacccuccacagagcccccagacccaccagaacuuccacagacgcccccacuagcuacucca

SEQ ID NO: 529531 - RNA, 64 nt, Human
aggugauggauauguuaauuagcuugauuuaauccuuccacauuguauacauguaucagaacau

SEQ ID NO: 529532 - RNA, 64 nt, Human
acaccugcccagcauguuccugucucuccuuuuccuuccacaucccaccagucaccagcgcuau

SEQ ID NO: 529533 - RNA, 64 nt, Human
gucacagguugcagcccuggccuucugugaaucccuuccacagcuaaagggcauauguccucug

SEQ ID NO: 529534 - RNA, 64 nt, Human
gggacuuuaccugcugggaccugcucccagagaccuuccacacugaaucucaccugcuaggagc

SEQ ID NO: 529535 - RNA, 64 nt, Human
gaaaaucccuucuaggcaucuccucuccccaacccuuccacacguuugauuucuuccugcagag

SEQ ID NO: 529536 - RNA, 64 nt, Human
aagaugagcaggagcuccacuacgcuguccuacacuuccacaaggugcaaccucaggaaccaaa

SEQ ID NO: 529537 - RNA, 64 nt, Human
uggccccuguccuccuccugcccauucuuugucucuuccacaugggagccaggaggccucaguu

SEQ ID NO: 529538 - RNA, 64 nt, Human
ccgugaucauuaccuggggagggguuccugaaaccuuccacaaugggaucuguggacuuucauu

SEQ ID NO: 529539 - RNA, 64 nt, Human
acauguguuuauuaauugacaaugacccaaaucucuuccacaagacuuaaaaccaaauucaggg

SEQ ID NO: 529540 - RNA, 64 nt, Human
aauaaguaaaugccuuaagaguauuuaaaauaugcuuccacauuucaaaauauaaaauguaaca

SEQ ID NO: 529541 - RNA, 64 nt, Human
ccaggggccaacagccccagcugugacccccaggcuuccacaugaacucacaaaggagaggccc

SEQ ID NO: 529542 - RNA, 64 nt, Human
cccucaccuccccuucccucuugcccagggaacucuuccacaggacaaagccgacaucaagacu

SEQ ID NO: 529543 - RNA, 64 nt, Human
ucuuugagaccaaguuccagguggacaaagucaacuuccacauguuugacguggguggccagcg

SEQ ID NO: 529544 - RNA, 64 nt, Human
auguaaccccucucucaccccggcacaaccugggcuuccacagucuggagcugcccuaccccca

SEQ ID NO: 529545 - RNA, 64 nt, Human
aacuuuucuccccaacccccaaacccacgacucacuuccacaccgucuuccccagcgucccccg

SEQ ID NO: 529546 - RNA, 64 nt, Human
cucuggggauugcugggucacaggugccccucaccuuccacagucaggcagggaaguuauaggc

SEQ ID NO: 529547 - RNA, 64 nt, Human
cugguucuagaucuuucaggaauuggcacacucucuuccacaaugguugaaccaauuuacauuc

SEQ ID NO: 529548 - RNA, 64 nt, Human
uuggauauuucaaaauagucuagaccagcuagugcuuccacagucaaagcuggacauuuuuaug

SEQ ID NO: 529549 - RNA, 64 nt, Human
agggacuucuguucauucaucccgagaacauuggcuuccacaucacaguaucuacccuuacaug

SEQ ID NO: 529550 - RNA, 64 nt, Human
gaaaugcaguacuguaaggaagagggaccuccagcuuccacaaacaccaucuucagcuguauga

SEQ ID NO: 529551 - RNA, 64 nt, Human
ggcucagggccccgagacuuggccucaguucuuccuuccacagggauuuucaggaaaggcagaa

SEQ ID NO: 529552 - RNA, 64 nt, Human
cuccucguccccacccacccccacauuugcacaccuuccacagggucaggauggaguagcugcc

SEQ ID NO: 529553 - RNA, 64 nt, Human
cucuggcuucagcuucucagcagcaagcaccagccuuccacaacaacacuauauuuuuaugcua

SEQ ID NO: 529554 - RNA, 64 nt, Human
ccugagccuccuguagcagcagugucauucugcacuuccacauucugucugucuuccccgccug

SEQ ID NO: 529555 - RNA, 64 nt, Human
accucaccucccgaagccaccauccccacccugucuuccacagccgccugaaagccacaaugag

SEQ ID NO: 529556 - RNA, 64 nt, Human
cuggaaagcccuagaaacuaggguuccucugccccuuccacaucccaccugucucucuagcuug

SEQ ID NO: 529557 - RNA, 64 nt, Human
ccugagagccuguggaggggcuugggccugcacccuuccacagcuggccugguuuccucgagag

SEQ ID NO: 529558 - RNA, 64 nt, Human
uuuccuacaugauugcaggcgagaacacgaucuucuuccacaucuccagcaaguucucaagcuc

SEQ ID NO: 529559 - RNA, 64 nt, Human
uccuggugccucuauugaagacuuugcccugccacuuccacagcaguaagccgaaaggaugaag

SEQ ID NO: 529560 - RNA, 64 nt, Human
gcgcuugagaaaucguuguugcugcaccuaguuccuuccacaucccuacaacucggacacuaac

SEQ ID NO: 529561 - RNA, 64 nt, Human
aaccagagagcugcuggggauucuggccuagucccuuccacacccccaccccuugcucucaacc

SEQ ID NO: 529562 - RNA, 64 nt, Human
ggcuuauccuggcaaugggguagucacugccacccuuccacacacacacacacacacacacaca

SEQ ID NO: 529563 - RNA, 64 nt, Human
augucacauaauauggugggauaucaauuuacuucuuccacacaugugguugugcacaugugag

SEQ ID NO: 529564 - RNA, 64 nt, Human
agguccacacagugaugccaugggggacccuugccuuccacacuugcaggugucacguuuugca

SEQ ID NO: 529565 - RNA, 64 nt, Human
cuccauuuuuggcuacauguccgagugaguugcucuuccacagcaguuacauaaguuuuguauu

SEQ ID NO: 529566 - RNA, 64 nt, Human
aacucucauuaucuccuccacagaaaacacacagcuuccacaacuucucuguuuucugucaguc

SEQ ID NO: 529567 - RNA, 64 nt, Human
agacauuuuuccuggugggagcugaagcacugggcuuccacaggccccuggccuccuugcccua

SEQ ID NO: 529568 - RNA, 64 nt, Human
uaauuacugguaaaauuucaggguuguggauuaucuuccacacaugaauuuucucucuccuggc

SEQ ID NO: 529569 - RNA, 64 nt, Human
cuucccaucgucuuguguacacugcuccuguggccuuccacagcagaaaccagggcaaaagggu

SEQ ID NO: 529570 - RNA, 64 nt, Human
uuuucccagcaaaugaggcaggcaauucuaagaucuuccacaaaacaucuagccaucuaaaaug

SEQ ID NO: 529571 - RNA, 64 nt, Human
uuauauuuauauaguccauauggcacauuugauucuuccacauauauuuuguguuaauguuuag

SEQ ID NO: 529572 - RNA, 64 nt, Human
acuucuguuugugcccuucugcuucccccauucccuuccacagcucauagcucgucaucucggc

SEQ ID NO: 529573 - RNA, 64 nt, Human
ugcuaggcacuccucacagcuugaccuggguuugcuuccacacccucagaagaggagagccggc

SEQ ID NO: 529574 - RNA, 64 nt, Human
aaggugggaauugaguucaaauauaguguuuuaucuuccacacaaaucaucucuauaggaguua

SEQ ID NO: 529575 - RNA, 64 nt, Human
aguuaaaucaucuguuagccccuaacucuacugccuuccacauauugguuccuugauacauuuc

SEQ ID NO: 529576 - RNA, 64 nt, Human
agggggaacuggaggaugcguaagagacccagaacuuccacagaaggaggaaaauuaaccuccu

SEQ ID NO: 529577 - RNA, 64 nt, Human; identical to SEQ ID NO: 529202

SEQ ID NO: 529578 - RNA, 64 nt, Human; identical to SEQ ID NO: 529203

SEQ ID NO: 529579 - RNA, 64 nt, Human; identical to SEQ ID NO: 529204

SEQ ID NO: 529580 - RNA, 64 nt, Human; identical to SEQ ID NO: 529205

SEQ ID NO: 529581 - RNA, 64 nt, Human; identical to SEQ ID NO: 529206

SEQ ID NO: 529582 - RNA, 64 nt, Human; identical to SEQ ID NO: 529207

SEQ ID NO: 529583 - RNA, 53 nt, Human; identical to SEQ ID NO: 529208

SEQ ID NO: 529584 - RNA, 64 nt, Human; identical to SEQ ID NO: 529209

SEQ ID NO: 529585 - RNA, 64 nt, Human; identical to SEQ ID NO: 529210

SEQ ID NO: 529586 - RNA, 64 nt, Human; identical to SEQ ID NO: 529211

SEQ ID NO: 529587 - RNA, 64 nt, Human; identical to SEQ ID NO: 529212

SEQ ID NO: 529588 - RNA, 64 nt, Human; identical to SEQ ID NO: 529213

SEQ ID NO: 529589 - RNA, 64 nt, Human; identical to SEQ ID NO: 529214

SEQ ID NO: 529590 - RNA, 64 nt, Human; identical to SEQ ID NO: 529215

SEQ ID NO: 529591 - RNA, 64 nt, Human; identical to SEQ ID NO: 529216

SEQ ID NO: 529592 - RNA, 64 nt, Human; identical to SEQ ID NO: 529217

SEQ ID NO: 529593 - RNA, 64 nt, Human; identical to SEQ ID NO: 529218

SEQ ID NO: 529594 - RNA, 64 nt, Human; identical to SEQ ID NO: 529219

SEQ ID NO: 529595 - RNA, 64 nt, Human; identical to SEQ ID NO: 529220

SEQ ID NO: 529596 - RNA, 64 nt, Human; identical to SEQ ID NO: 529221

SEQ ID NO: 529597 - RNA, 64 nt, Human; identical to SEQ ID NO: 529222

SEQ ID NO: 529598 - RNA, 64 nt, Human; identical to SEQ ID NO: 529223

SEQ ID NO: 529599 - RNA, 64 nt, Human; identical to SEQ ID NO: 529224

SEQ ID NO: 529600 - RNA, 64 nt, Human; identical to SEQ ID NO: 529225

SEQ ID NO: 529601 - RNA, 64 nt, Human; identical to SEQ ID NO: 529226

SEQ ID NO: 529602 - RNA, 64 nt, Human; identical to SEQ ID NO: 529227

SEQ ID NO: 529603 - RNA, 64 nt, Human; identical to SEQ ID NO: 529228

SEQ ID NO: 529604 - RNA, 64 nt, Human; identical to SEQ ID NO: 529229

SEQ ID NO: 529605 - RNA, 64 nt, Human; identical to SEQ ID NO: 529230

SEQ ID NO: 529606 - RNA, 64 nt, Human; identical to SEQ ID NO: 529231

SEQ ID NO: 529607 - RNA, 64 nt, Human; identical to SEQ ID NO: 529232

SEQ ID NO: 529608 - RNA, 64 nt, Human; identical to SEQ ID NO: 529233

SEQ ID NO: 529609 - RNA, 56 nt, Human; identical to SEQ ID NO: 529234

SEQ ID NO: 529610 - RNA, 64 nt, Human; identical to SEQ ID NO: 529235

SEQ ID NO: 529611 - RNA, 64 nt, Human; identical to SEQ ID NO: 529236

SEQ ID NO: 529612 - RNA, 64 nt, Human; identical to SEQ ID NO: 529237

SEQ ID NO: 529613 - RNA, 64 nt, Human; identical to SEQ ID NO: 529238

SEQ ID NO: 529614 - RNA, 64 nt, Human; identical to SEQ ID NO: 529239

SEQ ID NO: 529615 - RNA, 64 nt, Human; identical to SEQ ID NO: 529240

SEQ ID NO: 529616 - RNA, 64 nt, Human; identical to SEQ ID NO: 529241

SEQ ID NO: 529617 - RNA, 64 nt, Human; identical to SEQ ID NO: 529242

SEQ ID NO: 529618 - RNA, 64 nt, Human; identical to SEQ ID NO: 529243

SEQ ID NO: 529619 - RNA, 52 nt, Human; identical to SEQ ID NO: 529244

SEQ ID NO: 529620 - RNA, 64 nt, Human; identical to SEQ ID NO: 529245

SEQ ID NO: 529621 - RNA, 64 nt, Human; identical to SEQ ID NO: 529246

SEQ ID NO: 529622 - RNA, 64 nt, Human; identical to SEQ ID NO: 529247

SEQ ID NO: 529623 - RNA, 64 nt, Human; identical to SEQ ID NO: 529248

SEQ ID NO: 529624 - RNA, 64 nt, Human; identical to SEQ ID NO: 529249

SEQ ID NO: 529625 - RNA, 64 nt, Human; identical to SEQ ID NO: 529250

SEQ ID NO: 529626 - RNA, 64 nt, Human; identical to SEQ ID NO: 529251

SEQ ID NO: 529627 - RNA, 64 nt, Human; identical to SEQ ID NO: 529252

SEQ ID NO: 529628 - RNA, 64 nt, Human; identical to SEQ ID NO: 529253

SEQ ID NO: 529629 - RNA, 64 nt, Human; identical to SEQ ID NO: 529254

SEQ ID NO: 529630 - RNA, 64 nt, Human; identical to SEQ ID NO: 529255

SEQ ID NO: 529631 - RNA, 64 nt, Human; identical to SEQ ID NO: 529256

SEQ ID NO: 529632 - RNA, 64 nt, Human; identical to SEQ ID NO: 529257

SEQ ID NO: 529633 - RNA, 64 nt, Human; identical to SEQ ID NO: 529258

SEQ ID NO: 529634 - RNA, 64 nt, Human; identical to SEQ ID NO: 529259

SEQ ID NO: 529635 - RNA, 64 nt, Human; identical to SEQ ID NO: 529260

SEQ ID NO: 529636 - RNA, 64 nt, Human; identical to SEQ ID NO: 529261

SEQ ID NO: 529637 - RNA, 64 nt, Human; identical to SEQ ID NO: 529262

SEQ ID NO: 529638 - RNA, 64 nt, Human; identical to SEQ ID NO: 529263

SEQ ID NO: 529639 - RNA, 64 nt, Human; identical to SEQ ID NO: 529264

SEQ ID NO: 529640 - RNA, 64 nt, Human; identical to SEQ ID NO: 529265

SEQ ID NO: 529641 - RNA, 64 nt, Human; identical to SEQ ID NO: 529266

SEQ ID NO: 529642 - RNA, 64 nt, Human; identical to SEQ ID NO: 529267

SEQ ID NO: 529643 - RNA, 64 nt, Human; identical to SEQ ID NO: 529268

SEQ ID NO: 529644 - RNA, 64 nt, Human; identical to SEQ ID NO: 529269

SEQ ID NO: 529645 - RNA, 64 nt, Human; identical to SEQ ID NO: 529270

SEQ ID NO: 529646 - RNA, 64 nt, Human; identical to SEQ ID NO: 529271

SEQ ID NO: 529647 - RNA, 64 nt, Human; identical to SEQ ID NO: 529272

SEQ ID NO: 529648 - RNA, 64 nt, Human; identical to SEQ ID NO: 529273

SEQ ID NO: 529649 - RNA, 64 nt, Human; identical to SEQ ID NO: 529274

SEQ ID NO: 529650 - RNA, 64 nt, Human; identical to SEQ ID NO: 529275

SEQ ID NO: 529651 - RNA, 64 nt, Human; identical to SEQ ID NO: 529276

SEQ ID NO: 529652 - RNA, 64 nt, Human; identical to SEQ ID NO: 529277

SEQ ID NO: 529653 - RNA, 64 nt, Human; identical to SEQ ID NO: 529278

SEQ ID NO: 529654 - RNA, 64 nt, Human; identical to SEQ ID NO: 529279

SEQ ID NO: 529655 - RNA, 64 nt, Human; identical to SEQ ID NO: 529280

SEQ ID NO: 529656 - RNA, 64 nt, Human; identical to SEQ ID NO: 529281

SEQ ID NO: 529657 - RNA, 64 nt, Human; identical to SEQ ID NO: 529282

SEQ ID NO: 529658 - RNA, 64 nt, Human; identical to SEQ ID NO: 529283

SEQ ID NO: 529659 - RNA, 64 nt, Human; identical to SEQ ID NO: 529284

SEQ ID NO: 529660 - RNA, 64 nt, Human; identical to SEQ ID NO: 529285

SEQ ID NO: 529661 - RNA, 64 nt, Human; identical to SEQ ID NO: 529286

SEQ ID NO: 529662 - RNA, 64 nt, Human; identical to SEQ ID NO: 529287

SEQ ID NO: 529663 - RNA, 64 nt, Human; identical to SEQ ID NO: 529288

SEQ ID NO: 529664 - RNA, 64 nt, Human; identical to SEQ ID NO: 529289

SEQ ID NO: 529665 - RNA, 64 nt, Human; identical to SEQ ID NO: 529290

SEQ ID NO: 529666 - RNA, 64 nt, Human; identical to SEQ ID NO: 529291

SEQ ID NO: 529667 - RNA, 64 nt, Human; identical to SEQ ID NO: 529292

SEQ ID NO: 529668 - RNA, 64 nt, Human; identical to SEQ ID NO: 529293

SEQ ID NO: 529669 - RNA, 64 nt, Human; identical to SEQ ID NO: 529294

SEQ ID NO: 529670 - RNA, 64 nt, Human; identical to SEQ ID NO: 529295

SEQ ID NO: 529671 - RNA, 64 nt, Human; identical to SEQ ID NO: 529296

SEQ ID NO: 529672 - RNA, 64 nt, Human; identical to SEQ ID NO: 529297

SEQ ID NO: 529673 - RNA, 64 nt, Human; identical to SEQ ID NO: 529298

SEQ ID NO: 529674 - RNA, 64 nt, Human; identical to SEQ ID NO: 529299

SEQ ID NO: 529675 - RNA, 64 nt, Human; identical to SEQ ID NO: 529300

SEQ ID NO: 529676 - RNA, 64 nt, Human; identical to SEQ ID NO: 529301

SEQ ID NO: 529677 - RNA, 64 nt, Human; identical to SEQ ID NO: 529302

SEQ ID NO: 529678 - RNA, 64 nt, Human; identical to SEQ ID NO: 529303

SEQ ID NO: 529679 - RNA, 64 nt, Human; identical to SEQ ID NO: 529304

SEQ ID NO: 529680 - RNA, 55 nt, Human; identical to SEQ ID NO: 529305

SEQ ID NO: 529681 - RNA, 64 nt, Human; identical to SEQ ID NO: 529306

SEQ ID NO: 529682 - RNA, 64 nt, Human; identical to SEQ ID NO: 529307

SEQ ID NO: 529683 - RNA, 64 nt, Human; identical to SEQ ID NO: 529308

SEQ ID NO: 529684 - RNA, 64 nt, Human; identical to SEQ ID NO: 529309

SEQ ID NO: 529685 - RNA, 64 nt, Human; identical to SEQ ID NO: 529310

SEQ ID NO: 529686 - RNA, 64 nt, Human; identical to SEQ ID NO: 529311

SEQ ID NO: 529687 - RNA, 58 nt, Human; identical to SEQ ID NO: 529312

SEQ ID NO: 529688 - RNA, 64 nt, Human; identical to SEQ ID NO: 529313

SEQ ID NO: 529689 - RNA, 64 nt, Human; identical to SEQ ID NO: 529314

SEQ ID NO: 529690 - RNA, 64 nt, Human; identical to SEQ ID NO: 529315

SEQ ID NO: 529691 - RNA, 64 nt, Human; identical to SEQ ID NO: 529316

SEQ ID NO: 529692 - RNA, 64 nt, Human; identical to SEQ ID NO: 529317

SEQ ID NO: 529693 - RNA, 64 nt, Human; identical to SEQ ID NO: 529318

SEQ ID NO: 529694 - RNA, 64 nt, Human; identical to SEQ ID NO: 529319

SEQ ID NO: 529695 - RNA, 64 nt, Human; identical to SEQ ID NO: 529320

SEQ ID NO: 529696 - RNA, 64 nt, Human; identical to SEQ ID NO: 529321

SEQ ID NO: 529697 - RNA, 64 nt, Human; identical to SEQ ID NO: 529322

SEQ ID NO: 529698 - RNA, 64 nt, Human; identical to SEQ ID NO: 529323

SEQ ID NO: 529699 - RNA, 64 nt, Human; identical to SEQ ID NO: 529324

SEQ ID NO: 529700 - RNA, 64 nt, Human; identical to SEQ ID NO: 529325

SEQ ID NO: 529701 - RNA, 64 nt, Human; identical to SEQ ID NO: 529326

SEQ ID NO: 529702 - RNA, 64 nt, Human; identical to SEQ ID NO: 529327

SEQ ID NO: 529703 - RNA, 64 nt, Human; identical to SEQ ID NO: 529328

SEQ ID NO: 529704 - RNA, 64 nt, Human; identical to SEQ ID NO: 529329

SEQ ID NO: 529705 - RNA, 64 nt, Human; identical to SEQ ID NO: 529330

SEQ ID NO: 529706 - RNA, 64 nt, Human; identical to SEQ ID NO: 529331

SEQ ID NO: 529707 - RNA, 64 nt, Human; identical to SEQ ID NO: 529332

SEQ ID NO: 529708 - RNA, 64 nt, Human; identical to SEQ ID NO: 529333

SEQ ID NO: 529709 - RNA, 64 nt, Human; identical to SEQ ID NO: 529334

SEQ ID NO: 529710 - RNA, 64 nt, Human; identical to SEQ ID NO: 529335

SEQ ID NO: 529711 - RNA, 64 nt, Human; identical to SEQ ID NO: 529336

SEQ ID NO: 529712 - RNA, 64 nt, Human; identical to SEQ ID NO: 529337

SEQ ID NO: 529713 - RNA, 64 nt, Human; identical to SEQ ID NO: 529338

SEQ ID NO: 529714 - RNA, 64 nt, Human; identical to SEQ ID NO: 529339

SEQ ID NO: 529715 - RNA, 64 nt, Human; identical to SEQ ID NO: 529340

SEQ ID NO: 529716 - RNA, 64 nt, Human; identical to SEQ ID NO: 529341

SEQ ID NO: 529717 - RNA, 64 nt, Human; identical to SEQ ID NO: 529342

SEQ ID NO: 529718 - RNA, 64 nt, Human; identical to SEQ ID NO: 529343

SEQ ID NO: 529719 - RNA, 64 nt, Human; identical to SEQ ID NO: 529344

SEQ ID NO: 529720 - RNA, 64 nt, Human; identical to SEQ ID NO: 529345

SEQ ID NO: 529721 - RNA, 64 nt, Human; identical to SEQ ID NO: 529346

SEQ ID NO: 529722 - RNA, 64 nt, Human; identical to SEQ ID NO: 529347

SEQ ID NO: 529723 - RNA, 64 nt, Human; identical to SEQ ID NO: 529348

SEQ ID NO: 529724 - RNA, 64 nt, Human; identical to SEQ ID NO: 529349

SEQ ID NO: 529725 - RNA, 64 nt, Human; identical to SEQ ID NO: 529350

SEQ ID NO: 529726 - RNA, 64 nt, Human; identical to SEQ ID NO: 529351

SEQ ID NO: 529727 - RNA, 64 nt, Human; identical to SEQ ID NO: 529352

SEQ ID NO: 529728 - RNA, 64 nt, Human; identical to SEQ ID NO: 529353

SEQ ID NO: 529729 - RNA, 64 nt, Human; identical to SEQ ID NO: 529354

SEQ ID NO: 529730 - RNA, 64 nt, Human; identical to SEQ ID NO: 529355

SEQ ID NO: 529731 - RNA, 64 nt, Human; identical to SEQ ID NO: 529356

SEQ ID NO: 529732 - RNA, 64 nt, Human; identical to SEQ ID NO: 529357

SEQ ID NO: 529733 - RNA, 64 nt, Human; identical to SEQ ID NO: 529358

SEQ ID NO: 529734 - RNA, 64 nt, Human; identical to SEQ ID NO: 529359

SEQ ID NO: 529735 - RNA, 64 nt, Human; identical to SEQ ID NO: 529360

SEQ ID NO: 529736 - RNA, 64 nt, Human; identical to SEQ ID NO: 529361

SEQ ID NO: 529737 - RNA, 64 nt, Human; identical to SEQ ID NO: 529362

SEQ ID NO: 529738 - RNA, 64 nt, Human; identical to SEQ ID NO: 529363

SEQ ID NO: 529739 - RNA, 64 nt, Human; identical to SEQ ID NO: 529364

SEQ ID NO: 529740 - RNA, 64 nt, Human; identical to SEQ ID NO: 529365

SEQ ID NO: 529741 - RNA, 64 nt, Human; identical to SEQ ID NO: 529366

SEQ ID NO: 529742 - RNA, 64 nt, Human; identical to SEQ ID NO: 529367

SEQ ID NO: 529743 - RNA, 64 nt, Human; identical to SEQ ID NO: 529368

SEQ ID NO: 529744 - RNA, 64 nt, Human; identical to SEQ ID NO: 529369

SEQ ID NO: 529745 - RNA, 64 nt, Human; identical to SEQ ID NO: 529370

SEQ ID NO: 529746 - RNA, 64 nt, Human; identical to SEQ ID NO: 529371

SEQ ID NO: 529747 - RNA, 64 nt, Human; identical to SEQ ID NO: 529372

SEQ ID NO: 529748 - RNA, 64 nt, Human; identical to SEQ ID NO: 529373

SEQ ID NO: 529749 - RNA, 64 nt, Human; identical to SEQ ID NO: 529374

SEQ ID NO: 529750 - RNA, 64 nt, Human; identical to SEQ ID NO: 529375

SEQ ID NO: 529751 - RNA, 64 nt, Human; identical to SEQ ID NO: 529376

SEQ ID NO: 529752 - RNA, 64 nt, Human; identical to SEQ ID NO: 529377

SEQ ID NO: 529753 - RNA, 64 nt, Human; identical to SEQ ID NO: 529378

SEQ ID NO: 529754 - RNA, 64 nt, Human; identical to SEQ ID NO: 529379

SEQ ID NO: 529755 - RNA, 64 nt, Human; identical to SEQ ID NO: 529380

SEQ ID NO: 529756 - RNA, 64 nt, Human; identical to SEQ ID NO: 529381

SEQ ID NO: 529757 - RNA, 64 nt, Human; identical to SEQ ID NO: 529382

SEQ ID NO: 529758 - RNA, 64 nt, Human; identical to SEQ ID NO: 529383

SEQ ID NO: 529759 - RNA, 64 nt, Human; identical to SEQ ID NO: 529384

SEQ ID NO: 529760 - RNA, 64 nt, Human; identical to SEQ ID NO: 529385

SEQ ID NO: 529761 - RNA, 64 nt, Human; identical to SEQ ID NO: 529386

SEQ ID NO: 529762 - RNA, 64 nt, Human; identical to SEQ ID NO: 529387

SEQ ID NO: 529763 - RNA, 64 nt, Human; identical to SEQ ID NO: 529388

SEQ ID NO: 529764 - RNA, 64 nt, Human; identical to SEQ ID NO: 529389

SEQ ID NO: 529765 - RNA, 64 nt, Human; identical to SEQ ID NO: 529390

SEQ ID NO: 529766 - RNA, 64 nt, Human; identical to SEQ ID NO: 529391

SEQ ID NO: 529767 - RNA, 64 nt, Human; identical to SEQ ID NO: 529392

SEQ ID NO: 529768 - RNA, 64 nt, Human; identical to SEQ ID NO: 529393

SEQ ID NO: 529769 - RNA, 64 nt, Human; identical to SEQ ID NO: 529394

SEQ ID NO: 529770 - RNA, 64 nt, Human; identical to SEQ ID NO: 529395

SEQ ID NO: 529771 - RNA, 64 nt, Human; identical to SEQ ID NO: 529396

SEQ ID NO: 529772 - RNA, 64 nt, Human; identical to SEQ ID NO: 529397

SEQ ID NO: 529773 - RNA, 64 nt, Human; identical to SEQ ID NO: 529398

SEQ ID NO: 529774 - RNA, 64 nt, Human; identical to SEQ ID NO: 529399

SEQ ID NO: 529775 - RNA, 64 nt, Human; identical to SEQ ID NO: 529400

SEQ ID NO: 529776 - RNA, 64 nt, Human; identical to SEQ ID NO: 529401

SEQ ID NO: 529777 - RNA, 64 nt, Human; identical to SEQ ID NO: 529402

SEQ ID NO: 529778 - RNA, 64 nt, Human; identical to SEQ ID NO: 529403

SEQ ID NO: 529779 - RNA, 64 nt, Human; identical to SEQ ID NO: 529404

SEQ ID NO: 529780 - RNA, 60 nt, Human; identical to SEQ ID NO: 529405

SEQ ID NO: 529781 - RNA, 64 nt, Human; identical to SEQ ID NO: 529406

SEQ ID NO: 529782 - RNA, 64 nt, Human; identical to SEQ ID NO: 529407

SEQ ID NO: 529783 - RNA, 64 nt, Human; identical to SEQ ID NO: 529408

SEQ ID NO: 529784 - RNA, 64 nt, Human; identical to SEQ ID NO: 529409

SEQ ID NO: 529785 - RNA, 64 nt, Human; identical to SEQ ID NO: 529410

SEQ ID NO: 529786 - RNA, 64 nt, Human; identical to SEQ ID NO: 529411

SEQ ID NO: 529787 - RNA, 64 nt, Human; identical to SEQ ID NO: 529412

SEQ ID NO: 529788 - RNA, 64 nt, Human; identical to SEQ ID NO: 529413

SEQ ID NO: 529789 - RNA, 64 nt, Human; identical to SEQ ID NO: 529414

SEQ ID NO: 529790 - RNA, 64 nt, Human; identical to SEQ ID NO: 529415

SEQ ID NO: 529791 - RNA, 64 nt, Human; identical to SEQ ID NO: 529416

SEQ ID NO: 529792 - RNA, 64 nt, Human; identical to SEQ ID NO: 529417

SEQ ID NO: 529793 - RNA, 64 nt, Human; identical to SEQ ID NO: 529418

SEQ ID NO: 529794 - RNA, 64 nt, Human; identical to SEQ ID NO: 529419

SEQ ID NO: 529795 - RNA, 64 nt, Human; identical to SEQ ID NO: 529420

SEQ ID NO: 529796 - RNA, 64 nt, Human; identical to SEQ ID NO: 529421

SEQ ID NO: 529797 - RNA, 64 nt, Human; identical to SEQ ID NO: 529422

SEQ ID NO: 529798 - RNA, 64 nt, Human; identical to SEQ ID NO: 529423

SEQ ID NO: 529799 - RNA, 64 nt, Human; identical to SEQ ID NO: 529424

SEQ ID NO: 529800 - RNA, 64 nt, Human; identical to SEQ ID NO: 529425

SEQ ID NO: 529801 - RNA, 64 nt, Human; identical to SEQ ID NO: 529426

SEQ ID NO: 529802 - RNA, 64 nt, Human; identical to SEQ ID NO: 529427

SEQ ID NO: 529803 - RNA, 64 nt, Human; identical to SEQ ID NO: 529428

SEQ ID NO: 529804 - RNA, 64 nt, Human; identical to SEQ ID NO: 529429

SEQ ID NO: 529805 - RNA, 64 nt, Human; identical to SEQ ID NO: 529430

SEQ ID NO: 529806 - RNA, 64 nt, Human; identical to SEQ ID NO: 529431

SEQ ID NO: 529807 - RNA, 64 nt, Human; identical to SEQ ID NO: 529432

SEQ ID NO: 529808 - RNA, 64 nt, Human; identical to SEQ ID NO: 529433

SEQ ID NO: 529809 - RNA, 64 nt, Human; identical to SEQ ID NO: 529434

SEQ ID NO: 529810 - RNA, 64 nt, Human; identical to SEQ ID NO: 529435

SEQ ID NO: 529811 - RNA, 64 nt, Human; identical to SEQ ID NO: 529436

SEQ ID NO: 529812 - RNA, 64 nt, Human; identical to SEQ ID NO: 529437

SEQ ID NO: 529813 - RNA, 64 nt, Human; identical to SEQ ID NO: 529438

SEQ ID NO: 529814 - RNA, 64 nt, Human; identical to SEQ ID NO: 529439

SEQ ID NO: 529815 - RNA, 64 nt, Human; identical to SEQ ID NO: 529440

SEQ ID NO: 529816 - RNA, 64 nt, Human; identical to SEQ ID NO: 529441

SEQ ID NO: 529817 - RNA, 64 nt, Human; identical to SEQ ID NO: 529442

SEQ ID NO: 529818 - RNA, 64 nt, Human; identical to SEQ ID NO: 529443

SEQ ID NO: 529819 - RNA, 64 nt, Human; identical to SEQ ID NO: 529444

SEQ ID NO: 529820 - RNA, 64 nt, Human; identical to SEQ ID NO: 529445

SEQ ID NO: 529821 - RNA, 64 nt, Human; identical to SEQ ID NO: 529446

SEQ ID NO: 529822 - RNA, 64 nt, Human; identical to SEQ ID NO: 529447

SEQ ID NO: 529823 - RNA, 64 nt, Human; identical to SEQ ID NO: 529448

SEQ ID NO: 529824 - RNA, 64 nt, Human; identical to SEQ ID NO: 529449

SEQ ID NO: 529825 - RNA, 64 nt, Human; identical to SEQ ID NO: 529450

SEQ ID NO: 529826 - RNA, 64 nt, Human; identical to SEQ ID NO: 529451

SEQ ID NO: 529827 - RNA, 64 nt, Human; identical to SEQ ID NO: 529452

SEQ ID NO: 529828 - RNA, 64 nt, Human; identical to SEQ ID NO: 529453

SEQ ID NO: 529829 - RNA, 64 nt, Human; identical to SEQ ID NO: 529454

SEQ ID NO: 529830 - RNA, 64 nt, Human; identical to SEQ ID NO: 529455

SEQ ID NO: 529831 - RNA, 64 nt, Human; identical to SEQ ID NO: 529456

SEQ ID NO: 529832 - RNA, 64 nt, Human; identical to SEQ ID NO: 529457

SEQ ID NO: 529833 - RNA, 64 nt, Human; identical to SEQ ID NO: 529458

SEQ ID NO: 529834 - RNA, 64 nt, Human; identical to SEQ ID NO: 529459

SEQ ID NO: 529835 - RNA, 64 nt, Human; identical to SEQ ID NO: 529460

SEQ ID NO: 529836 - RNA, 64 nt, Human; identical to SEQ ID NO: 529461

SEQ ID NO: 529837 - RNA, 64 nt, Human; identical to SEQ ID NO: 529462

SEQ ID NO: 529838 - RNA, 64 nt, Human; identical to SEQ ID NO: 529463

SEQ ID NO: 529839 - RNA, 64 nt, Human; identical to SEQ ID NO: 529464

SEQ ID NO: 529840 - RNA, 64 nt, Human; identical to SEQ ID NO: 529465

SEQ ID NO: 529841 - RNA, 64 nt, Human; identical to SEQ ID NO: 529466

SEQ ID NO: 529842 - RNA, 64 nt, Human; identical to SEQ ID NO: 529467

SEQ ID NO: 529843 - RNA, 64 nt, Human; identical to SEQ ID NO: 529468

SEQ ID NO: 529844 - RNA, 64 nt, Human; identical to SEQ ID NO: 529469

SEQ ID NO: 529845 - RNA, 64 nt, Human; identical to SEQ ID NO: 529470

SEQ ID NO: 529846 - RNA, 64 nt, Human; identical to SEQ ID NO: 529471

SEQ ID NO: 529847 - RNA, 64 nt, Human; identical to SEQ ID NO: 529472

SEQ ID NO: 529848 - RNA, 64 nt, Human; identical to SEQ ID NO: 529473

SEQ ID NO: 529849 - RNA, 64 nt, Human; identical to SEQ ID NO: 529474

SEQ ID NO: 529850 - RNA, 64 nt, Human; identical to SEQ ID NO: 529475

SEQ ID NO: 529851 - RNA, 64 nt, Human; identical to SEQ ID NO: 529476

SEQ ID NO: 529852 - RNA, 64 nt, Human; identical to SEQ ID NO: 529477

SEQ ID NO: 529853 - RNA, 64 nt, Human; identical to SEQ ID NO: 529478

SEQ ID NO: 529854 - RNA, 64 nt, Human; identical to SEQ ID NO: 529479

SEQ ID NO: 529855 - RNA, 64 nt, Human; identical to SEQ ID NO: 529480

SEQ ID NO: 529856 - RNA, 64 nt, Human; identical to SEQ ID NO: 529481

SEQ ID NO: 529857 - RNA, 64 nt, Human; identical to SEQ ID NO: 529482

SEQ ID NO: 529858 - RNA, 64 nt, Human; identical to SEQ ID NO: 529483

SEQ ID NO: 529859 - RNA, 64 nt, Human; identical to SEQ ID NO: 529484

SEQ ID NO: 529860 - RNA, 64 nt, Human; identical to SEQ ID NO: 529485

SEQ ID NO: 529861 - RNA, 64 nt, Human; identical to SEQ ID NO: 529486

SEQ ID NO: 529862 - RNA, 64 nt, Human; identical to SEQ ID NO: 529487

SEQ ID NO: 529863 - RNA, 64 nt, Human; identical to SEQ ID NO: 529488

SEQ ID NO: 529864 - RNA, 64 nt, Human; identical to SEQ ID NO: 529489

SEQ ID NO: 529865 - RNA, 64 nt, Human; identical to SEQ ID NO: 529490

SEQ ID NO: 529866 - RNA, 64 nt, Human; identical to SEQ ID NO: 529491

SEQ ID NO: 529867 - RNA, 64 nt, Human; identical to SEQ ID NO: 529492

SEQ ID NO: 529868 - RNA, 64 nt, Human; identical to SEQ ID NO: 529493

SEQ ID NO: 529869 - RNA, 64 nt, Human; identical to SEQ ID NO: 529494

SEQ ID NO: 529870 - RNA, 64 nt, Human; identical to SEQ ID NO: 529495

SEQ ID NO: 529871 - RNA, 64 nt, Human; identical to SEQ ID NO: 529496

SEQ ID NO: 529872 - RNA, 64 nt, Human; identical to SEQ ID NO: 529497

SEQ ID NO: 529873 - RNA, 64 nt, Human; identical to SEQ ID NO: 529498

SEQ ID NO: 529874 - RNA, 64 nt, Human; identical to SEQ ID NO: 529499

SEQ ID NO: 529875 - RNA, 64 nt, Human; identical to SEQ ID NO: 529500

SEQ ID NO: 529876 - RNA, 64 nt, Human; identical to SEQ ID NO: 529501

SEQ ID NO: 529877 - RNA, 64 nt, Human; identical to SEQ ID NO: 529502

SEQ ID NO: 529878 - RNA, 64 nt, Human; identical to SEQ ID NO: 529503

SEQ ID NO: 529879 - RNA, 64 nt, Human; identical to SEQ ID NO: 529504

SEQ ID NO: 529880 - RNA, 64 nt, Human; identical to SEQ ID NO: 529505

SEQ ID NO: 529881 - RNA, 64 nt, Human; identical to SEQ ID NO: 529506

SEQ ID NO: 529882 - RNA, 64 nt, Human; identical to SEQ ID NO: 529507

SEQ ID NO: 529883 - RNA, 64 nt, Human; identical to SEQ ID NO: 529508

SEQ ID NO: 529884 - RNA, 64 nt, Human; identical to SEQ ID NO: 529509

SEQ ID NO: 529885 - RNA, 64 nt, Human; identical to SEQ ID NO: 529510

SEQ ID NO: 529886 - RNA, 64 nt, Human; identical to SEQ ID NO: 529511

SEQ ID NO: 529887 - RNA, 64 nt, Human; identical to SEQ ID NO: 529512

SEQ ID NO: 529888 - RNA, 64 nt, Human; identical to SEQ ID NO: 529513

SEQ ID NO: 529889 - RNA, 64 nt, Human; identical to SEQ ID NO: 529514

SEQ ID NO: 529890 - RNA, 64 nt, Human; identical to SEQ ID NO: 529515

SEQ ID NO: 529891 - RNA, 64 nt, Human; identical to SEQ ID NO: 529516

SEQ ID NO: 529892 - RNA, 64 nt, Human; identical to SEQ ID NO: 529517

SEQ ID NO: 529893 - RNA, 64 nt, Human; identical to SEQ ID NO: 529518

SEQ ID NO: 529894 - RNA, 64 nt, Human; identical to SEQ ID NO: 529519

SEQ ID NO: 529895 - RNA, 64 nt, Human; identical to SEQ ID NO: 529520

SEQ ID NO: 529896 - RNA, 64 nt, Human; identical to SEQ ID NO: 529521

SEQ ID NO: 529897 - RNA, 64 nt, Human; identical to SEQ ID NO: 529522

SEQ ID NO: 529898 - RNA, 64 nt, Human; identical to SEQ ID NO: 529523

SEQ ID NO: 529899 - RNA, 64 nt, Human; identical to SEQ ID NO: 529524

SEQ ID NO: 529900 - RNA, 64 nt, Human; identical to SEQ ID NO: 529525

SEQ ID NO: 529901 - RNA, 64 nt, Human; identical to SEQ ID NO: 529526

SEQ ID NO: 529902 - RNA, 64 nt, Human; identical to SEQ ID NO: 529527

SEQ ID NO: 529903 - RNA, 64 nt, Human; identical to SEQ ID NO: 529528

SEQ ID NO: 529904 - RNA, 64 nt, Human; identical to SEQ ID NO: 529529

SEQ ID NO: 529905 - RNA, 64 nt, Human; identical to SEQ ID NO: 529530

SEQ ID NO: 529906 - RNA, 64 nt, Human; identical to SEQ ID NO: 529531

SEQ ID NO: 529907 - RNA, 64 nt, Human; identical to SEQ ID NO: 529532

SEQ ID NO: 529908 - RNA, 64 nt, Human; identical to SEQ ID NO: 529533

SEQ ID NO: 529909 - RNA, 64 nt, Human; identical to SEQ ID NO: 529534

SEQ ID NO: 529910 - RNA, 64 nt, Human; identical to SEQ ID NO: 529535

SEQ ID NO: 529911 - RNA, 64 nt, Human; identical to SEQ ID NO: 529536

SEQ ID NO: 529912 - RNA, 64 nt, Human; identical to SEQ ID NO: 529537

SEQ ID NO: 529913 - RNA, 64 nt, Human; identical to SEQ ID NO: 529538

SEQ ID NO: 529914 - RNA, 64 nt, Human; identical to SEQ ID NO: 529539

SEQ ID NO: 529915 - RNA, 64 nt, Human; identical to SEQ ID NO: 529540

SEQ ID NO: 529916 - RNA, 64 nt, Human; identical to SEQ ID NO: 529541

SEQ ID NO: 529917 - RNA, 64 nt, Human; identical to SEQ ID NO: 529542

SEQ ID NO: 529918 - RNA, 64 nt, Human; identical to SEQ ID NO: 529543

SEQ ID NO: 529919 - RNA, 64 nt, Human; identical to SEQ ID NO: 529544

SEQ ID NO: 529920 - RNA, 64 nt, Human; identical to SEQ ID NO: 529545

SEQ ID NO: 529921 - RNA, 64 nt, Human; identical to SEQ ID NO: 529546

SEQ ID NO: 529922 - RNA, 64 nt, Human; identical to SEQ ID NO: 529547

SEQ ID NO: 529923 - RNA, 64 nt, Human; identical to SEQ ID NO: 529548

SEQ ID NO: 529924 - RNA, 64 nt, Human; identical to SEQ ID NO: 529549

SEQ ID NO: 529925 - RNA, 64 nt, Human; identical to SEQ ID NO: 529550

SEQ ID NO: 529926 - RNA, 64 nt, Human; identical to SEQ ID NO: 529551

SEQ ID NO: 529927 - RNA, 64 nt, Human; identical to SEQ ID NO: 529552

SEQ ID NO: 529928 - RNA, 64 nt, Human; identical to SEQ ID NO: 529553

SEQ ID NO: 529929 - RNA, 64 nt, Human; identical to SEQ ID NO: 529554

SEQ ID NO: 529930 - RNA, 64 nt, Human; identical to SEQ ID NO: 529555

SEQ ID NO: 529931 - RNA, 64 nt, Human; identical to SEQ ID NO: 529556

SEQ ID NO: 529932 - RNA, 64 nt, Human; identical to SEQ ID NO: 529557

SEQ ID NO: 529933 - RNA, 64 nt, Human; identical to SEQ ID NO: 529558

SEQ ID NO: 529934 - RNA, 64 nt, Human; identical to SEQ ID NO: 529559

SEQ ID NO: 529935 - RNA, 64 nt, Human; identical to SEQ ID NO: 529560

SEQ ID NO: 529936 - RNA, 64 nt, Human; identical to SEQ ID NO: 529561

SEQ ID NO: 529937 - RNA, 64 nt, Human; identical to SEQ ID NO: 529562

SEQ ID NO: 529938 - RNA, 64 nt, Human; identical to SEQ ID NO: 529563

SEQ ID NO: 529939 - RNA, 64 nt, Human; identical to SEQ ID NO: 529564

SEQ ID NO: 529940 - RNA, 64 nt, Human; identical to SEQ ID NO: 529565

SEQ ID NO: 529941 - RNA, 64 nt, Human; identical to SEQ ID NO: 529566

SEQ ID NO: 529942 - RNA, 64 nt, Human; identical to SEQ ID NO: 529567

SEQ ID NO: 529943 - RNA, 64 nt, Human; identical to SEQ ID NO: 529568

SEQ ID NO: 529944 - RNA, 64 nt, Human; identical to SEQ ID NO: 529569

SEQ ID NO: 529945 - RNA, 64 nt, Human; identical to SEQ ID NO: 529570

SEQ ID NO: 529946 - RNA, 64 nt, Human; identical to SEQ ID NO: 529571

SEQ ID NO: 529947 - RNA, 64 nt, Human; identical to SEQ ID NO: 529572

SEQ ID NO: 529948 - RNA, 64 nt, Human; identical to SEQ ID NO: 529573

SEQ ID NO: 529949 - RNA, 64 nt, Human; identical to SEQ ID NO: 529574

SEQ ID NO: 529950 - RNA, 64 nt, Human; identical to SEQ ID NO: 529575

SEQ ID NO: 529951 - RNA, 64 nt, Human; identical to SEQ ID NO: 529576

SEQ ID NO: 529952 - RNA, 64 nt, Human
guuggugagugagugauaggguaacaugggccuucaggaugaccccuuggaacugugccgaguu

SEQ ID NO: 529953 - RNA, 64 nt, Human
uaagucugucucuuucagcugccaguaaguuuuccaggaugagaggggaaaaagaaagccucca

SEQ ID NO: 529954 - RNA, 64 nt, Human
aaaaaaucauauguaccaaggauguuacaguaaacaggaugaacuauuuaaacccacugggucc

SEQ ID NO: 529955 - RNA, 64 nt, Human
ggcugugucguagccaaggugggcugagcccuggcaggaugacccugcgaaggggcccuggucc

SEQ ID NO: 529956 - RNA, 64 nt, Human
cuccacagcccgaggggacacaggauggaaaccccaggaugagaagggagcagggagaguucca

SEQ ID NO: 529957 - RNA, 64 nt, Human
aacgggaggacucgcagcucucccuuuccccagccaggaugagggaauuagacaauggaagucg

SEQ ID NO: 529958 - RNA, 64 nt, Human
cuucuccuccugcuguccagauacagggaagacucaggaugagggugcccgggcuggacggcua

SEQ ID NO: 529959 - RNA, 64 nt, Human
cugcccacaggacagugggaguuacaguucauaucaggaugacccuacauacccaggucagauu

SEQ ID NO: 529960 - RNA, 64 nt, Human
ugcuuaguguuuccugggucaggaacagagccaacaggaugaacgugugcaaaagccuuggacu

SEQ ID NO: 529961 - RNA, 64 nt, Human
accauuuauagcaugaagcccuacaugaucacugcaggaugauccuccucccauccuuucccuu

SEQ ID NO: 529962 - RNA, 59 nt, Human; identical to SEQ ID NO: 65838

SEQ ID NO: 529963 - RNA, 64 nt, Human
guucuugcacaacuucaagaaaagcagcucagcucaggaugagucuuccugccugaaacugaga

SEQ ID NO: 529964 - RNA, 64 nt, Human
caugaggagggugcccuccuagcuccacccucaccaggaugaaggcgugcaaggggcucagcaa

SEQ ID NO: 529965 - RNA, 64 nt, Human
gauuguuuacaaucacaaggacauagauaccuaucaggaugaagaacaggcauugcaaggaccc

SEQ ID NO: 529966 - RNA, 64 nt, Human
cuagcaaagcaggcuccaguggggccucaucauacaggaugacaagacuggggcccuguucacc

SEQ ID NO: 529967 - RNA, 64 nt, Human
cuacccaguggugucuacugaagaucccuuugaccaggaugacuggggagcuuggcagaaguuc

SEQ ID NO: 529968 - RNA, 53 nt, Human; identical to SEQ ID NO: 65844

SEQ ID NO: 529969 - RNA, 64 nt, Human
ccauauuccaaaaaccacuucugucccauuucaccaggaugacuaaggcaagcucccuguggcc

SEQ ID NO: 529970 - RNA, 64 nt, Human
ccuuuguugcugcuucccugaaugaguauuaccccaggaugaggucugccaucagcuuaguuag

SEQ ID NO: 529971 - RNA, 64 nt, Human
uugcugagcaagcaugugguugcauuggguggcccaggaugacaaugcacagcacagaugccau

SEQ ID NO: 529972 - RNA, 64 nt, Human
aagcaggcagucucaugcaugagagguuacccuucaggaugacagagcugagggucuuuguagg

SEQ ID NO: 529973 - RNA, 64 nt, Human
ucauugaggaucuugggugagagagagggaccugcaggaugaacaaaugucuacucuaagacag

SEQ ID NO: 529974 - RNA, 64 nt, Human
gaugggccucucagcucccacaaucucuggccuccaggaugagcuaucccaucuucaggaguua

SEQ ID NO: 529975 - RNA, 64 nt, Human
gagcugcucaagcaauagcagagguuucacccggcaggaugacacagaccacuucccagggagc

SEQ ID NO: 529976 - RNA, 64 nt, Human
aggccagaccugcagacgcccagauuaugagacacaggaugaagcauuuacaacccgguucacu

SEQ ID NO: 529977 - RNA, 64 nt, Human
uuuguggaaggugaaggaagacccacagagugcucaggaugaugcuauugcuggagagcgaaag

SEQ ID NO: 529978 - RNA, 64 nt, Human
ugggcugggaaaugucucuuucauauuguaaguccaggaugaacuaggagaaagcaauuuguug

SEQ ID NO: 529979 - RNA, 64 nt, Human
aaaauuuaaccuacuagacaaugaugugaguacccaggaugauuuccuggggcacaguggguga

SEQ ID NO: 529980 - RNA, 64 nt, Human
ucucaaaaaaaaaaaaaaaguuuucuagaauaagcaggaugauuguuuaauuugaagauggaac

SEQ ID NO: 529981 - RNA, 64 nt, Human
aguucagauguguaacucaaauuauuaugccuuucaggaugaugguagagcaauauuaaacaag

SEQ ID NO: 529982 - RNA, 64 nt, Human
guuguuucauaaaaguuggaucuguuccuaugcccaggaugauuuugugaaccgugaaguacgu

SEQ ID NO: 529983 - RNA, 64 nt, Human
uuaaauuuguuaauaaugaaaacccuuaagcaugcaggaugagguauuuggguuuuuuuuuuag

SEQ ID NO: 529984 - RNA, 64 nt, Human
ggaagaugguaauuuuuuuuuauggaugauauggcaggaugauugguucugaucuuaccggcua

SEQ ID NO: 529985 - RNA, 64 nt, Human
acugccuugaacauagagaaaaauuaaggccucacaggaugagucuccauucucuguaaaugcu

SEQ ID NO: 529986 - RNA, 64 nt, Human
caugucuccucauuccuacaccuauuuucugcugcaggaugaggcuaggguuagcauucuagac

SEQ ID NO: 529987 - RNA, 64 nt, Human
ggggcuccacaggccccuggcaaggccgauggcucaggaugauggggcacagcccgccuuugaa

SEQ ID NO: 529988 - RNA, 64 nt, Human
gauuuaccguucugcaacaacggacugguacauacaggaugaucacaaugguaaggcacauaaa

SEQ ID NO: 529989 - RNA, 64 nt, Human
aaucucucaggaccccguggaauugcaucuucugcaggaugaaggagucuccgggaagccaaca

SEQ ID NO: 529990 - RNA, 64 nt, Human
gcugugcuaagugcuuuacgaacauucgucauaucaggaugaccucgagagcugaggcucuagc

SEQ ID NO: 529991 - RNA, 64 nt, Human
gaauauguaucgugcccccucuggugucuuugaucaggaugacaugugccauuuuucagaggac

SEQ ID NO: 529992 - RNA, 64 nt, Human
gguugucccuccaguucccuccugagggcugugccaggaugacugucucaugcccccucugcau

SEQ ID NO: 529993 - RNA, 64 nt, Human
cugcugggucacagccacucaggaggggaagggucaggaugagaggcugcagccucgacacuug

SEQ ID NO: 529994 - RNA, 64 nt, Human
uguucaaccuguuuugaccucccaggcaucugaacaggaugacaucaucuuauuauaucuuacu

SEQ ID NO: 529995 - RNA, 64 nt, Human
aacaugaggaaaugccucuuucuuccccagacuccaggaugacuuugcacguuaauuuuucuug

SEQ ID NO: 529996 - RNA, 64 nt, Human
cauggggaggggagagaagguggucugcaccccacaggaugaacuagccaugacuaggguccuc

SEQ ID NO: 529997 - RNA, 64 nt, Human
cgcugcuuggugugacccacggaggauccacucccaggaugacgugcuccguagcucugcugcu

SEQ ID NO: 529998 - RNA, 64 nt, Human
ucccugugugguuaauuuaaugaaccaugaaagacaggaugaccuuggacaaggccaaacuguc

SEQ ID NO: 529999 - RNA, 64 nt, Human
gaagacaauuuuuccguggaugggggaaugguuucaggaugaacuguuccaccucagaucauca

SEQ ID NO: 530000 - RNA, 64 nt, Human
cuugcacuuaacggaaguuacaucaggcaaguaccaggaugaaaagaacuaugaaauaaaugaa

SEQ ID NO: 530001 - RNA, 64 nt, Human
aauggcauuucuaaagcuuuugggcacuguguaccaggaugaggaagagaagaaaugaggagcc

SEQ ID NO: 530002 - RNA, 64 nt, Human
agagcagcugacccaacucagaaucucuuuccuacaggaugaagugccuuuugaauguuauuuu

SEQ ID NO: 530003 - RNA, 64 nt, Human
ccagucauucccaucgcuuugcaaucacaagccacaggaugagaaguucugacucacucaugcc

SEQ ID NO: 530004 - RNA, 64 nt, Human
aauuuuaguagagaugggguuucacugcguuggccaggaugaucucgaucucuugaccuuggga

SEQ ID NO: 530005 - RNA, 64 nt, Human
ugccuuuauccaaaagcacaucuugugcuccaugcaggaugaugacagaauugaucugauguua

SEQ ID NO: 530006 - RNA, 64 nt, Human
agauaacagaaccuacgaugaaaugagucugauucaggaugacguggaccuccgugacacacgg

SEQ ID NO: 530007 - RNA, 64 nt, Human
gggcccuuggauacucuucucccaucucccuucacaggaugacacccucccauaccccauagcu

SEQ ID NO: 530008 - RNA, 64 nt, Human
acugaaaggagggccugggccagcuuugaaaaggcaggaugaaauggaaaggucaccacacuua

SEQ ID NO: 530009 - RNA, 64 nt, Human
uaccauguucagcccagacuccugccacauggaccaggaugaagagggaucaaagagauaauua

SEQ ID NO: 530010 - RNA, 52 nt, Human; identical to SEQ ID NO: 65886

SEQ ID NO: 530011 - RNA, 64 nt, Human
auuuuuaguagaggcaggguuucaccauguuagccaggaugaucucgaucuccugaccucauga

SEQ ID NO: 530012 - RNA, 64 nt, Human
uugaagccaauaaguuuuaucuuuuauaaucugucaggaugaaccacuccuuagcuuuuaucca

SEQ ID NO: 530013 - RNA, 64 nt, Human
uuucuccuguugacagagccaccggauuaugacacaggaugaggaagauuaaggauaaucaauu

SEQ ID NO: 530014 - RNA, 64 nt, Human
uaaauugcauccuguaacuucuguccaaaaagaacaggaugauguacaaauugcucuuccaggu

SEQ ID NO: 530015 - RNA, 64 nt, Human
uggccauccaugcguggacgcuguguggagaguccaggaugacgggaucccgcacaagcucccu

SEQ ID NO: 530016 - RNA, 64 nt, Human
gccuaccugaggucccuacucucacugggguccccaggaugaaaacgacaaugugccuuuuuau

SEQ ID NO: 530017 - RNA, 64 nt, Human
ggagacaggccauccauccuggagccucauggaacaggaugauggcacugagaaagccaaugac

SEQ ID NO: 530018 - RNA, 64 nt, Human
uucccuuccuuuccuuucucaggccuugcucccccaggaugacccacucuuagggggguggugg

SEQ ID NO: 530019 - RNA, 64 nt, Human
cacaggaaucuucuucuuggcagcugcagucugucaggaugagauaucagauuagguuggauag

SEQ ID NO: 530020 - RNA, 64 nt, Human
auuugagaaauauuuagaaguaaaguugacaggacaggaugauugauuaaaagaggggagcaag

SEQ ID NO: 530021 - RNA, 64 nt, Human
uuuuuucaguuguuuuuggaaaaauucuagaaaucaggaugaaaaaugcagcuuuuccaggguu

SEQ ID NO: 530022 - RNA, 64 nt, Human
auuccuucacaagauggaaggcaggugaggaugucaggaugagaugggaccagguagccgagga

SEQ ID NO: 530023 - RNA, 64 nt, Human
aaaagcaauaaccucaaagugacuauucaguuuucaggaugauacacuaugaagauguuucaaa

SEQ ID NO: 530024 - RNA, 64 nt, Human
cuacuagaaaagcugaguggagucuccuuuccaacaggaugaugcauuugcucaauucucaggg

SEQ ID NO: 530025 - RNA, 64 nt, Human
uuuucagaggucgcacacagugacucuccucucucaggaugacgaggaccugugccuucaacaa

SEQ ID NO: 530026 - RNA, 64 nt, Human
ucaugguuuacaggaaggcucugguucccccucacaggaugagcaugcucaguugggcgugugu

SEQ ID NO: 530027 - RNA, 64 nt, Human
ccuggauccucaguucucaaauguguguggcagccaggaugacuagauccuggguuuccauccu

SEQ ID NO: 530028 - RNA, 64 nt, Human
agcaauuaaugcaggcuauuaucagacacagcagcaggaugaagccaaccugcaguauuaaccu

SEQ ID NO: 530029 - RNA, 64 nt, Human
cagauguucuucaccccuuuugguagaacaaaagcaggaugauaaccauauccccccagugcuc

SEQ ID NO: 530030 - RNA, 58 nt, Human; identical to SEQ ID NO: 65906

SEQ ID NO: 530031 - RNA, 64 nt, Human
agcucauugaguauauugcuucaagguacaaacccaggaugaugauguugucaccacugucucu

SEQ ID NO: 530032 - RNA, 64 nt, Human
uagcuauugcugcuguuguuuuuuauucuauuuacaggaugauuuuuaaacugucaaaugaagu

SEQ ID NO: 530033 - RNA, 64 nt, Human
cuuagcaaagagcaacuaauauguuuucugaaaccaggaugaugcucauucaggaaauccacua

SEQ ID NO: 530034 - RNA, 64 nt, Human
uauaugucauuuucuccuuucuuuucacguuacucaggaugaacucucugagcagggaccugcu

SEQ ID NO: 530035 - RNA, 64 nt, Human
uccaggaugccugugaagaaagaucccuggaucccaggaugauuauaggacaaguuguucauaa

SEQ ID NO: 530036 - RNA, 64 nt, Human
uaaagugcuacaggcagcuggaucuguuugcaugcaggaugaagaggguuaaaacacuguuuau

SEQ ID NO: 530037 - RNA, 64 nt, Human
ugcaagccugggaacuugggcaucguugggccagcaggaugagcagcaaagggucugaggacag

SEQ ID NO: 530038 - RNA, 64 nt, Human
uauaguaaauuaugauccuuaaauauuugagagucaggaugaagcagaucugcuguagacuuuu

SEQ ID NO: 530039 - RNA, 64 nt, Human
gccaucucaacagaaucgcaccaaacuauacuuucaggaugaauuucuucuuucugccaucuuu

SEQ ID NO: 530040 - RNA, 64 nt, Human
gccucacugaccaauugugggacaauuugaacaucaggaugaauaaugacaggagagauuauaa

SEQ ID NO: 530041 - RNA, 64 nt, Human
acgggacgccaugggcacugcagggacagucagucaggaugacacuucggcaucaucucuuccc

SEQ ID NO: 530042 - RNA, 64 nt, Human
ugccuuucuagagggagccacgcacagaauguaacaggaugaaacaguuucaaguaagccuuga

SEQ ID NO: 530043 - RNA, 64 nt, Human; identical to SEQ ID NO: 530035

SEQ ID NO: 530044 - RNA, 64 nt, Human
agagauguaugugucacugcauggcuucugaaagcaggaugaauuuucugcagcuguuucaaag

SEQ ID NO: 530045 - RNA, 64 nt, Human
gcauuuuucuaucacauucucaauaguuccagcucaggaugaaaggauagacacaaaauuguuu

SEQ ID NO: 530046 - RNA, 64 nt, Human
agcaccacgagcuaaaauuuaccaacccauuuaucaggaugaccauugccauuugucaggugac

SEQ ID NO: 530047 - RNA, 59 nt, Human; identical to SEQ ID NO: 65923

SEQ ID NO: 530048 - RNA, 64 nt, Human
gcuguggacuuggaaugaggccaacaggguucaccaggaugagagaggagagaggaauccacag

SEQ ID NO: 530049 - RNA, 64 nt, Human
agagauuagguugugauacaugaagagccaagagcaggaugagguggaggcguuacaacuaccu

SEQ ID NO: 530050 - RNA, 64 nt, Human
agggaagaagcaagaaacuucggggcugcagccucaggaugaggcagaaggaaggguaagggaa

SEQ ID NO: 530051 - RNA, 64 nt, Human
cugagacagggucaccuugggaaggcuugggagccaggaugagugucgggcucucgugugugca

SEQ ID NO: 530052 - RNA, 64 nt, Human
cuccgagcuuuccuggcauaggucaaucaggucccaggaugaauaauccaggcuucagcaacac

SEQ ID NO: 530053 - RNA, 64 nt, Human
ucaaggagcagugcagauuucaauuuggcuaaaacaggaugauugcuuuugucuguuuacugaa

SEQ ID NO: 530054 - RNA, 64 nt, Human
cacauucaaggaagaacuuucugccccggcuuugcaggaugaaaagcuuuccugcuuggcaguu

SEQ ID NO: 530055 - RNA, 64 nt, Human
ggagaaccacagcugcagaguaggcagcugccuccaggaugaguuacuugaaauuugccuugag

SEQ ID NO: 530056 - RNA, 64 nt, Human
ccucuuaucuuccuaagcggaguuuuaggugacacaggaugaagcagaagagaucuacccaucu

SEQ ID NO: 530057 - RNA, 64 nt, Human
ugcacuugaguuuauugccccauaacuaaaggaucaggaugaugguagaacggagaucuggguu

SEQ ID NO: 530058 - RNA, 64 nt, Human
aggacaggggaguuaaauggcugggcaggugccacaggaugaggccacugaaagaucugcuuca

SEQ ID NO: 530059 - RNA, 64 nt, Human
ucagcaauguggaaauucuaaagcucccugagaacaggaugacucguguuugaaggaucuuauu

SEQ ID NO: 530060 - RNA, 64 nt, Human
aauauugugucuacaauugcaaaaaacacaguaacaggaugaauauuaucugauaucaagucaa

SEQ ID NO: 530061 - RNA, 64 nt, Human
aaggggucccccauuguuuugcuuccccagcgcccaggaugagcgguuuaccaucgagcuuacc

SEQ ID NO: 530062 - RNA, 64 nt, Human
gcgauuuaccuguuuucgcaccuaccaucagggacaggaugaccuggauaacuuagguggcaag

SEQ ID NO: 530063 - RNA, 64 nt, Human
ccgagaggcaggucaagaucugguuccagaaccgcaggaugaaaaugaagaaaaucaacaaaga

SEQ ID NO: 530064 - RNA, 64 nt, Human
uuuacuuuacaaauaaaaccaaaucuuuugucaacaggaugaaacccaucuuaaaggaaagaaa

SEQ ID NO: 530065 - RNA, 64 nt, Human
cuaguuuccaaagcggagacuuccgacuuccuuacaggaugaggcugggcauugccugggacag

SEQ ID NO: 530066 - RNA, 64 nt, Human
gucaacaguaucuguguuuguacugugcaguuuucaggaugagaugacagauagcacgacuaca

SEQ ID NO: 530067 - RNA, 64 nt, Human
uuuuuccaguucacguaacaaguaaaugggaaaccaggaugaaaaucaagguuuaucugucauc

SEQ ID NO: 530068 - RNA, 64 nt, Human
agccacaugccccaggcucucgcugcccuguggacaggaugaggacagagggcacaugaacagc

SEQ ID NO: 530069 - RNA, 64 nt, Human
ccucgguguuagcagcagcguucccugccuccugcaggaugacuuagaaaucuagugaguuucu

SEQ ID NO: 530070 - RNA, 64 nt, Human
cuugcccaaggucagagccacuuggugacagagccaggaugagaacaaagauuccauuugcacc

SEQ ID NO: 530071 - RNA, 64 nt, Human
cugaaagcuggcagcuuuuguuacagaagauucucaggaugaaggcaggggcugaggccucugc

SEQ ID NO: 530072 - RNA, 64 nt, Human
uuauuguccuuucguguauuguucauccagcaaccaggaugaucuuguuaaaacauuaaacaga

SEQ ID NO: 530073 - RNA, 64 nt, Human
ccuacagacgggguuuauaaguacugauacuggacaggaugagaagggaguaggaugucauccu

SEQ ID NO: 530074 - RNA, 64 nt, Human
ugugaagcuuuaggaccaaauuguuagaaagcaucaggaugaccaguuaucucgaguagauuuu

SEQ ID NO: 530075 - RNA, 64 nt, Human
uacaaaaaauuauaaaaauaaguuuucagucagucaggaugacaucacucccaauguuaugcag

SEQ ID NO: 530076 - RNA, 64 nt, Human
aaauggauucccuuagaaguaagauuucuauuugcaggaugaguugggcagggaaaagggucag

SEQ ID NO: 530077 - RNA, 64 nt, Human
cuuuggcgugguaccaaccagauaaugacugcaucaggaugaaagcugcugaacucggcauggc

SEQ ID NO: 530078 - RNA, 64 nt, Human
ucaggacuuugauucaaccaauuuugaggaaucucaggaugaggaugaugcucuuaaugaaauu

SEQ ID NO: 530079 - RNA, 64 nt, Human
acagagacgcaggaauggaaagcggaguuccuaacaggaugaaaguucccccaucaguuccccc

SEQ ID NO: 530080 - RNA, 64 nt, Human
cugaaagagcaaaccuaacaggagaaaggacaaccaggaugaggaugucaccaacugaauuaaa

SEQ ID NO: 530081 - RNA, 64 nt, Human
gaaggccaaggagaguccuugcacccgugagcgucaggaugaggaaaugacaggaggaagacgu

SEQ ID NO: 530082 - RNA, 64 nt, Human
agggauuuccccauuucuguuugcugccugaaagcaggaugaggaaggccaaggagaguccuug

SEQ ID NO: 530083 - RNA, 64 nt, Human
guuuuuuuuuuuucguuuguuuuagugacuaauucaggaugaaaguuuuuuuguucuuguauuu

SEQ ID NO: 530084 - RNA, 64 nt, Human
gagggaccuucccucuaccucccccaguuagugacaggaugaggaaaagaagagccuuugcuga

SEQ ID NO: 530085 - RNA, 64 nt, Human
ucuguauuucaucugccagauuauuugaaucacacaggaugauguguuaacaguauuagggugg

SEQ ID NO: 530086 - RNA, 64 nt, Human
ucugacugccaguaauuagugcagaaaacuaagacaggaugauacagguuugaggggcugggga

SEQ ID NO: 530087 - RNA, 64 nt, Human
ucuguaugagaccagugggcgccauuuaaaagaacaggaugagaaucuaagauauauuauuaau

SEQ ID NO: 530088 - RNA, 64 nt, Human
gagauacuauuuuugcugagcaaccaguguguuucaggaugauacaaagaaaaauauagaauag

SEQ ID NO: 530089 - RNA, 64 nt, Human
acucccuuugaauuaauaugggaagaaauuaauacaggaugaacuggagagaaggguugagugu

SEQ ID NO: 530090 - RNA, 64 nt, Human
auuuuuaguagaaacgggguuucaccauguuggccaggaugauccucaaucuccugaccucgug

SEQ ID NO: 530091 - RNA, 64 nt, Human
cucugguucccaggcugagacugacggguuuucucaggaugaugucuugggugaggguagggag

SEQ ID NO: 530092 - RNA, 64 nt, Human
cacccuaacuucguauuuuuugauacgcacuuugcaggaugaccucagggcuauguggauugag

SEQ ID NO: 530093 - RNA, 64 nt, Human
gaugggaagagaacugggcugacuccaggaccuccaggaugaggcagaggcaugaugcuuccug

SEQ ID NO: 530094 - RNA, 64 nt, Human
cagaucuggcccgcacgaugccuugcaggauggacaggaugacagacagggacgaagcagagac

SEQ ID NO: 530095 - RNA, 64 nt, Human
gcauccagccagugagugggcacccaaugccucucaggaugagaccaguaaaugccggaggugg

SEQ ID NO: 530096 - RNA, 64 nt, Human
cugcgacgauccccauggaacagcccugcacgcccaggaugaaggggccagaccacgccccugc

SEQ ID NO: 530097 - RNA, 64 nt, Human
gagagauucccgcggguuccgcaggcagacuacacaggaugaggugguggaguggagugagagc

SEQ ID NO: 530098 - RNA, 64 nt, Human
cugcugacugccaggggcgggggcucugcauagccaggaugacggcuuucaugucccagagacc

SEQ ID NO: 530099 - RNA, 64 nt, Human
agacgucacaugaagaagaaaacuugucgacauccaggaugaucaggagccuucauuaaaacag

SEQ ID NO: 530100 - RNA, 64 nt, Human
gcacaugaggcugguuuaccaacaucuacucccucaggaugagcgugagccagaagcagcugug

SEQ ID NO: 530101 - RNA, 64 nt, Human
caucugcaaaaugcaaagagaacuaccucauaugcaggaugagccaauggcagucucaagaaau

SEQ ID NO: 530102 - RNA, 64 nt, Human
gagcaccugcugguaacccugggccuauugaaagcaggaugagaugauaauuuaagacacugaa

SEQ ID NO: 530103 - RNA, 64 nt, Human
agacucaaugucccccucacccccaccucaaggucaggaugagaacacacugagugaggagugg

SEQ ID NO: 530104 - RNA, 64 nt, Human
gucagaaaugcauccuccagcugacagaaaaauccaggaugagaucagaaggauacugguguuu

SEQ ID NO: 530105 - RNA, 64 nt, Human
auggacaaagaaggcacagguguaaauauaguagcaggaugaggaaccucaaacuggguaucau

SEQ ID NO: 530106 - RNA, 64 nt, Human
caaagguaaaucagacuaugaaguuuuuuuuauacaggaugaugacuauggaaagaguacucuu

SEQ ID NO: 530107 - RNA, 64 nt, Human
uggauauauuaagguucuccuugcccugaagcuucaggaugaaggacaggaagcugaaggagaa

SEQ ID NO: 530108 - RNA, 64 nt, Human
ugggaacaggccuccuaucuuuagucacuuuguacaggaugauauccaugaguacuuuaguguu

SEQ ID NO: 530109 - RNA, 64 nt, Human
gcgggcggagcugaggacaggccuuggcuggucccaggaugagcgacgaguuugguuuuagcug

SEQ ID NO: 530110 - RNA, 64 nt, Human
uguagccagaccucucugagagacauggauaucacaggaugaagguagaacuauaaucugcaau

SEQ ID NO: 530111 - RNA, 64 nt, Human
uuaaaguugcgguauuuaacguaucugccaauaccaggaugagcaacaacaguaacaaucaaac

SEQ ID NO: 530112 - RNA, 64 nt, Human
ccuuuuaaaauauauaucuuuauaaaguaauauucaggaugaugauaaaaauuguuuauauugu

SEQ ID NO: 530113 - RNA, 64 nt, Human
gggggcuggucuggcuguggccaccgucacaguccaggaugaagaggaguacaggguccuguga

SEQ ID NO: 530114 - RNA, 64 nt, Human
cccccaguauuagaauaaauuaaaacauacaagccaggaugaaugaagccaauaggaaauaaaa

SEQ ID NO: 530115 - RNA, 64 nt, Human
cucuguugauccaggcagucuuucucugccaauucaggaugagauguuuagguaaguauuuuau

SEQ ID NO: 530116 - RNA, 64 nt, Human
ggccugguuggucaaacucugggcaaaggguuuucaggaugaggaggucaagacaggaucucca

SEQ ID NO: 530117 - RNA, 64 nt, Human
cugccucugcagcccacugccugcccagugccaucaggaugagcaguaccggccaagcauaaug

SEQ ID NO: 530118 - RNA, 64 nt, Human
ugugccuaggagggggcuggcugccuuuaugucccaggaugacucuuuaugggugggauuacau

SEQ ID NO: 530119 - RNA, 64 nt, Human
cagguuguuacuuucuuaguauguacagucuucucaggaugagcaguaaaaccuuugaacaaag

SEQ ID NO: 530120 - RNA, 64 nt, Human
aauaauugcuucauuuucuugagcaauacugaagcaggaugaaguaagaggaaugcauucauuu

SEQ ID NO: 530121 - RNA, 64 nt, Human
uuccuuacacagcauuuuagggaaagaauacaggcaggaugacacuuuguguuaaaguguuauu

SEQ ID NO: 530122 - RNA, 64 nt, Human
agauuuaguauucacuagcagcgccuucggguagcaggaugauuccuuuuccugccugucugcu

SEQ ID NO: 530123 - RNA, 64 nt, Human
uguuguagucucucauauuuacucaaggagggaccaggaugauacagucaucugagguuaugcu

SEQ ID NO: 530124 - RNA, 64 nt, Human
ucccccagcacacaaggaagaccagauguagcuacaggaugaugaaacaugguuucaaacgagu

SEQ ID NO: 530125 - RNA, 64 nt, Human
gucaagaagaaaaagguuugcauucucacauugccaggaugauaaguuccuuuccuuuucuuua

SEQ ID NO: 530126 - RNA, 64 nt, Human
ccuagucacucauaucggagccuggacuggccuccaggaugaggauggggguggcaaugacacc

SEQ ID NO: 530127 - RNA, 64 nt, Human
gaugcacucuugcagcuccccagucucuaccugucaggaugacuccaggaagacagcuggagua

SEQ ID NO: 530128 - RNA, 64 nt, Human
acccaggcuucauuacacaggcuuuucauguaugcaggaugacucaauguuaaagcauuuaaau

SEQ ID NO: 530129 - RNA, 64 nt, Human
ugauaggaugagaaagauuuauauuauuagauuucaggaugauuuauaauaauucaaaaaugaa

SEQ ID NO: 530130 - RNA, 64 nt, Human
gauuuaaaucaugcaacaacgagaguaucacagccaggaugacccuugggucccauuccuaaga

SEQ ID NO: 530131 - RNA, 64 nt, Human
uucuacuuaaugggaagggaagaacauuuguuuccaggaugacuuucuggccagaauaccggaa

SEQ ID NO: 530132 - RNA, 64 nt, Human
cauccguuugacuuugguugugacaucuuccuuucaggaugauggaauuagaugcagucugucu

SEQ ID NO: 530133 - RNA, 64 nt, Human
agacuaucaguguuugccucccaaaucccaggaccaggaugacaucaaaaaucagguagaguag

SEQ ID NO: 530134 - RNA, 64 nt, Human
gcugccucuuguaggugcuggcuaagggccaggccaggaugaguuuccccauggugaauguuac

SEQ ID NO: 530135 - RNA, 64 nt, Human
ugaggacaaacugcuaggcuguaucccauaauuucaggaugagaaacauuaacaauaaaaauuu

SEQ ID NO: 530136 - RNA, 64 nt, Human
auuuuuaguagagacgggguuucaccguguuagccaggaugaucucgaucuccugaccucguga

SEQ ID NO: 530137 - RNA, 64 nt, Human
cugcagugacccugcccccaugaccuuggccaggcaggaugauuccagagcccguacugugggg

SEQ ID NO: 530138 - RNA, 64 nt, Human
ccaccgauacacugggaccaccccuuaccccggacaggaugaauggaucaaaggagugagguug

SEQ ID NO: 530139 - RNA, 64 nt, Human
cuagucuaagacccagauucugccaacauuugggcaggaugagagggcugacccugggcuccaa

SEQ ID NO: 530140 - RNA, 64 nt, Human
ugugacugcugaggaccaagguggcauccuagggcaggaugaacuggcucugagcacccugccg

SEQ ID NO: 530141 - RNA, 64 nt, Human
ggauugugggacuucccccaggcaacuaaaccugcaggaugaaaaugcuauauuuucuuucaug

SEQ ID NO: 530142 - RNA, 64 nt, Human
uuuuuuuggucacccuuuaaguguccuucucucccaggaugagugaggagcugugcugauguug

SEQ ID NO: 530143 - RNA, 64 nt, Human
uacauagauaugaaaagauuggcagaggccauugcaggaugaaucacuugucacuuuucuucug

SEQ ID NO: 530144 - RNA, 64 nt, Human
cuguggucccuggaggguggcuucuccugacuggcaggaugaccuuagccaagauauuccucug

SEQ ID NO: 530145 - RNA, 64 nt, Human
gaaugagcugcagaagaugacccgggggcagcuucaggaugaguuagagaaaggugaacgggac

SEQ ID NO: 530146 - RNA, 64 nt, Human
gaaccuuuuaaacgacaacaauacugcuagcuuucaggaugauuuuuaaaaaauagauucaaau

SEQ ID NO: 530147 - RNA, 64 nt, Human
ccuugaggucagaggucaggagcagggcuggggucaggaugacgaggccugggguccugguguu

SEQ ID NO: 530148 - RNA, 64 nt, Human
agccaccucucccucaacaagggagagacuuuaucaggaugaacccaggacugcuucugaaugc

SEQ ID NO: 530149 - RNA, 64 nt, Human
agccaccucucccucaacaagggagagaccucaucaggaugaacccaggacgcuucugaaugcu

SEQ ID NO: 530150 - RNA, 64 nt, Human
gcuaucuuggggccauguccccuucuugcugccacaggaugaauaaaguguugagauuugucua

SEQ ID NO: 530151 - RNA, 64 nt, Human
acagccuuuacuugcuccaucagaaacaacuuugcaggaugacgccaauauuuaggacaccacg

SEQ ID NO: 530152 - RNA, 64 nt, Human
auccccuccacuaucccaugggcucucucugccccaggaugaucuucugugcugggacagggac

SEQ ID NO: 530153 - RNA, 64 nt, Human
augaaaaccaguaguacguuuuagucauauuagucaggaugagaaacuauaagauguguguaac

SEQ ID NO: 530154 - RNA, 64 nt, Human
acugguuuuauaccaauauuauaugcagaaaucacaggaugaauuuagaauuaaaucucaauua

SEQ ID NO: 530155 - RNA, 64 nt, Human
ggaacccccacauucucucacugaaguuucccaccaggaugaccccacagccagagucccuugg

SEQ ID NO: 530156 - RNA, 64 nt, Human
aauauaccuuguaugcaaacgaugauaaacuagucaggaugagcagagcugccugaccucuuga

SEQ ID NO: 530157 - RNA, 64 nt, Human
cacgcaggcggccagggcggccagggacccaaagcaggaugaccacgcaccuccacgccacugc

SEQ ID NO: 530158 - RNA, 64 nt, Human
ugguuuguccgcuagcgucugucugcagaacuuucaggaugacuauuaauuccucucagauguc

SEQ ID NO: 530159 - RNA, 64 nt, Human
cauuguuuugcugaguuauuugugauuagcuaaccaggaugaaaaauaacagauuauauauagu

SEQ ID NO: 530160 - RNA, 64 nt, Human
ccuuuagguuaccuauauagucuccuaggaagaucaggaugaaagaccuagaugauaccccuga

SEQ ID NO: 530161 - RNA, 64 nt, Human
uugauauauucaaagaugugauucccaaccaacucaggaugaaguaacuaguguuacaacugag

SEQ ID NO: 530162 - RNA, 64 nt, Human
aggaaacaggcuccaagaggcugaggacuuugcccaggaugacauagccaauggacaagcagug

SEQ ID NO: 530163 - RNA, 64 nt, Human
aaaaggagaagcaggcaccuuuuucacagggcggcaggaugaaaaugacugccagcaguggaaa

SEQ ID NO: 530164 - RNA, 64 nt, Human
aagcucucuguuuucauuucuuuuucuguaaaugcaggaugaaaacaauauguaucuccuagga

SEQ ID NO: 530165 - RNA, 54 nt, Human; identical to SEQ ID NO: 66041

SEQ ID NO: 530166 - RNA, 62 nt, Human
cacugcggccuggcugcugagggacgagagaccaggaugauuucgagguuggccuuagagga

SEQ ID NO: 530167 - RNA, 64 nt, Human
acgaaagaccaagaggaaaugacugugccuggaacaggaugaaauagacaaguagagauuuaau

SEQ ID NO: 530168 - RNA, 64 nt, Human
aaaucagacugucagucauuaaaaacagcauuagcaggaugaggauagcaauggggaaggguug

SEQ ID NO: 530169 - RNA, 64 nt, Human
uugguaaaguucccaguuuuccugccuucugugacaggaugaaugagguggguauggacagugg

SEQ ID NO: 530170 - RNA, 64 nt, Human
acugaaaacaaacacauuuaaaauugguuuaccucaggaugacgugcagaaaaaugggugaagg

SEQ ID NO: 530171 - RNA, 64 nt, Human
gcugcauucccaugagcuuaggcauucuaagucacaggaugagacaggaggucagcacaagaua

SEQ ID NO: 530172 - RNA, 64 nt, Human
cuccaagcaaggcuugggguccuuuauggaaccccaggaugacucagcaauaaaauauuuuugg

SEQ ID NO: 530173 - RNA, 64 nt, Human
gcgaucaugagaaaccuuccagggaaacugagcacaggaugaacuguuaguuguuuuuaaaagu

SEQ ID NO: 530174 - RNA, 64 nt, Human
agccucuuccaggcacuggcaaugcagugaugaacaggaugacaagauucaugccaucaggggc

SEQ ID NO: 530175 - RNA, 64 nt, Human
uaauguaaauaaagugaguaauugguaugacuugcaggaugauguacauguuaguuuguagcuc

SEQ ID NO: 530176 - RNA, 64 nt, Human
acuugcaggaugauguacauguuaguuuguagcucaggaugauuguuaagcaauagauuugcuc

SEQ ID NO: 530177 - RNA, 64 nt, Human
cccucccgaguccccagauggagaccccuuucuacaggaugaccccuugauauuugcacaggga

SEQ ID NO: 530178 - RNA, 64 nt, Human
ccugguccuggcuagcagcagcaccguggugaugcaggaugaguccuucccugccugcaagauu

SEQ ID NO: 530179 - RNA, 64 nt, Human
aacaaaaacaagacagaacuucugguacucuaaucaggaugauuccuaacaagucagucauuug

SEQ ID NO: 530180 - RNA, 64 nt, Human
cuugagaggggucagucuagaagcuagauccuaucaggaugaggagcagcagcccagggcuugu

SEQ ID NO: 530181 - RNA, 64 nt, Human
ccaaagcccgcaguggacugaugccuucgaugggcaggaugaaggccaggggcacuggagugag

SEQ ID NO: 530182 - RNA, 64 nt, Human
ccugggccuccucacaacauggugucuggauucccaggaugagcaucccaggaucgcaagagcc

SEQ ID NO: 530183 - RNA, 64 nt, Human
uagcuuugcucugccaacuucuucagagcugacacaggaugaaggcaaugccauccucaaacac

SEQ ID NO: 530184 - RNA, 50 nt, Human; identical to SEQ ID NO: 66060

SEQ ID NO: 530185 - RNA, 64 nt, Human
aagaguuaaugaacaugagguaguguuccacuggcaggaugacuuuucaauagcucaaaucaau

SEQ ID NO: 530186 - RNA, 64 nt, Human
cuaagaugccuucucucuccaucuaccuuccagucaggaugacgguauuaugcuucuuggaguc

SEQ ID NO: 530187 - RNA, 64 nt, Human
cuagcagacacauccaguaucuccuucuggagcacaggaugaaauaagggagcuguauuauuuc

SEQ ID NO: 530188 - RNA, 64 nt, Human
ugcccuccaaggaugagcugguccagagauacaacaggaugaauaccaucccccagguauugga

SEQ ID NO: 530189 - RNA, 64 nt, Human
cucugcccuggcuguggggguggagggaccuugccaggaugaaccccccagucccaggcacccu

SEQ ID NO: 530190 - RNA, 64 nt, Human
agcauugcgggucucuguagaagucccaaagcuucaggaugagaagauggaggggcugguuucc

SEQ ID NO: 530191 - RNA, 64 nt, Human
ggugucccaacaaccccagcugccccccgcugcucaggaugaaccuggaggcccaccucaagga

SEQ ID NO: 530192 - RNA, 64 nt, Human
uccggugggcgacccugacaaguaccgccugucucaggaugaccgcgauggccugcagcaacuc

SEQ ID NO: 530193 - RNA, 63 nt, Human
uucucauaauaaagagaguguauacugacaugggcaggaugauaaaaaucaugguuuaauauu

SEQ ID NO: 530194 - RNA, 54 nt, Human; identical to SEQ ID NO: 66070

SEQ ID NO: 530195 - RNA, 64 nt, Human
accaagccaacggcguuccuggcucuccugcccacaggaugaacauuuucggcuuccuuaggag

SEQ ID NO: 530196 - RNA, 64 nt, Human
gugucauuaacugaaaaguagcagcuucucuauccaggaugaugagucaacagguuucacuaau

SEQ ID NO: 530197 - RNA, 64 nt, Human
uuuagccaaagcaaauucuccuauuaacacuuagcaggaugaauuuaauauucauucaaaaagg

SEQ ID NO: 530198 - RNA, 64 nt, Human
accagaaagcaguugagacaagaaaauaagagcucaggaugagggaaaagaaaaagauugagag

SEQ ID NO: 530199 - RNA, 64 nt, Human
aauuuccuggguuccaccaagcagcgaaaacugccaggaugaaugaggaaaaaacccagcccca

SEQ ID NO: 530200 - RNA, 64 nt, Human
gagagaccuguucuuucacagaugugagaagccccaggaugauugaccaugguguucaggagcg

SEQ ID NO: 530201 - RNA, 64 nt, Human
agaaguugacugucuugauaauuagccugaccagcaggaugaaugcaagacugacagugaugga

SEQ ID NO: 530202 - RNA, 64 nt, Human
auaccacuuuugaaguuaauccuuuugugugauacaggaugaacuugggauguuugaacccugg

SEQ ID NO: 530203 - RNA, 64 nt, Human
cccucaggccagcgagagauggagcuaccguguccaggaugaagcugcaggucugggggacacu

SEQ ID NO: 530204 - RNA, 64 nt, Human
ggagacccagcauccuuugcauuacuuuuuccuucaggaugaucuagagcagcauggagcuguu

SEQ ID NO: 530205 - RNA, 64 nt, Human
ccucuccucuuccucucccauuucuuuuuuaagacaggaugaaacagguucagagaggggaagu

SEQ ID NO: 530206 - RNA, 64 nt, Human
uucccgccuccuccagcugcuucaggcuaaaacccaggaugaggaggaacagguaagggcagga

SEQ ID NO: 530207 - RNA, 64 nt, Human
gccggugaauguguccacaguugagagguuggagcaggaugagggaauccugucaccaucaaua

SEQ ID NO: 530208 - RNA, 64 nt, Human
ccugagcacuuccucccguuggcaaacagaaguucaggaugagacccugcuggccugguccugg

SEQ ID NO: 530209 - RNA, 64 nt, Human
uguuuguauacaaaggggcccuccuuaaaagggacaggaugaccuucccgaggaacucauuggc

SEQ ID NO: 530210 - RNA, 64 nt, Human
gcgcuagggguucuuagucucuggggcuacuaggcaggaugaauuugacugggucgguaggagc

SEQ ID NO: 530211 - RNA, 64 nt, Human
cccaggcuucgugaauugcaagaagggacccuuccaggaugacacuaggaacagggcuagggca

SEQ ID NO: 530212 - RNA, 64 nt, Human
uugcauuuguacuuaagucauuccaucuuucacucaggaugaaugcgaaaagugacuguucaca

SEQ ID NO: 530213 - RNA, 64 nt, Human
cauuccuuaccccccagccccugcccaccuucagcaggaugaggcccuggguugccgugcucuc

SEQ ID NO: 530214 - RNA, 64 nt, Human
ucccauuagagauguaucaccaccuugucaccaacaggaugaugucaccagguaauaaaccuuc

SEQ ID NO: 530215 - RNA, 64 nt, Human
cuuaucuggaagggaaagcacaugccuucacgggcaggaugaucaagcggugcugauucacgag

SEQ ID NO: 530216 - RNA, 64 nt, Human
agagcugacugcaugaugagucugaaggcauuugcaggaugagccugaacugguugugcagaac

SEQ ID NO: 530217 - RNA, 64 nt, Human
uugcagacaaagcaccccugcaccuccuauggcucaggaugagggaggcccccaggcccuucug

SEQ ID NO: 530218 - RNA, 64 nt, Human
aaaggcuccagugagcgcgccugcuuuagagacacaggaugauucagaccggaaacagaccucg

SEQ ID NO: 530219 - RNA, 64 nt, Human
aacccacgccccucgcuggcuuccccaccucucucaggaugaaagcccaagucaucaggguggc

SEQ ID NO: 530220 - RNA, 64 nt, Human
ucgugaaggauaagagaaacaggcccggggggaccaggaugacaccuccauuucucuccaggaa

SEQ ID NO: 530221 - RNA, 64 nt, Human
cgccugagccccucugccugguccccuuugcccccaggaugaauacgacgacauugugguucac

SEQ ID NO: 530222 - RNA, 64 nt, Human
uuuguccuugcuuaugccugccucuuucgcuuggcaggaugaugcugucauuaguauuucacaa

SEQ ID NO: 530223 - RNA, 64 nt, Human
cacagcccagagcaggaggacgcugcacaccaugcaggaugacaugggggaugcgcucgggauu

SEQ ID NO: 530224 - RNA, 64 nt, Human
aacuucauuuaaccuuggucacauugagucauuccaggaugaguggcucaaguauuuccucagg

SEQ ID NO: 530225 - RNA, 64 nt, Human
caaaaguuguggguuaggguuucucccccucccucaggaugacgcuaguuagcugacacagaug

SEQ ID NO: 530226 - RNA, 64 nt, Human
gacacagauggucaccuccauuaccaaguagagucaggaugaacuaugugugacuguucaacua

SEQ ID NO: 530227 - RNA, 64 nt, Human
aaaaccacaaugugcugucacucuagacagucaccaggaugauuaaauuuaaaucacaauaaca

SEQ ID NO: 530228 - RNA, 64 nt, Human
cuguacuucacucagaaugaaggaacaaguaucucaggaugaaaucucaaugaaaaacacuuau

SEQ ID NO: 530229 - RNA, 64 nt, Human
aguggcugcagagggagccuccugcucccugcuccaggaugaaaccaagagggggaugucagcc

SEQ ID NO: 530230 - RNA, 64 nt, Human
ccucuguccugggaagaccaaaagaaaagcauuucaggaugagggaauggcaugcgcaaaggcc

SEQ ID NO: 530231 - RNA, 64 nt, Human
cugcauucucagacaguggaggcauucuaagucacaggaugagacaggagguccguacaagaua

SEQ ID NO: 530232 - RNA, 64 nt, Human
cuaauaauuaggcaaugucaagugaacacaaauucaggaugacagacugcaaaguaacauccau

SEQ ID NO: 530233 - RNA, 64 nt, Human
guauaacguggggauaauaauaauagcugcuucacaggaugaaaugaaguuugaggugagaagc

SEQ ID NO: 530234 - RNA, 64 nt, Human
cucucugccucuggaggagggugggguauucuggcaggaugaaucgcaggauggcgcguacuga

SEQ ID NO: 530235 - RNA, 64 nt, Human
gggugcuugugucugcugucucagaggccuuggucaggaugaaguuggcugacacagcuuagcu

SEQ ID NO: 530236 - RNA, 64 nt, Human
cucuucaacaucucaggcuguggcuggaacaggacaggaugaucuaaaacacacguaccauugg

SEQ ID NO: 530237 - RNA, 64 nt, Human
cucucagcccuacagaguagggaguugaugcugacaggaugaagauuuaggaauaaauaugccu

SEQ ID NO: 530238 - RNA, 64 nt, Human
uacaggagaacuguggcguguaggaggaauacuucaggaugagugaaggcuggagccagggagc

SEQ ID NO: 530239 - RNA, 64 nt, Human
caaaccuuuauaugcauguguuauguccauuuugcaggaugaacugaguuuaaaagaauuuuuu

SEQ ID NO: 530240 - RNA, 54 nt, Human; identical to SEQ ID NO: 66116

SEQ ID NO: 530241 - RNA, 64 nt, Human
guaugcuauuuucuuagaucuugguacauccagacaggaugaggguggagggagagcuauuuaa

SEQ ID NO: 530242 - RNA, 64 nt, Human
ucgccccauucccagcuccccccaacccuggccucaggaugagagcugucaccugagacaguga

SEQ ID NO: 530243 - RNA, 64 nt, Human
aggcaugagcaccugggcacagguuggggcucugcaggaugaggaagacaggccaaucccuucc

SEQ ID NO: 530244 - RNA, 64 nt, Human
uacuguuugauuuucuuguaucugguucuacucccaggaugaaauuauccaacuacauauauau

SEQ ID NO: 530245 - RNA, 64 nt, Human
agagauuugcaccaggugccuuguugccuccgcucaggaugaaagaggagcugagagaagugcu

SEQ ID NO: 530246 - RNA, 64 nt, Human
ucaauuaccaagaauucuccaaaacaauuuucugcaggaugauuguacagaaucauugcuuaug

SEQ ID NO: 530247 - RNA, 59 nt, Human; identical to SEQ ID NO: 66123

SEQ ID NO: 530248 - RNA, 64 nt, Human
uccacugcaaaaguggcugcuuuggaugccagcccaggaugaguaguuccuguucucagggagg

SEQ ID NO: 530249 - RNA, 64 nt, Human
ugcugcgucauauggagccuccugggacaagccucaggaugaaaaggacacagaaggccagaug

SEQ ID NO: 530250 - RNA, 64 nt, Human
cuccugggcuguggccguggagagacacugcccccaggaugacacaggcaagagccccugaggc

SEQ ID NO: 530251 - RNA, 64 nt, Human
ggguuuucagauaucagaaauccccuugggggagcaggaugagaccuuuggauagaacagaagc

SEQ ID NO: 530252 - RNA, 64 nt, Human
ucagucugugaguaaaacugggggcucaaaugcccaggaugaggggaucagugacugucuagga

SEQ ID NO: 530253 - RNA, 64 nt, Human
aggcugacaagcaauccagggacaagauacucaccaggaugaggaagaggacuuugggggacgg

SEQ ID NO: 530254 - RNA, 64 nt, Human
guguuccugugcaagggggagcuuugcuccaggacaggaugacugucuucccuauucuuaggga

SEQ ID NO: 530255 - RNA, 64 nt, Human
gucagacauuuuuuugacaguaugagacagacugcaggaugaaaauauuugucaaaaucuuaac

SEQ ID NO: 530256 - RNA, 64 nt, Human
gcggcaggugcucuguggaugagaggaaccaucgcaggaugacagcucccggguccccaaaccu

SEQ ID NO: 530257 - RNA, 64 nt, Human
cuucggccgauauuuaaacaugggcagcuuccuucaggaugaucaccgaggcucccgugacuuu

SEQ ID NO: 530258 - RNA, 64 nt, Human
ccccaguggcuccaggccucacuaguggcaagggcaggaugaggcugcaccgcugggaagaguc

SEQ ID NO: 530259 - RNA, 64 nt, Human
gggacccuucagcuauugcuuccugaaccgagggcaggaugaagauggugaggaagaagaggag

SEQ ID NO: 530260 - RNA, 64 nt, Human
uuccacugguagaaggccuuuaaugaucugggcccaggaugauuuccugcccuuuuaucauggg

SEQ ID NO: 530261 - RNA, 64 nt, Human
gcuaaugcaccauuagaagauauuagucuuggggcaggaugauuuuggccucauuacuuuacca

SEQ ID NO: 530262 - RNA, 64 nt, Human
guuaauacuguuuuucuucuaucuguaguuaguacaggaugaauuuaaauguguuuuuccugag

SEQ ID NO: 530263 - RNA, 64 nt, Human
gcauuuucuaguucauaugaaaauaaccauaguacaggaugauuucuguccacacaaagguuaa

SEQ ID NO: 530264 - RNA, 64 nt, Human
cgaaggccuagacucagcugaaggaucuucaaagcaggaugaagaccuagacuuaccugaaggc

SEQ ID NO: 530265 - RNA, 64 nt, Human
ugaaggccuagacucagcugaaggaucuucaaagcaggaugaagaccuagacuuaccugaagga

SEQ ID NO: 530266 - RNA, 64 nt, Human
ugaagaccuaggcuuaccugaaggaucuucaaagcaggaugaagaccuagacuuaccugaagga

SEQ ID NO: 530267 - RNA, 64 nt, Human
gcagucugcgcuuuccucucccgccugccuagcccaggaugaagggcuggguggccacaacugg

SEQ ID NO: 530268 - RNA, 64 nt, Human
ugggacucauccuugcccaggugagggaaggagacaggaugaggucucgacccuguccccuagg

SEQ ID NO: 530269 - RNA, 64 nt, Human
cugggacuuucccacccaggaaaggaggaccagucaggaugaggccccgccuuuucccccaccc

SEQ ID NO: 530270 - RNA, 64 nt, Human
ugaagaccuagacucaucugcagaaucuucaaagcaggaugaagaccuacaauuaccugaagga

SEQ ID NO: 530271 - RNA, 64 nt, Human
ucuuuauucuucaucccccgcuagagcuggaaggcaggaugaggagagguaugaaggagccuga

SEQ ID NO: 530272 - RNA, 64 nt, Human
uucuggccuuuguuugagagucagccagccugcucaggaugaaaaugaggcgccuggcuuuuag

SEQ ID NO: 530273 - RNA, 64 nt, Human
uuugcuuuuaaaacugauagguauuguuggaaagcaggaugaagccugagccaguggaaaagcu

SEQ ID NO: 530274 - RNA, 64 nt, Human
ucagcaccaaguaacaccacacacacgcagcacccaggaugaugguuucacuucagucuucccc

SEQ ID NO: 530275 - RNA, 64 nt, Human
gugcauuuuugucuaacgagagacaucaguuucucaggaugauccucaagaacguuauggaguc

SEQ ID NO: 530276 - RNA, 63 nt, Human
gcacacgagugcggcuggacgugccgacacgcggugauguacccaugcuccgugugucugugu

SEQ ID NO: 530277 - RNA, 63 nt, Human
cugacacagugaguuuucucugauguauuuaaggugauguauuugcuugaguuacuccuguau

SEQ ID NO: 530278 - RNA, 63 nt, Human
cguugaugaacucauugguuucacaagucauuugugauguacuguuuuugauuggccagucau

SEQ ID NO: 530279 - RNA, 63 nt, Human
uagcccuuaauuuaguuguguuaauuuuucaaggugauguaucaacagcuuuuuuuauuuugc

SEQ ID NO: 530280 - RNA, 63 nt, Human
cagugguucuugguccccuuuaccacaucuugggugauguauuuuugucuucuuccccuuugc

SEQ ID NO: 530281 - RNA, 63 nt, Human
aguuugaauuauuaaagguacagaggaaauguggugauguagaacuuuuccuaacacagguau

SEQ ID NO: 530282 - RNA, 63 nt, Human
cagggauauuuggguuacuuuuaagaaagcagugugauguaguggagagagcccaugggucuu

SEQ ID NO: 530283 - RNA, 63 nt, Human
uuauucuaaaguauauuaaugaaaccaguuccugugauguaacuguaagccuucucgacuuag

SEQ ID NO: 530284 - RNA, 63 nt, Human
guuaaucuaugcaaagagaaaggaaaggaugaggugauguauugacucaagguucauucuugc

SEQ ID NO: 530285 - RNA, 63 nt, Human
ucacagauuauauuuauaaccugacuagagcaggugauguauuuuuauacaguaaaaaaaaaa

SEQ ID NO: 530286 - RNA, 63 nt, Human
uuuauaagguaggcuguuccaguuaaguagugggugauguaguuacaaagauaauaugcucag

SEQ ID NO: 530287 - RNA, 63 nt, Human
gacuagggugaauuuuauguucuguacuguacugugauguagcuuucuucuguaacaguuaug

SEQ ID NO: 530288 - RNA, 63 nt, Human
ccacagccccucgggagcaccccaccucugugugugauguagcuuucucucccucagccugca

SEQ ID NO: 530289 - RNA, 63 nt, Human
caaauccugugacugggaucacucaacagcacugugauguauuauuuucaaugaggugccuuu

SEQ ID NO: 530290 - RNA, 63 nt, Human
cuccucuccugcugcuccugggauaccaggucagugauguagucuugcaguuuggcaacuucc

SEQ ID NO: 530291 - RNA, 63 nt, Human
ugaauuuuauggaaaccuguuuuauaguucuaugugauguaaaggucuagggagcaauaacca

SEQ ID NO: 530292 - RNA, 63 nt, Human
gccagaucacugccuaaucucgcuuugcugucugugauguagauggugguuccuauccugaga

SEQ ID NO: 530293 - RNA, 63 nt, Human
agcacaaugcauaaugucuuuaaaaagcauguugugauguacacauuuuguaauuaccuuuuu

SEQ ID NO: 530294 - RNA, 63 nt, Human
gucauuucaacagcaugaaugugguucuguacagugauguauguggagauuucuaaaauauuc

SEQ ID NO: 530295 - RNA, 63 nt, Human
caaauuuaagacccucucaaacuaacaggcuuagugauguaauuaugguuaguagagguacac

SEQ ID NO: 530296 - RNA, 63 nt, Human
cugauccauauggucaaaaaggacugaaaaauugugauguauuugauccuguaacaaaguugu

SEQ ID NO: 530297 - RNA, 63 nt, Human
aaaugucuaguuucuagugucacugaugaacuagugauguagaaaagagacuucucuguaagu

SEQ ID NO: 530298 - RNA, 63 nt, Human
gaauccuggaccaagcacaaaaacuuaacaaaagugauguaaaaaugaaaagccaaauaaaaa

SEQ ID NO: 530299 - RNA, 63 nt, Human
aacacuauucauccccaucuuaaguuuuacaaggugauguaaucagcuuguuguagugaugcu

SEQ ID NO: 530300 - RNA, 63 nt, Human
ccuuuaugccauugcagucuuguacuuuuuacugugauguacagaaauagucaacagauguuu

SEQ ID NO: 530301 - RNA, 63 nt, Human
aacucuucuauuuauuaaggaaaaugucacauugugauguauuaagccaguacuucaauuacg

SEQ ID NO: 530302 - RNA, 63 nt, Human
gaugucucacaaauuacuguguaccuaaguggugugauguaaauacuggaaacaaaaacagca

SEQ ID NO: 530303 - RNA, 63 nt, Human
aggccagagaugggccuccuucccuggggaggugugauguaguuaucacauucaggacccuug

SEQ ID NO: 530304 - RNA, 63 nt, Human
gagcgugcuguuuguggcuguugaugcauauucgugauguaacagguccuggggccucacuuu

SEQ ID NO: 530305 - RNA, 63 nt, Human
accaaagaacugucagcagcugccugcuuuucugugauguauguauccuguugacuuuuccag

SEQ ID NO: 530306 - RNA, 63 nt, Human
gugcauagauauaugcauuaaguguagcaaaucgugauguaaauuuuuuacugcuggucaugg

SEQ ID NO: 530307 - RNA, 63 nt, Human
aaaauuuuaugauaauaacaugauucaagaaaugugauguagauuuuugagaaugccaaaaau

SEQ ID NO: 530308 - RNA, 63 nt, Human
uguucaagaguaacagguuuaacucaugaccaagugauguacauccaagugauguauucugga

SEQ ID NO: 530309 - RNA, 63 nt, Human
gguuuaacucaugaccaagugauguacauccaagugauguauucuggaaacgauggaauuuua

SEQ ID NO: 530310 - RNA, 63 nt, Human
uccugcccuguauuuaggcuuugccugcuuggugugauguaagggaaauugaaagacuugccc

SEQ ID NO: 530311 - RNA, 63 nt, Human
accuacuuuauauaaaacaugacaaauugcagugugauguaaucaaaaacaaagaagcccuau

SEQ ID NO: 530312 - RNA, 63 nt, Human
uucauguaucgugggauacagguguuauuucaggugauguacuugcauuauuuucuuuagcca

SEQ ID NO: 530313 - RNA, 63 nt, Human
gucuugcuucuuugggauaucaaaauguauuuugugauguacuaaggauacugguccugaagu

SEQ ID NO: 530314 - RNA, 63 nt, Human
gauuaugaagaacauguguauuucuaucugguagugauguauauuuuacauuugucauuucag

SEQ ID NO: 530315 - RNA, 63 nt, Human
auaauguuccuuagugguagaggugugugccuagugauguagaaagauacacugacuuggugc

SEQ ID NO: 530316 - RNA, 63 nt, Human
gaaauaugguacucauuaaaaaaaaaaaaaaaagugauguacaaccacuucggaaaacaauuu

SEQ ID NO: 530317 - RNA, 63 nt, Human
acugguguuuauauuugcacaaaguauugauaugugauguauuaagucacaaaaguaagcugu

SEQ ID NO: 530318 - RNA, 63 nt, Human
aacaauuacugaaaagcugaaauuuaauggguggugauguagcccaaugagggcgaaugacau

SEQ ID NO: 530319 - RNA, 63 nt, Human
ugucaggaaacuuguauuauaaguuuauuaguugugauguaucaguaacugcuguuaccccuu

SEQ ID NO: 530320 - RNA, 63 nt, Human
cccucugacacaauaucccucacauacaagauggugauguaccacucccgagaauauucccau

SEQ ID NO: 530321 - RNA, 63 nt, Human
uugauccauuucgaguauauuuuuauauaugaugugauguagggguccagcuucauucuuuug

SEQ ID NO: 530322 - RNA, 63 nt, Human
ugacuacauuuuccaaaacuuaguggacucuaugugauguacuaaauguauacaccuuguaag

SEQ ID NO: 530323 - RNA, 63 nt, Human
agcuacuucacaccuuaaacuugcuuugauuuggugauguaaacuuuuaaacauugcagauca

SEQ ID NO: 530324 - RNA, 63 nt, Human
ggaauuuuuuuuuuuugauauauuagcaagucugugauguacuuucacuggcucuguuuguac

SEQ ID NO: 530325 - RNA, 63 nt, Human
cugauuuugcagcgaucacuuuuaaacccuguagugauguaagacuaaaauauaauugcuaag

SEQ ID NO: 530326 - RNA, 63 nt, Human
uauguucauuuggagagucagggcgaaagacaggugauguagcacuucuguuuuuaauaauua

SEQ ID NO: 530327 - RNA, 63 nt, Human
uccuccagaagcaaagagcaaaauuuuacuguugugauguaccaauucuaacuaauuguaauu

SEQ ID NO: 530328 - RNA, 63 nt, Human
gcagagcagaagauuuuaauaugcuuuuauuaagugauguaaaauaaaugcuuuuuggauuau

SEQ ID NO: 530329 - RNA, 63 nt, Human
uuugccucaguugauuuucuaagaauuucaggagugauguaugucuuaagagggagaaaaaaa

SEQ ID NO: 530330 - RNA, 63 nt, Human
cuugcccucucucagggucucauaaacuccccagugauguaaacguugcuauugaagguucuc

SEQ ID NO: 530331 - RNA, 63 nt, Human
aaaguuuaauauuuauguuugaaauuauuuauugugauguaauauuuuuguacguaaaaugau

SEQ ID NO: 530332 - RNA, 63 nt, Human
uuuccuuuuuguauuuucuuagcagagcuccuggugauguagaguauaaaacaguuguaacaa

SEQ ID NO: 530333 - RNA, 63 nt, Human
gccaacugcuuuuuauuuuuuuacuucaucaaggugauguaagugacucaccuuuaaaguuuu

SEQ ID NO: 530334 - RNA, 63 nt, Human
gugggggugggcuaaagccauaggaagaaaaaugugauguauguguccaguauguacuauuuu

SEQ ID NO: 530335 - RNA, 63 nt, Human
cugcaucaguucuugguuuugccuaucuacagugugauguauggacucaaucaaaaacauuaa

SEQ ID NO: 530336 - RNA, 63 nt, Human
cauuucugccuauuuauuucugcuuuguucucagugauguauaugcaacauuuuguugaaagc

SEQ ID NO: 530337 - RNA, 63 nt, Human
cuauagagucauguauuuauuuuugccuguugugugauguaaugcaaucauguuccuuugagu

SEQ ID NO: 530338 - RNA, 63 nt, Human
aucuucuuugucccaauuaaacaguugcuugcugugauguaaucuuaaaauaucuuuguaaga

SEQ ID NO: 530339 - RNA, 63 nt, Human
cuucauagaauacucagggaaagcauuuaaagggugauguacacauguauccuuucacacauu

SEQ ID NO: 530340 - RNA, 63 nt, Human
cugcauuccacaucucagucuaacaguuuaguagugauguaaagagaaguacaaaccgaacuc

SEQ ID NO: 530341 - RNA, 63 nt, Human
uucaaaagguggaggcauuguaaaaaggaaauagugauguaaauaaacauguucucuuucaag

SEQ ID NO: 530342 - RNA, 63 nt, Human
gaauuugaaaccagggcuuuuuuuuuuuuuugggugauguaaaaccaacucccugccaccaaa

SEQ ID NO: 530343 - RNA, 63 nt, Human
gaagacucggcuuuuaauguacuugucaccugagugauguacauuguacccaauagguaauuu

SEQ ID NO: 530344 - RNA, 63 nt, Human
caggaucuauggaaccaaauggaagguuuugaggugauguaggucuuucacagcuagcuuugg

SEQ ID NO: 530345 - RNA, 63 nt, Human
uauugaauuuauagcaucagcagaacagaaaaugugauguauuuuaugcaugucaauaaagga

SEQ ID NO: 530346 - RNA, 63 nt, Human
caaaaggaaccaggagguuuuuuugucaacauugugauguauauuccuuugaagauaguaacu

SEQ ID NO: 530347 - RNA, 63 nt, Human
ugggaacaggcaaauaaaguaucaguauacauggugauguacaucuguagcaaagcucuugga

SEQ ID NO: 530348 - RNA, 63 nt, Human
gcccucaagagcaaaguagaucaugcauagagugugauguauguguaauaaauauguuucaca

SEQ ID NO: 530349 - RNA, 63 nt, Human
auguuagacagcaagaaaugaauacuuuaaaaagugauguauguuggaguuauaaagaaauac

SEQ ID NO: 530350 - RNA, 63 nt, Human
uuaauguuugaaaaagcucuugcaaucaagucugugauguauuaauaaugccuuauauauugu

SEQ ID NO: 530351 - RNA, 63 nt, Human
cagggacuccaggggcagcugccauucguuccagugauguauuuggggccuucucaggugagg

SEQ ID NO: 530352 - RNA, 63 nt, Human
uaugucuccuacacaaagcuaaauauucuagcagugauguaaugaaaaauuacaucuuacugu

SEQ ID NO: 530353 - RNA, 63 nt, Human
ccccuuugcagugauugguuuaugcaugaauaugugauguauuuuuguccagugaaucuugaa

SEQ ID NO: 530354 - RNA, 63 nt, Human
gaacaugaauugcuggaacagcuacauaaaauagugauguagccaagucaugcuauuuaaauu

SEQ ID NO: 530355 - RNA, 63 nt, Human
uuaaaacauuggcuuuauuucauuuugugaugagugauguaucuguguuaacaaaaaauugua

SEQ ID NO: 530356 - RNA, 63 nt, Human
ugucaguuuguugucccuauuguagaugaaauagugauguagcaaaaaccuaguaaauucuga

SEQ ID NO: 530357 - RNA, 63 nt, Human
cagagagauacuaagcagcaaaaucuugguguugugauguacagaaauggagaagaguauuaa

SEQ ID NO: 530358 - RNA, 63 nt, Human
uauugggcagcagacuguguuucgugaacugcagugauguauacaucuuauagaugcaaagua

SEQ ID NO: 530359 - RNA, 63 nt, Human
aacauguuagaacuuaccaaaaugaaagcaacagugauguauugaaaucuuaguuuugauauu

SEQ ID NO: 530360 - RNA, 63 nt, Human
gugaagauuugcaagcaguguaaacugcaacuagugauguaaaugugcuauuaccuagguaac

SEQ ID NO: 530361 - RNA, 63 nt, Human
gauccauguuucugaggaaaaagacauucucaggugauguauuuuuuucaugcauuaguaugc

SEQ ID NO: 530362 - RNA, 63 nt, Human
caaaccaaauaaaaauauuguguugugaauguugugauguauucuagcuaauguaauaacugu

SEQ ID NO: 530363 - RNA, 63 nt, Human
uuuuuuaaauauuuuuuuuacugccuaugggcugugauguauauagaaguuguacauuaaaca

SEQ ID NO: 530364 - RNA, 63 nt, Human
aaacagccaccguuucuuccugccagcaggggugugauguaccaguuuguccaucuugagaug

SEQ ID NO: 530365 - RNA, 63 nt, Human
cauguuggaagcuccacauguccauggaaguuugugauguacggccgacccuacaggcaguua

SEQ ID NO: 530366 - RNA, 63 nt, Human
aauggaacaaguuguguuuguguuagcaugugggugauguaaacuucaaauugggagauguuc

SEQ ID NO: 530367 - RNA, 63 nt, Human
gacucaggaaaacuaggccccucuuuaaaccgugugauguauuugaaugucuguuauuuccag

SEQ ID NO: 530368 - RNA, 63 nt, Human
cucuggacaaugguauuauuuuuaaaaaucauggugauguauuuauuagaauguuucuuauaa

SEQ ID NO: 530369 - RNA, 63 nt, Human
uauuuuaugaguuuagaauauaguaaauaaaaggugauguaaaugaaugcugcacaaacggug

SEQ ID NO: 530370 - RNA, 63 nt, Human
ugaauguagauggcuaaacgauucuuacucagugugauguauaaugaugcaacagggacccuu

SEQ ID NO: 530371 - RNA, 63 nt, Human
uuaaggugcauuuucuuacucuagguuuauagagugauguaauucaacugaagaaaacacaca

SEQ ID NO: 530372 - RNA, 63 nt, Human
aaaguaaaguacaagcuguaaacuuggguuuuugugauguaggaaaugguuuccaucuguacu

SEQ ID NO: 530373 - RNA, 59 nt, Human
auugcuguucaaggaaguaagaggaggaggugauguagcacuuccaagauggcaccagc

SEQ ID NO: 530374 - RNA, 63 nt, Human
uauaugaaauguaauucuuauuuuauaaauaaugugauguaaauguaacuggugcccccuccc

SEQ ID NO: 530375 - RNA, 63 nt, Human
agagcaucccuaacacugagaaauccuauaaaugugauguaugugggaaaauuuuccaucaga

SEQ ID NO: 530376 - RNA, 63 nt, Human
aagaaguccucaccagacagaaagccuuugauugugauguaugggaaaagaacuccagucaga

SEQ ID NO: 530377 - RNA, 63 nt, Human
uugagggccugagaggcaaaugcaucccgccuugugauguaucagcuauuuguagauaaauaa

SEQ ID NO: 530378 - RNA, 63 nt, Human
ugccugugagcgcuggucuuuguguuugguuuugugauguaacgaucuuugcugggguuuuuu

SEQ ID NO: 530379 - RNA, 63 nt, Human
uuuuauuaccugaaugucagaccauuuuuucaugugauguaccuagugaguggaguuugcuuu

SEQ ID NO: 530380 - RNA, 63 nt, Human
uaaauucgguaaaaacacauuauuuuuucauaugugauguauucaugcagaacaacuaucuuu

SEQ ID NO: 530381 - RNA, 63 nt, Human
auuucucugcacacaagaggcuacguuuuggaagugauguauguuauuugaugacugaaaaug

SEQ ID NO: 530382 - RNA, 63 nt, Human
guucauuuauaaaaguaguuuccuguuccuagugugauguaucacaaauugugcugagguuau

SEQ ID NO: 530383 - RNA, 59 nt, Human
uauucccauuucuccucagauaacuucaagugauguacgaaaagguuuggaguucauuu

SEQ ID NO: 530384 - RNA, 63 nt, Human
guagcccuaacugucugagcaguaguggcugcugugauguaaacuuagggugcugagauaagc

SEQ ID NO: 530385 - RNA, 63 nt, Human
aaaacaaaaguuugcuuguuuaaaaugacaguugugauguaaaaaguuuaagaaauaugaaug

SEQ ID NO: 530386 - RNA, 63 nt, Human
ccagugccacuuuuaagaagugaaucacuauaugugauguaaaaguuauuacacuaaacagga

SEQ ID NO: 530387 - RNA, 63 nt, Human
auggauuuauauaugcacacaaacauauaauaugugauguaacauguagaugauaauaugauu

SEQ ID NO: 530388 - RNA, 63 nt, Human
agauugcucuacgaauuaauugacacauuaugugugauguacuuaaaggaauaauaaaugcau

SEQ ID NO: 530389 - RNA, 63 nt, Human
aaugcaguuuauuuuuagacccgauugcaaauagugauguaguuuuaaccaguauggauuagu

SEQ ID NO: 530390 - RNA, 63 nt, Human
cagaaaaggaaacucauucagacuggugauaucgugauguaccuaaaagucagaaaccacauu

SEQ ID NO: 530391 - RNA, 63 nt, Human
aacuugcaauuugcaaggauuacacauuucacugugauguauauuguguugcaaaaaaaaaaa

SEQ ID NO: 530392 - RNA, 63 nt, Human
guguuuuuccgacagugguuaauaauuauauuggugauguagcagcaauuguguuggcagggu

SEQ ID NO: 530393 - RNA, 63 nt, Human
uuaauuuuguguuuaaguuaauaaaauuuauuugugauguacuguaagcucccugacugucgg

SEQ ID NO: 530394 - RNA, 63 nt, Human
cagaacuaacuuuggucucagcgggagccaguggugauguaaaaaugcuuccacugcaagucu

SEQ ID NO: 530395 - RNA, 63 nt, Human
aaguggaaugaggagcuuugacauucaaauuaugugauguaauuuaucuuccuuaggaauuuu

SEQ ID NO: 530396 - RNA, 63 nt, Human
uguacauucuuauuuuauuuucacaauagcucugugauguaagugcuaucuccaugagaaaau

SEQ ID NO: 530397 - RNA, 63 nt, Human
aaaagaggaaaaaaagccguuuucaugagcugagugauguagcguaacaaacaaaaucaugga

SEQ ID NO: 530398 - RNA, 63 nt, Human
ggcagggucuguuuggacugcagaagcaagggggugauguagcccauccuucccuuuggagau

SEQ ID NO: 530399 - RNA, 63 nt, Human
uaaacugaugacuuuuauauguacacugaccaugugauguacauuuauuaugucuuuuuuuaa

SEQ ID NO: 530400 - RNA, 63 nt, Human
agcuaauguuuuguacauuuuuuguaugaggaagugauguagcuugcccugauuuuuuuuuuu

SEQ ID NO: 530401 - RNA, 63 nt, Human
augauuuuuguagcuuuuuguaaauuauuuaaagugauguaaaagauauuuuuggaaaauacu

SEQ ID NO: 530402 - RNA, 63 nt, Human
cccagcaaguggauucugggcaagccuguuccggugauguagacaauaauuaacacagaggac

SEQ ID NO: 530403 - RNA, 63 nt, Human
uaaucacuucuguguuauaauggaagguuuuuugugauguaugaaacuuguguuuuuuauaua

SEQ ID NO: 530404 - RNA, 63 nt, Human
uuuuuuuaaguucucaucauuauuacauagacugugauguaucuuuacuggaaaugagcccaa

SEQ ID NO: 530405 - RNA, 63 nt, Human
ugacgugccgggguugagcuggcaccccgggaugugauguaagaacgcccugcgcgucagccu

SEQ ID NO: 530406 - RNA, 63 nt, Human
cauucucaugacuuggggcugucgagauuuaaagugauguaagcugugguuauguggauucuc

SEQ ID NO: 530407 - RNA, 63 nt, Human
agccuuuuuacgguucaggauaaaucagccuuugugauguacuguguuuaccuccuuuugugu

SEQ ID NO: 530408 - RNA, 63 nt, Human
aaucagaguaaaugcauuucuggaguuguuucugugauguaaauuaugaucauuauuuaagaa

SEQ ID NO: 530409 - RNA, 63 nt, Human
gagagguuuaauccuaugugguagucuauauaagugauguaugaguugaguuauguaaauuuu

SEQ ID NO: 530410 - RNA, 63 nt, Human
ggacuuggaccuuuccugagauuuauuuuauccgugauguauuuuuuuuaauucuuuugauac

SEQ ID NO: 530411 - RNA, 63 nt, Human
auguaacauguaggaaguaggaaguaaauuauagugauguaaucuugaauuguaacuguucuu

SEQ ID NO: 530412 - RNA, 63 nt, Human
gcaauuguguuggaaguguccuuggugccuugugugauguagacaauguuacaaggucugcau

SEQ ID NO: 530413 - RNA, 63 nt, Human
uggauuugcauuuguggcacugucuuugaugcagugauguacuuaauggugcaauaaagcugc

SEQ ID NO: 530414 - RNA, 63 nt, Human
uucauugugauugcacaaaaauuuuaaaaacacgugauguaaacuugcaagcauaucaaccag

SEQ ID NO: 530415 - RNA, 63 nt, Human
aaaaaaaaaauacccuuugcuuugugccucaaagugauguaaugugaucacagcuuuuguugu

SEQ ID NO: 530416 - RNA, 63 nt, Human
uucuguacuucucaguuaagacuuguucuuugagugauguauuaaaugcugcuagaaaagccu

SEQ ID NO: 530417 - RNA, 63 nt, Human
cgccuuccgauuccauucauggcauuuugugaugugauguaauuggaauagagcuguugauuu

SEQ ID NO: 530418 - RNA, 63 nt, Human
uugguuaaaguagaggguuucuugauuagcuuugugauguaaauccuuaaggaguuauacaag

SEQ ID NO: 530419 - RNA, 63 nt, Human
ucccuuaaacauuuugcacaaagaaaaugcugugugauguauaauguuguauuuuuaaauagg

SEQ ID NO: 530420 - RNA, 63 nt, Human
ggaagagaagcagcccugauucuaccacuuaaggugauguaugaucuuaggcuggacacuucu

SEQ ID NO: 530421 - RNA, 63 nt, Human
cuucuuaauugcugaaccuuacugcaaaaacuugugauguaagaaauuuguaugguguggcag

SEQ ID NO: 530422 - RNA, 63 nt, Human
cugguuuagcagcugaggugacugcagucugaugugauguaacuguuucccuuugauucucca

SEQ ID NO: 530423 - RNA, 63 nt, Human
gguuauguuguuauucucggacugugaauuuuggugauguaaaacagaauauucuguaaaccu

SEQ ID NO: 530424 - RNA, 63 nt, Human
auguaccuugaagggcuguugucagaauucuacgugauguaagucaagcaccuagcacagauc

SEQ ID NO: 530425 - RNA, 63 nt, Human
acauugccauuuguuuuuugccuuugauaaacugugauguacuguucugagaucuuuugggug

SEQ ID NO: 530426 - RNA, 63 nt, Human
ucaacaaaaccugaugcaaaaaacagaaaaggggugauguaggagauggucagguugguagga

SEQ ID NO: 530427 - RNA, 63 nt, Human
ucaagccccagugcugccugcuugguggcgggggugauguauguggagaaggguugggggaga

SEQ ID NO: 530428 - RNA, 63 nt, Human
ccaaauuaccggaagaguguaugaagauugaaugugauguauucacguaacaugcuugaaacu

SEQ ID NO: 530429 - RNA, 63 nt, Human
uauuaacauuuuggaauauguuuuauuaguuuugugauguacuguuuuacaauuuuuaccauu

SEQ ID NO: 530430 - RNA, 63 nt, Human
guaaaaggcaugugauuuuugagauuuuauuuugugauguauugucuucugcaguauuaaagg

SEQ ID NO: 530431 - RNA, 63 nt, Human
gacaauuagcacuaaucuggcacuuuauaaauugugauguagccucgcuagucaagcugugaa

SEQ ID NO: 530432 - RNA, 63 nt, Human
gguggcuagucagagagaguguuuggggguuccgugauguaggguaaggugccuucuuauucu

SEQ ID NO: 530433 - RNA, 63 nt, Human
cugaucuucucuugcagugucccugaauggcaagugauguaccuucugaugcagucugcauuc

SEQ ID NO: 530434 - RNA, 63 nt, Human
aaugacauuuuagaaauauuacaauuaaaaauagugauguagcuguaacauaugcuggaauug

SEQ ID NO: 530435 - RNA, 63 nt, Human
accacauuucuuugccacugaucucaauggccagugauguaagucuuuugccugucuucuuga

SEQ ID NO: 530436 - RNA, 63 nt, Human
uugaaaauuugauacauuuuacagaaacuaauugugauguacauaucaguggugacauauuau

SEQ ID NO: 530437 - RNA, 63 nt, Human
cuuauucacucuguaaauacauuuaaaguuuuugugauguaagcuuaauugauauucuguuca

SEQ ID NO: 530438 - RNA, 63 nt, Human
agauggagggcaugggauaggacaggagaggaggugauguacacuuagagguaacuaaggcua

SEQ ID NO: 530439 - RNA, 63 nt, Human
auucaacguuucaggcccugguugggcaggaaagugauguauaguuauggacacuuugcguuu

SEQ ID NO: 530440 - RNA, 63 nt, Human
aucuucaaugaagacuuggcccaaacaccaccugugauguauauuguucuaauguaaaauugu

SEQ ID NO: 530441 - RNA, 63 nt, Human
uuugcaaguagcuuuccagaaguaaaagucccagugauguauucccauagaaauauuuuucag

SEQ ID NO: 530442 - RNA, 63 nt, Human
cuccucccagcacaggcaccuauguggcauguggugauguacgcugcgugccaugaguccaug

SEQ ID NO: 530443 - RNA, 63 nt, Human
uucugucucuguuuugauucuccaaacugcucugugauguauguagggauuauucuccccacu

SEQ ID NO: 530444 - RNA, 63 nt, Human
aaugagcucacccuuuaacacaaaaaaagcaaggugauguauuuuaaaaaaggaaguggaaau

SEQ ID NO: 530445 - RNA, 63 nt, Human
uccguugcuaaauuaagaaaugcuauguguacugugauguaaaaauaagacauuaacuuuauc

SEQ ID NO: 530446 - RNA, 63 nt, Human
uauuuaucgcaacaugaauuuuuaugauuucuugugauguauucuuuuaugaaauuaacaaga

SEQ ID NO: 530447 - RNA, 63 nt, Human
guagcacucguuuuacauaugcuuauaaaagaagugauguaucaguaauguaucaauaauccc

SEQ ID NO: 530448 - RNA, 63 nt, Human
uucuuuugugcauauagccauucuuaaauaucagugauguaaaccucacuuuauuaaaaaauu

SEQ ID NO: 530449 - RNA, 63 nt, Human
cuuuaugaaguaucagucagauuuuaugauuaagugauguaauauaggaauuauguaaaaggg

SEQ ID NO: 530450 - RNA, 63 nt, Human
uuucacagaauuuuaaaauagaguuaaagggaagugauguacauuucgggggcauuaggguag

SEQ ID NO: 530451 - RNA, 63 nt, Human
cauggcagcaugcgaugucauauuuuccuuuaugugauguaacuacuuucuguuaucuagaaa

SEQ ID NO: 530452 - RNA, 63 nt, Human
agaugaaacaugacagucugaguaaaauacccagugauguagaagugugccuguuuauuaugu

SEQ ID NO: 530453 - RNA, 63 nt, Human
gcgggcuauugugcugccuuuaauaaaauuugagugauguauacauaacauuguuuuugcugg

SEQ ID NO: 530454 - RNA, 63 nt, Human
uguauaguaacuaauggcaaaaauucauggcuagugauguauaaaauaaaauauucuuugcag

SEQ ID NO: 530455 - RNA, 63 nt, Human
aacaagaaaaaaggaauuccuugaaacgcccacgugauguagaucauagguaguuacucauuu

SEQ ID NO: 530456 - RNA, 63 nt, Human
aaaaaagaauggacuguaaccaguugcuguaacgugauguaaaaacguuacuguaaacagcau

SEQ ID NO: 530457 - RNA, 63 nt, Human
ucagccuuaaguuuaggcguuuguuguucuccagugauguagacaguucccuucacaagucac

SEQ ID NO: 530458 - RNA, 63 nt, Human
ccggcuucuccccaccacccugccaccuccacugugauguauguccgcucccucgucuguucc

SEQ ID NO: 530459 - RNA, 63 nt, Human
uuucacacagcuauaaagaaugccugagacugggugauguauaaagaaaagaaguuuaacuga

SEQ ID NO: 530460 - RNA, 63 nt, Human
agguuuaaggucaccugcacucccagccaaguggugauguaugccucccacucucugcaaggu

SEQ ID NO: 530461 - RNA, 63 nt, Human
guuuucaaaucaauuucuaauucuggugauugugugauguaaagaggugcuaugauggucaug

SEQ ID NO: 530462 - RNA, 63 nt, Human
caaucugaggugauguggugacugaagccagaggugauguacuuucaccauuagcuuaauuuu

SEQ ID NO: 530463 - RNA, 63 nt, Human
gguccaaaggacaaaucuaaaaugcaaagaacggugauguaguauggccugacagcucuguuu

SEQ ID NO: 530464 - RNA, 63 nt, Human
cgcugccagucuucgcucuaacucccucgguaggugauguaggaccaggggcacguggaacuu

SEQ ID NO: 530465 - RNA, 55 nt, Human
uuggcacauuucuuuucugacuacagugauguaaguagauagcaaaauacuggau

SEQ ID NO: 530466 - RNA, 63 nt, Human
agcuguauauuugaaacugcuaauuacacacgugugauguauguugguuuuuuagugcaauuu

SEQ ID NO: 530467 - RNA, 63 nt, Human
uuuuuaaaguaaauuauuaagcagacuggaaaagugauguauuuucauagugaccuguguuuc

SEQ ID NO: 530468 - RNA, 63 nt, Human
ugcuggccaggcucauguguagugugcgagauggugauguacucuuauauuuuucugggcuuu

SEQ ID NO: 530469 - RNA, 63 nt, Human
aagcugugggaagcguucuuggaagcauggggagugauguacauccaaccgucacugucccca

SEQ ID NO: 530470 - RNA, 63 nt, Human
guugaaugcuuaccaaguccugggaauaugcuagugauguacgagcugcgcguccugcccucu

SEQ ID NO: 530471 - RNA, 63 nt, Human
cugcauaguugaagauuuauggacagaaggaaagugauguauggaaaauggaagugagauaca

SEQ ID NO: 530472 - RNA, 63 nt, Human
uuccuaaccugggauuucuagacacauccugcugugauguaaacagaaaucacgaauucgcuc

SEQ ID NO: 530473 - RNA, 63 nt, Human
ucacuaaagcaguagaaauaauaugcauugucagugauguaccaugaaacaaagcugcaggcu

SEQ ID NO: 530474 - RNA, 63 nt, Human
uaauaaucaugaccacaaaccauaaaggacugugugauguaucaguaagagggugcucagaag

SEQ ID NO: 530475 - RNA, 63 nt, Human
gugggaggcccgccucaggucagggcccagcgugugauguaggggccggggcaggccaggguu

SEQ ID NO: 530476 - RNA, 63 nt, Human
cuggggggugggcguggauuuagggagggggcugugauguaaaacgucuccccugccaaagga

SEQ ID NO: 530477 - RNA, 63 nt, Human
gcaucauuccuuccuuacccccuuucuagcugugugauguagaccaaagucguugccccuccc

SEQ ID NO: 530478 - RNA, 63 nt, Human
cucucacagucugugucagucggggauuugggagugauguaucugggugguuguggcccagag

SEQ ID NO: 530479 - RNA, 63 nt, Human
uauguguguauauagugugugauguauaugugugugauguauacuauauaugcccacacaugc

SEQ ID NO: 530480 - RNA, 63 nt, Human
auaucacauauacuauauguguguauauagugugugauguauaugugugugauguauacuaua

SEQ ID NO: 530481 - RNA, 63 nt, Human
uguauauacacauauaguguauauaguguaugugugauguauacuauacauaucacauauacu

SEQ ID NO: 530482 - RNA, 63 nt, Human
agccagaaaaaguuggugccccugaacccaagagugauguacagucuauuccauagaaucaca

SEQ ID NO: 530483 - RNA, 63 nt, Human
cucaccucaugcuucuuauuuggggagagggcugugauguaaagggguugaccucagaggccu

SEQ ID NO: 530484 - RNA, 63 nt, Human
agacgguuccccacagcauccucagacagcucugugauguagcuuuuaggaggcacucaggug

SEQ ID NO: 530485 - RNA, 63 nt, Human
ugggcugccugcuguguuaagaggacuuaguuugugauguaaggcacugucaggaaugggggg

SEQ ID NO: 530486 - RNA, 63 nt, Human
ugugaacuaacuauauuuuagccauaacuguuugugauguacacaauguuaagggauuuauau

SEQ ID NO: 530487 - RNA, 63 nt, Human
aggcacccuacccgacgcagcugugaauggccggugauguaugucaggaggccacagggagca

SEQ ID NO: 530488 - RNA, 63 nt, Human
caggguuuugguauguuuauauuguuuaccuuagugauguauuuguuuaaguggcuaacaucc

SEQ ID NO: 530489 - RNA, 63 nt, Human
acacugcccuggcucagcgugcgagcuaagguggugauguaugcgaugggacucugcauggga

SEQ ID NO: 530490 - RNA, 63 nt, Human
guuacaugaagauguuaaaaucgguuuuuaaaggugauguaaauagugauuuccuuaaugaaa

SEQ ID NO: 530491 - RNA, 63 nt, Human
uuccugggucuccacucuccgucuggccuaaaggugauguauuugguguuuggcccugcaguc

SEQ ID NO: 530492 - RNA, 63 nt, Human
aggcugcgggugugcaggcgucugcuaaguugugugauguaucagcacaggcuuugagacguc

SEQ ID NO: 530493 - RNA, 63 nt, Human
uagaaacuuuggauacauuuuuguaugguaccugugauguauauagaauuaguacuuuauuuu

SEQ ID NO: 530494 - RNA, 63 nt, Human
ugauagucuuuaagccauuccagucaugaugaggugauguaugaauacaugcauacauucaaa

SEQ ID NO: 530495 - RNA, 63 nt, Human
gguauagguugacacagcacacaaguggcuauugugauguaugauguauguaguccuacaacu

SEQ ID NO: 530496 - RNA, 63 nt, Human
uccuucagugaauacaaaauguugauaucauaggugauguacaauuuaguuuugaaugaguua

SEQ ID NO: 530497 - RNA, 63 nt, Human
uuccaagguauuauguuacucuaacucugaaaagugauguaaucugguagcaauguaguaguu

SEQ ID NO: 530498 - RNA, 63 nt, Human
agagcagaaaagugcuaaucauuuagccacuuagugauguaagcaagaagcauaggagauaaa

SEQ ID NO: 530499 - RNA, 63 nt, Human
aagucauuauggcagaugcacagaaauugugcagugauguaaauguucauacuuuacagagcc

SEQ ID NO: 530500 - RNA, 63 nt, Human
ccucuauaaggccaacaaagaaaacaaauuaaugugauguaacuugcauuuaugugcacucug

SEQ ID NO: 530501 - RNA, 63 nt, Human
uucucuuuagccuuccaacauuucuuguugauagugauguauuuuauuauuuucuuuuucuua

SEQ ID NO: 530502 - RNA, 63 nt, Human
acguaguguucuuugcauuucugucccauaugggugauguagagauuuaccuguuuuucagua

SEQ ID NO: 530503 - RNA, 63 nt, Human
gggaaggaggcaaaagccccugcuucuuacuuugugauguaugugcauuuguuauuuauuuuu

SEQ ID NO: 530504 - RNA, 63 nt, Human
gguauagguugacacagcacacaaguggcuauugugauguaugauguauguagucccacaacu

SEQ ID NO: 530505 - RNA, 63 nt, Human
agaagucauuauggcagaugcacaaauugugcagugauguaaauauacauacuucacagagcc

SEQ ID NO: 530506 - RNA, 63 nt, Human
acuagucuuucaggagguuugcucuuagaacuggugauguaaagaauggaaguagcuguauga

SEQ ID NO: 530507 - RNA, 63 nt, Human; identical to SEQ ID NO: 530506

SEQ ID NO: 530508 - RNA, 64 nt, Human
ccagcgucuacgacggcaaguaccugccugcggccaacaugauggcugggcugagcagccugag

SEQ ID NO: 530509 - RNA, 64 nt, Human
ugguccucauucaaagggacggucaguuuggugucaacaugaaacaccaagaugucugucucug

SEQ ID NO: 530510 - RNA, 64 nt, Human
aaaaaauaacuuguuaucaauaaaaacuugcauccaacaugaauuuccagccgaugauaaucca

SEQ ID NO: 530511 - RNA, 64 nt, Human
gcuggcccaccaccccugggugcucaguuucuaccaacaugagccagcaaguccuugugguagc

SEQ ID NO: 530512 - RNA, 64 nt, Human
uggcaagaauauccuaaaugucauuaaaauccuccaacaugauggaucuacuuauggucuuguu

SEQ ID NO: 530513 - RNA, 64 nt, Human
uuuuucuguauauagaaaggaaaacuagccugggcaacaugaugaaaccccaucuccacugcaa

SEQ ID NO: 530514 - RNA, 64 nt, Human
uacuuaaaaugccugggauaguucuugggacuaacaacaugaucuucuuugaguuaaaccuacc

SEQ ID NO: 530515 - RNA, 64 nt, Human
uugcucagggagacuuccgcccuccucacugaggcaacaugaagcccgaggcccagaugggggc

SEQ ID NO: 530516 - RNA, 64 nt, Human
aaggggcggcuuuugaaaaccuggaccucuaugucaacaugacagggugaaacuauucccccua

SEQ ID NO: 530517 - RNA, 64 nt, Human
aggaugugguuuccagcuuugccugagggaauuccaacaugagauuaugggcuggcuccauuuc

SEQ ID NO: 530518 - RNA, 64 nt, Human
caauuagucaaaccacuguuauuaacagauguagcaacaugagaaacgcuuauguuacagguua

SEQ ID NO: 530519 - RNA, 64 nt, Human
ucacuuggugccaggaguucuagaccagccuggccaacaugacccaucuuuacuaaaaauacaa

SEQ ID NO: 530520 - RNA, 64 nt, Human
ugaauauaggaaaaaugcauuuuugaaacguuugcaacaugaucaagguguuaguucuccacca

SEQ ID NO: 530521 - RNA, 64 nt, Human
ucaccugaggucaggaguuuuagaccagccuggccaacaugacgaaacccggucucuacuaaaa

SEQ ID NO: 530522 - RNA, 64 nt, Human
gggugacaggccagggggaaaaauuauccccggacaacaugaaacaggugaggucaggucacug

SEQ ID NO: 530523 - RNA, 64 nt, Human
ccugguucuguauugaggagaaggauguauaaagcaacaugaaacauuagcccuccuuuuauuu

SEQ ID NO: 530524 - RNA, 64 nt, Human
ucuguugaugacgugugugcaaagcaggcucuagcaacaugaucacuguccuugccuuccuggu

SEQ ID NO: 530525 - RNA, 64 nt, Human
acuuuuuaaaagguaaaaaaauaaaauaaaauuacaacaugaagauucagauuuuuuuucuuuu

SEQ ID NO: 530526 - RNA, 64 nt, Human
aaauuugccuguccagcucccucuccccaagaaacaacaugaaugagcaacuucagagugucaa

SEQ ID NO: 530527 - RNA, 64 nt, Human
gaucacgaggucaagagaucgagaccauccuggccaacaugaugaaaccccguuucuacuaaaa

SEQ ID NO: 530528 - RNA, 64 nt, Human
caugcuaaaaaccuguauuuucaugcuuuucaaacaacaugaauagucagcugacuaaagacug

SEQ ID NO: 530529 - RNA, 64 nt, Human
cucccucugucagaucucugucccuuccucugaacaacaugaucuuugagagggaacaagaugc

SEQ ID NO: 530530 - RNA, 64 nt, Human
ugugaagauaaucauuuggacaacucaaauccaucaacaugaccaauguuuuucaucugccaca

SEQ ID NO: 530531 - RNA, 64 nt, Human
uccuucuaaucaacauaauuagggcagcuuaccccaacaugaaaaugaugaccuggccauuuuu

SEQ ID NO: 530532 - RNA, 64 nt, Human
gaaauucaagauucaaaaagaauuuuaaauacaccaacaugagacaucaguagucaguugguuu

SEQ ID NO: 530533 - RNA, 64 nt, Human
ggcaccuucugccaccccagcagaagccuucauacaacaugacgaaacaagggaucauguugaa

SEQ ID NO: 530534 - RNA, 64 nt, Human
gucaguucggaaggcugguuagaacaugugggagcaacaugaauguucuacaaaaguuuaaagc

SEQ ID NO: 530535 - RNA, 64 nt, Human
ggcugauuauauuguaaugauguuagauaauacucaacaugauucaguaugacaaacuuuuuug

SEQ ID NO: 530536 - RNA, 64 nt, Human
auaauuuuuaaaagaaaagaacgauaaaugaagccaacaugauuuucucauuucgggaggaacu

SEQ ID NO: 530537 - RNA, 64 nt, Human
cguagacugaaauaagucacuauugaaauggcaucaacaugaugcugcccauuccacugaaguu

SEQ ID NO: 530538 - RNA, 64 nt, Human
cacacacacacacacacacaccccugauccuugccaacaugauuccuaaagggagaugugacug

SEQ ID NO: 530539 - RNA, 64 nt, Human
ucaccugaggucaggaguucaagaccagccuggccaacaugacgaaaccccaucucuacuaaaa

SEQ ID NO: 530540 - RNA, 64 nt, Human
aggaagaaaucuuaauacuuccuuccuuaacauacaacaugagucccgagaauaauugauagua

SEQ ID NO: 530541 - RNA, 64 nt, Human
cugguaaagugcaacgugccaugugcaugcugagcaacaugacagccaucacuauggccugggc

SEQ ID NO: 530542 - RNA, 64 nt, Human
caugaaccuggguggcuuaugagagaguagagaacaacaugacccuggauggcuacuaagagga

SEQ ID NO: 530543 - RNA, 64 nt, Human
aguuccauuuacagcucuguuuuuuacguaguuacaacaugaugugauuguagcuuuuuaaacu

SEQ ID NO: 530544 - RNA, 64 nt, Human
aagaaauauuucuaggagcacuaccaucuguuuucaacaugaaaugccacacacauagaacucc

SEQ ID NO: 530545 - RNA, 64 nt, Human
aacucaguguagcacuuuaaagucugaaggacagcaacaugaaaagagcauaucaauguggugg

SEQ ID NO: 530546 - RNA, 64 nt, Human
auggaaguauuuuucucugugaagccacauuuuccaacaugagccucaugaagccaacuaagug

SEQ ID NO: 530547 - RNA, 64 nt, Human
auaauaauaaaacaacucauguuagagacccuuucaacaugaaagguuuguaguugagacauua

SEQ ID NO: 530548 - RNA, 64 nt, Human
ccuuuaaaacaaaaagccaucguagguaucaagucaacaugaaauuggaaugcaaaauuaauac

SEQ ID NO: 530549 - RNA, 64 nt, Human
auuuacaaacaccuuuacuuuugcacuuuuaauucaacaugaguaucauaugguaucucucuag

SEQ ID NO: 530550 - RNA, 64 nt, Human
uuuuauaacauuuuccaaauauuagaaauaccaucaacaugaucaguauucuugccuuuucaug

SEQ ID NO: 530551 - RNA, 64 nt, Human
cauccccccacuuagagcuaugugcucaaaaagccaacaugaaugcagugguaaaaauuuguua

SEQ ID NO: 530552 - RNA, 64 nt, Human
ucauauuuaaacagaaguauacguuuuucaguuucaacaugaauuuuuuuauuucugucaguua

SEQ ID NO: 530553 - RNA, 64 nt, Human
accaccuguaauuccucuuuggauuguguagacucaacaugagacauuccuuucugcuuucugg

SEQ ID NO: 530554 - RNA, 64 nt, Human
aaucuuuuggguucacguggaaaccaggacuuggcaacaugauguuugacuguaaucucaucac

SEQ ID NO: 530555 - RNA, 64 nt, Human
ggaccaugaaacaguaaacuguaacuaaacacuucaacaugaauuugaaaauaaauaauugugg

SEQ ID NO: 530556 - RNA, 64 nt, Human
aucacuggcucaacuuuagggcacuguccagagucaacaugaugugguuuagcagugaucacau

SEQ ID NO: 530557 - RNA, 64 nt, Human
gaacucuucuuuaaguuuuuugaaccuguuuccccaacaugaagucucuuuaugguuagagaag

SEQ ID NO: 530558 - RNA, 64 nt, Human
auuagguuauuaucugucaaaccuuuuaaguugacaacaugacucauauauauacauguguaua

SEQ ID NO: 530559 - RNA, 64 nt, Human
uuaggcuucaccuccaacacugaggaucaaauuucaacaugagauuuggaggaggucaaacaaa

SEQ ID NO: 530560 - RNA, 64 nt, Human
gguacgcccaggcuccugcugcccuagaggucugcaacaugagugaagagguuaauuagaggga

SEQ ID NO: 530561 - RNA, 64 nt, Human
cuuaauuugugauaucauguucuagaaauaccugcaacaugacagucuaaucaguagucuauua

SEQ ID NO: 530562 - RNA, 64 nt, Human
gggcggaaggaaguggagcuggagcaguaacugccaacaugaagcuggaggguuugggauuuuu

SEQ ID NO: 530563 - RNA, 64 nt, Human
gaucacgaggucaagagaucgagaccauccuggccaacaugaugaaacuccgucucuacuaaaa

SEQ ID NO: 530564 - RNA, 64 nt, Human
uuaguugaccuuuuuccuuugguuuucaaauguucaacaugaaucagaauaguguaacaccaaa

SEQ ID NO: 530565 - RNA, 60 nt, Human
cuacaaaggcuucagaguagauaucucugccaacaugaggacagaaggacuggugcgacc

SEQ ID NO: 530566 - RNA, 64 nt, Human
gcagugcaaagaaggaaggcuccaaacggaaaaucaacaugaguggcuacauccuguucagcag

SEQ ID NO: 530567 - RNA, 64 nt, Human
ggaaugugguuuucacuucuucgucagauaagaccaacaugaagggguauguugagaaacaucc

SEQ ID NO: 530568 - RNA, 64 nt, Human
ugaccugcguuuucugcagaugcugcugcugucacaacaugaacugcugacacaguccuuuacc

SEQ ID NO: 530569 - RNA, 64 nt, Human
uagcauccuuaucugaaagaaauaaccaucuucucaacaugaccugcuuaacccaaauaagaac

SEQ ID NO: 530570 - RNA, 64 nt, Human
ccacagaggagaggccacuucccaccaggacccccaacaugaagucuaggccucaggggcuccc

SEQ ID NO: 530571 - RNA, 64 nt, Human
ucacuccuaacuugcugggugaucauacauacaucaacaugaaggugugacaucagaaucauga

SEQ ID NO: 530572 - RNA, 64 nt, Human
ucacuugagguccggaguuccagacaagccuggccaacaugaugaagcccugucucuacuaaaa

SEQ ID NO: 530573 - RNA, 64 nt, Human
acaaggcguggcucauggccugcauuccagagaccaacaugauagcuuuuaauucagcugcaug

SEQ ID NO: 530574 - RNA, 64 nt, Human
gagauuuauuucauuuugcucccaaaggcacugacaacaugaguccuugugauuaggcccaccu

SEQ ID NO: 530575 - RNA, 64 nt, Human
aauuuucacuuuuguaguuuaauccuuuguauuacaacaugaaauauaguugcauauauggaca

SEQ ID NO: 530576 - RNA, 64 nt, Human
ugagcguuucugacagcucccagcugggagaaaccaacaugacgaaaagacaaagaauacugga

SEQ ID NO: 530577 - RNA, 64 nt, Human
ugggagggacuuugcugauuuccccucuucccuucaacaugaaaauauauacccccccaugcag

SEQ ID NO: 530578 - RNA, 64 nt, Human
ugcagaacuaccaccuuucuuuuagcaccaaucccaacaugaaauuauauuacucagauuuaaa

SEQ ID NO: 530579 - RNA, 64 nt, Human
cuugucaauuuuaagguggaaauaggaaggaccacaacaugacccguaagucaagaagguagac

SEQ ID NO: 530580 - RNA, 64 nt, Human
ucacagcuuuguguauaauugcaaaaguugaaaucaacaugaaugcccaaaauagugaauuauu

SEQ ID NO: 530581 - RNA, 64 nt, Human
ucacuugaggucaggaguucaacaucagccuggccaacaugaugaaaccuugucuuuacuaaaa

SEQ ID NO: 530582 - RNA, 64 nt, Human
gaagaucuaucagcuggcuuuuaaagaccuaugacaacaugaaagugguguucagccuggaaug

SEQ ID NO: 530583 - RNA, 64 nt, Human
aauuggccuugaaucaggucagaguguuaacugucaacaugaaguauuuucacuucgcagcauc

SEQ ID NO: 530584 - RNA, 64 nt, Human
aucucacuuuaauaauaaaaaucaugcuuauaagcaacaugaauuaagaacugacacaaaggac

SEQ ID NO: 530585 - RNA, 64 nt, Human
aacauaugcauuuuaagccuucaaauuacauuaucaacaugagagaaaucaccaacaaagaaga

SEQ ID NO: 530586 - RNA, 64 nt, Human
cuucaguggcacaaaccaacccguugagcccugacaacaugaguggagagugcauuugccauac

SEQ ID NO: 530587 - RNA, 64 nt, Human
aauuacaaaaugagucccggaaggucaguaagugcaacaugaaaaaaaucuaugaaaagauuau

SEQ ID NO: 530588 - RNA, 64 nt, Human
ugcuuugaccacucuuccugaguucaguggcacucaacaugagucaagagcauccugcuucuac

SEQ ID NO: 530589 - RNA, 64 nt, Human
auuggcagauaaaauuuuauguauuuaccacguacaacaugaaauuuugaaacauguauacauu

SEQ ID NO: 530590 - RNA, 64 nt, Human
ucucaauaauauaauaauaguuauuauuuaauugcaacaugaaguuggaagccauuuucuguua

SEQ ID NO: 530591 - RNA, 64 nt, Human
uauaaugagaaaucuaggggaaaaccaaucaguccaacaugagauuuuaggaauagaaauuugc

SEQ ID NO: 530592 - RNA, 64 nt, Human
uuaauguuuccaaaugggaaggacaguugauuuccaacaugagguuuuuuguuuuuuauccaga

SEQ ID NO: 530593 - RNA, 64 nt, Human
gaaaugcagcgugacugacucuguugcuaccugucaacaugaauguuucugugagcucuggugu

SEQ ID NO: 530594 - RNA, 64 nt, Human
aacuuuccagcaguacauuugaagcacuuuuuaacaacaugaaacuauaaaccauauuuaaaag

SEQ ID NO: 530595 - RNA, 64 nt, Human
auuuuucaaguuaucuuuuccccaacaucaacaucaacaugauauccuucauucagggcauauu

SEQ ID NO: 530596 - RNA, 64 nt, Human
ucugggaacaacccccaaaugcccuugggaggaacaacaugagcucaggaagccucucuuucuu

SEQ ID NO: 530597 - RNA, 64 nt, Human
cagcucccugacucucggggggagaaggggcucccaacaugacccugaguccccuggauuuugc

SEQ ID NO: 530598 - RNA, 64 nt, Human
uuugacacauucaguaacuaauggaacacaccgucaacaugaauucgcaccuuacaugacagaa

SEQ ID NO: 530599 - RNA, 64 nt, Human
uagaaauaaaaucucugagaugaaacaaaggaaucaacaugauaaaauuuaggcgaaguaguua

SEQ ID NO: 530600 - RNA, 64 nt, Human
cuuucuuaauaguauccuaguuccagcauauauucaacaugaauuuuaucauucuccuccuaau

SEQ ID NO: 530601 - RNA, 64 nt, Human
gucauauuuugcaaguauggaagcugaggcagggcaacaugaaguaacuuacauaacucauaca

SEQ ID NO: 530602 - RNA, 64 nt, Human
gagugucuugguugagagaauaaccucauaguaccaacaugacaugugacuuggaaagagacua

SEQ ID NO: 530603 - RNA, 64 nt, Human
uccuggacuaugaagcuggagaugucuccuucuacaacaugagggacagaucgcacaucuacac

SEQ ID NO: 530604 - RNA, 64 nt, Human
guccugggaucuaguuaucuuggcccugcacucucaacaugaguagcgaacacuuaaauugggu

SEQ ID NO: 530605 - RNA, 64 nt, Human
guguaccuuccuccucuuacucauccaucccagucaacaugauguugucaaugaaauaaaggaa

SEQ ID NO: 530606 - RNA, 64 nt, Human
ucccuucuucuuagcaccacaaauaaucaaaacccaacaugacuguuuguuuuccuuuaaaaau

SEQ ID NO: 530607 - RNA, 64 nt, Human
aacacuucaaguugacuugggauauaucauuccucaacaugaaacuuuucaugaaugggagaag

SEQ ID NO: 530608 - RNA, 64 nt, Human
ugucagaggcaaaacaucuguuuaucauagacaucaacaugaccuauaaguaaagugcgugucu

SEQ ID NO: 530609 - RNA, 64 nt, Human
cagccuguaccgguuuggcuggcuuguuugauuucaacaugaguguauuuuuuaaaauugauuu

SEQ ID NO: 530610 - RNA, 64 nt, Human
uuaacaaauaaaaauugcauauauuuaggcuucacaacaugaugcuuuaguauauguauacauu

SEQ ID NO: 530611 - RNA, 64 nt, Human
accaauaaaagagauuucugcuucaaaaggcucucaacaugaagguuaacacagucaaucaaac

SEQ ID NO: 530612 - RNA, 64 nt, Human
uacuuuagguucacauaccugccugcuagucgggcaacaugaaguaggacaguucuguugauuu

SEQ ID NO: 530613 - RNA, 64 nt, Human
ggagaaggcaaaagcuagaaacacuugggguugucaacaugaguauuacauuaacauugcuuga

SEQ ID NO: 530614 - RNA, 64 nt, Human
guaauaaugugauggcaaucuuaauuuuuggguacaacaugacaagcugugaguuuguguguuu

SEQ ID NO: 530615 - RNA, 64 nt, Human
ucaccuaauuuuuauacugaaauguagaugcccccaacaugauuuuggaaagauauaauuucuu

SEQ ID NO: 530616 - RNA, 64 nt, Human
ucacuugaggucaggaguucaggaccagccuggccaacaugaugaaacccugucucuacuaaau

SEQ ID NO: 530617 - RNA, 64 nt, Human
aaccguucauaauuaaaguauuauuuuguuuugccaacaugaaaacuguuauaaggaaacaauu

SEQ ID NO: 530618 - RNA, 64 nt, Human
aaacuaaugguuuaagcuuugaagcaugcgcaagcaacaugaacaacugaauacagaaaguaac

SEQ ID NO: 530619 - RNA, 64 nt, Human
cacuuuaugugagaucucccgagaguuuccaucccaacaugauggacuuugguuugaacacaau

SEQ ID NO: 530620 - RNA, 64 nt, Human
guaacuauuccucuucaaguauuugcagauggggcaacaugauauuuggguagcugaugucaua

SEQ ID NO: 530621 - RNA, 64 nt, Human
ucugaugggggaaaaugccgccuuaggcuggagccaacaugacuguccuuuaaacuccaguggc

SEQ ID NO: 530622 - RNA, 64 nt, Human
uaacuucauguguauuucaaaauauacugaacgucaacaugauuugaauaaagaaaauguauuu

SEQ ID NO: 530623 - RNA, 64 nt, Human
uuuguuguacagggauucagguuucuuauucuuacaacaugauuguuuauaugugaagcacauc

SEQ ID NO: 530624 - RNA, 64 nt, Human
gguucguuagccacaaagagaaauaucugaaagucaacaugaugcuucuugcauauuauccaga

SEQ ID NO: 530625 - RNA, 64 nt, Human
aaauaaaaaucauacaacuuuuggaaaguuaguucaacaugaacuaaaauggcaugcuauuugg

SEQ ID NO: 530626 - RNA, 64 nt, Human
ccugugucugaaugcaacagggguguugcgggggcaacaugagagccccucacccccaacucuc

SEQ ID NO: 530627 - RNA, 64 nt, Human
cucccauuuccgugcuauuaaucacuuguuagagcaacaugacaugcccagcaucccacuuccc

SEQ ID NO: 530628 - RNA, 64 nt, Human
gcaguugagaccaggaguucgaguccagccugaccaacaugaagaaacccugucuguacuaaaa

SEQ ID NO: 530629 - RNA, 64 nt, Human
ccaagcuccaaauccaaggaaacaugcagcucuucaacaugacauccagagaugacuauuacuu

SEQ ID NO: 530630 - RNA, 64 nt, Human
auuuuguggaauuuugagaaaaauagagcaaaaucaacaugacugguggugagagaccacacau

SEQ ID NO: 530631 - RNA, 64 nt, Human
gaagaagaagaaaaaaaagaaaaagaaaucuaagcaacaugacuauucagacuaugaagacagu

SEQ ID NO: 530632 - RNA, 64 nt, Human
ugcacauccugcaggugcuacugagacugcugcccaacaugagcagugaucuccaaggccagcu

SEQ ID NO: 530633 - RNA, 64 nt, Human
caucaucugggucccuuugguuuauaucaguuuccaacaugacuuguuuguggggcuuguggga

SEQ ID NO: 530634 - RNA, 64 nt, Human
guuuaagcuuauuccuuuaacauaagcuuccugacaacaugaaauuguugggguuuuuuggcgu

SEQ ID NO: 530635 - RNA, 64 nt, Human
guguccaaauggguucugaauucuacagacucaucaacaugaggcaaggaaucauugaaaacca

SEQ ID NO: 530636 - RNA, 64 nt, Human
aaagucacuuuuauuuuuaauuauuuuacauaugcaacaugaagaaaucguguagguggguuuu

SEQ ID NO: 530637 - RNA, 64 nt, Human
uguaauuuuaauuccaugaaagucuuaauguuuccaacaugaaaauucucuuacuuaaauacgu

SEQ ID NO: 530638 - RNA, 64 nt, Human
uuguagcagggagcuagcguauuagccuugugggcaacaugaugcaugggaaaugaaagauuuu

SEQ ID NO: 530639 - RNA, 64 nt, Human
agcuacagaaguucagccaugagauuuuguuuggcaacaugaacagauuuguguauaacugcaa

SEQ ID NO: 530640 - RNA, 64 nt, Human
uguuauaagagauaguucuuuuaaugugacuaugcaacaugauagccaauggugagggaaaagg

SEQ ID NO: 530641 - RNA, 64 nt, Human
gagcugugguuaggcuugguuagagugcagcaagcaacaugacagaugguggcacgcuguuuuu

SEQ ID NO: 530642 - RNA, 64 nt, Human
uauuaaaaaaauacuucauagagccugccuuauccaacaugaaauucccuucuuuuguuauucu

SEQ ID NO: 530643 - RNA, 64 nt, Human
auagucuuuaaaagcuuggaccuuuguagcaccucaacaugaaagggcauuagcuauguuuccu

SEQ ID NO: 530644 - RNA, 59 nt, Human
gauuaaggaggaaggaauaacaucugguccaacaugaaaacaauucuuauugacucaua

SEQ ID NO: 530645 - RNA, 64 nt, Human
ucaccugaggucaggaguucaagaccagccuggccaacaugaugaaaccccgucucuacuaaaa

SEQ ID NO: 530646 - RNA, 64 nt, Human
ccuguaaucuucaggauuucaagaccagccuagccaacaugacgaaaccccaucucuacugaaa

SEQ ID NO: 530647 - RNA, 64 nt, Human
agacagacugaagccacugaacucugccaggagucaacaugagauuccuuuugcuggauaugca

SEQ ID NO: 530648 - RNA, 64 nt, Human
guaacuuacaaccacccauuccggauuuguaaagcaacaugaaaaccuuugauaaaugauaacc

SEQ ID NO: 530649 - RNA, 64 nt, Human
ucaccugaggucaggaguucgagaccaaccuggccaacaugacgaaacuccgucucuauuuaaa

SEQ ID NO: 530650 - RNA, 64 nt, Human
agucuauuauacauagcccuguauauauguacaccaacaugaaacuuuuauuuaacagacgugu

SEQ ID NO: 530651 - RNA, 64 nt, Human
ugcuuacguuuucuucuuuuuucuucaccaaaaccaacaugaaaguaccacugaaguaaaacac

SEQ ID NO: 530652 - RNA, 64 nt, Human
uugggccccacuuccaacacuggugaucacauuucaacaugagguuuagggaaacaaaugccua

SEQ ID NO: 530653 - RNA, 64 nt, Human
auuuauuucacgacagaguugaauguauggccuucaacaugaugcacaugcuuuugugugaaug

SEQ ID NO: 530654 - RNA, 64 nt, Human
ucaccugaggucaggaguuccagaccagccuggccaacaugaugaaacccugucucuacuaaaa

SEQ ID NO: 530655 - RNA, 64 nt, Human
ucacuugagguugggaguucaugaccagcuugaccaacaugaagaaacccugucucuauuaaaa

SEQ ID NO: 530656 - RNA, 64 nt, Human
augagcuucaccuucugggugaaguuucuaaggucaacaugaauccucuuaccucucucacugc

SEQ ID NO: 530657 - RNA, 64 nt, Human
aaauuugaguaugcuugauuuguauauuggaacucaacaugaucauaaggagaagauacguacc

SEQ ID NO: 530658 - RNA, 64 nt, Human
ucacuugagcccaggaguucgagagcagccugggcaacaugacgaaaccccgucucuacagaga

SEQ ID NO: 530659 - RNA, 64 nt, Human
ccagcuaauaacugaucucguuuuuucuucacugcaacaugaugagguaguaccuuuuauaucc

SEQ ID NO: 530660 - RNA, 64 nt, Human
cucaggaacaggucucaggauggagagaagcauacaacaugagcaaagcuuuuucucgugcucu

SEQ ID NO: 530661 - RNA, 64 nt, Human
uguggucaaguuaaaaaaaaaaaacaauauuaaacaacaugaaacugcagucuguuuuugaaaa

SEQ ID NO: 530662 - RNA, 64 nt, Human
guuacugaguuagcucuacucuuuuggaccaaagcaacaugagagcaaguacuuuucacacuug

SEQ ID NO: 530663 - RNA, 64 nt, Human
ucacccugcaaaagacuugcacuuuccucagaaccaacaugacgcagcucaauaagggugaggg

SEQ ID NO: 530664 - RNA, 64 nt, Human
guaaauugcaauucuuucuggggauauauugguacaacaugacuuaaaacuuuuuuuuuucuau

SEQ ID NO: 530665 - RNA, 64 nt, Human
aaccgugccaugaggacaguaaguguucauaaagcaacaugaagcaagaaacagugcagggugc

SEQ ID NO: 530666 - RNA, 64 nt, Human
cauuuggcuucgaguuccccaggcgcuguagacacaacaugaaucgggcucucugcucucuccu

SEQ ID NO: 530667 - RNA, 64 nt, Human
uugcuugagcccaggaguuagagaccagccugggcaacaugaugugaaaacccaucucuacaaa

SEQ ID NO: 530668 - RNA, 64 nt, Human
ccucggauaaugaucugccccggagcuagggcagcaacaugaggaccaaaccaugcacauaaag

SEQ ID NO: 530669 - RNA, 64 nt, Human
ggcaguaauguuccucccaggguuuccagggaaacaacaugaaaaacaggugacaugaacuaca

SEQ ID NO: 530670 - RNA, 64 nt, Human
gauuaaguaaaaugcccaaggguauaaacaaaagcaacaugaaaguggaagccguaucugucau

SEQ ID NO: 530671 - RNA, 64 nt, Human
caucacuacaaccuugaauuuaauuucaggucuucaacaugaugaccuuggauuuaauuuaaag

SEQ ID NO: 530672 - RNA, 64 nt, Human
agaaucuguuugcaaauuguccaacccacccccucaacaugaggggcuuccauuuucuguguuu

SEQ ID NO: 530673 - RNA, 64 nt, Human
agaccuagaacccuuuccccagcacuugguuuuccaacaugauauuuaugaguaauuuauuuug

SEQ ID NO: 530674 - RNA, 64 nt, Human
ccagcuaaucuuaacauuuagcagaaagcucuagcaacaugaucuuaauuguauccagaggauu

SEQ ID NO: 530675 - RNA, 64 nt, Human
ggacaugauggggaaggaguacaaaacaaucucucaacaugauugaaccauuugggauggagaa

SEQ ID NO: 530676 - RNA, 64 nt, Human
acaccagcaauuaugccaagggccguuaggcucucaacaugacuauagagaccccgugucauca

SEQ ID NO: 530677 - RNA, 64 nt, Human
uaaaagacagaacaaaacuguggaucauugcccucaacaugaagacugccauauuccaagucac

SEQ ID NO: 530678 - RNA, 64 nt, Human
ccgcggcacguccccccugugacgcguuccagaccaacaugaccucucccugcuuucuagcggc

SEQ ID NO: 530679 - RNA, 64 nt, Human
cuucauggugcccgguaccaucugcccuaggucucaacaugagcauacuucugaccuaaccuuc

SEQ ID NO: 530680 - RNA, 64 nt, Human
ucgcuugagcccaggaguuugagaccgacaugggcaacaugacaagaccccaucucuacaaaaa

SEQ ID NO: 530681 - RNA, 64 nt, Human
uagacauaucacuguauccaucuauacuuggcagcaacaugagaagugugauacaugugaaccc

SEQ ID NO: 530682 - RNA, 64 nt, Human
aagaguuccucgcauauaucguugugcacaggaucaacaugauggugacugggaaaaaauuacu

SEQ ID NO: 530683 - RNA, 64 nt, Human
auuugcaguuuuuuuuuccaauucugugcucugucaacaugagggaccuaucuauguauguuga

SEQ ID NO: 530684 - RNA, 64 nt, Human
agcccagugaauuagucgguuagaauucguucuacaacaugauagaacuuuucuuacuagcuuc

SEQ ID NO: 530685 - RNA, 64 nt, Human
uguguaaggagccauauacaauauguaaacaaaucaacaugacuguguuucaacaaggccugau

SEQ ID NO: 530686 - RNA, 64 nt, Human
uugaggcaucaaaaaaacaaguuuagaaagcuggcaacaugaagaaugcauucaaaauauaaca

SEQ ID NO: 530687 - RNA, 64 nt, Human
uugcacuuaauauugaaauguacuguauaggaaccaacaugaacaauuuuaauugaaaacacca

SEQ ID NO: 530688 - RNA, 64 nt, Human
ccuagagagaggagacaaaucggugugccauugacaacaugagccaggguaaaggcacccuuug

SEQ ID NO: 530689 - RNA, 64 nt, Human
gagaauuauuuggguagauucacugaggcuaugucaacaugauauuuagaccaacaggugauca

SEQ ID NO: 530690 - RNA, 64 nt, Human
aaaacgaagggccuuagaggggccuacaaaccagcaacaugaaauggacaaaccaaucugcuua

SEQ ID NO: 530691 - RNA, 64 nt, Human
ggguuaagccuguaauuauguaaccuauuuaucgcaacaugaauuuuuaugauuucuugugaug

SEQ ID NO: 530692 - RNA, 64 nt, Human
uugcccucagaaagauucugauacccugccuugacaacaugaaacuugaggcugcuuugguuca

SEQ ID NO: 530693 - RNA, 64 nt, Human
ugauugauugauuguaaauaaaggaugauggccacaacaugaaaacuccauauuuauuuagaug

SEQ ID NO: 530694 - RNA, 64 nt, Human
ucaccugaagucaggaguuugagaccagccugaccaacaugaugaaaccucgauucuacuaaaa

SEQ ID NO: 530695 - RNA, 64 nt, Human
aucucaccggggccaccugccccuacacccuguccaacaugaccuacaaggaggaagacuucga

SEQ ID NO: 530696 - RNA, 64 nt, Human
cuaaacguacaacaucauaguaauuugucaugggcaacaugaccagagagaagauuuuugucau

SEQ ID NO: 530697 - RNA, 64 nt, Human
ucaucagaugacaaggacaacccucaugacgaagcaacaugaauuagggggccucuuggccuug

SEQ ID NO: 530698 - RNA, 64 nt, Human
ucuuuacagaucuuuagguuccugaaacugguggcaacaugaccugcuaaaauuuucugcuugg

SEQ ID NO: 530699 - RNA, 64 nt, Human
cacgucccaugugcccccaggucuggaguauggacaacaugaucugcacgcagacccugcugcg

SEQ ID NO: 530700 - RNA, 64 nt, Human
guacugugugauauuuuucauuauuuuaggacgccaacaugagaccuguaauaaaauauguaau

SEQ ID NO: 530701 - RNA, 64 nt, Human
ucgguugagcucaggcguucgggaccagccuggccaacaugaugaaaccccgucucuaccaaaa

SEQ ID NO: 530702 - RNA, 64 nt, Human
ucaccugaggucaggaguuugagaccagccuggccaacaugaugaaauguugucucuacugaaa

SEQ ID NO: 530703 - RNA, 64 nt, Human
gaaaggagugggaggaauacagcaguuuguuuuucaacaugaaucugauauugauuuaaacugu

SEQ ID NO: 530704 - RNA, 64 nt, Human
uccccuccacuuuuuuuuuuugucagcuccaugacaacaugaccagcucagcaaaggcugagac

SEQ ID NO: 530705 - RNA, 64 nt, Human
guaacgagucuuucaugaugugacuuugaggccccaacaugacagccacugggccaccgggacc

SEQ ID NO: 530706 - RNA, 64 nt, Human
aaaaaacaagaaaguuauguuucauaauuucuuacaacaugagccaguaacccuuuaggaacuc

SEQ ID NO: 530707 - RNA, 64 nt, Human
agcggcugcugaacugggcugcccaccuggcugccaacaugauccccgucucugcccugggcuc

SEQ ID NO: 530708 - RNA, 64 nt, Human
cuucaggaagaauuguaaagaccuguacauagcacaacaugauccggauaauauauauacuguu

SEQ ID NO: 530709 - RNA, 64 nt, Human
ucacuugaggucaggaguucgagaccagccuggccaacaugaugaaaccccaucucuacuaaaa

SEQ ID NO: 530710 - RNA, 64 nt, Human
ucacuugaggccaggaguucaagaccagccuggccaacaugaugagaccuccgucucuacuaaa

SEQ ID NO: 530711 - RNA, 64 nt, Human
auuuucucuggaaggcugaggcacacuucaccaucaacaugaauuacuguacuauccuguacug

SEQ ID NO: 530712 - RNA, 64 nt, Human
gaccaagguaccgauuucugcuaaguucucccaacaacaugaaacugccuauucacgccguaau

SEQ ID NO: 530713 - RNA, 64 nt, Human
cuccucuaacaucucuggauacagugucccuggucaacaugaagaaguuacagaagaacgcuuu

SEQ ID NO: 530714 - RNA, 64 nt, Human
agugcuagauggagauagauauauguagagagagcaacaugacuggggcugcaccacacaaggg

SEQ ID NO: 530715 - RNA, 64 nt, Human
auacagggaaaggagcuguucuucaagguccccucaacaugagcggaagagcgaaccccagggg

SEQ ID NO: 530716 - RNA, 64 nt, Human
gggacgguagaaaccuaaggaaaaugcuuuugggcaacaugagaggaaccuuuucauauuaaug

SEQ ID NO: 530717 - RNA, 64 nt, Human
gugccuacugcgucaugggcuucacgcagaagagcaacaugaagcugcacaugaagcgggcgca

SEQ ID NO: 530718 - RNA, 64 nt, Human
cagcaucuugcuccacucggcaucucugugaaagcaacaugaaaugaacuguaguaggugugua

SEQ ID NO: 530719 - RNA, 64 nt, Human
aacaaauuugauuauuuuuucauuguuaaauaggcaacaugaccagaaaggauggaauggcuua

SEQ ID NO: 530720 - RNA, 64 nt, Human
uuaaguaauuauaaacauaaauuuccuguagcuccaacaugacuuugaucugaguaauaguguu

SEQ ID NO: 530721 - RNA, 64 nt, Human
cugaggcugauggacagugaccgccacuggcccccaacaugaccacacgugggugcugaacucg

SEQ ID NO: 530722 - RNA, 64 nt, Human
uuuuuuuuccugccuaauuucugugauuuccaaccaacaugaaaugacuauaaaugguuuuuua

SEQ ID NO: 530723 - RNA, 64 nt, Human
caaauaaguacgauaacauagucauagucccacccaacaugaugcaguuaucuugcauacaacu

SEQ ID NO: 530724 - RNA, 64 nt, Human
uuuaaaggguugaaaaaagugaaaagaauauuuucaacaugaaaauuauaugaaauuuaaguuu

SEQ ID NO: 530725 - RNA, 64 nt, Human
uggaaaagcuuccaguuaugauacuuuccuuauucaacaugagaaagcucaugggcaagaaacu

SEQ ID NO: 530726 - RNA, 64 nt, Human
gauugagggacacgaucuguguuccacucuauagcaacaugacucuagcaaugugacuuucggu

SEQ ID NO: 530727 - RNA, 64 nt, Human
caggaaagcauucucuuggcucacuugccuucuacaacaugaaagaauucacacucgagagaaa

SEQ ID NO: 530728 - RNA, 64 nt, Human
uagaaaagccuucagucauuuuggucacuuaaagcaacaugaaaggauucacacuggagagaag

SEQ ID NO: 530729 - RNA, 64 nt, Human
ucagaccuuuagacucauuguaaguugccacugccaacaugagaccaaagugugugacuaguca

SEQ ID NO: 530730 - RNA, 64 nt, Human
accccugccccuacccgaaggcccucuguccacacaacaugaaccuaggcugugaccuuuugcc

SEQ ID NO: 530731 - RNA, 64 nt, Human
cguauuacaaaugagcccgaaucaugacagucagcaacaugauaccuggauccagccauuccug

SEQ ID NO: 530732 - RNA, 64 nt, Human
gaucacggggucaggagaucgagaccauccuggccaacaugaugaaacccuaucucuacuaaaa

SEQ ID NO: 530733 - RNA, 64 nt, Human
acuaggaugaaugcuaucaaugucagaaaggcuucaacaugaauucaggcucugaauucuuuga

SEQ ID NO: 530734 - RNA, 64 nt, Human
aacaaaugcaagcccaaauauguuaaaacucacacaacaugauauauauuaaagguugcaggau

SEQ ID NO: 530735 - RNA, 64 nt, Human
uugcuugaggccaggaguuccagaucaaccugggcaacaugaugagaccccaucucuacaaaca

SEQ ID NO: 530736 - RNA, 64 nt, Human
cuucugucauaugaauguugagcaaagcuuaggccaacaugaauuguuugugaagugugguuga

SEQ ID NO: 530737 - RNA, 64 nt, Human
ggucccugaaagaaagcauuugugugggcaaucccaacaugaaauguagacagcgugaauacgg

SEQ ID NO: 530738 - RNA, 64 nt, Human
cacaggagcugacagguuuuucaauuaauauucccaacaugaaugagaugccucauuccucagu

SEQ ID NO: 530739 - RNA, 64 nt, Human
aggaggccugagaaagcaagcacgcacucucagucaacaugacagauucuggaggauaaccagc

SEQ ID NO: 530740 - RNA, 64 nt, Human
gaucaauucucacuuaagaggccaauaaacaacccaacaugaaaaggugacaagccuggguuuc

SEQ ID NO: 530741 - RNA, 64 nt, Human
caaagaaaaaugaaaacaaauuuuaaaaacguugcaacaugaauaaaaguuucaccaaaucggg

SEQ ID NO: 530742 - RNA, 64 nt, Human
gaaccaugaauucuggucacauuccauuucucuccaacaugaaggaucaaaaaauguuuuucaa

SEQ ID NO: 530743 - RNA, 64 nt, Human
uuauuucuaccgagaauuaaaacuucagauuguucaacaugagagaaaggcucagcaacgugaa

SEQ ID NO: 530744 - RNA, 64 nt, Human
gagcugagauugcaccauuucauuccagccugggcaacaugagugaaagucugacucaaaaaaa

SEQ ID NO: 530745 - RNA, 64 nt, Human
acacauugcugugaacaggaaacuccugugaccacaacaugaggccacuggagacgcauaugag

SEQ ID NO: 530746 - RNA, 64 nt, Human
agagcugcuuccucagcaacaggagccggaccuacaacaugauccaguacuaucagaaugacau

SEQ ID NO: 530747 - RNA, 64 nt, Human
aagcagguagacauccgcgaggucagaugcuuuccaacaugacaccugaacaucuuccuuuaug

SEQ ID NO: 530748 - RNA, 64 nt, Human
ugccaucagaaggaaggaaucaggcaggugaaggcaacaugaugccagauuugagaaaggaucu

SEQ ID NO: 530749 - RNA, 64 nt, Human
aauucuuuuauaagggcauucaauacuacaaaaucaacaugauuucauaaggugcaaauaaaag

SEQ ID NO: 530750 - RNA, 64 nt, Human
auuuucugcgcagauaugcuagguguauccacaccaacaugaagacacugaccuugucccgcua

SEQ ID NO: 530751 - RNA, 64 nt, Human
ugagggaucuauacuugcuuuguguucuuugugucaacaugaacaaauuuuauuuguaggggaa

SEQ ID NO: 530752 - RNA, 64 nt, Human
auuuggaaguauuucauuacuaacaaucucaguacaacaugaaaauuguugcuucucaucuaaa

SEQ ID NO: 530753 - RNA, 64 nt, Human
ucccuguccccaccaccccugccccacccagggccaacaugacuaagcucucucaugacccacc

SEQ ID NO: 530754 - RNA, 64 nt, Human
ucgcuggagcccaguaggucaagaccagccagggcaacaugaugagacccugucucugccaaaa

SEQ ID NO: 530755 - RNA, 64 nt, Human
ucaccugaggucaggaguuugagaccagccuggccaacaugaugaaacccuugucucuauuaaa

SEQ ID NO: 530756 - RNA, 64 nt, Human
auuuccaauugucuccugcuagcaauaugugccacaacaugacagucuugugacaucuuaagga

SEQ ID NO: 530757 - RNA, 64 nt, Human; identical to SEQ ID NO: 270185

SEQ ID NO: 530758 - RNA, 64 nt, Human; identical to SEQ ID NO: 270186

SEQ ID NO: 530759 - RNA, 64 nt, Human; identical to SEQ ID NO: 270187

SEQ ID NO: 530760 - RNA, 64 nt, Human; identical to SEQ ID NO: 270188

SEQ ID NO: 530761 - RNA, 64 nt, Human; identical to SEQ ID NO: 270189

SEQ ID NO: 530762 - RNA, 64 nt, Human; identical to SEQ ID NO: 270190

SEQ ID NO: 530763 - RNA, 64 nt, Human; identical to SEQ ID NO: 270191

SEQ ID NO: 530764 - RNA, 64 nt, Human; identical to SEQ ID NO: 270192

SEQ ID NO: 530765 - RNA, 64 nt, Human; identical to SEQ ID NO: 270193

SEQ ID NO: 530766 - RNA, 64 nt, Human; identical to SEQ ID NO: 270194

SEQ ID NO: 530767 - RNA, 64 nt, Human; identical to SEQ ID NO: 270195

SEQ ID NO: 530768 - RNA, 64 nt, Human; identical to SEQ ID NO: 270196

SEQ ID NO: 530769 - RNA, 64 nt, Human; identical to SEQ ID NO: 270197

SEQ ID NO: 530770 - RNA, 64 nt, Human; identical to SEQ ID NO: 270198

SEQ ID NO: 530771 - RNA, 64 nt, Human
cugcccaugagcugccacacagcaccuuugccaugccccguaauuuggauuuuauggugguugu

SEQ ID NO: 530772 - RNA, 64 nt, Human; identical to SEQ ID NO: 57065

SEQ ID NO: 530773 - RNA, 64 nt, Human; identical to SEQ ID NO: 57066

SEQ ID NO: 530774 - RNA, 64 nt, Human; identical to SEQ ID NO: 57067

SEQ ID NO: 530775 - RNA, 64 nt, Human; identical to SEQ ID NO: 57068

SEQ ID NO: 530776 - RNA, 64 nt, Human; identical to SEQ ID NO: 57069

SEQ ID NO: 530777 - RNA, 64 nt, Human; identical to SEQ ID NO: 57070

SEQ ID NO: 530778 - RNA, 64 nt, Human; identical to SEQ ID NO: 57071

SEQ ID NO: 530779 - RNA, 64 nt, Human; identical to SEQ ID NO: 57072

SEQ ID NO: 530780 - RNA, 64 nt, Human; identical to SEQ ID NO: 57073

SEQ ID NO: 530781 - RNA, 64 nt, Human; identical to SEQ ID NO: 57074

SEQ ID NO: 530782 - RNA, 64 nt, Human; identical to SEQ ID NO: 57075

SEQ ID NO: 530783 - RNA, 64 nt, Human; identical to SEQ ID NO: 57076

SEQ ID NO: 530784 - RNA, 64 nt, Human; identical to SEQ ID NO: 57077

SEQ ID NO: 530785 - RNA, 64 nt, Human; identical to SEQ ID NO: 57078

SEQ ID NO: 530786 - RNA, 64 nt, Human; identical to SEQ ID NO: 57079

SEQ ID NO: 530787 - RNA, 64 nt, Human; identical to SEQ ID NO: 57080

SEQ ID NO: 530788 - RNA, 64 nt, Human
cuccaccgggacugcuggucacugcuuagaaccgucaugccagggucccaaaagugugggugcc

SEQ ID NO: 530789 - RNA, 64 nt, Human
uucuaugaagacggacucuucaugagguugaauuucaugccaguuuguauuuuuauaaguaucu

SEQ ID NO: 530790 - RNA, 64 nt, Human
ugagcccagagguagaggcugcagugagccaugaucaugccacugcacucugggcuggguaaca

SEQ ID NO: 530791 - RNA, 64 nt, Human; identical to SEQ ID NO: 57081

SEQ ID NO: 530792 - RNA, 64 nt, Human; identical to SEQ ID NO: 57082

SEQ ID NO: 530793 - RNA, 64 nt, Human; identical to SEQ ID NO: 57083

SEQ ID NO: 530794 - RNA, 64 nt, Human; identical to SEQ ID NO: 57084

SEQ ID NO: 530795 - RNA, 64 nt, Human; identical to SEQ ID NO: 57085

SEQ ID NO: 530796 - RNA, 64 nt, Human; identical to SEQ ID NO: 57086

SEQ ID NO: 530797 - RNA, 64 nt, Human; identical to SEQ ID NO: 57087

SEQ ID NO: 530798 - RNA, 64 nt, Human; identical to SEQ ID NO: 57088

SEQ ID NO: 530799 - RNA, 64 nt, Human; identical to SEQ ID NO: 57089

SEQ ID NO: 530800 - RNA, 64 nt, Human; identical to SEQ ID NO: 57090

SEQ ID NO: 530801 - RNA, 64 nt, Human; identical to SEQ ID NO: 57091

SEQ ID NO: 530802 - RNA, 64 nt, Human; identical to SEQ ID NO: 57092

SEQ ID NO: 530803 - RNA, 64 nt, Human; identical to SEQ ID NO: 57093

SEQ ID NO: 530804 - RNA, 64 nt, Human; identical to SEQ ID NO: 57094

SEQ ID NO: 530805 - RNA, 64 nt, Human; identical to SEQ ID NO: 57095

SEQ ID NO: 530806 - RNA, 64 nt, Human; identical to SEQ ID NO: 57096

SEQ ID NO: 530807 - RNA, 64 nt, Human
ugguaguaggggcgccagcuugggcucuccuggcgccccguagcaucgagugucuucuuugucu

SEQ ID NO: 530808 - RNA, 64 nt, Human
gagauaggaaacggcauuugaguggguguccagggccccguagagagacauuuaagauggugua

SEQ ID NO: 530809 - RNA, 60 nt, Human
ccuccccgcucccuuccacucugcacgaggccgccacaccggcgcuggcucccugcccgg

SEQ ID NO: 530810 - RNA, 64 nt, Human; identical to SEQ ID NO: 57097

SEQ ID NO: 530811 - RNA, 64 nt, Human; identical to SEQ ID NO: 57098

SEQ ID NO: 530812 - RNA, 64 nt, Human; identical to SEQ ID NO: 57099

SEQ ID NO: 530813 - RNA, 64 nt, Human; identical to SEQ ID NO: 57100

SEQ ID NO: 530814 - RNA, 64 nt, Human; identical to SEQ ID NO: 57101

SEQ ID NO: 530815 - RNA, 63 nt, Human; identical to SEQ ID NO: 57102

SEQ ID NO: 530816 - RNA, 64 nt, Human; identical to SEQ ID NO: 57103

SEQ ID NO: 530817 - RNA, 64 nt, Human; identical to SEQ ID NO: 57104

SEQ ID NO: 530818 - RNA, 64 nt, Human; identical to SEQ ID NO: 57105

SEQ ID NO: 530819 - RNA, 64 nt, Human; identical to SEQ ID NO: 57106

SEQ ID NO: 530820 - RNA, 64 nt, Human; identical to SEQ ID NO: 57107

SEQ ID NO: 530821 - RNA, 64 nt, Human; identical to SEQ ID NO: 57108

SEQ ID NO: 530822 - RNA, 64 nt, Human; identical to SEQ ID NO: 57109

SEQ ID NO: 530823 - RNA, 64 nt, Human; identical to SEQ ID NO: 57110

SEQ ID NO: 530824 - RNA, 64 nt, Human; identical to SEQ ID NO: 57111

SEQ ID NO: 530825 - RNA, 64 nt, Human; identical to SEQ ID NO: 57112

SEQ ID NO: 530826 - RNA, 60 nt, Human
acuggagacuuugaguucuccuacauucauccgccacaaaucuuaauguguugaaagaau

SEQ ID NO: 530827 - RNA, 60 nt, Human
gcacacggcagccugcaaagcacagggccaccgccacagcccggcagaggggcacacucu

SEQ ID NO: 530828 - RNA, 60 nt, Human
cacccaaauagcuggaacuacaggcauauaccgccacacccagcuaauuuuauuuuuuga

SEQ ID NO: 530829 - RNA, 60 nt, Human
cugcccccagccugugccagcagcagcugcccgccacagggguacccaucacacaccagc

SEQ ID NO: 530830 - RNA, 64 nt, Human; identical to SEQ ID NO: 57113

SEQ ID NO: 530831 - RNA, 64 nt, Human; identical to SEQ ID NO: 57114

SEQ ID NO: 530832 - RNA, 64 nt, Human; identical to SEQ ID NO: 57115

SEQ ID NO: 530833 - RNA, 64 nt, Human; identical to SEQ ID NO: 57116

SEQ ID NO: 530834 - RNA, 64 nt, Human; identical to SEQ ID NO: 57117

SEQ ID NO: 530835 - RNA, 64 nt, Human; identical to SEQ ID NO: 57118

SEQ ID NO: 530836 - RNA, 64 nt, Human; identical to SEQ ID NO: 57119

SEQ ID NO: 530837 - RNA, 64 nt, Human; identical to SEQ ID NO: 57120

SEQ ID NO: 530838 - RNA, 64 nt, Human; identical to SEQ ID NO: 57121

SEQ ID NO: 530839 - RNA, 64 nt, Human; identical to SEQ ID NO: 57122

SEQ ID NO: 530840 - RNA, 64 nt, Human; identical to SEQ ID NO: 57123

SEQ ID NO: 530841 - RNA, 64 nt, Human; identical to SEQ ID NO: 57124

SEQ ID NO: 530842 - RNA, 64 nt, Human; identical to SEQ ID NO: 57125

SEQ ID NO: 530843 - RNA, 60 nt, Human; identical to SEQ ID NO: 57126

SEQ ID NO: 530844 - RNA, 64 nt, Human; identical to SEQ ID NO: 57127

SEQ ID NO: 530845 - RNA, 64 nt, Human; identical to SEQ ID NO: 57128

SEQ ID NO: 530846 - RNA, 64 nt, Human
ugaagauuacuuucuuuugugacuuucuucuaccucaugccacuguuuaaaaguaaaacguauu

SEQ ID NO: 530847 - RNA, 64 nt, Human
gaaccugggaggcagagguugcagugagccaaaaucaugccacugcacucccgccuggcaacag

SEQ ID NO: 530848 - RNA, 64 nt, Human
uuucuuggcaccuucaggucucugguuuucucauucaugccaaugcuugugggcugggguuggc

SEQ ID NO: 530849 - RNA, 64 nt, Human; identical to SEQ ID NO: 57129

SEQ ID NO: 530850 - RNA, 64 nt, Human; identical to SEQ ID NO: 57130

SEQ ID NO: 530851 - RNA, 64 nt, Human; identical to SEQ ID NO: 57131

SEQ ID NO: 530852 - RNA, 64 nt, Human; identical to SEQ ID NO: 57132

SEQ ID NO: 530853 - RNA, 64 nt, Human; identical to SEQ ID NO: 57133

SEQ ID NO: 530854 - RNA, 64 nt, Human; identical to SEQ ID NO: 57134

SEQ ID NO: 530855 - RNA, 64 nt, Human; identical to SEQ ID NO: 57135

SEQ ID NO: 530856 - RNA, 64 nt, Human; identical to SEQ ID NO: 57136

SEQ ID NO: 530857 - RNA, 64 nt, Human; identical to SEQ ID NO: 57137

SEQ ID NO: 530858 - RNA, 64 nt, Human; identical to SEQ ID NO: 57138

SEQ ID NO: 530859 - RNA, 64 nt, Human; identical to SEQ ID NO: 57139

SEQ ID NO: 530860 - RNA, 64 nt, Human; identical to SEQ ID NO: 57140

SEQ ID NO: 530861 - RNA, 64 nt, Human; identical to SEQ ID NO: 57141

SEQ ID NO: 530862 - RNA, 64 nt, Human; identical to SEQ ID NO: 57142

SEQ ID NO: 530863 - RNA, 64 nt, Human; identical to SEQ ID NO: 57143

SEQ ID NO: 530864 - RNA, 64 nt, Human; identical to SEQ ID NO: 57144

SEQ ID NO: 530865 - RNA, 64 nt, Human
ccuugcacugugcuggugaucaaguuuguccuaaucaugccauguguagacaacacccuuacaa

SEQ ID NO: 530866 - RNA, 64 nt, Human
uauuuuaagcaaauagccuggacguaagagauucucaugccagcaugcuuucauuugucaguug

SEQ ID NO: 530867 - RNA, 64 nt, Human
gaacccaggaggcggaaguugcagugagcugagaucaugccacugcacuccagccugggcaaca

SEQ ID NO: 530868 - RNA, 64 nt, Human; identical to SEQ ID NO: 57145

SEQ ID NO: 530869 - RNA, 64 nt, Human; identical to SEQ ID NO: 57146

SEQ ID NO: 530870 - RNA, 64 nt, Human; identical to SEQ ID NO: 57147

SEQ ID NO: 530871 - RNA, 64 nt, Human; identical to SEQ ID NO: 57148

SEQ ID NO: 530872 - RNA, 64 nt, Human; identical to SEQ ID NO: 57149

SEQ ID NO: 530873 - RNA, 64 nt, Human; identical to SEQ ID NO: 57150

SEQ ID NO: 530874 - RNA, 64 nt, Human; identical to SEQ ID NO: 57151

SEQ ID NO: 530875 - RNA, 64 nt, Human; identical to SEQ ID NO: 57152

SEQ ID NO: 530876 - RNA, 64 nt, Human; identical to SEQ ID NO: 57153

SEQ ID NO: 530877 - RNA, 64 nt, Human; identical to SEQ ID NO: 57154

SEQ ID NO: 530878 - RNA, 64 nt, Human; identical to SEQ ID NO: 57155

SEQ ID NO: 530879 - RNA, 64 nt, Human; identical to SEQ ID NO: 57156

SEQ ID NO: 530880 - RNA, 64 nt, Human; identical to SEQ ID NO: 57157

SEQ ID NO: 530881 - RNA, 64 nt, Human; identical to SEQ ID NO: 57158

SEQ ID NO: 530882 - RNA, 64 nt, Human; identical to SEQ ID NO: 57159

SEQ ID NO: 530883 - RNA, 64 nt, Human; identical to SEQ ID NO: 57160

SEQ ID NO: 530884 - RNA, 64 nt, Human
uuuuguugccguugugaaauuguugaaauuuccuucaugccaagcuucuuguuauaugagauaa

SEQ ID NO: 530885 - RNA, 64 nt, Human
gagacaucccacccccaguugaauaauggcccauucaugccaaccuugccaacacggagagggc

SEQ ID NO: 530886 - RNA, 64 nt, Human
cucgagcuagcuuauuucagccacuucuagcagaucaugccauggagcucacgacgugugacca

SEQ ID NO: 530887 - RNA, 64 nt, Human; identical to SEQ ID NO: 57161

SEQ ID NO: 530888 - RNA, 64 nt, Human; identical to SEQ ID NO: 57162

SEQ ID NO: 530889 - RNA, 64 nt, Human; identical to SEQ ID NO: 57163

SEQ ID NO: 530890 - RNA, 64 nt, Human; identical to SEQ ID NO: 57164

SEQ ID NO: 530891 - RNA, 64 nt, Human; identical to SEQ ID NO: 57165

SEQ ID NO: 530892 - RNA, 64 nt, Human; identical to SEQ ID NO: 57166

SEQ ID NO: 530893 - RNA, 64 nt, Human; identical to SEQ ID NO: 57167

SEQ ID NO: 530894 - RNA, 64 nt, Human; identical to SEQ ID NO: 57168

SEQ ID NO: 530895 - RNA, 64 nt, Human; identical to SEQ ID NO: 57169

SEQ ID NO: 530896 - RNA, 64 nt, Human; identical to SEQ ID NO: 57170

SEQ ID NO: 530897 - RNA, 64 nt, Human; identical to SEQ ID NO: 57171

SEQ ID NO: 530898 - RNA, 58 nt, Human; identical to SEQ ID NO: 57172

SEQ ID NO: 530899 - RNA, 64 nt, Human; identical to SEQ ID NO: 57173

SEQ ID NO: 530900 - RNA, 64 nt, Human; identical to SEQ ID NO: 57174

SEQ ID NO: 530901 - RNA, 64 nt, Human; identical to SEQ ID NO: 57175

SEQ ID NO: 530902 - RNA, 64 nt, Human; identical to SEQ ID NO: 57176

SEQ ID NO: 530903 - RNA, 64 nt, Human
ugaaauagaugaccuauuuaaugccauuuguguuucaugccauuuuauccaaagcuuuuucucu

SEQ ID NO: 530904 - RNA, 64 nt, Human
gagcucaggaggccgaggcugccuuaagcugugaucaugccacugcauuccagccugggagaga

SEQ ID NO: 530905 - RNA, 64 nt, Human
gaacucgggaggcagagguugcagugagccaagaucaugccaucccacucuagcuugggcaaua

SEQ ID NO: 530906 - RNA, 64 nt, Human
gagccugggaggucaaggcugcagugagccaugaucaugccacugcacuccauccugggugaca

SEQ ID NO: 530907 - RNA, 64 nt, Human; identical to SEQ ID NO: 57192

SEQ ID NO: 530908 - RNA, 64 nt, Human
uuuacugccuucugucuuucuucccgccucuccagguugacagccuucucugaacgaccucucc

SEQ ID NO: 530909 - RNA, 64 nt, Human
aucugauuccauagggggcuggguguggccuucggguugacaugagaaaggucuuuagcaauca

SEQ ID NO: 530910 - RNA, 64 nt, Human
cugcagcucucaugcugccccugccuuggggucagguugacaggagguuggagggaaagccuua

SEQ ID NO: 530911 - RNA, 64 nt, Human
aaguuauuucuuugacugaauagacagugguauagguugacacagcacacaaguggcuauugug

SEQ ID NO: 530912 - RNA, 64 nt, Human
cccagcauaugugccauaaacagaacaaauggauccaggguauaccucuaauaaccuuuaucua

SEQ ID NO: 530913 - RNA, 64 nt, Human
cuucagaaagggacuguucuggguggcuggaucuccaggguacccuccaccccagcugccaagc

SEQ ID NO: 530914 - RNA, 64 nt, Human
ccaggagcgccucaucuucccaggccucagccacccaggguaaaaggugccagggaaguugugg

SEQ ID NO: 530915 - RNA, 64 nt, Human
ccaguauuacggugccucuucucugcccccuuucccaggguaucuguggguugccaggcugggg

SEQ ID NO: 530916 - RNA, 64 nt, Human
gcucugccccaccccuacucaaggagucaggugcccaggguagggaauaagucuaggaaagggg

SEQ ID NO: 530917 - RNA, 64 nt, Human
uuggauguggucucuacacuaaccuucuugauguccaggguagauaaagggucgaaucucucug

SEQ ID NO: 530918 - RNA, 64 nt, Human
gcaaacuagucucaugaagaauucuggcgugcagccaggguagcugaaguuugggucugggacu

SEQ ID NO: 530919 - RNA, 64 nt, Human
gacagguuuugcccaaggcuuugauaccugucacccaggguaucuuaaaagcaaguuguucucc

SEQ ID NO: 530920 - RNA, 64 nt, Human
acucugcaccucuuccucagcugcuccagaccggccaggguaaccagcuaaccaugccuggcau

SEQ ID NO: 530921 - RNA, 64 nt, Human
uccagcaggcuugaagcaggguaagcaggcuggcccaggguaagggcuguugagguaccuuaag

SEQ ID NO: 530922 - RNA, 64 nt, Human
cucugcuuuugugaagcaacuauuuauuugaagaccaggguaugggcacuuuugccuucucucc

SEQ ID NO: 530923 - RNA, 60 nt, Human
accgaagguccuacagggccacaacugcccccgccacaacccaccccgcuuucguaguuu

SEQ ID NO: 530924 - RNA, 60 nt, Human
cccgacuccaguccaagucucgcuacauuuccgccacaucccucucugcuggacguccag

SEQ ID NO: 530925 - RNA, 60 nt, Human
uauuuuaccucuuuccgugcaucccugcacccgccacacccccuucagcuaugcuuuugg

SEQ ID NO: 530926 - RNA, 64 nt, Human; identical to SEQ ID NO: 57193

SEQ ID NO: 530927 - RNA, 64 nt, Human; identical to SEQ ID NO: 57194

SEQ ID NO: 530928 - RNA, 64 nt, Human; identical to SEQ ID NO: 57195

SEQ ID NO: 530929 - RNA, 64 nt, Human; identical to SEQ ID NO: 57196

SEQ ID NO: 530930 - RNA, 64 nt, Human; identical to SEQ ID NO: 57197

SEQ ID NO: 530931 - RNA, 64 nt, Human; identical to SEQ ID NO: 57198

SEQ ID NO: 530932 - RNA, 64 nt, Human; identical to SEQ ID NO: 57199

SEQ ID NO: 530933 - RNA, 64 nt, Human; identical to SEQ ID NO: 57200

SEQ ID NO: 530934 - RNA, 64 nt, Human; identical to SEQ ID NO: 57201

SEQ ID NO: 530935 - RNA, 64 nt, Human; identical to SEQ ID NO: 57202

SEQ ID NO: 530936 - RNA, 64 nt, Human; identical to SEQ ID NO: 57203

SEQ ID NO: 530937 - RNA, 64 nt, Human; identical to SEQ ID NO: 57204

SEQ ID NO: 530938 - RNA, 64 nt, Human; identical to SEQ ID NO: 57205

SEQ ID NO: 530939 - RNA, 64 nt, Human; identical to SEQ ID NO: 57206

SEQ ID NO: 530940 - RNA, 64 nt, Human; identical to SEQ ID NO: 57207

SEQ ID NO: 530941 - RNA, 64 nt, Human; identical to SEQ ID NO: 57208

SEQ ID NO: 530942 - RNA, 64 nt, Human
agagcagagagagagagagagagagagagugucuucaugccaaccacagccuguuucugcugag

SEQ ID NO: 530943 - RNA, 64 nt, Human
ugggaggauugcuugagccuagagugagcuauuaucaugccacuguacagccuggguguucaca

SEQ ID NO: 530944 - RNA, 64 nt, Human
uuuaauaauauucaaaaguugacucuccuguggcucaugccacaggaucccagcacuuugggag

SEQ ID NO: 530945 - RNA, 64 nt, Human; identical to SEQ ID NO: 57209

SEQ ID NO: 530946 - RNA, 64 nt, Human; identical to SEQ ID NO: 57210

SEQ ID NO: 530947 - RNA, 64 nt, Human; identical to SEQ ID NO: 57211

SEQ ID NO: 530948 - RNA, 64 nt, Human; identical to SEQ ID NO: 57212

SEQ ID NO: 530949 - RNA, 64 nt, Human; identical to SEQ ID NO: 57213

SEQ ID NO: 530950 - RNA, 64 nt, Human; identical to SEQ ID NO: 57214

SEQ ID NO: 530951 - RNA, 64 nt, Human; identical to SEQ ID NO: 57215

SEQ ID NO: 530952 - RNA, 64 nt, Human; identical to SEQ ID NO: 57216

SEQ ID NO: 530953 - RNA, 64 nt, Human; identical to SEQ ID NO: 57217

SEQ ID NO: 530954 - RNA, 64 nt, Human; identical to SEQ ID NO: 57218

SEQ ID NO: 530955 - RNA, 64 nt, Human; identical to SEQ ID NO: 57219

SEQ ID NO: 530956 - RNA, 64 nt, Human; identical to SEQ ID NO: 57220

SEQ ID NO: 530957 - RNA, 64 nt, Human; identical to SEQ ID NO: 57221

SEQ ID NO: 530958 - RNA, 64 nt, Human; identical to SEQ ID NO: 57222

SEQ ID NO: 530959 - RNA, 64 nt, Human; identical to SEQ ID NO: 57223

SEQ ID NO: 530960 - RNA, 64 nt, Human; identical to SEQ ID NO: 57224

SEQ ID NO: 530961 - RNA, 64 nt, Human
cauaagagaaaguauauuuuaacagcauuacauuucaugccaauugacaaguuuugccaauuuu

SEQ ID NO: 530962 - RNA, 64 nt, Human
aauuaucuucgcuuuuuuaauguggccucaaaugucaugccaauuuucacaucuuccacaaacu

SEQ ID NO: 530963 - RNA, 64 nt, Human
aguggaauauuuggugccauuuacaacauuauuuucaugccaauaaaagauuuuuuuugcaaau

SEQ ID NO: 530964 - RNA, 64 nt, Human
uuuuuagcuauuugacagauuaaaagcaaaauaaucaugccauauuuaguccuggaguucaagu

SEQ ID NO: 530965 - RNA, 64 nt, Human; identical to SEQ ID NO: 57225

SEQ ID NO: 530966 - RNA, 64 nt, Human; identical to SEQ ID NO: 57226

SEQ ID NO: 530967 - RNA, 55 nt, Human; identical to SEQ ID NO: 57227

SEQ ID NO: 530968 - RNA, 64 nt, Human; identical to SEQ ID NO: 57228

SEQ ID NO: 530969 - RNA, 64 nt, Human; identical to SEQ ID NO: 57229

SEQ ID NO: 530970 - RNA, 64 nt, Human; identical to SEQ ID NO: 57230

SEQ ID NO: 530971 - RNA, 64 nt, Human; identical to SEQ ID NO: 57231

SEQ ID NO: 530972 - RNA, 64 nt, Human; identical to SEQ ID NO: 57232

SEQ ID NO: 530973 - RNA, 64 nt, Human; identical to SEQ ID NO: 57233

SEQ ID NO: 530974 - RNA, 64 nt, Human; identical to SEQ ID NO: 57234

SEQ ID NO: 530975 - RNA, 64 nt, Human; identical to SEQ ID NO: 57235

SEQ ID NO: 530976 - RNA, 64 nt, Human; identical to SEQ ID NO: 57236

SEQ ID NO: 530977 - RNA, 64 nt, Human; identical to SEQ ID NO: 57237

SEQ ID NO: 530978 - RNA, 64 nt, Human; identical to SEQ ID NO: 57238

SEQ ID NO: 530979 - RNA, 64 nt, Human; identical to SEQ ID NO: 57239

SEQ ID NO: 530980 - RNA, 64 nt, Human; identical to SEQ ID NO: 57240

SEQ ID NO: 530981 - RNA, 64 nt, Human
gagcccaggagauggagguugcagugagccaagaucaugccacugcacuccagacugggcaaca

SEQ ID NO: 530982 - RNA, 64 nt, Human
caaaauauuugugaaagugccaaaauaaagucugucaugccaaaaguaaaucauuguauagacu

SEQ ID NO: 530983 - RNA, 64 nt, Human
gugugaaacuuucauaacacauguucaaauuuuaucaugccaguaggagaaaucucagcuccac

SEQ ID NO: 530984 - RNA, 64 nt, Human
guaccugguucugcccuuggaagccauuuccugcucaugccacuaacagcaugcugccaaacug

SEQ ID NO: 530985 - RNA, 64 nt, Human; identical to SEQ ID NO: 57241

SEQ ID NO: 530986 - RNA, 64 nt, Human; identical to SEQ ID NO: 57242

SEQ ID NO: 530987 - RNA, 64 nt, Human; identical to SEQ ID NO: 57243

SEQ ID NO: 530988 - RNA, 64 nt, Human; identical to SEQ ID NO: 57244

SEQ ID NO: 530989 - RNA, 64 nt, Human; identical to SEQ ID NO: 57245

SEQ ID NO: 530990 - RNA, 64 nt, Human; identical to SEQ ID NO: 57246

SEQ ID NO: 530991 - RNA, 64 nt, Human; identical to SEQ ID NO: 57247

SEQ ID NO: 530992 - RNA, 64 nt, Human; identical to SEQ ID NO: 57248

SEQ ID NO: 530993 - RNA, 64 nt, Human; identical to SEQ ID NO: 57249

SEQ ID NO: 530994 - RNA, 64 nt, Human; identical to SEQ ID NO: 57250

SEQ ID NO: 530995 - RNA, 64 nt, Human; identical to SEQ ID NO: 57251

SEQ ID NO: 530996 - RNA, 64 nt, Human; identical to SEQ ID NO: 57252

SEQ ID NO: 530997 - RNA, 64 nt, Human; identical to SEQ ID NO: 57253

SEQ ID NO: 530998 - RNA, 64 nt, Human; identical to SEQ ID NO: 57254

SEQ ID NO: 530999 - RNA, 64 nt, Human; identical to SEQ ID NO: 57255

SEQ ID NO: 531000 - RNA, 64 nt, Human; identical to SEQ ID NO: 57256

SEQ ID NO: 531001 - RNA, 64 nt, Human
gaacccgggaggcggagguugcagugagccuagaucaugccacugcacuccaaccugggcagca

SEQ ID NO: 531002 - RNA, 64 nt, Human
acagauucagcucuucucuccuuacauuuuacauucaugccacauucaauauuuugauucuugc

SEQ ID NO: 531003 - RNA, 64 nt, Human
ugccucagccucccaaguagcugggauuacagacucaugccaccacgccagcuaauuuuuguau

SEQ ID NO: 531004 - RNA, 64 nt, Human
aggaaaggacaauaagauuuuuuaucaaaaugugucaugccaguaagagauguuauauucuuuu

SEQ ID NO: 531005 - RNA, 64 nt, Human; identical to SEQ ID NO: 57257

SEQ ID NO: 531006 - RNA, 64 nt, Human; identical to SEQ ID NO: 57258

SEQ ID NO: 531007 - RNA, 64 nt, Human; identical to SEQ ID NO: 57259

SEQ ID NO: 531008 - RNA, 64 nt, Human; identical to SEQ ID NO: 57260

SEQ ID NO: 531009 - RNA, 64 nt, Human; identical to SEQ ID NO: 57261

SEQ ID NO: 531010 - RNA, 64 nt, Human; identical to SEQ ID NO: 57262

SEQ ID NO: 531011 - RNA, 64 nt, Human; identical to SEQ ID NO: 57263

SEQ ID NO: 531012 - RNA, 64 nt, Human; identical to SEQ ID NO: 57264

SEQ ID NO: 531013 - RNA, 64 nt, Human; identical to SEQ ID NO: 57265

SEQ ID NO: 531014 - RNA, 64 nt, Human; identical to SEQ ID NO: 57266

SEQ ID NO: 531015 - RNA, 64 nt, Human; identical to SEQ ID NO: 57267

SEQ ID NO: 531016 - RNA, 64 nt, Human; identical to SEQ ID NO: 57268

SEQ ID NO: 531017 - RNA, 64 nt, Human; identical to SEQ ID NO: 57269

SEQ ID NO: 531018 - RNA, 64 nt, Human; identical to SEQ ID NO: 57270

SEQ ID NO: 531019 - RNA, 64 nt, Human; identical to SEQ ID NO: 57271

SEQ ID NO: 531020 - RNA, 64 nt, Human; identical to SEQ ID NO: 57272

SEQ ID NO: 531021 - RNA, 64 nt, Human
cuuugcccugucugaccugaacuugcuuagggagucaugccacuccccacuguggccauaguuu

SEQ ID NO: 531022 - RNA, 64 nt, Human
gccagagaagcuuuuacgcauggaaaaacacuaaucaugccaagguguauguguuuaagggggu

SEQ ID NO: 531023 - RNA, 64 nt, Human
gagcccaggaggucaaggguacagugagccgaggucaugccacugcacuccagccuggccuggg

SEQ ID NO: 531024 - RNA, 64 nt, Human; identical to SEQ ID NO: 57273

SEQ ID NO: 531025 - RNA, 64 nt, Human; identical to SEQ ID NO: 57274

SEQ ID NO: 531026 - RNA, 64 nt, Human; identical to SEQ ID NO: 57275

SEQ ID NO: 531027 - RNA, 64 nt, Human; identical to SEQ ID NO: 57276

SEQ ID NO: 531028 - RNA, 64 nt, Human; identical to SEQ ID NO: 57277

SEQ ID NO: 531029 - RNA, 64 nt, Human; identical to SEQ ID NO: 57278

SEQ ID NO: 531030 - RNA, 64 nt, Human; identical to SEQ ID NO: 57279

SEQ ID NO: 531031 - RNA, 64 nt, Human; identical to SEQ ID NO: 57280

SEQ ID NO: 531032 - RNA, 64 nt, Human; identical to SEQ ID NO: 57281

SEQ ID NO: 531033 - RNA, 64 nt, Human; identical to SEQ ID NO: 57282

SEQ ID NO: 531034 - RNA, 64 nt, Human; identical to SEQ ID NO: 57283

SEQ ID NO: 531035 - RNA, 64 nt, Human; identical to SEQ ID NO: 57284

SEQ ID NO: 531036 - RNA, 64 nt, Human; identical to SEQ ID NO: 57285

SEQ ID NO: 531037 - RNA, 64 nt, Human; identical to SEQ ID NO: 57286

SEQ ID NO: 531038 - RNA, 64 nt, Human; identical to SEQ ID NO: 57287

SEQ ID NO: 531039 - RNA, 64 nt, Human; identical to SEQ ID NO: 57288

SEQ ID NO: 531040 - RNA, 64 nt, Human
uggcaucugugauaaacuaucaaugaggcucccaucaugccauuuuuuguucauuuuaaucuuu

SEQ ID NO: 531041 - RNA, 64 nt, Human
aaucucgggucacugcaagcucugccucccaaguucaugccauucuccugccucagccucccaa

SEQ ID NO: 531042 - RNA, 64 nt, Human
gucucaagaacaagaauaaaauugaaaucugcauucaugccaauucagcauaaaaaagaauagg

SEQ ID NO: 531043 - RNA, 64 nt, Human; identical to SEQ ID NO: 57289

SEQ ID NO: 531044 - RNA, 64 nt, Human; identical to SEQ ID NO: 57290

SEQ ID NO: 531045 - RNA, 64 nt, Human; identical to SEQ ID NO: 57291

SEQ ID NO: 531046 - RNA, 64 nt, Human; identical to SEQ ID NO: 57292

SEQ ID NO: 531047 - RNA, 64 nt, Human; identical to SEQ ID NO: 57293

SEQ ID NO: 531048 - RNA, 64 nt, Human; identical to SEQ ID NO: 57294

SEQ ID NO: 531049 - RNA, 64 nt, Human; identical to SEQ ID NO: 57295

SEQ ID NO: 531050 - RNA, 64 nt, Human; identical to SEQ ID NO: 57296

SEQ ID NO: 531051 - RNA, 64 nt, Human; identical to SEQ ID NO: 57297

SEQ ID NO: 531052 - RNA, 63 nt, Human; identical to SEQ ID NO: 57298

SEQ ID NO: 531053 - RNA, 64 nt, Human; identical to SEQ ID NO: 57299

SEQ ID NO: 531054 - RNA, 64 nt, Human; identical to SEQ ID NO: 57300

SEQ ID NO: 531055 - RNA, 64 nt, Human; identical to SEQ ID NO: 57301

SEQ ID NO: 531056 - RNA, 64 nt, Human; identical to SEQ ID NO: 57302

SEQ ID NO: 531057 - RNA, 64 nt, Human; identical to SEQ ID NO: 57303

SEQ ID NO: 531058 - RNA, 64 nt, Human; identical to SEQ ID NO: 57304

SEQ ID NO: 531059 - RNA, 64 nt, Human
aaccugggaagucgaggcugcaagugagcugagaucaugccauggcagucuagccugggcaaca

SEQ ID NO: 531060 - RNA, 64 nt, Human
auugguccuuuuauaaacauugguauauuuccauucaugccaaagcaaaagaaguaaaagcuaa

SEQ ID NO: 531061 - RNA, 64 nt, Human
gacccacggcucucgucccucugcuccgugugucucaugccagcagcacgucgccauccgucac

SEQ ID NO: 531062 - RNA, 64 nt, Human
gaaccugggaggcagagucugcagugagccgagaucaugccacugcacuccagccugggugaca

SEQ ID NO: 531063 - RNA, 64 nt, Human; identical to SEQ ID NO: 57305

SEQ ID NO: 531064 - RNA, 64 nt, Human; identical to SEQ ID NO: 57306

SEQ ID NO: 531065 - RNA, 64 nt, Human; identical to SEQ ID NO: 57307

SEQ ID NO: 531066 - RNA, 64 nt, Human; identical to SEQ ID NO: 57308

SEQ ID NO: 531067 - RNA, 64 nt, Human; identical to SEQ ID NO: 57309

SEQ ID NO: 531068 - RNA, 64 nt, Human; identical to SEQ ID NO: 57310

SEQ ID NO: 531069 - RNA, 64 nt, Human; identical to SEQ ID NO: 57311

SEQ ID NO: 531070 - RNA, 64 nt, Human; identical to SEQ ID NO: 57312

SEQ ID NO: 531071 - RNA, 64 nt, Human; identical to SEQ ID NO: 57313

SEQ ID NO: 531072 - RNA, 64 nt, Human; identical to SEQ ID NO: 57314

SEQ ID NO: 531073 - RNA, 64 nt, Human; identical to SEQ ID NO: 57315

SEQ ID NO: 531074 - RNA, 64 nt, Human; identical to SEQ ID NO: 57316

SEQ ID NO: 531075 - RNA, 64 nt, Human; identical to SEQ ID NO: 57317

SEQ ID NO: 531076 - RNA, 64 nt, Human; identical to SEQ ID NO: 57318

SEQ ID NO: 531077 - RNA, 64 nt, Human; identical to SEQ ID NO: 57319

SEQ ID NO: 531078 - RNA, 64 nt, Human; identical to SEQ ID NO: 57320

SEQ ID NO: 531079 - RNA, 64 nt, Human
gaugaccuggcauguggaguuacagagggaucccucaugccacugcugccaccaccucuuccug

SEQ ID NO: 531080 - RNA, 64 nt, Human
accacgugaaggaaugagauuagcaccacaaguuucaugccaauaaaagagacuggugugaucc

SEQ ID NO: 531081 - RNA, 64 nt, Human
gggcccuagacauuuccagcaaaaccuggaacuuucaugccaaaccuggggcagggcaggaaac

SEQ ID NO: 531082 - RNA, 64 nt, Human; identical to SEQ ID NO: 57321

SEQ ID NO: 531083 - RNA, 64 nt, Human; identical to SEQ ID NO: 57322

SEQ ID NO: 531084 - RNA, 64 nt, Human; identical to SEQ ID NO: 57323

SEQ ID NO: 531085 - RNA, 64 nt, Human; identical to SEQ ID NO: 57324

SEQ ID NO: 531086 - RNA, 64 nt, Human; identical to SEQ ID NO: 57325

SEQ ID NO: 531087 - RNA, 64 nt, Human; identical to SEQ ID NO: 57326

SEQ ID NO: 531088 - RNA, 64 nt, Human; identical to SEQ ID NO: 57327

SEQ ID NO: 531089 - RNA, 64 nt, Human; identical to SEQ ID NO: 57328

SEQ ID NO: 531090 - RNA, 64 nt, Human; identical to SEQ ID NO: 57329

SEQ ID NO: 531091 - RNA, 64 nt, Human; identical to SEQ ID NO: 57330

SEQ ID NO: 531092 - RNA, 64 nt, Human; identical to SEQ ID NO: 57331

SEQ ID NO: 531093 - RNA, 64 nt, Human; identical to SEQ ID NO: 57332

SEQ ID NO: 531094 - RNA, 64 nt, Human; identical to SEQ ID NO: 57333

SEQ ID NO: 531095 - RNA, 64 nt, Human; identical to SEQ ID NO: 57334

SEQ ID NO: 531096 - RNA, 64 nt, Human; identical to SEQ ID NO: 57335

SEQ ID NO: 531097 - RNA, 64 nt, Human; identical to SEQ ID NO: 57336

SEQ ID NO: 531098 - RNA, 60 nt, Human
agaaaaaaggcagaagcccuggauucaaauccgccacacauucaguuucuuuaucuguaa

SEQ ID NO: 531099 - RNA, 60 nt, Human
cgcccaggacccuggccugcagagacgcccccgccacaggauccagagcaagcaccgccc

SEQ ID NO: 531100 - RNA, 60 nt, Human
ggagacagagcuggaccugcagggguggucccgccacaacccugcguguggacccuggca

SEQ ID NO: 531101 - RNA, 60 nt, Human
ucccucaccuccugaccggccacauccuugccgccacaucccggguggcucuggggcucu

SEQ ID NO: 531102 - RNA, 64 nt, Human; identical to SEQ ID NO: 57337

SEQ ID NO: 531103 - RNA, 64 nt, Human; identical to SEQ ID NO: 57338

SEQ ID NO: 531104 - RNA, 64 nt, Human; identical to SEQ ID NO: 57339

SEQ ID NO: 531105 - RNA, 64 nt, Human; identical to SEQ ID NO: 57340

SEQ ID NO: 531106 - RNA, 64 nt, Human; identical to SEQ ID NO: 57341

SEQ ID NO: 531107 - RNA, 64 nt, Human; identical to SEQ ID NO: 57342

SEQ ID NO: 531108 - RNA, 64 nt, Human; identical to SEQ ID NO: 57343

SEQ ID NO: 531109 - RNA, 64 nt, Human; identical to SEQ ID NO: 57344

SEQ ID NO: 531110 - RNA, 64 nt, Human; identical to SEQ ID NO: 57345

SEQ ID NO: 531111 - RNA, 64 nt, Human; identical to SEQ ID NO: 57346

SEQ ID NO: 531112 - RNA, 64 nt, Human; identical to SEQ ID NO: 57347

SEQ ID NO: 531113 - RNA, 64 nt, Human; identical to SEQ ID NO: 57348

SEQ ID NO: 531114 - RNA, 64 nt, Human; identical to SEQ ID NO: 57349

SEQ ID NO: 531115 - RNA, 64 nt, Human; identical to SEQ ID NO: 57350

SEQ ID NO: 531116 - RNA, 64 nt, Human; identical to SEQ ID NO: 57351

SEQ ID NO: 531117 - RNA, 64 nt, Human; identical to SEQ ID NO: 57352

SEQ ID NO: 531118 - RNA, 64 nt, Human
gaaccugggaggcagagguugcagugagcugagaucaugccacugugcuccagccugguggcac

SEQ ID NO: 531119 - RNA, 64 nt, Human; identical to SEQ ID NO: 531062

SEQ ID NO: 531120 - RNA, 64 nt, Human
cuuccugugcccugcaaauauuagcaaagaagcuucaugccagguuaggaaggcagcauuccau

SEQ ID NO: 531121 - RNA, 64 nt, Human; identical to SEQ ID NO: 57353

SEQ ID NO: 531122 - RNA, 64 nt, Human; identical to SEQ ID NO: 57354

SEQ ID NO: 531123 - RNA, 64 nt, Human; identical to SEQ ID NO: 57355

SEQ ID NO: 531124 - RNA, 64 nt, Human; identical to SEQ ID NO: 57356

SEQ ID NO: 531125 - RNA, 64 nt, Human; identical to SEQ ID NO: 57357

SEQ ID NO: 531126 - RNA, 64 nt, Human; identical to SEQ ID NO: 57358

SEQ ID NO: 531127 - RNA, 64 nt, Human; identical to SEQ ID NO: 57359

SEQ ID NO: 531128 - RNA, 64 nt, Human; identical to SEQ ID NO: 57360

SEQ ID NO: 531129 - RNA, 64 nt, Human; identical to SEQ ID NO: 57361

SEQ ID NO: 531130 - RNA, 64 nt, Human; identical to SEQ ID NO: 57362

SEQ ID NO: 531131 - RNA, 64 nt, Human; identical to SEQ ID NO: 57363

SEQ ID NO: 531132 - RNA, 64 nt, Human; identical to SEQ ID NO: 57364

SEQ ID NO: 531133 - RNA, 64 nt, Human; identical to SEQ ID NO: 57365

SEQ ID NO: 531134 - RNA, 64 nt, Human; identical to SEQ ID NO: 57366

SEQ ID NO: 531135 - RNA, 64 nt, Human; identical to SEQ ID NO: 57367

SEQ ID NO: 531136 - RNA, 64 nt, Human; identical to SEQ ID NO: 57368

SEQ ID NO: 531137 - RNA, 64 nt, Human
cacuauccuaacugccucaugccccuucacuaguucaugccaagaacgugacuggaaaggcaug

SEQ ID NO: 531138 - RNA, 64 nt, Human
gaggcugaaauguuuauucugcuucucccguguuucaugccaucucgcgucccccuuccugcac

SEQ ID NO: 531139 - RNA, 64 nt, Human
uugaacccauuuacugaucucuguuguauauuuuucaugccacugcuuuguuuucuccucagaa

SEQ ID NO: 531140 - RNA, 64 nt, Human; identical to SEQ ID NO: 57369

SEQ ID NO: 531141 - RNA, 64 nt, Human; identical to SEQ ID NO: 57370

SEQ ID NO: 531142 - RNA, 64 nt, Human; identical to SEQ ID NO: 57371

SEQ ID NO: 531143 - RNA, 64 nt, Human; identical to SEQ ID NO: 57372

SEQ ID NO: 531144 - RNA, 64 nt, Human; identical to SEQ ID NO: 57373

SEQ ID NO: 531145 - RNA, 64 nt, Human; identical to SEQ ID NO: 57374

SEQ ID NO: 531146 - RNA, 64 nt, Human; identical to SEQ ID NO: 57375

SEQ ID NO: 531147 - RNA, 64 nt, Human; identical to SEQ ID NO: 57376

SEQ ID NO: 531148 - RNA, 64 nt, Human; identical to SEQ ID NO: 57377

SEQ ID NO: 531149 - RNA, 64 nt, Human; identical to SEQ ID NO: 57378

SEQ ID NO: 531150 - RNA, 64 nt, Human; identical to SEQ ID NO: 57379

SEQ ID NO: 531151 - RNA, 64 nt, Human; identical to SEQ ID NO: 57380

SEQ ID NO: 531152 - RNA, 64 nt, Human; identical to SEQ ID NO: 57381

SEQ ID NO: 531153 - RNA, 64 nt, Human; identical to SEQ ID NO: 57382

SEQ ID NO: 531154 - RNA, 64 nt, Human; identical to SEQ ID NO: 57383

SEQ ID NO: 531155 - RNA, 64 nt, Human; identical to SEQ ID NO: 57384

SEQ ID NO: 531156 - RNA, 64 nt, Human
guuggaggugggacgaugagacuuugaaacuaucucaugccagugccuuauuacccaggaagau

SEQ ID NO: 531157 - RNA, 64 nt, Human
aagcaaauguuagaaucuuaggcauccuauuuguucaugccauggguauuugcuuuggacuugg

SEQ ID NO: 531158 - RNA, 64 nt, Human
caaaaacaauguuugggggaaaaaaaagaaaaaaucaugccagcuaaucaugucaaguucacug

SEQ ID NO: 531159 - RNA, 64 nt, Human; identical to SEQ ID NO: 57385

SEQ ID NO: 531160 - RNA, 64 nt, Human; identical to SEQ ID NO: 57386

SEQ ID NO: 531161 - RNA, 64 nt, Human; identical to SEQ ID NO: 57387

SEQ ID NO: 531162 - RNA, 64 nt, Human; identical to SEQ ID NO: 57388

SEQ ID NO: 531163 - RNA, 64 nt, Human; identical to SEQ ID NO: 57389

SEQ ID NO: 531164 - RNA, 64 nt, Human; identical to SEQ ID NO: 57390

SEQ ID NO: 531165 - RNA, 64 nt, Human; identical to SEQ ID NO: 57391

SEQ ID NO: 531166 - RNA, 64 nt, Human; identical to SEQ ID NO: 57392

SEQ ID NO: 531167 - RNA, 64 nt, Human; identical to SEQ ID NO: 57393

SEQ ID NO: 531168 - RNA, 64 nt, Human; identical to SEQ ID NO: 57394

SEQ ID NO: 531169 - RNA, 64 nt, Human; identical to SEQ ID NO: 57395

SEQ ID NO: 531170 - RNA, 64 nt, Human; identical to SEQ ID NO: 57396

SEQ ID NO: 531171 - RNA, 64 nt, Human; identical to SEQ ID NO: 57397

SEQ ID NO: 531172 - RNA, 64 nt, Human; identical to SEQ ID NO: 57398

SEQ ID NO: 531173 - RNA, 64 nt, Human; identical to SEQ ID NO: 57399

SEQ ID NO: 531174 - RNA, 64 nt, Human; identical to SEQ ID NO: 57400

SEQ ID NO: 531175 - RNA, 64 nt, Human
auaacuuuugguguuguagcuaaauaaggaauacucaugccaagauugcacaauugugccuccu

SEQ ID NO: 531176 - RNA, 64 nt, Human
cacugccauggcacaccagucauggaucuuguaaucaugccaagagaauagauacauuauggac

SEQ ID NO: 531177 - RNA, 64 nt, Human
aaaagaggaacagguggauguauagcauuuuuauucaugccaucuguuuucaaccaacuauuuu

SEQ ID NO: 531178 - RNA, 64 nt, Human; identical to SEQ ID NO: 57401

SEQ ID NO: 531179 - RNA, 64 nt, Human; identical to SEQ ID NO: 57402

SEQ ID NO: 531180 - RNA, 64 nt, Human; identical to SEQ ID NO: 57403

SEQ ID NO: 531181 - RNA, 64 nt, Human; identical to SEQ ID NO: 57404

SEQ ID NO: 531182 - RNA, 64 nt, Human; identical to SEQ ID NO: 57405

SEQ ID NO: 531183 - RNA, 64 nt, Human; identical to SEQ ID NO: 57406

SEQ ID NO: 531184 - RNA, 64 nt, Human; identical to SEQ ID NO: 57407

SEQ ID NO: 531185 - RNA, 64 nt, Human; identical to SEQ ID NO: 57408

SEQ ID NO: 531186 - RNA, 64 nt, Human; identical to SEQ ID NO: 57409

SEQ ID NO: 531187 - RNA, 64 nt, Human; identical to SEQ ID NO: 57410

SEQ ID NO: 531188 - RNA, 64 nt, Human; identical to SEQ ID NO: 57411

SEQ ID NO: 531189 - RNA, 64 nt, Human; identical to SEQ ID NO: 57412

SEQ ID NO: 531190 - RNA, 64 nt, Human; identical to SEQ ID NO: 57413

SEQ ID NO: 531191 - RNA, 64 nt, Human; identical to SEQ ID NO: 57414

SEQ ID NO: 531192 - RNA, 64 nt, Human; identical to SEQ ID NO: 57415

SEQ ID NO: 531193 - RNA, 64 nt, Human; identical to SEQ ID NO: 57416

SEQ ID NO: 531194 - RNA, 64 nt, Human
cuaaaggacuggacucaaacaaaaacgaggucaaucaugccauugaccgagugaccacuucugu

SEQ ID NO: 531195 - RNA, 64 nt, Human
gaacccuggagguggagguugcagugagccgagaucaugccacugcacugcacuccagccuggg

SEQ ID NO: 531196 - RNA, 64 nt, Human
ugaacccaggaguggagguugcagugagcugagaucaugccacugcacuccagccugggcgaca

SEQ ID NO: 531197 - RNA, 64 nt, Human; identical to SEQ ID NO: 57417

SEQ ID NO: 531198 - RNA, 64 nt, Human; identical to SEQ ID NO: 57418

SEQ ID NO: 531199 - RNA, 64 nt, Human; identical to SEQ ID NO: 57419

SEQ ID NO: 531200 - RNA, 64 nt, Human; identical to SEQ ID NO: 57420

SEQ ID NO: 531201 - RNA, 64 nt, Human; identical to SEQ ID NO: 57421

SEQ ID NO: 531202 - RNA, 64 nt, Human; identical to SEQ ID NO: 57422

SEQ ID NO: 531203 - RNA, 64 nt, Human; identical to SEQ ID NO: 57423

SEQ ID NO: 531204 - RNA, 64 nt, Human; identical to SEQ ID NO: 57424

SEQ ID NO: 531205 - RNA, 64 nt, Human; identical to SEQ ID NO: 57425

SEQ ID NO: 531206 - RNA, 64 nt, Human; identical to SEQ ID NO: 57426

SEQ ID NO: 531207 - RNA, 64 nt, Human; identical to SEQ ID NO: 57427

SEQ ID NO: 531208 - RNA, 64 nt, Human; identical to SEQ ID NO: 57428

SEQ ID NO: 531209 - RNA, 64 nt, Human; identical to SEQ ID NO: 57429

SEQ ID NO: 531210 - RNA, 64 nt, Human; identical to SEQ ID NO: 57430

SEQ ID NO: 531211 - RNA, 64 nt, Human; identical to SEQ ID NO: 57431

SEQ ID NO: 531212 - RNA, 64 nt, Human; identical to SEQ ID NO: 57432

SEQ ID NO: 531213 - RNA, 64 nt, Human
uugccuaccauguguccaccagaggcuauuuaauucaugccaacuugaaaacucuccaguuugu

SEQ ID NO: 531214 - RNA, 57 nt, Human
aaacugcuccguugcccuaacagggucucaugccauuccgaccuucaccaagcuuag

SEQ ID NO: 531215 - RNA, 60 nt, Human
aaaaaacucuuucacagugacccaugguauucaugccaacauuggugcucauuugucacu

SEQ ID NO: 531216 - RNA, 60 nt, Human
aggaaggcuagaguuacccagagcaucaggccgccacaagugccugcuuuuaggagaccg

SEQ ID NO: 531217 - RNA, 64 nt, Human; identical to SEQ ID NO: 57433

SEQ ID NO: 531218 - RNA, 64 nt, Human; identical to SEQ ID NO: 57434

SEQ ID NO: 531219 - RNA, 64 nt, Human; identical to SEQ ID NO: 57435

SEQ ID NO: 531220 - RNA, 64 nt, Human; identical to SEQ ID NO: 57436

SEQ ID NO: 531221 - RNA, 64 nt, Human; identical to SEQ ID NO: 57437

SEQ ID NO: 531222 - RNA, 64 nt, Human; identical to SEQ ID NO: 57438

SEQ ID NO: 531223 - RNA, 64 nt, Human; identical to SEQ ID NO: 57439

SEQ ID NO: 531224 - RNA, 64 nt, Human; identical to SEQ ID NO: 57440

SEQ ID NO: 531225 - RNA, 64 nt, Human; identical to SEQ ID NO: 57441

SEQ ID NO: 531226 - RNA, 64 nt, Human; identical to SEQ ID NO: 57442

SEQ ID NO: 531227 - RNA, 64 nt, Human; identical to SEQ ID NO: 57443

SEQ ID NO: 531228 - RNA, 64 nt, Human; identical to SEQ ID NO: 57444

SEQ ID NO: 531229 - RNA, 64 nt, Human; identical to SEQ ID NO: 57445

SEQ ID NO: 531230 - RNA, 64 nt, Human; identical to SEQ ID NO: 57446

SEQ ID NO: 531231 - RNA, 64 nt, Human; identical to SEQ ID NO: 57447

SEQ ID NO: 531232 - RNA, 64 nt, Human; identical to SEQ ID NO: 57448

SEQ ID NO: 531233 - RNA, 64 nt, Human
cuuuugcugugugugugugugugugccuuccaaaucaugccauaauuguaauguugaaucggac

SEQ ID NO: 531234 - RNA, 64 nt, Human
auaauuauuugucugucauuuacccugucaggugucaugccagguuauguauacauuuaugugg

SEQ ID NO: 531235 - RNA, 64 nt, Human
uuaguuuuuauuacuauauuaaagcaucaacauuucaugccacauaaauuauauuuaauaagaa

SEQ ID NO: 531236 - RNA, 64 nt, Human; identical to SEQ ID NO: 57449

SEQ ID NO: 531237 - RNA, 64 nt, Human; identical to SEQ ID NO: 57450

SEQ ID NO: 531238 - RNA, 64 nt, Human; identical to SEQ ID NO: 57451

SEQ ID NO: 531239 - RNA, 64 nt, Human; identical to SEQ ID NO: 57452

SEQ ID NO: 531240 - RNA, 64 nt, Human; identical to SEQ ID NO: 57453

SEQ ID NO: 531241 - RNA, 64 nt, Human; identical to SEQ ID NO: 57454

SEQ ID NO: 531242 - RNA, 64 nt, Human; identical to SEQ ID NO: 57455

SEQ ID NO: 531243 - RNA, 64 nt, Human; identical to SEQ ID NO: 57456

SEQ ID NO: 531244 - RNA, 64 nt, Human; identical to SEQ ID NO: 57457

SEQ ID NO: 531245 - RNA, 64 nt, Human; identical to SEQ ID NO: 57458

SEQ ID NO: 531246 - RNA, 64 nt, Human; identical to SEQ ID NO: 57459

SEQ ID NO: 531247 - RNA, 64 nt, Human; identical to SEQ ID NO: 57460

SEQ ID NO: 531248 - RNA, 64 nt, Human; identical to SEQ ID NO: 57461

SEQ ID NO: 531249 - RNA, 64 nt, Human; identical to SEQ ID NO: 57462

SEQ ID NO: 531250 - RNA, 64 nt, Human; identical to SEQ ID NO: 57463

SEQ ID NO: 531251 - RNA, 64 nt, Human; identical to SEQ ID NO: 57464

SEQ ID NO: 531252 - RNA, 64 nt, Human
cucucacucaauuguuaauucuuuggguucagucucaugccauauuuacuccuaguaccuaaug

SEQ ID NO: 531253 - RNA, 64 nt, Human
gaacccgggcggcggagauugcagugagccgaggucaugccacugcacugcagccugggcgaca

SEQ ID NO: 531254 - RNA, 64 nt, Human
guuuuuuaaaggaucaggcucguagggagcaggaucaugccagaaauagggauggaagugcauc

SEQ ID NO: 531255 - RNA, 64 nt, Human; identical to SEQ ID NO: 57465

SEQ ID NO: 531256 - RNA, 64 nt, Human; identical to SEQ ID NO: 57466

SEQ ID NO: 531257 - RNA, 64 nt, Human; identical to SEQ ID NO: 57467

SEQ ID NO: 531258 - RNA, 64 nt, Human; identical to SEQ ID NO: 57468

SEQ ID NO: 531259 - RNA, 64 nt, Human; identical to SEQ ID NO: 57469

SEQ ID NO: 531260 - RNA, 64 nt, Human; identical to SEQ ID NO: 57470

SEQ ID NO: 531261 - RNA, 64 nt, Human; identical to SEQ ID NO: 57471

SEQ ID NO: 531262 - RNA, 64 nt, Human; identical to SEQ ID NO: 57472

SEQ ID NO: 531263 - RNA, 64 nt, Human; identical to SEQ ID NO: 57473

SEQ ID NO: 531264 - RNA, 64 nt, Human; identical to SEQ ID NO: 57474

SEQ ID NO: 531265 - RNA, 64 nt, Human; identical to SEQ ID NO: 57475

SEQ ID NO: 531266 - RNA, 64 nt, Human; identical to SEQ ID NO: 57476

SEQ ID NO: 531267 - RNA, 64 nt, Human; identical to SEQ ID NO: 57477

SEQ ID NO: 531268 - RNA, 64 nt, Human; identical to SEQ ID NO: 57478

SEQ ID NO: 531269 - RNA, 64 nt, Human; identical to SEQ ID NO: 57479

SEQ ID NO: 531270 - RNA, 64 nt, Human; identical to SEQ ID NO: 57480

SEQ ID NO: 531271 - RNA, 64 nt, Human
gccauaggaacugggggccuucccuggacagugaucaugccaggccuggaccuuuaggccugcc

SEQ ID NO: 531272 - RNA, 64 nt, Human
aaauuucauagcuguacuucuugaauauaaaaaaucaugccaguauuuuuaaaggcauuagagu

SEQ ID NO: 531273 - RNA, 64 nt, Human
cuaucaaagcaggccugacugaccaggugucucaucaugccagauuaaagacagacugacaguu

SEQ ID NO: 531274 - RNA, 64 nt, Human; identical to SEQ ID NO: 57481

SEQ ID NO: 531275 - RNA, 64 nt, Human; identical to SEQ ID NO: 57482

SEQ ID NO: 531276 - RNA, 64 nt, Human; identical to SEQ ID NO: 57483

SEQ ID NO: 531277 - RNA, 64 nt, Human; identical to SEQ ID NO: 57484

SEQ ID NO: 531278 - RNA, 64 nt, Human; identical to SEQ ID NO: 57485

SEQ ID NO: 531279 - RNA, 64 nt, Human; identical to SEQ ID NO: 57486

SEQ ID NO: 531280 - RNA, 64 nt, Human; identical to SEQ ID NO: 57487

SEQ ID NO: 531281 - RNA, 60 nt, Human
cuccugaguagcugggauuacaggugugcgccgccacacccagcuaauuuuguauuuuua

SEQ ID NO: 531282 - RNA, 60 nt, Human
aggaauaccucugagccugcccaccgggagccgccacaucacagcacaaguggcugcagc

SEQ ID NO: 531283 - RNA, 54 nt, Human
uugagcagaugcagaacuagacccccgccacagcagccucugaaguuggacagc

SEQ ID NO: 531284 - RNA, 60 nt, Human
aucauggagcccugcgaccuacccgcccugccgccacaugcaguggaggagaggccugug

SEQ ID NO: 531285 - RNA, 64 nt, Human
guugacucuuucccucagcuccaccagcucuucaucaugccacucauuucagaacuugagcaaa

SEQ ID NO: 531286 - RNA, 64 nt, Human
gugugauaaagcauuuagucagucccccaaacagucaugccaacugugaaggaaugucccacaa

SEQ ID NO: 531287 - RNA, 64 nt, Human
aaccgaugguaauuaagcuuguauucacaagacuucaugccaaauucacuuuuuagcauuauau

SEQ ID NO: 531288 - RNA, 64 nt, Human; identical to SEQ ID NO: 417530

SEQ ID NO: 531289 - RNA, 64 nt, Human; identical to SEQ ID NO: 417531

SEQ ID NO: 531290 - RNA, 57 nt, Human; identical to SEQ ID NO: 417532

SEQ ID NO: 531291 - RNA, 64 nt, Human; identical to SEQ ID NO: 417533

SEQ ID NO: 531292 - RNA, 64 nt, Human; identical to SEQ ID NO: 417534

SEQ ID NO: 531293 - RNA, 64 nt, Human; identical to SEQ ID NO: 417535

SEQ ID NO: 531294 - RNA, 64 nt, Human; identical to SEQ ID NO: 417536

SEQ ID NO: 531295 - RNA, 64 nt, Human; identical to SEQ ID NO: 417537

SEQ ID NO: 531296 - RNA, 64 nt, Human; identical to SEQ ID NO: 417538

SEQ ID NO: 531297 - RNA, 64 nt, Human; identical to SEQ ID NO: 417539

SEQ ID NO: 531298 - RNA, 64 nt, Human; identical to SEQ ID NO: 417540

SEQ ID NO: 531299 - RNA, 64 nt, Human; identical to SEQ ID NO: 417541

SEQ ID NO: 531300 - RNA, 64 nt, Human; identical to SEQ ID NO: 417542

SEQ ID NO: 531301 - RNA, 64 nt, Human; identical to SEQ ID NO: 417543

SEQ ID NO: 531302 - RNA, 64 nt, Human
gagccugggagguggaggcuacugugagccaugaucaugccacugcacuccagccugggcaaca

SEQ ID NO: 531303 - RNA, 64 nt, Human
agucuuuucuacgauaaaaauuguauguguacuuucaugccaguauaggaaaccucaaucuuuu

SEQ ID NO: 531304 - RNA, 64 nt, Human
cagagggccuggcacuaucaccaccucucugccuucaugccaauaauaaagcugaucuuuauuc

SEQ ID NO: 531305 - RNA, 64 nt, Human; identical to SEQ ID NO: 417544

SEQ ID NO: 531306 - RNA, 64 nt, Human; identical to SEQ ID NO: 414404

SEQ ID NO: 531307 - RNA, 64 nt, Human; identical to SEQ ID NO: 414405

SEQ ID NO: 531308 - RNA, 64 nt, Human; identical to SEQ ID NO: 410988

SEQ ID NO: 531309 - RNA, 64 nt, Human; identical to SEQ ID NO: 417453

SEQ ID NO: 531310 - RNA, 64 nt, Human; identical to SEQ ID NO: 417454

SEQ ID NO: 531311 - RNA, 64 nt, Human; identical to SEQ ID NO: 417455

SEQ ID NO: 531312 - RNA, 64 nt, Human; identical to SEQ ID NO: 417317

SEQ ID NO: 531313 - RNA, 64 nt, Human; identical to SEQ ID NO: 417318

SEQ ID NO: 531314 - RNA, 64 nt, Human; identical to SEQ ID NO: 410989

SEQ ID NO: 531315 - RNA, 64 nt, Human; identical to SEQ ID NO: 417487

SEQ ID NO: 531316 - RNA, 64 nt, Human; identical to SEQ ID NO: 417488

SEQ ID NO: 531317 - RNA, 64 nt, Human; identical to SEQ ID NO: 417489

SEQ ID NO: 531318 - RNA, 64 nt, Human; identical to SEQ ID NO: 417266

SEQ ID NO: 531319 - RNA, 64 nt, Human; identical to SEQ ID NO: 417267

SEQ ID NO: 531320 - RNA, 64 nt, Human; identical to SEQ ID NO: 410990

SEQ ID NO: 531321 - RNA, 64 nt, Human
gccgccucuaacaaacaccaugguccguggaaguucaugccagcagcuugccuuugagaagaaa

SEQ ID NO: 531322 - RNA, 64 nt, Human
agaaacuuaauacaaaugaacuagagguuuguaaucaugccacucacuaacgauuuuauuucug

SEQ ID NO: 531323 - RNA, 64 nt, Human
gaacccaggaggcagagguugcagugagcugagaucaugccauugcacuccaaccugggugaca

SEQ ID NO: 531324 - RNA, 64 nt, Human; identical to SEQ ID NO: 417503

SEQ ID NO: 531325 - RNA, 64 nt, Human; identical to SEQ ID NO: 417504

SEQ ID NO: 531326 - RNA, 64 nt, Human; identical to SEQ ID NO: 417505

SEQ ID NO: 531327 - RNA, 64 nt, Human; identical to SEQ ID NO: 417522

SEQ ID NO: 531328 - RNA, 64 nt, Human; identical to SEQ ID NO: 417523

SEQ ID NO: 531329 - RNA, 64 nt, Human; identical to SEQ ID NO: 414123

SEQ ID NO: 531330 - RNA, 64 nt, Human; identical to SEQ ID NO: 417232

SEQ ID NO: 531331 - RNA, 64 nt, Human; identical to SEQ ID NO: 417233

SEQ ID NO: 531332 - RNA, 64 nt, Human; identical to SEQ ID NO: 417234

SEQ ID NO: 531333 - RNA, 64 nt, Human; identical to SEQ ID NO: 417524

SEQ ID NO: 531334 - RNA, 64 nt, Human; identical to SEQ ID NO: 414124

SEQ ID NO: 531335 - RNA, 64 nt, Human; identical to SEQ ID NO: 417249

SEQ ID NO: 531336 - RNA, 60 nt, Human; identical to SEQ ID NO: 417250

SEQ ID NO: 531337 - RNA, 64 nt, Human; identical to SEQ ID NO: 417251

SEQ ID NO: 531338 - RNA, 64 nt, Human; identical to SEQ ID NO: 417268

SEQ ID NO: 531339 - RNA, 64 nt, Human; identical to SEQ ID NO: 414125

SEQ ID NO: 531340 - RNA, 64 nt, Human
aucacaagccacaggaugagaaguucugacucacucaugccaugcccagggcuaucugaaacaa

SEQ ID NO: 531341 - RNA, 64 nt, Human
uaucucagcucacugcaagcuccaccuccuggguucaugccauucuucugccucagccucccaa

SEQ ID NO: 531342 - RNA, 64 nt, Human
uucuggcauuguguguuuuuguaugcacuccccuucaugccacuucagauguuuauuuggaugu

SEQ ID NO: 531343 - RNA, 64 nt, Human; identical to SEQ ID NO: 417283

SEQ ID NO: 531344 - RNA, 64 nt, Human; identical to SEQ ID NO: 417284

SEQ ID NO: 531345 - RNA, 64 nt, Human; identical to SEQ ID NO: 417285

SEQ ID NO: 531346 - RNA, 64 nt, Human; identical to SEQ ID NO: 417300

SEQ ID NO: 531347 - RNA, 64 nt, Human; identical to SEQ ID NO: 417301

SEQ ID NO: 531348 - RNA, 64 nt, Human; identical to SEQ ID NO: 414141

SEQ ID NO: 531349 - RNA, 64 nt, Human; identical to SEQ ID NO: 417319

SEQ ID NO: 531350 - RNA, 64 nt, Human; identical to SEQ ID NO: 417402

SEQ ID NO: 531351 - RNA, 64 nt, Human; identical to SEQ ID NO: 417403

SEQ ID NO: 531352 - RNA, 64 nt, Human; identical to SEQ ID NO: 414142

SEQ ID NO: 531353 - RNA, 64 nt, Human; identical to SEQ ID NO: 417334

SEQ ID NO: 531354 - RNA, 64 nt, Human; identical to SEQ ID NO: 417335

SEQ ID NO: 531355 - RNA, 64 nt, Human; identical to SEQ ID NO: 417336

SEQ ID NO: 531356 - RNA, 64 nt, Human; identical to SEQ ID NO: 417181

SEQ ID NO: 531357 - RNA, 64 nt, Human; identical to SEQ ID NO: 417182

SEQ ID NO: 531358 - RNA, 64 nt, Human; identical to SEQ ID NO: 414143

SEQ ID NO: 531359 - RNA, 64 nt, Human
gaucucggcucuaugcaaccuccaccuccuggguucaugccauucuccugccucagccucccga

SEQ ID NO: 531360 - RNA, 64 nt, Human
aaaugaccucaauacacuaaugccaaccucagcgucaugccagaaugcacagggcagcccaggg

SEQ ID NO: 531361 - RNA, 64 nt, Human
gaucucggcucacugcaagcuccgccucccagguucaugccauucuccuaccucagccucccga

SEQ ID NO: 531362 - RNA, 64 nt, Human; identical to SEQ ID NO: 417351

SEQ ID NO: 531363 - RNA, 64 nt, Human; identical to SEQ ID NO: 417352

SEQ ID NO: 531364 - RNA, 64 nt, Human; identical to SEQ ID NO: 417353

SEQ ID NO: 531365 - RNA, 64 nt, Human; identical to SEQ ID NO: 417419

SEQ ID NO: 531366 - RNA, 64 nt, Human; identical to SEQ ID NO: 417420

SEQ ID NO: 531367 - RNA, 64 nt, Human; identical to SEQ ID NO: 414159

SEQ ID NO: 531368 - RNA, 64 nt, Human; identical to SEQ ID NO: 417385

SEQ ID NO: 531369 - RNA, 64 nt, Human; identical to SEQ ID NO: 417386

SEQ ID NO: 531370 - RNA, 64 nt, Human; identical to SEQ ID NO: 417387

SEQ ID NO: 531371 - RNA, 51 nt, Human; identical to SEQ ID NO: 417215

SEQ ID NO: 531372 - RNA, 64 nt, Human; identical to SEQ ID NO: 417216

SEQ ID NO: 531373 - RNA, 64 nt, Human; identical to SEQ ID NO: 414160

SEQ ID NO: 531374 - RNA, 64 nt, Human; identical to SEQ ID NO: 417404

SEQ ID NO: 531375 - RNA, 64 nt, Human; identical to SEQ ID NO: 417147

SEQ ID NO: 531376 - RNA, 64 nt, Human; identical to SEQ ID NO: 417148

SEQ ID NO: 531377 - RNA, 64 nt, Human; identical to SEQ ID NO: 414161

SEQ ID NO: 531378 - RNA, 64 nt, Human
acaaaacuuauggaucagaauuugucuacagugaucaugccaaagaacuuauuguaggggagau

SEQ ID NO: 531379 - RNA, 64 nt, Human
ucaaagaugcauaccuaguuaguuuccuauauauucaugccaucuugaaaagacagacuauggu

SEQ ID NO: 531380 - RNA, 64 nt, Human
ugccucagccucccaaguagcuggaacuacaggcucaugccacugcgcccagcuaauuuuugua

SEQ ID NO: 531381 - RNA, 64 nt, Human; identical to SEQ ID NO: 417421

SEQ ID NO: 531382 - RNA, 64 nt, Human; identical to SEQ ID NO: 417096

SEQ ID NO: 531383 - RNA, 64 nt, Human; identical to SEQ ID NO: 417097

SEQ ID NO: 531384 - RNA, 64 nt, Human; identical to SEQ ID NO: 414175

SEQ ID NO: 531385 - RNA, 64 nt, Human; identical to SEQ ID NO: 417470

SEQ ID NO: 531386 - RNA, 64 nt, Human; identical to SEQ ID NO: 417471

SEQ ID NO: 531387 - RNA, 64 nt, Human; identical to SEQ ID NO: 417472

SEQ ID NO: 531388 - RNA, 64 nt, Human; identical to SEQ ID NO: 417079

SEQ ID NO: 531389 - RNA, 64 nt, Human; identical to SEQ ID NO: 417080

SEQ ID NO: 531390 - RNA, 64 nt, Human; identical to SEQ ID NO: 414176

SEQ ID NO: 531391 - RNA, 64 nt, Human; identical to SEQ ID NO: 417028

SEQ ID NO: 531392 - RNA, 64 nt, Human; identical to SEQ ID NO: 417029

SEQ ID NO: 531393 - RNA, 64 nt, Human; identical to SEQ ID NO: 417030

SEQ ID NO: 531394 - RNA, 64 nt, Human; identical to SEQ ID NO: 417081

SEQ ID NO: 531395 - RNA, 64 nt, Human; identical to SEQ ID NO: 414177

SEQ ID NO: 531396 - RNA, 64 nt, Human; identical to SEQ ID NO: 417046

SEQ ID NO: 531397 - RNA, 64 nt, Human
gaucucggcucacugcaagcuccgccucccagguucaugccauucuccugccucagccuccuga

SEQ ID NO: 531398 - RNA, 64 nt, Human
uucuacccugaacauaccucacagauccucccugucaugccacauuucacugauuggaaugugg

SEQ ID NO: 531399 - RNA, 64 nt, Human
agaaaucaugucugaggguguacguuugauaugaucaugccagauuggagaagauccaagccag

SEQ ID NO: 531400 - RNA, 64 nt, Human; identical to SEQ ID NO: 417047

SEQ ID NO: 531401 - RNA, 64 nt, Human; identical to SEQ ID NO: 417048

SEQ ID NO: 531402 - RNA, 64 nt, Human; identical to SEQ ID NO: 417064

SEQ ID NO: 531403 - RNA, 64 nt, Human; identical to SEQ ID NO: 417065

SEQ ID NO: 531404 - RNA, 64 nt, Human; identical to SEQ ID NO: 414194

SEQ ID NO: 531405 - RNA, 64 nt, Human; identical to SEQ ID NO: 417098

SEQ ID NO: 531406 - RNA, 64 nt, Human; identical to SEQ ID NO: 417149

SEQ ID NO: 531407 - RNA, 64 nt, Human; identical to SEQ ID NO: 414195

SEQ ID NO: 531408 - RNA, 64 nt, Human; identical to SEQ ID NO: 417113

SEQ ID NO: 531409 - RNA, 64 nt, Human; identical to SEQ ID NO: 417114

SEQ ID NO: 531410 - RNA, 64 nt, Human; identical to SEQ ID NO: 417115

SEQ ID NO: 531411 - RNA, 64 nt, Human; identical to SEQ ID NO: 417130

SEQ ID NO: 531412 - RNA, 64 nt, Human; identical to SEQ ID NO: 417131

SEQ ID NO: 531413 - RNA, 64 nt, Human; identical to SEQ ID NO: 414196

SEQ ID NO: 531414 - RNA, 64 nt, Human; identical to SEQ ID NO: 417132

SEQ ID NO: 531415 - RNA, 64 nt, Human; identical to SEQ ID NO: 417436

SEQ ID NO: 531416 - RNA, 64 nt, Human
gaaccuaggagguggcgguugcugugagccaagaucaugccacuccacuccagucugggcgaca

SEQ ID NO: 531417 - RNA, 64 nt, Human
uacgucuucauaucgauaccagaugccuucuucaucaugccacugaagccacucaccaccuuca

SEQ ID NO: 531418 - RNA, 64 nt, Human
ugaggggccacaccaccuauuccccccaccuaacucaugccauuccagcuuccuucaggacccu

SEQ ID NO: 531419 - RNA, 64 nt, Human; identical to SEQ ID NO: 417437

SEQ ID NO: 531420 - RNA, 64 nt, Human; identical to SEQ ID NO: 414212

SEQ ID NO: 531421 - RNA, 64 nt, Human; identical to SEQ ID NO: 417183

SEQ ID NO: 531422 - RNA, 64 nt, Human; identical to SEQ ID NO: 417164

SEQ ID NO: 531423 - RNA, 64 nt, Human; identical to SEQ ID NO: 417165

SEQ ID NO: 531424 - RNA, 64 nt, Human; identical to SEQ ID NO: 414213

SEQ ID NO: 531425 - RNA, 64 nt, Human; identical to SEQ ID NO: 417198

SEQ ID NO: 531426 - RNA, 64 nt, Human; identical to SEQ ID NO: 417199

SEQ ID NO: 531427 - RNA, 64 nt, Human; identical to SEQ ID NO: 417200

SEQ ID NO: 531428 - RNA, 64 nt, Human; identical to SEQ ID NO: 416956

SEQ ID NO: 531429 - RNA, 64 nt, Human; identical to SEQ ID NO: 416957

SEQ ID NO: 531430 - RNA, 64 nt, Human; identical to SEQ ID NO: 414214

SEQ ID NO: 531431 - RNA, 64 nt, Human; identical to SEQ ID NO: 417217

SEQ ID NO: 531432 - RNA, 64 nt, Human; identical to SEQ ID NO: 416884

SEQ ID NO: 531433 - RNA, 64 nt, Human; identical to SEQ ID NO: 416885

SEQ ID NO: 531434 - RNA, 64 nt, Human; identical to SEQ ID NO: 414283

SEQ ID NO: 531435 - RNA, 64 nt, Human
uuuaguaauuucuuaccaugcuaauauguaaaguucaugccauccaggcauuuaagagcgaucc

SEQ ID NO: 531436 - RNA, 64 nt, Human
acauccccaucucaaggccgaaccugugugaaccucaugccaagcacagauauagggcuggcgc

SEQ ID NO: 531437 - RNA, 64 nt, Human
cuuaaguauuggccaacacgaacuccccaguuauucaugccagccaggaaggaaacgccuuccu

SEQ ID NO: 531438 - RNA, 51 nt, Human; identical to SEQ ID NO: 417368

SEQ ID NO: 531439 - RNA, 64 nt, Human; identical to SEQ ID NO: 417369

SEQ ID NO: 531440 - RNA, 64 nt, Human; identical to SEQ ID NO: 417370

SEQ ID NO: 531441 - RNA, 64 nt, Human; identical to SEQ ID NO: 416848

SEQ ID NO: 531442 - RNA, 64 nt, Human; identical to SEQ ID NO: 416849

SEQ ID NO: 531443 - RNA, 64 nt, Human; identical to SEQ ID NO: 414386

SEQ ID NO: 531444 - RNA, 64 nt, Human; identical to SEQ ID NO: 416830

SEQ ID NO: 531445 - RNA, 64 nt, Human; identical to SEQ ID NO: 416831

SEQ ID NO: 531446 - RNA, 64 nt, Human; identical to SEQ ID NO: 416832

SEQ ID NO: 531447 - RNA, 64 nt, Human; identical to SEQ ID NO: 416850

SEQ ID NO: 531448 - RNA, 64 nt, Human; identical to SEQ ID NO: 414387

SEQ ID NO: 531449 - RNA, 64 nt, Human; identical to SEQ ID NO: 416866

SEQ ID NO: 531450 - RNA, 64 nt, Human; identical to SEQ ID NO: 416867

SEQ ID NO: 531451 - RNA, 64 nt, Human; identical to SEQ ID NO: 416868

SEQ ID NO: 531452 - RNA, 64 nt, Human; identical to SEQ ID NO: 416886

SEQ ID NO: 531453 - RNA, 64 nt, Human; identical to SEQ ID NO: 414388

SEQ ID NO: 531454 - RNA, 64 nt, Human
gaaccugggagggugagguugcagugagcugagaucaugccacugcacuccagccugggugaca

SEQ ID NO: 531455 - RNA, 64 nt, Human
auccuaagaaggugcauuucuuuacagagcugugucaugccauccuuugggcccucugcuggaa

SEQ ID NO: 531456 - RNA, 64 nt, Human
ucucccagcaguuuuaaaggaugaacauuggauuucaugccaucccauagaaaaccuguuuuaa

SEQ ID NO: 531457 - RNA, 64 nt, Human; identical to SEQ ID NO: 416902

SEQ ID NO: 531458 - RNA, 64 nt, Human; identical to SEQ ID NO: 416903

SEQ ID NO: 531459 - RNA, 64 nt, Human; identical to SEQ ID NO: 416904

SEQ ID NO: 531460 - RNA, 64 nt, Human; identical to SEQ ID NO: 416920

SEQ ID NO: 531461 - RNA, 64 nt, Human; identical to SEQ ID NO: 416921

SEQ ID NO: 531462 - RNA, 64 nt, Human; identical to SEQ ID NO: 414406

SEQ ID NO: 531463 - RNA, 64 nt, Human; identical to SEQ ID NO: 416938

SEQ ID NO: 531464 - RNA, 64 nt, Human; identical to SEQ ID NO: 416939

SEQ ID NO: 531465 - RNA, 64 nt, Human; identical to SEQ ID NO: 416940

SEQ ID NO: 531466 - RNA, 64 nt, Human; identical to SEQ ID NO: 417066

SEQ ID NO: 531467 - RNA, 64 nt, Human; identical to SEQ ID NO: 414422

SEQ ID NO: 531468 - RNA, 64 nt, Human; identical to SEQ ID NO: 511560

SEQ ID NO: 531469 - RNA, 64 nt, Human; identical to SEQ ID NO: 511561

SEQ ID NO: 531470 - RNA, 64 nt, Human; identical to SEQ ID NO: 511562

SEQ ID NO: 531471 - RNA, 64 nt, Human; identical to SEQ ID NO: 511563

SEQ ID NO: 531472 - RNA, 64 nt, Human; identical to SEQ ID NO: 511564

SEQ ID NO: 531473 - RNA, 64 nt, Human
auugcuuuuaaaguuuccucugcucagcaucauuucaugccaaagugcugcuaugggcugcuuu

SEQ ID NO: 531474 - RNA, 64 nt, Human
cucuaagggccaaaguccuacaaucggaauggauucaugccacguugaagauaaaauuauccuc

SEQ ID NO: 531475 - RNA, 64 nt, Human
aaucucggcucauagcaagcuccgccuccuggguucaugccauucuccugccucagccuccaga

SEQ ID NO: 531476 - RNA, 64 nt, Human; identical to SEQ ID NO: 511565

SEQ ID NO: 531477 - RNA, 64 nt, Human; identical to SEQ ID NO: 511566

SEQ ID NO: 531478 - RNA, 64 nt, Human; identical to SEQ ID NO: 511567

SEQ ID NO: 531479 - RNA, 64 nt, Human; identical to SEQ ID NO: 511568

SEQ ID NO: 531480 - RNA, 64 nt, Human; identical to SEQ ID NO: 511569

SEQ ID NO: 531481 - RNA, 64 nt, Human; identical to SEQ ID NO: 511570

SEQ ID NO: 531482 - RNA, 64 nt, Human; identical to SEQ ID NO: 511571

SEQ ID NO: 531483 - RNA, 64 nt, Human; identical to SEQ ID NO: 511572

SEQ ID NO: 531484 - RNA, 64 nt, Human; identical to SEQ ID NO: 511573

SEQ ID NO: 531485 - RNA, 64 nt, Human; identical to SEQ ID NO: 511574

SEQ ID NO: 531486 - RNA, 64 nt, Human; identical to SEQ ID NO: 511575

SEQ ID NO: 531487 - RNA, 64 nt, Human; identical to SEQ ID NO: 511576

SEQ ID NO: 531488 - RNA, 64 nt, Human; identical to SEQ ID NO: 511577

SEQ ID NO: 531489 - RNA, 64 nt, Human; identical to SEQ ID NO: 511578

SEQ ID NO: 531490 - RNA, 64 nt, Human; identical to SEQ ID NO: 511579

SEQ ID NO: 531491 - RNA, 64 nt, Human; identical to SEQ ID NO: 511580

SEQ ID NO: 531492 - RNA, 64 nt, Human
cuaggagcuguccuggugggcccagguccuuguaucaugccacggucccaacuacaggguccua

SEQ ID NO: 531493 - RNA, 64 nt, Human
gagggauaguaugugacgagggagaacuguccacucaugccauuuucucucuugucuaguauuu

SEQ ID NO: 531494 - RNA, 64 nt, Human
ccuccagguuauaugcaucgagaaccugaauaaaucaugccacuauauuaauuuauauuacaug

SEQ ID NO: 531495 - RNA, 64 nt, Human; identical to SEQ ID NO: 511581

SEQ ID NO: 531496 - RNA, 64 nt, Human; identical to SEQ ID NO: 511582

SEQ ID NO: 531497 - RNA, 64 nt, Human; identical to SEQ ID NO: 511583

SEQ ID NO: 531498 - RNA, 64 nt, Human; identical to SEQ ID NO: 511584

SEQ ID NO: 531499 - RNA, 64 nt, Human; identical to SEQ ID NO: 511585

SEQ ID NO: 531500 - RNA, 64 nt, Human; identical to SEQ ID NO: 511586

SEQ ID NO: 531501 - RNA, 64 nt, Human; identical to SEQ ID NO: 511587

SEQ ID NO: 531502 - RNA, 64 nt, Human; identical to SEQ ID NO: 511591

SEQ ID NO: 531503 - RNA, 64 nt, Human; identical to SEQ ID NO: 511588

SEQ ID NO: 531504 - RNA, 64 nt, Human; identical to SEQ ID NO: 511589

SEQ ID NO: 531505 - RNA, 64 nt, Human; identical to SEQ ID NO: 511590

SEQ ID NO: 531506 - RNA, 64 nt, Human; identical to SEQ ID NO: 511592

SEQ ID NO: 531507 - RNA, 64 nt, Human; identical to SEQ ID NO: 511593

SEQ ID NO: 531508 - RNA, 64 nt, Human; identical to SEQ ID NO: 511594

SEQ ID NO: 531509 - RNA, 64 nt, Human; identical to SEQ ID NO: 511595

SEQ ID NO: 531510 - RNA, 64 nt, Human; identical to SEQ ID NO: 511596

SEQ ID NO: 531511 - RNA, 64 nt, Human
gacuucuuuuguguuagagugaauaaaauuuuguucaugccaguguuauuuuugguuuuacucu

SEQ ID NO: 531512 - RNA, 64 nt, Human
cagcgcaaguauuccauuugcauuugguaauuuuucaugccaccuauuuaugaauauauaaauc

SEQ ID NO: 531513 - RNA, 64 nt, Human
cccuccccuggcucuuagcaaccugcccuuuuauucaugccauuuggggucacagaugccuagc

SEQ ID NO: 531514 - RNA, 64 nt, Human; identical to SEQ ID NO: 511597

SEQ ID NO: 531515 - RNA, 64 nt, Human; identical to SEQ ID NO: 511598

SEQ ID NO: 531516 - RNA, 64 nt, Human; identical to SEQ ID NO: 511599

SEQ ID NO: 531517 - RNA, 64 nt, Human; identical to SEQ ID NO: 511600

SEQ ID NO: 531518 - RNA, 64 nt, Human; identical to SEQ ID NO: 511601

SEQ ID NO: 531519 - RNA, 64 nt, Human; identical to SEQ ID NO: 511602

SEQ ID NO: 531520 - RNA, 64 nt, Human; identical to SEQ ID NO: 511603

SEQ ID NO: 531521 - RNA, 64 nt, Human; identical to SEQ ID NO: 511604

SEQ ID NO: 531522 - RNA, 64 nt, Human; identical to SEQ ID NO: 511605

SEQ ID NO: 531523 - RNA, 64 nt, Human; identical to SEQ ID NO: 511606

SEQ ID NO: 531524 - RNA, 64 nt, Human; identical to SEQ ID NO: 511607

SEQ ID NO: 531525 - RNA, 64 nt, Human; identical to SEQ ID NO: 511608

SEQ ID NO: 531526 - RNA, 64 nt, Human; identical to SEQ ID NO: 511611

SEQ ID NO: 531527 - RNA, 64 nt, Human; identical to SEQ ID NO: 511612

SEQ ID NO: 531528 - RNA, 64 nt, Human; identical to SEQ ID NO: 511613

SEQ ID NO: 531529 - RNA, 64 nt, Human; identical to SEQ ID NO: 511614

SEQ ID NO: 531530 - RNA, 64 nt, Human
cccuccaugggcuagugugaguggcagccaugccucaugccacaccuucuucgcaaacugaugg

SEQ ID NO: 531531 - RNA, 64 nt, Human
gacccucacaaccacguacaugacccuuucuccuucaugccaggcuccuaugcuccccuugccc

SEQ ID NO: 531532 - RNA, 64 nt, Human
uuagaacacugaggucaagccaguccucccauggucaugccacccaccagggaagcaugccuga

SEQ ID NO: 531533 - RNA, 64 nt, Human; identical to SEQ ID NO: 511615

SEQ ID NO: 531534 - RNA, 64 nt, Human; identical to SEQ ID NO: 511616

SEQ ID NO: 531535 - RNA, 64 nt, Human; identical to SEQ ID NO: 511617

SEQ ID NO: 531536 - RNA, 64 nt, Human; identical to SEQ ID NO: 511618

SEQ ID NO: 531537 - RNA, 64 nt, Human; identical to SEQ ID NO: 511619

SEQ ID NO: 531538 - RNA, 64 nt, Human; identical to SEQ ID NO: 511620

SEQ ID NO: 531539 - RNA, 64 nt, Human; identical to SEQ ID NO: 511621

SEQ ID NO: 531540 - RNA, 64 nt, Human; identical to SEQ ID NO: 511622

SEQ ID NO: 531541 - RNA, 64 nt, Human; identical to SEQ ID NO: 511623

SEQ ID NO: 531542 - RNA, 64 nt, Human; identical to SEQ ID NO: 511624

SEQ ID NO: 531543 - RNA, 64 nt, Human; identical to SEQ ID NO: 511625

SEQ ID NO: 531544 - RNA, 64 nt, Human; identical to SEQ ID NO: 511626

SEQ ID NO: 531545 - RNA, 64 nt, Human; identical to SEQ ID NO: 511627

SEQ ID NO: 531546 - RNA, 64 nt, Human; identical to SEQ ID NO: 511628

SEQ ID NO: 531547 - RNA, 64 nt, Human; identical to SEQ ID NO: 511629

SEQ ID NO: 531548 - RNA, 64 nt, Human; identical to SEQ ID NO: 511630

SEQ ID NO: 531549 - RNA, 64 nt, Human
gagcccaggaauuugagguuguaguaagcuacgaucaugccacugcacuccacucugggcaaca

SEQ ID NO: 531550 - RNA, 64 nt, Human
cuacauacaaugagagcccugagcccucaagaacucaugccagcucagcccuacaccaguuucc

SEQ ID NO: 531551 - RNA, 64 nt, Human
uuuaaaaguuucacacaaccauaaguauaguauuucaugccaguaaaauuuuuuuagugguauu

SEQ ID NO: 531552 - RNA, 64 nt, Human; identical to SEQ ID NO: 511609

SEQ ID NO: 531553 - RNA, 64 nt, Human; identical to SEQ ID NO: 511631

SEQ ID NO: 531554 - RNA, 64 nt, Human; identical to SEQ ID NO: 511632

SEQ ID NO: 531555 - RNA, 64 nt, Human; identical to SEQ ID NO: 511633

SEQ ID NO: 531556 - RNA, 64 nt, Human; identical to SEQ ID NO: 511634

SEQ ID NO: 531557 - RNA, 64 nt, Human; identical to SEQ ID NO: 511635

SEQ ID NO: 531558 - RNA, 64 nt, Human; identical to SEQ ID NO: 511636

SEQ ID NO: 531559 - RNA, 64 nt, Human; identical to SEQ ID NO: 511637

SEQ ID NO: 531560 - RNA, 64 nt, Human; identical to SEQ ID NO: 511638

SEQ ID NO: 531561 - RNA, 64 nt, Human; identical to SEQ ID NO: 511639

SEQ ID NO: 531562 - RNA, 64 nt, Human; identical to SEQ ID NO: 511640

SEQ ID NO: 531563 - RNA, 64 nt, Human; identical to SEQ ID NO: 511641

SEQ ID NO: 531564 - RNA, 64 nt, Human; identical to SEQ ID NO: 511642

SEQ ID NO: 531565 - RNA, 64 nt, Human; identical to SEQ ID NO: 511643

SEQ ID NO: 531566 - RNA, 64 nt, Human; identical to SEQ ID NO: 511644

SEQ ID NO: 531567 - RNA, 64 nt, Human; identical to SEQ ID NO: 511645

SEQ ID NO: 531568 - RNA, 64 nt, Human
gagcccgggagagggagguugcagugaggcgagaucaugccacugcacuccagccuggcugaca

SEQ ID NO: 531569 - RNA, 64 nt, Human
uuugagauuagacccaaacaugcuuuuaaaugucucaugccaaggcacugaauuaagacuucuu

SEQ ID NO: 531570 - RNA, 64 nt, Human
uucaacuccuucaguuuaucuuggacugacugacucaugccagcccuacagaagugccuuuuac

SEQ ID NO: 531571 - RNA, 64 nt, Human; identical to SEQ ID NO: 511646

SEQ ID NO: 531572 - RNA, 64 nt, Human; identical to SEQ ID NO: 511647

SEQ ID NO: 531573 - RNA, 64 nt, Human; identical to SEQ ID NO: 511648

SEQ ID NO: 531574 - RNA, 64 nt, Human; identical to SEQ ID NO: 511649

SEQ ID NO: 531575 - RNA, 64 nt, Human; identical to SEQ ID NO: 511650

SEQ ID NO: 531576 - RNA, 64 nt, Human; identical to SEQ ID NO: 511610

SEQ ID NO: 531577 - RNA, 64 nt, Human; identical to SEQ ID NO: 511651

SEQ ID NO: 531578 - RNA, 64 nt, Human; identical to SEQ ID NO: 511652

SEQ ID NO: 531579 - RNA, 64 nt, Human; identical to SEQ ID NO: 511653

SEQ ID NO: 531580 - RNA, 64 nt, Human; identical to SEQ ID NO: 511654

SEQ ID NO: 531581 - RNA, 64 nt, Human; identical to SEQ ID NO: 511655

SEQ ID NO: 531582 - RNA, 64 nt, Human; identical to SEQ ID NO: 511656

SEQ ID NO: 531583 - RNA, 64 nt, Human; identical to SEQ ID NO: 511657

SEQ ID NO: 531584 - RNA, 64 nt, Human; identical to SEQ ID NO: 511658

SEQ ID NO: 531585 - RNA, 64 nt, Human; identical to SEQ ID NO: 511659

SEQ ID NO: 531586 - RNA, 64 nt, Human; identical to SEQ ID NO: 511660

SEQ ID NO: 531587 - RNA, 64 nt, Human
gaacccaggaggaagagguugcagugagccaagaucaugccacaucacuccaaccugggcaaca

SEQ ID NO: 531588 - RNA, 64 nt, Human
accuuuagcugcuugaucauuaagccauccaacuucaugccaguucccuucuuuauagaagagu

SEQ ID NO: 531589 - RNA, 64 nt, Human
gaacccaggagguggagguuccagugagccaaaaucaugccaauguauuccagucugggugaca

SEQ ID NO: 531590 - RNA, 64 nt, Human; identical to SEQ ID NO: 511661

SEQ ID NO: 531591 - RNA, 64 nt, Human; identical to SEQ ID NO: 511662

SEQ ID NO: 531592 - RNA, 64 nt, Human; identical to SEQ ID NO: 511663

SEQ ID NO: 531593 - RNA, 64 nt, Human; identical to SEQ ID NO: 511664

SEQ ID NO: 531594 - RNA, 64 nt, Human; identical to SEQ ID NO: 511665

SEQ ID NO: 531595 - RNA, 64 nt, Human; identical to SEQ ID NO: 511666

SEQ ID NO: 531596 - RNA, 64 nt, Human; identical to SEQ ID NO: 511667

SEQ ID NO: 531597 - RNA, 64 nt, Human; identical to SEQ ID NO: 511668

SEQ ID NO: 531598 - RNA, 64 nt, Human; identical to SEQ ID NO: 511669

SEQ ID NO: 531599 - RNA, 64 nt, Human; identical to SEQ ID NO: 511670

SEQ ID NO: 531600 - RNA, 64 nt, Human; identical to SEQ ID NO: 511671

SEQ ID NO: 531601 - RNA, 64 nt, Human; identical to SEQ ID NO: 511672

SEQ ID NO: 531602 - RNA, 64 nt, Human; identical to SEQ ID NO: 511673

SEQ ID NO: 531603 - RNA, 64 nt, Human; identical to SEQ ID NO: 511674

SEQ ID NO: 531604 - RNA, 64 nt, Human; identical to SEQ ID NO: 511675

SEQ ID NO: 531605 - RNA, 64 nt, Human; identical to SEQ ID NO: 511676

SEQ ID NO: 531606 - RNA, 64 nt, Human
cuuuaaaaaaaaaaaaauuagaaccaauucauguucaugccaaaaacaaauuguccccaagccu

SEQ ID NO: 531607 - RNA, 64 nt, Human
ggucauaaucagaagcuaagcugggugcaguggcucaugccaguuaucccagcacuuugggagg

SEQ ID NO: 531608 - RNA, 64 nt, Human
gaacccgggaggcagagguugcaguguggugagaucaugccacuacacuccagccuggcgacag

SEQ ID NO: 531609 - RNA, 64 nt, Human; identical to SEQ ID NO: 511677

SEQ ID NO: 531610 - RNA, 64 nt, Human; identical to SEQ ID NO: 511678

SEQ ID NO: 531611 - RNA, 64 nt, Human; identical to SEQ ID NO: 511679

SEQ ID NO: 531612 - RNA, 64 nt, Human; identical to SEQ ID NO: 511680

SEQ ID NO: 531613 - RNA, 64 nt, Human; identical to SEQ ID NO: 511681

SEQ ID NO: 531614 - RNA, 64 nt, Human; identical to SEQ ID NO: 511682

SEQ ID NO: 531615 - RNA, 64 nt, Human; identical to SEQ ID NO: 511683

SEQ ID NO: 531616 - RNA, 64 nt, Human; identical to SEQ ID NO: 511684

SEQ ID NO: 531617 - RNA, 64 nt, Human; identical to SEQ ID NO: 511685

SEQ ID NO: 531618 - RNA, 64 nt, Human; identical to SEQ ID NO: 511686

SEQ ID NO: 531619 - RNA, 64 nt, Human; identical to SEQ ID NO: 511687

SEQ ID NO: 531620 - RNA, 64 nt, Human; identical to SEQ ID NO: 511688

SEQ ID NO: 531621 - RNA, 64 nt, Human; identical to SEQ ID NO: 511691

SEQ ID NO: 531622 - RNA, 64 nt, Human; identical to SEQ ID NO: 511689

SEQ ID NO: 531623 - RNA, 64 nt, Human; identical to SEQ ID NO: 511690

SEQ ID NO: 531624 - RNA, 64 nt, Human; identical to SEQ ID NO: 511692

SEQ ID NO: 531625 - RNA, 64 nt, Human
cagaccugcaagucuucgucucaagggaccucccucaugccaggccccugccucucacagcagc

SEQ ID NO: 531626 - RNA, 64 nt, Human
gaaccugggaggcggagguugcagugagccgagaucaugccauugcacuccagccugggcgaca

SEQ ID NO: 531627 - RNA, 64 nt, Human
gagacugggaggcagagguugcagugaaccgagaucaugccaccgcacuucagccugggugaca

SEQ ID NO: 531628 - RNA, 64 nt, Human; identical to SEQ ID NO: 511693

SEQ ID NO: 531629 - RNA, 64 nt, Human; identical to SEQ ID NO: 511694

SEQ ID NO: 531630 - RNA, 64 nt, Human; identical to SEQ ID NO: 511695

SEQ ID NO: 531631 - RNA, 64 nt, Human; identical to SEQ ID NO: 511696

SEQ ID NO: 531632 - RNA, 64 nt, Human; identical to SEQ ID NO: 511697

SEQ ID NO: 531633 - RNA, 64 nt, Human; identical to SEQ ID NO: 511698

SEQ ID NO: 531634 - RNA, 64 nt, Human; identical to SEQ ID NO: 511699

SEQ ID NO: 531635 - RNA, 64 nt, Human; identical to SEQ ID NO: 511700

SEQ ID NO: 531636 - RNA, 64 nt, Human; identical to SEQ ID NO: 511701

SEQ ID NO: 531637 - RNA, 64 nt, Human; identical to SEQ ID NO: 511702

SEQ ID NO: 531638 - RNA, 64 nt, Human; identical to SEQ ID NO: 511703

SEQ ID NO: 531639 - RNA, 64 nt, Human; identical to SEQ ID NO: 511704

SEQ ID NO: 531640 - RNA, 64 nt, Human; identical to SEQ ID NO: 511705

SEQ ID NO: 531641 - RNA, 64 nt, Human; identical to SEQ ID NO: 511706

SEQ ID NO: 531642 - RNA, 64 nt, Human; identical to SEQ ID NO: 511707

SEQ ID NO: 531643 - RNA, 64 nt, Human; identical to SEQ ID NO: 511708

SEQ ID NO: 531644 - RNA, 64 nt, Human
uggacccugucacuuccuaaaauuacucguucugucaugccauagaggucaguuuuccucuuuc

SEQ ID NO: 531645 - RNA, 64 nt, Human
gaucucggcucacugcaagcuccgccucccggguucaugccauucuccugccucagccucccga

SEQ ID NO: 531646 - RNA, 64 nt, Human
ucaggggaggccggaggguuuuccagcauuugccucaugccagcaccuuugaaccggucucuua

SEQ ID NO: 531647 - RNA, 64 nt, Human; identical to SEQ ID NO: 511709

SEQ ID NO: 531648 - RNA, 64 nt, Human; identical to SEQ ID NO: 511711

SEQ ID NO: 531649 - RNA, 64 nt, Human; identical to SEQ ID NO: 511712

SEQ ID NO: 531650 - RNA, 64 nt, Human; identical to SEQ ID NO: 511713

SEQ ID NO: 531651 - RNA, 64 nt, Human; identical to SEQ ID NO: 511714

SEQ ID NO: 531652 - RNA, 64 nt, Human; identical to SEQ ID NO: 511715

SEQ ID NO: 531653 - RNA, 64 nt, Human; identical to SEQ ID NO: 511716

SEQ ID NO: 531654 - RNA, 64 nt, Human; identical to SEQ ID NO: 511717

SEQ ID NO: 531655 - RNA, 64 nt, Human; identical to SEQ ID NO: 511718

SEQ ID NO: 531656 - RNA, 64 nt, Human; identical to SEQ ID NO: 511719

SEQ ID NO: 531657 - RNA, 64 nt, Human; identical to SEQ ID NO: 511720

SEQ ID NO: 531658 - RNA, 64 nt, Human; identical to SEQ ID NO: 511721

SEQ ID NO: 531659 - RNA, 64 nt, Human; identical to SEQ ID NO: 511722

SEQ ID NO: 531660 - RNA, 64 nt, Human; identical to SEQ ID NO: 511723

SEQ ID NO: 531661 - RNA, 64 nt, Human; identical to SEQ ID NO: 511724

SEQ ID NO: 531662 - RNA, 64 nt, Human; identical to SEQ ID NO: 511725

SEQ ID NO: 531663 - RNA, 64 nt, Human
aggacuucauuccagauagcugugugcauuuaugucaugccaauuacuauaacauuuccaaagu

SEQ ID NO: 531664 - RNA, 64 nt, Human
gaaccugggagguggagguugcagugagccgagaucaugccacugcacugggcaacagagcaaa

SEQ ID NO: 531665 - RNA, 64 nt, Human
guauaugaaugguaaaauuguuacauauccuauuucaugccauucuuguuaguugacugguauu

SEQ ID NO: 531666 - RNA, 53 nt, Human; identical to SEQ ID NO: 511726

SEQ ID NO: 531667 - RNA, 64 nt, Human; identical to SEQ ID NO: 511727

SEQ ID NO: 531668 - RNA, 64 nt, Human; identical to SEQ ID NO: 511728

SEQ ID NO: 531669 - RNA, 64 nt, Human; identical to SEQ ID NO: 511731

SEQ ID NO: 531670 - RNA, 64 nt, Human; identical to SEQ ID NO: 511729

SEQ ID NO: 531671 - RNA, 64 nt, Human; identical to SEQ ID NO: 511730

SEQ ID NO: 531672 - RNA, 64 nt, Human; identical to SEQ ID NO: 511732

SEQ ID NO: 531673 - RNA, 64 nt, Human; identical to SEQ ID NO: 511710

SEQ ID NO: 531674 - RNA, 64 nt, Human; identical to SEQ ID NO: 511733

SEQ ID NO: 531675 - RNA, 64 nt, Human; identical to SEQ ID NO: 511734

SEQ ID NO: 531676 - RNA, 64 nt, Human; identical to SEQ ID NO: 511735

SEQ ID NO: 531677 - RNA, 64 nt, Human; identical to SEQ ID NO: 511736

SEQ ID NO: 531678 - RNA, 64 nt, Human; identical to SEQ ID NO: 511737

SEQ ID NO: 531679 - RNA, 64 nt, Human; identical to SEQ ID NO: 511738

SEQ ID NO: 531680 - RNA, 64 nt, Human; identical to SEQ ID NO: 511739

SEQ ID NO: 531681 - RNA, 64 nt, Human; identical to SEQ ID NO: 511740

SEQ ID NO: 531682 - RNA, 64 nt, Human
gagccuuggaggucaaggcugcagugaaucaugaucaugccacuguacuccagccugggcaaca

SEQ ID NO: 531683 - RNA, 64 nt, Human
ggcagccccaacaugugcaccccugcauuuccugucaugccacagacuggcccuugagggcagc

SEQ ID NO: 531684 - RNA, 64 nt, Human
gcaacuacaaagguggacucaaagcaaagcacaaucaugccagccaacauuccagaauucugcu

SEQ ID NO: 531685 - RNA, 64 nt, Human; identical to SEQ ID NO: 511741

SEQ ID NO: 531686 - RNA, 64 nt, Human; identical to SEQ ID NO: 511742

SEQ ID NO: 531687 - RNA, 64 nt, Human; identical to SEQ ID NO: 511743

SEQ ID NO: 531688 - RNA, 64 nt, Human; identical to SEQ ID NO: 511744

SEQ ID NO: 531689 - RNA, 64 nt, Human; identical to SEQ ID NO: 511745

SEQ ID NO: 531690 - RNA, 64 nt, Human; identical to SEQ ID NO: 511746

SEQ ID NO: 531691 - RNA, 64 nt, Human; identical to SEQ ID NO: 511747

SEQ ID NO: 531692 - RNA, 64 nt, Human; identical to SEQ ID NO: 511748

SEQ ID NO: 531693 - RNA, 64 nt, Human; identical to SEQ ID NO: 511749

SEQ ID NO: 531694 - RNA, 64 nt, Human; identical to SEQ ID NO: 511750

SEQ ID NO: 531695 - RNA, 64 nt, Human; identical to SEQ ID NO: 511751

SEQ ID NO: 531696 - RNA, 64 nt, Human; identical to SEQ ID NO: 511752

SEQ ID NO: 531697 - RNA, 64 nt, Human; identical to SEQ ID NO: 511753

SEQ ID NO: 531698 - RNA, 64 nt, Human; identical to SEQ ID NO: 511754

SEQ ID NO: 531699 - RNA, 64 nt, Human; identical to SEQ ID NO: 511755

SEQ ID NO: 531700 - RNA, 64 nt, Human
ccaccgucuuccuccuacacaccaaugaugagccucaugccagugaggcccggagcgcuuggga

SEQ ID NO: 531701 - RNA, 64 nt, Human
gcagggcccaggcagccaccaagcccaccccaggucaugccagcggcagaggacgugaggggcu

SEQ ID NO: 531702 - RNA, 64 nt, Human
caaucugggagguggaaguugcagugagccgagaucaugccacugcacuccagccugggcgacg

SEQ ID NO: 531703 - RNA, 64 nt, Human
uaaauauuucauuacagaauuuauguuagagcuuucaugccaagaauguuuucuuacaaaauuc

SEQ ID NO: 531704 - RNA, 64 nt, Human
agaccccaagaggagauauuggaacaggcucccuucaugccaagggucuuucuaaguuaauacu

SEQ ID NO: 531705 - RNA, 64 nt, Human
uuggccucagaugauguuuccaucuccaaccccuucaugccagauggggaaacugaggcucaga

SEQ ID NO: 531706 - RNA, 64 nt, Human
cagauuaggacaguccuuugcacugaguugacacucaugccaacaagaaccugugccccuccuu

SEQ ID NO: 531707 - RNA, 64 nt, Human
agcaagcaguucuaccuaacgucccacauccuucucaugccaacacuucuguaauugaucauua

SEQ ID NO: 531708 - RNA, 64 nt, Human
caaaaaaaacaaaaaaaacauauauacugcuguaucaugccaggauuuaucagcauucccaagg

SEQ ID NO: 531709 - RNA, 64 nt, Human
ugccucagccuccccaguagcugggauuacaggcucaugccaccaugcccagcuaauuuuugua

SEQ ID NO: 531710 - RNA, 64 nt, Human
gacagucccagcugagucccaucgauguugaaucucaugccacugcaagugccauucaccacug

SEQ ID NO: 531711 - RNA, 64 nt, Human
gaacccgggagguggaggcugcaaugagcugagaucaugccauugcacuccagccugggcaacg

SEQ ID NO: 531712 - RNA, 64 nt, Human
uuuaaaaaaucuuaaugaaugagucuguugugugucaugccagugagggacgucagacuuggcu

SEQ ID NO: 531713 - RNA, 64 nt, Human
aaaaauuuuaaaccccugauuuauauagauaucuucaugccauuacagcuuucuagaugcuaau

SEQ ID NO: 531714 - RNA, 64 nt, Human
uccauguuacucccuuucucuuccuaccuguggcucaugccaugccaugaagugccuaggguac

SEQ ID NO: 531715 - RNA, 64 nt, Human
gaaccugggagguggggguuucagugagcugagaucaugccacugcacuccagccugagugaca

SEQ ID NO: 531716 - RNA, 64 nt, Human
ugggcuacccagagcgagcacgcuucucucguggucaugccaagaacacaggagggugagucua

SEQ ID NO: 531717 - RNA, 64 nt, Human
uaaaaugccuuugggggcaguuugaagcaguucuucaugccacuuaguuugaaaauaaaauucu

SEQ ID NO: 531718 - RNA, 64 nt, Human
uucaccaaaucagcuuccacuuagcauuaggaggucaugccauacaacucacguaugcgggcaa

SEQ ID NO: 531719 - RNA, 64 nt, Human
gaucucugcucacugcaagcuccgccuccuggguucaugccauucuccugccucagccuccuga

SEQ ID NO: 531720 - RNA, 64 nt, Human
ggugguugccucccguccugggcaggcugcagccucaugccaugucucucucccacuaccugau

SEQ ID NO: 531721 - RNA, 64 nt, Human
ugccuuccgucuucccaaccucagcugccuguauucaugccagaggugcaaaggcugccagcca

SEQ ID NO: 531722 - RNA, 64 nt, Human
gagccugggagauggagguugcagugagcugagaucaugccacugcacuccagccugggcaaca

SEQ ID NO: 531723 - RNA, 64 nt, Human
aaauguuuuauuauuuugaaaauaauguuguaauucaugccagggacugacaaaagacuugaga

SEQ ID NO: 531724 - RNA, 64 nt, Human
caaagaagcuuugguugguuuugguggauuuuuaucaugccauguuggacaugagauuuuuuag

SEQ ID NO: 531725 - RNA, 64 nt, Human
acagggccaagagccagcacugcuggccuuggugucaugccagaaucuaccaggacugagggag

SEQ ID NO: 531726 - RNA, 64 nt, Human
gaucucggcucacugcaagcucugucuccuggguucaugccauucuccugcuucagccucccga

SEQ ID NO: 531727 - RNA, 64 nt, Human
gagccugugacauacccccucccccaccguugucucaugccaguaacaggcucaaacaaugaca

SEQ ID NO: 531728 - RNA, 64 nt, Human
uagugcaacugcuguguauguugagccacuguugucaugccagccaggugcaaaggcagcuuag

SEQ ID NO: 531729 - RNA, 64 nt, Human
agagccucuggguucugagucagcaagccagaggucaugccacaggccuggcuggaacuuacac

SEQ ID NO: 531730 - RNA, 64 nt, Human
gcccaaggugaugugcugcagggaagcaugucucucaugccaagaaccaagaucggacuaugaa

SEQ ID NO: 531731 - RNA, 64 nt, Human
caagaaccuacagacuccaucucuucugcaagccucaugccaacccugggcuauugcugcugcc

SEQ ID NO: 531732 - RNA, 64 nt, Human
auaugucugagccaaacugcacugggggcugcccucaugccaagcaagagccuggaauuccccu

SEQ ID NO: 531733 - RNA, 64 nt, Human
guuggccaaguugaaguagcuacuguagacccuuucaugccagcaguggucauauugagugcca

SEQ ID NO: 531734 - RNA, 64 nt, Human
uugagcccaggaguuugagguugcagugagcugaucaugccacugcacucuagccuaggcuaca

SEQ ID NO: 531735 - RNA, 64 nt, Human
aagaauugauguaugccucuuugccucugcuuugucaugccauuaagcucacaauaaggaagaa

SEQ ID NO: 531736 - RNA, 64 nt, Human
gcccuuugggcggccucugggcuugggcaccagcucaugccagccccagagggucaggguugga

SEQ ID NO: 531737 - RNA, 64 nt, Human
cagaggcuaacagauccaaugggaguccauggugucaugccaagacaguaucagacacagcccc

SEQ ID NO: 531738 - RNA, 64 nt, Human
ccucuucacucccuuuucuuccuuuccccugucuucaugccacugcuuucccaugcuucuuucg

SEQ ID NO: 531739 - RNA, 64 nt, Human
gaaccugggagguggagguugcagugagccaagaucaugccacugcacuccagccugggcgaca

SEQ ID NO: 531740 - RNA, 64 nt, Human
ugaacccgguaggggagcuugcagugagcccagaucaugccacuguacuccagccuaggugaca

SEQ ID NO: 531741 - RNA, 64 nt, Human
uuugggguugcuuucugcaaaaaguugcugugacucaugccauagacaagguugagugccugga

SEQ ID NO: 531742 - RNA, 64 nt, Human
gucccucuacagauguauuuuccacuugcauaauucaugccaacacugguuuucuuagguuucu

SEQ ID NO: 531743 - RNA, 64 nt, Human
aacuuaccaggaagguuuuuaaguuuagaaauauucaugccaauaaaauaggaaauuauaaaua

SEQ ID NO: 531744 - RNA, 64 nt, Human
caauguggagacacguccuccuccccaacccaccucaugccaccgccaacccccugccccagga

SEQ ID NO: 531745 - RNA, 64 nt, Human
ccagcugggggcagagagguggguggcgggcaccucaugccagcugagaccaagagugguugua

SEQ ID NO: 531746 - RNA, 64 nt, Human
auuaugaaugccacugaggcacugaggcccuaccucaugccaaacaaaggguucaaggcugggu

SEQ ID NO: 531747 - RNA, 64 nt, Human
gagaccucacacacggcugucccucauggagaccucaugccauggucuuugcuaggccucuugc

SEQ ID NO: 531748 - RNA, 64 nt, Human
ucuuguaaauauuugugaauagaaugaauaccuuucaugccacugcagccacuggaaauacauu

SEQ ID NO: 531749 - RNA, 64 nt, Human
cuggagauccugaacugucaagccacuggcagccucaugccaccacauuugccagaaaugcagu

SEQ ID NO: 531750 - RNA, 64 nt, Human
cuucccuggaggucucucccucccccagagccccucaugccacagugguacucugugucuggca

SEQ ID NO: 531751 - RNA, 64 nt, Human
gaacccggaaggcggagcuugcaguuagccgagaucaugccacugcacuccagccuacaugaca

SEQ ID NO: 531752 - RNA, 64 nt, Human
uuuuauauuuuugacuucauguuuuaagagacaaucaugccagagucccacaugagggugacua

SEQ ID NO: 531753 - RNA, 64 nt, Human
cagccagaaguuaaacaucugggauaugacgucuucaugccaggggcacucauuucuuagcagc

SEQ ID NO: 531754 - RNA, 64 nt, Human
cgacgaggaggccaccgugccaagccggcagaggucaugccaggcgccaagggccaugugccca

SEQ ID NO: 531755 - RNA, 64 nt, Human
ucugaggaggcauaugugagauugauuuguugguucaugccaaguguguuccacagguugacuu

SEQ ID NO: 531756 - RNA, 64 nt, Human
cuuuagcauuucagaagugugggccauauguaguucaugccauaaaaaguaggauuuaauuaaa

SEQ ID NO: 531757 - RNA, 64 nt, Human
guaguaucaauguguuacaagagugauuguuucuucaugccagagaaaaugaauugcaaucauc

SEQ ID NO: 531758 - RNA, 64 nt, Human
uaaguaagagugaagauaggccgggugugauggcucaugccaguaaucccagcacuuugggcug

SEQ ID NO: 531759 - RNA, 64 nt, Human
cuucuuugcuuugggauugcacugggccaucagcucaugccaggcuaugggggcagccaguugg

SEQ ID NO: 531760 - RNA, 64 nt, Human
aggaggugugggcugacuaccucccagaagccccucaugccaagccugucccacuggggcucca

SEQ ID NO: 531761 - RNA, 64 nt, Human
uuacuuuuuucccauuuagccccuggaauagcuuucaugccaaguuuagaauuagccaaugaaa

SEQ ID NO: 531762 - RNA, 64 nt, Human
ugggcuuggauaugucucaagacacucaugugaaucaugccaccccaaauccuggcuuaucaag

SEQ ID NO: 531763 - RNA, 64 nt, Human
guuuagucauccugugggaucuauguuaacucuuucaugccacuggugaggcauuuguuaauuu

SEQ ID NO: 531764 - RNA, 64 nt, Human
ccgguguccuguuccugccacauggagcuugacuucaugccagcuauaaucuccccugccuucc

SEQ ID NO: 531765 - RNA, 64 nt, Human
gaaccugggagguggagguugcagugagccgagaucaugccacugcacuccagccugggcaaca

SEQ ID NO: 531766 - RNA, 64 nt, Human
gcagucuguucugaacauagggacauaaguucauucaugccaaguaucuuuccagcauguuucu

SEQ ID NO: 531767 - RNA, 64 nt, Human
gaacccgcgacagggagguugugaugagccaaggucaugccacugcacuccagccugggagaca

SEQ ID NO: 531768 - RNA, 64 nt, Human
cugggugcccuccgauggguggaauaagucugcuucaugccaaggcugggcuuugggucccacc

SEQ ID NO: 531769 - RNA, 64 nt, Human
guaagcccaagcuaagcugcaggcacacacgccuucaugccagugcaugccaggaagcacguuc

SEQ ID NO: 531770 - RNA, 64 nt, Human
auggaaccacaaaaggucacacaagccaaccaugucaugccagaguacaaaacacauaguucuu

SEQ ID NO: 531771 - RNA, 64 nt, Human
gagcccaggagucugaggcuuuagugaucuaagaucaugccacugcacuccagccugggcaaca

SEQ ID NO: 531772 - RNA, 64 nt, Human
aaucucagcucacugcaagcuccgccucccagguucaugccauucuccugccucagccucccga

SEQ ID NO: 531773 - RNA, 64 nt, Human
acuggcaaugcagugaugaacaggaugacaagauucaugccaucaggggcaccuugucacugcc

SEQ ID NO: 531774 - RNA, 64 nt, Human
gugaauauguguauauauguacauagccagagagucaugccacguggucauuaaaccgaugaug

SEQ ID NO: 531775 - RNA, 64 nt, Human
ggcgcaaucucacugcaagcuccacuuccuggguucaugccauuuuccugccucagccucccga

SEQ ID NO: 531776 - RNA, 64 nt, Human
cauguuuagauguuggagcagauuagagcagcauucaugccacucggagcaaccagacuuacag

SEQ ID NO: 531777 - RNA, 64 nt, Human
acauccauccagucugagaaagugagagaggcaaucaugccaagaacaagccagcaaagcucuu

SEQ ID NO: 531778 - RNA, 64 nt, Human
uuuuuuuucugguaagauuuagaccuaaaucgcaucaugccaacuugugacuuugagacuauuc

SEQ ID NO: 531779 - RNA, 64 nt, Human
cuguagcauuuuuuuuucauguguggcaucuuuuucaugccaccaacaaacuuguugugugugu

SEQ ID NO: 531780 - RNA, 64 nt, Human
auaaaaaagaaacaugacucagaccauaagcuuuucaugccagaugucaacauuaagcugcaac

SEQ ID NO: 531781 - RNA, 64 nt, Human
caaccugggaggcggagguugcagugagcuuagaucaugccaccaugccacugcacuccagccu

SEQ ID NO: 531782 - RNA, 64 nt, Human
aguaacagcacaacaaauuaaaaacaaaaacaacucaugccacaguaugucgucuucauguguc

SEQ ID NO: 531783 - RNA, 64 nt, Human
uuuugcggauuucuuagaauuuucuguagacagaucaugccaucuccaaauagagaugguuuua

SEQ ID NO: 531784 - RNA, 64 nt, Human
aaaccgccacagucuucaauccagauuugaagacucaugccauaggugacauucuaaaauacca

SEQ ID NO: 531785 - RNA, 64 nt, Human
ugucaaaugagaguaaucaugcccacccucauugucaugccagauugucagaaguuccagacag

SEQ ID NO: 531786 - RNA, 64 nt, Human
gaacccaggaggcggagguugcaguaagccaaggucaugccacugcacucuagccugggugaca

SEQ ID NO: 531787 - RNA, 64 nt, Human
cucucaucuuucucucucucucucaucauccuccucaugccagauagcauucaggguguccucu

SEQ ID NO: 531788 - RNA, 64 nt, Human
aaugucacagaucugggaggggacuuaagaccuaucaugccaagaggacaccugucuacucagu

SEQ ID NO: 531789 - RNA, 64 nt, Human
ccaggcugccugagcaccucccagccccugccccucaugccaaccccgcccuaggccuggcaug

SEQ ID NO: 531790 - RNA, 64 nt, Human
gagaccaggagguuguggcuguagugagugaugaucaugccacugcacuucagccuggaccaca

SEQ ID NO: 531791 - RNA, 64 nt, Human
gcuuguuaacaauuguuuugagagagauggcuggucaugccacagcugcuggggacuccgccua

SEQ ID NO: 531792 - RNA, 64 nt, Human
gagaccaggaaguugaggcugcaaugagccgugaucaugccacugcacuccagccugggugaca

SEQ ID NO: 531793 - RNA, 58 nt, Human
uggccugguacuacaugugaagcacccaucaugccacaccgguacccuccucccgacu

SEQ ID NO: 531794 - RNA, 64 nt, Human
gagaugugggccuuugauagacccacuugggccuucaugccauggccuguggauggagaaugug

SEQ ID NO: 531795 - RNA, 64 nt, Human
guuguuguuguuguuggcucuuuugcacacggcuucaugccauaaucuuccacucaaggaaucu

SEQ ID NO: 531796 - RNA, 64 nt, Human
gagcccaggaguucgaggcugcagugagccaggaucaugccacugcacuccagccugguccaca

SEQ ID NO: 531797 - RNA, 64 nt, Human
ugaagaaguuggcuuucuuuacaugggaaggaaaucaugccaaaaaaauccaaaacaaagaagu

SEQ ID NO: 531798 - RNA, 64 nt, Human
gaacccaggagguggagguugcagugagucgagaucaugccauugcauuccagccuaggcaaca

SEQ ID NO: 531799 - RNA, 64 nt, Human
gaucucggcucacugcaagcuccaccuccuggguucaugccauuuuccugcuucagccuccuga

SEQ ID NO: 531800 - RNA, 64 nt, Human
ucccugacuacggagccgguucuggaacuuuucuucaugccacggccccugcaaggaaauagau

SEQ ID NO: 531801 - RNA, 64 nt, Human
ggacuccagagguggagguugcaguaagcugagaucaugccacugcacccuagcuuggguggca

SEQ ID NO: 531802 - RNA, 64 nt, Human
guuuugauggaguuugcuuggaauccucuugacuucaugccacauugacgugaacuuugaugua

SEQ ID NO: 531803 - RNA, 64 nt, Human
caccaacaaagcacugcucauacuagacagugcgucaugccacucuguaaauuugagcgaccuu

SEQ ID NO: 531804 - RNA, 64 nt, Human
ucauauuaagccuauuuauaaucuauaugcaauuucaugccauucaggaauucugagugggggc

SEQ ID NO: 531805 - RNA, 64 nt, Human
gagcccgagagguggagacugcaguaagccaagaucaugccauugcacuccagccugggcaaca

SEQ ID NO: 531806 - RNA, 64 nt, Human
cccgauccccgcucccaacacugccggagucgcgucaugccaugcccccucuccugcaccuccc

SEQ ID NO: 531807 - RNA, 64 nt, Human
aaaaaucaaggauucagucaaacuaagcagguacucaugccagguacuccuuucucuacccaca

SEQ ID NO: 531808 - RNA, 64 nt, Human
uagguccgacuacacagcaguguuaacucauuucucaugccauuagcucucuacaaaauaaagc

SEQ ID NO: 531809 - RNA, 64 nt, Human
gagauuauuuuuccauccagggugccaucaguaaucaugccacuacucaccaguguuguucacc

SEQ ID NO: 531810 - RNA, 64 nt, Human
cacguguuucugugugcagcagaggccguguuuuucaugccaaaccccacgcggcugucaacug

SEQ ID NO: 531811 - RNA, 64 nt, Human
caccugucuccaucuuccuugccugccuggguacucaugccaagcagagacugggauuaggggu

SEQ ID NO: 531812 - RNA, 64 nt, Human
caccucagccuccugaguagcugggacuacaggcucaugccaucaugcccagcuaauauuuuuu

SEQ ID NO: 531813 - RNA, 64 nt, Human
uuaauuuccacuggcuaugccacuucagagucuuucaugccagcguuugagcuccucuggguaa

SEQ ID NO: 531814 - RNA, 64 nt, Human
ugccucagccuccggaguagcugggaccacagguucaugccaccauggccagccaacuuuugca

SEQ ID NO: 531815 - RNA, 64 nt, Human
augcaaauguauguuuuaaacacaccaaaacagaucaugccaaaugaguugccugucaaaggcu

SEQ ID NO: 531816 - RNA, 64 nt, Human
cccgggagguugaggcugcaguggggggucauaaucaugccacuguacuccagccugggugaca

SEQ ID NO: 531817 - RNA, 64 nt, Human
caaacuugcauguggagccauguggcacaaauacucaugccagcucauuacagcaugagaacag

SEQ ID NO: 531818 - RNA, 64 nt, Human
ccaaaagcuagggaaacagauacucuuuacaccaucaugccacgcauuguuuuuaaagcauugc

SEQ ID NO: 531819 - RNA, 64 nt, Human
cacuaucauuguauccauauaacuucuagcauuuucaugccaugguaauccaugagcuacacau

SEQ ID NO: 531820 - RNA, 64 nt, Human
cuauuuuuuaguaggaagugagaacagcugauuuucaugccacguuucauagccccacuuuugg

SEQ ID NO: 531821 - RNA, 64 nt, Human
guuuaguuuucaagaauaaagccaucauaagaccucaugccacagaagagauaaaagugcuuuu

SEQ ID NO: 531822 - RNA, 64 nt, Human
gaacccgggaggcagagguugcagugagcugagaucaugccacugcacuccggccuaggugaca

SEQ ID NO: 531823 - RNA, 64 nt, Human
gagcccgggaggcggagguugcagugagccaagaucaugccacugcacuccagccugggcaaca

SEQ ID NO: 531824 - RNA, 64 nt, Human
guacggucugacuucuugagcccauacucaauaaucaugccauccugccuuuccauggaauaac

SEQ ID NO: 531825 - RNA, 64 nt, Human
cacauucuaaaauucaaauacggugcuuaagguuucaugccaugcuuaucuguaaguauccuau

SEQ ID NO: 531826 - RNA, 64 nt, Human
gaacccaggaggcagagguugcagugauccaagaucaugccacugcacuccagccugggcaaca

SEQ ID NO: 531827 - RNA, 64 nt, Human
cacagagaugaacaagaucgguuccuucacuucuucaugccacaaguguuuauugagcaccugu

SEQ ID NO: 531828 - RNA, 64 nt, Human
cagccuggcugagcccgagauucgcuccucccccucaugccaaccccacacaggucccggccuu

SEQ ID NO: 531829 - RNA, 64 nt, Human
agccguuccgugucucuugcaggcugggccggcuucaugccagugcgagggcgucccgugccca

SEQ ID NO: 531830 - RNA, 64 nt, Human
uggaaaggaacaacugauaccagccgcugcaaaaucaugccaaaauguaaagaccaucgagacu

SEQ ID NO: 531831 - RNA, 64 nt, Human
gccuggcacagggaacagcaugcccccuccggggucaugccacccagagacugucgcugucuau

SEQ ID NO: 531832 - RNA, 64 nt, Human
acccugcuaauguaacacgugagaaagccuuuggucaugccacccacucuaccaguugucccca

SEQ ID NO: 531833 - RNA, 64 nt, Human
gaucuuggcucacugcaagcuccgccucccagguucaugccauucuccugccucacccucccga

SEQ ID NO: 531834 - RNA, 64 nt, Human
gagcuugggaggcggugguugcagugagcugugaucaugccaucacaccgcugccuugugagag

SEQ ID NO: 531835 - RNA, 64 nt, Human
gaucucggcucacugcaagcucugccucccggguucaugccauucuccugccucagccucccaa

SEQ ID NO: 531836 - RNA, 64 nt, Human
cgggcugacccagaauccgaucaugcaccuguccucaugccagcggcuuuggcugggguugguc

SEQ ID NO: 531837 - RNA, 64 nt, Human
gaacccaggaagcagagguugcagugagcagagaucaugccacugcacuccagccugggcgaug

SEQ ID NO: 531838 - RNA, 64 nt, Human
cuuuuacauggaauuguuuaauuauuuguacuuuucaugccagaaaauaaaaguucagaaucuu

SEQ ID NO: 531839 - RNA, 64 nt, Human
gaauucaggagguggagguugcagugagccgacaucaugccacugcacuccagccugggcgaca

SEQ ID NO: 531840 - RNA, 64 nt, Human
gaaguucuucagcacuugagcugcauuagaaauuucaugccaaaaaugaauuucaugaauguga

SEQ ID NO: 531841 - RNA, 64 nt, Human
gagcccgggaggcagaggcugcagugaaccaagaucaugccacugcacuccagccugggcaaca

SEQ ID NO: 531842 - RNA, 64 nt, Human
gaucucagcucacugcaagcucugccucccggguucaugccauucugccucagccuccugagua

SEQ ID NO: 531843 - RNA, 64 nt, Human
accauaugagccuuguaaggccaguucaguugggucaugccacuguuugagucucauagggcca

SEQ ID NO: 531844 - RNA, 64 nt, Human
gagccuaggaguucgaggcugcagggagccaugaucaugccauuguacuccagcaugggugaca

SEQ ID NO: 531845 - RNA, 64 nt, Human
gaacccaggaggcggagguuguggugagccaagaucaugccacugcacuccagccugggcaaca

SEQ ID NO: 531846 - RNA, 64 nt, Human
ugaaccugggaggcggagguugcagugagcgagaucaugccauugcacuccagccugggcaaca

SEQ ID NO: 531847 - RNA, 64 nt, Human
aaucucggcucacugcaagcccugccuccuggguucaugccauucuccugccucagccucccua

SEQ ID NO: 531848 - RNA, 64 nt, Human
caguacucagcauauuaaaacaguacaucagaacucaugccaacagucuuuaugaugggauuaa

SEQ ID NO: 531849 - RNA, 64 nt, Human
guaggugggauauuuuuuuucacuaggauacagcucaugccaacccauccuaagugaguucaga

SEQ ID NO: 531850 - RNA, 64 nt, Human
ggagacaguucaagaaagcuucaaacugcaugauucaugccaauuagcaauugacugucacugu

SEQ ID NO: 531851 - RNA, 64 nt, Human
guuguaauaauaaacagauaaggcugcauuugcuucaugccaugugaccucacaguaaacaucu

SEQ ID NO: 531852 - RNA, 64 nt, Human
ggaaaucaagaaaguucuggaaugaugaagcuguucaugccaagaccgaaagugcuggcccagu

SEQ ID NO: 531853 - RNA, 64 nt, Human
uacccuucagcucuuaguuccucugcuggaaacaucaugccaacaacuuacaucucagucacuc

SEQ ID NO: 531854 - RNA, 64 nt, Human
gagcuugggagguugaggcugcagugagccuuggucaugccacuacuguguucuagucugggca

SEQ ID NO: 531855 - RNA, 64 nt, Human
gaucuuggcucacugcaagcuuccccuuccggguucaugccauucuccugccucagccucccga

SEQ ID NO: 531856 - RNA, 64 nt, Human
ucaauuucauuaccguguaccuuucccauuguggucaugccauuuggcagggggagaaugggag

SEQ ID NO: 531857 - RNA, 64 nt, Human
uccuccuuuuucccuuuaagcccacagauucaggucaugccaaaagcucucugguuguaaccug

SEQ ID NO: 531858 - RNA, 64 nt, Human
ggcccuugccacugucuccuggcccucucucugaucaugccagguuugcaccagccucgagucu

SEQ ID NO: 531859 - RNA, 64 nt, Human
gaaccugggacacggagguugcagugagcuaagaucaugccaucgcacuccagccugggggaca

SEQ ID NO: 531860 - RNA, 64 nt, Human
uuaguaaaaacaaaauuggcgacuugaaauuaaaucaugccaagguuuugauacacuugucuua

SEQ ID NO: 531861 - RNA, 64 nt, Human
gagccugggaaguugaggcugcagugagccgugaucaugccacugcauuccagccugugugaug

SEQ ID NO: 531862 - RNA, 64 nt, Human
ggcuggagcagaaaaaaauugucaguaccuuugcucaugccaugcccucagccuggaaugcccu

SEQ ID NO: 531863 - RNA, 64 nt, Human
ugugcuggagccacuaacuagagcagcccuggagucaugccaagcauuuaauguagccauggga

SEQ ID NO: 531864 - RNA, 64 nt, Human
aggggaaaaggccaccacucguuuucucacugauucaugccaauuaagccuacaguuaaagacc

SEQ ID NO: 531865 - RNA, 64 nt, Human
cauccucucuuugcaagcugcugacugggcacacucaugccaaguuucagaauuauuggucuuc

SEQ ID NO: 531866 - RNA, 64 nt, Human
ucgggcuccaaguauuucagaaugauuuaaaaagucaugccacaggaagggucuauugcagaau

SEQ ID NO: 531867 - RNA, 64 nt, Human
cagccuugcugagacacuuucuuuuguguuuacaucaugccaggggcuucauucagggugucug

SEQ ID NO: 531868 - RNA, 64 nt, Human
gauaugagaucaauauccaacaugccaaaaaugcucaugccaguuaaugccaggaaaaaaauca

SEQ ID NO: 531869 - RNA, 64 nt, Human
gaguccaggaguuugagucugcagugagcuaugaucaugccacugcacuccagucugggugaca

SEQ ID NO: 531870 - RNA, 64 nt, Human
aagcuaaggacugguaggaaaaagcuuuacucuuucaugccauuuuauuucuuuuugauuuuua

SEQ ID NO: 531871 - RNA, 63 nt, Human
aguguugcugcaacaauaaagccuguugcaucucucaugccaauuugagccuccuggguaaag

SEQ ID NO: 531872 - RNA, 64 nt, Human
caaauaaccuuuuuucagcauccucuguccucagucaugccagucuggacaugcucuguugugc

SEQ ID NO: 531873 - RNA, 64 nt, Human
ucaaacuaauuuguugggguagagauuuuacaagucaugccauuagaagauuuucucugauauu

SEQ ID NO: 531874 - RNA, 64 nt, Human
guugccgcacagauuccugaccauccucagaaucucaugccauuuucccgcagagcugagggau

SEQ ID NO: 531875 - RNA, 64 nt, Human
ccuagauuaggagaggaagccaggggcccugcacucaugccaccugccagguaguguaguauca

SEQ ID NO: 531876 - RNA, 64 nt, Human
agaaacaucugcaaagauacagucugacucaguggguugacaggaacaugcgaagccaccaucg

SEQ ID NO: 531877 - RNA, 64 nt, Human
uuugaauuucuucuuucagggaauaagaaacccugguugacagaggcuucaucaggcuguggug

SEQ ID NO: 531878 - RNA, 64 nt, Human
ucaaagguaaauugcaguuguagacaccgaggaugguugacaacccaugguugagaugggcacc

SEQ ID NO: 531879 - RNA, 64 nt, Human
agggcuugugaccaaugaagucauauuuguugaugguugacaaagcuugcuucacuccaucaga

SEQ ID NO: 531880 - RNA, 64 nt, Human
uaaauacugaaacacauuaugccucuguaauugggguugacacaugaacagaauagcagacaca

SEQ ID NO: 531881 - RNA, 64 nt, Human
ccaucuuccccagaaacgaucaagaagggcaauggguugacagcccagauauggcaggaccaga

SEQ ID NO: 531882 - RNA, 64 nt, Human
ggugguuuuacaauguuccagagcaggaacgccagguugacaagcuaugguaggauuaggaaag

SEQ ID NO: 531883 - RNA, 64 nt, Human
aauguaauugacaggauggcugcugcagaaugcugguugacacagggauuauuauacugcuauu

SEQ ID NO: 531884 - RNA, 64 nt, Human
cuuagcugcaugagaauaauacuauuauaaguuagguugacaaaugauguugauuauguaagga

SEQ ID NO: 531885 - RNA, 64 nt, Human
aagaaagcgucacagccagcgucuguucacccaagguugacaagugaaguuucucuaauguuga

SEQ ID NO: 531886 - RNA, 64 nt, Human
cguaaucucggcucacugcaagcuccgccucccggguugacaccauuuuccugccucagccucc

SEQ ID NO: 531887 - RNA, 64 nt, Human
uguccacauccaguucaccccagagggucgggcagguugacauauuuauuuuugucuauucugu

SEQ ID NO: 531888 - RNA, 64 nt, Human
uucccuguccauuucugugacuaagcugugcagagguugacagcagggcaaguuacauugauau

SEQ ID NO: 531889 - RNA, 64 nt, Human
acuucaucccaauugucaaacauccuagguaagugguugacauuucuuacagcaauuacagauu

SEQ ID NO: 531890 - RNA, 64 nt, Human
ggacaguuaccuuccuggugucauugccauccuggguugacaagcugagaguagaggauacaag

SEQ ID NO: 531891 - RNA, 64 nt, Human
agaguuuaugauuuaagguacuuaaagcuucuaugguugacauuguauauauaauuuuuuaaaa

SEQ ID NO: 531892 - RNA, 64 nt, Human
ccuggggaaugaaugaaauuuugagcuucuucaauacguaaaauuaaauuuauaccacugaggg

SEQ ID NO: 531893 - RNA, 64 nt, Human
auuuuuuauguauuguuuuacuccuuuuuauucauacguaaaauuuuggauuaauuugugaaaa

SEQ ID NO: 531894 - RNA, 64 nt, Human
augcaguaagcucuccuuaccauaaauguuucuugguugacaacaucuaagacaauauuagugg

SEQ ID NO: 531895 - RNA, 64 nt, Human
gcucgugggcagggcgcagaccugaucuuuauaggguugacauagaaagcaguaguugugggug

SEQ ID NO: 531896 - RNA, 64 nt, Human
cuuuguuguccaucccuauacaaccugccaacaugguugacauuuaaugagaggaaugucaaaa

SEQ ID NO: 531897 - RNA, 64 nt, Human
acucucucuuugauaacuaagcaaauggaauuaugguugacagagaguuuaugauccagaagac

SEQ ID NO: 531898 - RNA, 64 nt, Human
ccuuugacuuguuaaagguaccacccuacaucaugguugacacccuccuuuggaccaugcaguc

SEQ ID NO: 531899 - RNA, 64 nt, Human
cuuaugucagaccuauuugacauaacacuauaaagguugacaauaaaugugcuuauguuuaucu

SEQ ID NO: 531900 - RNA, 64 nt, Human
cgcaaucucggcucacugcaaccuccgccucccagguugacaccauucuccugccucacccucc

SEQ ID NO: 531901 - RNA, 64 nt, Human
acugcuguucauuucuaucugccauuucugucaggguugacacaauccugcaagaauaguuauu

SEQ ID NO: 531902 - RNA, 64 nt, Human
aaauaaauuuugaauguuuauguucucagaaucagguugacagucccuugcugacauggcuuug

SEQ ID NO: 531903 - RNA, 64 nt, Human
caguagccaugacugcaccacugcauuccagccugguugacagagugacccuugucuccaagaa

SEQ ID NO: 531904 - RNA, 64 nt, Human
uaaggggccacuggggaagccugggucaguauaugguugacauucuuacucucaacaccuuggc

SEQ ID NO: 531905 - RNA, 64 nt, Human
ucucauuccaguuuuuucuaacaugaauuuuccugguugacauugauuucaaaggguuuuaugc

SEQ ID NO: 531906 - RNA, 64 nt, Human
uuuaugcuuucaaacugaauuaaacccauugugagguugacacugggaggggcuagaagauugg

SEQ ID NO: 531907 - RNA, 64 nt, Human
caaaguuacuuucuauaugcggccggaacagggugguugacaucaguuuucuucagguuacuuu

SEQ ID NO: 531908 - RNA, 64 nt, Human
aaccccaggcacucagucucuaacaagcuuuucugguugacaguguuucacaagugcuguuaca

SEQ ID NO: 531909 - RNA, 64 nt, Human
auuggacaggaggacaguauuucagaaaaggagagguugacagucauccacaaggcauagccuc

SEQ ID NO: 531910 - RNA, 64 nt, Human
cauuuuuaaguauuguuuuacuccuuuuuauucauacguaaaauuuuggauuaauuugugaaaa

SEQ ID NO: 531911 - RNA, 64 nt, Human
uaucuaauuacaggagaauuuacaacaucucaaguacguaaauuaaguugucauugagugaaag

SEQ ID NO: 531912 - RNA, 64 nt, Human
ugucuuugauguguccaagaaaauucguguaguuuacguaaaaauaucugacucacaagaaagc

SEQ ID NO: 531913 - RNA, 64 nt, Human
ccaacauggugaaaccccgucucuacuaaaaaaauacguaaaaauuagccaggcgugguggcac

SEQ ID NO: 531914 - RNA, 64 nt, Human
auaacuuacuguuaaaagcaaaaauggccaugcagguugacaccguugguaauuuauaauagcu

SEQ ID NO: 531915 - RNA, 64 nt, Human
aguggguggugguuauguuugacagaaggcauuagguugacaacuugucaugauuuugacggua

SEQ ID NO: 531916 - RNA, 64 nt, Human
gucugacauuugaagcuggaaaaccagauagauggguugacaucaguuuauuccagcaagaaag

SEQ ID NO: 531917 - RNA, 64 nt, Human
uuuuucuuaguguauauaauuguuuaaacugcaagguugacauuuauuguguugugucuaaguu

SEQ ID NO: 531918 - RNA, 64 nt, Human
aaacaaaaugaaauaauuugaguuguauuacagagguugacauuguucagggaugggacaaagc

SEQ ID NO: 531919 - RNA, 64 nt, Human
agcucaggagggaugggccugaccugacgcucaggguugacaucuuauuugaacaagggucccc

SEQ ID NO: 531920 - RNA, 64 nt, Human
gauuuuugcugccuucgggucaaauaguuucccugguugacacucuugggccacucugauuggc

SEQ ID NO: 531921 - RNA, 64 nt, Human
uuguguuuuaauuuuucauaaaauugaaccuguugguugacaaaauuggcuguuggcaucagua

SEQ ID NO: 531922 - RNA, 64 nt, Human
cacuuaaaagauggugaacugugaguacuacuuagguugacagcaacaaagcauaagacaagcc

SEQ ID NO: 531923 - RNA, 64 nt, Human
ugccauguucaguuaaagugcacagucuguuacagguugacacauugcuugaccugauuuaugc

SEQ ID NO: 531924 - RNA, 64 nt, Human
uguguuagcacacuugcauaugugccguauuaaggguugacaauuacuacaucuuuauucucua

SEQ ID NO: 531925 - RNA, 64 nt, Human
aagcuagggcuugcuguaaguuggaagaacacuggguugacagagaucuacugugagcuguauu

SEQ ID NO: 531926 - RNA, 64 nt, Human
cagccacucucuucuacgcugccucaacacugaagguugacacaggaaagucguacuguucaca

SEQ ID NO: 531927 - RNA, 64 nt, Human
agagugguccuaggagaggaccuggcacaccuuagguugacauucagaaaacuucaagacauca

SEQ ID NO: 531928 - RNA, 64 nt, Human
auugcauuuuuucaaguggaaaaguuaacuaaaugguugacacacaaaaauugguggagaaauu

SEQ ID NO: 531929 - RNA, 64 nt, Human
uaauauuaugccaggauagaaaugaacaugccaugguugacaguaauaggaauaacaggagaca

SEQ ID NO: 531930 - RNA, 64 nt, Human
uccaacauagaugugauuuauauaacuuuguugauacguaaauugucuugggguuuacggaaau

SEQ ID NO: 531931 - RNA, 64 nt, Human
aguuuaaaaagcuacaaucacaucauguuguaacuacguaaaaaacagagcuguaaauggaacu

SEQ ID NO: 531932 - RNA, 64 nt, Human
aaguacaaaacuugauguaaauuguaccaaugaauacguaaacauacagugacaacauuaaacu

SEQ ID NO: 531933 - RNA, 64 nt, Human
cucaccuucaaaaauauuuauauugucacucauuuacguaaaaagauauuucuaauuuacuguu

SEQ ID NO: 531934 - RNA, 64 nt, Human
agccucuuugaucauuucugugguguucaguggagguugacagcucccuaaagauuuuccuguu

SEQ ID NO: 531935 - RNA, 64 nt, Human
gaaucuuugaaucagaaggaaaaaaagcagcgcugguugacaaaggguguugaagauuuuugcu

SEQ ID NO: 531936 - RNA, 64 nt, Human
gacacucaugcagaaugagaucaggcauauuugugguugacauacucuagauagcuuuuccaac

SEQ ID NO: 531937 - RNA, 64 nt, Human
cgggcuuaaucuuaaaauugguggucauuucaaugguugacauauuuggcuauuuauuaaccuc

SEQ ID NO: 531938 - RNA, 64 nt, Human
agauacuccuuagagguuucuagcaugcgcccgggguugacaacagcuggacaaacuugaaaag

SEQ ID NO: 531939 - RNA, 64 nt, Human
uacuaagcuuaauuuuuaaaaacaaaaucuguaggguugacaaauaaauaguugcucuucuaca

SEQ ID NO: 531940 - RNA, 64 nt, Human
acguuuauuucacagcagagccaagucuguggcagguugacacagacuguguugccagagcuga

SEQ ID NO: 531941 - RNA, 64 nt, Human
uucuuuuuuuaaaaauaaguuaauugcuuuugcagguugacacucucaccugacagaugaugua

SEQ ID NO: 531942 - RNA, 64 nt, Human
uuauagcugauuugaagguuuucuauuuaacacugguugacaguauaauuuucccaaagggcaa

SEQ ID NO: 531943 - RNA, 64 nt, Human
uuuguaaaaugacaaucauguagaaaccugucuugguugacaaucucuuugaaacauuuccgag

SEQ ID NO: 531944 - RNA, 64 nt, Human
gauuuuauuuacagauuuuuuuaaaagccaccuggguugacaccuuccuacuuauccacuagau

SEQ ID NO: 531945 - RNA, 64 nt, Human
cuguuuuaggaucaagacuaggaauuaggagccagguugacaaggacuuuuucugagaguuggg

SEQ ID NO: 531946 - RNA, 64 nt, Human
uucaucuggcaacaucuuuauccguaguggguaugguugacacuagcccaaugaaaugaauuaa

SEQ ID NO: 531947 - RNA, 64 nt, Human
uguauaggaagaagccagcaggagcucugacuaagguugacauaauaguccaccucccauuacu

SEQ ID NO: 531948 - RNA, 64 nt, Human
augauggaaauuaaauaguaugccagaauaacaugguugacaaauaagugaacaaggauuaaaa

SEQ ID NO: 531949 - RNA, 64 nt, Human
agagaagcugagggcggucucugaucuguguguggguugacauuuuagcuaauaaagccuugca

SEQ ID NO: 531950 - RNA, 64 nt, Human
auuaauguuaagaauggccauauaccacuucauuuacguaaaaggaauaaaauaagcaaguuaa

SEQ ID NO: 531951 - RNA, 64 nt, Human
aaaggaacaugacguugaucauuugggcaaauuuuacguaaagagaagagcauuuauuguguuu

SEQ ID NO: 531952 - RNA, 64 nt, Human
ccaaggucuguguucagcacuuggucucuguuguuacguaaaauaauaagcauuuaaaauaguu

SEQ ID NO: 531953 - RNA, 64 nt, Human
gaauuccccuauuucucaugaguagauacaaucuuacguaaaagagugguuagucacgugaauu

SEQ ID NO: 531954 - RNA, 64 nt, Human
uaagcaaaucaugcuucucuguuucacguaguuggguugacaaguuucugccuuuaagauaaau

SEQ ID NO: 531955 - RNA, 64 nt, Human
aguucaaauaacuugcauauuuacuauacaaaaugguugacaaguguucuuuuugcaaagacuu

SEQ ID NO: 531956 - RNA, 64 nt, Human
aucuuaguaacugaggaucauuuucuaacaaugugguugacauaccuucaguugcuuuccacau

SEQ ID NO: 531957 - RNA, 64 nt, Human
gaguuugaaaguccugauucagagagagacugaggguugacaaauaaacuguaucaacuaaacu

SEQ ID NO: 531958 - RNA, 64 nt, Human
uuguuuaugccaagguggacaacaacacagcauugguugacaaauugaagcguuuccagcagga

SEQ ID NO: 531959 - RNA, 64 nt, Human
caugcuucaucauucccucucaucucagguagaagguugacacaguuguaggguuacagagacc

SEQ ID NO: 531960 - RNA, 64 nt, Human
ugcucauuuucugguuuggcauggugaguguugggguugacauuuagaacuuuaagucucaccc

SEQ ID NO: 531961 - RNA, 64 nt, Human
ccuagaggggacuacccaaggauggagcuccguggguugacacuuuuucugugaaaagaacacu

SEQ ID NO: 531962 - RNA, 64 nt, Human
caccaguggguauaugauugaauuuagggaacaggguugacacagcagggcuaguccugcauau

SEQ ID NO: 531963 - RNA, 64 nt, Human
auuuucuacacuaaauaccauuggugucuuuauagguugacauaauuauauauguguauguaca

SEQ ID NO: 531964 - RNA, 64 nt, Human
caggagucagcaggucacagucuggcuuugugaugguugacaaggucuagcuacaugggaaagc

SEQ ID NO: 531965 - RNA, 64 nt, Human
uaaagcaguggcuuuguauagcaagcugaguaaagguugacauauuccaaaacccuucuuuuua

SEQ ID NO: 531966 - RNA, 64 nt, Human
gaaauuucuugcuagugaaucaagaaaacauccagguugacagucuaaaauggcuacugguauu

SEQ ID NO: 531967 - RNA, 64 nt, Human
ucauucagugugcucccugggccuuuauggcauggguugacaggauuuguuuauuuucuaaaau

SEQ ID NO: 531968 - RNA, 64 nt, Human
auuauaaagcauuuuucacacucaagugaaacaagguugacaaacucacuucgcaggucacaug

SEQ ID NO: 531969 - RNA, 64 nt, Human
cagcaugucugcacgugugcaugcauacacaccggguugacagauagagaaaacuggguuugaa

SEQ ID NO: 531970 - RNA, 64 nt, Human
cccuggcucuuuucuuuaaagcccaggccccacuuacguaaaacauuucagggucacuggaaac

SEQ ID NO: 531971 - RNA, 64 nt, Human
uuucacguauguggaugccaguuaauuaaaugaguacguaaauaaauuaauuaaaacacauaga

SEQ ID NO: 531972 - RNA, 64 nt, Human
guuugaaauuauuuauugugauguaauauuuuuguacguaaaaugauucuauuaugacugccuu

SEQ ID NO: 531973 - RNA, 64 nt, Human
aagacugaaugcuguguuuaaauaaauugaaaacuacguaaacucuggaaaguauucuauaaga

SEQ ID NO: 531974 - RNA, 64 nt, Human
ucccuacgguaauccacaaucuguucuuuguguggguugacaccuauuuauaauucuuaaaaua

SEQ ID NO: 531975 - RNA, 64 nt, Human
ggccaagggaguggcagaacugggccgccucucugguugacaagcaaaccacaugcuaaggcuu

SEQ ID NO: 531976 - RNA, 64 nt, Human
gguucuaggcuauagguaaauuuaaauauuuucugguugacaauuaguugaguuugucugaaga

SEQ ID NO: 531977 - RNA, 64 nt, Human
gaaacaugaugacuggaagucaugucuucuaauugguugacauuuugcaaacaaauaaauugua

SEQ ID NO: 531978 - RNA, 64 nt, Human
ucuuccccuuccugccauuuucccucccuugaaagguugacacuggacaaccuuggggcagcug

SEQ ID NO: 531979 - RNA, 64 nt, Human
uguugguaaaauucugucuugaugcauucaaaaugguugacauaauuaaugagaagaauuugga

SEQ ID NO: 531980 - RNA, 64 nt, Human
ggauugaggccuuuuaaaggucacucagguuccagguugacaguuggaggacuucaccguacca

SEQ ID NO: 531981 - RNA, 64 nt, Human
augaugucugguuuaguacuggaauugcacuugggguugacaaggugcucacaccaugagaaug

SEQ ID NO: 531982 - RNA, 64 nt, Human
uagacauggguaccaaaaauacccaauucuaagugguugacagauguucacuuugaagugugaa

SEQ ID NO: 531983 - RNA, 64 nt, Human
cagaaaugauaugagaaauacugauauuuuaaaugguugacaucauccagcgaaaugaaucuac

SEQ ID NO: 531984 - RNA, 64 nt, Human
guucgaguaaguaaagcauauuagaauaauuguggguugacagauuuuuaaaauagaauuuaga

SEQ ID NO: 531985 - RNA, 64 nt, Human
acccccugcccuuuugcuucccucccaucagucugguugacaggaagaaaccacaccaucaaca

SEQ ID NO: 531986 - RNA, 64 nt, Human
gauacuggagauuuaaugagaaaaaguaccaaaagguugacacaugguaagcauucauuguaag

SEQ ID NO: 531987 - RNA, 64 nt, Human
uugauacugagacuugggagggaaacuaagaaaugguugacagcguucccacccaucuacaaug

SEQ ID NO: 531988 - RNA, 64 nt, Human
cugcauuugauuuucaaggaugccgucaagacgggguugacacaaugcugcacgugucugguca

SEQ ID NO: 531989 - RNA, 64 nt, Human
cucuuggccucagcagcucuucccuguucuuacugguugacauuuugaucacucuuugcacacu

SEQ ID NO: 531990 - RNA, 64 nt, Human
acauauguaaaaauuguuguuuuacauuuacauauacguaaagaaguauguuuuuacacuuuuc

SEQ ID NO: 531991 - RNA, 64 nt, Human
ucucuucaaaaacuucucgaaccgcugugucuccuacguaaaaaaagagauguacaaaucaaua

SEQ ID NO: 531992 - RNA, 64 nt, Human
cauaaaauauagcaagcuuacauauuaaacuauuuacguaaauggaauguaagccaugacuuua

SEQ ID NO: 531993 - RNA, 64 nt, Human
caauauaaaggguuuuguugaaucaacaaugugauacguaaauuauagaaaaagaaaagaaaca

SEQ ID NO: 531994 - RNA, 64 nt, Human
auugcauuuauucaaguagaaaaguuaacuaaaugguugacacacacgaauugguggagacauu

SEQ ID NO: 531995 - RNA, 64 nt, Human
gaaguacuuaccucuugaagauuuaauauauaaugguugacaugauacauguacaugaugaaug

SEQ ID NO: 531996 - RNA, 64 nt, Human
cagcugcugcucgccagaagcccuugauuccacugguugacauggcagcaguuacuggcaagag

SEQ ID NO: 531997 - RNA, 64 nt, Human
ccaguuuacgucucaggaaugaaguguagucuaugguugacaauggaguuuugugauccugcuu

SEQ ID NO: 531998 - RNA, 64 nt, Human
uccgaguggcagcccaugccuucugcgggguauggguugacacuugacagguugaaaccagugc

SEQ ID NO: 531999 - RNA, 64 nt, Human
cacaaacacaguuauuccaugaaguuuaguauuugguugacauagugcucuucaaauucauccc

SEQ ID NO: 532000 - RNA, 64 nt, Human
aaaaccaaggaaguccuugguguucuccacaagugguugacauuugacugcuuguuccaauuau

SEQ ID NO: 532001 - RNA, 64 nt, Human
gccauuguugaacuccucuauacuccugggcacugguugacaguacugaggcuuaaggcagcug

SEQ ID NO: 532002 - RNA, 64 nt, Human
aucacacagaccucgaguuucugguaagacugcugguugacaucagacccaacccaugaaggcu

SEQ ID NO: 532003 - RNA, 64 nt, Human
gcuggccuucucauuccacaagggcccuggaaaggguugacagccagccuuggcauauggcugg

SEQ ID NO: 532004 - RNA, 64 nt, Human
guuucaaaugugucaaauacaaaaaugguaacuagguugacagauacuuuguauuuuucuuuug

SEQ ID NO: 532005 - RNA, 64 nt, Human
ggcacagggugugucugugguauaccugugaggugguugacaauuaguaguuuaaucacagggu

SEQ ID NO: 532006 - RNA, 64 nt, Human
gccaaaccgcuucacaucugcagugcuuccccaggguugacaaggggccguccuuuccacacag

SEQ ID NO: 532007 - RNA, 64 nt, Human
uuuacaugccucugaaacuaugugcaauauuuuugguugacacuuguauccauccuuaagaaau

SEQ ID NO: 532008 - RNA, 64 nt, Human
cucccucucaccucugggaagugcaaauacucuugguugacauccccuuccucagcccucccag

SEQ ID NO: 532009 - RNA, 64 nt, Human
gcuguuuaucugccccaaaggagaagccucaugggguugacauagguccuuucugccaucucug

SEQ ID NO: 532010 - RNA, 64 nt, Human
cauuguuauuguggaagauuuaccuuuucuguuguacguaaagcuuaaauugcuuuuguuguga

SEQ ID NO: 532011 - RNA, 64 nt, Human
ugugcuaacuaucuuauauauaaugagagccagcuacguaaaaguagcugagaggccuugggag

SEQ ID NO: 532012 - RNA, 64 nt, Human
auaaaaugcuauuuuaaaauucauggaacuuucauacguaaaggugcaguugcucauuguagag

SEQ ID NO: 532013 - RNA, 64 nt, Human
uacuagacaauuuuguuuuuuauguauguguauguacguaaauacauacauauuaauuuacauu

SEQ ID NO: 532014 - RNA, 64 nt, Human
gacucaauagucuugguugggacuauugccucaggguugacaacagggugauggaggccuggga

SEQ ID NO: 532015 - RNA, 64 nt, Human
agcuggacggcccuguuccagggaggaggugcucgguugacaccaucagggagggagggugggc

SEQ ID NO: 532016 - RNA, 64 nt, Human
agugaguugugaucacaccauugcaguccagccagguugacagaaugagacccugucucuuaaa

SEQ ID NO: 532017 - RNA, 64 nt, Human
gcuuccugggaagguuuaccauuuucauggaaaugguugacauuacacaugguauuugucaugc

SEQ ID NO: 532018 - RNA, 64 nt, Human
caaccgcuucaacauuguaagcgauguaugcuuugguugacaggaaguuccuuuuccaggcagg

SEQ ID NO: 532019 - RNA, 64 nt, Human
ugaaauaauggaucuaggcaugauucucuguacagguugacaccauucagugaagguugugaac

SEQ ID NO: 532020 - RNA, 64 nt, Human
gagcugaaccucauguguuccacucccaauaaaagguugacaggggcuucuccuucucugggau

SEQ ID NO: 532021 - RNA, 64 nt, Human
auuugguguggaaagcauaggaggccccuuccgagguugacaccguguccuccgcgguguuucu

SEQ ID NO: 532022 - RNA, 64 nt, Human
guaauauuaauaguuauuauuuacuggugcagaugguugacauuuuucccuauuuuccucacuu

SEQ ID NO: 532023 - RNA, 64 nt, Human
uauguuuucauuaaggguuuuuaguuuuugguuggguugacacuaacuuuucuuaagaugcugu

SEQ ID NO: 532024 - RNA, 64 nt, Human
agagaaccaaaacagcuaagagagguauuaucaggguugacaacuccuaugauugaaucuaugg

SEQ ID NO: 532025 - RNA, 64 nt, Human
gacacuaaacuacaucauuaacaugucacagcuugguugacaauaaucaccaagaaaaucucuu

SEQ ID NO: 532026 - RNA, 64 nt, Human
aaguuauuucucugacugaauagacagugguauagguugacacagcacacaaguggcuauugug

SEQ ID NO: 532027 - RNA, 64 nt, Human
uacagccuuuuuuuaaaauaaauuaaucuauauugguugacaaacaagccaccaaccacugacu

SEQ ID NO: 532028 - RNA, 64 nt, Human
accuuugggucauugcccuuucacuucagaaacagguugacaacucagcccugcucaugaggca

SEQ ID NO: 532029 - RNA, 64 nt, Human
aacauguuaucuuaaauaccccuuuauccuuacagguugacauaacuuugaauguuuuaacagc

SEQ ID NO: 532030 - RNA, 64 nt, Human
uucugguuucauguucucuugaaacauugaauuguacguaaauauaaaggaucuacuguugcgg

SEQ ID NO: 532031 - RNA, 64 nt, Human
cauuggccagcaucuguuuaucaaaugacauaaauacguaaaccuauaagaauuaaguuuauua

SEQ ID NO: 532032 - RNA, 64 nt, Human
aacaauacuaugcauucucuauggcuauauaauguacguaaaucuauuuuuaaagguucagagg

SEQ ID NO: 532033 - RNA, 64 nt, Human
uuaaugcacaaaugaucucuaauauauacuuacauacguaaaaucauaaaguuugguaaugcag

SEQ ID NO: 532034 - RNA, 64 nt, Human
caaaagcuuguguguugacccuuuguagccuaaguacguaaacaaauuaauguuaucuaaguuu

SEQ ID NO: 532035 - RNA, 64 nt, Human
ucuugaacaccacugugauucuccaaggacgaauuacguaaauuauacuuucauacaaaggaga

SEQ ID NO: 532036 - RNA, 64 nt, Human
uccugugucagucuaugaaaucccuguuuugaaauacguaaacagccuaaaauguguugaaauu

SEQ ID NO: 532037 - RNA, 64 nt, Human
cuugaaaguuguaaaaaaauuaaagcauauuuguuacguaaaguuaaaaugauuuuugucugaa

SEQ ID NO: 532038 - RNA, 64 nt, Human
aauaugcuaaaaauauuuucauauuuaaauaacauacguaaaggugugcuuucuguguuuuaua

SEQ ID NO: 532039 - RNA, 64 nt, Human
cauguggagugaaagcugguuuuuauacaggagauacguaaaguaggccccacaaauaauauuu

SEQ ID NO: 532040 - RNA, 64 nt, Human
uuguuguguaauauaucaucauugcuuuuguaaauacguaaaacuguaauuuuuuaauggugug

SEQ ID NO: 532041 - RNA, 64 nt, Human
accucugaaggaaaucauuugaauuuuguuuuuguacguaaaguuaaccuuccaauugucugag

SEQ ID NO: 532042 - RNA, 64 nt, Human
uugaauuucucauauuauauaguaaauauauuccuacguaaaccuuugauaccuagaucaggaa

SEQ ID NO: 532043 - RNA, 64 nt, Human
auuuuccucuaaguuccuuccaccaaauaaauauuacguaaaaaauucauaccaaaucaaugag

SEQ ID NO: 532044 - RNA, 64 nt, Human
aacagcugugacaguacacuccaaaauguauaauuacguaaacacauauucaauucuugcuaac

SEQ ID NO: 532045 - RNA, 64 nt, Human
cugggagaaccucuuuuucucccucgacucuuccuacguaaacucccaccccugacuuacccug

SEQ ID NO: 532046 - RNA, 64 nt, Human
uuuaaaaaauaauacuguguuguguuuaucuaaauacguaaacucaagcuaccaaagagaaaga

SEQ ID NO: 532047 - RNA, 64 nt, Human
uauaaacaggccaugcauauaauguacaguguauuacguaaauauguaaagauucuucaaggua

SEQ ID NO: 532048 - RNA, 64 nt, Human
acuuuguuuauuguaaaacagcuaaauuuggagauacguaaagccuuguuuucucugugugguu

SEQ ID NO: 532049 - RNA, 64 nt, Human
guauuuuuguaaauaguuuaacacuuucuuuuuuuacguaaaccugaaauauauuuuaaaugug

SEQ ID NO: 532050 - RNA, 64 nt, Human
ugaagccucugauacuuaaacagcauggcgcugguacguaaauagaccaaugcaguuagguggc

SEQ ID NO: 532051 - RNA, 64 nt, Human
ucuagcauugcuauucaccggcuuccuuauuuuauacguaaaaauuaagauuuuauauuuuauc

SEQ ID NO: 532052 - RNA, 64 nt, Human
uaccguugaccugaguuaaauucauuuagucguguacguaaaaacucuccuuuuaguguguuau

SEQ ID NO: 532053 - RNA, 64 nt, Human
auuuuuuaacuuuguuuuaugcaaaaaaguaucuuacguaaauuaaugauauaaaucaugauua

SEQ ID NO: 532054 - RNA, 64 nt, Human
guuucuucaguuuaauauuuugauuuuguguuuuuacguaaauauuuauauuccuugaaagcaa

SEQ ID NO: 532055 - RNA, 64 nt, Human
uucaaaagguggaauauaguucugucagggcuuuuacguaaaccuccacuuguacaugcaauuu

SEQ ID NO: 532056 - RNA, 64 nt, Human
gacggauuaucuagagaauaaucauauauaugcauacguaaaaauggaccacagugacuuauuu

SEQ ID NO: 532057 - RNA, 64 nt, Human
uguggcuuauaaauauuuugguauuuuucuauacuacguaaauucugaguuuaaaugucauaca

SEQ ID NO: 532058 - RNA, 64 nt, Human
ugaagaugcccuuuuuacccguugacguuuauuuuacguaaaauaaacuguuguuuccaaugca

SEQ ID NO: 532059 - RNA, 64 nt, Human
gaacauugcuuaauccuuuuaaaaaaaaugcauuuacguaaacacgaauacugaaauuguugga

SEQ ID NO: 532060 - RNA, 64 nt, Human
ucuguuugcuucuaaagguuucacuguucaugaauacguaaacugcguaggagagaacagggau

SEQ ID NO: 532061 - RNA, 64 nt, Human
aacggguucucugccuauuuuaaaauagugaauauacguaaauuuucucuggaaggcugaggca

SEQ ID NO: 532062 - RNA, 64 nt, Human
uuaccuuucuucaccuugguuauuuggccaggaauacguaaauucaaacuuguacaugcugaug

SEQ ID NO: 532063 - RNA, 64 nt, Human
auauuuggggacguagccuaacauuuuaccaacuuacguaaaucaaaaaagucauuauuguugc

SEQ ID NO: 532064 - RNA, 64 nt, Human
gaugccaggugcaaucuacuggaaauguagcacuuacguaaaacauuuguuucccccacaguuu

SEQ ID NO: 532065 - RNA, 64 nt, Human
gacuggcuugcuuugauuuuuagugaagggaauguacguaaaacaaaauagggcuuggcugguc

SEQ ID NO: 532066 - RNA, 64 nt, Human
cagacauuaaccuauuccaccuuacucaaggguguacguaaaacaugguaacaguauacuauuu

SEQ ID NO: 532067 - RNA, 64 nt, Human
uuucauaauaaucaugaauacuuuuccaggucaguacguaaagauguaacccauucuuuguaag

SEQ ID NO: 532068 - RNA, 58 nt, Human
caucuaggcaaccccuuugaucauguuguacguaaacaguauuuauuauaaauuacua

SEQ ID NO: 532069 - RNA, 64 nt, Human
acuacuaauugagcaaccuacgcacucaguugacuacguaaaucugucaggucuuuugugauuu

SEQ ID NO: 532070 - RNA, 64 nt, Human
accaaaaaacuaaagcaguuuuuaaaccgauauuuacguaaagaaaaucauaaaauccaaugcu

SEQ ID NO: 532071 - RNA, 64 nt, Human
aacugcuuccuauaauuuugauagugggaccacauacguaaaaaucucucauuuguguggaguc

SEQ ID NO: 532072 - RNA, 64 nt, Human; identical to SEQ ID NO: 99117

SEQ ID NO: 532073 - RNA, 64 nt, Human; identical to SEQ ID NO: 99118

SEQ ID NO: 532074 - RNA, 64 nt, Human; identical to SEQ ID NO: 99119

SEQ ID NO: 532075 - RNA, 64 nt, Human; identical to SEQ ID NO: 99120

SEQ ID NO: 532076 - RNA, 64 nt, Human; identical to SEQ ID NO: 99121

SEQ ID NO: 532077 - RNA, 64 nt, Human; identical to SEQ ID NO: 99122

SEQ ID NO: 532078 - RNA, 64 nt, Human; identical to SEQ ID NO: 99123

SEQ ID NO: 532079 - RNA, 64 nt, Human; identical to SEQ ID NO: 99124

SEQ ID NO: 532080 - RNA, 64 nt, Human; identical to SEQ ID NO: 99125

SEQ ID NO: 532081 - RNA, 64 nt, Human; identical to SEQ ID NO: 99126

SEQ ID NO: 532082 - RNA, 64 nt, Human; identical to SEQ ID NO: 99127

SEQ ID NO: 532083 - RNA, 64 nt, Human; identical to SEQ ID NO: 99128

SEQ ID NO: 532084 - RNA, 64 nt, Human; identical to SEQ ID NO: 99129

SEQ ID NO: 532085 - RNA, 64 nt, Human; identical to SEQ ID NO: 99130

SEQ ID NO: 532086 - RNA, 64 nt, Human; identical to SEQ ID NO: 99131

SEQ ID NO: 532087 - RNA, 64 nt, Human; identical to SEQ ID NO: 99132

SEQ ID NO: 532088 - RNA, 64 nt, Human; identical to SEQ ID NO: 99133

SEQ ID NO: 532089 - RNA, 64 nt, Human; identical to SEQ ID NO: 99134

SEQ ID NO: 532090 - RNA, 64 nt, Human; identical to SEQ ID NO: 99135

SEQ ID NO: 532091 - RNA, 64 nt, Human; identical to SEQ ID NO: 99136

SEQ ID NO: 532092 - RNA, 64 nt, Human; identical to SEQ ID NO: 99138

SEQ ID NO: 532093 - RNA, 64 nt, Human; identical to SEQ ID NO: 99139

SEQ ID NO: 532094 - RNA, 64 nt, Human; identical to SEQ ID NO: 99142

SEQ ID NO: 532095 - RNA, 64 nt, Human; identical to SEQ ID NO: 99137

SEQ ID NO: 532096 - RNA, 64 nt, Human; identical to SEQ ID NO: 99140

SEQ ID NO: 532097 - RNA, 64 nt, Human; identical to SEQ ID NO: 99141

SEQ ID NO: 532098 - RNA, 64 nt, Human; identical to SEQ ID NO: 99143

SEQ ID NO: 532099 - RNA, 64 nt, Human; identical to SEQ ID NO: 99144

SEQ ID NO: 532100 - RNA, 64 nt, Human; identical to SEQ ID NO: 99145

SEQ ID NO: 532101 - RNA, 64 nt, Human; identical to SEQ ID NO: 99146

SEQ ID NO: 532102 - RNA, 64 nt, Human; identical to SEQ ID NO: 99147

SEQ ID NO: 532103 - RNA, 64 nt, Human; identical to SEQ ID NO: 99148

SEQ ID NO: 532104 - RNA, 64 nt, Human; identical to SEQ ID NO: 99149

SEQ ID NO: 532105 - RNA, 64 nt, Human; identical to SEQ ID NO: 99150

SEQ ID NO: 532106 - RNA, 64 nt, Human; identical to SEQ ID NO: 99151

SEQ ID NO: 532107 - RNA, 64 nt, Human; identical to SEQ ID NO: 99152

SEQ ID NO: 532108 - RNA, 64 nt, Human; identical to SEQ ID NO: 99153

SEQ ID NO: 532109 - RNA, 64 nt, Human; identical to SEQ ID NO: 99154

SEQ ID NO: 532110 - RNA, 64 nt, Human; identical to SEQ ID NO: 99155

SEQ ID NO: 532111 - RNA, 64 nt, Human; identical to SEQ ID NO: 99156

SEQ ID NO: 532112 - RNA, 64 nt, Human; identical to SEQ ID NO: 99178

SEQ ID NO: 532113 - RNA, 64 nt, Human; identical to SEQ ID NO: 99179

SEQ ID NO: 532114 - RNA, 64 nt, Human; identical to SEQ ID NO: 99180

SEQ ID NO: 532115 - RNA, 64 nt, Human; identical to SEQ ID NO: 99157

SEQ ID NO: 532116 - RNA, 64 nt, Human; identical to SEQ ID NO: 99158

SEQ ID NO: 532117 - RNA, 64 nt, Human; identical to SEQ ID NO: 99159

SEQ ID NO: 532118 - RNA, 64 nt, Human; identical to SEQ ID NO: 99160

SEQ ID NO: 532119 - RNA, 64 nt, Human; identical to SEQ ID NO: 99161

SEQ ID NO: 532120 - RNA, 64 nt, Human; identical to SEQ ID NO: 99162

SEQ ID NO: 532121 - RNA, 64 nt, Human; identical to SEQ ID NO: 99163

SEQ ID NO: 532122 - RNA, 64 nt, Human; identical to SEQ ID NO: 99164

SEQ ID NO: 532123 - RNA, 64 nt, Human; identical to SEQ ID NO: 99165

SEQ ID NO: 532124 - RNA, 58 nt, Human; identical to SEQ ID NO: 99166

SEQ ID NO: 532125 - RNA, 64 nt, Human; identical to SEQ ID NO: 99167

SEQ ID NO: 532126 - RNA, 64 nt, Human; identical to SEQ ID NO: 99168

SEQ ID NO: 532127 - RNA, 64 nt, Human; identical to SEQ ID NO: 99169

SEQ ID NO: 532128 - RNA, 64 nt, Human; identical to SEQ ID NO: 99170

SEQ ID NO: 532129 - RNA, 64 nt, Human; identical to SEQ ID NO: 99171

SEQ ID NO: 532130 - RNA, 64 nt, Human; identical to SEQ ID NO: 99172

SEQ ID NO: 532131 - RNA, 64 nt, Human; identical to SEQ ID NO: 99173

SEQ ID NO: 532132 - RNA, 64 nt, Human; identical to SEQ ID NO: 99174

SEQ ID NO: 532133 - RNA, 64 nt, Human; identical to SEQ ID NO: 99176

SEQ ID NO: 532134 - RNA, 64 nt, Human; identical to SEQ ID NO: 99177

SEQ ID NO: 532135 - RNA, 64 nt, Human; identical to SEQ ID NO: 99175

SEQ ID NO: 532136 - RNA, 64 nt, Human; identical to SEQ ID NO: 99181

SEQ ID NO: 532137 - RNA, 64 nt, Human; identical to SEQ ID NO: 99182

SEQ ID NO: 532138 - RNA, 64 nt, Human; identical to SEQ ID NO: 99183

SEQ ID NO: 532139 - RNA, 64 nt, Human; identical to SEQ ID NO: 99184

SEQ ID NO: 532140 - RNA, 64 nt, Human; identical to SEQ ID NO: 99185

SEQ ID NO: 532141 - RNA, 64 nt, Human; identical to SEQ ID NO: 99186

SEQ ID NO: 532142 - RNA, 64 nt, Human; identical to SEQ ID NO: 99187

SEQ ID NO: 532143 - RNA, 64 nt, Human; identical to SEQ ID NO: 99188

SEQ ID NO: 532144 - RNA, 64 nt, Human; identical to SEQ ID NO: 99189

SEQ ID NO: 532145 - RNA, 64 nt, Human; identical to SEQ ID NO: 99190

SEQ ID NO: 532146 - RNA, 64 nt, Human; identical to SEQ ID NO: 99191

SEQ ID NO: 532147 - RNA, 64 nt, Human; identical to SEQ ID NO: 99192

SEQ ID NO: 532148 - RNA, 64 nt, Human; identical to SEQ ID NO: 99193

SEQ ID NO: 532149 - RNA, 64 nt, Human; identical to SEQ ID NO: 99194

SEQ ID NO: 532150 - RNA, 64 nt, Human; identical to SEQ ID NO: 99195

SEQ ID NO: 532151 - RNA, 64 nt, Human; identical to SEQ ID NO: 99196

SEQ ID NO: 532152 - RNA, 64 nt, Human; identical to SEQ ID NO: 99197

SEQ ID NO: 532153 - RNA, 64 nt, Human; identical to SEQ ID NO: 99198

SEQ ID NO: 532154 - RNA, 64 nt, Human; identical to SEQ ID NO: 99199

SEQ ID NO: 532155 - RNA, 64 nt, Human; identical to SEQ ID NO: 99200

SEQ ID NO: 532156 - RNA, 64 nt, Human; identical to SEQ ID NO: 99201

SEQ ID NO: 532157 - RNA, 64 nt, Human; identical to SEQ ID NO: 99202

SEQ ID NO: 532158 - RNA, 64 nt, Human; identical to SEQ ID NO: 99203

SEQ ID NO: 532159 - RNA, 64 nt, Human; identical to SEQ ID NO: 99204

SEQ ID NO: 532160 - RNA, 64 nt, Human; identical to SEQ ID NO: 99205

SEQ ID NO: 532161 - RNA, 64 nt, Human; identical to SEQ ID NO: 99206

SEQ ID NO: 532162 - RNA, 64 nt, Human; identical to SEQ ID NO: 99207

SEQ ID NO: 532163 - RNA, 64 nt, Human; identical to SEQ ID NO: 99208

SEQ ID NO: 532164 - RNA, 60 nt, Human; identical to SEQ ID NO: 99209

SEQ ID NO: 532165 - RNA, 64 nt, Human; identical to SEQ ID NO: 99210

SEQ ID NO: 532166 - RNA, 64 nt, Human; identical to SEQ ID NO: 99211

SEQ ID NO: 532167 - RNA, 64 nt, Human; identical to SEQ ID NO: 99212

SEQ ID NO: 532168 - RNA, 64 nt, Human; identical to SEQ ID NO: 99213

SEQ ID NO: 532169 - RNA, 64 nt, Human; identical to SEQ ID NO: 99214

SEQ ID NO: 532170 - RNA, 64 nt, Human; identical to SEQ ID NO: 99215

SEQ ID NO: 532171 - RNA, 55 nt, Human; identical to SEQ ID NO: 99216

SEQ ID NO: 532172 - RNA, 64 nt, Human; identical to SEQ ID NO: 99218

SEQ ID NO: 532173 - RNA, 64 nt, Human; identical to SEQ ID NO: 99219

SEQ ID NO: 532174 - RNA, 64 nt, Human; identical to SEQ ID NO: 99220

SEQ ID NO: 532175 - RNA, 64 nt, Human; identical to SEQ ID NO: 99217

SEQ ID NO: 532176 - RNA, 64 nt, Human; identical to SEQ ID NO: 99221

SEQ ID NO: 532177 - RNA, 64 nt, Human; identical to SEQ ID NO: 99222

SEQ ID NO: 532178 - RNA, 64 nt, Human; identical to SEQ ID NO: 99223

SEQ ID NO: 532179 - RNA, 64 nt, Human; identical to SEQ ID NO: 99224

SEQ ID NO: 532180 - RNA, 64 nt, Human; identical to SEQ ID NO: 99225

SEQ ID NO: 532181 - RNA, 64 nt, Human; identical to SEQ ID NO: 99226

SEQ ID NO: 532182 - RNA, 64 nt, Human; identical to SEQ ID NO: 99227

SEQ ID NO: 532183 - RNA, 64 nt, Human; identical to SEQ ID NO: 99228

SEQ ID NO: 532184 - RNA, 51 nt, Human; identical to SEQ ID NO: 99229

SEQ ID NO: 532185 - RNA, 64 nt, Human; identical to SEQ ID NO: 99230

SEQ ID NO: 532186 - RNA, 64 nt, Human; identical to SEQ ID NO: 99231

SEQ ID NO: 532187 - RNA, 64 nt, Human; identical to SEQ ID NO: 99232

SEQ ID NO: 532188 - RNA, 64 nt, Human; identical to SEQ ID NO: 99233

SEQ ID NO: 532189 - RNA, 64 nt, Human; identical to SEQ ID NO: 99234

SEQ ID NO: 532190 - RNA, 64 nt, Human; identical to SEQ ID NO: 99235

SEQ ID NO: 532191 - RNA, 64 nt, Human; identical to SEQ ID NO: 99236

SEQ ID NO: 532192 - RNA, 64 nt, Human; identical to SEQ ID NO: 99237

SEQ ID NO: 532193 - RNA, 58 nt, Human; identical to SEQ ID NO: 99261

SEQ ID NO: 532194 - RNA, 64 nt, Human; identical to SEQ ID NO: 99262

SEQ ID NO: 532195 - RNA, 64 nt, Human; identical to SEQ ID NO: 99238

SEQ ID NO: 532196 - RNA, 64 nt, Human; identical to SEQ ID NO: 99239

SEQ ID NO: 532197 - RNA, 64 nt, Human; identical to SEQ ID NO: 99240

SEQ ID NO: 532198 - RNA, 55 nt, Human; identical to SEQ ID NO: 99241

SEQ ID NO: 532199 - RNA, 64 nt, Human; identical to SEQ ID NO: 99242

SEQ ID NO: 532200 - RNA, 64 nt, Human; identical to SEQ ID NO: 99243

SEQ ID NO: 532201 - RNA, 64 nt, Human; identical to SEQ ID NO: 99244

SEQ ID NO: 532202 - RNA, 64 nt, Human; identical to SEQ ID NO: 99245

SEQ ID NO: 532203 - RNA, 64 nt, Human; identical to SEQ ID NO: 99246

SEQ ID NO: 532204 - RNA, 52 nt, Human; identical to SEQ ID NO: 99247

SEQ ID NO: 532205 - RNA, 64 nt, Human; identical to SEQ ID NO: 99248

SEQ ID NO: 532206 - RNA, 64 nt, Human; identical to SEQ ID NO: 99249

SEQ ID NO: 532207 - RNA, 64 nt, Human; identical to SEQ ID NO: 99250

SEQ ID NO: 532208 - RNA, 64 nt, Human; identical to SEQ ID NO: 99251

SEQ ID NO: 532209 - RNA, 64 nt, Human; identical to SEQ ID NO: 99252

SEQ ID NO: 532210 - RNA, 64 nt, Human; identical to SEQ ID NO: 99253

SEQ ID NO: 532211 - RNA, 64 nt, Human; identical to SEQ ID NO: 99254

SEQ ID NO: 532212 - RNA, 64 nt, Human; identical to SEQ ID NO: 99255

SEQ ID NO: 532213 - RNA, 64 nt, Human; identical to SEQ ID NO: 99259

SEQ ID NO: 532214 - RNA, 64 nt, Human; identical to SEQ ID NO: 99260

SEQ ID NO: 532215 - RNA, 64 nt, Human; identical to SEQ ID NO: 99256

SEQ ID NO: 532216 - RNA, 64 nt, Human; identical to SEQ ID NO: 99257

SEQ ID NO: 532217 - RNA, 64 nt, Human; identical to SEQ ID NO: 99258

SEQ ID NO: 532218 - RNA, 64 nt, Human; identical to SEQ ID NO: 99263

SEQ ID NO: 532219 - RNA, 64 nt, Human; identical to SEQ ID NO: 99264

SEQ ID NO: 532220 - RNA, 64 nt, Human; identical to SEQ ID NO: 99265

SEQ ID NO: 532221 - RNA, 64 nt, Human; identical to SEQ ID NO: 99266

SEQ ID NO: 532222 - RNA, 64 nt, Human; identical to SEQ ID NO: 99267

SEQ ID NO: 532223 - RNA, 64 nt, Human; identical to SEQ ID NO: 99268

SEQ ID NO: 532224 - RNA, 64 nt, Human; identical to SEQ ID NO: 99269

SEQ ID NO: 532225 - RNA, 64 nt, Human; identical to SEQ ID NO: 99270

SEQ ID NO: 532226 - RNA, 64 nt, Human; identical to SEQ ID NO: 99271

SEQ ID NO: 532227 - RNA, 64 nt, Human; identical to SEQ ID NO: 99272

SEQ ID NO: 532228 - RNA, 64 nt, Human; identical to SEQ ID NO: 99273

SEQ ID NO: 532229 - RNA, 64 nt, Human; identical to SEQ ID NO: 99274

SEQ ID NO: 532230 - RNA, 64 nt, Human; identical to SEQ ID NO: 99275

SEQ ID NO: 532231 - RNA, 64 nt, Human; identical to SEQ ID NO: 99276

SEQ ID NO: 532232 - RNA, 64 nt, Human; identical to SEQ ID NO: 99277

SEQ ID NO: 532233 - RNA, 64 nt, Human; identical to SEQ ID NO: 99278

SEQ ID NO: 532234 - RNA, 64 nt, Human; identical to SEQ ID NO: 99319

SEQ ID NO: 532235 - RNA, 64 nt, Human; identical to SEQ ID NO: 99279

SEQ ID NO: 532236 - RNA, 64 nt, Human; identical to SEQ ID NO: 99280

SEQ ID NO: 532237 - RNA, 64 nt, Human; identical to SEQ ID NO: 99281

SEQ ID NO: 532238 - RNA, 64 nt, Human; identical to SEQ ID NO: 99282

SEQ ID NO: 532239 - RNA, 64 nt, Human; identical to SEQ ID NO: 99283

SEQ ID NO: 532240 - RNA, 64 nt, Human; identical to SEQ ID NO: 99284

SEQ ID NO: 532241 - RNA, 64 nt, Human; identical to SEQ ID NO: 99285

SEQ ID NO: 532242 - RNA, 64 nt, Human; identical to SEQ ID NO: 99286

SEQ ID NO: 532243 - RNA, 64 nt, Human; identical to SEQ ID NO: 99287

SEQ ID NO: 532244 - RNA, 64 nt, Human; identical to SEQ ID NO: 99288

SEQ ID NO: 532245 - RNA, 64 nt, Human; identical to SEQ ID NO: 99289

SEQ ID NO: 532246 - RNA, 64 nt, Human; identical to SEQ ID NO: 99290

SEQ ID NO: 532247 - RNA, 64 nt, Human; identical to SEQ ID NO: 99291

SEQ ID NO: 532248 - RNA, 64 nt, Human; identical to SEQ ID NO: 99292

SEQ ID NO: 532249 - RNA, 64 nt, Human; identical to SEQ ID NO: 99293

SEQ ID NO: 532250 - RNA, 64 nt, Human; identical to SEQ ID NO: 99294

SEQ ID NO: 532251 - RNA, 64 nt, Human; identical to SEQ ID NO: 99295

SEQ ID NO: 532252 - RNA, 64 nt, Human; identical to SEQ ID NO: 99297

SEQ ID NO: 532253 - RNA, 64 nt, Human; identical to SEQ ID NO: 99298

SEQ ID NO: 532254 - RNA, 64 nt, Human; identical to SEQ ID NO: 99299

SEQ ID NO: 532255 - RNA, 64 nt, Human; identical to SEQ ID NO: 99296

SEQ ID NO: 532256 - RNA, 64 nt, Human; identical to SEQ ID NO: 99300

SEQ ID NO: 532257 - RNA, 64 nt, Human; identical to SEQ ID NO: 99301

SEQ ID NO: 532258 - RNA, 64 nt, Human; identical to SEQ ID NO: 99302

SEQ ID NO: 532259 - RNA, 64 nt, Human; identical to SEQ ID NO: 99303

SEQ ID NO: 532260 - RNA, 64 nt, Human; identical to SEQ ID NO: 99304

SEQ ID NO: 532261 - RNA, 64 nt, Human; identical to SEQ ID NO: 99305

SEQ ID NO: 532262 - RNA, 64 nt, Human; identical to SEQ ID NO: 99306

SEQ ID NO: 532263 - RNA, 64 nt, Human; identical to SEQ ID NO: 99307

SEQ ID NO: 532264 - RNA, 64 nt, Human; identical to SEQ ID NO: 99308

SEQ ID NO: 532265 - RNA, 62 nt, Human; identical to SEQ ID NO: 99309

SEQ ID NO: 532266 - RNA, 58 nt, Human; identical to SEQ ID NO: 99310

SEQ ID NO: 532267 - RNA, 64 nt, Human; identical to SEQ ID NO: 99311

SEQ ID NO: 532268 - RNA, 64 nt, Human; identical to SEQ ID NO: 99312

SEQ ID NO: 532269 - RNA, 64 nt, Human; identical to SEQ ID NO: 99313

SEQ ID NO: 532270 - RNA, 64 nt, Human; identical to SEQ ID NO: 99314

SEQ ID NO: 532271 - RNA, 64 nt, Human; identical to SEQ ID NO: 99315

SEQ ID NO: 532272 - RNA, 64 nt, Human; identical to SEQ ID NO: 99316

SEQ ID NO: 532273 - RNA, 64 nt, Human; identical to SEQ ID NO: 99317

SEQ ID NO: 532274 - RNA, 64 nt, Human; identical to SEQ ID NO: 99318

SEQ ID NO: 532275 - RNA, 64 nt, Human; identical to SEQ ID NO: 99320

SEQ ID NO: 532276 - RNA, 64 nt, Human; identical to SEQ ID NO: 99321

SEQ ID NO: 532277 - RNA, 64 nt, Human; identical to SEQ ID NO: 99322

SEQ ID NO: 532278 - RNA, 64 nt, Human; identical to SEQ ID NO: 99323

SEQ ID NO: 532279 - RNA, 64 nt, Human; identical to SEQ ID NO: 99324

SEQ ID NO: 532280 - RNA, 64 nt, Human; identical to SEQ ID NO: 99325

SEQ ID NO: 532281 - RNA, 64 nt, Human; identical to SEQ ID NO: 99326

SEQ ID NO: 532282 - RNA, 64 nt, Human; identical to SEQ ID NO: 99327

SEQ ID NO: 532283 - RNA, 64 nt, Human; identical to SEQ ID NO: 99328

SEQ ID NO: 532284 - RNA, 64 nt, Human; identical to SEQ ID NO: 99329

SEQ ID NO: 532285 - RNA, 64 nt, Human; identical to SEQ ID NO: 99330

SEQ ID NO: 532286 - RNA, 64 nt, Human; identical to SEQ ID NO: 99331

SEQ ID NO: 532287 - RNA, 64 nt, Human; identical to SEQ ID NO: 99332

SEQ ID NO: 532288 - RNA, 64 nt, Human; identical to SEQ ID NO: 99333

SEQ ID NO: 532289 - RNA, 64 nt, Human; identical to SEQ ID NO: 99334

SEQ ID NO: 532290 - RNA, 64 nt, Human; identical to SEQ ID NO: 99335

SEQ ID NO: 532291 - RNA, 64 nt, Human; identical to SEQ ID NO: 99336

SEQ ID NO: 532292 - RNA, 64 nt, Human; identical to SEQ ID NO: 99338

SEQ ID NO: 532293 - RNA, 50 nt, Human; identical to SEQ ID NO: 99339

SEQ ID NO: 532294 - RNA, 64 nt, Human; identical to SEQ ID NO: 99340

SEQ ID NO: 532295 - RNA, 64 nt, Human; identical to SEQ ID NO: 99337

SEQ ID NO: 532296 - RNA, 64 nt, Human; identical to SEQ ID NO: 99341

SEQ ID NO: 532297 - RNA, 64 nt, Human; identical to SEQ ID NO: 99342

SEQ ID NO: 532298 - RNA, 64 nt, Human; identical to SEQ ID NO: 99343

SEQ ID NO: 532299 - RNA, 64 nt, Human; identical to SEQ ID NO: 99344

SEQ ID NO: 532300 - RNA, 64 nt, Human; identical to SEQ ID NO: 99345

SEQ ID NO: 532301 - RNA, 64 nt, Human; identical to SEQ ID NO: 99346

SEQ ID NO: 532302 - RNA, 64 nt, Human; identical to SEQ ID NO: 99347

SEQ ID NO: 532303 - RNA, 64 nt, Human; identical to SEQ ID NO: 99348

SEQ ID NO: 532304 - RNA, 64 nt, Human; identical to SEQ ID NO: 99349

SEQ ID NO: 532305 - RNA, 64 nt, Human; identical to SEQ ID NO: 99350

SEQ ID NO: 532306 - RNA, 64 nt, Human; identical to SEQ ID NO: 99351

SEQ ID NO: 532307 - RNA, 64 nt, Human; identical to SEQ ID NO: 99352

SEQ ID NO: 532308 - RNA, 64 nt, Human; identical to SEQ ID NO: 99353

SEQ ID NO: 532309 - RNA, 64 nt, Human; identical to SEQ ID NO: 99354

SEQ ID NO: 532310 - RNA, 64 nt, Human; identical to SEQ ID NO: 99355

SEQ ID NO: 532311 - RNA, 64 nt, Human; identical to SEQ ID NO: 99356

SEQ ID NO: 532312 - RNA, 64 nt, Human; identical to SEQ ID NO: 99357

SEQ ID NO: 532313 - RNA, 64 nt, Human; identical to SEQ ID NO: 99378

SEQ ID NO: 532314 - RNA, 64 nt, Human; identical to SEQ ID NO: 99379

SEQ ID NO: 532315 - RNA, 64 nt, Human; identical to SEQ ID NO: 99358

SEQ ID NO: 532316 - RNA, 64 nt, Human; identical to SEQ ID NO: 99359

SEQ ID NO: 532317 - RNA, 64 nt, Human; identical to SEQ ID NO: 99360

SEQ ID NO: 532318 - RNA, 64 nt, Human; identical to SEQ ID NO: 99361

SEQ ID NO: 532319 - RNA, 64 nt, Human; identical to SEQ ID NO: 99362

SEQ ID NO: 532320 - RNA, 64 nt, Human; identical to SEQ ID NO: 99363

SEQ ID NO: 532321 - RNA, 64 nt, Human; identical to SEQ ID NO: 99364

SEQ ID NO: 532322 - RNA, 64 nt, Human; identical to SEQ ID NO: 99365

SEQ ID NO: 532323 - RNA, 64 nt, Human; identical to SEQ ID NO: 99366

SEQ ID NO: 532324 - RNA, 64 nt, Human; identical to SEQ ID NO: 99367

SEQ ID NO: 532325 - RNA, 64 nt, Human; identical to SEQ ID NO: 99368

SEQ ID NO: 532326 - RNA, 64 nt, Human; identical to SEQ ID NO: 99369

SEQ ID NO: 532327 - RNA, 64 nt, Human; identical to SEQ ID NO: 99370

SEQ ID NO: 532328 - RNA, 64 nt, Human; identical to SEQ ID NO: 99371

SEQ ID NO: 532329 - RNA, 64 nt, Human; identical to SEQ ID NO: 99372

SEQ ID NO: 532330 - RNA, 64 nt, Human; identical to SEQ ID NO: 99373

SEQ ID NO: 532331 - RNA, 64 nt, Human; identical to SEQ ID NO: 99374

SEQ ID NO: 532332 - RNA, 64 nt, Human; identical to SEQ ID NO: 99375

SEQ ID NO: 532333 - RNA, 64 nt, Human; identical to SEQ ID NO: 99376

SEQ ID NO: 532334 - RNA, 64 nt, Human; identical to SEQ ID NO: 99377

SEQ ID NO: 532335 - RNA, 64 nt, Human; identical to SEQ ID NO: 99380

SEQ ID NO: 532336 - RNA, 64 nt, Human; identical to SEQ ID NO: 99381

SEQ ID NO: 532337 - RNA, 64 nt, Human; identical to SEQ ID NO: 99382

SEQ ID NO: 532338 - RNA, 64 nt, Human; identical to SEQ ID NO: 99383

SEQ ID NO: 532339 - RNA, 56 nt, Human; identical to SEQ ID NO: 99384

SEQ ID NO: 532340 - RNA, 64 nt, Human; identical to SEQ ID NO: 99385

SEQ ID NO: 532341 - RNA, 64 nt, Human; identical to SEQ ID NO: 99386

SEQ ID NO: 532342 - RNA, 64 nt, Human; identical to SEQ ID NO: 99387

SEQ ID NO: 532343 - RNA, 64 nt, Human; identical to SEQ ID NO: 99388

SEQ ID NO: 532344 - RNA, 64 nt, Human; identical to SEQ ID NO: 99389

SEQ ID NO: 532345 - RNA, 64 nt, Human; identical to SEQ ID NO: 99390

SEQ ID NO: 532346 - RNA, 64 nt, Human; identical to SEQ ID NO: 99391

SEQ ID NO: 532347 - RNA, 64 nt, Human; identical to SEQ ID NO: 99392

SEQ ID NO: 532348 - RNA, 64 nt, Human; identical to SEQ ID NO: 99393

SEQ ID NO: 532349 - RNA, 64 nt, Human; identical to SEQ ID NO: 99394

SEQ ID NO: 532350 - RNA, 64 nt, Human; identical to SEQ ID NO: 99395

SEQ ID NO: 532351 - RNA, 64 nt, Human; identical to SEQ ID NO: 99377

SEQ ID NO: 532352 - RNA, 64 nt, Human; identical to SEQ ID NO: 99397

SEQ ID NO: 532353 - RNA, 64 nt, Human; identical to SEQ ID NO: 99398

SEQ ID NO: 532354 - RNA, 64 nt, Human; identical to SEQ ID NO: 99399

SEQ ID NO: 532355 - RNA, 64 nt, Human; identical to SEQ ID NO: 99400

SEQ ID NO: 532356 - RNA, 64 nt, Human; identical to SEQ ID NO: 99401

SEQ ID NO: 532357 - RNA, 64 nt, Human; identical to SEQ ID NO: 99402

SEQ ID NO: 532358 - RNA, 64 nt, Human; identical to SEQ ID NO: 99403

SEQ ID NO: 532359 - RNA, 64 nt, Human; identical to SEQ ID NO: 99404

SEQ ID NO: 532360 - RNA, 64 nt, Human; identical to SEQ ID NO: 99405

SEQ ID NO: 532361 - RNA, 64 nt, Human; identical to SEQ ID NO: 99406

SEQ ID NO: 532362 - RNA, 64 nt, Human; identical to SEQ ID NO: 99407

SEQ ID NO: 532363 - RNA, 64 nt, Human; identical to SEQ ID NO: 99408

SEQ ID NO: 532364 - RNA, 64 nt, Human; identical to SEQ ID NO: 99409

SEQ ID NO: 532365 - RNA, 64 nt, Human; identical to SEQ ID NO: 99410

SEQ ID NO: 532366 - RNA, 64 nt, Human; identical to SEQ ID NO: 99411

SEQ ID NO: 532367 - RNA, 51 nt, Human; identical to SEQ ID NO: 99412

SEQ ID NO: 532368 - RNA, 64 nt, Human; identical to SEQ ID NO: 99413

SEQ ID NO: 532369 - RNA, 64 nt, Human; identical to SEQ ID NO: 99414

SEQ ID NO: 532370 - RNA, 64 nt, Human; identical to SEQ ID NO: 99415

SEQ ID NO: 532371 - RNA, 64 nt, Human; identical to SEQ ID NO: 99416

SEQ ID NO: 532372 - RNA, 64 nt, Human; identical to SEQ ID NO: 99418

SEQ ID NO: 532373 - RNA, 64 nt, Human; identical to SEQ ID NO: 99419

SEQ ID NO: 532374 - RNA, 64 nt, Human; identical to SEQ ID NO: 99420

SEQ ID NO: 532375 - RNA, 64 nt, Human; identical to SEQ ID NO: 99417

SEQ ID NO: 532376 - RNA, 64 nt, Human; identical to SEQ ID NO: 99421

SEQ ID NO: 532377 - RNA, 64 nt, Human; identical to SEQ ID NO: 99422

SEQ ID NO: 532378 - RNA, 64 nt, Human; identical to SEQ ID NO: 99423

SEQ ID NO: 532379 - RNA, 64 nt, Human; identical to SEQ ID NO: 99424

SEQ ID NO: 532380 - RNA, 64 nt, Human; identical to SEQ ID NO: 99425

SEQ ID NO: 532381 - RNA, 64 nt, Human; identical to SEQ ID NO: 99426

SEQ ID NO: 532382 - RNA, 64 nt, Human; identical to SEQ ID NO: 99427

SEQ ID NO: 532383 - RNA, 64 nt, Human; identical to SEQ ID NO: 99428

SEQ ID NO: 532384 - RNA, 64 nt, Human; identical to SEQ ID NO: 99429

SEQ ID NO: 532385 - RNA, 64 nt, Human; identical to SEQ ID NO: 99430

SEQ ID NO: 532386 - RNA, 64 nt, Human; identical to SEQ ID NO: 99431

SEQ ID NO: 532387 - RNA, 64 nt, Human; identical to SEQ ID NO: 99432

SEQ ID NO: 532388 - RNA, 64 nt, Human; identical to SEQ ID NO: 99433

SEQ ID NO: 532389 - RNA, 64 nt, Human; identical to SEQ ID NO: 99434

SEQ ID NO: 532390 - RNA, 64 nt, Human; identical to SEQ ID NO: 99435

SEQ ID NO: 532391 - RNA, 64 nt, Human; identical to SEQ ID NO: 99436

SEQ ID NO: 532392 - RNA, 64 nt, Human; identical to SEQ ID NO: 99437

SEQ ID NO: 532393 - RNA, 64 nt, Human; identical to SEQ ID NO: 99438

SEQ ID NO: 532394 - RNA, 64 nt, Human; identical to SEQ ID NO: 99462

SEQ ID NO: 532395 - RNA, 64 nt, Human; identical to SEQ ID NO: 99439

SEQ ID NO: 532396 - RNA, 52 nt, Human; identical to SEQ ID NO: 99440

SEQ ID NO: 532397 - RNA, 64 nt, Human; identical to SEQ ID NO: 99441

SEQ ID NO: 532398 - RNA, 64 nt, Human; identical to SEQ ID NO: 99442

SEQ ID NO: 532399 - RNA, 64 nt, Human; identical to SEQ ID NO: 99443

SEQ ID NO: 532400 - RNA, 64 nt, Human; identical to SEQ ID NO: 99444

SEQ ID NO: 532401 - RNA, 64 nt, Human; identical to SEQ ID NO: 99445

SEQ ID NO: 532402 - RNA, 64 nt, Human; identical to SEQ ID NO: 99446

SEQ ID NO: 532403 - RNA, 64 nt, Human; identical to SEQ ID NO: 99447

SEQ ID NO: 532404 - RNA, 64 nt, Human; identical to SEQ ID NO: 99448

SEQ ID NO: 532405 - RNA, 64 nt, Human; identical to SEQ ID NO: 99449

SEQ ID NO: 532406 - RNA, 64 nt, Human; identical to SEQ ID NO: 99450

SEQ ID NO: 532407 - RNA, 64 nt, Human; identical to SEQ ID NO: 99451

SEQ ID NO: 532408 - RNA, 64 nt, Human; identical to SEQ ID NO: 99452

SEQ ID NO: 532409 - RNA, 64 nt, Human; identical to SEQ ID NO: 99453

SEQ ID NO: 532410 - RNA, 64 nt, Human; identical to SEQ ID NO: 99454

SEQ ID NO: 532411 - RNA, 64 nt, Human; identical to SEQ ID NO: 99455

SEQ ID NO: 532412 - RNA, 64 nt, Human; identical to SEQ ID NO: 99456

SEQ ID NO: 532413 - RNA, 64 nt, Human; identical to SEQ ID NO: 99460

SEQ ID NO: 532414 - RNA, 64 nt, Human; identical to SEQ ID NO: 99461

SEQ ID NO: 532415 - RNA, 64 nt, Human; identical to SEQ ID NO: 99457

SEQ ID NO: 532416 - RNA, 64 nt, Human; identical to SEQ ID NO: 99458

SEQ ID NO: 532417 - RNA, 64 nt, Human; identical to SEQ ID NO: 99459

SEQ ID NO: 532418 - RNA, 64 nt, Human; identical to SEQ ID NO: 99463

SEQ ID NO: 532419 - RNA, 64 nt, Human; identical to SEQ ID NO: 99464

SEQ ID NO: 532420 - RNA, 64 nt, Human; identical to SEQ ID NO: 99465

SEQ ID NO: 532421 - RNA, 64 nt, Human; identical to SEQ ID NO: 99466

SEQ ID NO: 532422 - RNA, 64 nt, Human; identical to SEQ ID NO: 99467

SEQ ID NO: 532423 - RNA, 64 nt, Human; identical to SEQ ID NO: 99468

SEQ ID NO: 532424 - RNA, 64 nt, Human; identical to SEQ ID NO: 99469

SEQ ID NO: 532425 - RNA, 64 nt, Human; identical to SEQ ID NO: 99470

SEQ ID NO: 532426 - RNA, 64 nt, Human; identical to SEQ ID NO: 99471

SEQ ID NO: 532427 - RNA, 64 nt, Human; identical to SEQ ID NO: 99472

SEQ ID NO: 532428 - RNA, 64 nt, Human; identical to SEQ ID NO: 99473

SEQ ID NO: 532429 - RNA, 64 nt, Human; identical to SEQ ID NO: 99474

SEQ ID NO: 532430 - RNA, 64 nt, Human; identical to SEQ ID NO: 99475

SEQ ID NO: 532431 - RNA, 64 nt, Human; identical to SEQ ID NO: 99476

SEQ ID NO: 532432 - RNA, 64 nt, Human; identical to SEQ ID NO: 99477

SEQ ID NO: 532433 - RNA, 64 nt, Human; identical to SEQ ID NO: 99478

SEQ ID NO: 532434 - RNA, 64 nt, Human; identical to SEQ ID NO: 99519

SEQ ID NO: 532435 - RNA, 64 nt, Human; identical to SEQ ID NO: 99479

SEQ ID NO: 532436 - RNA, 64 nt, Human; identical to SEQ ID NO: 99480

SEQ ID NO: 532437 - RNA, 64 nt, Human; identical to SEQ ID NO: 99481

SEQ ID NO: 532438 - RNA, 64 nt, Human; identical to SEQ ID NO: 99482

SEQ ID NO: 532439 - RNA, 64 nt, Human; identical to SEQ ID NO: 99483

SEQ ID NO: 532440 - RNA, 64 nt, Human; identical to SEQ ID NO: 99484

SEQ ID NO: 532441 - RNA, 64 nt, Human; identical to SEQ ID NO: 99485

SEQ ID NO: 532442 - RNA, 64 nt, Human; identical to SEQ ID NO: 99486

SEQ ID NO: 532443 - RNA, 64 nt, Human; identical to SEQ ID NO: 99487

SEQ ID NO: 532444 - RNA, 64 nt, Human; identical to SEQ ID NO: 99488

SEQ ID NO: 532445 - RNA, 64 nt, Human; identical to SEQ ID NO: 99489

SEQ ID NO: 532446 - RNA, 64 nt, Human; identical to SEQ ID NO: 99490

SEQ ID NO: 532447 - RNA, 64 nt, Human; identical to SEQ ID NO: 99491

SEQ ID NO: 532448 - RNA, 64 nt, Human; identical to SEQ ID NO: 99492

SEQ ID NO: 532449 - RNA, 64 nt, Human; identical to SEQ ID NO: 99493

SEQ ID NO: 532450 - RNA, 60 nt, Human; identical to SEQ ID NO: 99494

SEQ ID NO: 532451 - RNA, 64 nt, Human; identical to SEQ ID NO: 99495

SEQ ID NO: 532452 - RNA, 64 nt, Human; identical to SEQ ID NO: 99496

SEQ ID NO: 532453 - RNA, 64 nt, Human; identical to SEQ ID NO: 99497

SEQ ID NO: 532454 - RNA, 64 nt, Human; identical to SEQ ID NO: 99498

SEQ ID NO: 532455 - RNA, 64 nt, Human; identical to SEQ ID NO: 99499

SEQ ID NO: 532456 - RNA, 64 nt, Human; identical to SEQ ID NO: 99500

SEQ ID NO: 532457 - RNA, 51 nt, Human; identical to SEQ ID NO: 99501

SEQ ID NO: 532458 - RNA, 64 nt, Human; identical to SEQ ID NO: 99502

SEQ ID NO: 532459 - RNA, 64 nt, Human; identical to SEQ ID NO: 99503

SEQ ID NO: 532460 - RNA, 64 nt, Human; identical to SEQ ID NO: 99504

SEQ ID NO: 532461 - RNA, 64 nt, Human; identical to SEQ ID NO: 99505

SEQ ID NO: 532462 - RNA, 64 nt, Human; identical to SEQ ID NO: 99506

SEQ ID NO: 532463 - RNA, 64 nt, Human; identical to SEQ ID NO: 99507

SEQ ID NO: 532464 - RNA, 64 nt, Human; identical to SEQ ID NO: 99508

SEQ ID NO: 532465 - RNA, 64 nt, Human; identical to SEQ ID NO: 99509

SEQ ID NO: 532466 - RNA, 64 nt, Human; identical to SEQ ID NO: 99510

SEQ ID NO: 532467 - RNA, 64 nt, Human; identical to SEQ ID NO: 99511

SEQ ID NO: 532468 - RNA, 64 nt, Human; identical to SEQ ID NO: 99512

SEQ ID NO: 532469 - RNA, 64 nt, Human; identical to SEQ ID NO: 99513

SEQ ID NO: 532470 - RNA, 64 nt, Human; identical to SEQ ID NO: 99514

SEQ ID NO: 532471 - RNA, 64 nt, Human; identical to SEQ ID NO: 99515

SEQ ID NO: 532472 - RNA, 64 nt, Human; identical to SEQ ID NO: 99516

SEQ ID NO: 532473 - RNA, 64 nt, Human; identical to SEQ ID NO: 99517

SEQ ID NO: 532474 - RNA, 64 nt, Human; identical to SEQ ID NO: 99518

SEQ ID NO: 532475 - RNA, 64 nt, Human; identical to SEQ ID NO: 99520

SEQ ID NO: 532476 - RNA, 64 nt, Human; identical to SEQ ID NO: 99521

SEQ ID NO: 532477 - RNA, 64 nt, Human; identical to SEQ ID NO: 99522

SEQ ID NO: 532478 - RNA, 64 nt, Human; identical to SEQ ID NO: 99523

SEQ ID NO: 532479 - RNA, 64 nt, Human; identical to SEQ ID NO: 99524

SEQ ID NO: 532480 - RNA, 64 nt, Human; identical to SEQ ID NO: 99525

SEQ ID NO: 532481 - RNA, 64 nt, Human; identical to SEQ ID NO: 99526

SEQ ID NO: 532482 - RNA, 64 nt, Human; identical to SEQ ID NO: 99527

SEQ ID NO: 532483 - RNA, 64 nt, Human; identical to SEQ ID NO: 99528

SEQ ID NO: 532484 - RNA, 64 nt, Human; identical to SEQ ID NO: 99529

SEQ ID NO: 532485 - RNA, 64 nt, Human; identical to SEQ ID NO: 99530

SEQ ID NO: 532486 - RNA, 64 nt, Human; identical to SEQ ID NO: 99531

SEQ ID NO: 532487 - RNA, 64 nt, Human; identical to SEQ ID NO: 99532

SEQ ID NO: 532488 - RNA, 64 nt, Human; identical to SEQ ID NO: 99533

SEQ ID NO: 532489 - RNA, 64 nt, Human; identical to SEQ ID NO: 99534

SEQ ID NO: 532490 - RNA, 64 nt, Human; identical to SEQ ID NO: 99535

SEQ ID NO: 532491 - RNA, 64 nt, Human; identical to SEQ ID NO: 99536

SEQ ID NO: 532492 - RNA, 64 nt, Human; identical to SEQ ID NO: 99538

SEQ ID NO: 532493 - RNA, 64 nt, Human; identical to SEQ ID NO: 99539

SEQ ID NO: 532494 - RNA, 64 nt, Human; identical to SEQ ID NO: 99540

SEQ ID NO: 532495 - RNA, 64 nt, Human; identical to SEQ ID NO: 99537

SEQ ID NO: 532496 - RNA, 64 nt, Human; identical to SEQ ID NO: 99541

SEQ ID NO: 532497 - RNA, 64 nt, Human; identical to SEQ ID NO: 99542

SEQ ID NO: 532498 - RNA, 64 nt, Human; identical to SEQ ID NO: 99543

SEQ ID NO: 532499 - RNA, 64 nt, Human; identical to SEQ ID NO: 99544

SEQ ID NO: 532500 - RNA, 64 nt, Human; identical to SEQ ID NO: 99545

SEQ ID NO: 532501 - RNA, 64 nt, Human; identical to SEQ ID NO: 99546

SEQ ID NO: 532502 - RNA, 64 nt, Human; identical to SEQ ID NO: 99547

SEQ ID NO: 532503 - RNA, 64 nt, Human; identical to SEQ ID NO: 99548

SEQ ID NO: 532504 - RNA, 64 nt, Human; identical to SEQ ID NO: 99549

SEQ ID NO: 532505 - RNA, 64 nt, Human; identical to SEQ ID NO: 99550

SEQ ID NO: 532506 - RNA, 64 nt, Human; identical to SEQ ID NO: 99551

SEQ ID NO: 532507 - RNA, 64 nt, Human; identical to SEQ ID NO: 99552

SEQ ID NO: 532508 - RNA, 64 nt, Human; identical to SEQ ID NO: 99553

SEQ ID NO: 532509 - RNA, 64 nt, Human; identical to SEQ ID NO: 99554

SEQ ID NO: 532510 - RNA, 64 nt, Human; identical to SEQ ID NO: 99555

SEQ ID NO: 532511 - RNA, 64 nt, Human; identical to SEQ ID NO: 99556

SEQ ID NO: 532512 - RNA, 64 nt, Human; identical to SEQ ID NO: 99557

SEQ ID NO: 532513 - RNA, 64 nt, Human; identical to SEQ ID NO: 99558

SEQ ID NO: 532514 - RNA, 64 nt, Human; identical to SEQ ID NO: 516375

SEQ ID NO: 532515 - RNA, 64 nt, Human; identical to SEQ ID NO: 516370

SEQ ID NO: 532516 - RNA, 64 nt, Human; identical to SEQ ID NO: 516372

SEQ ID NO: 532517 - RNA, 64 nt, Human; identical to SEQ ID NO: 516373

SEQ ID NO: 532518 - RNA, 64 nt, Human; identical to SEQ ID NO: 516366

SEQ ID NO: 532519 - RNA, 64 nt, Human; identical to SEQ ID NO: 516371

SEQ ID NO: 532520 - RNA, 64 nt, Human; identical to SEQ ID NO: 516374

SEQ ID NO: 532521 - RNA, 64 nt, Human; identical to SEQ ID NO: 516376

SEQ ID NO: 532522 - RNA, 64 nt, Human; identical to SEQ ID NO: 516377

SEQ ID NO: 532523 - RNA, 64 nt, Human; identical to SEQ ID NO: 516378

SEQ ID NO: 532524 - RNA, 64 nt, Human; identical to SEQ ID NO: 516379

SEQ ID NO: 532525 - RNA, 64 nt, Human; identical to SEQ ID NO: 516380

SEQ ID NO: 532526 - RNA, 64 nt, Human; identical to SEQ ID NO: 516381

SEQ ID NO: 532527 - RNA, 64 nt, Human; identical to SEQ ID NO: 516382

SEQ ID NO: 532528 - RNA, 64 nt, Human; identical to SEQ ID NO: 516383

SEQ ID NO: 532529 - RNA, 64 nt, Human; identical to SEQ ID NO: 516436

SEQ ID NO: 532530 - RNA, 64 nt, Human; identical to SEQ ID NO: 516384

SEQ ID NO: 532531 - RNA, 64 nt, Human; identical to SEQ ID NO: 516385

SEQ ID NO: 532532 - RNA, 64 nt, Human; identical to SEQ ID NO: 516390

SEQ ID NO: 532533 - RNA, 64 nt, Human; identical to SEQ ID NO: 516391

SEQ ID NO: 532534 - RNA, 64 nt, Human; identical to SEQ ID NO: 516392

SEQ ID NO: 532535 - RNA, 64 nt, Human; identical to SEQ ID NO: 516393

SEQ ID NO: 532536 - RNA, 64 nt, Human; identical to SEQ ID NO: 516394

SEQ ID NO: 532537 - RNA, 64 nt, Human; identical to SEQ ID NO: 516395

SEQ ID NO: 532538 - RNA, 64 nt, Human; identical to SEQ ID NO: 516396

SEQ ID NO: 532539 - RNA, 64 nt, Human; identical to SEQ ID NO: 516397

SEQ ID NO: 532540 - RNA, 64 nt, Human; identical to SEQ ID NO: 516398

SEQ ID NO: 532541 - RNA, 64 nt, Human; identical to SEQ ID NO: 516399

SEQ ID NO: 532542 - RNA, 64 nt, Human; identical to SEQ ID NO: 516400

SEQ ID NO: 532543 - RNA, 64 nt, Human; identical to SEQ ID NO: 516401

SEQ ID NO: 532544 - RNA, 64 nt, Human; identical to SEQ ID NO: 516402

SEQ ID NO: 532545 - RNA, 64 nt, Human; identical to SEQ ID NO: 516403

SEQ ID NO: 532546 - RNA, 64 nt, Human; identical to SEQ ID NO: 516404

SEQ ID NO: 532547 - RNA, 64 nt, Human; identical to SEQ ID NO: 516405

SEQ ID NO: 532548 - RNA, 64 nt, Human; identical to SEQ ID NO: 516410

SEQ ID NO: 532549 - RNA, 64 nt, Human; identical to SEQ ID NO: 516411

SEQ ID NO: 532550 - RNA, 64 nt, Human; identical to SEQ ID NO: 516412

SEQ ID NO: 532551 - RNA, 64 nt, Human; identical to SEQ ID NO: 516413

SEQ ID NO: 532552 - RNA, 64 nt, Human; identical to SEQ ID NO: 516414

SEQ ID NO: 532553 - RNA, 64 nt, Human; identical to SEQ ID NO: 516415

SEQ ID NO: 532554 - RNA, 64 nt, Human; identical to SEQ ID NO: 516416

SEQ ID NO: 532555 - RNA, 64 nt, Human; identical to SEQ ID NO: 516417

SEQ ID NO: 532556 - RNA, 64 nt, Human; identical to SEQ ID NO: 516418

SEQ ID NO: 532557 - RNA, 64 nt, Human; identical to SEQ ID NO: 516419

SEQ ID NO: 532558 - RNA, 64 nt, Human; identical to SEQ ID NO: 516420

SEQ ID NO: 532559 - RNA, 64 nt, Human; identical to SEQ ID NO: 516421

SEQ ID NO: 532560 - RNA, 64 nt, Human; identical to SEQ ID NO: 516422

SEQ ID NO: 532561 - RNA, 64 nt, Human; identical to SEQ ID NO: 516423

SEQ ID NO: 532562 - RNA, 64 nt, Human; identical to SEQ ID NO: 516424

SEQ ID NO: 532563 - RNA, 64 nt, Human; identical to SEQ ID NO: 516425

SEQ ID NO: 532564 - RNA, 64 nt, Human; identical to SEQ ID NO: 516430

SEQ ID NO: 532565 - RNA, 64 nt, Human; identical to SEQ ID NO: 516431

SEQ ID NO: 532566 - RNA, 64 nt, Human; identical to SEQ ID NO: 516432

SEQ ID NO: 532567 - RNA, 64 nt, Human; identical to SEQ ID NO: 516433

SEQ ID NO: 532568 - RNA, 64 nt, Human; identical to SEQ ID NO: 516434

SEQ ID NO: 532569 - RNA, 64 nt, Human; identical to SEQ ID NO: 516435

SEQ ID NO: 532570 - RNA, 64 nt, Human; identical to SEQ ID NO: 516437

SEQ ID NO: 532571 - RNA, 64 nt, Human; identical to SEQ ID NO: 516438

SEQ ID NO: 532572 - RNA, 64 nt, Human; identical to SEQ ID NO: 516439

SEQ ID NO: 532573 - RNA, 64 nt, Human; identical to SEQ ID NO: 516440

SEQ ID NO: 532574 - RNA, 64 nt, Human; identical to SEQ ID NO: 516441

SEQ ID NO: 532575 - RNA, 64 nt, Human; identical to SEQ ID NO: 516442

SEQ ID NO: 532576 - RNA, 64 nt, Human; identical to SEQ ID NO: 516443

SEQ ID NO: 532577 - RNA, 64 nt, Human; identical to SEQ ID NO: 516444

SEQ ID NO: 532578 - RNA, 64 nt, Human; identical to SEQ ID NO: 516445

SEQ ID NO: 532579 - RNA, 64 nt, Human; identical to SEQ ID NO: 516450

SEQ ID NO: 532580 - RNA, 51 nt, Human; identical to SEQ ID NO: 516451

SEQ ID NO: 532581 - RNA, 64 nt, Human; identical to SEQ ID NO: 516452

SEQ ID NO: 532582 - RNA, 64 nt, Human; identical to SEQ ID NO: 516453

SEQ ID NO: 532583 - RNA, 64 nt, Human; identical to SEQ ID NO: 516454

SEQ ID NO: 532584 - RNA, 64 nt, Human; identical to SEQ ID NO: 516455

SEQ ID NO: 532585 - RNA, 64 nt, Human; identical to SEQ ID NO: 516456

SEQ ID NO: 532586 - RNA, 64 nt, Human; identical to SEQ ID NO: 516457

SEQ ID NO: 532587 - RNA, 64 nt, Human; identical to SEQ ID NO: 516458

SEQ ID NO: 532588 - RNA, 64 nt, Human; identical to SEQ ID NO: 516459

SEQ ID NO: 532589 - RNA, 64 nt, Human; identical to SEQ ID NO: 516460

SEQ ID NO: 532590 - RNA, 64 nt, Human; identical to SEQ ID NO: 516461

SEQ ID NO: 532591 - RNA, 64 nt, Human; identical to SEQ ID NO: 516462

SEQ ID NO: 532592 - RNA, 64 nt, Human; identical to SEQ ID NO: 516463

SEQ ID NO: 532593 - RNA, 64 nt, Human; identical to SEQ ID NO: 516464

SEQ ID NO: 532594 - RNA, 64 nt, Human; identical to SEQ ID NO: 516465

SEQ ID NO: 532595 - RNA, 64 nt, Human; identical to SEQ ID NO: 516470

SEQ ID NO: 532596 - RNA, 64 nt, Human; identical to SEQ ID NO: 516471

SEQ ID NO: 532597 - RNA, 64 nt, Human; identical to SEQ ID NO: 516472

SEQ ID NO: 532598 - RNA, 64 nt, Human; identical to SEQ ID NO: 516473

SEQ ID NO: 532599 - RNA, 64 nt, Human; identical to SEQ ID NO: 516474

SEQ ID NO: 532600 - RNA, 54 nt, Human; identical to SEQ ID NO: 516475

SEQ ID NO: 532601 - RNA, 64 nt, Human; identical to SEQ ID NO: 516476

SEQ ID NO: 532602 - RNA, 63 nt, Human; identical to SEQ ID NO: 516477

SEQ ID NO: 532603 - RNA, 64 nt, Human; identical to SEQ ID NO: 516478

SEQ ID NO: 532604 - RNA, 64 nt, Human; identical to SEQ ID NO: 516479

SEQ ID NO: 532605 - RNA, 64 nt, Human; identical to SEQ ID NO: 516480

SEQ ID NO: 532606 - RNA, 64 nt, Human; identical to SEQ ID NO: 516481

SEQ ID NO: 532607 - RNA, 64 nt, Human; identical to SEQ ID NO: 516483

SEQ ID NO: 532608 - RNA, 64 nt, Human; identical to SEQ ID NO: 516484

SEQ ID NO: 532609 - RNA, 64 nt, Human; identical to SEQ ID NO: 516485

SEQ ID NO: 532610 - RNA, 64 nt, Human; identical to SEQ ID NO: 516482

SEQ ID NO: 532611 - RNA, 64 nt, Human; identical to SEQ ID NO: 516490

SEQ ID NO: 532612 - RNA, 64 nt, Human; identical to SEQ ID NO: 516491

SEQ ID NO: 532613 - RNA, 64 nt, Human; identical to SEQ ID NO: 516492

SEQ ID NO: 532614 - RNA, 64 nt, Human; identical to SEQ ID NO: 516493

SEQ ID NO: 532615 - RNA, 64 nt, Human; identical to SEQ ID NO: 516494

SEQ ID NO: 532616 - RNA, 64 nt, Human; identical to SEQ ID NO: 516495

SEQ ID NO: 532617 - RNA, 64 nt, Human; identical to SEQ ID NO: 516496

SEQ ID NO: 532618 - RNA, 64 nt, Human; identical to SEQ ID NO: 516497

SEQ ID NO: 532619 - RNA, 64 nt, Human; identical to SEQ ID NO: 516498

SEQ ID NO: 532620 - RNA, 64 nt, Human; identical to SEQ ID NO: 516499

SEQ ID NO: 532621 - RNA, 64 nt, Human; identical to SEQ ID NO: 516500

SEQ ID NO: 532622 - RNA, 64 nt, Human; identical to SEQ ID NO: 516501

SEQ ID NO: 532623 - RNA, 64 nt, Human; identical to SEQ ID NO: 516502

SEQ ID NO: 532624 - RNA, 64 nt, Human; identical to SEQ ID NO: 516503

SEQ ID NO: 532625 - RNA, 64 nt, Human; identical to SEQ ID NO: 516504

SEQ ID NO: 532626 - RNA, 64 nt, Human; identical to SEQ ID NO: 516505

SEQ ID NO: 532627 - RNA, 64 nt, Human; identical to SEQ ID NO: 516510

SEQ ID NO: 532628 - RNA, 64 nt, Human; identical to SEQ ID NO: 516511

SEQ ID NO: 532629 - RNA, 64 nt, Human; identical to SEQ ID NO: 516512

SEQ ID NO: 532630 - RNA, 64 nt, Human; identical to SEQ ID NO: 516513

SEQ ID NO: 532631 - RNA, 64 nt, Human; identical to SEQ ID NO: 516514

SEQ ID NO: 532632 - RNA, 64 nt, Human; identical to SEQ ID NO: 516515

SEQ ID NO: 532633 - RNA, 64 nt, Human; identical to SEQ ID NO: 516516

SEQ ID NO: 532634 - RNA, 64 nt, Human; identical to SEQ ID NO: 516517

SEQ ID NO: 532635 - RNA, 64 nt, Human; identical to SEQ ID NO: 516518

SEQ ID NO: 532636 - RNA, 64 nt, Human; identical to SEQ ID NO: 516519

SEQ ID NO: 532637 - RNA, 64 nt, Human; identical to SEQ ID NO: 516520

SEQ ID NO: 532638 - RNA, 64 nt, Human; identical to SEQ ID NO: 516521

SEQ ID NO: 532639 - RNA, 64 nt, Human; identical to SEQ ID NO: 516522

SEQ ID NO: 532640 - RNA, 64 nt, Human; identical to SEQ ID NO: 516523

SEQ ID NO: 532641 - RNA, 64 nt, Human; identical to SEQ ID NO: 516524

SEQ ID NO: 532642 - RNA, 64 nt, Human; identical to SEQ ID NO: 516525

SEQ ID NO: 532643 - RNA, 64 nt, Human; identical to SEQ ID NO: 516530

SEQ ID NO: 532644 - RNA, 64 nt, Human; identical to SEQ ID NO: 516531

SEQ ID NO: 532645 - RNA, 64 nt, Human; identical to SEQ ID NO: 516532

SEQ ID NO: 532646 - RNA, 64 nt, Human; identical to SEQ ID NO: 516533

SEQ ID NO: 532647 - RNA, 64 nt, Human; identical to SEQ ID NO: 516534

SEQ ID NO: 532648 - RNA, 64 nt, Human; identical to SEQ ID NO: 516535

SEQ ID NO: 532649 - RNA, 64 nt, Human; identical to SEQ ID NO: 516536

SEQ ID NO: 532650 - RNA, 64 nt, Human; identical to SEQ ID NO: 516537

SEQ ID NO: 532651 - RNA, 64 nt, Human; identical to SEQ ID NO: 516538

SEQ ID NO: 532652 - RNA, 64 nt, Human; identical to SEQ ID NO: 516539

SEQ ID NO: 532653 - RNA, 64 nt, Human; identical to SEQ ID NO: 516540

SEQ ID NO: 532654 - RNA, 64 nt, Human; identical to SEQ ID NO: 516541

SEQ ID NO: 532655 - RNA, 64 nt, Human; identical to SEQ ID NO: 516542

SEQ ID NO: 532656 - RNA, 64 nt, Human; identical to SEQ ID NO: 516543

SEQ ID NO: 532657 - RNA, 64 nt, Human; identical to SEQ ID NO: 516544

SEQ ID NO: 532658 - RNA, 64 nt, Human; identical to SEQ ID NO: 516545

SEQ ID NO: 532659 - RNA, 64 nt, Human; identical to SEQ ID NO: 516550

SEQ ID NO: 532660 - RNA, 64 nt, Human; identical to SEQ ID NO: 516551

SEQ ID NO: 532661 - RNA, 64 nt, Human; identical to SEQ ID NO: 516552

SEQ ID NO: 532662 - RNA, 64 nt, Human; identical to SEQ ID NO: 516553

SEQ ID NO: 532663 - RNA, 64 nt, Human; identical to SEQ ID NO: 516554

SEQ ID NO: 532664 - RNA, 64 nt, Human; identical to SEQ ID NO: 516555

SEQ ID NO: 532665 - RNA, 64 nt, Human; identical to SEQ ID NO: 516556

SEQ ID NO: 532666 - RNA, 64 nt, Human; identical to SEQ ID NO: 516557

SEQ ID NO: 532667 - RNA, 64 nt, Human; identical to SEQ ID NO: 516558

SEQ ID NO: 532668 - RNA, 64 nt, Human; identical to SEQ ID NO: 516559

SEQ ID NO: 532669 - RNA, 64 nt, Human; identical to SEQ ID NO: 516560

SEQ ID NO: 532670 - RNA, 64 nt, Human; identical to SEQ ID NO: 516561

SEQ ID NO: 532671 - RNA, 64 nt, Human; identical to SEQ ID NO: 516562

SEQ ID NO: 532672 - RNA, 64 nt, Human; identical to SEQ ID NO: 516563

SEQ ID NO: 532673 - RNA, 64 nt, Human; identical to SEQ ID NO: 516564

SEQ ID NO: 532674 - RNA, 64 nt, Human; identical to SEQ ID NO: 516565

SEQ ID NO: 532675 - RNA, 64 nt, Human; identical to SEQ ID NO: 516570

SEQ ID NO: 532676 - RNA, 64 nt, Human; identical to SEQ ID NO: 516571

SEQ ID NO: 532677 - RNA, 64 nt, Human; identical to SEQ ID NO: 516572

SEQ ID NO: 532678 - RNA, 64 nt, Human; identical to SEQ ID NO: 516573

SEQ ID NO: 532679 - RNA, 64 nt, Human; identical to SEQ ID NO: 516574

SEQ ID NO: 532680 - RNA, 64 nt, Human; identical to SEQ ID NO: 516575

SEQ ID NO: 532681 - RNA, 64 nt, Human; identical to SEQ ID NO: 516576

SEQ ID NO: 532682 - RNA, 64 nt, Human; identical to SEQ ID NO: 516577

SEQ ID NO: 532683 - RNA, 64 nt, Human; identical to SEQ ID NO: 516578

SEQ ID NO: 532684 - RNA, 64 nt, Human; identical to SEQ ID NO: 516579

SEQ ID NO: 532685 - RNA, 64 nt, Human; identical to SEQ ID NO: 516580

SEQ ID NO: 532686 - RNA, 64 nt, Human; identical to SEQ ID NO: 516581

SEQ ID NO: 532687 - RNA, 64 nt, Human; identical to SEQ ID NO: 516583

SEQ ID NO: 532688 - RNA, 64 nt, Human; identical to SEQ ID NO: 516585

SEQ ID NO: 532689 - RNA, 64 nt, Human; identical to SEQ ID NO: 516590

SEQ ID NO: 532690 - RNA, 64 nt, Human; identical to SEQ ID NO: 516582

SEQ ID NO: 532691 - RNA, 64 nt, Human; identical to SEQ ID NO: 516584

SEQ ID NO: 532692 - RNA, 64 nt, Human; identical to SEQ ID NO: 516591

SEQ ID NO: 532693 - RNA, 64 nt, Human; identical to SEQ ID NO: 516592

SEQ ID NO: 532694 - RNA, 64 nt, Human; identical to SEQ ID NO: 516593

SEQ ID NO: 532695 - RNA, 64 nt, Human; identical to SEQ ID NO: 516594

SEQ ID NO: 532696 - RNA, 64 nt, Human; identical to SEQ ID NO: 516595

SEQ ID NO: 532697 - RNA, 64 nt, Human; identical to SEQ ID NO: 516596

SEQ ID NO: 532698 - RNA, 64 nt, Human; identical to SEQ ID NO: 516597

SEQ ID NO: 532699 - RNA, 64 nt, Human; identical to SEQ ID NO: 516598

SEQ ID NO: 532700 - RNA, 64 nt, Human; identical to SEQ ID NO: 516599

SEQ ID NO: 532701 - RNA, 64 nt, Human; identical to SEQ ID NO: 516600

SEQ ID NO: 532702 - RNA, 64 nt, Human; identical to SEQ ID NO: 516601

SEQ ID NO: 532703 - RNA, 64 nt, Human; identical to SEQ ID NO: 516602

SEQ ID NO: 532704 - RNA, 64 nt, Human; identical to SEQ ID NO: 516603

SEQ ID NO: 532705 - RNA, 64 nt, Human; identical to SEQ ID NO: 516604

SEQ ID NO: 532706 - RNA, 64 nt, Human; identical to SEQ ID NO: 516605

SEQ ID NO: 532707 - RNA, 64 nt, Human; identical to SEQ ID NO: 516610

SEQ ID NO: 532708 - RNA, 64 nt, Human; identical to SEQ ID NO: 516611

SEQ ID NO: 532709 - RNA, 64 nt, Human; identical to SEQ ID NO: 516612

SEQ ID NO: 532710 - RNA, 64 nt, Human; identical to SEQ ID NO: 516613

SEQ ID NO: 532711 - RNA, 64 nt, Human; identical to SEQ ID NO: 516614

SEQ ID NO: 532712 - RNA, 64 nt, Human; identical to SEQ ID NO: 516615

SEQ ID NO: 532713 - RNA, 64 nt, Human; identical to SEQ ID NO: 516616

SEQ ID NO: 532714 - RNA, 64 nt, Human; identical to SEQ ID NO: 516617

SEQ ID NO: 532715 - RNA, 64 nt, Human; identical to SEQ ID NO: 516618

SEQ ID NO: 532716 - RNA, 64 nt, Human; identical to SEQ ID NO: 516619

SEQ ID NO: 532717 - RNA, 64 nt, Human; identical to SEQ ID NO: 516620

SEQ ID NO: 532718 - RNA, 64 nt, Human; identical to SEQ ID NO: 516621

SEQ ID NO: 532719 - RNA, 64 nt, Human; identical to SEQ ID NO: 516622

SEQ ID NO: 532720 - RNA, 64 nt, Human; identical to SEQ ID NO: 516623

SEQ ID NO: 532721 - RNA, 64 nt, Human; identical to SEQ ID NO: 516624

SEQ ID NO: 532722 - RNA, 64 nt, Human; identical to SEQ ID NO: 516625

SEQ ID NO: 532723 - RNA, 64 nt, Human; identical to SEQ ID NO: 516630

SEQ ID NO: 532724 - RNA, 64 nt, Human; identical to SEQ ID NO: 516631

SEQ ID NO: 532725 - RNA, 51 nt, Human; identical to SEQ ID NO: 516632

SEQ ID NO: 532726 - RNA, 64 nt, Human; identical to SEQ ID NO: 516633

SEQ ID NO: 532727 - RNA, 57 nt, Human; identical to SEQ ID NO: 516634

SEQ ID NO: 532728 - RNA, 64 nt, Human; identical to SEQ ID NO: 516635

SEQ ID NO: 532729 - RNA, 64 nt, Human; identical to SEQ ID NO: 516636

SEQ ID NO: 532730 - RNA, 64 nt, Human; identical to SEQ ID NO: 516637

SEQ ID NO: 532731 - RNA, 64 nt, Human; identical to SEQ ID NO: 516638

SEQ ID NO: 532732 - RNA, 64 nt, Human; identical to SEQ ID NO: 516639

SEQ ID NO: 532733 - RNA, 64 nt, Human; identical to SEQ ID NO: 516640

SEQ ID NO: 532734 - RNA, 64 nt, Human; identical to SEQ ID NO: 516641

SEQ ID NO: 532735 - RNA, 64 nt, Human; identical to SEQ ID NO: 516642

SEQ ID NO: 532736 - RNA, 64 nt, Human; identical to SEQ ID NO: 516643

SEQ ID NO: 532737 - RNA, 64 nt, Human; identical to SEQ ID NO: 516644

SEQ ID NO: 532738 - RNA, 64 nt, Human; identical to SEQ ID NO: 516645

SEQ ID NO: 532739 - RNA, 64 nt, Human; identical to SEQ ID NO: 516650

SEQ ID NO: 532740 - RNA, 64 nt, Human; identical to SEQ ID NO: 516651

SEQ ID NO: 532741 - RNA, 64 nt, Human; identical to SEQ ID NO: 516652

SEQ ID NO: 532742 - RNA, 64 nt, Human; identical to SEQ ID NO: 516653

SEQ ID NO: 532743 - RNA, 54 nt, Human; identical to SEQ ID NO: 516654

SEQ ID NO: 532744 - RNA, 64 nt, Human; identical to SEQ ID NO: 516655

SEQ ID NO: 532745 - RNA, 64 nt, Human; identical to SEQ ID NO: 516656

SEQ ID NO: 532746 - RNA, 64 nt, Human; identical to SEQ ID NO: 516657

SEQ ID NO: 532747 - RNA, 64 nt, Human; identical to SEQ ID NO: 516658

SEQ ID NO: 532748 - RNA, 64 nt, Human; identical to SEQ ID NO: 516660

SEQ ID NO: 532749 - RNA, 64 nt, Human; identical to SEQ ID NO: 516661

SEQ ID NO: 532750 - RNA, 64 nt, Human; identical to SEQ ID NO: 516659

SEQ ID NO: 532751 - RNA, 64 nt, Human; identical to SEQ ID NO: 516662

SEQ ID NO: 532752 - RNA, 64 nt, Human; identical to SEQ ID NO: 516663

SEQ ID NO: 532753 - RNA, 64 nt, Human; identical to SEQ ID NO: 516664

SEQ ID NO: 532754 - RNA, 64 nt, Human; identical to SEQ ID NO: 516665

SEQ ID NO: 532755 - RNA, 64 nt, Human; identical to SEQ ID NO: 516670

SEQ ID NO: 532756 - RNA, 64 nt, Human; identical to SEQ ID NO: 516671

SEQ ID NO: 532757 - RNA, 64 nt, Human; identical to SEQ ID NO: 516672

SEQ ID NO: 532758 - RNA, 64 nt, Human; identical to SEQ ID NO: 516673

SEQ ID NO: 532759 - RNA, 64 nt, Human; identical to SEQ ID NO: 516674

SEQ ID NO: 532760 - RNA, 64 nt, Human; identical to SEQ ID NO: 516675

SEQ ID NO: 532761 - RNA, 64 nt, Human; identical to SEQ ID NO: 516676

SEQ ID NO: 532762 - RNA, 64 nt, Human; identical to SEQ ID NO: 516677

SEQ ID NO: 532763 - RNA, 64 nt, Human; identical to SEQ ID NO: 516678

SEQ ID NO: 532764 - RNA, 64 nt, Human; identical to SEQ ID NO: 516679

SEQ ID NO: 532765 - RNA, 64 nt, Human; identical to SEQ ID NO: 516680

SEQ ID NO: 532766 - RNA, 64 nt, Human; identical to SEQ ID NO: 516681

SEQ ID NO: 532767 - RNA, 64 nt, Human; identical to SEQ ID NO: 516711

SEQ ID NO: 532768 - RNA, 64 nt, Human; identical to SEQ ID NO: 516714

SEQ ID NO: 532769 - RNA, 64 nt, Human; identical to SEQ ID NO: 516715

SEQ ID NO: 532770 - RNA, 64 nt, Human; identical to SEQ ID NO: 516682

SEQ ID NO: 532771 - RNA, 64 nt, Human; identical to SEQ ID NO: 516683

SEQ ID NO: 532772 - RNA, 64 nt, Human; identical to SEQ ID NO: 516684

SEQ ID NO: 532773 - RNA, 64 nt, Human; identical to SEQ ID NO: 516685

SEQ ID NO: 532774 - RNA, 64 nt, Human; identical to SEQ ID NO: 516690

SEQ ID NO: 532775 - RNA, 64 nt, Human; identical to SEQ ID NO: 516691

SEQ ID NO: 532776 - RNA, 54 nt, Human; identical to SEQ ID NO: 516692

SEQ ID NO: 532777 - RNA, 64 nt, Human; identical to SEQ ID NO: 516693

SEQ ID NO: 532778 - RNA, 64 nt, Human; identical to SEQ ID NO: 516694

SEQ ID NO: 532779 - RNA, 64 nt, Human; identical to SEQ ID NO: 516695

SEQ ID NO: 532780 - RNA, 64 nt, Human; identical to SEQ ID NO: 516696

SEQ ID NO: 532781 - RNA, 64 nt, Human; identical to SEQ ID NO: 516697

SEQ ID NO: 532782 - RNA, 64 nt, Human; identical to SEQ ID NO: 516698

SEQ ID NO: 532783 - RNA, 64 nt, Human; identical to SEQ ID NO: 516699

SEQ ID NO: 532784 - RNA, 64 nt, Human; identical to SEQ ID NO: 516700

SEQ ID NO: 532785 - RNA, 64 nt, Human; identical to SEQ ID NO: 516701

SEQ ID NO: 532786 - RNA, 64 nt, Human; identical to SEQ ID NO: 516702

SEQ ID NO: 532787 - RNA, 64 nt, Human; identical to SEQ ID NO: 516704

SEQ ID NO: 532788 - RNA, 64 nt, Human; identical to SEQ ID NO: 516705

SEQ ID NO: 532789 - RNA, 64 nt, Human; identical to SEQ ID NO: 516710

SEQ ID NO: 532790 - RNA, 64 nt, Human; identical to SEQ ID NO: 516703

SEQ ID NO: 532791 - RNA, 64 nt, Human; identical to SEQ ID NO: 516712

SEQ ID NO: 532792 - RNA, 64 nt, Human; identical to SEQ ID NO: 516713

SEQ ID NO: 532793 - RNA, 64 nt, Human; identical to SEQ ID NO: 516716

SEQ ID NO: 532794 - RNA, 64 nt, Human; identical to SEQ ID NO: 516717

SEQ ID NO: 532795 - RNA, 64 nt, Human; identical to SEQ ID NO: 516718

SEQ ID NO: 532796 - RNA, 64 nt, Human; identical to SEQ ID NO: 516719

SEQ ID NO: 532797 - RNA, 64 nt, Human; identical to SEQ ID NO: 516720

SEQ ID NO: 532798 - RNA, 64 nt, Human; identical to SEQ ID NO: 516721

SEQ ID NO: 532799 - RNA, 64 nt, Human; identical to SEQ ID NO: 516722

SEQ ID NO: 532800 - RNA, 64 nt, Human; identical to SEQ ID NO: 516723

SEQ ID NO: 532801 - RNA, 64 nt, Human; identical to SEQ ID NO: 516724

SEQ ID NO: 532802 - RNA, 64 nt, Human; identical to SEQ ID NO: 516725

SEQ ID NO: 532803 - RNA, 64 nt, Human; identical to SEQ ID NO: 516730

SEQ ID NO: 532804 - RNA, 64 nt, Human; identical to SEQ ID NO: 516731

SEQ ID NO: 532805 - RNA, 64 nt, Human; identical to SEQ ID NO: 516732

SEQ ID NO: 532806 - RNA, 64 nt, Human; identical to SEQ ID NO: 516733

SEQ ID NO: 532807 - RNA, 64 nt, Human; identical to SEQ ID NO: 516734

SEQ ID NO: 532808 - RNA, 64 nt, Human; identical to SEQ ID NO: 516735

SEQ ID NO: 532809 - RNA, 64 nt, Human; identical to SEQ ID NO: 516736

SEQ ID NO: 532810 - RNA, 64 nt, Human; identical to SEQ ID NO: 516737

SEQ ID NO: 532811 - RNA, 64 nt, Human; identical to SEQ ID NO: 516738

SEQ ID NO: 532812 - RNA, 64 nt, Human; identical to SEQ ID NO: 516739

SEQ ID NO: 532813 - RNA, 64 nt, Human; identical to SEQ ID NO: 516740

SEQ ID NO: 532814 - RNA, 64 nt, Human; identical to SEQ ID NO: 516741

SEQ ID NO: 532815 - RNA, 64 nt, Human; identical to SEQ ID NO: 516742

SEQ ID NO: 532816 - RNA, 64 nt, Human; identical to SEQ ID NO: 516743

SEQ ID NO: 532817 - RNA, 64 nt, Human; identical to SEQ ID NO: 516744

SEQ ID NO: 532818 - RNA, 64 nt, Human; identical to SEQ ID NO: 516745

SEQ ID NO: 532819 - RNA, 64 nt, Human; identical to SEQ ID NO: 516750

SEQ ID NO: 532820 - RNA, 64 nt, Human; identical to SEQ ID NO: 516751

SEQ ID NO: 532821 - RNA, 64 nt, Human; identical to SEQ ID NO: 516752

SEQ ID NO: 532822 - RNA, 64 nt, Human; identical to SEQ ID NO: 516753

SEQ ID NO: 532823 - RNA, 64 nt, Human; identical to SEQ ID NO: 516754

SEQ ID NO: 532824 - RNA, 64 nt, Human; identical to SEQ ID NO: 516755

SEQ ID NO: 532825 - RNA, 64 nt, Human; identical to SEQ ID NO: 516756

SEQ ID NO: 532826 - RNA, 64 nt, Human; identical to SEQ ID NO: 516757

SEQ ID NO: 532827 - RNA, 64 nt, Human; identical to SEQ ID NO: 516758

SEQ ID NO: 532828 - RNA, 64 nt, Human; identical to SEQ ID NO: 516759

SEQ ID NO: 532829 - RNA, 64 nt, Human; identical to SEQ ID NO: 516760

SEQ ID NO: 532830 - RNA, 64 nt, Human; identical to SEQ ID NO: 516761

SEQ ID NO: 532831 - RNA, 64 nt, Human; identical to SEQ ID NO: 516762

SEQ ID NO: 532832 - RNA, 64 nt, Human; identical to SEQ ID NO: 516763

SEQ ID NO: 532833 - RNA, 64 nt, Human; identical to SEQ ID NO: 516764

SEQ ID NO: 532834 - RNA, 64 nt, Human; identical to SEQ ID NO: 516765

SEQ ID NO: 532835 - RNA, 64 nt, Human; identical to SEQ ID NO: 516770

SEQ ID NO: 532836 - RNA, 64 nt, Human; identical to SEQ ID NO: 516771

SEQ ID NO: 532837 - RNA, 64 nt, Human; identical to SEQ ID NO: 516772

SEQ ID NO: 532838 - RNA, 64 nt, Human; identical to SEQ ID NO: 516773

SEQ ID NO: 532839 - RNA, 64 nt, Human; identical to SEQ ID NO: 516774

SEQ ID NO: 532840 - RNA, 64 nt, Human; identical to SEQ ID NO: 516775

SEQ ID NO: 532841 - RNA, 64 nt, Human; identical to SEQ ID NO: 516776

SEQ ID NO: 532842 - RNA, 64 nt, Human; identical to SEQ ID NO: 516777

SEQ ID NO: 532843 - RNA, 64 nt, Human; identical to SEQ ID NO: 516778

SEQ ID NO: 532844 - RNA, 64 nt, Human; identical to SEQ ID NO: 516779

SEQ ID NO: 532845 - RNA, 64 nt, Human; identical to SEQ ID NO: 516780

SEQ ID NO: 532846 - RNA, 64 nt, Human; identical to SEQ ID NO: 516781

SEQ ID NO: 532847 - RNA, 64 nt, Human; identical to SEQ ID NO: 516782

SEQ ID NO: 532848 - RNA, 64 nt, Human; identical to SEQ ID NO: 516783

SEQ ID NO: 532849 - RNA, 64 nt, Human; identical to SEQ ID NO: 516784

SEQ ID NO: 532850 - RNA, 64 nt, Human; identical to SEQ ID NO: 516785

SEQ ID NO: 532851 - RNA, 64 nt, Human; identical to SEQ ID NO: 516790

SEQ ID NO: 532852 - RNA, 64 nt, Human; identical to SEQ ID NO: 516791

SEQ ID NO: 532853 - RNA, 64 nt, Human; identical to SEQ ID NO: 516792

SEQ ID NO: 532854 - RNA, 64 nt, Human; identical to SEQ ID NO: 516793

SEQ ID NO: 532855 - RNA, 64 nt, Human; identical to SEQ ID NO: 516794

SEQ ID NO: 532856 - RNA, 64 nt, Human; identical to SEQ ID NO: 516795

SEQ ID NO: 532857 - RNA, 64 nt, Human; identical to SEQ ID NO: 516796

SEQ ID NO: 532858 - RNA, 64 nt, Human; identical to SEQ ID NO: 516797

SEQ ID NO: 532859 - RNA, 64 nt, Human; identical to SEQ ID NO: 516798

SEQ ID NO: 532860 - RNA, 64 nt, Human; identical to SEQ ID NO: 516799

SEQ ID NO: 532861 - RNA, 64 nt, Human; identical to SEQ ID NO: 516800

SEQ ID NO: 532862 - RNA, 64 nt, Human; identical to SEQ ID NO: 516801

SEQ ID NO: 532863 - RNA, 64 nt, Human; identical to SEQ ID NO: 516802

SEQ ID NO: 532864 - RNA, 64 nt, Human; identical to SEQ ID NO: 516803

SEQ ID NO: 532865 - RNA, 64 nt, Human; identical to SEQ ID NO: 516804

SEQ ID NO: 532866 - RNA, 64 nt, Human; identical to SEQ ID NO: 516805

SEQ ID NO: 532867 - RNA, 64 nt, Human; identical to SEQ ID NO: 516810

SEQ ID NO: 532868 - RNA, 64 nt, Human; identical to SEQ ID NO: 516812

SEQ ID NO: 532869 - RNA, 64 nt, Human; identical to SEQ ID NO: 516813

SEQ ID NO: 532870 - RNA, 64 nt, Human; identical to SEQ ID NO: 516811

SEQ ID NO: 532871 - RNA, 64 nt, Human; identical to SEQ ID NO: 516814

SEQ ID NO: 532872 - RNA, 64 nt, Human; identical to SEQ ID NO: 516815

SEQ ID NO: 532873 - RNA, 64 nt, Human; identical to SEQ ID NO: 516816

SEQ ID NO: 532874 - RNA, 64 nt, Human; identical to SEQ ID NO: 516817

SEQ ID NO: 532875 - RNA, 64 nt, Human; identical to SEQ ID NO: 516818

SEQ ID NO: 532876 - RNA, 64 nt, Human; identical to SEQ ID NO: 516819

SEQ ID NO: 532877 - RNA, 64 nt, Human; identical to SEQ ID NO: 516820

SEQ ID NO: 532878 - RNA, 64 nt, Human; identical to SEQ ID NO: 516821

SEQ ID NO: 532879 - RNA, 64 nt, Human; identical to SEQ ID NO: 516435

SEQ ID NO: 532880 - RNA, 64 nt, Human; identical to SEQ ID NO: 516823

SEQ ID NO: 532881 - RNA, 64 nt, Human; identical to SEQ ID NO: 516824

SEQ ID NO: 532882 - RNA, 64 nt, Human; identical to SEQ ID NO: 516825

SEQ ID NO: 532883 - RNA, 64 nt, Human; identical to SEQ ID NO: 516830

SEQ ID NO: 532884 - RNA, 64 nt, Human; identical to SEQ ID NO: 516831

SEQ ID NO: 532885 - RNA, 64 nt, Human; identical to SEQ ID NO: 516832

SEQ ID NO: 532886 - RNA, 64 nt, Human; identical to SEQ ID NO: 516833

SEQ ID NO: 532887 - RNA, 64 nt, Human; identical to SEQ ID NO: 516834

SEQ ID NO: 532888 - RNA, 64 nt, Human; identical to SEQ ID NO: 516835

SEQ ID NO: 532889 - RNA, 64 nt, Human; identical to SEQ ID NO: 516836

SEQ ID NO: 532890 - RNA, 64 nt, Human; identical to SEQ ID NO: 516837

SEQ ID NO: 532891 - RNA, 64 nt, Human; identical to SEQ ID NO: 516838

SEQ ID NO: 532892 - RNA, 64 nt, Human; identical to SEQ ID NO: 516839

SEQ ID NO: 532893 - RNA, 64 nt, Human
gucucugcucagcaccccagccggggcucuggacccaggguaacagccccaguucaucccaacc

SEQ ID NO: 532894 - RNA, 64 nt, Human
cccagaggacugagggaauccuguacaggaugucccaggguagauggggagcaggauugggacc

SEQ ID NO: 532895 - RNA, 64 nt, Human
gagucugaaagagcagugggaugggagcuggugaccaggguaccccaggaggcaugaugugccg

SEQ ID NO: 532896 - RNA, 64 nt, Human
ccccucucacacugaccuccccccuuacggcccaccaggguauguaaauaucucuuuucuacca

SEQ ID NO: 532897 - RNA, 64 nt, Human
aaaaagaggcccacaccuugauauccaggccauaccaggguaucccuugucccuucacccccau

SEQ ID NO: 532898 - RNA, 64 nt, Human
ucuauaugcugaauguucugcuguugcaaacuugccaggguauuagccaguguuugugccaagc

SEQ ID NO: 532899 - RNA, 64 nt, Human
gcccgaugucuggcuccccugcaggagggaggcuccaggguaagacagggcuggcaggagcaga

SEQ ID NO: 532900 - RNA, 64 nt, Human
cucucccuccccgcaacccugccccaccuugcauccaggguaugguguaaauaaaccuguguug

SEQ ID NO: 532901 - RNA, 64 nt, Human
aaucaguauuucuucuacuuagaaggcuuggggcccaggguaaugaggcaccagaugaagauaa

SEQ ID NO: 532902 - RNA, 55 nt, Human
cuaccuggccguccaaauagaucccccaggguaccacggaggcgaaggaguugga

SEQ ID NO: 532903 - RNA, 64 nt, Human
caguuuccucaucccauuuacaguuuuucuaacuccaggguaguguuuaguguuaauauuuggg

SEQ ID NO: 532904 - RNA, 62 nt, Human
uaacugaagcacagagaauacaucagacuuaugcauccaagacaucagaacuuggauuuuau

SEQ ID NO: 532905 - RNA, 62 nt, Human
aauugaucaucagaugcccucuggaaugguuagcauccaaggugacagugacugcauugagg

SEQ ID NO: 532906 - RNA, 64 nt, Human
ggcuccuggccuugaucccugccccuccagguguccaggguaaaguguaacucagacugaccug

SEQ ID NO: 532907 - RNA, 64 nt, Human
aucuaaaguccugcucccugucacuuuuuaaaagccaggguagcaguaacaugacaaacggcug

SEQ ID NO: 532908 - RNA, 64 nt, Human
uacggaggggagcccagggccauccauacccaccccaggguaacggggcuggccuggcauuagu

SEQ ID NO: 532909 - RNA, 64 nt, Human
ucaguauucucagguguucuucguucuggcccuuccaggguaauuaggaaggcagaacaagaca

SEQ ID NO: 532910 - RNA, 64 nt, Human
auucagcacuuuuuggugggaacuguuggaaauuccaggguaaggaggaagaugccuguucucc

SEQ ID NO: 532911 - RNA, 64 nt, Human
aaggaaagcgcaggaggugaaaaugcuuucuuggccaggguaguaagaauuagagguuaaugca

SEQ ID NO: 532912 - RNA, 64 nt, Human
cuuuaaaaaaaaaaaaaaaagauuuuggagacuaccaggguaagauuccaacuuguccaaaagc

SEQ ID NO: 532913 - RNA, 64 nt, Human
ggcagucuaguccuggggguaaagcccucagaucccaggguacacucuucuccauucccuccac

SEQ ID NO: 532914 - RNA, 64 nt, Human
gaggaagaagccccguuuccagggcauccgcagcccaggguagggagaaauauucucuccacuu

SEQ ID NO: 532915 - RNA, 64 nt, Human
gucccugcugcccaccccucugagccuuuucuccccaggguauggcuccugcugaguuucuugu

SEQ ID NO: 532916 - RNA, 64 nt, Human
agccagcaccaccucagagacacuguucccugcuccaggguagaccugagaugaaccucccugg

SEQ ID NO: 532917 - RNA, 64 nt, Human
ugcucauuuagaaauaaaucaucugguuguuccuccaggguacuuucuaagauaagccuuaaac

SEQ ID NO: 532918 - RNA, 64 nt, Human
caagcucuaaagggagaagucaggcccugccucuccaggguauagacggcccugcuaggcccca

SEQ ID NO: 532919 - RNA, 64 nt, Human
auucugcaauacuuuaaaacauuuagaaaacaccccaggguaggucuguggcccuuagacagug

SEQ ID NO: 532920 - RNA, 64 nt, Human
acuuuucauuacauacuuguuuaaacucugucuuccaggguaaaaauaauaagguugaaucauu

SEQ ID NO: 532921 - RNA, 62 nt, Human
ggagcaagccccaccugcguuuuucugccacagcauccaaucgugaagaacucgggagaggg

SEQ ID NO: 532922 - RNA, 62 nt, Human
uguagagauaaggacuggcaaccagagccucagcauccaaagauggacugaagugggauggc

SEQ ID NO: 532923 - RNA, 62 nt, Human
caauaacugauucauuuuuuucagagcuugaagcauccaaugauuuuucccuccacugcugu

SEQ ID NO: 532924 - RNA, 64 nt, Human
cagaccagaaauucuaccacuucccagauccuuuccaggguaccacccuauuaagcauuaauuu

SEQ ID NO: 532925 - RNA, 64 nt, Human
aaugacccuugggcuggcaggggcagugacccuuccaggguaccacugagggaagggccugggu

SEQ ID NO: 532926 - RNA, 64 nt, Human
cagguguacgaugucaagauggauucuuugagagccaggguagaucauaugacugccuuucugu

SEQ ID NO: 532927 - RNA, 64 nt, Human
uucuguuuucuucucuuuucacuuuuuguuucuaccaggguagaggccauguugaacuggccuc

SEQ ID NO: 532928 - RNA, 64 nt, Human
gcagggcccaggagugggagcccaggcccucccuccaggguagagaugcaccgaauggaaauug

SEQ ID NO: 532929 - RNA, 64 nt, Human
aagucaguuggguacagcaggacacgccaccauuccaggguagcugguaccgccagaaacagga

SEQ ID NO: 532930 - RNA, 64 nt, Human
agugcucaaacacaccagagggggcaggcaccagccaggguaugauggcuacuacccuuuucug

SEQ ID NO: 532931 - RNA, 64 nt, Human
cagggcucauuuugguuauucuacugccucuaggccaggguaguccuaacacagccugacauag

SEQ ID NO: 532932 - RNA, 64 nt, Human
cauggcagccuacucuccuugaguguaugaguagccaggguaagggguaaaaggauaguaagca

SEQ ID NO: 532933 - RNA, 64 nt, Human
gcaucagguccuucugcacuuugguggaagucucccaggguagguuuccuauuugaaacagugg

SEQ ID NO: 532934 - RNA, 64 nt, Human
acaaaacuucauuuaaaagguuuuucuacugaauccaggguauucugaagaucgaagccugugu

SEQ ID NO: 532935 - RNA, 64 nt, Human
ccugcugguaauaucgggaaagauuuuaaugaaaccaggguagaauuguuuggcaaugcacuga

SEQ ID NO: 532936 - RNA, 64 nt, Human
cucugcggggaggacccgggaccacagcugcuggccaggguagacuuggagcuguccuccagag

SEQ ID NO: 532937 - RNA, 64 nt, Human
ccagcgagcuuaauugcguaaucccuguuguccuccaggguaagcugacacgucuacauaacug

SEQ ID NO: 532938 - RNA, 64 nt, Human
acaugggaccauguuagcugaugccaguugaaggccaggguauuugggaaggggaaggguauua

SEQ ID NO: 532939 - RNA, 62 nt, Human
uauuacuuggcaauaccugaugucagucacaggcauccaacucaugacaagagauaccacug

SEQ ID NO: 532940 - RNA, 62 nt, Human
cugguuuuuagaccucuaucaaucaguaguuagcauccaagagacuuugcagaggcguagga

SEQ ID NO: 532941 - RNA, 62 nt, Human
acuaaugggagaagcuguuugucacucuaagagcauccaagcccuggcccgucugugcacuc

SEQ ID NO: 532942 - RNA, 64 nt, Human
acuugcaaaacagaaguaaauaagaguucgggacccaggguaaaaugguagcuucauccaauau

SEQ ID NO: 532943 - RNA, 64 nt, Human
auuauguccuaauauaaaguacuggcucauagggccaggguauuauuauagaauauuauucucg

SEQ ID NO: 532944 - RNA, 64 nt, Human
uagggguauaccugggaggauccagcaguaauccccaggguacuaggauuacuaguacucugau

SEQ ID NO: 532945 - RNA, 64 nt, Human
cagccaacaguaccaaaagugauuuuugagugugccaggguaaaggcuuccaguucagccucag

SEQ ID NO: 532946 - RNA, 64 nt, Human
ucccccucagcucucccucacaccucccuucaucccaggguauccaccugcaccccacucccaa

SEQ ID NO: 532947 - RNA, 64 nt, Human
ucauugagggaugcugggcacugcugccggguggccaggguauggggcaugugcccagcaaugu

SEQ ID NO: 532948 - RNA, 64 nt, Human
accaaucaaugucacaugaacaaacaagcugcccccaggguaccauuuggggaggggaaaucuu

SEQ ID NO: 532949 - RNA, 64 nt, Human
ucccuuuuagacuuccaucugaaugagucagucaccaggguauucugcauagcauuguauauuc

SEQ ID NO: 532950 - RNA, 64 nt, Human
agcuagcugccugggaggaauuguuaacugaguaccaggguaccuuuaaagaagacccuuggag

SEQ ID NO: 532951 - RNA, 64 nt, Human
auguguauguugacuuuuuaaaauucugagugauccaggguaugaccuagggaaugaacuagcu

SEQ ID NO: 532952 - RNA, 64 nt, Human
ccuggaggcuggggugcuggggcuugggguggccccaggguagguaacagucuuaggacuuagc

SEQ ID NO: 532953 - RNA, 64 nt, Human
ccacuggccaccuagagcccuuggcugugguaauccaggguaauugcgcagaggcaucugaugu

SEQ ID NO: 532954 - RNA, 64 nt, Human
auauuucaguggaaauacaaaaccacuucagagaccaggguaucuccucuggaaggaucuaaga

SEQ ID NO: 532955 - RNA, 64 nt, Human
uuagaaauguaaccaaaaaaauguuaaguguucaccaggguauuaaaauacagaggaguauggu

SEQ ID NO: 532956 - RNA, 64 nt, Human
ggugcugacuuucaggucccuggaccccagaaacccaggguagacauggacucuacucuccuuc

SEQ ID NO: 532957 - RNA, 62 nt, Human
caaggguuccccucucucaugcaugaacaggggcauccaaaauaagaagcucuccauucugu

SEQ ID NO: 532958 - RNA, 62 nt, Human
ggggcaucuguccagccccauugccacucagggcauccaaacaggaggcacccgcugggaag

SEQ ID NO: 532959 - RNA, 62 nt, Human
ugaaccccuggacaacugaccacacccacaaggcauccaaagucuguuggcuuccaauccau

SEQ ID NO: 532960 - RNA, 64 nt, Human
gugcgaccucgguucugugggcucuggaaggccaccaggguagggucuccccagggcuccuccc

SEQ ID NO: 532961 - RNA, 64 nt, Human
auaaucaucuuggaggaaccauaagaaaagguguccaggguaucuauauaaagaggguuaaauu

SEQ ID NO: 532962 - RNA, 64 nt, Human
gccccaaggcagcuacugccccuaacccuucccaccaggguagcuuugggcacugcagcucugg

SEQ ID NO: 532963 - RNA, 64 nt, Human
ugggaagggguugcuaggggguggggacggcuaaccaggguaagaauguucagggggcugccca

SEQ ID NO: 532964 - RNA, 64 nt, Human
aauggcuagaauuauucagacgauuuggcagcguccaggguaagcugguguuauaauacgcugc

SEQ ID NO: 532965 - RNA, 64 nt, Human
aaaauguuggucauuuuauguuaagggaagaauuccaggguauggccauggaguguacaaguau

SEQ ID NO: 532966 - RNA, 64 nt, Human
gaguucccuuuucugaguggauuucaagcauuugccaggguaugcuggaggagggacuccuaaa

SEQ ID NO: 532967 - RNA, 64 nt, Human
ugugccguagacacaaagaagggaacaauagacaccaggguauacuugaggguggaggguggca

SEQ ID NO: 532968 - RNA, 64 nt, Human
aauauccuugccauuuauguuuccugcuguaaagccaggguagcugcaugcacuggcauuugaa

SEQ ID NO: 532969 - RNA, 64 nt, Human
gacagaauuuaauuucucgagcuguuuuucucauccaggguauauguggcagccuuugccauau

SEQ ID NO: 532970 - RNA, 64 nt, Human
auaaucaucuuggaggaaccauaagaaaaaguguccaggguaucuauauaaagaggguuaaauu

SEQ ID NO: 532971 - RNA, 64 nt, Human
cugugacuuccccaagccgcaggugagaccugguccaggguaagaaugggaucgguggagagcc

SEQ ID NO: 532972 - RNA, 64 nt, Human
ugugaauauauagaaaucugugccuggccggaguccaggguaaauuaguagcaugguguuagau

SEQ ID NO: 532973 - RNA, 64 nt, Human
guggaccguggacaggcccagcgcggccagcgucccaggguacccgccugagcuccugcugcgg

SEQ ID NO: 532974 - RNA, 64 nt, Human
uguugccaacucccuguuucuaaugaccaaagacccaggguaccuaaaaggacuuugcaaccaa

SEQ ID NO: 532975 - RNA, 62 nt, Human
agagacaaggaagccaccuguaagcagaagcagcauccaagugccccuggcccccccaugug

SEQ ID NO: 532976 - RNA, 62 nt, Human
acucacacuaugugcaaaaaucaacucaaaacgcauccaagaucuaaauauaagagcugaaa

SEQ ID NO: 532977 - RNA, 62 nt, Human
guuuuguuggcauucacugagaccuuguauuagcauccaagaaaugaugagagagagagaaa

SEQ ID NO: 532978 - RNA, 64 nt, Human
gcccaaauggugugaugcuccuuguagcaggauaccaggguacuggggggcaaugcuaugauua

SEQ ID NO: 532979 - RNA, 64 nt, Human
cucuugguaccuguggguuagcaucaaguucuccccaggguagaauucaaucagagcuccaguu

SEQ ID NO: 532980 - RNA, 64 nt, Human
ccgcucccuucccuccauagccacgcuccaaaccccaggguagccauggccggguaaagcaagg

SEQ ID NO: 532981 - RNA, 64 nt, Human
uguuguuuacagcuuuucuagagcagcugugcgaccaggguagagaguguugaaauucaauacc

SEQ ID NO: 532982 - RNA, 64 nt, Human
uuguaaagaagguuuacuuuuuggugucucauacccaggguaaucuguacaucucuacuuauuu

SEQ ID NO: 532983 - RNA, 64 nt, Human
cccaagcugggccccagcccacccuccugucuucccaggguagcccgccugccaguccuagcug

SEQ ID NO: 532984 - RNA, 64 nt, Human
guauuuaaaaacaagaacagccaaggguuguucgccaggguaggaugugucuuaaagauugguc

SEQ ID NO: 532985 - RNA, 64 nt, Human
gauaagucuguacauugacguguauggacuaaauccaggguaaaaucaauguuacaaaauuuaa

SEQ ID NO: 532986 - RNA, 64 nt, Human
uuacagauuuuaaaugccauguucauuaagaaauccaggguauucagauucugggguuuuucau

SEQ ID NO: 532987 - RNA, 64 nt, Human
gcagcagcuccucucaagcucacucucuaggucuccaggguaggaguguuuuucuagcaagaau

SEQ ID NO: 532988 - RNA, 64 nt, Human
aaaucaguauaccuaucugcugcaccuucacucuccaggguacaugcuuuaaaaccgacccgca

SEQ ID NO: 532989 - RNA, 64 nt, Human
aggccagcugggcgccuuccucccaccugccagcccaggguaccccagacuccaguuucauccu

SEQ ID NO: 532990 - RNA, 64 nt, Human
ggcuccgcccaggcaugguagccugagcgcgcccccaggguaguagggggcaccugaggagcag

SEQ ID NO: 532991 - RNA, 64 nt, Human
gaaguccugaaauaaagugaugggcuuugcaaauccaggguagaggcccuaacaggcacagaga

SEQ ID NO: 532992 - RNA, 64 nt, Human
aaguccuguagguuuauuuuggaagggacuguggccaggguaguucucagguugugcuagagca

SEQ ID NO: 532993 - RNA, 55 nt, Human
cccccagccacccucgcugaggacagcauccaagggaguggguuuugugcaaggg

SEQ ID NO: 532994 - RNA, 62 nt, Human
uccaugaugguuauuuucuuuucuuucaacuugcauccaacuccaggauagugggcacccca

SEQ ID NO: 532995 - RNA, 62 nt, Human
cacugcguuguccacaagacagaagcugaagugcauccaaaggugcucagagagccggcccg

SEQ ID NO: 532996 - RNA, 64 nt, Human
gcuucggcagcggcggcagcgcacagccguugcaccaggguacugcagccggggccgcgugcgc

SEQ ID NO: 532997 - RNA, 64 nt, Human
guccuccuuccccuuugccaacaaggccugaaggccaggguagauuggggggugggacaaugaa

SEQ ID NO: 532998 - RNA, 64 nt, Human
gguccugccagcacccagcaacuuggcaaagcaaccaggguaggggagaaccacgagagaagca

SEQ ID NO: 532999 - RNA, 64 nt, Human
gcccuguuaaaaggaggaggcaaaauagucaaacccaggguaguuuacacuuaaugcuagggag

SEQ ID NO: 533000 - RNA, 64 nt, Human
gauuggcacaaagcaugaagaaaccccauuuuucccaggguaaucaugaaagaaggcucagaga

SEQ ID NO: 533001 - RNA, 64 nt, Human
gccacguucucuagcucuccagucacccacucauccaggguaggagggguucucccugcccccc

SEQ ID NO: 533002 - RNA, 64 nt, Human
accgccagaggacaaggaagugggggccgcuggcccaggguaggggaggguggggcaaugggga

SEQ ID NO: 533003 - RNA, 64 nt, Human
aaccauuuccuaugugccaagcugugccagcaguccaggguacccugacugucccucuguagac

SEQ ID NO: 533004 - RNA, 64 nt, Human
gcagggagcccuuuccucgguucuggccuccagaccaggguaagggcaggccccuccaacaggu

SEQ ID NO: 533005 - RNA, 64 nt, Human
caaggucugcccgacccaugucuaugcucuacccccaggguagcaucucagcuuccgaacccug

SEQ ID NO: 533006 - RNA, 64 nt, Human
ucguggacacugcuggcuugcgggcagucggucuccaggguaccuguugucucuuuuccgaugu

SEQ ID NO: 533007 - RNA, 64 nt, Human
aaaauuauuguuaaacauaucauaacuaaucauaccaggguacugcaauaccacuguuuauaag

SEQ ID NO: 533008 - RNA, 64 nt, Human
caauaaagcuccuuuggcagaaucccccaaagaaccaggguauucuuuuuccaucccuagccau

SEQ ID NO: 533009 - RNA, 64 nt, Human
auucauaaguugcaaauauuacuauuuuccuaaaccaggguacacaauuuaaguugccacuuau

SEQ ID NO: 533010 - RNA, 64 nt, Human
cuaaacuauaaaugcaguuguguccaguuggaggccaggguaccacaugucacaggcggccuua

SEQ ID NO: 533011 - RNA, 62 nt, Human
gcagaaauauauuacaguucauuccacagaaagcauccaaaccacccaaaugaccaaggcau

SEQ ID NO: 533012 - RNA, 62 nt, Human
cuaggcugugcugagcccacucucccgagggcgcauccaagcgggggccacuugagaaguga

SEQ ID NO: 533013 - RNA, 62 nt, Human
cucauaucugcgugcacuucccagagcaucuugcauccaaaccuguaaccuuucggcaagga

SEQ ID NO: 533014 - RNA, 64 nt, Human
uuuccuuaauuagacuaauuauuuuauccccaucccaggguauaaacaggaauuguuuugauag

SEQ ID NO: 533015 - RNA, 64 nt, Human
cuuccuaggaacaauggaagaagaaaggacugaaccaggguauuuuuguuagguuuucuaugug

SEQ ID NO: 533016 - RNA, 64 nt, Human
uauuaaugugcauuacccuaucuuguuuuugaagccaggguaguuguaugauuuuguuaccagc

SEQ ID NO: 533017 - RNA, 64 nt, Human
ucucaggagcaggaacagccaggggaccucagacccaggguauuuucauaccagacuauuugca

SEQ ID NO: 533018 - RNA, 64 nt, Human
uuucaaaacucuuaaaucaguaguuugacuuuugccaggguaaucuucaguuggcccugauuca

SEQ ID NO: 533019 - RNA, 64 nt, Human
uuccuuauuucacugaagaugaaaaaaagcuaauccaggguaccuuugacuuuuuggcuuuaag

SEQ ID NO: 533020 - RNA, 64 nt, Human
ugaaggcaacccuauuucuacuguuucucucuugccaggguauuaggaaggacaggaaaaguag

SEQ ID NO: 533021 - RNA, 64 nt, Human
caucuccgaauuagcauuucuggauauguuucauccaggguaucauugauuuaugauggaaaac

SEQ ID NO: 533022 - RNA, 64 nt, Human
augcugaugcaaaaggauuuuucaacacacuaaaccaggguagggaaaggaaccgagaaagaaa

SEQ ID NO: 533023 - RNA, 64 nt, Human
uugaaguccuccugugccagggaauuuacuaucuccaggguagcacauucccuguguagacggu

SEQ ID NO: 533024 - RNA, 64 nt, Human
aggagacaaaucggugugccauugacaacaugagccaggguaaaggcacccuuuggaauuacug

SEQ ID NO: 533025 - RNA, 64 nt, Human
augaucaaaaggauauauugacaguuaucuauagccaggguaguuguuaauaccugcuuguuug

SEQ ID NO: 533026 - RNA, 51 nt, Human
uuuccaucucagaugacuaagccaggguagggagggaccuccugccuacuc

SEQ ID NO: 533027 - RNA, 64 nt, Human
ccuuccugaauucuuuaaauaugaaauaucauugccaggguauggcuuacagugacuacuauua

SEQ ID NO: 533028 - RNA, 64 nt, Human
ccuggucauccuguuagaguacaucuuuggaaauccaggguaauauucucuuucagagaugcuc

SEQ ID NO: 533029 - RNA, 64 nt, Human
ugugcccuugcucucuaacuucugagcccaccucccaggguaggcaccugggggcaugcaggug

SEQ ID NO: 533030 - RNA, 64 nt, Human
gguaggcaccugggggcaugcaggugcccaccucccaggguaggcaccugggggcaugcaggua

SEQ ID NO: 533031 - RNA, 64 nt, Human
ggguucugggcuccaggggagggagcuggggaggccaggguauaagaaaagcaucagaacucuc

SEQ ID NO: 533032 - RNA, 64 nt, Human
gguccucgcuggccuugccagagguugagccgccccaggguaugaggagaugaauaacuccaca

SEQ ID NO: 533033 - RNA, 64 nt, Human
gagacccagugagaauguagcauuuuguucauccccaggguagcugcccuggggucugggcacu

SEQ ID NO: 533034 - RNA, 64 nt, Human
gaguuuguucacuaaugugaaauaagcuauguguccaggguauugcuccccugaguguauauga

SEQ ID NO: 533035 - RNA, 64 nt, Human
acggagagaaauaaggggauguaaccagcaauggccaggguacaacagcccuggaaaacaguag

SEQ ID NO: 533036 - RNA, 64 nt, Human
ccuccugcccuggagcugguuugggcugucaaaaccaggguaaccuccuacaugggucaugacu

SEQ ID NO: 533037 - RNA, 64 nt, Human
aucuguggccaccucccgggcuguccgagggaccccaggguaccucacacucggagcucgccug

SEQ ID NO: 533038 - RNA, 64 nt, Human
ugugggaaaacggaccgcucuuggcuccugacucccaggguacagcgcccaguaacucauccuu

SEQ ID NO: 533039 - RNA, 64 nt, Human
uuggguaaaauaggucugcaagcuuuauauuugcccaggguaucauucauucuucagguguuga

SEQ ID NO: 533040 - RNA, 64 nt, Human
ucuucuucgagucggagagcuacaaggacagcguccaggguagggugagagggggaccaugagu

SEQ ID NO: 533041 - RNA, 64 nt, Human
ucccaaagcucagcccucugggcgguccccuugcccaggguaucuccuacgguaccucuucaga

SEQ ID NO: 533042 - RNA, 64 nt, Human
cuugaggcacuguugaagaaaucucacuuuucagccaggguacugguucugguacauauggauc

SEQ ID NO: 533043 - RNA, 64 nt, Human
ugaccugccccugccgccugugcccuugcuggguccaggguaggcaaggcugccggcugcaccc

SEQ ID NO: 533044 - RNA, 64 nt, Human
cuaacaacuguccccucacccaccagcuauuuccccaggguagagugggcaauucucaccuuca

SEQ ID NO: 533045 - RNA, 64 nt, Human
ugugucccuguuucaguugcacugggguuggagcccaggguagggguuuccagcuuccccaggc

SEQ ID NO: 533046 - RNA, 64 nt, Human
aucaguguagccccaagaaggcuggggcuauuuaccaggguagaaaaaggagcuuaccucccac

SEQ ID NO: 533047 - RNA, 64 nt, Human
ugugccaggaggaugacaaaaauguuccuguguuccaggguaaugccagguggguuuugagagc

SEQ ID NO: 533048 - RNA, 64 nt, Human
gaagcccagagggucugggggcacaagacugacgccaggguaugaagaguguuauuuucauuca

SEQ ID NO: 533049 - RNA, 64 nt, Human
gggucauacccccucccucuuguccacccuacccccaggguaaggggagccucucuccuucccc

SEQ ID NO: 533050 - RNA, 64 nt, Human
caucccugggauagagugagcccucuugcgucuuccaggguagcucagguuggcccaguuuggg

SEQ ID NO: 533051 - RNA, 64 nt, Human
cagcaggauuaacuugaccauggugggaacugcaccaggguacuccucacagcgccaucaccaa

SEQ ID NO: 533052 - RNA, 64 nt, Human
augaacacuucuccagccaccucauacccccuucccaggguaagugcccacgaaagcccagucc

SEQ ID NO: 533053 - RNA, 64 nt, Human
auggccugagguaugggguaugugcauguggaggccaggguaaggugaauggggaggcugggag

SEQ ID NO: 533054 - RNA, 64 nt, Human
ucuguguaaauauuuuucccuccgggcaggggagccaggguagagcaaaggagacaaagcagga

SEQ ID NO: 533055 - RNA, 64 nt, Human
aagugagaaagagagcaggcucgggaggcccugcccaggguaggaggagcuuccugcuuugcac

SEQ ID NO: 533056 - RNA, 64 nt, Human
cacauagguggcccauucagccucaaggggaaauccaggguaggaagcagcagcucugcuggac

SEQ ID NO: 533057 - RNA, 64 nt, Human
uccccacgugcaccauaccuggggaguuccugguccaggguauccuggggccacccucccugcc

SEQ ID NO: 533058 - RNA, 64 nt, Human
ucucuucucugccucucaccaggacagccgccccccaggguacuccugcccuugcuugacucag

SEQ ID NO: 533059 - RNA, 64 nt, Human
uauuuuuaguagagacgggguuucaccauguuggccaggguagucuugaacuccugacuucaaa

SEQ ID NO: 533060 - RNA, 64 nt, Human
uucuagccagcuguggacacauaggaaugcuggaccaggguaccagauuuuuucaacaaagggg

SEQ ID NO: 533061 - RNA, 64 nt, Human
gugguggcuuauaacuguaagggagauggcagccccaggguacagccagcaggcauugagcagc

SEQ ID NO: 533062 - RNA, 64 nt, Human
uccucacacccugcuaccacccuaacguggacacccaggguaacauaugccuggacauccugaa

SEQ ID NO: 533063 - RNA, 64 nt, Human
uuccccuuuuucauucccugugcugaaagagggaccaggguagaugcccccugcccucgaaucc

SEQ ID NO: 533064 - RNA, 64 nt, Human
agguuuuuaaaaucuccaguggccauaaaacuagccaggguagcucaugcuuuuacugguugga

SEQ ID NO: 533065 - RNA, 64 nt, Human
aaaugccuggcgugagagccagcagacagccaggccaggguaggcagugccugcuucugcucca

SEQ ID NO: 533066 - RNA, 64 nt, Human
cugugcaccagcugcacuggcuucccccucagcaccaggguaccaggugagccagaggccugag

SEQ ID NO: 533067 - RNA, 64 nt, Human
gguuccuggcgcccugagguggcucagcaccugcccaggguaggccuggcaugagggguuaggu

SEQ ID NO: 533068 - RNA, 64 nt, Human
ccagguugaggugggggccuugcaucggggguccccaggguaugggguaggggugggggugggc

SEQ ID NO: 533069 - RNA, 64 nt, Human
acagcggucaaggcaaggaugucaugcuugaaggccaggguagacuugagagaguucacauucc

SEQ ID NO: 533070 - RNA, 64 nt, Human
aaagucaaaagauaaauuggggccuuguaaaaggccaggguaaaaugucucaggcaagcaaaag

SEQ ID NO: 533071 - RNA, 64 nt, Human
gggugaacaauauggagagagaccugggaaaaguccaggguagcuugcccaggggaagacagca

SEQ ID NO: 533072 - RNA, 64 nt, Human
agagugguggcaucuucaccugaauucuucaaugccaggguaauaaaccaaaauaguccuaauc

SEQ ID NO: 533073 - RNA, 64 nt, Human
agcugucgccucagucugcgcacaggcaugcaccccaggguagugccugcagggaugcaugugu

SEQ ID NO: 533074 - RNA, 64 nt, Human
guguccacacaccuguaggccucugagccagcguccaggguacaggugcgggugguggggauga

SEQ ID NO: 533075 - RNA, 64 nt, Human
ggguggggcgugguguuuagacacagauaggaguccaggguaugacugauggaggccccggccc

SEQ ID NO: 533076 - RNA, 64 nt, Human
ggcucucagcucucgggccagugcucugcucuguccaggguagguaauacugggagacuccugu

SEQ ID NO: 533077 - RNA, 64 nt, Human
cgccucaucagccucugccuugucccacugagguccaggguagcucggggcagggguggggcag

SEQ ID NO: 533078 - RNA, 64 nt, Human
ggcaaccucugagccaucccagagccuggggaggccaggguagaggcugacggcgcaagaccag

SEQ ID NO: 533079 - RNA, 64 nt, Human
aaacguaccuugaaacucucuaucucuggacacuccaggguagagaaugaaggguauggaagua

SEQ ID NO: 533080 - RNA, 64 nt, Human
ugccagugccccugagcuugcuuuccacauucucccaggguauggagaccuagaccugucuuug

SEQ ID NO: 533081 - RNA, 64 nt, Human
cuggcucaagacgggguggggaaggggcugggagccaggguacuccaaugcguggcucuccugc

SEQ ID NO: 533082 - RNA, 64 nt, Human
aaaguuuauuuucagaaaauaaaauaauaaaagcccaggguauuuuaaaugcuucuaauauaag

SEQ ID NO: 533083 - RNA, 64 nt, Human
ugguaccccuuugguaaguaggcuucagugcauaccaggguaucacuggagaugggaguuagug

SEQ ID NO: 533084 - RNA, 64 nt, Human
ccccuacuccaggcuccccaucucccugaagcuuccaggguagcagcuggugggacacugaucu

SEQ ID NO: 533085 - RNA, 64 nt, Human
agagcuuaaggcagggcuggcacuauuuccuuggccaggguaccuuauggggccauauccuaca

SEQ ID NO: 533086 - RNA, 64 nt, Human
uugguuugucagaggcuauugggaacagcugggcccaggguauuugcucaguaaauauuuuggg

SEQ ID NO: 533087 - RNA, 64 nt, Human
aauguauggcaggcugggcagaauguauacugauccaggguauagacuagauauuuuugcuguu

SEQ ID NO: 533088 - RNA, 64 nt, Human
ccagcugcccccauaacuggcagcauucccagacccaggguacucuaauaggggcggcucaggc

SEQ ID NO: 533089 - RNA, 64 nt, Human
aaugaagaagcaacacauaaguuucaaaaaauauccaggguacuccuggacaguguccccuuuu

SEQ ID NO: 533090 - RNA, 64 nt, Human
aggggguagcccugccgcacuuugucacgggagcccaggguacccgccuccuuuucguaacacu

SEQ ID NO: 533091 - RNA, 64 nt, Human
cccugggguccgugggcaaguugcccagggugggggugccuagccaggugcaguccccgccccg

SEQ ID NO: 533092 - RNA, 64 nt, Human
cucagcucuggugcgggcagaucccugccauuuaggugccuaagcaaaaggacaggcuguccaa

SEQ ID NO: 533093 - RNA, 64 nt, Human
agacugccuggguccuggcgccuggcggucaccuggugccuacuguccgacaggaugccuugau

SEQ ID NO: 533094 - RNA, 64 nt, Human
gugaggccccguccuucucacugccuggucacauggugccuagggaugcagggcuggaggccag

SEQ ID NO: 533095 - RNA, 64 nt, Human
aaaguagcccagguccugggccagaugcaggggaggugccuauccaugagugaaggccaguguc

SEQ ID NO: 533096 - RNA, 64 nt, Human
agcucaagcaggagugucaggggcccucacucucggugccuacuuccugucaggcuucuggucc

SEQ ID NO: 533097 - RNA, 64 nt, Human
ugggcacuucucacaaacuuucuagugaacaaaaggugccuauucuuuuuuaaaaaaauaaaau

SEQ ID NO: 533098 - RNA, 64 nt, Human
gagugggagggacagagggaaggucacaggcaagggugccuaucuaaguggaacuaauugcccg

SEQ ID NO: 533099 - RNA, 64 nt, Human
guauuaguagacaaggucuuuguucagacgauuaggugccuaacuggcaaaugccuuaguuucu

SEQ ID NO: 533100 - RNA, 64 nt, Human
uucccaauagaagaauaagucauggagccugaagggugccuaguugacuuacugacaaaaggcu

SEQ ID NO: 533101 - RNA, 64 nt, Human
gaacuaaagcagaugucaagcaggggcuggugggggugccuacucccuuuuccacucuaucuuu

SEQ ID NO: 533102 - RNA, 64 nt, Human
ucccccaacuucugucgcaugcagugccuguacuggugccuaccauacacggaaagcaaaacag

SEQ ID NO: 533103 - RNA, 64 nt, Human
uuucugcagcuucuaacccaggaccaugaacucaggugccuagagaagccaggcagcuaaagga

SEQ ID NO: 533104 - RNA, 64 nt, Human
uaaaacacuuuguaaccauguauuuacucugccaggugccuauauuccaauaaaauguucaucc

SEQ ID NO: 533105 - RNA, 64 nt, Human
cagccccugaccccugccacccuccgguggcccaggugccuaccucccucaagccugggaaggu

SEQ ID NO: 533106 - RNA, 64 nt, Human
gaugcuaccugcuguuacuuauucagauaaacauggugccuauuggaacaauagcggauagagc

SEQ ID NO: 533107 - RNA, 64 nt, Human
acuccuuuccucaccccaagugcccugcucuccaggugccuagaguauccuaacucuuaggacc

SEQ ID NO: 533108 - RNA, 64 nt, Human
aucuauucucuuacauuuugugcuuuuuaucuugggugccuagcauucuguuuuuuugauccua

SEQ ID NO: 533109 - RNA, 64 nt, Human
auacauuuuuguaugagaaaggugauugguacagggugccuauuuuagucauggaucaaaauuu

SEQ ID NO: 533110 - RNA, 64 nt, Human
aucuuaugcaucucuguauuucugcgccuagcacggugccuagcacacaguaggcgcucaauaa

SEQ ID NO: 533111 - RNA, 64 nt, Human
aacaccacacaagacauuuuucuacaguauuucaggugccuaccacacaggaaaccuugaagaa

SEQ ID NO: 533112 - RNA, 64 nt, Human
aggaccugggacgugcgagggaaacgugggugacggugccuaggcugcggcccuucacugcugu

SEQ ID NO: 533113 - RNA, 64 nt, Human
cacucuguucuagcauucuuuguggagauggucuggugccuagcugggagugagcagcagccca

SEQ ID NO: 533114 - RNA, 64 nt, Human
gaugguaucuauagucaagacgaacauguagcauggugccuauguagacaauauaagagcuucc

SEQ ID NO: 533115 - RNA, 64 nt, Human
aggaguguccuggccagagaucagaggaugguagggugccuauucucggcucuucuccuggggu

SEQ ID NO: 533116 - RNA, 64 nt, Human
cauguaugcauacaugcacagagaugcauacacaggugccuaugcaaguucauuuaagccucag

SEQ ID NO: 533117 - RNA, 64 nt, Human
uucugccucagccucccgaguagcugggaccacaggugccuaccaccaugccaggcuaauuuuu

SEQ ID NO: 533118 - RNA, 64 nt, Human
aauaaaaacauauuuuauaagaacaaaaggccugggugccuacccgugugggggcacuguggga

SEQ ID NO: 533119 - RNA, 64 nt, Human
gaauaaccgacaugaaaauuuuuuaggauaacuuggugccuaccugaaaaauguauuguguuuu

SEQ ID NO: 533120 - RNA, 64 nt, Human
augcuaauaauaaauauauugauagccaagucauggugccuaaaaugccagcuauugccaagaa

SEQ ID NO: 533121 - RNA, 64 nt, Human
cccuuagaacuacagacucgaaaucuuuaaagauggugccuaagcaucuauguauuuuuuuuaa

SEQ ID NO: 533122 - RNA, 64 nt, Human
cuuucuaagccuugugcuaaaggcguauaacgguggugccuaucuacuuaagggggcauucuag

SEQ ID NO: 533123 - RNA, 64 nt, Human
ggcuucuuccuaggggccucgugaucugagggguggugccuacuuccacuguaagaaagaaucu

SEQ ID NO: 533124 - RNA, 64 nt, Human
gauguugcauuuccaaggagauaaucuccuucuuggugccuaauuuucuagaugauaauaggcu

SEQ ID NO: 533125 - RNA, 64 nt, Human
caccaagaauucuuagcacugguguaaauaucauggugccuacucgaaagaaauguagaugcua

SEQ ID NO: 533126 - RNA, 64 nt, Human
uuugcucuuuagaugcaaguggcugaggccaauaggugccuaguaaauguuaacuguucuugga

SEQ ID NO: 533127 - RNA, 64 nt, Human
ucuacuguucuaucuaggauggugaaauuccaaaggugccuaacuugaguaagggauuugugac

SEQ ID NO: 533128 - RNA, 64 nt, Human
ugagagcaggacaggaaaacccaccuauggaauaggugccuaucccugugaagaugaaccucug

SEQ ID NO: 533129 - RNA, 56 nt, Human
acaacuguugcauucaauaaaauuggggugccuaaugcuacuggaaguggaacuug

SEQ ID NO: 533130 - RNA, 64 nt, Human
uagguuuaugacaguaauuguguuuacauuuuauggugccuaguauugacaaaauguuauuucc

SEQ ID NO: 533131 - RNA, 64 nt, Human
ucaaguuuaaauauuguuggcucauacugauuauggugccuaagagagcuauauauauacacau

SEQ ID NO: 533132 - RNA, 64 nt, Human
ugccccucugaggauuugggcauauuuuuuggaaggugccuaaugcuuaggauagucucuaggg

SEQ ID NO: 533133 - RNA, 64 nt, Human
gaaagccagcuggauguuugugguggggccucauggugccuaggaggagauaaagaugaggagg

SEQ ID NO: 533134 - RNA, 64 nt, Human
acaguggguagcaggagaaggaccgguguugguaggugccuacagagacuauagagcuagacaa

SEQ ID NO: 533135 - RNA, 60 nt, Human
uuccaaagugcugggauaauaggcauggagccgccacacccagccaaugugccgaagaaa

SEQ ID NO: 533136 - RNA, 60 nt, Human
cucaaggcccugcccccagcccugcaggacccgccacaugugcccccgagggucccacga

SEQ ID NO: 533137 - RNA, 60 nt, Human
ucccgauguucccacccgcaugaucccuucccgccacacgaugcuccguuuucuuccguu

SEQ ID NO: 533138 - RNA, 60 nt, Human
cauauaaaauacaaggugaaagccccccccccgccacauuagcugcgccccugaaguguc

SEQ ID NO: 533139 - RNA, 64 nt, Human
uucuagaaaugauucugagaggaguguauaguauggugccuaucuacacucacaugauauucuu

SEQ ID NO: 533140 - RNA, 64 nt, Human
cucacgcucgguggagggacgcgugcggcgggacggugccuacggguacuugcagcuguguccc

SEQ ID NO: 533141 - RNA, 64 nt, Human
gagaaauuuaaaauacugggguuuuuuguuuaauggugccuauuuagaguuggaaguugaacag

SEQ ID NO: 533142 - RNA, 64 nt, Human
ccauagaguacuccaacaagacaugcauaccauuggugccuaagaaagauuuuuuuacaguugu

SEQ ID NO: 533143 - RNA, 64 nt, Human
uguuuaagaaacuguagcugcuucuuuuacaaguggugccuauuaaagucaguaauggccauua

SEQ ID NO: 533144 - RNA, 64 nt, Human
uucacuuuacacacuaaguaaacacuuauugucaggugccuagucuugagugaauuguuagaug

SEQ ID NO: 533145 - RNA, 64 nt, Human
guuuucaacgcuuaaaggugucuuccucccaaguggugccuaaaguuuaaccaaaaagaccaga

SEQ ID NO: 533146 - RNA, 64 nt, Human
cgaacccacaccccaacucccucccaagaacuucggugccuaaagccuccuguuccaccucagg

SEQ ID NO: 533147 - RNA, 64 nt, Human
guuuauacuugcgcucugaaauguguaaacauagggugccuaccuauuucaccugacccauacu

SEQ ID NO: 533148 - RNA, 64 nt, Human
ccuucccucccaagcagugaauuaauaaccagcaggugccuaucacugaguaacagaagagcug

SEQ ID NO: 533149 - RNA, 64 nt, Human
uuuacccugaggggcucagcacucauuaggacuuggugccuaauuuuauaaaaagucacuaagc

SEQ ID NO: 533150 - RNA, 64 nt, Human
ucugagaauugugucccucuucagguucccucuuggugccuaaccuggauuaguaaugugcauu

SEQ ID NO: 533151 - RNA, 64 nt, Human
ggagguggcuuccuccaaaggacacccgauggcaggugccuagggggugugggguuccguucuc

SEQ ID NO: 533152 - RNA, 64 nt, Human
gagcuucccuuccggcuggcucugaaccgugcguggugccuacagccugcagucuggagacaag

SEQ ID NO: 533153 - RNA, 64 nt, Human
uaauggaaaggcaaagggguaccccaaauccagaggugccuacauuucaggcagccuuggagua

SEQ ID NO: 533154 - RNA, 64 nt, Human
agaagguauaauuuuuugacacccuuucccaccuggugccuaugcuaggcuuguccugagaaca

SEQ ID NO: 533155 - RNA, 60 nt, Human
agugcuaacaugcaaccauuccucacgccaccgccacaucagagcugguugggaacccuu

SEQ ID NO: 533156 - RNA, 60 nt, Human
cuuacaucucccucccuuggcugaggucccccgccacagccuggacccuucccucagaag

SEQ ID NO: 533157 - RNA, 60 nt, Human
aucauggagcccugcgaccucccugcccugccgccacaugcaguggaggagaggccugug

SEQ ID NO: 533158 - RNA, 60 nt, Human
acuuagacccagucauucuagagggauccaccgccacacuggccggcccacguccugggu

SEQ ID NO: 533159 - RNA, 64 nt, Human
gggucagggcaguaucucucugccuauuuauuggggugccuauuuauuggggaucugcauuccc

SEQ ID NO: 533160 - RNA, 64 nt, Human
uuuuugguguuuaugaaaaucauuuaguugacaaggugccuaugccauuguuaaauuuucuuua

SEQ ID NO: 533161 - RNA, 64 nt, Human
aguuuacuugucugccuuccuuuccaagaccguuggugccuagaggacuagaaucguguccuau

SEQ ID NO: 533162 - RNA, 64 nt, Human
guuuauuucucaaaccagucauuuucaaagaacaggugccuaaauuauaaauuggugaaaaaug

SEQ ID NO: 533163 - RNA, 64 nt, Human
uaaacagggacuuuguccaugguuuguaucauggggugccuacugcugucuaaacucugcucuc

SEQ ID NO: 533164 - RNA, 64 nt, Human
gggcagggacuuuggucuauugucuguauuugccggugccuaggauugugccuguaugcaacag

SEQ ID NO: 533165 - RNA, 64 nt, Human
uuuaaaauugacauuuaauuuucaaaucacuguuggugccuaaucacuuaaguuauuaauuuau

SEQ ID NO: 533166 - RNA, 64 nt, Human
agguccuacgaaaacggaauaauaaaaagcauuuggugccuauuugaaguacagcauaagggaa

SEQ ID NO: 533167 - RNA, 64 nt, Human
gccgguccucugggcaguguggggugcagaauggggugccuaggccugagcguugccuggagcc

SEQ ID NO: 533168 - RNA, 64 nt, Human
acucuuugaacucuguugcugucugagcaaucguggugccuagacuuugcauuccuuguucugu

SEQ ID NO: 533169 - RNA, 64 nt, Human
gcaacccucugucucugacagauugggagccacaggugccuaauugggaaccagggcaugggaa

SEQ ID NO: 533170 - RNA, 64 nt, Human
gaagggcugagcccaccuucuugcuccuacccuuggugccuaaugcugugugaugcaccugcag

SEQ ID NO: 533171 - RNA, 64 nt, Human
gugccuacucugugcaaggcacuaugcuagaucuggugccuagaagcccugagaaagaacuuaa

SEQ ID NO: 533172 - RNA, 64 nt, Human
acucauguggccauuuccgccagcaucacuccccggugccuauggggucccgguguaccuaaag

SEQ ID NO: 533173 - RNA, 64 nt, Human
caggacuuuuaaaacaagcaucccaggggauuccggugccuaccagaagucgcaagcugcuugg

SEQ ID NO: 533174 - RNA, 64 nt, Human
ugcuuauuuuuauugacauguguauaauaagaugggugccuacugugaugcauuuuaccaggca

SEQ ID NO: 533175 - RNA, 60 nt, Human
cauuccucauugggaccaggugggcuguguccgccacaucacccauccccauccccugac

SEQ ID NO: 533176 - RNA, 60 nt, Human
gggcgagggggccucugagcagggcauggcccgccacagccacucaggccuccgugcugg

SEQ ID NO: 533177 - RNA, 60 nt, Human
cacaacaucugaagccauccaggacgucauccgccacauccgcgucaucaacggccgggc

SEQ ID NO: 533178 - RNA, 62 nt, Human
ucuaauauauuuuaaacaagugaaguuaauaugcauccaaaauauuucaaccuguaaucaac

SEQ ID NO: 533179 - RNA, 64 nt, Human
uucagaaagucaucauucuugggaagacuuuggaggugccuauuuuuucugcuguaauuguucu

SEQ ID NO: 533180 - RNA, 64 nt, Human
ugccugccacccuccucucccacucaggcacaauggugccuaaaguguuuccaaucucugggac

SEQ ID NO: 533181 - RNA, 64 nt, Human
ugccuggucucuagaggguugcugccuuucaagcggugccuaagaaguuauuuucuuguuuaac

SEQ ID NO: 533182 - RNA, 64 nt, Human
cuuaaaaggauucacaaaaacuuuugccacacuuggugccuaggcccuguuccuaauaaccccu

SEQ ID NO: 533183 - RNA, 64 nt, Human
gugacacagacauuuugugugagacuuaaaacauggugccuauaucugagagaccugugugaac

SEQ ID NO: 533184 - RNA, 64 nt, Human
ccugaccaccuugcacuauuggacuuuggaaggaggugccuauagaaaacgauuuugaacauac

SEQ ID NO: 533185 - RNA, 64 nt, Human
uuuuaugcuuuuuuugaguucuguuguacaguguggugccuauacuuaauaaugggguauuaua

SEQ ID NO: 533186 - RNA, 64 nt, Human
ucauaguuuuguuagcaauacacugucuuuuaguggugccuaaaauaaugguauaguugugagg

SEQ ID NO: 533187 - RNA, 64 nt, Human
uguggccuuuauuuaauuucuaacuacguaccugggugccuauaucgacaaagagugagaagag

SEQ ID NO: 533188 - RNA, 64 nt, Human
aucuguaaccaaucugacaauaauguguucaucaggugccuauggauuaaaucacauacuggca

SEQ ID NO: 533189 - RNA, 64 nt, Human
ggacucugguuuggcagggcucaggccugacccgggugccuauuccugcagcgcugguuuuggu

SEQ ID NO: 533190 - RNA, 64 nt, Human
agaugauugugcugugggaacagcacacagugagggugccuagcacaaugucuggcacaaagua

SEQ ID NO: 533191 - RNA, 51 nt, Human
cgugccuccuggccggguaagggugccuagcugcccacagagggcaggcac

SEQ ID NO: 533192 - RNA, 64 nt, Human
ccugccuuaggcuccugaguagcuggggauuacaggugccuaccagcaugcucggcuaauuuuu

SEQ ID NO: 533193 - RNA, 64 nt, Human
caguguccugagccccagggagagggggcuggugggugccuaggccugggcaguggauggccgu

SEQ ID NO: 533194 - RNA, 64 nt, Human
ucccugaacgcccugguaaggcuggugagguccuggugccuaucugccuggaggcaaaggccug

SEQ ID NO: 533195 - RNA, 62 nt, Human
gcuguuuugaagccaagugaagagugugguuugcauccaagagaaaacaccacacugugaug

SEQ ID NO: 533196 - RNA, 60 nt, Human
ucauccuuaaggagcuguaaggccucucgagcauccaaacccucacgaccugcaaggggc

SEQ ID NO: 533197 - RNA, 62 nt, Human
uuccucauuuggcuguuggauuuuaagcaaaagcauccaagaaaaacaaggccuguucaaaa

SEQ ID NO: 533198 - RNA, 64 nt, Human
gaaaguggacccgcggugccacuagauggcacuuggugccuagccauggugaaugaccagggcg

SEQ ID NO: 533199 - RNA, 64 nt, Human
ggggguggggggaagcacugauucccaguuagggggugccuaacugagcaguagggauagaagg

SEQ ID NO: 533200 - RNA, 64 nt, Human
caggccuggaucuugcuccucugugaggaacaagggugccuaauaaauacauuucugcuuuauu

SEQ ID NO: 533201 - RNA, 64 nt, Human
augcugaggccucccuggaggaaggaggguuaggggugccuauccucaaguauuggaagagcag

SEQ ID NO: 533202 - RNA, 64 nt, Human
cagacuuugaaauacucgugggauaugaaguggaggugccuagaggguugaagauaaugaggac

SEQ ID NO: 533203 - RNA, 64 nt, Human
uggaaugaaaaagugacuucauauacguaagacuggugccuaagaaugacuugaauguuaucag

SEQ ID NO: 533204 - RNA, 64 nt, Human
uuguguugugggcgaggaggcguuuccacccccuggugccuaucagggcagggugaccuacucc

SEQ ID NO: 533205 - RNA, 64 nt, Human
ccagccuagcccugugagaccccauggggacacgggugccuauguauuuucacuaaaauauaca

SEQ ID NO: 533206 - RNA, 64 nt, Human
guguuaugccugggagugccacuggcauaccgcaggugccuaaaucccaggccccuuucucagg

SEQ ID NO: 533207 - RNA, 64 nt, Human
ccagcuuccgguccccugcagugauagagggcuuggugccuagcugaguccucgcuguccccgc

SEQ ID NO: 533208 - RNA, 64 nt, Human
ccacuccagagugaguagacaagacuuugacaggggugccuaauuuuuuuuuuuuuuugagaug

SEQ ID NO: 533209 - RNA, 64 nt, Human
uacccaaugucucccacacccacccuuuuuuuggggugccuagguugguuuccccugcacuccc

SEQ ID NO: 533210 - RNA, 64 nt, Human
ucuucgcaacccacagaccaggagaucccccuugggugccuaugccaccaaggcccuggguuuc

SEQ ID NO: 533211 - RNA, 64 nt, Human
aaaauaaauaaaaaauaaaagacagaaagcaaggggugccuaaaucuagacuugggguccacac

SEQ ID NO: 533212 - RNA, 64 nt, Human
gggggucuuccuaucccccuccaccucuccccuuggugccuaacccaggacuuuguccccagag

SEQ ID NO: 533213 - RNA, 64 nt, Human
ccugcuggggaccuugccagcuggggcuggggauggugccuacuggggaccuugcuuucuggag

SEQ ID NO: 533214 - RNA, 53 nt, Human
cugcucagcacgccuccuaauuaggugccuaggaagagucccaucugagcagg

SEQ ID NO: 533215 - RNA, 62 nt, Human
ccuucaaccccacuuccuacuguaauagaucagcauccaaaagcaggaacccaucuaaacca

SEQ ID NO: 533216 - RNA, 62 nt, Human
uuuuguaaaauuccauggaucuugcuggagaagcauccaaggaacuucaugcuugauuugac

SEQ ID NO: 533217 - RNA, 64 nt, Human
cuguggcuauuuugcauccuuaagcaccuuucguggugccuaucugggaaagaaccacaguaug

SEQ ID NO: 533218 - RNA, 64 nt, Human
aguuuaguuuuucacuuuagcaaaggggcaauggggugccuacuaugugcgagacauugggagg

SEQ ID NO: 533219 - RNA, 64 nt, Human
ccgucccauccuugcggguaccuggcuaugcgggggugccuaaggagccuggaaaaagcgcucc

SEQ ID NO: 533220 - RNA, 64 nt, Human
uccucgcgcguccucacccugucucuaccagggaggugccuagcuuggugagguuacuccugcu

SEQ ID NO: 533221 - RNA, 64 nt, Human
agauuuuaccugggauaugacaagcaagguuucuggugccuauuuauucauucagugagacaca

SEQ ID NO: 533222 - RNA, 64 nt, Human
cugccugcccugggcgaugagguacgguggggaaggugccuauuuuagagaacuuugucacagu

SEQ ID NO: 533223 - RNA, 64 nt, Human
gauugugaacuauguuuagugugauugugaacuuggugccuaauguuccaugucugaaguuugc

SEQ ID NO: 533224 - RNA, 64 nt, Human
ucuuucuccauggagccuaccucugucugagacaggugccuaaccugggaccuguggucaugug

SEQ ID NO: 533225 - RNA, 64 nt, Human
ccaagaccgcuauaccuaaagaccucuauauccuggugccuaagaaacuucugccucccacaga

SEQ ID NO: 533226 - RNA, 64 nt, Human
ugugguguuguaugccaagaaaauucuuuuuauuggugccuauauuguaacaauuauuuuuaau

SEQ ID NO: 533227 - RNA, 64 nt, Human
aauaaaaucuaugcuuuuuaacaaacauaguuuuggugccuaauucuguaauauguuuuauuga

SEQ ID NO: 533228 - RNA, 64 nt, Human
acagaaagagaucagguuuccagagcugaggaguggugccuauaaugaagacagcguguuuaug

SEQ ID NO: 533229 - RNA, 64 nt, Human
acauuaaaaaaaaaaaaaaaaaaaaaaaaaaacuggugccuaauuuauuaaagagaauuagcuu

SEQ ID NO: 533230 - RNA, 64 nt, Human
aaguuuuauuuuuuacaucuaugguaguuuuugaggugccuauuauaaaguauuacggaaguuu

SEQ ID NO: 533231 - RNA, 62 nt, Human
uguccugggccaacuggugggugaucucugcugcauccaacaugggagcagagacuggcagc

SEQ ID NO: 533232 - RNA, 62 nt, Human
ggccaacugcaagauucuggacuguuuugguggcauccaaagacgaucucagagcacuuuga

SEQ ID NO: 533233 - RNA, 62 nt, Human
accaaaaaauaacuuguuaucaauaaaaacuugcauccaacaugaauuuccagccgaugaua

SEQ ID NO: 533234 - RNA, 64 nt, Human
gcaaguaccugccugcggccaacaugauggcugggcugagcagccugagcagcggcuucggugg

SEQ ID NO: 533235 - RNA, 64 nt, Human
gaaaccccaucucuacuaagaauacaaaaaauuagcugagcaugguggugggcuccuguagucc

SEQ ID NO: 533236 - RNA, 64 nt, Human
ugucugggucagccagagguuccuccaggcaggagcugagcauggggugggcagugaggucccu

SEQ ID NO: 533237 - RNA, 64 nt, Human
gagucuaaaaugauacccuggguggagugggggagcugagcaggaggccagguggcaaccagua

SEQ ID NO: 533238 - RNA, 64 nt, Human
caccaagagugguuuccaugccugcugggaauaggcugagcaugcaaugacaugagggccaagg

SEQ ID NO: 533239 - RNA, 64 nt, Human
gcaagccggcccagccuguccaggauacaguggggcugagcacccccaggccuuccacuccucu

SEQ ID NO: 533240 - RNA, 64 nt, Human
gcccagccaggccuggcccauaaaaggcucccaugcugagcagcccauugcugaagccaggaug

SEQ ID NO: 533241 - RNA, 64 nt, Human
acguggcagcagucgcugaucucccagcugaggggcugagcacuggaaugcuguggcugcacug

SEQ ID NO: 533242 - RNA, 64 nt, Human
gguucaaagaggggcuaggcugauggggaagggggcugagcagcucccaggcagacugccuucu

SEQ ID NO: 533243 - RNA, 64 nt, Human
gccgucccccugcagugggcucugcuaggccugugcugagcaacagcuguuauugucaugguuu

SEQ ID NO: 533244 - RNA, 64 nt, Human
ucuucaucgccuuaaugucuaaagaucagaaaucgcugagcaaacccgcuuuuguuuccuuccc

SEQ ID NO: 533245 - RNA, 64 nt, Human
acagggcagugacaaguggagggggugucuggaagcugagcaggcccgacagagagaugaagcc

SEQ ID NO: 533246 - RNA, 64 nt, Human
uguuuauuucauggaaacugaaguucugcugagggcugagcagcacuggcauugaaaaauauaa

SEQ ID NO: 533247 - RNA, 64 nt, Human
gccugggugggcaggaacugcaguauggccaugggcugagcaggcugagcaccucagccuuuag

SEQ ID NO: 533248 - RNA, 62 nt, Human
ccucccagagccuggcugaaacgucacucccugcauccaacaucugaucugcugagauaugu

SEQ ID NO: 533249 - RNA, 62 nt, Human
gaggaagcaccucugugucagggcucaccugggcauccaaagcggccacgcccacaauccga

SEQ ID NO: 533250 - RNA, 62 nt, Human
uuuuacuauuucucuacuucagacaaaauguugcauccaagguacaucaagugaccauuugc

SEQ ID NO: 533251 - RNA, 64 nt, Human
ggcaggaacugcaguauggccaugggcugagcaggcugagcaccucagccuuuagggcuuaugg

SEQ ID NO: 533252 - RNA, 64 nt, Human
ccucauuccccgacacccucuggcuugaaccauggcugagcagugccggcauacgcuuugcugg

SEQ ID NO: 533253 - RNA, 64 nt, Human
cuggaggaggaggaaaaagauacacucccuuggggcugagcaugccccacacucuuggaucuuc

SEQ ID NO: 533254 - RNA, 57 nt, Human
ugaaggcaaaauuguuguaacacuacagcugagcagauguaauagaaauaaaccuau

SEQ ID NO: 533255 - RNA, 64 nt, Human
aucaggaaaaaaaaaugcagggagguauuuaacagcugagcaaaaacauugagucgcucucaaa

SEQ ID NO: 533256 - RNA, 64 nt, Human
guccucagagcaagcccucaaagagcugggucuggcugagcaccagcugcgcuucaccugccgc

SEQ ID NO: 533257 - RNA, 64 nt, Human
guagggagguuuauucagaucgcuggcagccucggcugagcagaugcacagaggggaucacugu

SEQ ID NO: 533258 - RNA, 64 nt, Human
gggcugggcccucuuucccugcgagacgcacacagcugagcacuuagcaggcaccgccacgucc

SEQ ID NO: 533259 - RNA, 64 nt, Human
cgggaaguccaccuagcggcuguuugccugucgggcugagcaacaagaugccccucccuccugu

SEQ ID NO: 533260 - RNA, 64 nt, Human
aguagagugggacugggggagacccaggccccgggcugagcacugugaggccuggaugugaaga

SEQ ID NO: 533261 - RNA, 64 nt, Human
uugaaaauggaggauggcugcugacuucugacuggcugagcaguggguuccuucagguuccuug

SEQ ID NO: 533262 - RNA, 64 nt, Human
caccaggagcucagcucuguggaguuuucccuuugcugagcaagcaugugguugcauugggugg

SEQ ID NO: 533263 - RNA, 64 nt, Human
cuccuuggucaccugcuccaagaaggaagcaguagcugagcaccugcccucacauucugcucuu

SEQ ID NO: 533264 - RNA, 64 nt, Human
cuccggauguccucuuugcccgucuucucccuuggcugagcaaagccauccccucaauucaggg

SEQ ID NO: 533265 - RNA, 64 nt, Human
cauuguccccuggaaaccuguguggcuaaagucugcugagcaggcagcagccucugcucugugg

SEQ ID NO: 533266 - RNA, 60 nt, Human
uggucuguugaccgcugggcucgcuggugaccgccacagccccgcuuuguaaccagggaa

SEQ ID NO: 533267 - RNA, 60 nt, Human
gccagggaaguccccgaguuuccccagacaccgccacauggcuuccuccugcgcgcaugu

SEQ ID NO: 533268 - RNA, 60 nt, Human
gugccagcaccaccagcaccagauccuccgccgccacaccgcacugaggacacgccggcc

SEQ ID NO: 533269 - RNA, 62 nt, Human
acgagcagaucaagauaaaaaagauugaagaugcauccaacccucugcugcugaagaggcgg

SEQ ID NO: 533270 - RNA, 64 nt, Human
ucagcucagaagagccuucuggagaggacagucagcugagcaccucccauccugcucacacguc

SEQ ID NO: 533271 - RNA, 64 nt, Human
gauaaacuugugcugguguuuuggaucuuaugaugcugagcauguucugcacuggugcuaaugu

SEQ ID NO: 533272 - RNA, 64 nt, Human
aagaugauuaaaguucaggcauccuuauccagcggcugagcagaggaaccccaaaugacuugga

SEQ ID NO: 533273 - RNA, 64 nt, Human
aaaguguccagugaacuuggaagugggccccugagcugagcacagggccaaagcagccauggca

SEQ ID NO: 533274 - RNA, 64 nt, Human
uuuccacccuggcuccuucagacacgugcuugaugcugagcaaguucaauaaagauucuuggaa

SEQ ID NO: 533275 - RNA, 64 nt, Human
cugccucuucccggagaauccagcugggcuagaggcugagcaccuuuggaaacaacauuuaagg

SEQ ID NO: 533276 - RNA, 64 nt, Human
ugagaucuacagagauccaggaaaccaaagcccugcugagcagagccauuuuguggcuauuucu

SEQ ID NO: 533277 - RNA, 64 nt, Human
caacaccuucuuggcuucugggaccuguguucuugcugagcacccucuccgguuuggguuggga

SEQ ID NO: 533278 - RNA, 64 nt, Human
caagucccucuuccuccgugaagcuucucccucagcugagcagugaucacuuacucacucuuaa

SEQ ID NO: 533279 - RNA, 64 nt, Human
aaggaaugaugcagaugagaagcacccagaacaugcugagcagaacaucagaaaaagcaagaag

SEQ ID NO: 533280 - RNA, 64 nt, Human
gccuccuacgaggcugggcugcaggguaugugaggcugagcaaaaggucugcaaaucuccccug

SEQ ID NO: 533281 - RNA, 64 nt, Human
ccucguaguuggcaggagcuccuggaagcacagcgcugagcauggggcgcucccacucagaacu

SEQ ID NO: 533282 - RNA, 64 nt, Human
uccuccugcauaugaaccgaggggaggaggagaagcugagcacgugugacauugccgucuacuc

SEQ ID NO: 533283 - RNA, 64 nt, Human
uucuaggcuggcuuguggguccccugagacgaaggcugagcagggugagccucgaaaaccccau

SEQ ID NO: 533284 - RNA, 64 nt, Human
ccggaccuccccaaguccagaaggaaggaauggagcugagcaacugacgucaaauccccaaguc

SEQ ID NO: 533285 - RNA, 62 nt, Human
cuugaucaacugaaccaguaugccaaaaccaggcauccaauuuguaaaccaauuaugauaaa

SEQ ID NO: 533286 - RNA, 62 nt, Human
cagacacuucuuaugaugaaaguccaaaaguggcauccaauuuaaggccccaucuuucguug

SEQ ID NO: 533287 - RNA, 62 nt, Human; identical to SEQ ID NO: 533197

SEQ ID NO: 533288 - RNA, 64 nt, Human
cggggcacugccucuggcucacgucaauggcugugcugagcacaauggugggcccucucuagac

SEQ ID NO: 533289 - RNA, 64 nt, Human
guaggaaaugcuggcaugcugauuacaagauacagcugagcaaugcacacauuuucagcuggga

SEQ ID NO: 533290 - RNA, 64 nt, Human
uuuucgaaaguuguaaccauaacuggauaucuuagcugagcaaaggcgguuauaauuugucuuu

SEQ ID NO: 533291 - RNA, 64 nt, Human
ugaaaccccgucucuacuaaaaauacaaaaauuagcugagcauggugguacgugccuguacugu

SEQ ID NO: 533292 - RNA, 64 nt, Human
gccauucagaaguucaagccgagaugcugacguugcugagcaacgagauggugagcaucagugc

SEQ ID NO: 533293 - RNA, 64 nt, Human
uggucucaccuguggucugcaguagacacaauuggcugagcaggauaugugauacugugugguu

SEQ ID NO: 533294 - RNA, 64 nt, Human
ggggaacagaugagcacguggggagcuggagugagcugagcagaaguuuugugcccgccugccc

SEQ ID NO: 533295 - RNA, 64 nt, Human
ccuaucuaguacuugauguugauguuuuuauuuugcugagcaaaauaaagccaaugggagaaag

SEQ ID NO: 533296 - RNA, 64 nt, Human
auuuggaaagaagaaagaggauaaggguggaaaggcugagcagaaagguacucugaaacauggu

SEQ ID NO: 533297 - RNA, 64 nt, Human
gaagcccaaccucugugaucauaugagggccaaggcugagcaguguagacagagacccuuugaa

SEQ ID NO: 533298 - RNA, 64 nt, Human
agugaccugguaaagugcaacgugccaugugcaugcugagcaacaugacagccaucacuauggc

SEQ ID NO: 533299 - RNA, 64 nt, Human
acacagacccacagcuuugaaugaucauguuguggcugagcagccgcuuuuuagacguuaucau

SEQ ID NO: 533300 - RNA, 64 nt, Human
uuccucuguuuucccaugcauugaaauuauguuggcugagcaugguggcucacaccuguaaucc

SEQ ID NO: 533301 - RNA, 59 nt, Human
gaacccaugucuuugcagaacgucgaaaugcugagcagcauggauucugcaucgguucg

SEQ ID NO: 533302 - RNA, 64 nt, Human
cacuucaccacagcaauagcuugccuauuagucugcugagcagucaugaauuuuauuguauuuc

SEQ ID NO: 533303 - RNA, 62 nt, Human
cucuuccaccaucaaggcucaacauuuuguaagcauccaaaaaauugguaauuagggggcuu

SEQ ID NO: 533304 - RNA, 62 nt, Human
aacuaccacauucuguccccaaaauguggaaugcauccaaauaggagucuucugccucuuaa

SEQ ID NO: 533305 - RNA, 62 nt, Human
gguaucaguuaugagucuacuacuguauaauggcauccaaaagaauuuuaaaguaccucggu

SEQ ID NO: 533306 - RNA, 64 nt, Human
uguuauggcuauuuuaaauugucccuaauucguugcugagcaaacauguugcuguuuccaguuc

SEQ ID NO: 533307 - RNA, 64 nt, Human
uacuuaugaauauauccagggacuacuucucauugcugagcagcuuuuaauacaccucugcuug

SEQ ID NO: 533308 - RNA, 64 nt, Human
augaagaagcuaaauccuuuacuguuagucauuugcugagcauguacugagccuuguaauucua

SEQ ID NO: 533309 - RNA, 64 nt, Human
cuugugaaauggaagcagccuuuguuccuuucuggcugagcaagcuccugaggcugggagagac

SEQ ID NO: 533310 - RNA, 64 nt, Human
auggaaagaaguagaucuguuuuuucucaauguugcugagcaaagucugcuucucaucagauga

SEQ ID NO: 533311 - RNA, 55 nt, Human
cuuucuccccacagguauagacaaggcugagcaggguuccuguggcccaggaugg

SEQ ID NO: 533312 - RNA, 64 nt, Human
gguagggcugagugauuaccuuagccacaggguggcugagcaggaacuuuagaagaaaauccug

SEQ ID NO: 533313 - RNA, 64 nt, Human
ggccucgaccugugacucacacccaguggacagugcugagcacggggucagggcuggagggcac

SEQ ID NO: 533314 - RNA, 64 nt, Human
agauucucaaguccccuggugauuuccaaguggagcugagcaguuuuagggaaauugagugcug

SEQ ID NO: 533315 - RNA, 64 nt, Human
gaaccuugacggcauugcuccgucuaagucaugagcugagcagggagauccugguugguguugc

SEQ ID NO: 533316 - RNA, 64 nt, Human
cagcugaaacaccaggacccaauagagagggcaagcugagcaucuguauuuccagauaaaaguu

SEQ ID NO: 533317 - RNA, 64 nt, Human
ucaagagaggggccugcagugcaaacccucuuccgcugagcagcugucugaacuauaggcccca

SEQ ID NO: 533318 - RNA, 64 nt, Human
aguccuaacacagccugacauaggagagccccuggcugagcauggcagccuugaagacaccaca

SEQ ID NO: 533319 - RNA, 64 nt, Human
cugugaucauccagcaugaugcagcgugaggacagcugagcagggaccgggacagcccucaccg

SEQ ID NO: 533320 - RNA, 64 nt, Human
acacacuugcagaccuccugagguacacagaauagcugagcaguucacuucagggaucagguca

SEQ ID NO: 533321 - RNA, 62 nt, Human
cuuggguuggcugggguuguuuccugagccaagcauccaauaucaugccccacucaauggcc

SEQ ID NO: 533322 - RNA, 62 nt, Human
ucauuacauuuaaaauauaccuuacagcaaaagcauccaaauaaguauaggguuuauguccu

SEQ ID NO: 533323 - RNA, 62 nt, Human
ggccacccaacagcaccaauuguacauucccugcauccaaucugcucagcaggcccuaagau

SEQ ID NO: 533324 - RNA, 64 nt, Human
agggcccccgacacuccacuccugcugccccugagcugagcagagucauuauuggagaguuuug

SEQ ID NO: 533325 - RNA, 64 nt, Human
uucuggaauguugcugacccaggccguggacuuggcugagcacuguuagacacacacagaccug

SEQ ID NO: 533326 - RNA, 64 nt, Human
cgggaccgggucugacaugccagugccuuccugggcugagcacagauuagagacucucccccuu

SEQ ID NO: 533327 - RNA, 64 nt, Human
aggcagcagcgguccaucuguuuaacagaaaugugcugagcacucccauacaccaggcgcuggu

SEQ ID NO: 533328 - RNA, 64 nt, Human
cucuuaaaacuuuuuuuaugucucaaguaaaauggcugagcauugcagagaaaaaaaaaagucc

SEQ ID NO: 533329 - RNA, 64 nt, Human
cugguagccuggccuuuccuggacagacugaagagcugagcagggcacugccagccugucccuc

SEQ ID NO: 533330 - RNA, 64 nt, Human
aacaaugaaccagaggcuuggucagugugcagcugcugagcaaaaggguuagaggguggggagg

SEQ ID NO: 533331 - RNA, 64 nt, Human
aacccacggccaccaccuccuccccucaaggcaugcugagcaugggcacagacagcccaucccu

SEQ ID NO: 533332 - RNA, 64 nt, Human
ggggggugcuggcaaguguggcagcugccucugggcugagcacagcuugaccccucuagccccu

SEQ ID NO: 533333 - RNA, 64 nt, Human
cauauauguagcaugugcucugcgcucccugcaagcugagcagauacaaccaaugcaucacugu

SEQ ID NO: 533334 - RNA, 64 nt, Human
aguauauaaauaaggaagaaagaaaacaugccaagcugagcaugcugcuccaaauaaauaucug

SEQ ID NO: 533335 - RNA, 64 nt, Human
cauggcucuuucauauaggacuauuuacaagacugcugagcagaaugccuuauaaaccugcagg

SEQ ID NO: 533336 - RNA, 64 nt, Human
uuuggagagucucauguagcuggagacguuaagagcugagcacaccacaggaaaggagggagga

SEQ ID NO: 533337 - RNA, 64 nt, Human
uucccuccaagaggcuggaaaagggcucagagcugcugagcaggaaccggagggugacccauuu

SEQ ID NO: 533338 - RNA, 64 nt, Human
gcacacagguguccauucagaugagaguugggucgcugagcauugguuacuccugcagagugua

SEQ ID NO: 533339 - RNA, 62 nt, Human
uacuguggguuuaaguaugcuacuuucucucagcauccaauaaucauggccccucaauuuau

SEQ ID NO: 533340 - RNA, 62 nt, Human
uuacuaauuauuccucuuugcccaaaauacuugcauccaagguucuagucucuguugcugug

SEQ ID NO: 533341 - RNA, 62 nt, Human
cugcacauuggaaucaccuguaggguuuuaaagcauccaaaugguaauuaacaggcagcaaa

SEQ ID NO: 533342 - RNA, 64 nt, Human
ccagccaagugaccaggacacuuuagugcaaagagcugagcacauuccagcagggaaacgaacu

SEQ ID NO: 533343 - RNA, 64 nt, Human
acccuugacuucugaucuuugucuacuucauuuagcugagcaggcuuucuuucaugcacuuuac

SEQ ID NO: 533344 - RNA, 64 nt, Human
uccuaacguuugucauuccaguuugaguuaaugugcugagcauuuuuuuaaaagaagcuuugua

SEQ ID NO: 533345 - RNA, 64 nt, Human
aaagcacaugagaaugcuagcaggcuguggggcagcugagcagcuuuucuccccucauaucugc

SEQ ID NO: 533346 - RNA, 64 nt, Human
ucccgcagcauccugugagcauuuccgcggggaagcugagcacgugaagcucgcugguucugug

SEQ ID NO: 533347 - RNA, 64 nt, Human
agaaagaugccacugaaaugcugaaauuaucuuugcugagcagcuuuugaaugcuaaggguucc

SEQ ID NO: 533348 - RNA, 64 nt, Human
ccuucauccucaccaugcccugcuaucuccagcugcugagcagcugaggugcugcagccccuuc

SEQ ID NO: 533349 - RNA, 64 nt, Human
acacuggauccaccuagugccucugggccauaaggcugagcagagugagcuuguauuaguuggu

SEQ ID NO: 533350 - RNA, 64 nt, Human
ccagaguuuugguguggaugagcagggacaaauugcugagcaugaagaagaguaaaauuaagca

SEQ ID NO: 533351 - RNA, 64 nt, Human
gcagggagggaggcuguguccucaguggccuggggcugagcagaccuuaggaaggggcccuccc

SEQ ID NO: 533352 - RNA, 64 nt, Human
gcagugucuguggggguuucucugccagcagggggcugagcagagcccauccaggacacuccac

SEQ ID NO: 533353 - RNA, 64 nt, Human
guauagugagucgugauuguaccacugcauuccugcugagcaacagagugagaccccaucucaa

SEQ ID NO: 533354 - RNA, 50 nt, Human
ccaagcuggacgccaacuaggcugagcaaugacagaaccagcugcaccau

SEQ ID NO: 533355 - RNA, 64 nt, Human
uccccauuugcaccuagcuggaucaaguugggaggcugagcaaacucauauuccaguuaguugg

SEQ ID NO: 533356 - RNA, 64 nt, Human
agcaauggauacaaaugaccuugcucuuggauuugcugagcaugaucccuauucugaugucaga

SEQ ID NO: 533357 - RNA, 60 nt, Human
aucccuuguagauuauaaauaaaagcaaaaccgccacagaacuagaggucuucucuuuaa

SEQ ID NO: 533358 - RNA, 60 nt, Human
cccaugucccuccaggccucagccaccugcccgccacauccucugccugcuguccccuuc

SEQ ID NO: 533359 - RNA, 60 nt, Human
gaggcuagccgggccucaccccaccccuacccgccacagccucagggugugcaggggagc

SEQ ID NO: 533360 - RNA, 60 nt, Human
gggagaauguggaacccagccacacugccaccgccacacuagugcugaacguggugcccg

SEQ ID NO: 533361 - RNA, 64 nt, Human
gugucgggcugcccacuggugacaccgggaucgggcugagcaggagaacaucaccggcuccagu

SEQ ID NO: 533362 - RNA, 64 nt, Human
auagacaccuucccgacacuuuuuuaauguuguagcugagcacuuuaacaaguugagcauucca

SEQ ID NO: 533363 - RNA, 64 nt, Human
ugagggguagaacgggaggcugcugaagugaguagcugagcagcuggagccaucccaagcauca

SEQ ID NO: 533364 - RNA, 64 nt, Human
aauucaaccucugaacugaaaugugucaggggcagcugagcaagacagcaguuguauccccuca

SEQ ID NO: 533365 - RNA, 64 nt, Human
aaaagguguucaugccucccuguggcuaguacaggcugagcacuaagaugcuuagugcucagac

SEQ ID NO: 533366 - RNA, 64 nt, Human
agaaacaauugagugcgauuauuggcuucugagcgcugagcagagcagguggaagaggaacuuu

SEQ ID NO: 533367 - RNA, 64 nt, Human
gcuugacauuuggacagauccugucauuguuuaagcugagcaaaaaaccacacaaaaguugugu

SEQ ID NO: 533368 - RNA, 64 nt, Human
ugaaccgggcuguguggauuucuuucugcccguugcugagcacaaugguuuugucgccguuccu

SEQ ID NO: 533369 - RNA, 64 nt, Human
uccagaguggaguccaggcuucucugaaaccagggcugagcauauuuccauagccaaggaggug

SEQ ID NO: 533370 - RNA, 56 nt, Human
ccggaguucaggcccacugagccgcagcugagcacaggcggggcaggaaaaaggau

SEQ ID NO: 533371 - RNA, 64 nt, Human
uggggggucuggggcagaaagguaagagugggaggcugagcagaugcacacauccugagagagg

SEQ ID NO: 533372 - RNA, 62 nt, Human
acaccaaccaugcaaucuagcgaguccauggagcugagcagcaggaggaggagccgugaccc

SEQ ID NO: 533373 - RNA, 64 nt, Human
gugcaggggguccugggcacauugccagcugggugcugagcauugagucacugaucucuuguga

SEQ ID NO: 533374 - RNA, 64 nt, Human
ugggaugaagcuaaauccccagaaugcagcagcagcugagcauguuaaaauggggaaggaugau

SEQ ID NO: 533375 - RNA, 64 nt, Human
guaucugugcuuugcccacaugcccuuggugacagcugagcacccagcucugucuugguagguu

SEQ ID NO: 533376 - RNA, 60 nt, Human
augugguaugacauacacacaccagagcaaccgccacaccagauaucgacagaguggucu

SEQ ID NO: 533377 - RNA, 60 nt, Human
uuaaagguugccccugaugggggccagguuccgccacagaacaucuuagaugucagccuu

SEQ ID NO: 533378 - RNA, 60 nt, Human
cauaaaggugugcauuucaguuaggcugccccgccacagagcaggcuucaucugcucugc

SEQ ID NO: 533379 - RNA, 60 nt, Human
acgccgcaccggagcacggcaccgagggagccgccacacggucaccugcaaggacgucac

SEQ ID NO: 533380 - RNA, 64 nt, Human
uuguuuucaacauuagaagugguguaacauguaagcugagcacgguggcaugccuauaguccca

SEQ ID NO: 533381 - RNA, 64 nt, Human
uuuugccucucuagaguaccacccaguaagucuggcugagcaucuuauguccaguagguucuug

SEQ ID NO: 533382 - RNA, 64 nt, Human
gccagcccagcccuguccucaccuuccagccccagcugagcagccccuccccacaucaucuuca

SEQ ID NO: 533383 - RNA, 64 nt, Human
gcugguguuuaucgaugcuacgugccagaauggggcugagcacggcgccucacuguauccuaac

SEQ ID NO: 533384 - RNA, 64 nt, Human
uuuaaaauacauuuuauuuggggaggaacauguggcugagcagacuuuuguauaauauuacuuc

SEQ ID NO: 533385 - RNA, 64 nt, Human
gccgagauggaaguuuugucccaauagaugagcugcugagcaucaacaaggugacauuuuucug

SEQ ID NO: 533386 - RNA, 64 nt, Human
ggccugcauauucuuuuuuaggccacaggcuacagcugagcaauggcuuagucuaaugauuggg

SEQ ID NO: 533387 - RNA, 64 nt, Human
auucaucuagacccuagggcagugccagugcuaggcugagcaccaucagcucucccagguccuu

SEQ ID NO: 533388 - RNA, 64 nt, Human
gagggcugaucccauggggcggagguccccaguggcugagcaaacagccccuucucucgcuuug

SEQ ID NO: 533389 - RNA, 64 nt, Human
cccccagaacauggaaauaaccauuguuuacagagcugagcauuggugacagggucugacaugg

SEQ ID NO: 533390 - RNA, 64 nt, Human
uucuuucaaacauaaaauaauaagauaauugggagcugagcauaaaacauuauuuggaaaaauu

SEQ ID NO: 533391 - RNA, 64 nt, Human
cccauugaucgccaggauugauuugguugaucuggcugagcaggcggguguccccguccucccu

SEQ ID NO: 533392 - RNA, 64 nt, Human
auguccagaugggagucccauuccuagcagacaagcugagcaccguuguaaccagagaacuauu

SEQ ID NO: 533393 - RNA, 64 nt, Human
ugcgaggccagggaagcccugaguuucuggcggggcugagcagugggggagcauuguguugugg

SEQ ID NO: 533394 - RNA, 64 nt, Human
uucuugguuucaagacagugguguucuuuccauagcugagcagauuauuuugagagguggguga

SEQ ID NO: 533395 - RNA, 60 nt, Human
aaaaugauacugaagaggaaaguaauaaauccgccacaacagacaaugaaauaaguagga

SEQ ID NO: 533396 - RNA, 60 nt, Human
ggaacagaaaaugggcauucuggaucuaaaccgccacaggggccugagagcugaagagca

SEQ ID NO: 533397 - RNA, 60 nt, Human
caucuucaaaacugccauuaccaaacgauuccgccacacauccuuuuagcuacagggcug

SEQ ID NO: 533398 - RNA, 62 nt, Human
ugucuuccacguaagggagaccuuugcaaagggcauccaaauggguaggcaggugacagccg

SEQ ID NO: 533399 - RNA, 64 nt, Human
ccaugugaaggucacuucccuucucauggagucagcugagcaucagcucagcccugccaugucc

SEQ ID NO: 533400 - RNA, 64 nt, Human
aacccuuuguguaucuuuucagacuggggugggggcugagcaugcuugugcagaaagaagccau

SEQ ID NO: 533401 - RNA, 64 nt, Human
ccaagcccuccugagguuguugggccucucuggagcugagcacauuguggagcacaggcuuaca

SEQ ID NO: 533402 - RNA, 64 nt, Human; identical to SEQ ID NO: 533385

SEQ ID NO: 533403 - RNA, 64 nt, Human
uucauuccuugauucacccaacaaauaccgacuggcugagcaccugcugugugugcacugcugu

SEQ ID NO: 533404 - RNA, 64 nt, Human
gagucaggaauaaggggauccccagaagugcagagcugagcaggcuugggccugucauggcugg

SEQ ID NO: 533405 - RNA, 64 nt, Human
ugagacccugucucaaaagaaagcccucuccuuagcugagcagaggaagggaaggaguguggcu

SEQ ID NO: 533406 - RNA, 64 nt, Human
uaaaucuuuagccuugugaaaacuaaccuucucugcugagcaauuguggcccauagccauauuu

SEQ ID NO: 533407 - RNA, 64 nt, Human
uaaacggcccaggccaggugcccaggaaaggacggcugagcauguggagcgagagggaggcagg

SEQ ID NO: 533408 - RNA, 64 nt, Human
ggaacgggaaauaggucuccuaggugccugaagcgcugagcaaccuggguacccugguggggau

SEQ ID NO: 533409 - RNA, 64 nt, Human
gagaaucaggauuucuuaaauacucaacagagaggcugagcagagcaaauggggggcuucaccc

SEQ ID NO: 533410 - RNA, 64 nt, Human
aacugcucaaagugacggguucuugguugucucugcugagcacgcugugucaauggagauggcc

SEQ ID NO: 533411 - RNA, 64 nt, Human
cugugauuuccaccagagaaauuauagcagaguggcugagcaugugcucugaggccaggcccca

SEQ ID NO: 533412 - RNA, 64 nt, Human
cacccaguccuuacgaaucaccgaggaacacugggcugagcacaugacagggagccuggagccc

SEQ ID NO: 533413 - RNA, 64 nt, Human
aauucuuucagaauauaaaauuugggcauucucugcugagcaguucccaaauuaaguacaagga

SEQ ID NO: 533414 - RNA, 60 nt, Human
gguuugccucugcuuuuguucccugccuuuccgccacaucacacggccucacugggcuuc

SEQ ID NO: 533415 - RNA, 60 nt, Human
cggccuccugaguagcugggauuacaguugccgccacacccggcuuauuuuuuuguauuu

SEQ ID NO: 533416 - RNA, 60 nt, Human
ccugucauucccaccacccugaggccccaaccgccacacacacaggagcauuuggagaga

SEQ ID NO: 533417 - RNA, 60 nt, Human
uguguaaacagcagcagucacguuccucggccgccacaaccaacaccaaagcaggaaaac

SEQ ID NO: 533418 - RNA, 64 nt, Human
gaagcacccccucaauagccagcacccacagugagcugagcacuuacagcaacaauuguaaguc

SEQ ID NO: 533419 - RNA, 64 nt, Human
cccagccccuguuuacugguucuugcaaaugggagcugagcagccucuggacagccagugaccu

SEQ ID NO: 533420 - RNA, 64 nt, Human
uggauuuagaauauauuuauguugaugucaaacagcugagcaccguagcaugcagaugucaagg

SEQ ID NO: 533421 - RNA, 64 nt, Human
guagagaaugcacagguguuggugagggcguguggcugagcacuacaugucaaguccagaguca

SEQ ID NO: 533422 - RNA, 64 nt, Human
cacaguuggugauugugagaucuguuagcggcaggcugagcagauacuacuugguuuugcuugg

SEQ ID NO: 533423 - RNA, 64 nt, Human
guaacaguggcgcgguguccgagggcagaguccagcugagcacuuccugcaugcgcccccggca

SEQ ID NO: 533424 - RNA, 64 nt, Human
ggaauaaaauaaggagguaagagauacuauuuuugcugagcaaccaguguguuucaggaugaua

SEQ ID NO: 533425 - RNA, 64 nt, Human
cggccacauuccaaaccucuaccgucaccuagcugcugagcagaaaccgcaccccgagagaaaa

SEQ ID NO: 533426 - RNA, 64 nt, Human
uggcacagcagcaggaccuugucaugggacugaugcugagcagggagggggcugccaggcuggc

SEQ ID NO: 533427 - RNA, 64 nt, Human
ugggcuaagauggggcuugcaacauuaaacaugagcugagcauccauaagcauugaauugggau

SEQ ID NO: 533428 - RNA, 64 nt, Human
agggugggccccacgcugggaggacacgggcugggcugagcagggccucuaguggaacacaugg

SEQ ID NO: 533429 - RNA, 64 nt, Human
ggagaagggccuccugcuggccagagcaaggaaggcugagcagcuugguucuccccucuggccc

SEQ ID NO: 533430 - RNA, 59 nt, Human
uggccucccagcaguugugacgggcaguugcugagcagaccgccccacccuccccggcu

SEQ ID NO: 533431 - RNA, 64 nt, Human
caagggucaggggccggguccacucuuucccuaggcugagcaccucuaggcccucuaggcuggg

SEQ ID NO: 533432 - RNA, 64 nt, Human
ccccuuuccuugaaucauaccugcuuuauucuuagcugagcaaaacaagcaaugcuuugggagg

SEQ ID NO: 533433 - RNA, 60 nt, Human
acauuuaagaucuuacaugcaguuauaaaaccgccacagucuucaauccagauuugaaga

SEQ ID NO: 533434 - RNA, 60 nt, Human
uugagugaccgucugugcaggcccuguaguccgccacagggcucugagcugcacuggccc

SEQ ID NO: 533435 - RNA, 60 nt, Human
cugcucgccgauccguggggcccccugugcccgccacacgcacgcacacacucuuacacg

SEQ ID NO: 533436 - RNA, 60 nt, Human
ccccaaggaggaugggaucuuggugcugagccgccacacccugggccuggcccugcggga

SEQ ID NO: 533437 - RNA, 64 nt, Human
gugcuuugggaaccaaauggaccuucugggacaagcugagcaagcuguaugaacgccacguuug

SEQ ID NO: 533438 - RNA, 64 nt, Human
gaagaguuguuuuauuucauuaauugcuagcaaggcugagcacuuuuccaugugaugauuuacu

SEQ ID NO: 533439 - RNA, 64 nt, Human
acuagauggcagggcacugggggucaggcugaaggcugagcaacaccucucugcccucccuccc

SEQ ID NO: 533440 - RNA, 64 nt, Human
acggaggaagccgcuuauccuguuuucauggacagcugagcacuaaaggaauuucuaaggacau

SEQ ID NO: 533441 - RNA, 64 nt, Human
uccuggccugagcgcagcgccuccacccugcccugcugagcacagacggaggaagccgcuuauc

SEQ ID NO: 533442 - RNA, 64 nt, Human
ccugccagggcccgaccuggggcugagugcagaggcugagcaggacguuaggcccgggccccug

SEQ ID NO: 533443 - RNA, 64 nt, Human
ucugagcaaggucucgaaagcgcaggccgcccuggcugagcagcaccgcccuuucccagcugca

SEQ ID NO: 533444 - RNA, 64 nt, Human
acagaucucaggcuuguggcugggaauaagcccagcugagcagguggggaucucagccagccuc

SEQ ID NO: 533445 - RNA, 64 nt, Human
ugggaggggaucaccuggguuccaggccauccuugcugagcaucuuugagccugccuuccggug

SEQ ID NO: 533446 - RNA, 64 nt, Human
ccauggucauaagcuuccugaggccucccuggaagcugagcagaugccagcaccaugcuuccug

SEQ ID NO: 533447 - RNA, 64 nt, Human
acgauaggaagacagggggccccaaccugggauugcugagcagggaagcuuugcauguugcucu

SEQ ID NO: 533448 - RNA, 64 nt, Human
cucccugagcagguuucugagccagccuggguuggcugagcaacgaagggccaaagcugaccuc

SEQ ID NO: 533449 - RNA, 64 nt, Human
uuaugccuuauuuagcucuugccaaacugcaguggcugagcaauuggacaagauaaagaaauaa

SEQ ID NO: 533450 - RNA, 64 nt, Human
ggaggaccuggaugauguccccaucccugugcccgcugagcacuuccaugaagguaaaggacga

SEQ ID NO: 533451 - RNA, 64 nt, Human
gaacaaaggccucuugaagcccagccacagcccagcugagcaugaggcccagcccauagacggc

SEQ ID NO: 533452 - RNA, 60 nt, Human
cagcgcucugccucaccgcuucccuccugcccgccacacagaccaccauccaccgcugcu

SEQ ID NO: 533453 - RNA, 60 nt, Human
acuuugaugcuucaauauuuaaugaugaauccgccacacuccauuuucccuccucugaag

SEQ ID NO: 533454 - RNA, 52 nt, Human
gcccggccagcucgcccugagcccgccacagccaugagcagccgcucccacc

SEQ ID NO: 533455 - RNA, 60 nt, Human
uccucuggccuggcugggcugggucuggggccgccacaggccccucacggggcggcagag

SEQ ID NO: 533456 - RNA, 64 nt, Human
uuuccccucucuggcuccaauuuggagagggaaugcugagcagauagcccccauuguuaaucca

SEQ ID NO: 533457 - RNA, 64 nt, Human
ggauuucaaaaaguuagcaacuugagaggccagugcugagcaacccaguacccaggaaaugaaa

SEQ ID NO: 533458 - RNA, 64 nt, Human
gguuacuguguauuagacagggccgaacuagugugcugagcaaaaagaauugaagcaaauugua

SEQ ID NO: 533459 - RNA, 64 nt, Human
cccuuugaacaacucauggacgugagggaugggugcugagcagaaccaagagaggaaacuuugg

SEQ ID NO: 533460 - RNA, 64 nt, Human
cacugcaaaccgccaccucccuauacugcuuggagcugagcaaaucaccacaaacuguaauaca

SEQ ID NO: 533461 - RNA, 64 nt, Human
ugggguaguaguguguuguagucguacuuaccaagcugagcaaccucuucagcugggaaggccg

SEQ ID NO: 533462 - RNA, 64 nt, Human
cugggaguccugucagcuuccccaggagcucucugcugagcagcccagcacaacccccaggaaa

SEQ ID NO: 533463 - RNA, 64 nt, Human
aacaagauggugacuucuccuuggggaucugggagcugagcacuugucuauacuuguuccuaau

SEQ ID NO: 533464 - RNA, 64 nt, Human
acaaaucuaagggaaaggaauauuaugggauuaagcugagcaagcaauucugguggaaagucaa

SEQ ID NO: 533465 - RNA, 64 nt, Human
uuagaaacauuuuuacuuaauuucaaaugagugggcugagcauguagacuagcagcuuuuuauc

SEQ ID NO: 533466 - RNA, 64 nt, Human
gagcccugcugaguuccugcuuucugaccuggaggcugagcaggccggaguggauggaugcugu

SEQ ID NO: 533467 - RNA, 64 nt, Human
ccaccucauuaacuuacaaaaaaaugaagggcaugcugagcacucaaacaauuuguucuuacuu

SEQ ID NO: 533468 - RNA, 64 nt, Human
cugugacauugauucagauguuuggcaagagguggcugagcacuggggugggcuuggcacugug

SEQ ID NO: 533469 - RNA, 64 nt, Human
ggcucagaucagagcuccgaagcggucaaagugagcugagcaggacaggcccagccuuucucca

SEQ ID NO: 533470 - RNA, 64 nt, Human
cgggcaaaauacgugcucuccucucuccuugucagcugagcaaacccagggaauagcccuccuc

SEQ ID NO: 533471 - RNA, 60 nt, Human
uuuuuuuuaaaaauacacuccccucccccaccgccacacaccuuacaguucaaaagguug

SEQ ID NO: 533472 - RNA, 60 nt, Human
cccacugacccacccacccaccuacaccccccgccacacacacacacaaacgugcacacg

SEQ ID NO: 533473 - RNA, 60 nt, Human
caucuguguuaguccuuuccuggcugugacccgccacacucacugucaguauuaaggccc

SEQ ID NO: 533474 - RNA, 60 nt, Human
acuagggaagaaagcagaacaguuaagcagccgccacauccccgcuggcugggggccuca

SEQ ID NO: 533475 - RNA, 64 nt, Human
uguaaagccaguuggcuucugugccugacucugugcugagcacagagaaaagucaggugcaguc

SEQ ID NO: 533476 - RNA, 64 nt, Human
auguguuccacagagagggacagcaugugcaaaggcugagcaccaacacauaguggucaccugg

SEQ ID NO: 533477 - RNA, 64 nt, Human
auaugggggaaaaggcaauauauuuuucacugaagcugagcaaccacauauugcuacaaggcaa

SEQ ID NO: 533478 - RNA, 64 nt, Human
uuguaauguuuuucauguuacugccuagggcggugcugagcacacagcaaguuuaauaaacuug

SEQ ID NO: 533479 - RNA, 64 nt, Human
ccugccucagaccccuuugccaggggcuuugggggcugagcagagccacauccagaguggggua

SEQ ID NO: 533480 - RNA, 64 nt, Human
ucuccuccugcccaccugucaaacaaagccagaagcugagcaccaggggaugaguggagguuaa

SEQ ID NO: 533481 - RNA, 64 nt, Human
acccuggagauggcaguuacuccuggccaugguugcugagcaugggcagaccaguggaggccac

SEQ ID NO: 533482 - RNA, 64 nt, Human
ucuuugagguucccuccuucuggguguucuucaggcugagcagagaggcuccuguacccucucu

SEQ ID NO: 533483 - RNA, 64 nt, Human
agccuggccccugcccagggcuugggucuggugagcugagcagcuuccuguggauggugugggg

SEQ ID NO: 533484 - RNA, 64 nt, Human
aaaguagaauaaauucuguauucauggauuggaugcugagcauucuuacucauuaauuuaggug

SEQ ID NO: 533485 - RNA, 64 nt, Human
augcuaacagaucccccugagggauucuugaugggcugagcagcuggcuggagcuaguacugac

SEQ ID NO: 533486 - RNA, 64 nt, Human
ccugaggaaguacugaccaugcccacagccaccggcugagcaaagaagcucauuucaugugagu

SEQ ID NO: 533487 - RNA, 64 nt, Human
gccagggucacugaaggccuggcccacagcaggugcugagcaaagggaacagugaggugcccag

SEQ ID NO: 533488 - RNA, 64 nt, Human
cuuaaggggcagcuucuauuagccagucuuuacagcugagcacauucuggcucagggagguuaa

SEQ ID NO: 533489 - RNA, 64 nt, Human
gggaaccauuuuccuucgaacggcuuccccuugagcugagcauucugcuugcugcaguagacgg

SEQ ID NO: 533490 - RNA, 60 nt, Human
cggggccaccuccacuccaugugcccagccccgccacaaccucuccuccagcacauucca

SEQ ID NO: 533491 - RNA, 60 nt, Human
cagcccaccaggagcaccuggacccccugcccgccacaugguguggccaucacucagccc

SEQ ID NO: 533492 - RNA, 60 nt, Human
aagggcuuuccuguagggucuggggcuuccccgccacaucgcggcccuccagccuggccu

SEQ ID NO: 533493 - RNA, 62 nt, Human
gcagcccauccaaguguauaugaaugaauaaagcauccaaguauauaugaaugaauaaagua

SEQ ID NO: 533494 - RNA, 64 nt, Human
gucuccaaagcacagaguggcaaacaaaacccgagcugagcaucaggaccuugccucgaauugu

SEQ ID NO: 533495 - RNA, 64 nt, Human
guggggcagcugcugccuuacagcccuuccuacugcugagcaucccuaagggagaccuaaauca

SEQ ID NO: 533496 - RNA, 64 nt, Human
cugguauacuaucauccuggagggguguuguauggcugagcaagagagagagagaaugagagag

SEQ ID NO: 533497 - RNA, 62 nt, Human
aaccaccuucaaaagugugagcccugcuucgggcugagcagcugcagggagcccccuuucug

SEQ ID NO: 533498 - RNA, 64 nt, Human
aggguauugagugugagguugaggugggacauuugcugagcaaggagaaccgaugugaauggca

SEQ ID NO: 533499 - RNA, 64 nt, Human
aggaguuggccuguuggguugaauuguugauuuggcugagcagagcugaguuuugguaggagug

SEQ ID NO: 533500 - RNA, 64 nt, Human
ugagauauaaaggcccaucugaucacuggauugggcugagcagagaacaaggccaaccauggaa

SEQ ID NO: 533501 - RNA, 64 nt, Human
cugaguaaagaagagauuuaauuauucuccaguagcugagcaaugcuugugaaucuuuucuuaa

SEQ ID NO: 533502 - RNA, 64 nt, Human
ugaaacccugucuguacuaaaaauacaaaaauuagcugagcaugguggcgugugccuguaaucu

SEQ ID NO: 533503 - RNA, 64 nt, Human
guagcugagcucacaaggcagcaaggcccgagcagcugagcagggccggggaacuggccaagcu

SEQ ID NO: 533504 - RNA, 64 nt, Human
agaucaguguccacaaguggccgacauggaacaugcugagcaguggcuccucugaauguucacu

SEQ ID NO: 533505 - RNA, 64 nt, Human
aagaggaucugacugagagcccacugcaguuagagcugagcacuuuugaaaagcuuguccauca

SEQ ID NO: 533506 - RNA, 64 nt, Human
agcagugaagaugcagacugauaccaccuccaccgcugagcagugaccuuccucacuuucucuu

SEQ ID NO: 533507 - RNA, 64 nt, Human
guguuuauuguagagacacuguuuuaguaaacaugcugagcauucauuuugcguccucuggguu

SEQ ID NO: 533508 - RNA, 64 nt, Human
agcucuucgcaggggcugaugcacuggguguggagcugagcagagaggccuaaccaggaucagg

SEQ ID NO: 533509 - RNA, 60 nt, Human
gggcucacgugggaaccccccucccacccaccgccacaauaaagaucgcccccaccucca

SEQ ID NO: 533510 - RNA, 60 nt, Human
aggggaggggugagacgcucgcugccgugcccgccacaccaagauguuggggcugccugg

SEQ ID NO: 533511 - RNA, 60 nt, Human
ggucugucacagucugcuccuuuuuuuuguccgccacacguaacugagaugcuccuuuaa

SEQ ID NO: 533512 - RNA, 60 nt, Human
ccacgcccagaggaggggaggcacuggcccccgccacaggacuggagacgcaagaacaaa

SEQ ID NO: 533513 - RNA, 64 nt, Human
aggggaacaggaaugcaagauuaaggaaaccgcagcugagcaggugucacaagcuguaaaggag

SEQ ID NO: 533514 - RNA, 64 nt, Human
auuaauuucuugccuccaguguucuaucucugaggcugagcauuauaagaaaaugaccucugcu

SEQ ID NO: 533515 - RNA, 64 nt, Human
acacacacauacagagcucucugagggugauggggcugagcaggaggggggcuggguaagagca

SEQ ID NO: 533516 - RNA, 64 nt, Human
guugcucauauuuaaacugaccuaaauauguuuugcugagcauaagauaaacucacuuuuaccu

SEQ ID NO: 533517 - RNA, 64 nt, Human
cugguguuuuggcuuaugcguuccuucagguugagcugagcaguguguuaugggaagcugcuca

SEQ ID NO: 533518 - RNA, 64 nt, Human
cuggaguuuuauccagcgccucgucguauguuuggcugagcaccuguggccugggugcagguua

SEQ ID NO: 533519 - RNA, 64 nt, Human
caggacugaagaugggcaaauuguaggcauuucugcugagcagaguuggagccagagaucuacu

SEQ ID NO: 533520 - RNA, 64 nt, Human
caggacugaagaugggcaaauuguaggcguuucugcugagcagaguuggagccagagaucuacu

SEQ ID NO: 533521 - RNA, 64 nt, Human
ugcagaagcacacgguacucaucaucgcgcaccggcugagcaccguggagcacgcgcaccucau

SEQ ID NO: 533522 - RNA, 64 nt, Human
ugcagacauuugguggguagaggccagggaugcugcugagcaucccgcaguguacaggacagcc

SEQ ID NO: 533523 - RNA, 64 nt, Human
guuguuucuggaagagucugugcgcccauggauggcugagcaccacuacgacuuaguccgggau

SEQ ID NO: 533524 - RNA, 64 nt, Human
caggauuauaaaaguuguaaaaugcaacuguauugcugagcaaaaaaaaaaaaaauucaaaaca

SEQ ID NO: 533525 - RNA, 64 nt, Human
ggccggggcagggacuugccuccacucaccacaagcugagcaggacagccagcagcaggauggg

SEQ ID NO: 533526 - RNA, 64 nt, Human
uuuuaaaugaaggcaaauaaguacuuaaaagugagcugagcaauaaaaugguccaauaauaggu

SEQ ID NO: 533527 - RNA, 64 nt, Human
ucaggaguccuuggggagaugaaggggguggggagcugagcaggcugggcaauuugcccucaaa

SEQ ID NO: 533528 - RNA, 60 nt, Human
cagacgccaccuggcggcccuaagccacucccgccacacgcucacuccagguucguauag

SEQ ID NO: 533529 - RNA, 60 nt, Human
uccgcccuggcacguguccuugcuggcggcccgccacaggcccccuucaauggccgcauu

SEQ ID NO: 533530 - RNA, 60 nt, Human
gcucuccagacugugcccuuaccgccuuccccgccacacccgcucugucuucccacuguc

SEQ ID NO: 533531 - RNA, 62 nt, Human
cagacuagaaauaauuacccaguaugaucauggcauccaagaccagagucucagaacucauu

SEQ ID NO: 533532 - RNA, 64 nt, Human
guacuaauucccuacuagccaguuugggacauuggcugagcacugccugacagaaagcccguau

SEQ ID NO: 533533 - RNA, 64 nt, Human
ucacuccagacagacagggggcuaaggggcuagggcugagcaccucucagagcaagccuuugac

SEQ ID NO: 533534 - RNA, 64 nt, Human
gauagaaguguuggcacgcacagccauggacccagcugagcagagcagacgcuuugcaggcugc

SEQ ID NO: 533535 - RNA, 64 nt, Human
gaccaagacuccaagugagggcggccaaguccucgcugagcagagagggagccguucaugucag

SEQ ID NO: 533536 - RNA, 64 nt, Human
agcuagaauucugguguuuauaagcagguaacuagcugagcacuaguugauaacuuuggaguua

SEQ ID NO: 533537 - RNA, 64 nt, Human
uucugcugacacuuuggcccgaaauagauccagugcugagcaagcaauguacaccagagccuca

SEQ ID NO: 533538 - RNA, 64 nt, Human
ggacggcacaggagggugcauggggcgugggggagcugagcaagggucgcucacuuagaaaugu

SEQ ID NO: 533539 - RNA, 64 nt, Human
aaaaauaaaaugcuggcuaccucuggaucaucuggcugagcaacugaauuacaaaagagaauua

SEQ ID NO: 533540 - RNA, 64 nt, Human
aucuaacaucuuuauucccuucuuuccucuuccagcugagcagaguuggauaauugaauuaguc

SEQ ID NO: 533541 - RNA, 64 nt, Human
uuugccccguuaauuaugcuugaaguuuaagaaagcugagcagaggugucucauauuucccagc

SEQ ID NO: 533542 - RNA, 64 nt, Human
aguguggcuugggccuggugcugggaaccugcuagcugagcacuuccacaagggcauaccccug

SEQ ID NO: 533543 - RNA, 64 nt, Human
uugggggaacuuguagccagaaugcccuguucaugcugagcaaaguucagcaaguagagcagag

SEQ ID NO: 533544 - RNA, 64 nt, Human
guuguaauuuaacaagucaaauaaaauaaucauugcugagcacaaucacauguugaaacaagug

SEQ ID NO: 533545 - RNA, 64 nt, Human
ccuucucuaaacauccuacagagaagguuccaaagcugagcacccaucacccuaggugugcacc

SEQ ID NO: 533546 - RNA, 64 nt, Human
ccacagugugaugucucagaagggcucugggugggcugagcaucugggcugugcccuggcucug

SEQ ID NO: 533547 - RNA, 60 nt, Human
gccacccugagaagucucacgugaucacuuccgccacagccuguuuaucaaaagcaagcc

SEQ ID NO: 533548 - RNA, 60 nt, Human
uucccaaguagcggggaucacaggcaugagccgccacacccggccaucacaccuggauuu

SEQ ID NO: 533549 - RNA, 60 nt, Human
gcagacguggcacccgagugcacacaccgaccgccacaugugcuuuucugccgggaaucc

SEQ ID NO: 533550 - RNA, 64 nt, Human
aucagagacagagcagggcuguggucucacucuagcugagcagaguauuaacuugguagcaaga

SEQ ID NO: 533551 - RNA, 64 nt, Human
ucaauggcuuuucuaacaaccucaguaguaauuugcugagcaucauccagaccauuaauagaau

SEQ ID NO: 533552 - RNA, 64 nt, Human
uggagagugaggaggaggaggagccuugguccaugcugagcauccuggaggaccuggagagcug

SEQ ID NO: 533553 - RNA, 64 nt, Human
agacuccaucucaaaacaaaacaaaacaaaauuagcugagcaugguggugugugccuguagucc

SEQ ID NO: 533554 - RNA, 64 nt, Human
ugaaguucaugcacaccucacaccaguuccuccugcugagcagcccuccugccaaggaggcucg

SEQ ID NO: 533555 - RNA, 64 nt, Human
acuggcacagagguagucucacugcuugaacuaggcugagcaaucugacccuaugggucuagga

SEQ ID NO: 533556 - RNA, 64 nt, Human
aggcccaccugcuucccagaaccuccucacuagggcugagcaccuucucugaguagagucuuca

SEQ ID NO: 533557 - RNA, 64 nt, Human
ccugccggacccccagggugggccguggcagguggcugagcaggagcucccaagugccggccac

SEQ ID NO: 533558 - RNA, 64 nt, Human
cauaccugauucaccugcacugcuuccccugugugcugagcauagagcauacaauagcgccuac

SEQ ID NO: 533559 - RNA, 64 nt, Human
cgucuguucccccaggaucucgaagugacuccgggcugagcaguggggcggcugggggaggggu

SEQ ID NO: 533560 - RNA, 64 nt, Human
ugagcucaaagccaagcagaggccggcaguggaggcugagcagggacucuccaggcuucucugc

SEQ ID NO: 533561 - RNA, 64 nt, Human
gacuccguuuacacagacaaagugacaucagaaggcugagcacuuaucuggaucauuuggucag

SEQ ID NO: 533562 - RNA, 64 nt, Human
ugaaggauccucccugagacuggcaagggaggaggcugagcagaaggagucaucauggaggagc

SEQ ID NO: 533563 - RNA, 64 nt, Human
cuaauguucuccuagaaucacugaggcaccaauggcugagcaggaagggcgaggagacaccuug

SEQ ID NO: 533564 - RNA, 64 nt, Human
gacugcuugucuugcuaggagaggaggauggggggcugagcacucaggcuguccauugaaaccc

SEQ ID NO: 533565 - RNA, 64 nt, Human
gaucucuguaauuuuauguagaguuugagcugaagccccguauauuuaauuuauuuuguuaaac

SEQ ID NO: 533566 - RNA, 63 nt, Human
cagguaccuccagguucugaucccuccaccuuggccccguaagcguggucugcucagcuucca

SEQ ID NO: 533567 - RNA, 64 nt, Human
gaugcacucaaagcacugaugugaggaaguacuugccccguagcagcuauucacucuaccagug

SEQ ID NO: 533568 - RNA, 60 nt, Human
cgccugccgcccccuguccagguucccuccccgccacagugaaauaaagcaucccacccu

SEQ ID NO: 533569 - RNA, 64 nt, Human
gguucuuacccccaggugucacacggggccgagagcugagcaagaauuuggaauggaaguuaug

SEQ ID NO: 533570 - RNA, 64 nt, Human
cugggauuuguggggaaagcugcuggugugaccagcugagcacccagccaggagaccugcagcc

SEQ ID NO: 533571 - RNA, 64 nt, Human
gggcaagccaguggcguggccucugccucuaagcgcugagcauugggccccuuccccaccagac

SEQ ID NO: 533572 - RNA, 64 nt, Human
gcaucccacccccaagaagaacugaauaaagauugcugagcaaaggaaggcuucagucuggaac

SEQ ID NO: 533573 - RNA, 64 nt, Human
uaaucuuccacucaaggaaucuugugaggugugugcugagcauggcagacaccagauaggugag

SEQ ID NO: 533574 - RNA, 57 nt, Human
uccuggcuuggcuguucugagagcuccgcugagcaucuggccuugaaguuuguguuc

SEQ ID NO: 533575 - RNA, 64 nt, Human
aagugcgaagccaugugaaggugcugcaggagaugcugagcauguaccgcaggccagggcaggc

SEQ ID NO: 533576 - RNA, 64 nt, Human
guauaugauacuugaggaaaucaggccaaguguagcugagcaauuaauaaacacucaaguuuuu

SEQ ID NO: 533577 - RNA, 64 nt, Human
caacacguagcaccuuagucuuuguuccaggagagcugagcaagcuggugaaaccacucuccuu

SEQ ID NO: 533578 - RNA, 64 nt, Human
agguacgcugcuggccagcauuggagaagaagcugcugagcauggcuuucuguagucuuuagca

SEQ ID NO: 533579 - RNA, 64 nt, Human
ccucuagagagaccagcugccuuugagaccaggagcugagcaccgagaaccaucugugagcugc

SEQ ID NO: 533580 - RNA, 64 nt, Human
cgaaggguugcucugcccgccgcgcuagcugugagcugagcaaagcccugggcucacagcaccc

SEQ ID NO: 533581 - RNA, 64 nt, Human
gaccugcauauuugucagugccaugauggaagaagcugagcaugucuuaccaaaaacagagaga

SEQ ID NO: 533582 - RNA, 64 nt, Human
uagggaagguucucucagcuuguucuugccuaaggcugagcaccuccagucucuccuugauuug

SEQ ID NO: 533583 - RNA, 64 nt, Human
gauucuuccugcuuagcuugagggugacuauggagcugagcagguguucuucauuaccucagug

SEQ ID NO: 533584 - RNA, 60 nt, Human
gcgacccacccgcggaguggggggcccccuccgccacaaggaagcacaaccagcucgccc

SEQ ID NO: 533585 - RNA, 60 nt, Human
ccaggauggggcugcccugcacaccggugcccgccacaugccaacccucaccuccccgag

SEQ ID NO: 533586 - RNA, 60 nt, Human
auauuuccauucaaaaugugguucacagacccgccacaucagcaccauccgagagcuuau

SEQ ID NO: 533587 - RNA, 60 nt, Human
cagcccagagccacuggucccuacagggcgccgccacaccagcaggaaggaggauggcug

SEQ ID NO: 533588 - RNA, 64 nt, Human
cugccuagugggcgcccucagccccuugucgugugcugagcauggcaugaggcugaaguggcaa

SEQ ID NO: 533589 - RNA, 64 nt, Human
ccccauuuccuccucaucugaucccccauagguggcugagcaucggaguggaguucguggggaa

SEQ ID NO: 533590 - RNA, 64 nt, Human
guguccacacuuucucuccgagcaugugggucucgcugagcagucauggaaugcgguagagcca

SEQ ID NO: 533591 - RNA, 64 nt, Human
guccuuuggugcccggugagcgcagccagcaggagcugagcagcgggggagaugaaucaccucc

SEQ ID NO: 533592 - RNA, 64 nt, Human
auccccgucucugcccugggcuccucuuagcucagcugagcauggagacagcaguuuccagaga

SEQ ID NO: 533593 - RNA, 64 nt, Human
ccugugcucgacagcaaagucuugacuccuuccugcugagcacugugcuaccuucacugcucca

SEQ ID NO: 533594 - RNA, 64 nt, Human
uuucuuccugcaugaucccugggcccucccgcaggcugagcaagucuguaaacugauucuggga

SEQ ID NO: 533595 - RNA, 64 nt, Human
ccaccggcggcccccacuugguggccggacaguggcugagcacguggaagccauugagggcagc

SEQ ID NO: 533596 - RNA, 64 nt, Human
aggaagaaacacugagacagggguauggggaagagcugagcaaagagagaaaggagguaguuua

SEQ ID NO: 533597 - RNA, 64 nt, Human
ggggaggguugccccucugccccucuguucuguggcugagcacuuucccaguccagggcaggga

SEQ ID NO: 533598 - RNA, 64 nt, Human
guggaccccugucugggccacccuagugugcuaagcugagcagugcagugugaacagggcccau

SEQ ID NO: 533599 - RNA, 64 nt, Human
uuauuagaaauuaguguuugcuuccaucacuuaugcugagcaaccaaauauuacaguuauguga

SEQ ID NO: 533600 - RNA, 64 nt, Human
ucccagaauuggguguuccuggguuauuuacauagcugagcaguguccaggggaggugcgcagu

SEQ ID NO: 533601 - RNA, 64 nt, Human
gagcuucuaugcuuccuuguuuccaugccaacaugcugagcaugcucacaaagaaggcucgucc

SEQ ID NO: 533602 - RNA, 64 nt, Human
cucccugcaggcccaaggcguugguaagggggcagcugagcaauggaacgcguuucccccucuc

SEQ ID NO: 533603 - RNA, 64 nt, Human
uugcccaguuccccgguuaaccacacucuguccagccccguagacgugcacgcacacugucugc

SEQ ID NO: 533604 - RNA, 61 nt, Human
aacugaacacugagaucugacugcgucaccugccccguagagaauguguguagauacuucc

SEQ ID NO: 533605 - RNA, 64 nt, Human
guugaguugcagcaacagacuguauuuuugugacgccccguaguaugaauguacaucuuguaaa

SEQ ID NO: 533606 - RNA, 64 nt, Human
uagagccucuguaaacuucuccugcccagccccagcugagcauccccagaugggcagacucccg

SEQ ID NO: 533607 - RNA, 64 nt, Human
agaggcccugagaggcccccagaucacugucucugcugagcagggaaggcucagacugggccca

SEQ ID NO: 533608 - RNA, 64 nt, Human
aggggccagucccugugucucuggugcccagcgagcugagcaccagugggugaccggggagaaa

SEQ ID NO: 533609 - RNA, 64 nt, Human
aguggggagggggggcggaaacccaugccucccagcugagcacugggaaugucagcccaguaag

SEQ ID NO: 533610 - RNA, 64 nt, Human
auauuugauccacacacguuggucuuuuaaccgugcugagcagaaaacaaaacagguuaagaag

SEQ ID NO: 533611 - RNA, 64 nt, Human
aaggggaagcgccauucccgcgggggggcggggagcugagcaccuggggccucggggcgggcuc

SEQ ID NO: 533612 - RNA, 64 nt, Human
agccacacagcugcagcaacugcagauacugcgggcugagcaggagcagugguggcgccugccc

SEQ ID NO: 533613 - RNA, 64 nt, Human
agcugugacacucauagguuacucccaggagugugcugagcagaaggcaagcucuugcuggaug

SEQ ID NO: 533614 - RNA, 64 nt, Human
ccucuccagaauggcgacuguccccauccgccuggcugagcaggagagagggagcuggcggugc

SEQ ID NO: 533615 - RNA, 64 nt, Human
ggcugaggucaauaccgcagaccuuggggaggaagcugagcaucccccgggaugucuccagucc

SEQ ID NO: 533616 - RNA, 64 nt, Human
cucacaacucacccucacuucacugaaugaggaggcugagcagcugcaguguuucuguccggag

SEQ ID NO: 533617 - RNA, 64 nt, Human
agucaucucaugacaacagaagggagguggccgggcugagcacgggagacccaccgugcagggg

SEQ ID NO: 533618 - RNA, 64 nt, Human
gccgguagccgcgugcggaggggacagagcgugagcugagcaggccacacuucaaacuacuuug

SEQ ID NO: 533619 - RNA, 64 nt, Human
cugaacgccuuguggauccgcuguguccagcccggcugagcaucgccagggcuagcucaugcug

SEQ ID NO: 533620 - RNA, 64 nt, Human
uuucugcuugccucgccucuucccccuuuugucagcugagcaguuugugguuucuaugcccgca

SEQ ID NO: 533621 - RNA, 64 nt, Human
gaaggaccugucuuggugggccgggcccucuugugccccguaggcuaggucuuagggcaacucc

SEQ ID NO: 533622 - RNA, 64 nt, Human
cauaugccuggacauccugaaggagaaguggucugccccguaugauaucaggaccauccugcuc

SEQ ID NO: 533623 - RNA, 64 nt, Human
ccuucgacauccugcuugcucccugacucccagggccccguaguuagcaauucuggaaaaguua

SEQ ID NO: 533624 - RNA, 64 nt, Human
aucgaacggacugugaauccgcucuuugucggaagcugagcaagcuguggcuuuuuuccaacuc

SEQ ID NO: 533625 - RNA, 64 nt, Human
cagguuguuuugggggaagagggggucauggauggcugagcagagagcggggaaaaugcaggcu

SEQ ID NO: 533626 - RNA, 64 nt, Human
agggagggaggcaaggcaggggaguggggccugagcugagcacugcccccucacccccccacca

SEQ ID NO: 533627 - RNA, 64 nt, Human
aaacaccacuccuuuuugugugugugcacgcauggcugagcaugugugggugggagucagcaca

SEQ ID NO: 533628 - RNA, 64 nt, Human
cuaauuccuggcagggcccccagccccuccccuggcugagcagcccuguggcugaaaugacuag

SEQ ID NO: 533629 - RNA, 64 nt, Human
aauaucuucagaggaagacugccgccauacugaggcugagcacagauuugucuuuuucauugca

SEQ ID NO: 533630 - RNA, 64 nt, Human
gucucagccccacagaguuuggaguccucagugugcugagcaaacguggagacaccauuucccu

SEQ ID NO: 533631 - RNA, 64 nt, Human
cucacagcguaaacaaagccauggggaaguuccagcugagcagagcccuccacagcucagcaaa

SEQ ID NO: 533632 - RNA, 64 nt, Human
cauucauuuuuuagcaugugucagaaauuuuaaggcugagcaauauuucauuguuugcauuuac

SEQ ID NO: 533633 - RNA, 64 nt, Human
gccugagcaucucagggagaccaggggccgagccgcugagcagguguugguccucaggagcucc

SEQ ID NO: 533634 - RNA, 64 nt, Human
gcccccagacccuucuugaaacgagagccagcaagcugagcacagaccagcagcgaccucccuu

SEQ ID NO: 533635 - RNA, 64 nt, Human
cgucucugaacccaaaacccugacggccucucuggcugagcacagggcaucuaggcccuuagug

SEQ ID NO: 533636 - RNA, 64 nt, Human
gccaucgccgccugccacgcaacgucucugccuggcugagcacauccaccaaccaccugggcga

SEQ ID NO: 533637 - RNA, 64 nt, Human
ccggaugggcgcaccugcugcucagggcaggguugcugagcaagaccaccucccuaggccuugc

SEQ ID NO: 533638 - RNA, 64 nt, Human
cuuccaucccuccuuccuucuuuccuccuacagugcugagcaaaaaguccccaauaaaugguca

SEQ ID NO: 533639 - RNA, 60 nt, Human
ugaguggccugcugccucaccucccgcaggccgccacacuuauugcaggucagugauccu

SEQ ID NO: 533640 - RNA, 60 nt, Human
accuccugggcuuccuagaggacagccuugccgccacacaguuccagcagagccaggcca

SEQ ID NO: 533641 - RNA, 60 nt, Human
ucugcccuccuucccaucccacaugcugagccgccacaaagaccaaagaagugauggcuu

SEQ ID NO: 533642 - RNA, 60 nt, Human
agcaucaggcuccugcagagccccauccccccgccacacccacacgguggagcugccucu

SEQ ID NO: 533643 - RNA, 64 nt, Human
cuuuucucccccucaccuucuaaggucagcucuagcugagcaucagugcucucuuaaggaggaa

SEQ ID NO: 533644 - RNA, 64 nt, Human
agcccugggcagugucaggcaggacucacucaccgcugagcagaugagggaaguuuuagucuug

SEQ ID NO: 533645 - RNA, 64 nt, Human
ucagaguguagugccagguccuggugccacgcuagcugagcacucaggagaguucaucagcuca

SEQ ID NO: 533646 - RNA, 64 nt, Human
auaauuuucuuccuccagcuccagccaccaccaggcugagcagugaggagagaaaguuucugcc

SEQ ID NO: 533647 - RNA, 64 nt, Human
agcugacaguaugaaaaaugaaacugcugaaaaagcugagcaccuggucacccuuggccuucca

SEQ ID NO: 533648 - RNA, 64 nt, Human
ggacguggccaggcaggaggggccggguucaggagcugagcaggggaugccugugcguggugcc

SEQ ID NO: 533649 - RNA, 64 nt, Human
aaggcuugagucuggauaauuuguauaagaugcugcugagcacaucucuucaugcgcagucccc

SEQ ID NO: 533650 - RNA, 64 nt, Human
uggaaaaguguugccugccaccacccucuguagagcugagcauuucuuuuaaauagucuucauu

SEQ ID NO: 533651 - RNA, 64 nt, Human
acaucagcacuacucuccugaggacucuucaguggcugagcagcuuuggacuuguuuguuaucc

SEQ ID NO: 533652 - RNA, 64 nt, Human
acaccagcuguucccaggaguugacauaucaguggcugagcagcuccgugcauauuuguucucu

SEQ ID NO: 533653 - RNA, 64 nt, Human
gcuucuagcucuggggucuggcuaccgcuaggaggcugagcaagccaggaagggaaggagucug

SEQ ID NO: 533654 - RNA, 64 nt, Human
ccuucacccuguggagucaccccaacucuguggggcugagcaacauuuuuacauuuauuccuuc

SEQ ID NO: 533655 - RNA, 64 nt, Human
ucuugucagagauccucuaccacagacauuaauagcugagcaggagccacauggauugauugua

SEQ ID NO: 533656 - RNA, 64 nt, Human
aauucagggaccucaccugucggaccuauagcuugcugagcaggaaccuugcacuucacacuuc

SEQ ID NO: 533657 - RNA, 64 nt, Human
auagacuauugacugacccagcuaagaaucgugggcugagcagaguuaaaccaugggacaaacc

SEQ ID NO: 533658 - RNA, 60 nt, Human
ugggaagcagucucuuccuggucugaacucccgccacauuuuagccguacuuugcuaacu

SEQ ID NO: 533659 - RNA, 60 nt, Human
caggggcuuuccacccacacugcaccauaaccgccacacccuucggggggggggagggua

SEQ ID NO: 533660 - RNA, 60 nt, Human
ccacgucccagcaucccuggagcaggagccccgccacagccuucggacagacauauggga

SEQ ID NO: 533661 - RNA, 60 nt, Human
uugcaucccagguuccucgcccaccuacccccgccacaccccgucuuuuuagagaucucu

SEQ ID NO: 533662 - RNA, 64 nt, Human
uggucacuaguagauccagguuuacuuucuaucagcugagcaaccucucaagaaaaaauaaaua

SEQ ID NO: 533663 - RNA, 64 nt, Human
cuuuaagaccaucugugguuuucagugaacaagcgcugagcaccagcagcagaaaacaacaaca

SEQ ID NO: 533664 - RNA, 64 nt, Human
acacaucucugauacuuuuuucauuauugguugggcugagcagucagaagaccuggucgucguc

SEQ ID NO: 533665 - RNA, 64 nt, Human
agucagcgagugcuugggauccgcauccagccgugcugagcacacaacaggcuguguguggaaa

SEQ ID NO: 533666 - RNA, 64 nt, Human
cuuguggaagcuccccucauccguggugcagcaggcugagcacugcgcguuugccacgugcugc

SEQ ID NO: 533667 - RNA, 64 nt, Human
cagcugugccgugggcagggcaugcgcuccccuggcugagcaccccagagauucuccugcaccu

SEQ ID NO: 533668 - RNA, 64 nt, Human
uuugaugugguucccauguucucuaacagggccagcugagcagcacaggccaggaggccacagu

SEQ ID NO: 533669 - RNA, 64 nt, Human
ccaccagcugggccucagcccucacggcauuccugcugagcaccguggggcacccagggagcag

SEQ ID NO: 533670 - RNA, 64 nt, Human
caagggugcuggggccccauggccuucagcccuggcugagcaacugggcuguagggcagggcca

SEQ ID NO: 533671 - RNA, 64 nt, Human
aggucucaguccuggcaccaugcacaugucugaggcugagcaagggcugagaggagaggcuugg

SEQ ID NO: 533672 - RNA, 64 nt, Human
ggaggcaaaacuucuggcccagaaggccgcagaggcugagcaggaaaugcagcgcaucaaggcc

SEQ ID NO: 533673 - RNA, 64 nt, Human
uuucuccucuucucuucuugggacaggaauaacugcugagcagucccccuuugccacuccuggc

SEQ ID NO: 533674 - RNA, 64 nt, Human
ggaugaguaguuccuguucucagggaggucauccgcugagcaucccuucugcacagaugucucu

SEQ ID NO: 533675 - RNA, 64 nt, Human
ggaacugaguguuagggacuuuggcauuuccauagcugagcacagcaggggagggguuaaugca

SEQ ID NO: 533676 - RNA, 64 nt, Human
caaauagggucccaggguccagggaggggcgccugcugagcacuuccgccccucacccugccca

SEQ ID NO: 533677 - RNA, 60 nt, Human
uucaagcaugugaauaaucuuccaucuuccccgccacacauacacacacacacuuuuugu

SEQ ID NO: 533678 - RNA, 60 nt, Human
cuuccccccaacguccuucgacagugcccuccgccacagacuuugcccggccucaucugc

SEQ ID NO: 533679 - RNA, 60 nt, Human
cugccgagugccugcgauuacaggcgcgcgccgccacaccugacugguuuucguauuuuu

SEQ ID NO: 533680 - RNA, 60 nt, Human
caggccuuuguuaggaaaacccaugggccgccgccacacucagugccauggggaagcggg

SEQ ID NO: 533681 - RNA, 64 nt, Human
uggagggcccuacuccacacccuagagcugugaugcugagcaaggugccuguggcggaaggaac

SEQ ID NO: 533682 - RNA, 64 nt, Human
gcagccuuuccuguugucacauggguucagagcagcugagcagggaacacguccuaggcagguc

SEQ ID NO: 533683 - RNA, 64 nt, Human
ggggagcaggaugagaccuuuggauagaacagaagcugagcaagagaacauguugguuuggaua

SEQ ID NO: 533684 - RNA, 64 nt, Human
uggaccuggacagacagucagcuccacaccuugcgcugagcagcugugauugugccacgggagc

SEQ ID NO: 533685 - RNA, 64 nt, Human
caggcaccugucugcaucccucuggccagugcaugcugagcacgugaccuacccguguugggac

SEQ ID NO: 533686 - RNA, 64 nt, Human
uguauggagcgacccugugagaagcacuuggcuggcugagcaaauucauccucuggaaauauuc

SEQ ID NO: 533687 - RNA, 64 nt, Human
cuccagcccagcucuccacuuguuccuugugugagcugagcaggcagugcaccucugagugucc

SEQ ID NO: 533688 - RNA, 64 nt, Human
cucgacagcuuccaaugucagccugcuggcuuuggcugagcagagcuugaaggccauucugucu

SEQ ID NO: 533689 - RNA, 64 nt, Human
caguccacuccacucugggcugggcugugaugaagcugagcagaguggaaacuuccauagggag

SEQ ID NO: 533690 - RNA, 64 nt, Human
gcggcuugccugccugcucgcucccugcagaggggcugagcaggacgccgcuggugcuggccgc

SEQ ID NO: 533691 - RNA, 64 nt, Human
ggagcugaguguuagugacuuuggcauuucuguagcugagcacagcaggggagggguuaaugca

SEQ ID NO: 533692 - RNA, 64 nt, Human
auggaacucaguguuaggaacuuuggcaucuguagcugagcacagcaggggagggguuacucaa

SEQ ID NO: 533693 - RNA, 64 nt, Human
ggaacugaguguuagugacuuuggcauuuguguagcugagcacagcaagggagggguuaaugca

SEQ ID NO: 533694 - RNA, 64 nt, Human
gagguuuggagggcacuguugcugggcugaccuggcugagcaggcaaaaggugggugcagacug

SEQ ID NO: 533695 - RNA, 64 nt, Human
uagaguucacaggagagccaaaaaagaaaaggaagcugagcaucucccgaguccugggcaggga

SEQ ID NO: 533696 - RNA, 60 nt, Human
ggugccccauagucacagaacaccuggacaccgccacaugcagucaucaucauguuacuu

SEQ ID NO: 533697 - RNA, 60 nt, Human
auaccagcaugccgacacuggcugguguggccgccacagagaguguuaccaccagcaccc

SEQ ID NO: 533698 - RNA, 60 nt, Human
uaaaaaaauaaaaaggaaaggaagcguucaccgccacaaaucauaaaauggacaugacug

SEQ ID NO: 533699 - RNA, 60 nt, Human
agccucccaaguagcugggacuacaggcacccgccacagugccuggcuaauuuuuuguau

SEQ ID NO: 533700 - RNA, 64 nt, Human
ccucuacuuccaugugcgcagccccacagacguugcugagcaacucgccagccuccugagcucc

SEQ ID NO: 533701 - RNA, 64 nt, Human
agccuggccugcccgugcccuggugaaucaccuggcugagcaguuccccuggagccccuucggg

SEQ ID NO: 533702 - RNA, 64 nt, Human
accucacccacgcccaguuccagaaaggccuccagcugagcagacggccccgaucccgccagaa

SEQ ID NO: 533703 - RNA, 64 nt, Human
gagagcugcucaacccgcuggugcugaacucugugcugagcaaggcccugcagugcagccugca

SEQ ID NO: 533704 - RNA, 64 nt, Human
cgcccggccggcccuaacuuauuuuggcgucacagcugagcaccgugccgggagguggccaagg

SEQ ID NO: 533705 - RNA, 64 nt, Human
cuugacuugcuaccaacaacugcugugcaauucugcugagcaggaauaucaugagcuguucaau

SEQ ID NO: 533706 - RNA, 60 nt, Human
ugcucccgcgucuccuguaggccccaaggcgcugagcagccccgggaaacugucgccguc

SEQ ID NO: 533707 - RNA, 64 nt, Human
aaggccauggggaacuuugugcaaguaccucaucgcugagcaaauggagcuugcuauguuuuaa

SEQ ID NO: 533708 - RNA, 64 nt, Human
agagcccugggcaaccccaaaccuaguccugguagcugagcacccuguaaggcaggagcaggca

SEQ ID NO: 533709 - RNA, 64 nt, Human
guggguccugcccagaguccagagagcagccucagcugagcacagguccgagggggcgggggca

SEQ ID NO: 533710 - RNA, 64 nt, Human
aaucuuuuguauuugcucacaguguuugagcagugcugagcacaaagcagacacucaauaaaug

SEQ ID NO: 533711 - RNA, 64 nt, Human
ccucaagaaauuaaacauuuguuucugugugacugcugagcauccugaaauaccaagagcagau

SEQ ID NO: 533712 - RNA, 64 nt, Human
ucaucauucuagaccugauaaccacugagaaccugcugagcaaggacggcuuuuaccaacauua

SEQ ID NO: 533713 - RNA, 64 nt, Human
uucuaggagaacuuuuuugguguguguuggaauggcugagcaaauauuaaaauuguuaauaugc

SEQ ID NO: 533714 - RNA, 64 nt, Human
uccggugaacaaugcagucaggccuguuauaaccgcugagcagccacacucgcaccuccugggu

SEQ ID NO: 533715 - RNA, 60 nt, Human
ugucccaaugccacuugcuuccuuuccaagccgucgaacagacugugggauuugcagagu

SEQ ID NO: 533716 - RNA, 60 nt, Human
agagagggagcccuguauucuuggcuguacccgucgaauggaguuuugaucucgcugagu

SEQ ID NO: 533717 - RNA, 60 nt, Human
ucuugagcucaggcaguccucccaacuuggccgucgaaagugcugggauuauaggcauga

SEQ ID NO: 533718 - RNA, 60 nt, Human
cauuggcagaaccauaagguacugcagaagccgucgaaaccgacugcucggcuggauuag

SEQ ID NO: 533719 - RNA, 64 nt, Human; identical to SEQ ID NO: 473464

SEQ ID NO: 533720 - RNA, 64 nt, Human; identical to SEQ ID NO: 473465

SEQ ID NO: 533721 - RNA, 64 nt, Human; identical to SEQ ID NO: 473466

SEQ ID NO: 533722 - RNA, 64 nt, Human; identical to SEQ ID NO: 473467

SEQ ID NO: 533723 - RNA, 64 nt, Human; identical to SEQ ID NO: 473468

SEQ ID NO: 533724 - RNA, 64 nt, Human; identical to SEQ ID NO: 473469

SEQ ID NO: 533725 - RNA, 64 nt, Human; identical to SEQ ID NO: 473470

SEQ ID NO: 533726 - RNA, 64 nt, Human; identical to SEQ ID NO: 473471

SEQ ID NO: 533727 - RNA, 64 nt, Human; identical to SEQ ID NO: 473472

SEQ ID NO: 533728 - RNA, 64 nt, Human
cuagaugcauguggaagcaaugagaguugucccuuagccuuauaaacuccccaugaucugacau

SEQ ID NO: 533729 - RNA, 64 nt, Human
augacugccugugcagagacacaguuugcaccauuagccuuaccugcccugcccugauugugag

SEQ ID NO: 533730 - RNA, 64 nt, Human
guagugccaggaccaggccaaugaugcuucucaguagccuuaucauucacaggugccucucuag

SEQ ID NO: 533731 - RNA, 64 nt, Human
acauaaccccucccccuccgccccgccccgcccggccccguagagucccugucgcccgccggcc

SEQ ID NO: 533732 - RNA, 64 nt, Human
ccccgggcggccgaaggccgggccgccccgucccgccccguaguugcucuuucgguaguggcga

SEQ ID NO: 533733 - RNA, 64 nt, Human
gcccaagagcguccugcggucucgcuggcacagcgccccguacacuaggggguccuacagcuac

SEQ ID NO: 533734 - RNA, 64 nt, Human
aaaagucaaaaaaauucaaaaaaggggaugauacuagccuuaacauguaccugucaauguuaug

SEQ ID NO: 533735 - RNA, 64 nt, Human
uuggcucuccacugagcaccuuaucuugccaccuuagccuuaagaaugaauaugaagaaaaaua

SEQ ID NO: 533736 - RNA, 64 nt, Human
caauucaaucuucugaacggcauaaguccuauuuuagccuuaccuccugcauuugcaauacgua

SEQ ID NO: 533737 - RNA, 64 nt, Human
ugaaguuuuucucacuaaaauauggggcaauuguuagccuuacauguuguguagacuuacuuua

SEQ ID NO: 533738 - RNA, 64 nt, Human
gaauuaauugccuuguuuauguacagauuuucuguagccuuaaaggaaaaaaaaauaaagaucg

SEQ ID NO: 533739 - RNA, 64 nt, Human
cagaccagccagagggagagccaauggccucugguagccuuaagcccaaagggcagugggaaug

SEQ ID NO: 533740 - RNA, 64 nt, Human
uguguuuucugguuuaaaagcugcacuuauauuuuagccuuauuauuuucuguaguuccggaga

SEQ ID NO: 533741 - RNA, 64 nt, Human
cauagaauugcucuggucaaaaccaagcacaccauagccuuaacugaauauuuaggaaaucugc

SEQ ID NO: 533742 - RNA, 64 nt, Human
auagcuuauuuuaguuaaucuuuuuuuugucuuuuagccuuaccaccuuuuaaaaaauuuguua

SEQ ID NO: 533743 - RNA, 64 nt, Human
ucuggucuuaucagccaugcuaaaucacuuuaauuagccuuagugauucuaugguugaguaauc

SEQ ID NO: 533744 - RNA, 64 nt, Human
agacuggcaacuguuuuguagcaagagccauagguagccuuacuacuugggccucuuucuaguu

SEQ ID NO: 533745 - RNA, 64 nt, Human
uuccgaaaaauccucuuccucugaggcuggauccuagccuuauccucugaucuccauggcuucc

SEQ ID NO: 533746 - RNA, 64 nt, Human
gaggaaauaaggcuaacagagguugaccuaaaauuagccuuacaaaggagaaaggaccacauug

SEQ ID NO: 533747 - RNA, 64 nt, Human
aguucaucagcaccugcagaugccugacucuuguuagccuuacuauucaauacaguccuuagau

SEQ ID NO: 533748 - RNA, 60 nt, Human
aaaauaagauuuaguuguguuuucucagagccgccacaagauugaacaaaauguuuucug

SEQ ID NO: 533749 - RNA, 60 nt, Human
ugugccacuccagagacuucugccaccuggccgccacacugaaaacuguccugcucagug

SEQ ID NO: 533750 - RNA, 60 nt, Human
agugcaguacaucguuuguaccugaaacugccgccacaugcacuccuccaccgcugagag

SEQ ID NO: 533751 - RNA, 64 nt, Human
agcaggcacaagaacuguccaugaagaugggaaauagccuuaaggcugaugcaguuuacuuaca

SEQ ID NO: 533752 - RNA, 64 nt, Human
ggcuacuggcauuaauuauuaauaccaaauauuuuagccuuaaauuuuugucauuuuaaaaucu

SEQ ID NO: 533753 - RNA, 64 nt, Human
aaauauuguaugauuaauugauuuaaauaaugcuuagccuuaauuuuagauaauguaaauuuag

SEQ ID NO: 533754 - RNA, 64 nt, Human
uaugguugugcauauggaugugaagugaaaauauuagccuuaacuuuaaaauuuggguguuuga

SEQ ID NO: 533755 - RNA, 64 nt, Human
ucgaagccacaccuggucuguuuucugugcacuguagccuuagugucaccuuucuucuuguguc

SEQ ID NO: 533756 - RNA, 64 nt, Human
uccggaccugagacugaguuuugucuuuuuccuuuagccuuagcaguggguaugaggugugcag

SEQ ID NO: 533757 - RNA, 64 nt, Human
auuaaaugagcucuuuugcagauagcacauucaguagccuuauuuuguugauggaauacuguau

SEQ ID NO: 533758 - RNA, 64 nt, Human
aauuuuauugguaggauuuauaucuaaguuugguuagccuuaguuucucagacuuguugucuau

SEQ ID NO: 533759 - RNA, 64 nt, Human
gcucucacaaguucagcaucaccugcuuugaaauuagccuuagauugccaaccaauagaugaga

SEQ ID NO: 533760 - RNA, 64 nt, Human
agauuucucuacauaaaucuagauacucauuaaguagccuuaugacaaacaguaugagauacuu

SEQ ID NO: 533761 - RNA, 64 nt, Human
ugcuguauucuaccacuugcacuuacucaucuucuagccuuaugaccaggaaccuuuguuuugg

SEQ ID NO: 533762 - RNA, 64 nt, Human
ugacgugugacuuggauuugaguggaguugggcuuagccuuagucucauucaaucuccauuauu

SEQ ID NO: 533763 - RNA, 64 nt, Human
guguguuuugaaguugaaugugcgauaaaauuauuagccuuaagauugguaagcuagcaaugaa

SEQ ID NO: 533764 - RNA, 64 nt, Human
ccccuucuucauugcucucuccagaaaggguugcuagccuuaacuucagcuggugcaaaacauc

SEQ ID NO: 533765 - RNA, 60 nt, Human
ggggcaagggccccagcagcccuauggugaccgccacacugugccuuaaugucugccggg

SEQ ID NO: 533766 - RNA, 60 nt, Human
cgccccuccuccuucucucuuggcgaggccccgccacaccgcgcucuuccucccgggacu

SEQ ID NO: 533767 - RNA, 50 nt, Human
acaaagacgagagcgaguagccgccacaggccggggccgcgcccgcgccc

SEQ ID NO: 533768 - RNA, 64 nt, Human
uaaaaugaccuuaaagauaaaaaugauuagggaauagccuuagaaaauuuauagguauaaaaaa

SEQ ID NO: 533769 - RNA, 64 nt, Human
caguguugaccauuuaugcugcauagcuguauuauagccuuauuaguugugugguugacccuug

SEQ ID NO: 533770 - RNA, 64 nt, Human
cugaucagagcuuaccagccccaccccaccaugguagccuuagggugcugagugccugauacug

SEQ ID NO: 533771 - RNA, 64 nt, Human
uaaaguaacugaagauccacaaaagaaguaaaaauagccuuaacugaugacauuccaccauugu

SEQ ID NO: 533772 - RNA, 64 nt, Human
aauuggaagaacaaaaaguuuuagauuagagucauagccuuaauagcccuaguugucauccugg

SEQ ID NO: 533773 - RNA, 64 nt, Human
uguuuuguuuuguuuuguucagauuaacugcuuauagccuuagaaagccuuuuacaaaauuaaa

SEQ ID NO: 533774 - RNA, 64 nt, Human
agaaaaguaggucauucuuggaucuacuuuuuuuuagccuuauuaauauuuuucccuauuagaa

SEQ ID NO: 533775 - RNA, 64 nt, Human
uuuaggguccagaaggaauuguggacugaaucacuagccuuaggucuuucagcaaacagccuau

SEQ ID NO: 533776 - RNA, 64 nt, Human
gguuuggcaggccaucuuuuuuuguacuuaaaaguagccuuaagaacaauaauaaagugcucuu

SEQ ID NO: 533777 - RNA, 64 nt, Human
uugaacaggggaauguggccucaagugcacagacuagccuuagucaucuccaguugaggcuggg

SEQ ID NO: 533778 - RNA, 64 nt, Human
uuuauguaaaaggaaaaucuuguauggcaucgaauagccuuaaugaguuuaauucuuucacaaa

SEQ ID NO: 533779 - RNA, 64 nt, Human
uucauaagaaccucaaaauaauggugauacauucuagccuuaagacauuugaauugccgguugu

SEQ ID NO: 533780 - RNA, 64 nt, Human
aacacaaaaacuuuuaaagaauuaaaccaaggcuuagccuuaagcagcucaguggaaggaugag

SEQ ID NO: 533781 - RNA, 64 nt, Human
auaccauguagaauugugcaauagucuagccagcuagccuuaacaucuaagaaauuuuuccaac

SEQ ID NO: 533782 - RNA, 60 nt, Human
uuacaaacagaaaagcucgaggcucccaccccgccacaucccaacuucauuucccccuca

SEQ ID NO: 533783 - RNA, 60 nt, Human
agagacuucguggaucacagcugcagcucaccgccacaucacaggauccguuaacguuaa

SEQ ID NO: 533784 - RNA, 60 nt, Human
auuaccuuccugcgaagaaaggugacauccccgccacagacacggaggccccgccugcug

SEQ ID NO: 533785 - RNA, 64 nt, Human
uguuaccuaagacguaucacagaauaaacacauuuagccuuauagacauugccaaauugcucuu

SEQ ID NO: 533786 - RNA, 64 nt, Human
uauauuccuguuuauuuuucuauguucuguuuuguagccuuaagaaguguuucaaacauaucug

SEQ ID NO: 533787 - RNA, 64 nt, Human
agagcuagaaaauuuuauguaugaaaaacgauaauagccuuacacugaguacaaauaauacuuu

SEQ ID NO: 533788 - RNA, 64 nt, Human
uguuuacaucuauacauuuugaagaugaaauuuuuagccuuaaaguuuauauucucaaguccuu

SEQ ID NO: 533789 - RNA, 64 nt, Human
cuguuggacauguacugaaaauuaacacauguaguagccuuaaaauuuuagacuucucgaacau

SEQ ID NO: 533790 - RNA, 64 nt, Human
aucacuuaauucaccacacucucacuuccuuuauuagccuuauacaucucaaacucuucucuua

SEQ ID NO: 533791 - RNA, 64 nt, Human
caugggaguguacuuguggaaagguguguuugcguagccuuagggaaggaaggcaauugcuccu

SEQ ID NO: 533792 - RNA, 64 nt, Human
ugacaugugcaauugugagggacaugcucaccucuagccuuaaggggggcagggagugaugauu

SEQ ID NO: 533793 - RNA, 64 nt, Human
cucuuguaagugauaugauaaauaaaccccuaauuagccuuagaagaaaaaccacugcaagaua

SEQ ID NO: 533794 - RNA, 64 nt, Human
uguauauacauccuagcuacugauaucuuuauuauagccuuaagacuuaauuuuaagucuuaaa

SEQ ID NO: 533795 - RNA, 64 nt, Human
gggcuaagggcaaaaggggugggagguguggaacuagccuuaaugaguuucccauuccugaacc

SEQ ID NO: 533796 - RNA, 64 nt, Human
uuguuuuugugucaucccuacuuugaacugcuguuagccuuacauucucacuauaguccauaau

SEQ ID NO: 533797 - RNA, 64 nt, Human
aggagaugguuuucauugcauagugacauuuucuuagccuuaacguucugauaguagcuuacua

SEQ ID NO: 533798 - RNA, 64 nt, Human
ugcauuuuccaacuugaaaacaauaauugaaaaauagccuuauuguauauuuuaugccaugacu

SEQ ID NO: 533799 - RNA, 60 nt, Human
ggcugacauucugagccccccucggaggccccgccacagccaaccugcccagucuuuccu

SEQ ID NO: 533800 - RNA, 60 nt, Human
gccucgcugcagugagagcaugggacaaguccgccacagcccucccccgcccccuucccc

SEQ ID NO: 533801 - RNA, 60 nt, Human
cgccuuugaaauggcuuugcuaaaaugcucccgccacaaaguuguaggaaaugggaagag

SEQ ID NO: 533802 - RNA, 64 nt, Human
gacaagcaggagcguggcugcucgcucagugccauagccuuaccgcagccugcgcgggaggcca

SEQ ID NO: 533803 - RNA, 64 nt, Human
gguguugcuuugcuugaacuguucaagccuuuuauagccuuaccauaaguauuuagauauggug

SEQ ID NO: 533804 - RNA, 64 nt, Human
ccaccacgugacgcuguucuuaguucacuaauguuagccuuauuuaggacaaagucagccagac

SEQ ID NO: 533805 - RNA, 64 nt, Human
gucuuucacaccauucauauguuaaguggcagaauagccuuagugcuaccuccacuuuuuucuc

SEQ ID NO: 533806 - RNA, 64 nt, Human
gauauugcuacuauuuuauagauuuccuggugcuuagccuuauaaaaaagguuguaaaauguac

SEQ ID NO: 533807 - RNA, 64 nt, Human
ucuucaauucaagagaugcuucauaaaacacuuauagccuuaaaccauucaagggcuaauuaaa

SEQ ID NO: 533808 - RNA, 64 nt, Human
agaauguuuuauuauaguccuuuguguuaaaauuuagccuuacuaauuauaacaauaacucaua

SEQ ID NO: 533809 - RNA, 64 nt, Human
uauuuuaagagguauuucaguuuuaaaugcaaaauagccuuauuuucauuuaguuuguuagcac

SEQ ID NO: 533810 - RNA, 64 nt, Human
guuucuaugcuguuucuuagcacagaauccagccuagccuuagccgcagucuaggcccugcuug

SEQ ID NO: 533811 - RNA, 64 nt, Human
ccuuaagaugugcacuccaucuuuaagaacguguuagccuuaacuuugagguucuauauaguca

SEQ ID NO: 533812 - RNA, 64 nt, Human
augaacacuuagaaauucagggauauugggucuuuagccuuaugaauuugagcugcuuauuuaa

SEQ ID NO: 533813 - RNA, 64 nt, Human
gauaaggcuuuaggaugccucagugcuuaugucauagccuuaugaguuagcuuucuugcuagcc

SEQ ID NO: 533814 - RNA, 64 nt, Human
cagagguguuuaaaauaccuaugagauaccaauguagccuuaacauaugucaaaaugcauugcu

SEQ ID NO: 533815 - RNA, 64 nt, Human
ccagcucuguuagugggagagaucgcuggcaccauagccuuauggccaacagguggucuguggu

SEQ ID NO: 533816 - RNA, 60 nt, Human
ucacucaucucagaauguccccaccaauccccgccacagcaggcgccucgggucccagau

SEQ ID NO: 533817 - RNA, 60 nt, Human
cugcugaguagcugguauacaggcacaucgccgccacacccagcucauuuuuguauuagu

SEQ ID NO: 533818 - RNA, 60 nt, Human
ugccccagagcugccuccugccuggcacugccgccacacuccccuccugggauggggcuu

SEQ ID NO: 533819 - RNA, 64 nt, Human
ggcugguaaagcaacacccacccacuucucacacuagccuuaagaggccuccacucagcaguaa

SEQ ID NO: 533820 - RNA, 64 nt, Human
uaagcuucucaucccugcauagaugcaguauucuuagccuuaguagaaaaaccugguuuagugg

SEQ ID NO: 533821 - RNA, 64 nt, Human
caucugauaccuuguucagauuucaaaauaguuguagccuuauccugguuuuacagaugugaaa

SEQ ID NO: 533822 - RNA, 64 nt, Human
uacauauaaauguguauauaugugaauaaaccuauagccuuaacuuacuuauuuuauauggaau

SEQ ID NO: 533823 - RNA, 64 nt, Human
aguauggauuaguucagggaugaacugcucccucuagccuuacuggcucugauccacaggguuu

SEQ ID NO: 533824 - RNA, 64 nt, Human
cggccuuuucuaaacaucgacuucuacuacucucuagccuuaaaauaccuucugcuuagaucca

SEQ ID NO: 533825 - RNA, 64 nt, Human
aaaugcaccaaauaggaucauaugaauugcugucuagccuuagucaauaaacuuguaggacuuu

SEQ ID NO: 533826 - RNA, 64 nt, Human
auaacugguuuuggguaccugaauuuugauugguuagccuuaauuauagucuggcgugaucaug

SEQ ID NO: 533827 - RNA, 64 nt, Human
agggucaggggaaauguaaucuggaauuaaauauuagccuuaaaauucacaauuuugauuuucc

SEQ ID NO: 533828 - RNA, 64 nt, Human
aaguauugauuggcauaugguaauagagcaaccauagccuuaacuuacagaccugugaaauaaa

SEQ ID NO: 533829 - RNA, 64 nt, Human
uuacuguaugaaccacaaaacagcacuauuuauuuagccuuacuucuacuuccagaugcagugc

SEQ ID NO: 533830 - RNA, 64 nt, Human
cuuaauuauaaguaaauauaaucccaguagcauuuagccuuaaucucaagaguucaaaauguuu

SEQ ID NO: 533831 - RNA, 64 nt, Human
ggguagaauuuggucucaccaacaagugaggauauagccuuaucucauggaggacgagcuccgu

SEQ ID NO: 533832 - RNA, 64 nt, Human
ugacaagcauaauuuacuuggacaacuucguagguagccuuaacuucuggccaaguuuguuuuu

SEQ ID NO: 533833 - RNA, 60 nt, Human
uacacagaaccaccgccaccaccaccaacaccgccacaccaacaccaccacuacaaaaaa

SEQ ID NO: 533834 - RNA, 60 nt, Human
agucugaggcgauggcuccugguccccuguccgccacacaggccguggucauccacacaa

SEQ ID NO: 533835 - RNA, 60 nt, Human
uuucccccucacccuaacucucuuauucugccgccacaaugcaagcauaguuugauguuu

SEQ ID NO: 533836 - RNA, 64 nt, Human
aaucaguagcaaugcaaaaauauucugauuacuuuagccuuauggauauuaugcuuugaaguca

SEQ ID NO: 533837 - RNA, 64 nt, Human
uauuuucucaauauguuaacuuggaaaaaaauuuuagccuuaucuuaaucugucccaacagcaa

SEQ ID NO: 533838 - RNA, 64 nt, Human
aagugcuaggauuacuggcgugagccaccacuccuagccuuaaugcauauucuuaaauauacaa

SEQ ID NO: 533839 - RNA, 64 nt, Human
aguugcauguuuuagauaaaaaauuguuuaauuuuagccuuaauuguauacaaauuuuuguccu

SEQ ID NO: 533840 - RNA, 64 nt, Human
uagaucaugucucaauggaaacacucuucuuucuuagccuuacuugaaucuugccuauaauaaa

SEQ ID NO: 533841 - RNA, 64 nt, Human
guaccuuugggaauuuaggcuggagagacguccauagccuuagguauaucauuuauaccagaca

SEQ ID NO: 533842 - RNA, 64 nt, Human
uuuuuuuuucuuuuugaaaccaaauguuaaacuauagccuuaagaaaugcuugguagaaguguc

SEQ ID NO: 533843 - RNA, 64 nt, Human
uuuuguaguuucuucccucuuugugacuauuccuuagccuuauagauuucuaguacugcccagg

SEQ ID NO: 533844 - RNA, 64 nt, Human
aaauuugauggaaauggacacuugaguagugacuuagccuuauguacucuguuggaauuugugc

SEQ ID NO: 533845 - RNA, 64 nt, Human
uguccuuucuggccucuggcuagucaguuuuucauagccuuacaguaucuggcuuuguacugag

SEQ ID NO: 533846 - RNA, 64 nt, Human
accaaaaacuauucuguuguuuuucuucaccuacuagccuuaguuuuuaaccaaguauccaagg

SEQ ID NO: 533847 - RNA, 64 nt, Human
uccagccuccuucuugguugucauagugauaggguagccuuauugcccccucuucuuauacccu

SEQ ID NO: 533848 - RNA, 64 nt, Human
cacuuacugaucuacugugaauauaaaauguuauuagccuuaucaaauaaauaaaugagcacag

SEQ ID NO: 533849 - RNA, 64 nt, Human
uaccuuucuagccuuagacaaaugaucaccauguuagccuuagacgaagaagcuggcuaguccu

SEQ ID NO: 533850 - RNA, 60 nt, Human
caggccccuggaaaugcuaccuacguguugccgccacaggcuccugcucucuggccaagc

SEQ ID NO: 533851 - RNA, 60 nt, Human
auggucacguuuuuuaggcuggacagcgucccgccacagcuacuaccugacacugagcuc

SEQ ID NO: 533852 - RNA, 59 nt, Human
acgacgcccagacggaguaaccccagcccccgccacaccaccccuugccaaagucaucu

SEQ ID NO: 533853 - RNA, 64 nt, Human
ucucuccucaguuuacaucuuguugguaccuuucuagccuuagacaaaugaucaccauguuagc

SEQ ID NO: 533854 - RNA, 64 nt, Human
uacaauuuuuggccauccugaggcauuuacuaaguagccuuaauuuguauuuuaguaguauuuu

SEQ ID NO: 533855 - RNA, 64 nt, Human
aguguauuugaucagaaguggccauuuggauuaguagccuuagcaaugcuacaggguuauaggc

SEQ ID NO: 533856 - RNA, 64 nt, Human
agugaaauauuuauuuuuugaauaaaggagauaauagccuuaaacuggaugcuuaucauguuuu

SEQ ID NO: 533857 - RNA, 64 nt, Human
agauaauuuaucucacagaagcaccgggaagacuuagccuuaaagagccuacaguguccuuuug

SEQ ID NO: 533858 - RNA, 64 nt, Human
uuuauagagauggaggaaaaggucuaauacuacauagccuuaaguguuucugucauuguucaag

SEQ ID NO: 533859 - RNA, 64 nt, Human
ccuuccuguccccaggggagguguauuguguauguagccuuagagcaucucugccuccaaccca

SEQ ID NO: 533860 - RNA, 64 nt, Human
aacuuucuuuguguguuccugauggaauucaccauagccuuacagcuuuucucagaagguaacu

SEQ ID NO: 533861 - RNA, 64 nt, Human
aauuaagauacacaaauggccauggauguugccuuagccuuaaacauuacuaauaguuucacau

SEQ ID NO: 533862 - RNA, 64 nt, Human
agcuauuuggggcccacaaaaauaacuauuauuuuagccuuagagccuuacacuuguuucauga

SEQ ID NO: 533863 - RNA, 64 nt, Human
auaaaguagcuuuauauuaacuacaggauaauauuagccuuauuacccccacaagauuuuuuaa

SEQ ID NO: 533864 - RNA, 64 nt, Human
guuuagguuuucaauuauuuuugguaagaguauguagccuuaugaucuggauauauuuugcauu

SEQ ID NO: 533865 - RNA, 64 nt, Human
gguuugggaaggaaggaauguaauauuauggauuuagccuuaggcuuuaaguuuuaggcuggca

SEQ ID NO: 533866 - RNA, 64 nt, Human
cgcucuugcucuugguaaaauauagaguggucaguagccuuaugcaccuaauucaaaaggugga

SEQ ID NO: 533867 - RNA, 64 nt, Human
cugcucagauggccugagccucccgaggcuugcugccccguaggaggagacugucuucccgugg

SEQ ID NO: 533868 - RNA, 64 nt, Human
gcgauccucuugggcucuccuaggauccccccaugccccguaagagguggaagacgcuuccuuc

SEQ ID NO: 533869 - RNA, 60 nt, Human
gcaccuucugggucacguaggggggccggggccccguaugccccuccucgugaaaggccu

SEQ ID NO: 533870 - RNA, 64 nt, Human
acuuaagaggucauguugcuuuagguuuaauaaauagccuuaacuauuuggaggggaaaaaaug

SEQ ID NO: 533871 - RNA, 64 nt, Human
aagagggaagcaacugugaugggaagagauuaccuagccuuacuaacaagaagcauucuaauag

SEQ ID NO: 533872 - RNA, 64 nt, Human
cuggcauuucuauuucuagaaauaauauuugacauagccuuaaugguccuuaaagaagacauuu

SEQ ID NO: 533873 - RNA, 64 nt, Human
uagacagcacaagaaggggugagagugcgucuccuagccuuaaugugggaggguaguuucaguc

SEQ ID NO: 533874 - RNA, 64 nt, Human
ggauuguuaagugcugccuuaguugcuaguuuaguagccuuacugugaaggaauaauuaagauu

SEQ ID NO: 533875 - RNA, 64 nt, Human
agauuuuacugucuauggauuugggguguuacaguagccuuauucaccuuuuuaauaaaaauac

SEQ ID NO: 533876 - RNA, 64 nt, Human
aauucuuuugcaaugcauuugcaacagaauuuuguagccuuaagggguaggaagaaaaaccuga

SEQ ID NO: 533877 - RNA, 64 nt, Human
uuugugaauguguggaaaauauaaagcagggauuuagccuuaauaaagguaaccuucugacauc

SEQ ID NO: 533878 - RNA, 64 nt, Human
aucauuaaaagcaaggcucaagggacauguuuucuagccuuaguuccccaucuacaaaaugggc

SEQ ID NO: 533879 - RNA, 64 nt, Human
gcuugucuggaacuccugggcucaagggaucuuguagccuuagccuccuaaagugcugggauua

SEQ ID NO: 533880 - RNA, 64 nt, Human
auaaauacaaagggaaaacaaaaagcuacaaaaguagccuuacaaaaaaaaaaaaauuguuuag

SEQ ID NO: 533881 - RNA, 64 nt, Human
agcauaucagacgccuugguucuguuuguacacuuagccuuacauuucaggaggaggcuuuuca

SEQ ID NO: 533882 - RNA, 64 nt, Human
acuuuaaacagcucaaaguagcuagcuaaaggaguagccuuaaauaccuaaaagaugacagaag

SEQ ID NO: 533883 - RNA, 64 nt, Human
aaguuuuaauugaacuaguagcuuugugcuauaauagccuuaacaaauggacccuugcagggcu

SEQ ID NO: 533884 - RNA, 60 nt, Human
aaagcaagcacaacuaaaccuucuuaauauccgccacagaaggcucaagaauccagcccu

SEQ ID NO: 533885 - RNA, 60 nt, Human
cacagacacacaaucacacgcagccccuccccgccacagagacacaccauuacauacaca

SEQ ID NO: 533886 - RNA, 60 nt, Human
cacagacacaaaaucacacacacacccuccccgccacagagacacaccauuacauacaca

SEQ ID NO: 533887 - RNA, 64 nt, Human
auguccguccuuugucauauauuguaacuuuuuuuagccuuauuugucauuuaacauaguuugu

SEQ ID NO: 533888 - RNA, 64 nt, Human
augacugcagcuuuuuuucaugcuauggcuucacuagccuuaguuuaauaaacugaauguuugg

SEQ ID NO: 533889 - RNA, 64 nt, Human
ugacguuauccaauugcaggucaacuuauaguuguagccuuacaacuuacaggcaucagaaaau

SEQ ID NO: 533890 - RNA, 64 nt, Human
aggaggggauagagagagaccacuuuucauaaccuagccuuagaagucacacaguauuacuucu

SEQ ID NO: 533891 - RNA, 64 nt, Human
gccugaaguuacugaagauccacagaagugaaaauagccuuaacugaugacauugcaccauugu

SEQ ID NO: 533892 - RNA, 64 nt, Human
ugagcauuagaccagccacagugccugauugguauagccuuaugugcuuuccuacaaaauggaa

SEQ ID NO: 533893 - RNA, 64 nt, Human
agccagaguucuggacccauguuuggagcauuuguagccuuauucucuugcgugugaaucucuu

SEQ ID NO: 533894 - RNA, 64 nt, Human
auuuaaauccuuugauaguggauugugcugcuguuagccuuaguuucagugcuuuacaagucuc

SEQ ID NO: 533895 - RNA, 64 nt, Human
agggccaguguuacaguguuacccuguaagguguuagccuuaaaccaccgagcagcguucucuu

SEQ ID NO: 533896 - RNA, 64 nt, Human
uuugggcccagaaccaucuuucuauuguuuguguuagccuuacccugucccugccccaccuugg

SEQ ID NO: 533897 - RNA, 64 nt, Human
guauaauucaucuagaguguaauuucuuuuauauuagccuuaaaaaccaaaaaugcuggguuca

SEQ ID NO: 533898 - RNA, 64 nt, Human
aucugucguuuuugauauucagguuuccucaauuuagccuuagugaaggagggguuguacacac

SEQ ID NO: 533899 - RNA, 64 nt, Human
uacccuagcuuuugauggguucucuuaccuguaguagccuuaucccuggucauuuggauuuuca

SEQ ID NO: 533900 - RNA, 64 nt, Human
uuaauccugugacucuuuuaaagauaauauuuuauagccuuaauaugccuuauaucagaggugg

SEQ ID NO: 533901 - RNA, 60 nt, Human
cacagacacaaaaucacacacacacccuccccgccacagagacaccauuacauacacaga

SEQ ID NO: 533902 - RNA, 60 nt, Human
agcugccccuuugcccccagcucagucaagccgccacaugcccacaaccucaccagaggg

SEQ ID NO: 533903 - RNA, 60 nt, Human
guuacgccuuaggaaggggacaaccaggccccgccacacgcucacacacaaaccugcuca

SEQ ID NO: 533904 - RNA, 64 nt, Human
auucuguauagaauucuugccgccaucccaggucuagccuuaggagcaaauguaguagauaguc

SEQ ID NO: 533905 - RNA, 64 nt, Human
acaguccuugacauguguucugugugugucuguauagccuuaagaaaaagaauggcuucacuuu

SEQ ID NO: 533906 - RNA, 64 nt, Human
gcgggcagugugggaaauccuuuagccgaaaaucuagccuuauuauacaucugagaguucacac

SEQ ID NO: 533907 - RNA, 64 nt, Human
ugagagaauaauguaaugaauguaggaaaaucuuuagccuuaucugucauuaucucccuuucuc

SEQ ID NO: 533908 - RNA, 64 nt, Human
uauauuaauuuauauucaaaaggaauccugcaaguagccuuaauaacguuaguuucaguaagua

SEQ ID NO: 533909 - RNA, 64 nt, Human
gcaggaggaucgcuugagcucaggaguucgagacuagccuuagcaacacagugagacacaauug

SEQ ID NO: 533910 - RNA, 64 nt, Human
gggaauggauccuggaggaugcccaauuagggccuagccuuaaucagguccucagagaauuucu

SEQ ID NO: 533911 - RNA, 64 nt, Human
cagacacaccauuucaccucccuugccaagcuguuagccuuagagugauugcagugaacacugu

SEQ ID NO: 533912 - RNA, 64 nt, Human
agaagaggaagaagugagaagauucgccagauuuuagccuuauauguaauuccuucacauuugg

SEQ ID NO: 533913 - RNA, 64 nt, Human
auuuguguguucuaaugaguaacaucuacuuaguuagccuuagggauggaaaaacagggccacu

SEQ ID NO: 533914 - RNA, 64 nt, Human
aagauucaugaaauucggggccagggaaacaguuuagccuuagggaagggaaaacacuaaguga

SEQ ID NO: 533915 - RNA, 64 nt, Human
agggaagaagcuuguuauauuccaguuguaagaauagccuuaguguuuagauuuuuuuaugaua

SEQ ID NO: 533916 - RNA, 64 nt, Human
uccccacgaccccagaaugaaacagcuuuaaaaauagccuuaagcaaaaggauguuauuucauu

SEQ ID NO: 533917 - RNA, 64 nt, Human
aagcagacuauaauucucagcucucuuuucuucuuagccuuaaauuaauauucucuuucuucua

SEQ ID NO: 533918 - RNA, 64 nt, Human
ugcaggacaguucaugguaauguugcccucugaggccccguacaccagaagggaggcccuggaa

SEQ ID NO: 533919 - RNA, 64 nt, Human
cccacugacccagccguaccuauucguccacggugccccguagcagcagguccugcggccaaau

SEQ ID NO: 533920 - RNA, 64 nt, Human
caggagugggggaaaugaggugcaccccaggaaggccccguagaccuccgaagacuccacaaga

SEQ ID NO: 533921 - RNA, 64 nt, Human
uuacaucuuuauuuucagcaaugaaacugaaauuuagccuuacucccaaguuauaaaugcuggc

SEQ ID NO: 533922 - RNA, 64 nt, Human
gaagagcccccuccagaccacucuacagcugcucuagccuuaguugccacuaggaaguuuucug

SEQ ID NO: 533923 - RNA, 64 nt, Human
acaugaucacacucucaaucugucacgugcccccuagccuuacugggaaccuucugucccccaa

SEQ ID NO: 533924 - RNA, 64 nt, Human
guugucuuacacuucucaaaugcuacucaguauauagccuuaagucuuacuguuuugugcggug

SEQ ID NO: 533925 - RNA, 64 nt, Human
cugaauauuauuaccagccuagagucuugaaugauagccuuaccgaauucuucuugugagguau

SEQ ID NO: 533926 - RNA, 64 nt, Human
auuuucacuugugccaaagaggguaagcguuuauuagccuuaucuuuauuggccagggaaaacu

SEQ ID NO: 533927 - RNA, 64 nt, Human
ugugaacuucagauugaaccauucauugcagcaguagccuuaaaaaggcuuuuguuuauuucuu

SEQ ID NO: 533928 - RNA, 64 nt, Human
aaauaagcacccagcacccauccuggcugccggugccccguacccuguauuuauucuuuuaaca

SEQ ID NO: 533929 - RNA, 64 nt, Human
ugcggcucccacgcggggcugggccucggaguuugccccguaaagcgaauugcacuuugauguu

SEQ ID NO: 533930 - RNA, 64 nt, Human
uugcucuucagagagagugguuggagccccccccgccccguaugcuuacauuauugcucuuuua

SEQ ID NO: 533931 - RNA, 64 nt, Human
cuccuuugcccaauaagggggguggcugccuggagccccguagccagcgcuuuccacgguuucu

SEQ ID NO: 533932 - RNA, 64 nt, Human
guauacaacuaguauuuaagauaccauuuaauaugccccguaaaugucuucaguguucuucagg

SEQ ID NO: 533933 - RNA, 64 nt, Human
gacaaaaaguuuuguacuuuucacauagcuuguugccccguaaaaggguuaacagcacaauuuu

SEQ ID NO: 533934 - RNA, 64 nt, Human
agagggcagggagcucgccuggggagagggcugugccccguagggacagugcccaggugaagga

SEQ ID NO: 533935 - RNA, 64 nt, Human
cuccacuugcuccagcugacaggcaccucuccaggccccguagaugggcaaggacuugauaacc

SEQ ID NO: 533936 - RNA, 64 nt, Human
cccaugguacuguaugcuauuaacuccuggaaacgccccguaaaugcgaguuguuuuuguauuu

SEQ ID NO: 533937 - RNA, 62 nt, Human
ucaugccacugcugccaccaccucuuccuggggcauccaaaggccagcuggccucaucuaau

SEQ ID NO: 533938 - RNA, 62 nt, Human
ugugccuaaugcucugucucuuggucacugaagcauccaaauaaagaauuucccucaugggc

SEQ ID NO: 533939 - RNA, 62 nt, Human
caacuuggaaaggaaacaaagagugcuuuugggcauccaacaguuaaucacuuauguuuuua

SEQ ID NO: 533940 - RNA, 62 nt, Human
cauggguccggcaaaacgugccucacccuccagcauccaacccaaggagcauacccauggug

SEQ ID NO: 533941 - RNA, 62 nt, Human
uguugcccugacagugcauggaaaggacguuggcauccaauuggcacuccuucucccuuauu

SEQ ID NO: 533942 - RNA, 62 nt, Human
agacugguuuaaaguaacaugccagaacuuacgcauccaauguggguugucacuuguuauuc

SEQ ID NO: 533943 - RNA, 62 nt, Human
acucucagcugccuaucuucugccuuucacuugcauccaacuccuggggcugggaccguagu

SEQ ID NO: 533944 - RNA, 62 nt, Human
uggugguuaugaguuucagaaaucuauacuuggcauccaacucaugaguggauuuuauauag

SEQ ID NO: 533945 - RNA, 62 nt, Human
ucaaaauaacuccauggugcacaggagcaccugcauccaagagcaugcuuacauuuuacugu

SEQ ID NO: 533946 - RNA, 62 nt, Human
aauagggaacacguagauuugacccugguucugcauccaacuagcuguuucuugaaagagcc

SEQ ID NO: 533947 - RNA, 62 nt, Human
cuuuugcuugccuccccaggaaagaaggaauugcauccaagguauacauacauauucaucga

SEQ ID NO: 533948 - RNA, 62 nt, Human
ccaaauucugucuccugcauacacuccggcaugcauccaacaccaauggcuuucuagaugag

SEQ ID NO: 533949 - RNA, 62 nt, Human
gagauucaagaaaaauuucuauucuuuuuuuugcauccaauugugccugaacuuuuaaaaua

SEQ ID NO: 533950 - RNA, 62 nt, Human
accaucgagcuacuucccauaauaaccacuuugcauccaacacucuucacccaccucccaua

SEQ ID NO: 533951 - RNA, 62 nt, Human
agggucagagugcccagcguuuaucagaggcagcauccaagcccagagccagugucgacucu

SEQ ID NO: 533952 - RNA, 62 nt, Human
caagaccagugcuuagcaaaaaauaaugacaggcauccaaggaagggauguauuuguagugu

SEQ ID NO: 533953 - RNA, 62 nt, Human
aagucacugacauucuuuagaguggguugggugcauccaaaaauguauaaaaauauuauuau

SEQ ID NO: 533954 - RNA, 62 nt, Human
acuucaggaucaaguccuaguuguucagcauggcauccaagacucuuuaugaucuggcccuu

SEQ ID NO: 533955 - RNA, 62 nt, Human
uaauacacuuccuguaaacaaauggggacaaugcauccaaaaaaucuuuuuaaacagauuac

SEQ ID NO: 533956 - RNA, 62 nt, Human
cagccaggugccgaguggauugagugccaggugcauccaagacuuucccucccuuccagaag

SEQ ID NO: 533957 - RNA, 62 nt, Human
gaaauagggcauggcuugccccuguggcccuggcauccaaauggcugcuuuugucucccuua

SEQ ID NO: 533958 - RNA, 62 nt, Human
uggcuggauccaaccaucucuucugaaauaaugcauccaaaggguugauauucugggggagg

SEQ ID NO: 533959 - RNA, 62 nt, Human
uuuuuauauugcaucaaacuuggaacaucaaggcauccaaaacacuaagaauucuaucauca

SEQ ID NO: 533960 - RNA, 62 nt, Human
gauauuguauauguaaugaugacauaguugaugcauccaauccuaaaacuuacauuccaaag

SEQ ID NO: 533961 - RNA, 62 nt, Human
caguccuuaaugucaccaugcuuguggccaaugcauccaaauaaggauaccccucagggcuc

SEQ ID NO: 533962 - RNA, 62 nt, Human
ugaaaaacgcugugagugugcaccacgcauuggcauccaaggccacggacuaugagaagaaa

SEQ ID NO: 533963 - RNA, 62 nt, Human
ccuggcugggcucuggugggggcuccugauccgcauccaagcuuaaccaaggcuccaauaaa

SEQ ID NO: 533964 - RNA, 62 nt, Human
auaucucuuaaccuccaucggccuuaguuuuugcauccaaaaagaagugauugggcuggucu

SEQ ID NO: 533965 - RNA, 62 nt, Human
guugaagacaccagacugaaguaaacagcugugcauccaauuuauuauaguuuuguaaguaa

SEQ ID NO: 533966 - RNA, 62 nt, Human
uuaaagaguacugagucacaacauguuuuagagcauccaaguaccauauaauccaacuauca

SEQ ID NO: 533967 - RNA, 62 nt, Human
accaugcacgugugcagccccaccuaauuccugcauccaaggcagguguuguuaaucuauca

SEQ ID NO: 533968 - RNA, 62 nt, Human
agcaacauuaggcuagaggggucuuguucaaagcauccaacucugacuucggaggcauuccc

SEQ ID NO: 533969 - RNA, 62 nt, Human
agacuuuguacacacugucaccaggguuauuugcauccaagggagcuggaauugaguaccua

SEQ ID NO: 533970 - RNA, 62 nt, Human
uggccacaucuuuggaaggggaugguggccuugcauccaagaugccugaaaaucagcacgug

SEQ ID NO: 533971 - RNA, 62 nt, Human
ccuaggccaggaaccaucaggggggccagccggcauccaauuccugcggauaaguagcguug

SEQ ID NO: 533972 - RNA, 62 nt, Human
acagagaccagcaagguucugccaggccucgagcauccaagcaugauuuugcugugacaaau

SEQ ID NO: 533973 - RNA, 62 nt, Human
ucuauuggaggauggcuguuccccuggugguugcauccaaguaucugucuuucuuuauggac

SEQ ID NO: 533974 - RNA, 62 nt, Human
ucaaaucuucccauucacucaauaucccauaagcauccaaacuccauuaaggagaguuguuc

SEQ ID NO: 533975 - RNA, 62 nt, Human
cugcuuuccuuguaucuuuuaaacucaguucugcauccaacuugagaagaaaaaaagcuucu

SEQ ID NO: 533976 - RNA, 62 nt, Human
cucguguacugugccugaagcugaaguuggaggcauccaaaauaaggcggggcacagugugg

SEQ ID NO: 533977 - RNA, 62 nt, Human
caggccggggccaagagugagcugcuaacacggcauccaagaauggcccagcugguaggauc

SEQ ID NO: 533978 - RNA, 62 nt, Human
gcaucugacucaggccacaccauggaaucacugcauccaaggccauuccugcccucucugag

SEQ ID NO: 533979 - RNA, 62 nt, Human
agggccucagggugcacacaggauggcaggaggcauccaaaggcuccugagacacaugggug

SEQ ID NO: 533980 - RNA, 62 nt, Human
cucuuuggccagggguguucagaugucauccagcauccaaguguggcauggccugcuguaua

SEQ ID NO: 533981 - RNA, 62 nt, Human
gaugguagaccuuuauuggguaucaagacauagcauccaaguggcauaauucaggggcugac

SEQ ID NO: 533982 - RNA, 62 nt, Human
ccauuuauaacugccuauugccuguucuauuagcauccaaaaauguggaaggccucccaacc

SEQ ID NO: 533983 - RNA, 62 nt, Human
cucccuggcaugugccaguuauagacuguccagcauccaagacguuucgguuaugucggguc

SEQ ID NO: 533984 - RNA, 62 nt, Human
uggcugcuggcuggcccaagcagagagcugaggcauccaagaaauguuccauuggggggugg

SEQ ID NO: 533985 - RNA, 62 nt, Human
gagcaaagaaaugaauuugaugaggaaauuaagcauccaauggaggauuggucuugaagacc

SEQ ID NO: 533986 - RNA, 62 nt, Human
cauccauugacugacccccuccuccagcaauagcauccaaggggccuggaaguuauguuguu

SEQ ID NO: 533987 - RNA, 62 nt, Human
ccugcaggacugguugggucuggggaucuauggcauccaagacagugacacucucauccucu

SEQ ID NO: 533988 - RNA, 62 nt, Human
gauuaaaagcuacucuggaccuacaguguccggcauccaaaaaaacuaauguguuaugcaaa

SEQ ID NO: 533989 - RNA, 61 nt, Human
ggaaugcucuguccgcauaaugucugcacgugcauccaaacgcugugcucugucgcccuca

SEQ ID NO: 533990 - RNA, 62 nt, Human
gcccccagccugagccuuuuuuuuuuucuaaugcauccaagguuaaggggaagacgcaaaua

SEQ ID NO: 533991 - RNA, 62 nt, Human
gcugauaaugaacuuuauuggagcauugaucugcauccaaggccuucucaggcuggcuugag

SEQ ID NO: 533992 - RNA, 62 nt, Human
ggaaaccugccaggggcagccgauguucagaggcauccaaaaaaagucucccacuucggcag

SEQ ID NO: 533993 - RNA, 62 nt, Human
ucuaguucaaugccucacgagauuugccaggggcauccaaggcaaacaaucccaaucuuucu

SEQ ID NO: 533994 - RNA, 62 nt, Human
uuuuaaaaaaagaaaaugaaaaacaaccaagcgcauccaaucucaaggaaucuuuaagcaga

SEQ ID NO: 533995 - RNA, 62 nt, Human
uaaaaaaggaauuggccauuagacguuccugagcauccaagaugaacauuuuguagugcaaa

SEQ ID NO: 533996 - RNA, 62 nt, Human
uguaguauuacauauacuaaguuacagaggaugcauccaaguagagaaaauaauaugugggu

SEQ ID NO: 533997 - RNA, 62 nt, Human
uauuaaaauauauauagauaauuuuuuaauaagcauccaagucuguuuacuuuaagaaaacc

SEQ ID NO: 533998 - RNA, 62 nt, Human
ccaguucauggccucccaggggugcuggggaugcauccaaagugguugucugagacagaguu

SEQ ID NO: 533999 - RNA, 62 nt, Human
uggcauuugcacaaacacggcaacacuggguggcauccaagucuuggaaaaccgugugaagc

SEQ ID NO: 534000 - RNA, 62 nt, Human
cugagaauggagaaggagaagcuacaaagugggcauccaagccggguucuggcugcagaagu

SEQ ID NO: 534001 - RNA, 62 nt, Human
uuugaacccagacaaucugacuucaugauuuugcauccaauucgugucugugccuuuuaaag

SEQ ID NO: 534002 - RNA, 62 nt, Human
uuucgguagcuuugaaagcuuguuuggggaaagcauccaaauuuaaagggcugguacauagg

SEQ ID NO: 534003 - RNA, 62 nt, Human
ucagacauccaccagaaucaacucagccucaggcauccaaagccacaccacagucgguggug

SEQ ID NO: 534004 - RNA, 62 nt, Human
gcucugagaggcagcacacacagaauaacccugcauccaaauuccaggaagcucuuaggggu

SEQ ID NO: 534005 - RNA, 62 nt, Human
uugaaaauguuuauuggcucaggauagcuucggcauccaaucugcgaaggccccugauggag

SEQ ID NO: 534006 - RNA, 62 nt, Human
gucacuuagggcagcuucuccaacuuuaacaugcauccaagucaccugggaauguuguuaaa

SEQ ID NO: 534007 - RNA, 62 nt, Human
ccuuugcuccaccccacucacagagacacagggcauccaacugagaaaacgaaacugcucua

SEQ ID NO: 534008 - RNA, 62 nt, Human
cugcagcagcgguggccucuuuucagaucauggcauccaagagugcgccgagucugucucug

SEQ ID NO: 534009 - RNA, 62 nt, Human
uccaaaagcccuuuucuggugggugacccagugcauccaacagaaacagccgcugcccgaac

SEQ ID NO: 534010 - RNA, 62 nt, Human
aucaggcacgcugacacccuuaucagcaucuggcauccaaagcaacaucagagagagagaac

SEQ ID NO: 534011 - RNA, 62 nt, Human
gcccaaggaauauccuggagugguccccagaagcauccaagaaaagauauuuggggacguag

SEQ ID NO: 534012 - RNA, 62 nt, Human
uugugaggggcugaggcgacugucccauggaggcauccaaggcuuucugugccaagaauccc

SEQ ID NO: 534013 - RNA, 62 nt, Human
ccacccugagcaaggaacuccugcaauucacggcauccaagauuccuuacagccuccggcgg

SEQ ID NO: 534014 - RNA, 62 nt, Human
acaaaugugccauauuggcuuguagcuggcaugcauccaaguccauagguccugccucuuca

SEQ ID NO: 534015 - RNA, 62 nt, Human
ugggaccaccaagcucuaggucauccaucucugcauccaaauaguagggaaacguggagaua

SEQ ID NO: 534016 - RNA, 62 nt, Human
cucccccaacagcagggaugggucagguggcagcauccaaaaccacggugaagauacuaggg

SEQ ID NO: 534017 - RNA, 62 nt, Human
cuccuagaagacaggcgggacuucccaguggugcauccaaaggggagcuggaagccuugccu

SEQ ID NO: 534018 - RNA, 62 nt, Human
ugugguuuaagucuuugcagucaaguacugaugcauccaagccaggcccaugccuggugucu

SEQ ID NO: 534019 - RNA, 62 nt, Human
uccaggccccuccaagccuggggaaggacguggcauccaagcugagccagagggaacugcug

SEQ ID NO: 534020 - RNA, 62 nt, Human
cucuggaucucagcugugguuccuuucuaggagcauccaacaggagucagcaaucaaagaug

SEQ ID NO: 534021 - RNA, 62 nt, Human
gcauauggcuuuugaucaguuuuucaguggcagcauccaaugaacaagauccuacaagcugu

SEQ ID NO: 534022 - RNA, 62 nt, Human
gcuuuaucaaagacauguuugaaaaauaaaaagcauccaagugagagcuggugagaccacgu

SEQ ID NO: 534023 - RNA, 62 nt, Human
cccuucgaagcuggggagugcuuguugcagaugcauccaagagggguaauugcguaucaaca

SEQ ID NO: 534024 - RNA, 62 nt, Human
caccacaaauguuacccucauuggcuugaaaagcauccaagggugcacagggaguauggcca

SEQ ID NO: 534025 - RNA, 62 nt, Human
cugugacaggcaguguucuuggggguggggcugcauccaaggcuuuguaaaccggcuggacc

SEQ ID NO: 534026 - RNA, 62 nt, Human
auucaucaggguaggaagucuuaaauccuuaggcauccaagaaguauacuagcuuuuugcuu

SEQ ID NO: 534027 - RNA, 62 nt, Human
guaacagccuagaaaauuaaaaggagguggaugcauccaaagcacgagucacuuaaaauauc

SEQ ID NO: 534028 - RNA, 62 nt, Human
auauacgagacacaaaauaaaguuuguuugaagcauccaaaauaacuagauauugcagauuu

SEQ ID NO: 534029 - RNA, 62 nt, Human
uuuauguuuacagucucagcaacaacacuuaugcauccaaacacucacaaaugaaaccugaa

SEQ ID NO: 534030 - RNA, 62 nt, Human
guuccuuuuaauggaugguugaauuaacuucagcauccaaguuuaugaaucguaguuaacgu

SEQ ID NO: 534031 - RNA, 62 nt, Human
ucuugggugcacgaccuguacagccaaacacagcauccaauaugaauacccauccccugacc

SEQ ID NO: 534032 - RNA, 62 nt, Human
guuccuuuuaacggaugguugaaugaacuucagcauccaaguuuaugaaugacaguagucac

SEQ ID NO: 534033 - RNA, 62 nt, Human
guuccuuuuaacaaaugguuggaugaacuucagcauccaaguuuaugaaugacaguagucac

SEQ ID NO: 534034 - RNA, 62 nt, Human
uuuuuuuuuaagggaugguugaaugaacuucagcauccaaguuuaugaaugacagcagucac

SEQ ID NO: 534035 - RNA, 62 nt, Human
gacaaggauaaguuauagagcaguuggaggaagcauccaaagauugcaacccagggcaaaug

SEQ ID NO: 534036 - RNA, 62 nt, Human
ccugcauuucuuugguggggggccaggagggugcauccaauuuaacuuaacucuuaccuauu

SEQ ID NO: 534037 - RNA, 62 nt, Human; identical to SEQ ID NO: 534027

SEQ ID NO: 534038 - RNA, 63 nt, Human
gggggcgcggggagugaccaggcgggggccucaccgccccagggccguugccugcucagaccu

SEQ ID NO: 534039 - RNA, 63 nt, Human
aucugaagacccgcaacggaguggggguggcggccgccccacccuccccacccggggaagcca

SEQ ID NO: 534040 - RNA, 63 nt, Human
ccuguccgcagccucgcagcuccguggggcccuccgccccagccccagccagccaggcccugg

SEQ ID NO: 534041 - RNA, 63 nt, Human
cgggacagggugagcggagagacagaacuguccccgccccaccccgccacccauuccuagggu

SEQ ID NO: 534042 - RNA, 63 nt, Human
aacagcugcagaccugcugcucuaugcucacccccgccccauucugggccaaugugauuuuau

SEQ ID NO: 534043 - RNA, 63 nt, Human
gcgaaucucucucaucugagcccacuggaggcgccgccccacccggcccacuggcagacacag

SEQ ID NO: 534044 - RNA, 63 nt, Human
aacccuggagccaucccuucggagccaacaagaccgccccagggcuauagcagaaagaacuuu

SEQ ID NO: 534045 - RNA, 63 nt, Human
cgccgccgcaccccuguccagcuguugagcugcccgccccaccugcucaagucuaaguccgag

SEQ ID NO: 534046 - RNA, 63 nt, Human
gaccccagagggagaggcccaccccgcccagccccgccccagccccugcucaggucugaguau

SEQ ID NO: 534047 - RNA, 63 nt, Human
caagugcucuuaucgccucuguguguggaucgcccgccccagcccggggccgcucaggucugc

SEQ ID NO: 534048 - RNA, 63 nt, Human
cugagugccucucccuucccuuucccuguccccccgccccacgccugccagcaaagccucgcu

SEQ ID NO: 534049 - RNA, 63 nt, Human
aaucggggcuuucugagcugccccuucaccaccccgccccaaggaauaaggaagguucuuuua

SEQ ID NO: 534050 - RNA, 63 nt, Human
cccaaaccgugucauuaaaagcagauccugcgcccgccccauccacaggcacagcccggcaga

SEQ ID NO: 534051 - RNA, 63 nt, Human
gacguguuuuugguuuguccccccaaaccccgcccgccccacuacagguuauggaaagaauca

SEQ ID NO: 534052 - RNA, 63 nt, Human
guugggaauccgccucuuuacccgcccccacucccgccccacacgcgcccugguggcuccuug

SEQ ID NO: 534053 - RNA, 63 nt, Human
agugcugggauuacaggcgugagccaccaugccccgccccagauggauuuuacauuugcucuu

SEQ ID NO: 534054 - RNA, 63 nt, Human
uacucugugcagugcugaccacagcuagagccaccgccccauugcucaaccaguauuuauuuc

SEQ ID NO: 534055 - RNA, 63 nt, Human
gucgcccaacacuucccagggugcugcugccacccgccccagccagccaccugcuccugacag

SEQ ID NO: 534056 - RNA, 63 nt, Human
acgccugccggccagagccucccggcguuucuuccgccccagcggagugcgcuggggcgcgcc

SEQ ID NO: 534057 - RNA, 63 nt, Human
ccucaccacccaacagugaugaugcauggaggaccgccccacccuggaaugccaaugucagca

SEQ ID NO: 534058 - RNA, 63 nt, Human
acuugagcugaaaacccagaugguguuaacuggccgccccacuuuccggcauaacuuuuuaga

SEQ ID NO: 534059 - RNA, 63 nt, Human
cagcaucugcguuguuagcagucaguaccacccccgccccacaaugacagucaaggcugacuu

SEQ ID NO: 534060 - RNA, 63 nt, Human
ucauccuaugcacccucccaaagggagcuauccccgccccacagagcucaggguggcagaucu

SEQ ID NO: 534061 - RNA, 63 nt, Human
ccgcuagggauacccaggggccgcgcccaucccccgccccagccccugacacacacucggacc

SEQ ID NO: 534062 - RNA, 63 nt, Human
agaccacgugacuuucaacaaugggggguugaaccgccccaauuauuuguccaaacuguuggg

SEQ ID NO: 534063 - RNA, 63 nt, Human
uucagcaaugaggccugaccuuuuuugcuauaaccgccccaccacuccccugcccuugccaac

SEQ ID NO: 534064 - RNA, 63 nt, Human
agagauacauguugccucaccagcccugaggcuccgccccagcccucagccccaggccccagc

SEQ ID NO: 534065 - RNA, 63 nt, Human
ccaagguccgucccaugacauaacacuccacacccgccccagccaacuucaugggucacuuuu

SEQ ID NO: 534066 - RNA, 63 nt, Human
acucggccccauggggugugccagucuugcaguccgccccagcugaguagcgugagccagaug

SEQ ID NO: 534067 - RNA, 63 nt, Human
cgaccgcuuuccccuaccucccggcccccgcucccgccccagcacuuuuggcucuguugcgcg

SEQ ID NO: 534068 - RNA, 63 nt, Human
ggcagcgggggccaucaccuguggccucugagaccgccccauuuacaggaaucugcacugggu

SEQ ID NO: 534069 - RNA, 63 nt, Human
gggcuggcaagccacuuccggggaaaacuccuuccgccccagguuucuucuucucuuaaggag

SEQ ID NO: 534070 - RNA, 63 nt, Human
cacccacugcccaagacucagccauagaagaugccgccccaccuucuacuuggguagcugggc

SEQ ID NO: 534071 - RNA, 63 nt, Human
uucacagucucccagagccgaucguccucucccccgccccaccccgugcuucagccuugcagg

SEQ ID NO: 534072 - RNA, 63 nt, Human
aggcagguucugccccccagaccccacacacggccgccccacgugcugucgcucagcccgagg

SEQ ID NO: 534073 - RNA, 63 nt, Human
auaccgagacccaccauccuuccauccugaggaccgccccaacccucggagccccccacucag

SEQ ID NO: 534074 - RNA, 63 nt, Human
cuaagaauauaugaguggaucauuuaccgccccccgccccacaacaucuauaaggggcaaaaa

SEQ ID NO: 534075 - RNA, 63 nt, Human
agaccccuggcagaacccagccucugcucacacccgccccagcuucugccacggcuucaguca

SEQ ID NO: 534076 - RNA, 63 nt, Human
cgcacaauccgagcccccgccccgcgccccgucccgccccaggcccgggccugacaagaaagc

SEQ ID NO: 534077 - RNA, 63 nt, Human
cuacaguuguuccuaucucucccccgccccccaccgccccaccacacacauauuuuuaaaguu

SEQ ID NO: 534078 - RNA, 63 nt, Human
ccagcauucuccuguggcccucuaguccaccccccgccccaccccagccccuggcaaccacug

SEQ ID NO: 534079 - RNA, 63 nt, Human
gccuaaacuuguuccugccucccucaccccaccccgccccacccccagcccuggcccuuggcu

SEQ ID NO: 534080 - RNA, 63 nt, Human
ucuucaagagcugagaaacauuauuagcacuucccgccccagggcacuacauaauugcuguuc

SEQ ID NO: 534081 - RNA, 63 nt, Human
acuccugccugacugccaagccaccugcaucccccgccccagaucucaugagaucaaucacuu

SEQ ID NO: 534082 - RNA, 63 nt, Human
ucuagggccccgccgcgcgccccuccgccccgcccgccccacuaucuuuaaggagaccagaga

SEQ ID NO: 534083 - RNA, 63 nt, Human
cguucuccucgcaguggcccuggcucccaccucccgccccagccugccguggggcccgucagc

SEQ ID NO: 534084 - RNA, 63 nt, Human
cuagaugccaggggcacuguucuccccagccccccgccccaguugugacaauagucucuaaac

SEQ ID NO: 534085 - RNA, 63 nt, Human
ccaucaccugaaacacuggaccuggggguagccccgccccagcccucagucacccccacuucc

SEQ ID NO: 534086 - RNA, 63 nt, Human
aguaaccagagcugacaaucuaacuccccuccaccgccccauuuuggccuccccugccccccu

SEQ ID NO: 534087 - RNA, 63 nt, Human
ucagcuccccuuccuugcccgccucuccccccgccgccccaccaguuaaacggaugaccaaag

SEQ ID NO: 534088 - RNA, 63 nt, Human
cuccacccguccucccucagccuccccuucuucccgccccaccucccauuucuguugcuggag

SEQ ID NO: 534089 - RNA, 63 nt, Human
agaauuacagcccugucacaugugcccagcacuccgccccaugccuugcuaaauguagacuaa

SEQ ID NO: 534090 - RNA, 63 nt, Human
gacaagccacaaggaccaauguagguauucuccccgccccaucuucaaggcucagcgacugag

SEQ ID NO: 534091 - RNA, 63 nt, Human
gcaauuguucccucuggagggguccaggugcccccgccccacaaggccgcggagccucagcag

SEQ ID NO: 534092 - RNA, 63 nt, Human
aagugcuggcaggccacugugcaugcagacagcccgccccaaagaaaaaucagaggaggagaa

SEQ ID NO: 534093 - RNA, 63 nt, Human
gcaaaaggaggggaagagacaaucuccagccacccgccccacgcuugacuucuuaucacuuug

SEQ ID NO: 534094 - RNA, 63 nt, Human
uuggucccuaaaaccccgccuccucuauaagcaccgccccagcucugacaaaaccccgccucc

SEQ ID NO: 534095 - RNA, 63 nt, Human
gaaaaauaaugcauuuaucuucccccccaccccccgccccauggaauauuuaaucuauuuaau

SEQ ID NO: 534096 - RNA, 63 nt, Human
ggguucugcccuguggaguauggccgugaguccccgccccagcaaagacuuccaugcggagcu

SEQ ID NO: 534097 - RNA, 63 nt, Human
uuuuagcuguauuuuucagguacuguguggugaccgccccacuggugucuauuacaggccacu

SEQ ID NO: 534098 - RNA, 63 nt, Human
cacgcacaucaugcuuuuccagcucaucacaccccgccccacuaugggccuaccauuaauagu

SEQ ID NO: 534099 - RNA, 63 nt, Human
cucuggauguuucaagccaaggcucggcuauucccgccccauaguaaauuuccuuuucccugg

SEQ ID NO: 534100 - RNA, 63 nt, Human
cagggaguugugagcagauuagacccuccaagaccgccccagggguuggcccaugcuuucccu

SEQ ID NO: 534101 - RNA, 63 nt, Human
gccauuagaagaaggcucccauuuucugauguuccgccccacugugaagagugugcucguuuu

SEQ ID NO: 534102 - RNA, 63 nt, Human
ccuguggcccacagagcugccccagcagacgcuccgccccacccggugauggagccccggggg

SEQ ID NO: 534103 - RNA, 63 nt, Human
uuaaugugugcuggccaugauauugccccaaauccgccccacugaaguguucccuaaggaaca

SEQ ID NO: 534104 - RNA, 63 nt, Human; identical to SEQ ID NO: 534098

SEQ ID NO: 534105 - RNA, 63 nt, Human
accaccuuggggcuucucaugggaaaugugcccccgccccaggacccucucccuuguggacag

SEQ ID NO: 534106 - RNA, 63 nt, Human
cacccggcccggccccgagagcaggcucgaccgccgccccauggaccccucgcccaggccggg

SEQ ID NO: 534107 - RNA, 63 nt, Human
gucccagagucaccacagagacuguuuggaaucccgccccacauucuccaaauucagggcgcg

SEQ ID NO: 534108 - RNA, 62 nt, Human
gcaacuauccugacgugugacaggucccugauccgccccagccugcaggccagaagcagugu

SEQ ID NO: 534109 - RNA, 63 nt, Human
ccuaagauuuuugacugcugguugucacacuucccgccccacacucaacuguugugugaauga

SEQ ID NO: 534110 - RNA, 63 nt, Human
gucuccucgggggagcagaugagggcccugcccccgccccacugacuuccuccaauaaaguca

SEQ ID NO: 534111 - RNA, 63 nt, Human
uggcagaugucuucccugggcugccaccagcccccgccccagaguggcccaccguggcacuag

SEQ ID NO: 534112 - RNA, 62 nt, Human
ugcuaugauuaacuugcuucaaauaaaaaguucccgccccauaaccggcucucaggugucau

SEQ ID NO: 534113 - RNA, 63 nt, Human
gcagccucgaccucccuggcuugagugauccucccgccccagccuccugaguagcugggacua

SEQ ID NO: 534114 - RNA, 63 nt, Human
ggccggcggaugcuggauccggagccccagguuccgccccagagcgguccuggacaaggccag

SEQ ID NO: 534115 - RNA, 63 nt, Human
ggcuggcaggggccccucccugccucggcucugccgccccagccucaguuccugcuucugguc

SEQ ID NO: 534116 - RNA, 63 nt, Human
ucacaugaccuagcugcaccccagcgccugggcccgccccacgcucuguccacacccacgcgc

SEQ ID NO: 534117 - RNA, 63 nt, Human
ccugcugcucgggaaggccugagggaagcccacccgccccagagacugcccacccugggccuc

SEQ ID NO: 534118 - RNA, 63 nt, Human
cccagcaguugugacgggcaguugcugagcagaccgccccacccuccccggcugggagggcuc

SEQ ID NO: 534119 - RNA, 63 nt, Human
cucuccggagcuugacuucuuggaccuccucccccgccccaauuccaagcuccagaaacuccc

SEQ ID NO: 534120 - RNA, 63 nt, Human
gcaacgcuggagccgcuuccccagcucagagccccgccccaccccguccugauucgagguccu

SEQ ID NO: 534121 - RNA, 63 nt, Human
cugccacgugcuggguggaccuaagguuccuucccgccccauucuggcgacacuuggagccau

SEQ ID NO: 534122 - RNA, 63 nt, Human
uuccccacacacuuucaucucguuuccuccacuccgccccauccugcagggccuuguuuuugu

SEQ ID NO: 534123 - RNA, 63 nt, Human
gaugagcguacuggaacuggagaagaggaggccccgccccaccgcuccgggagcugcucauca

SEQ ID NO: 534124 - RNA, 63 nt, Human
uggugugacauccagagagcagcugggcugcucccgccccagcccggcccagggugaaggaag

SEQ ID NO: 534125 - RNA, 63 nt, Human
aaaaaguuaaaacaaaacauggaugucugggucccgccccauagagaaugacuuaauuggcau

SEQ ID NO: 534126 - RNA, 63 nt, Human
ggaggaccgacgcgacgcgaugccucccggccaccgccccagccucaccccaucccacgaccc

SEQ ID NO: 534127 - RNA, 63 nt, Human
uguaggauauuuugucaccagaacacaaugcuaccgccccaaaguaaaagaaaccacuucugg

SEQ ID NO: 534128 - RNA, 63 nt, Human
caguggucaggacagaccugaguguggcgccccccgccccacccuccacucccuuccuugugu

SEQ ID NO: 534129 - RNA, 63 nt, Human
cccugccagcugugccuugcuugcccucuggccccgccccaacuuccaggcugacccggcccu

SEQ ID NO: 534130 - RNA, 63 nt, Human
ccgcggacuggggucauuuugacuggcuugcucccgccccagggucugaaagggguguuuggg

SEQ ID NO: 534131 - RNA, 63 nt, Human
aacuucaguguuuucuacaauacuccuccugccccgccccauuaaaacaguucuuuuguuaag

SEQ ID NO: 534132 - RNA, 63 nt, Human
ugaccuggagcagucagagggcccucagucaccccgccccauuccucaccagagaaaagaauc

SEQ ID NO: 534133 - RNA, 63 nt, Human
cagugccacagcacaaggcgccuccccgccccgccgccccacaccucuccccuuugggcugga

SEQ ID NO: 534134 - RNA, 63 nt, Human
guaggagaggcgggagaacugaaguuuccgcccccgccccacagggcaaggacacagcgcggu

SEQ ID NO: 534135 - RNA, 63 nt, Human
gguuuagaacacacaccaacaccuccagcguccccgccccagcuuccgguggggugaugcggu

SEQ ID NO: 534136 - RNA, 63 nt, Human
gcgggccagcuggacgggcugccggccgcugcgccgccccaccugggcgagacugcagcgaug

SEQ ID NO: 534137 - RNA, 63 nt, Human
cuaggcagggcugccgguucuccaccuccccauccgccccaggcccccugccugugccugccu

SEQ ID NO: 534138 - RNA, 63 nt, Human
ccguggcgguggcccuucccggcugcggagagcccgccccacagauguauuuauuguacaaac

SEQ ID NO: 534139 - RNA, 63 nt, Human
ucacgucuguugccgcacacauuccucucagcuccgccccauacccgucacuacagccucacc

SEQ ID NO: 534140 - RNA, 63 nt, Human
gugcucggaggccaucucgggcacaggcccaccccgccccaccccuccagaacacggcucacg

SEQ ID NO: 534141 - RNA, 63 nt, Human
caugucucugcucauuuagucccgucuuccucaccgccccagcaggggaacgcucaagccugg

SEQ ID NO: 534142 - RNA, 63 nt, Human
cuaaaaggggcgcccuacaucuccgugccacucccgccccagccuagccccaagacuuuggau

SEQ ID NO: 534143 - RNA, 63 nt, Human
ugggugccaggccuggggccccucccaguucccccgccccaggaaacacugcugaccuuugca

SEQ ID NO: 534144 - RNA, 63 nt, Human
cugggccaggggccugacccucagcacuuucagccgccccaagucugaggccccguggacugc

SEQ ID NO: 534145 - RNA, 63 nt, Human
gggaaugagcagcugagcucuuugguguggacaccgccccaagcugaggugccucccuaucug

SEQ ID NO: 534146 - RNA, 63 nt, Human
cuccucaccuugaucaggacuaaaggacggaggccgccccacccccuucccuuuccuccaaac

SEQ ID NO: 534147 - RNA, 63 nt, Human
caucuccccaugaaagugcuguacaaauuccacccgccccaggacccccgcaccugcccucug

SEQ ID NO: 534148 - RNA, 63 nt, Human
cuacuaagagcagcgggccuguccaggggcuccccgccccaccccacgccuuagcugcaggcc

SEQ ID NO: 534149 - RNA, 61 nt, Human
agcgcuaugucugcaagugaggcccugcccuccgccccacgcaggagcgaggacucugcuc

SEQ ID NO: 534150 - RNA, 63 nt, Human
guagugagccaguguccugggccucugggaugcccgccccauugcugccaaugcuggcagccc

SEQ ID NO: 534151 - RNA, 63 nt, Human
gacuggcagccaggccugucgggccccccgacgccgccccauuucccuuccagcaaacucaac

SEQ ID NO: 534152 - RNA, 63 nt, Human
ccgcaccugcccgccucggcguucgugacucagccgccccaucccgagucgcuaaggggcugc

SEQ ID NO: 534153 - RNA, 63 nt, Human
gguggggagcagagugcccgccccguggagauaccgccccagcgggggcugcgacauccaugg

SEQ ID NO: 534154 - RNA, 63 nt, Human
aaaaaaccgaggcccucaauccaccuucaggccccgccccaugggccccucaccgcugguugg

SEQ ID NO: 534155 - RNA, 63 nt, Human
ccagcggaaacuucucgagcuccccccucuaccccgccccaccuugcagcuaaaugugauccu

SEQ ID NO: 534156 - RNA, 63 nt, Human
caguuccauuuaaaagcauaacuggcuaagucaccgccccacccgccgcauuacauuuccuaa

SEQ ID NO: 534157 - RNA, 63 nt, Human
agggagcccgccagcagaccccacacagcauguccgccccagggcaaagccucccaccuucgc

SEQ ID NO: 534158 - RNA, 63 nt, Human
aggccuugccccuccaccuggugcccaagccucccgccccaccgucuggaucaauguccucaa

SEQ ID NO: 534159 - RNA, 63 nt, Human
cugaagcauuaaccggugggccccgugcccuccccgccccacuuucccuucuucaaaggacaa

SEQ ID NO: 534160 - RNA, 63 nt, Human
ugaccgugucuaacuccccuggagugacgaccaccgccccaccaccuccugggaccacaccac

SEQ ID NO: 534161 - RNA, 63 nt, Human
aggagccagccagggguccagcacagcccuaccccgccccaguaucaugcgauggucccccac

SEQ ID NO: 534162 - RNA, 63 nt, Human
agccacugcaagagaaacccccacccggcaagcccgccccaucccagacaggaagcagagucc

SEQ ID NO: 534163 - RNA, 63 nt, Human
aaagaaggaagagcaagaacauggccacacccaccgccccacacgagaaauuugugcgcugaa

SEQ ID NO: 534164 - RNA, 63 nt, Human
caggagagggcuguguugcucucucaaccauguccgccccagcucuugaggcuggaucuuucu

SEQ ID NO: 534165 - RNA, 63 nt, Human
cccugaggaacugaggccacgucaaucccugugccgccccauucgcccguuacaucuuccaaa

SEQ ID NO: 534166 - RNA, 63 nt, Human
cagacgcacccacucaccucuccgauccgcaccccgccccacgggagcacuuccuacccccac

SEQ ID NO: 534167 - RNA, 63 nt, Human
uccccaccaccucccaagguauuucugaugacuccgccccaguacuugcuuugcuucauuugg

SEQ ID NO: 534168 - RNA, 63 nt, Human
gggcccugaguuccagccucuccccaaggguccccgccccaguggcugccucugucuugaccu

SEQ ID NO: 534169 - RNA, 63 nt, Human
uuuguuuuagaaaaauugggauuuccccccaccccgccccacccagauaaacuauaucuacac

SEQ ID NO: 534170 - RNA, 63 nt, Human
acgguaaaacuaauuagugcccacccacccuccccgccccagcaacugcauauugaaauuugu

SEQ ID NO: 534171 - RNA, 63 nt, Human
gcggcccggggccgcucggcggcaccuccacacccgccccaacgcguucucuggagcuuuggg

SEQ ID NO: 534172 - RNA, 63 nt, Human
gaccagggacccgcgggcucggguugccguuucccgccccaccccgcggccggccuggcuuca

SEQ ID NO: 534173 - RNA, 63 nt, Human
ggggcggggguggcaggugucccccccugguccccgccccaagagccugcugucuguauggag

SEQ ID NO: 534174 - RNA, 63 nt, Human
ggaccgcggauccucagcccccgcuccaccagcccgccccagcgcgugggucuguuugggagg

SEQ ID NO: 534175 - RNA, 63 nt, Human
ccccuucugcaugucugaggccaccggcaaccgccgccccacuccagauuugcccccgccuug

SEQ ID NO: 534176 - RNA, 63 nt, Human
cagugaacauucccagcccagccccgccccgccccgccccaccacuccagcagaccuugcccc

SEQ ID NO: 534177 - RNA, 63 nt, Human
cugggguccucgcuggccuugccagagguugagccgccccaggguaugaggagaugaauaacu

SEQ ID NO: 534178 - RNA, 63 nt, Human
ucccauaaccgcugauucucagggucucugcugccgccccacccagaugggggaaagcacagg

SEQ ID NO: 534179 - RNA, 63 nt, Human
aaaggagguuccagccccacccaccugcccaccccgccccaggcaccaucaggagcaggcuag

SEQ ID NO: 534180 - RNA, 63 nt, Human
ggacccauggccucucuccaggcccuccgcaccccgccccaugccccaguccuuuccuacucc

SEQ ID NO: 534181 - RNA, 63 nt, Human
ugggaggcacagggaggggagagaugggcggccccgccccagcgcagugccggccacacccau

SEQ ID NO: 534182 - RNA, 63 nt, Human
cugcugcuuggcuucuggcccccuuaucugcccccgccccacgcgcccuggcagcaccaugag

SEQ ID NO: 534183 - RNA, 63 nt, Human
cgccgggacgccaccuccgccagccgccuccacccgccccacaccacaaucgcugguuuucgg

SEQ ID NO: 534184 - RNA, 63 nt, Human
uggcugcaguaagcucccuggauggucacagugccgccccauccccaggcugugugcucaaag

SEQ ID NO: 534185 - RNA, 63 nt, Human
uccuucccugaagcaagcccaggagaagacucuccgccccacgccaaucccaaaggcaugcag

SEQ ID NO: 534186 - RNA, 63 nt, Human
ugccgaccuuuccccaccaccgcaacaagcgggccgccccagccaccuccgagggccagagca

SEQ ID NO: 534187 - RNA, 63 nt, Human
ggugugcugauccggggccacacggaggaggagccgccccagccugaggucugcaacaccaag

SEQ ID NO: 534188 - RNA, 63 nt, Human
uccuccuugccgcuguguggggcaguccccuguccgccccaaaacccggccuuggucccuggc

SEQ ID NO: 534189 - RNA, 63 nt, Human
gccccgccccgggcaggggggcggcgggugggcccgccccacgcacgcacgcacacucgggga

SEQ ID NO: 534190 - RNA, 63 nt, Human
ucuguuuccagcacugcacccucaggaagucgcccgccccaggacacgcagggaccacccuaa

SEQ ID NO: 534191 - RNA, 63 nt, Human
uggaacugcucuggcacuucugucaagccucccccgccccaauugccuugagaucucugcucu

SEQ ID NO: 534192 - RNA, 63 nt, Human
gaucggccucccucccccacgacucagcaauacccgccccaccggcugugaugcuccaauaaa

SEQ ID NO: 534193 - RNA, 63 nt, Human
cucugggccucacuguggacagaggagucaggcccgccccaggagccuccagcugccuaacca

SEQ ID NO: 534194 - RNA, 63 nt, Human
gcguuuuacagccguggggggaagcacauaaucccgccccagggcccacuagcauccacugau

SEQ ID NO: 534195 - RNA, 63 nt, Human
gcacgggaggcccuaucucccauccuguggaacccgccccauuggccaccccaugcugcugcu

SEQ ID NO: 534196 - RNA, 63 nt, Human
ccccggugugagcccaaccggggagcccccgccccgccccacauuccgacaaccgaugcucca

SEQ ID NO: 534197 - RNA, 63 nt, Human
ggcacaggcccacgguggccagccauuguggugccgccccagcuucuggauacagccuuuugg

SEQ ID NO: 534198 - RNA, 51 nt, Human
ugagaaccgccagaaacugagccgccccaggaugccgccagaaucacuggu

SEQ ID NO: 534199 - RNA, 63 nt, Human
uuuucaaugaauguuaagagauuguucucacucccgccccaucuuaauguauaaccaacacca

SEQ ID NO: 534200 - RNA, 63 nt, Human
ccuugggaagcucugucgugccccuaccccacgccgccccaccacuauaggcugcuggagucc

SEQ ID NO: 534201 - RNA, 63 nt, Human
ugacugucaguuccugucccaggcuuugcccggccgccccaggaacccaacccucugggcuga

SEQ ID NO: 534202 - RNA, 63 nt, Human
gaccacaagcccaguggucaccccugugugcgcccgccccagcccaggaguagucuuaccucu

SEQ ID NO: 534203 - RNA, 63 nt, Human
cugcaggcucuccugcugcaucuccaguugcugccgccccaacugcugccagaccaugugcug

SEQ ID NO: 534204 - RNA, 63 nt, Human
ccccggccggccacccaggaggcagggaggcagccgccccaucugccccacagucuccggccu

SEQ ID NO: 534205 - RNA, 63 nt, Human
guccgaggguggugggagggauagaaaucacauccgccccaacuucccaaagagcagcauccc

SEQ ID NO: 534206 - RNA, 63 nt, Human
cuaaaggccucuuccuugcugugucauaccaggccgccccagccucugagccccugggacugc

SEQ ID NO: 534207 - RNA, 63 nt, Human
cuuggcggcucuagccccagcgccaaaggagacccgccccagggccgggcuuggccuccugcu

SEQ ID NO: 534208 - RNA, 63 nt, Human
ccagguggcaaauggcgacucuauacucuccgcccgccccagggcuggauggauuagaaaaau

SEQ ID NO: 534209 - RNA, 63 nt, Human
agcacacugcaggaggcguucggaggaggaguuccgccccacccucuacagccuuccucaggc

SEQ ID NO: 534210 - RNA, 63 nt, Human
acacauugcugagagccgucuccugugccucccccgccccauccccggucuucguguuguguc

SEQ ID NO: 534211 - RNA, 61 nt, Human
aagaggagaucgauggauagucggaauagagccgccccaacucagauccuacaacacgcaa

SEQ ID NO: 534212 - RNA, 63 nt, Human
uuggggcuaagccugacccccucuccaugcuccccgccccaacccacucuggccucaguagau

SEQ ID NO: 534213 - RNA, 63 nt, Human
cggagccaccucuggaugaacugcccccagcccccgccccauuaaagacccggaagccugacu

SEQ ID NO: 534214 - RNA, 63 nt, Human
gaggggaacuacccccccagccugcccuccgccccgccccagccggcggacugugcuguuucc

SEQ ID NO: 534215 - RNA, 63 nt, Human
gucccccgggaccgaggccugugccguccccacccgccccaacauggugcucauccuugccga

SEQ ID NO: 534216 - RNA, 63 nt, Human
gcaguggcucugauccacucacccccccgccccccgccccacuucuagcugcuucuccucuug

SEQ ID NO: 534217 - RNA, 63 nt, Human
ccgcccccagcccugcaugcaggugcccucgcuccgccccaucaguuccugccccugccccuc

SEQ ID NO: 534218 - RNA, 63 nt, Human
cacgcacgcacgcacacggccccgcacacagccccgccccaccccgcaaccagcccugucgac

SEQ ID NO: 534219 - RNA, 61 nt, Human
cgccgccugccgcccgcugagcaccgaggacccgccccaagcagagccgccccugggcccg

SEQ ID NO: 534220 - RNA, 63 nt, Human
accucggccgugacauucggggccgggcgggacccgccccacagacuccaacuuccccuccaa

SEQ ID NO: 534221 - RNA, 63 nt, Human
cagcccguggucagguagagagugagccccacgccgccccagggaggaggcgccagagcgcgg

SEQ ID NO: 534222 - RNA, 63 nt, Human
accacccuccgcuggcucgggaagacaccgugcccgccccaagagcaagcaccggccaugcug

SEQ ID NO: 534223 - RNA, 63 nt, Human
cagccgcgcgccgggagcgcuccccggaaugagccgccccacccaccccaaggcuggagccgc

SEQ ID NO: 534224 - RNA, 63 nt, Human
ccuggcaccgcugcuacggcggccuagcaaauuccgccccagaagcgccccaggaagggcgcc

SEQ ID NO: 534225 - RNA, 63 nt, Human
cauccuggauggugugugguggcacaggaacccccgccccaacuuuuggauuguaauaaaaca

SEQ ID NO: 534226 - RNA, 63 nt, Human
uuccccucaaccaaagagccccccgggucacccccgccccacugaggccaguagggggccagg

SEQ ID NO: 534227 - RNA, 63 nt, Human
ccuccgcgcagccugcagcgggagacccuguccccgccccagccguccuccugggguggaccc

SEQ ID NO: 534228 - RNA, 63 nt, Human
gacccaggcccugggcuaggggcagagcaggccccgccccagggcaauguuggacccccuuuu

SEQ ID NO: 534229 - RNA, 63 nt, Human
cugagagggggaagaagcggggaggaagaaaucccgccccaaacguccgcuuuccuuuucucu

SEQ ID NO: 534230 - RNA, 63 nt, Human
ggagcccucgcccccgacucucggucggccuccccgccccaggcgucacucagugaucacggg

SEQ ID NO: 534231 - RNA, 63 nt, Human
agggacccuuggccccaagcucagcucuaagaaccgccccaaccccuccagcuccaaaucuga

SEQ ID NO: 534232 - RNA, 63 nt, Human
cccguccuggggugaggcuuccuguggcccagcccgccccauucaccuguggauuugugcgag

SEQ ID NO: 534233 - RNA, 63 nt, Human
ccggucuucgggggcgccggcuuccaccacucgccgccccaccccugcacuccgugaccucug

SEQ ID NO: 534234 - RNA, 63 nt, Human
aucccagcagaggggauguugcagcugugaugaccgccccagaucgguuagcgcugaguucau

SEQ ID NO: 534235 - RNA, 63 nt, Human
cugaggcccagagcucgggagaugcccgccucgccgccccaccggaccucguccucccccugc

SEQ ID NO: 534236 - RNA, 63 nt, Human
acgcagccccucgagcccccccaccggccccggccgccccagcgaccucccuggcaccggccg

SEQ ID NO: 534237 - RNA, 63 nt, Human
uagggggaggauccaccccaaccucugcccugcccgccccaggggcaccccgacauccaggcc

SEQ ID NO: 534238 - RNA, 63 nt, Human
cugcagggaauugggggggugcccggggaucccccgccccauccuccugcccccaccccaggc

SEQ ID NO: 534239 - RNA, 63 nt, Human
ccagagcugggcccccugggcagguuccccaccccgccccaccgcauccuucucggagcuggu

SEQ ID NO: 534240 - RNA, 63 nt, Human
ccggaccgcgggccggaaggaggcgcccccgccccgccccagagcugggcccccugggcaggu

SEQ ID NO: 534241 - RNA, 63 nt, Human
aggcgcugcccuccagcuaagcccuuggccuccccgccccacccgcccccgccaccccuccac

SEQ ID NO: 534242 - RNA, 63 nt, Human
gaagaugucccccaggggcccaggcuccccugcccgccccaagcccugccccuccuguacaua

SEQ ID NO: 534243 - RNA, 56 nt, Human
cauucgagauugaacuguagcccgagccgccccacccacuccaucaucuccaggug

SEQ ID NO: 534244 - RNA, 63 nt, Human
cucucccucuccucaccccucuauccauuccucccgccccagccaccucccugggcucuuuuu

SEQ ID NO: 534245 - RNA, 63 nt, Human
ugcgggcgcccggacugaccgaagggacggggcccgccccaggccccagcagucuccgcuccc

SEQ ID NO: 534246 - RNA, 63 nt, Human
uauaucuguauaaauaacgggauuuucauggcgccgccccacccgcauuaucacugugugaug

SEQ ID NO: 534247 - RNA, 63 nt, Human
auucauuuggggggugggagauuuuggcugaagccgccccagccuuaguccccagggccaagc

SEQ ID NO: 534248 - RNA, 63 nt, Human
cugugaauccugugcucugcccgugaccgccccccgccccaucaaucccauugcauagguuua

SEQ ID NO: 534249 - RNA, 52 nt, Human
ugggcgaggagcguaacuaaguccgccccaccacacuccccgccuguccugc

SEQ ID NO: 534250 - RNA, 63 nt, Human
cgggccgcguccgccccgucccacacuacgcccccgccccacucccggggccugcuaaucuga

SEQ ID NO: 534251 - RNA, 63 nt, Human
caccuccuucuuggaacagcacagccuguggcuccgccccaaggaaccacuuacacaaaauag

SEQ ID NO: 534252 - RNA, 63 nt, Human
gacuguggaauggaucgacccuaacgaucuuccccgccccaaacacuagaauagacuggccug

SEQ ID NO: 534253 - RNA, 63 nt, Human
uuucucucucuccuugccccccucccgcccuccccgccccauaccuuuucuuccccuggauuu

SEQ ID NO: 534254 - RNA, 63 nt, Human
uuuuuuauucuccuccucccuccccgcccucacccgccccacucccuccuaaccuagagauug

SEQ ID NO: 534255 - RNA, 63 nt, Human
ggaccgugcagcugucggcugaugaggaggcggccgccccagugcugauggagaugccacuuu

SEQ ID NO: 534256 - RNA, 53 nt, Human
cccagcaguggacuuggugagcgccgccccaacgagacucgcggccccaggcc

SEQ ID NO: 534257 - RNA, 63 nt, Human
uccaguggaaguucuucaagaggaaaggcgcccccgccccaggcuuccgcgcccagcgcucgc

SEQ ID NO: 534258 - RNA, 63 nt, Human
ugcuggagggcagcccaaagccaggggcccaccccgccccaccccaccccaccccacccucug

SEQ ID NO: 534259 - RNA, 63 nt, Human
cugugggacccucgggagaccccguggcugucuccgccccaucgaggaggaggcccgucagcc

SEQ ID NO: 534260 - RNA, 63 nt, Human
cccacuggccaccccucccucgccccgacugccccgccccacccucaccccgacugccccgcc

SEQ ID NO: 534261 - RNA, 63 nt, Human
aaagcacauguucaagagaacagaacacucuccccgccccagccugauuccugccuuacccag

SEQ ID NO: 534262 - RNA, 63 nt, Human
cagugagggggcuccugccguccugacgccaccccgccccaucagcacuuaagccacaugaca

SEQ ID NO: 534263 - RNA, 63 nt, Human
gaugccccauccaccgcaugcggugcccguggcccgccccacaccaccgccgccugcagaccu

SEQ ID NO: 534264 - RNA, 63 nt, Human
acagccgucucccaggccgcuuccccaacauccccgccccagccucccucuuaccccagaaag

SEQ ID NO: 534265 - RNA, 63 nt, Human
acugugcuguccccguccugagcaacuaugcccccgccccaguagguucaaggcaaagcagcu

SEQ ID NO: 534266 - RNA, 63 nt, Human
agacggacuaagccuagagaggccgcaaggggaccgccccaggcaccgccagaguguccugcu

SEQ ID NO: 534267 - RNA, 63 nt, Human
gacccaacagguggcaggcaguggacagggugcccgccccacagugcuuuccccagcacccca

SEQ ID NO: 534268 - RNA, 63 nt, Human
agaccccggccagcgcccaccccagccuucugcccgccccaucgaggaggccccucgggggca

SEQ ID NO: 534269 - RNA, 63 nt, Human
cuuucugucuggcucacugcccugaugacccacccgccccauccaggcuccagcagcaaagcc

SEQ ID NO: 534270 - RNA, 63 nt, Human
uucccccgcuccaccccucaccucaccucgcccccgccccacccaucgcgccccggcccgucc

SEQ ID NO: 534271 - RNA, 63 nt, Human
cgcucuuggguccgcgcgucaucggcaaagucuccgccccaacuugcuccaucuacggccgca

SEQ ID NO: 534272 - RNA, 63 nt, Human
aaaauuuguauuuugaacuaugaauggagacuaccgccccagcauuaguuucacaugauauac

SEQ ID NO: 534273 - RNA, 63 nt, Human
caguguugucugcaccugcuccgacuccuucagccgccccauucagcgcccgcuccguccagu

SEQ ID NO: 534274 - RNA, 63 nt, Human
acucaguuuucccugaauuuggagcaccaaacuccgccccaaaaaggagaguaacaaauacac

SEQ ID NO: 534275 - RNA, 63 nt, Human
gaggggccccgguccuggccccagcccccaccuccgccccagacacaccccccagucgagccc

SEQ ID NO: 534276 - RNA, 63 nt, Human
ggauccuaaauuucccuuuggcucaugucccccccgccccaccccaccuucuccuuuuuggca

SEQ ID NO: 534277 - RNA, 63 nt, Human; identical to SEQ ID NO: 534038

SEQ ID NO: 534278 - RNA, 63 nt, Human; identical to SEQ ID NO: 534039

SEQ ID NO: 534279 - RNA, 63 nt, Human; identical to SEQ ID NO: 534040

SEQ ID NO: 534280 - RNA, 63 nt, Human; identical to SEQ ID NO: 534041

SEQ ID NO: 534281 - RNA, 63 nt, Human; identical to SEQ ID NO: 534042

SEQ ID NO: 534282 - RNA, 63 nt, Human; identical to SEQ ID NO: 534043

SEQ ID NO: 534283 - RNA, 63 nt, Human; identical to SEQ ID NO: 534044

SEQ ID NO: 534284 - RNA, 63 nt, Human; identical to SEQ ID NO: 534045

SEQ ID NO: 534285 - RNA, 63 nt, Human; identical to SEQ ID NO: 534046

SEQ ID NO: 534286 - RNA, 63 nt, Human; identical to SEQ ID NO: 534047

SEQ ID NO: 534287 - RNA, 63 nt, Human; identical to SEQ ID NO: 534048

SEQ ID NO: 534288 - RNA, 63 nt, Human; identical to SEQ ID NO: 534049

SEQ ID NO: 534289 - RNA, 63 nt, Human; identical to SEQ ID NO: 534050

SEQ ID NO: 534290 - RNA, 63 nt, Human; identical to SEQ ID NO: 534051

SEQ ID NO: 534291 - RNA, 63 nt, Human; identical to SEQ ID NO: 534052

SEQ ID NO: 534292 - RNA, 63 nt, Human; identical to SEQ ID NO: 534053

SEQ ID NO: 534293 - RNA, 63 nt, Human; identical to SEQ ID NO: 534054

SEQ ID NO: 534294 - RNA, 63 nt, Human; identical to SEQ ID NO: 534055

SEQ ID NO: 534295 - RNA, 63 nt, Human; identical to SEQ ID NO: 534056

SEQ ID NO: 534296 - RNA, 63 nt, Human; identical to SEQ ID NO: 534057

SEQ ID NO: 534297 - RNA, 63 nt, Human; identical to SEQ ID NO: 534058

SEQ ID NO: 534298 - RNA, 63 nt, Human; identical to SEQ ID NO: 534059

SEQ ID NO: 534299 - RNA, 63 nt, Human; identical to SEQ ID NO: 534060

SEQ ID NO: 534300 - RNA, 63 nt, Human; identical to SEQ ID NO: 534061

SEQ ID NO: 534301 - RNA, 63 nt, Human; identical to SEQ ID NO: 534062

SEQ ID NO: 534302 - RNA, 63 nt, Human; identical to SEQ ID NO: 534063

SEQ ID NO: 534303 - RNA, 63 nt, Human; identical to SEQ ID NO: 534064

SEQ ID NO: 534304 - RNA, 63 nt, Human; identical to SEQ ID NO: 534065

SEQ ID NO: 534305 - RNA, 63 nt, Human; identical to SEQ ID NO: 534066

SEQ ID NO: 534306 - RNA, 63 nt, Human; identical to SEQ ID NO: 534067

SEQ ID NO: 534307 - RNA, 63 nt, Human; identical to SEQ ID NO: 534068

SEQ ID NO: 534308 - RNA, 63 nt, Human; identical to SEQ ID NO: 534069

SEQ ID NO: 534309 - RNA, 63 nt, Human; identical to SEQ ID NO: 534070

SEQ ID NO: 534310 - RNA, 63 nt, Human; identical to SEQ ID NO: 534071

SEQ ID NO: 534311 - RNA, 63 nt, Human; identical to SEQ ID NO: 534072

SEQ ID NO: 534312 - RNA, 63 nt, Human; identical to SEQ ID NO: 534073

SEQ ID NO: 534313 - RNA, 63 nt, Human; identical to SEQ ID NO: 534074

SEQ ID NO: 534314 - RNA, 63 nt, Human; identical to SEQ ID NO: 534075

SEQ ID NO: 534315 - RNA, 63 nt, Human; identical to SEQ ID NO: 534076

SEQ ID NO: 534316 - RNA, 63 nt, Human; identical to SEQ ID NO: 534077

SEQ ID NO: 534317 - RNA, 63 nt, Human; identical to SEQ ID NO: 534078

SEQ ID NO: 534318 - RNA, 63 nt, Human; identical to SEQ ID NO: 534079

SEQ ID NO: 534319 - RNA, 63 nt, Human; identical to SEQ ID NO: 534080

SEQ ID NO: 534320 - RNA, 63 nt, Human; identical to SEQ ID NO: 534081

SEQ ID NO: 534321 - RNA, 63 nt, Human; identical to SEQ ID NO: 534082

SEQ ID NO: 534322 - RNA, 63 nt, Human; identical to SEQ ID NO: 534083

SEQ ID NO: 534323 - RNA, 63 nt, Human; identical to SEQ ID NO: 534084

SEQ ID NO: 534324 - RNA, 63 nt, Human; identical to SEQ ID NO: 534085

SEQ ID NO: 534325 - RNA, 63 nt, Human; identical to SEQ ID NO: 534086

SEQ ID NO: 534326 - RNA, 63 nt, Human; identical to SEQ ID NO: 534087

SEQ ID NO: 534327 - RNA, 63 nt, Human; identical to SEQ ID NO: 534088

SEQ ID NO: 534328 - RNA, 63 nt, Human; identical to SEQ ID NO: 534089

SEQ ID NO: 534329 - RNA, 63 nt, Human; identical to SEQ ID NO: 534090

SEQ ID NO: 534330 - RNA, 63 nt, Human; identical to SEQ ID NO: 534091

SEQ ID NO: 534331 - RNA, 63 nt, Human; identical to SEQ ID NO: 534092

SEQ ID NO: 534332 - RNA, 63 nt, Human; identical to SEQ ID NO: 534093

SEQ ID NO: 534333 - RNA, 63 nt, Human; identical to SEQ ID NO: 534094

SEQ ID NO: 534334 - RNA, 63 nt, Human; identical to SEQ ID NO: 534095

SEQ ID NO: 534335 - RNA, 63 nt, Human; identical to SEQ ID NO: 534096

SEQ ID NO: 534336 - RNA, 63 nt, Human; identical to SEQ ID NO: 534097

SEQ ID NO: 534337 - RNA, 63 nt, Human; identical to SEQ ID NO: 534098

SEQ ID NO: 534338 - RNA, 63 nt, Human; identical to SEQ ID NO: 534099

SEQ ID NO: 534339 - RNA, 63 nt, Human; identical to SEQ ID NO: 534100

SEQ ID NO: 534340 - RNA, 63 nt, Human; identical to SEQ ID NO: 534101

SEQ ID NO: 534341 - RNA, 63 nt, Human; identical to SEQ ID NO: 534102

SEQ ID NO: 534342 - RNA, 63 nt, Human; identical to SEQ ID NO: 534103

SEQ ID NO: 534343 - RNA, 63 nt, Human; identical to SEQ ID NO: 534098

SEQ ID NO: 534344 - RNA, 63 nt, Human; identical to SEQ ID NO: 534105

SEQ ID NO: 534345 - RNA, 63 nt, Human; identical to SEQ ID NO: 534106

SEQ ID NO: 534346 - RNA, 63 nt, Human; identical to SEQ ID NO: 534107

SEQ ID NO: 534347 - RNA, 62 nt, Human; identical to SEQ ID NO: 534108

SEQ ID NO: 534348 - RNA, 63 nt, Human; identical to SEQ ID NO: 534109

SEQ ID NO: 534349 - RNA, 63 nt, Human; identical to SEQ ID NO: 534110

SEQ ID NO: 534350 - RNA, 63 nt, Human; identical to SEQ ID NO: 534111

SEQ ID NO: 534351 - RNA, 62 nt, Human; identical to SEQ ID NO: 534112

SEQ ID NO: 534352 - RNA, 63 nt, Human; identical to SEQ ID NO: 534113

SEQ ID NO: 534353 - RNA, 63 nt, Human; identical to SEQ ID NO: 534114

SEQ ID NO: 534354 - RNA, 63 nt, Human; identical to SEQ ID NO: 534115

SEQ ID NO: 534355 - RNA, 63 nt, Human; identical to SEQ ID NO: 534116

SEQ ID NO: 534356 - RNA, 63 nt, Human; identical to SEQ ID NO: 534117

SEQ ID NO: 534357 - RNA, 63 nt, Human; identical to SEQ ID NO: 534118

SEQ ID NO: 534358 - RNA, 63 nt, Human; identical to SEQ ID NO: 534119

SEQ ID NO: 534359 - RNA, 63 nt, Human; identical to SEQ ID NO: 534120

SEQ ID NO: 534360 - RNA, 63 nt, Human; identical to SEQ ID NO: 534121

SEQ ID NO: 534361 - RNA, 63 nt, Human; identical to SEQ ID NO: 534122

SEQ ID NO: 534362 - RNA, 63 nt, Human; identical to SEQ ID NO: 534123

SEQ ID NO: 534363 - RNA, 63 nt, Human; identical to SEQ ID NO: 534124

SEQ ID NO: 534364 - RNA, 63 nt, Human; identical to SEQ ID NO: 534125

SEQ ID NO: 534365 - RNA, 63 nt, Human; identical to SEQ ID NO: 534126

SEQ ID NO: 534366 - RNA, 63 nt, Human; identical to SEQ ID NO: 534127

SEQ ID NO: 534367 - RNA, 63 nt, Human; identical to SEQ ID NO: 534128

SEQ ID NO: 534368 - RNA, 63 nt, Human; identical to SEQ ID NO: 534129

SEQ ID NO: 534369 - RNA, 63 nt, Human; identical to SEQ ID NO: 534130

SEQ ID NO: 534370 - RNA, 63 nt, Human; identical to SEQ ID NO: 534131

SEQ ID NO: 534371 - RNA, 63 nt, Human; identical to SEQ ID NO: 534132

SEQ ID NO: 534372 - RNA, 63 nt, Human; identical to SEQ ID NO: 534133

SEQ ID NO: 534373 - RNA, 63 nt, Human; identical to SEQ ID NO: 534134

SEQ ID NO: 534374 - RNA, 63 nt, Human; identical to SEQ ID NO: 534135

SEQ ID NO: 534375 - RNA, 63 nt, Human; identical to SEQ ID NO: 534136

SEQ ID NO: 534376 - RNA, 63 nt, Human; identical to SEQ ID NO: 534137

SEQ ID NO: 534377 - RNA, 63 nt, Human; identical to SEQ ID NO: 534138

SEQ ID NO: 534378 - RNA, 63 nt, Human; identical to SEQ ID NO: 534139

SEQ ID NO: 534379 - RNA, 63 nt, Human; identical to SEQ ID NO: 534140

SEQ ID NO: 534380 - RNA, 63 nt, Human; identical to SEQ ID NO: 534141

SEQ ID NO: 534381 - RNA, 63 nt, Human; identical to SEQ ID NO: 534142

SEQ ID NO: 534382 - RNA, 63 nt, Human; identical to SEQ ID NO: 534143

SEQ ID NO: 534383 - RNA, 63 nt, Human; identical to SEQ ID NO: 534144

SEQ ID NO: 534384 - RNA, 63 nt, Human; identical to SEQ ID NO: 534145

SEQ ID NO: 534385 - RNA, 63 nt, Human; identical to SEQ ID NO: 534146

SEQ ID NO: 534386 - RNA, 63 nt, Human; identical to SEQ ID NO: 534147

SEQ ID NO: 534387 - RNA, 63 nt, Human; identical to SEQ ID NO: 534148

SEQ ID NO: 534388 - RNA, 61 nt, Human; identical to SEQ ID NO: 534149

SEQ ID NO: 534389 - RNA, 63 nt, Human; identical to SEQ ID NO: 534150

SEQ ID NO: 534390 - RNA, 63 nt, Human; identical to SEQ ID NO: 534151

SEQ ID NO: 534391 - RNA, 63 nt, Human; identical to SEQ ID NO: 534152

SEQ ID NO: 534392 - RNA, 63 nt, Human; identical to SEQ ID NO: 534153

SEQ ID NO: 534393 - RNA, 63 nt, Human; identical to SEQ ID NO: 534154

SEQ ID NO: 534394 - RNA, 63 nt, Human; identical to SEQ ID NO: 534155

SEQ ID NO: 534395 - RNA, 63 nt, Human; identical to SEQ ID NO: 534156

SEQ ID NO: 534396 - RNA, 63 nt, Human; identical to SEQ ID NO: 534157

SEQ ID NO: 534397 - RNA, 63 nt, Human; identical to SEQ ID NO: 534158

SEQ ID NO: 534398 - RNA, 63 nt, Human; identical to SEQ ID NO: 534159

SEQ ID NO: 534399 - RNA, 63 nt, Human; identical to SEQ ID NO: 534160

SEQ ID NO: 534400 - RNA, 63 nt, Human; identical to SEQ ID NO: 534161

SEQ ID NO: 534401 - RNA, 63 nt, Human; identical to SEQ ID NO: 534162

SEQ ID NO: 534402 - RNA, 63 nt, Human; identical to SEQ ID NO: 534163

SEQ ID NO: 534403 - RNA, 63 nt, Human; identical to SEQ ID NO: 534164

SEQ ID NO: 534404 - RNA, 63 nt, Human; identical to SEQ ID NO: 534165

SEQ ID NO: 534405 - RNA, 63 nt, Human; identical to SEQ ID NO: 534166

SEQ ID NO: 534406 - RNA, 63 nt, Human; identical to SEQ ID NO: 534167

SEQ ID NO: 534407 - RNA, 63 nt, Human; identical to SEQ ID NO: 534168

SEQ ID NO: 534408 - RNA, 63 nt, Human; identical to SEQ ID NO: 534169

SEQ ID NO: 534409 - RNA, 63 nt, Human; identical to SEQ ID NO: 534170

SEQ ID NO: 534410 - RNA, 63 nt, Human; identical to SEQ ID NO: 534171

SEQ ID NO: 534411 - RNA, 63 nt, Human; identical to SEQ ID NO: 534172

SEQ ID NO: 534412 - RNA, 63 nt, Human; identical to SEQ ID NO: 534173

SEQ ID NO: 534413 - RNA, 63 nt, Human; identical to SEQ ID NO: 534174

SEQ ID NO: 534414 - RNA, 63 nt, Human; identical to SEQ ID NO: 534175

SEQ ID NO: 534415 - RNA, 63 nt, Human; identical to SEQ ID NO: 534176

SEQ ID NO: 534416 - RNA, 63 nt, Human; identical to SEQ ID NO: 534177

SEQ ID NO: 534417 - RNA, 63 nt, Human; identical to SEQ ID NO: 534178

SEQ ID NO: 534418 - RNA, 63 nt, Human; identical to SEQ ID NO: 534179

SEQ ID NO: 534419 - RNA, 63 nt, Human; identical to SEQ ID NO: 534180

SEQ ID NO: 534420 - RNA, 63 nt, Human; identical to SEQ ID NO: 534181

SEQ ID NO: 534421 - RNA, 63 nt, Human; identical to SEQ ID NO: 534182

SEQ ID NO: 534422 - RNA, 63 nt, Human; identical to SEQ ID NO: 534183

SEQ ID NO: 534423 - RNA, 63 nt, Human; identical to SEQ ID NO: 534184

SEQ ID NO: 534424 - RNA, 63 nt, Human; identical to SEQ ID NO: 534185

SEQ ID NO: 534425 - RNA, 63 nt, Human; identical to SEQ ID NO: 534186

SEQ ID NO: 534426 - RNA, 63 nt, Human; identical to SEQ ID NO: 534187

SEQ ID NO: 534427 - RNA, 63 nt, Human; identical to SEQ ID NO: 534188

SEQ ID NO: 534428 - RNA, 63 nt, Human; identical to SEQ ID NO: 534189

SEQ ID NO: 534429 - RNA, 63 nt, Human; identical to SEQ ID NO: 534190

SEQ ID NO: 534430 - RNA, 63 nt, Human; identical to SEQ ID NO: 534191

SEQ ID NO: 534431 - RNA, 63 nt, Human; identical to SEQ ID NO: 534192

SEQ ID NO: 534432 - RNA, 63 nt, Human; identical to SEQ ID NO: 534193

SEQ ID NO: 534433 - RNA, 63 nt, Human; identical to SEQ ID NO: 534194

SEQ ID NO: 534434 - RNA, 63 nt, Human; identical to SEQ ID NO: 534195

SEQ ID NO: 534435 - RNA, 63 nt, Human; identical to SEQ ID NO: 534196

SEQ ID NO: 534436 - RNA, 63 nt, Human; identical to SEQ ID NO: 534197

SEQ ID NO: 534437 - RNA, 51 nt, Human; identical to SEQ ID NO: 534198

SEQ ID NO: 534438 - RNA, 63 nt, Human; identical to SEQ ID NO: 534199

SEQ ID NO: 534439 - RNA, 63 nt, Human; identical to SEQ ID NO: 534200

SEQ ID NO: 534440 - RNA, 63 nt, Human; identical to SEQ ID NO: 534201

SEQ ID NO: 534441 - RNA, 63 nt, Human; identical to SEQ ID NO: 534202

SEQ ID NO: 534442 - RNA, 63 nt, Human; identical to SEQ ID NO: 534203

SEQ ID NO: 534443 - RNA, 63 nt, Human; identical to SEQ ID NO: 534204

SEQ ID NO: 534444 - RNA, 63 nt, Human; identical to SEQ ID NO: 534205

SEQ ID NO: 534445 - RNA, 63 nt, Human; identical to SEQ ID NO: 534206

SEQ ID NO: 534446 - RNA, 63 nt, Human; identical to SEQ ID NO: 534207

SEQ ID NO: 534447 - RNA, 63 nt, Human; identical to SEQ ID NO: 534208

SEQ ID NO: 534448 - RNA, 63 nt, Human; identical to SEQ ID NO: 534209

SEQ ID NO: 534449 - RNA, 63 nt, Human; identical to SEQ ID NO: 534210

SEQ ID NO: 534450 - RNA, 61 nt, Human; identical to SEQ ID NO: 534211

SEQ ID NO: 534451 - RNA, 63 nt, Human; identical to SEQ ID NO: 534212

SEQ ID NO: 534452 - RNA, 63 nt, Human; identical to SEQ ID NO: 534213

SEQ ID NO: 534453 - RNA, 63 nt, Human; identical to SEQ ID NO: 534214

SEQ ID NO: 534454 - RNA, 63 nt, Human; identical to SEQ ID NO: 534215

SEQ ID NO: 534455 - RNA, 63 nt, Human; identical to SEQ ID NO: 534216

SEQ ID NO: 534456 - RNA, 63 nt, Human; identical to SEQ ID NO: 534217

SEQ ID NO: 534457 - RNA, 63 nt, Human; identical to SEQ ID NO: 534218

SEQ ID NO: 534458 - RNA, 61 nt, Human; identical to SEQ ID NO: 534219

SEQ ID NO: 534459 - RNA, 63 nt, Human; identical to SEQ ID NO: 534220

SEQ ID NO: 534460 - RNA, 63 nt, Human; identical to SEQ ID NO: 534221

SEQ ID NO: 534461 - RNA, 63 nt, Human; identical to SEQ ID NO: 534222

SEQ ID NO: 534462 - RNA, 63 nt, Human; identical to SEQ ID NO: 534223

SEQ ID NO: 534463 - RNA, 63 nt, Human; identical to SEQ ID NO: 534224

SEQ ID NO: 534464 - RNA, 63 nt, Human; identical to SEQ ID NO: 534225

SEQ ID NO: 534465 - RNA, 63 nt, Human; identical to SEQ ID NO: 534226

SEQ ID NO: 534466 - RNA, 63 nt, Human; identical to SEQ ID NO: 534227

SEQ ID NO: 534467 - RNA, 63 nt, Human; identical to SEQ ID NO: 534228

SEQ ID NO: 534468 - RNA, 63 nt, Human; identical to SEQ ID NO: 534229

SEQ ID NO: 534469 - RNA, 63 nt, Human; identical to SEQ ID NO: 534230

SEQ ID NO: 534470 - RNA, 63 nt, Human; identical to SEQ ID NO: 534231

SEQ ID NO: 534471 - RNA, 63 nt, Human; identical to SEQ ID NO: 534232

SEQ ID NO: 534472 - RNA, 63 nt, Human; identical to SEQ ID NO: 534233

SEQ ID NO: 534473 - RNA, 63 nt, Human; identical to SEQ ID NO: 534234

SEQ ID NO: 534474 - RNA, 63 nt, Human; identical to SEQ ID NO: 534235

SEQ ID NO: 534475 - RNA, 63 nt, Human; identical to SEQ ID NO: 534236

SEQ ID NO: 534476 - RNA, 63 nt, Human; identical to SEQ ID NO: 534237

SEQ ID NO: 534477 - RNA, 63 nt, Human; identical to SEQ ID NO: 534238

SEQ ID NO: 534478 - RNA, 63 nt, Human; identical to SEQ ID NO: 534239

SEQ ID NO: 534479 - RNA, 63 nt, Human; identical to SEQ ID NO: 534240

SEQ ID NO: 534480 - RNA, 63 nt, Human; identical to SEQ ID NO: 534241

SEQ ID NO: 534481 - RNA, 63 nt, Human; identical to SEQ ID NO: 534242

SEQ ID NO: 534482 - RNA, 56 nt, Human; identical to SEQ ID NO: 534243

SEQ ID NO: 534483 - RNA, 63 nt, Human; identical to SEQ ID NO: 534244

SEQ ID NO: 534484 - RNA, 63 nt, Human; identical to SEQ ID NO: 534245

SEQ ID NO: 534485 - RNA, 63 nt, Human; identical to SEQ ID NO: 534246

SEQ ID NO: 534486 - RNA, 63 nt, Human; identical to SEQ ID NO: 534247

SEQ ID NO: 534487 - RNA, 63 nt, Human; identical to SEQ ID NO: 534248

SEQ ID NO: 534488 - RNA, 52 nt, Human; identical to SEQ ID NO: 534249

SEQ ID NO: 534489 - RNA, 63 nt, Human; identical to SEQ ID NO: 534250

SEQ ID NO: 534490 - RNA, 63 nt, Human; identical to SEQ ID NO: 534251

SEQ ID NO: 534491 - RNA, 63 nt, Human; identical to SEQ ID NO: 534252

SEQ ID NO: 534492 - RNA, 63 nt, Human; identical to SEQ ID NO: 534253

SEQ ID NO: 534493 - RNA, 63 nt, Human; identical to SEQ ID NO: 534254

SEQ ID NO: 534494 - RNA, 63 nt, Human; identical to SEQ ID NO: 534255

SEQ ID NO: 534495 - RNA, 53 nt, Human; identical to SEQ ID NO: 534256

SEQ ID NO: 534496 - RNA, 63 nt, Human; identical to SEQ ID NO: 534257

SEQ ID NO: 534497 - RNA, 63 nt, Human; identical to SEQ ID NO: 534258

SEQ ID NO: 534498 - RNA, 63 nt, Human; identical to SEQ ID NO: 534259

SEQ ID NO: 534499 - RNA, 63 nt, Human; identical to SEQ ID NO: 534260

SEQ ID NO: 534500 - RNA, 63 nt, Human; identical to SEQ ID NO: 534261

SEQ ID NO: 534501 - RNA, 63 nt, Human; identical to SEQ ID NO: 534262

SEQ ID NO: 534502 - RNA, 63 nt, Human; identical to SEQ ID NO: 534263

SEQ ID NO: 534503 - RNA, 63 nt, Human; identical to SEQ ID NO: 534264

SEQ ID NO: 534504 - RNA, 63 nt, Human; identical to SEQ ID NO: 534265

SEQ ID NO: 534505 - RNA, 63 nt, Human; identical to SEQ ID NO: 534266

SEQ ID NO: 534506 - RNA, 63 nt, Human; identical to SEQ ID NO: 534267

SEQ ID NO: 534507 - RNA, 63 nt, Human; identical to SEQ ID NO: 534268

SEQ ID NO: 534508 - RNA, 63 nt, Human; identical to SEQ ID NO: 534269

SEQ ID NO: 534509 - RNA, 63 nt, Human; identical to SEQ ID NO: 534270

SEQ ID NO: 534510 - RNA, 63 nt, Human; identical to SEQ ID NO: 534271

SEQ ID NO: 534511 - RNA, 63 nt, Human; identical to SEQ ID NO: 534272

SEQ ID NO: 534512 - RNA, 63 nt, Human; identical to SEQ ID NO: 534273

SEQ ID NO: 534513 - RNA, 63 nt, Human; identical to SEQ ID NO: 534274

SEQ ID NO: 534514 - RNA, 63 nt, Human; identical to SEQ ID NO: 534275

SEQ ID NO: 534515 - RNA, 63 nt, Human; identical to SEQ ID NO: 534276

SEQ ID NO: 534516 - RNA, 64 nt, Human
guccccagcacguccagggugggugcucccuugcccgacagaaccauccccacugugaggcugu

SEQ ID NO: 534517 - RNA, 64 nt, Human
agaggccccaauggggcggugaccccagccucgcccgacagagcccggggcgcaggcgggcgcc

SEQ ID NO: 534518 - RNA, 64 nt, Human
auccuucggaccucaccacgcgaaacuacgcccgccgacagaaacaucugcaaagauacagucu

SEQ ID NO: 534519 - RNA, 64 nt, Human
acaaguggagggggugucuggaagcugagcaggcccgacagagagaugaagccaucagaaggac

SEQ ID NO: 534520 - RNA, 64 nt, Human
acacggaaguucauacuugaaugcugaauuggccccgacagauuaaaugcguguuggggauugg

SEQ ID NO: 534521 - RNA, 64 nt, Human
ccuggggccguguccaaggugccaaugaugcgggccgacagagcgggccgcacugucugucugu

SEQ ID NO: 534522 - RNA, 64 nt, Human
guucagcggaaaugggaugugagaaugaugaaacccgacagaaguaucucagccugcagucagu

SEQ ID NO: 534523 - RNA, 64 nt, Human
agggggccagcgggagcagggccugcaugagaccccgacagaaggugggggggggggggcucug

SEQ ID NO: 534524 - RNA, 64 nt, Human
gggugagccuccacaugggugcugaagcaagaaaccgacagauguugaggagaauggugugacc

SEQ ID NO: 534525 - RNA, 64 nt, Human
caaaagagggugcugccccuagccugggcccccaccgacagacugcagcugcguuacugugcug

SEQ ID NO: 534526 - RNA, 64 nt, Human
cugcaguccugccaacguuggacacugaggacgcccgacagagcuugugcaccuaagcugcaga

SEQ ID NO: 534527 - RNA, 64 nt, Human
aaaccucugcacccugaagguagccauacagaugccgacagauccacaaaggaacaauaaagcu

SEQ ID NO: 534528 - RNA, 64 nt, Human
uguucuaagagaagaauugcuucuuuauacagcuccgacagaagcaggaguccgaguuaaaccu

SEQ ID NO: 534529 - RNA, 53 nt, Human
ugcaacccaagcaggacugacgcccgacagacuccacccuaacagucucaagc

SEQ ID NO: 534530 - RNA, 64 nt, Human
uagggcagccuggugagaggggccuagcucgcugccgacagaagucacugccuaccucaggguc

SEQ ID NO: 534531 - RNA, 64 nt, Human
ccugcuagacugagugacugcaguuaggagggauccgacagagaagaccauuuccacucauucc

SEQ ID NO: 534532 - RNA, 64 nt, Human
guuucagagcagagcuccuggccagagcguuugaccgacagacaauucacauccauaugccagg

SEQ ID NO: 534533 - RNA, 64 nt, Human
ccucugcccugaucgucacaacccucaggaaccaccgacagaaagaaagaaacacaaaaacaug

SEQ ID NO: 534534 - RNA, 64 nt, Human
gccaggcuuuucucaggagcuucaaugaguauggccgacagacauggacaaggagcuguguuca

SEQ ID NO: 534535 - RNA, 64 nt, Human
aggaagcgugaaggccgagaagcaagaaagaaacccgacagagggaagaaaagagcuuucuucc

SEQ ID NO: 534536 - RNA, 64 nt, Human
uggauguagauuuuguuuuuaucauugauuuguaccgacagaaauagacauuucaucauguaaa

SEQ ID NO: 534537 - RNA, 64 nt, Human
gucaugagcuaugccgacagucagcagcugauccccgacagaaacgcagcagaugcagacggug

SEQ ID NO: 534538 - RNA, 64 nt, Human
uccacccacagagaaaugccucugugcgagugcaccgacagaaaacugucagcucugcuuucua

SEQ ID NO: 534539 - RNA, 64 nt, Human
gugaagcaccaagcucaaagcguggacaggugugccgacagaaggaaccagcguguauaugagg

SEQ ID NO: 534540 - RNA, 64 nt, Human
gugccuuugucagcucuucuuucaaaagaccccaccgacagaccgcauuccacccccaacaucg

SEQ ID NO: 534541 - RNA, 64 nt, Human
cccgccgcugacugcgccaggaugcacagaccgaccgacagaccucagugcccaccacgggcug

SEQ ID NO: 534542 - RNA, 64 nt, Human
cccccacccccacacgcacuuuaugagggagaccccgacagaggacgcuugagccagaaucuca

SEQ ID NO: 534543 - RNA, 60 nt, Human
cgggggccgaaccccaguagcggcuccuucccgacagagcugccucucgguggccagcag

SEQ ID NO: 534544 - RNA, 64 nt, Human
agagcccuuaagucuguccuggcuguggcccaugccgacagauaucguggggcugacaggucca

SEQ ID NO: 534545 - RNA, 64 nt, Human
ucugacccuggagcuugggguuggcaccucugccccgacagaauggggcugaaucagcuccagg

SEQ ID NO: 534546 - RNA, 64 nt, Human
aggggauaaagaggaagcaauaaaaaaaaaacauccgacagagcagcucuggcuuugcagccug

SEQ ID NO: 534547 - RNA, 64 nt, Human
uugcuggagguagaggagcuauguggagcaaaggccgacagaggggaaggaauggaccugugag

SEQ ID NO: 534548 - RNA, 64 nt, Human
cauguaaucagagcauuagcugcagaaaaaccccccgacagagcccuggcggagaggcaggcgc

SEQ ID NO: 534549 - RNA, 64 nt, Human
ucccaccccggggucagccggccgugugcgucccccgacagacacugugaacggaagacagcag

SEQ ID NO: 534550 - RNA, 64 nt, Human
augagggcggagccacuccuuguaaauucagugcccgacagaugcucuggcacagaugcuuugu

SEQ ID NO: 534551 - RNA, 64 nt, Human
uguaugagcccaauagccaaggguacaaguacuaccgacagaagcuggaggaguuccggaaagc

SEQ ID NO: 534552 - RNA, 64 nt, Human
uguccaggaggagccuggccauggguccuugcccccgacagacagagcagcccccacccgggag

SEQ ID NO: 534553 - RNA, 64 nt, Human
gcagcugggacccagaacugagccugggagggauccgacagaaaagcucagggcgggucuucuc

SEQ ID NO: 534554 - RNA, 64 nt, Human
ccuccaccuccuuccccuucucccucaggcaaccccgacagacaguggcacuccugguccugcu

SEQ ID NO: 534555 - RNA, 64 nt, Human
ucaccaacacggccucccugcagcugcccugccaccgacagaccccgauuaaacccacaccugg

SEQ ID NO: 534556 - RNA, 64 nt, Human
ugcaguaccguguggaaaaugcuuugguguuuacccgacagaggcuuuauuugugcuguaucag

SEQ ID NO: 534557 - RNA, 65 nt, Human
guuuuuuuuuuuuaaguuuguuuuggaaauaacagaaaagauauuuauuggccaggaaguuggug

SEQ ID NO: 534558 - RNA, 65 nt, Human
auuugaagacccaauaaaaauacucaacuuuuuaaaaaagauagugaaguggucuugauugauuu

SEQ ID NO: 534559 - RNA, 65 nt, Human
gacaagaaaugaguucuuacucugauuuuuuuguaaaaagauaauuuuugagacuugaaaaauac

SEQ ID NO: 534560 - RNA, 65 nt, Human
guauuuguuuaaauuguguguauugaagauuaggaaaaagauaguaguuauuuuuccuaaaugaa

SEQ ID NO: 534561 - RNA, 65 nt, Human
uaaauuugucauuuauuauguauaaaauaccauugaaaagauauuacuguuaauuuuuuauuuaa

SEQ ID NO: 534562 - RNA, 65 nt, Human
gucuuugaauaauccacucauuaauuuuuaauaugaaaagauauauauuuguacuuguaagcauu

SEQ ID NO: 534563 - RNA, 65 nt, Human
guuaaaaaucaauuuaaaucaugacuaauaugguaaaaagauaaagcaucaaagcaguauuucuc

SEQ ID NO: 534564 - RNA, 65 nt, Human
auauauacauauauauauauauuuccuaaaagaagaaaagauaccuuucuguucaacuuguauca

SEQ ID NO: 534565 - RNA, 65 nt, Human
aggaaaggcuagguucaguagaugagacauuauuuaaaagauaaauuuaaaaagaugguaaauga

SEQ ID NO: 534566 - RNA, 65 nt, Human
aaugaaaauaaaauaugaaaauaaugaaagaaaugaaaagauagcuuuuaauugugguauauaua

SEQ ID NO: 534567 - RNA, 65 nt, Human
uugacauguauuuuguuaugaauaguuuaucuuccaaaagauauuuugcucuauuuuaaagugua

SEQ ID NO: 534568 - RNA, 65 nt, Human
auugaauaucccacuguauauuauuuuuauauguaaaaagauaaguuuaauacuguaucaggguu

SEQ ID NO: 534569 - RNA, 50 nt, Human; identical to SEQ ID NO: 503709

SEQ ID NO: 534570 - RNA, 65 nt, Human
ccaaggaauugccuccagccugaguccuaggcucuaaaagauauuacauauuugaacuaauagag

SEQ ID NO: 534571 - RNA, 65 nt, Human
acaaaucuuucccacuagccauuuaauaaguuaaaaaaagauacaaaaacaaaaaccuacuaguc

SEQ ID NO: 534572 - RNA, 65 nt, Human
caggcaacauucuucaccacaacgaagaaacagauaaaagauacccaauuuugacuugauuucau

SEQ ID NO: 534573 - RNA, 65 nt, Human
aaugauuuaggaaaugagugugugcaccaaagacaaaaagauauugucuauuguuugugugcuug

SEQ ID NO: 534574 - RNA, 65 nt, Human
agaguucaagcuuggaaauaauggaguuuauagagaaaagauauauuuuuaaaagcucuagguca

SEQ ID NO: 534575 - RNA, 65 nt, Human
aagaucacacaaauaacagcuuucuuauucagugaaaaagauauuuuauuucugauguuuuauuu

SEQ ID NO: 534576 - RNA, 65 nt, Human
uuuucuauuuaaaggaacaagcggggaagggugcuaaaagauaauacguuuauuuauucacacuu

SEQ ID NO: 534577 - RNA, 65 nt, Human
cagauucucagaugggaugaucuggaggaggaggaaaaagauacacucccuuggggcugagcaug

SEQ ID NO: 534578 - RNA, 65 nt, Human
uaauauuaucuuagaaaaauuaauaugcaauuuccaaaagauauuuugguaagacaacaaccucc

SEQ ID NO: 534579 - RNA, 65 nt, Human
gcuguacucuuaauuuuaaggaauuucaaugaaccaaaagauaacugucaauuuauuuggaugga

SEQ ID NO: 534580 - RNA, 65 nt, Human
acuauagggaauauuguauagaaaauaucuucaagaaaagauaggaccaucagugacaguuaagu

SEQ ID NO: 534581 - RNA, 65 nt, Human
accaaaaacauuuuugaggggcacauguggggucaaaaagauagccaauuuccauuacauggguu

SEQ ID NO: 534582 - RNA, 65 nt, Human
uauaaaagaaguauaaggcaaucauauauucauucaaaagauauuuauuuagcaacugcuaugug

SEQ ID NO: 534583 - RNA, 65 nt, Human
uaaucaaugaaauauaauagcuaucuuuugguagcaaaagauauaaauuguauauguuuauacag

SEQ ID NO: 534584 - RNA, 65 nt, Human
ucacacucccaaaaaacucacaaaacauuuugcuaaaaagauaugacugcuugaaauagucucuc

SEQ ID NO: 534585 - RNA, 65 nt, Human
aaaggagaagagauauuuuggguugaaaaaaaguaaaaagauaauguagcugcauuucuuuaguu

SEQ ID NO: 534586 - RNA, 65 nt, Human
uggggauaaguuuagugaggggauuggaauccccaaaaagauaacauuuuucuucugcuuuuaaa

SEQ ID NO: 534587 - RNA, 65 nt, Human
aucuaauuauaucgaaauacaguuauuaaaauguuaaaagauaaguuuguuauauauuaauaugc

SEQ ID NO: 534588 - RNA, 65 nt, Human
ccaaggauuggcagugcuugugcccaaccucguaaaaaagauaaaguuccuuguccucauuacca

SEQ ID NO: 534589 - RNA, 65 nt, Human
auuaguauaaacucauaauaaacucugccuuuaaaaaaagauaaauauuuccuacgucuguucac

SEQ ID NO: 534590 - RNA, 65 nt, Human
gaagcucuuagaaucccaggcggacacccuuucucaaaagauauccccuaagaguccuuucugcu

SEQ ID NO: 534591 - RNA, 65 nt, Human
ccacgcacuguguugggcuuaguaauaaaaaaaagaaaagauaagugcuuguucuagcauaaauu

SEQ ID NO: 534592 - RNA, 65 nt, Human
ucagugccucagacaaauguguauuuaacuuauguaaaagauaagucuggaaauaaaugucuguu

SEQ ID NO: 534593 - RNA, 65 nt, Human
ugcuuuugugcauuacauccucuagagggaacauaaaaagauaccaauaaaauuuuguagcugaa

SEQ ID NO: 534594 - RNA, 65 nt, Human
aaucacuuaaaggcacaaauaggauguacuguugaaaaagauaaagagugcaggugcaguuucau

SEQ ID NO: 534595 - RNA, 65 nt, Human
gcagaucaacuuaaaggauaauaaaauuuuuaaagaaaagauauucuaauguacucucaauaauu

SEQ ID NO: 534596 - RNA, 65 nt, Human
cauuuaaacuuugaugcuuaguuauguugcuggagaaaagauacuuauguuuugcucaucuaacu

SEQ ID NO: 534597 - RNA, 65 nt, Human
aaugaccugcuaauauauuuuaagaacauguuuuaaaaagauacacucuaucacauauuuaagca

SEQ ID NO: 534598 - RNA, 65 nt, Human
auuuauuccacuauuuugcauuuaaaugauaacauaaaagauauaaaaaauuuaaaacugcuauu

SEQ ID NO: 534599 - RNA, 65 nt, Human
uccacuugauuuaguugaucaccaucucagucuucaaaagauaacaucaugaggugugggaaguc

SEQ ID NO: 534600 - RNA, 65 nt, Human
ccugaauauuaacaguguucugauuaaaaacaaaaaaaagauacauaugccuuguaaauggcuca

SEQ ID NO: 534601 - RNA, 65 nt, Human
ccaccacacacacaugcuccaaaagaggaaagaaaaaaagauaauuuuuaggacuugauaauugc

SEQ ID NO: 534602 - RNA, 65 nt, Human
ugagucgcuuugugguauagaagggaguaaggaauaaaagauauagaauaguaaucuaguugaac

SEQ ID NO: 534603 - RNA, 65 nt, Human
auuucuacacacccauagugcacacuuguauauugaaaagauagggaagagagaaacauuuaugg

SEQ ID NO: 534604 - RNA, 65 nt, Human
auaacagacuuugacucuaugaccuaugaagaauaaaaagauaaucugaagguguuugagucaga

SEQ ID NO: 534605 - RNA, 65 nt, Human
caggcucuccacuuugaaacuuuaguuugaauuuuaaaagauaggaaguaauacaguuuaaguuc

SEQ ID NO: 534606 - RNA, 65 nt, Human
gauucgguguugagcucuguguuguauuacuuccuaaaagauaaugcuuaaacauuaagcauuag

SEQ ID NO: 534607 - RNA, 65 nt, Human
gcuguuugucccuuuacuggguuugggggguuguuaaaagauagggaaugaagaaugcaaaaugg

SEQ ID NO: 534608 - RNA, 65 nt, Human
uuuucugugggaaucacaagaguuuauccacuaaaaaaagauauguaaaaaagauacuuuccagc

SEQ ID NO: 534609 - RNA, 65 nt, Human
ucacaagaguuuauccacuaaaaaaagauauguaaaaaagauacuuuccagcacauaaauaaagg

SEQ ID NO: 534610 - RNA, 65 nt, Human
auguuuguucuauuauucccuuuuuauauagcagcaaaagauaagaauaaaaucacauaaccaag

SEQ ID NO: 534611 - RNA, 65 nt, Human
gagauauaccaauauuuaacauuguuacaaagaagaaaagauacagauuuggugaauuuguuacu

SEQ ID NO: 534612 - RNA, 65 nt, Human
guguauuaauaacuugaaaaggagcauuucacuauaaaagauaaugaaguagguaaugaaaucag

SEQ ID NO: 534613 - RNA, 65 nt, Human
cugaugucagaagaaauggcucgagcucagaagauaaaagauaaguaggguaugcugauccucuu

SEQ ID NO: 534614 - RNA, 65 nt, Human
uuacaaaguggcauauauugcaauuuauuuuaauuaaaagauaccuauuuauauauuucuuuaua

SEQ ID NO: 534615 - RNA, 65 nt, Human
auugaaucuucauuggugcuaaugauggacaguuaaaaagauagcuaguguauauuguuaugggu

SEQ ID NO: 534616 - RNA, 65 nt, Human
auuuuaacuggcuuuaaaacuguaacacaucacauaaaagauacuuuaccagguauguauugcau

SEQ ID NO: 534617 - RNA, 65 nt, Human
ugugaauguuaaguaucaucucuuaucuaaauauuaaaagauaagucaaacauuuucaugagugg

SEQ ID NO: 534618 - RNA, 65 nt, Human
ugauuacgguccucuuucucacauacugcaaacuuaaaagauacauacaccaaauauaggucugu

SEQ ID NO: 534619 - RNA, 65 nt, Human
agcccaucugcagagcaaugacugugcucaccaguaaaagauaaccuuucuuucugaaauaguca

SEQ ID NO: 534620 - RNA, 65 nt, Human
aaucauuaauuaauauaagcauaggaaauggucuuaaaagauacugcauucauucaucagauauu

SEQ ID NO: 534621 - RNA, 65 nt, Human
cuucaaaaauauuuauauugucacucauuuacguaaaaagauauuucuaauuuacuguugcccau

SEQ ID NO: 534622 - RNA, 65 nt, Human
caacacucugucuccaaaaaaaaguuucugaagguaaaagauauacuaaaggauauacauauacu

SEQ ID NO: 534623 - RNA, 65 nt, Human
ggaggugggcauggauaguguggaguggggggaagaaaagauaggggggaugaauacuaggggaa

SEQ ID NO: 534624 - RNA, 65 nt, Human
uuaccuuaaaguuacggaauacuuuguuuuaaaggaaaagauaauaaguuuaguuauaucuuuuu

SEQ ID NO: 534625 - RNA, 65 nt, Human
uuaucaacagaauuuguguguuuucgauuuaagcuaaaagauaauuuaagaacauuuauuucccc

SEQ ID NO: 534626 - RNA, 65 nt, Human
gugugaaaagucuggggauuucaaacugaaaauccaaaagauaaguaaaugagugggaacucucu

SEQ ID NO: 534627 - RNA, 65 nt, Human
ugccagaaauagggauggaagugcauccucugggaaaaagauaauggcuucugauucaacauagc

SEQ ID NO: 534628 - RNA, 65 nt, Human
accuugaauacaggagcccucuccucauagugcugaaaagauacugaugcauugaccucauuuca

SEQ ID NO: 534629 - RNA, 65 nt, Human
uuucauaccaaugaaaucuuacuuuucagugacugaaaagauagaauuuauuugcuaauaaucau

SEQ ID NO: 534630 - RNA, 65 nt, Human
uucaguguaaagugugugauugaaggugauaagggaaaagauaaagaccagaaauucccuuuuca

SEQ ID NO: 534631 - RNA, 65 nt, Human
gucauccucuaauuucuaugacugcauuuuaagggaaaagauaaaauucuuccccuuaaaauucg

SEQ ID NO: 534632 - RNA, 65 nt, Human
aaaacuaccaccuggccuagccuaaguaggaagugaaaagauaauucaccaaacaaugauuaauc

SEQ ID NO: 534633 - RNA, 65 nt, Human
ccugugcugucuuaaugguuuaugucaggaaaugaaaaagauacuguaccaaaucuggaauuaca

SEQ ID NO: 534634 - RNA, 65 nt, Human
gagcauuuuccuucuagucuauuucagccuagaagaaaagauaaugaguaaaacaaauugcguug

SEQ ID NO: 534635 - RNA, 65 nt, Human
aauguaccucuuguuuacauaauuugcauaauuuuaaaagauaauguugccaaacuuuggaaaug

SEQ ID NO: 534636 - RNA, 65 nt, Human
uagacuagugauacaaacuuuaagaaaacaggauaaaaagauacccauugccugugucuacugau

SEQ ID NO: 534637 - RNA, 65 nt, Human
aaaauaauuagcaaaucaaauccagcaauguauaaaaaagauaauaggguuuauuccuggaaagu

SEQ ID NO: 534638 - RNA, 65 nt, Human
gggaaacuguaaauauauuuugcaaauuguuguucaaaagauaauuggaaaaaauugaauauauu

SEQ ID NO: 534639 - RNA, 65 nt, Human
uuugugccuauuuaugaauaaauauuacaaauucuaaaagauaaguguguuugcaaaaaaaaaga

SEQ ID NO: 534640 - RNA, 65 nt, Human
acaguacaguauuuaagugcccauaaggcagcaugaaaagauaacucuaaaguuaagcaugggca

SEQ ID NO: 534641 - RNA, 65 nt, Human
aggaaauuagaucgacuggagaagaaaaaaaagaaaaaagauagaaaaaagaaaaaguuucagaa

SEQ ID NO: 534642 - RNA, 65 nt, Human
agcaaaguagcuuugaauuuucucuguaagagaauaaaagauaaaauaauguauuuucuuuauuu

SEQ ID NO: 534643 - RNA, 65 nt, Human
aaguaauggagucuuuuuuuuggcaggucugcaguaaaagauaacauuuucuuuucuuaguccuc

SEQ ID NO: 534644 - RNA, 65 nt, Human
uucauggagguucaccuuugugacugauuggugauaaaagauagccaagugucuuacaagcagcu

SEQ ID NO: 534645 - RNA, 65 nt, Human
agugaguagggaaaaaaaucuacaguagauaaagcaaaagauaauuaggcaacaaagcauuuuca

SEQ ID NO: 534646 - RNA, 65 nt, Human
uuuuuauauccagucauaaaguugacuuucagcacaaaagauacuuauaaacaaauaaaaaauuu

SEQ ID NO: 534647 - RNA, 65 nt, Human
auguguaacuuuuuuuuaguauuugcccggggggaaaaagauauuguauuaucauauaugcuuuu

SEQ ID NO: 534648 - RNA, 65 nt, Human
cauauuugacuuugcuuaugcaggccauaaguuccaaaagauaauuucccugcccacaaaggcau

SEQ ID NO: 534649 - RNA, 65 nt, Human
aaaaacauuuuuacugcugcuuaguuuuuggacugaaaagauauuaaaacucaagaaggaccaag

SEQ ID NO: 534650 - RNA, 65 nt, Human
ugaaauagacuacuguacacgucuaccuagguucaaaaagauaacugucuugcuuucauggaaua

SEQ ID NO: 534651 - RNA, 65 nt, Human
uuaaaguuuguacacagguaacaaaaaguuacuuuaaaagauauauaaagggcuguaagcuaauu

SEQ ID NO: 534652 - RNA, 65 nt, Human
uucaguuuucucuugggaagaguuuuauguuguuuaaaagauauuuugauaacuuaaccugcuuu

SEQ ID NO: 534653 - RNA, 65 nt, Human
uuuuauauaugagugggauacucaaucuggccuuaaaaagauacacaaagaugggcugugggucc

SEQ ID NO: 534654 - RNA, 65 nt, Human
agagaacugacugaacuugggaaauaauuugaacaaaaagauaaaucuucacagauaugaauacu

SEQ ID NO: 534655 - RNA, 65 nt, Human
aagaugauacagguaagauuggaacucaugaagacaaaagauaagacaguggcauagaguuaaua

SEQ ID NO: 534656 - RNA, 65 nt, Human
uggcacagaucuuugagaaucucauacaucugugaaaaagauaaugugaaauaaacaguaaaaaa

SEQ ID NO: 534657 - RNA, 65 nt, Human
aaagagaaaaaaguuucugaaaacaaugaaaccauaaaagauaauauucuaaaaacugagaaauc

SEQ ID NO: 534658 - RNA, 65 nt, Human
ggccuuuugaucuguccaggagaacagaagggaaaaaaagauacuugaaagaaacugaaggaaau

SEQ ID NO: 534659 - RNA, 65 nt, Human
ccaugggccagccuagcccuugucccuuuuaauauaaaagauauauauauauauauauauauaua

SEQ ID NO: 534660 - RNA, 65 nt, Human
gguguuagaaaucaacaaaacuccuuuuuaaaaagaaaagauauuaagccugccuacuucuacaa

SEQ ID NO: 534661 - RNA, 65 nt, Human
uaguuagcgauuuacuacaauuucagagcuuuaacaaaagauaaaaauaaaucgucaccaauugu

SEQ ID NO: 534662 - RNA, 65 nt, Human
uuccuucauccuugugacauuucauuucaguaaggaaaagauaacaaagugcaauuaucagcauu

SEQ ID NO: 534663 - RNA, 65 nt, Human
cuuaucuuugcagcugaguacuuaaauucuuuuuaaaaagauacccuuuggauugaucacauugu

SEQ ID NO: 534664 - RNA, 65 nt, Human
uguucauuuaaucugccuguuuugaucuguuuugaaaaagauaaagagccucaaaucagaccagc

SEQ ID NO: 534665 - RNA, 65 nt, Human
aaacuguuccauuuguuuauguaaagugauauuaaaaaagauauaaacuauaacuguccguuacu

SEQ ID NO: 534666 - RNA, 65 nt, Human
aaagauauaaacuauaacuguccguuacuuuuggcaaaagauacaaccacauaauguauauaauu

SEQ ID NO: 534667 - RNA, 65 nt, Human
gaggcaauaguaucaauauccuaaauguagaaauuaaaagauacuguauaauuuuaugccuuugc

SEQ ID NO: 534668 - RNA, 65 nt, Human
cuucccuucaaggucauuuacuuguacgagacagaaaaagauagcauuggggacaugggaugggg

SEQ ID NO: 534669 - RNA, 65 nt, Human
uauuauuaaucuucugacauuuucuuauguuuuuaaaaagauaagagcaucuagugcauuaaaug

SEQ ID NO: 534670 - RNA, 65 nt, Human
aacuguaguuaacuaugguuuuuuauuagucuauuaaaagauacguggagauauuaaauuauacc

SEQ ID NO: 534671 - RNA, 65 nt, Human
cagaauuguaggggcuggccugagcuguuuauuucaaaagauacuauucaauuuaaagcuauuuu

SEQ ID NO: 534672 - RNA, 65 nt, Human
auguucucuaucauuuaauaauauacuuguggacuaaaagauauaagugcuguauaaaaucagcc

SEQ ID NO: 534673 - RNA, 65 nt, Human
cuguucagccggcacugagaagaacgaacacaagaaaaagauaagaaauacuagaguaaaggcca

SEQ ID NO: 534674 - RNA, 65 nt, Human
aguuuucuuuuuaucuuauuuuuacucguccguugaaaagauaaucaaggccuacauuuuagcug

SEQ ID NO: 534675 - RNA, 65 nt, Human
uaguucaaaagucagaaaugauucuaauuuaaacaaaaagauacuaaauauacagaaguuaaauu

SEQ ID NO: 534676 - RNA, 65 nt, Human
aauuugacauaggaugagagucagaguauagguuuaaaagauaaaaucuuuaguuaauaauuuug

SEQ ID NO: 534677 - RNA, 65 nt, Human
gcuuuugugauugaaaagacccuaucaagaaggugaaaagauaaccugcagaaugggagaaaaua

SEQ ID NO: 534678 - RNA, 65 nt, Human
uuguuggagugaagcauuuaaaagaguaaggguaaaaaagauaaaguccugaaccuuucaaaaug

SEQ ID NO: 534679 - RNA, 65 nt, Human
gauuacuguaagccaguuuuagcugcacugauuucaaaagauauaagaauauuacuauccuucaa

SEQ ID NO: 534680 - RNA, 65 nt, Human
aaggagacauuuugcuguuacauucugccaggggcaaaagauacuaggcccaggagucaagaaaa

SEQ ID NO: 534681 - RNA, 65 nt, Human
gcguaagccuugaauaccagguagccucaggagugaaaagauaaauguccuagaucauuaccuua

SEQ ID NO: 534682 - RNA, 65 nt, Human
cagacucugucucaaaaaaaaaaaaaaagaaaagaaaaagauaaagggauugugaaaagagcauu

SEQ ID NO: 534683 - RNA, 65 nt, Human
aaauacugaaguuaagugcauuguuuucaggaaucaaaagauaaaggggccgggugugguggcuc

SEQ ID NO: 534684 - RNA, 65 nt, Human
cauuaaaacaaccaagacaaagaaaggaggggaaaaaaagauaaaaagcaagccaggguucccug

SEQ ID NO: 534685 - RNA, 65 nt, Human
aauccuugauuuaaugaaauuaaauuuuuuauuucaaaagauaggcuucuguuuaucaaaggcgu

SEQ ID NO: 534686 - RNA, 65 nt, Human
aucuagccaucaucaaggugcuauaagaguuguauaaaagauauuuuuggcauuucuaggcaagu

SEQ ID NO: 534687 - RNA, 65 nt, Human
guuaaguugcagcauaaauccaagggcccacugggaaaagauacugucggguuuuuccauucagc

SEQ ID NO: 534688 - RNA, 65 nt, Human
auaauugaguuuuauagcacuauuuucagaauacgaaaagauacacaaucauucuguuuuuugaa

SEQ ID NO: 534689 - RNA, 65 nt, Human
uguagagacugaaugugaagucaagucugagcacaaaaagauaaugcacgaugagauugccuacc

SEQ ID NO: 534690 - RNA, 65 nt, Human
auuucagcuaaaaauggagucuaauauauuguuucaaaagauacauuuuuacccaccauaaaugu

SEQ ID NO: 534691 - RNA, 65 nt, Human
aaagaucacaccacaauguuuucaagaaacaucugaaaagauaaaacaaagaacaaauaacuuau

SEQ ID NO: 534692 - RNA, 65 nt, Human
uucugcuggaucucaaagaugugccaagccaaggaaaaagauacaagagcagaauaguacuuaaa

SEQ ID NO: 534693 - RNA, 65 nt, Human
agauuuugcaggacccugaucuuuugugguccuguaaaagauacugaggaaugucuuucagccaa

SEQ ID NO: 534694 - RNA, 65 nt, Human
cacuuaauggccuccagguccauccauguuguugcaaaagauaagauuucauuauuuuuuuuugg

SEQ ID NO: 534695 - RNA, 65 nt, Human
aaaaauaaauaauacacucacauguuuccacacccaaaagauauauagagugaaaagucucccuc

SEQ ID NO: 534696 - RNA, 65 nt, Human
ccuacauagaacauacaguugagugggaguaaacaaaaagauaaacaugcguguuaauggcuguu

SEQ ID NO: 534697 - RNA, 65 nt, Human
agcuagcuugcuguuaaaccacauugaagucuguuaaaagauauuuauuuuucuuguaaauaucu

SEQ ID NO: 534698 - RNA, 65 nt, Human
uggacuguguuuccauccuggccuagaggagcaguaaaagauagcauuugguuugacauggccuu

SEQ ID NO: 534699 - RNA, 65 nt, Human
ugcaauacuuuucuuaguaaaggaaaaacagcauaaaaagauaccuggucugccuuguacaagaa

SEQ ID NO: 534700 - RNA, 65 nt, Human
guguguguguguguguguaagaugucuuccuaucaaaaagauaucaaaggcacauggaauauauu

SEQ ID NO: 534701 - RNA, 65 nt, Human
uauaaauuaaaacaaguuacuuuuuucaaauguguaaaagauaaugacuguauuaaacuuuguau

SEQ ID NO: 534702 - RNA, 65 nt, Human
uuugcauacaguuauugacuuuuucccagcugauuaaaagauagucaagaaauucugcaauauag

SEQ ID NO: 534703 - RNA, 65 nt, Human
aauauaaagaggaacuucaauuaugaaaaauuuuuaaaagauauauauaucuauauaucuauaua

SEQ ID NO: 534704 - RNA, 65 nt, Human
auauauauauauaaaauaaauauauauaaaccuaaaaaagauauauuaaaaauauaaaacugcgu

SEQ ID NO: 534705 - RNA, 65 nt, Human
aauacuguguuuaaagcuuuuucucuggaugcaaaaaaagauaagaauaucaggaaaauauaugu

SEQ ID NO: 534706 - RNA, 65 nt, Human
cagauuuuauccacagugucauuuuuuacugucagaaaagauaccccuuuugucauugcaacuau

SEQ ID NO: 534707 - RNA, 65 nt, Human
aaggauuuacgguuugugaaaaauguguacuguggaaaagauaauaaauugaagacauuauugug

SEQ ID NO: 534708 - RNA, 65 nt, Human
uauuuauagccugugguagugcacaugguuaacauaaaagauaacacugguucacaucauacaug

SEQ ID NO: 534709 - RNA, 65 nt, Human
gcauugcacagucccacuaaaccuugugaaagaagaaaagauaacugaaugaagcauuugaguau

SEQ ID NO: 534710 - RNA, 65 nt, Human
uucuccaugaugugacuuccggagauaaaggauucaaaagauaaagacaaaguacgcucagaguu

SEQ ID NO: 534711 - RNA, 65 nt, Human
aaaaaguguauaugcaguaugauaccacuuuuaaaaaaagauaaauuuauagaaaaaaguuuaua

SEQ ID NO: 534712 - RNA, 65 nt, Human
uuuuuuucaacuagcuuccugggguaaacuuuucuaaaagauaaaauggaaaggaacuccaaacu

SEQ ID NO: 534713 - RNA, 65 nt, Human
auuuuuuucuucuuuucuagccuaaaccugagaagaaaagauauuuccucuuuggaaugcugugu

SEQ ID NO: 534714 - RNA, 65 nt, Human
aaggagaugaagagcaucuccaagaagagaugguaaaaagauauauaaauacauauccuucuaag

SEQ ID NO: 534715 - RNA, 65 nt, Human
uuaaaaaauuaaagcugcuaaaauugagugguuaaaaaagauaccuuauccuauuccuccccacc

SEQ ID NO: 534716 - RNA, 65 nt, Human
uuauguaacuguauacugaauucugacaaaauaaaaaaagauaccuuauugacgaaauauuuagg

SEQ ID NO: 534717 - RNA, 65 nt, Human
aauauugcaaauggucaauucgauuuuaauuucucaaaagauacucuguuauccagaagauuaaa

SEQ ID NO: 534718 - RNA, 65 nt, Human
aacagaaagagaauguagccauucuagccaccguuaaaagauacacagugagguguuguguuuug

SEQ ID NO: 534719 - RNA, 65 nt, Human
uaaucuaaaaagcauauaaaaguuucacacagcauaaaagauaccaaaauaucauaugguugaaa

SEQ ID NO: 534720 - RNA, 65 nt, Human
aagaauugauaucaauucaaaacauagaaaacuguaaaagauaaaucaggagauggcugauucau

SEQ ID NO: 534721 - RNA, 65 nt, Human
uauuggcaauaccuagugauacggauuuagcuaacaaaagauaugaagaacuauuauauugaggc

SEQ ID NO: 534722 - RNA, 65 nt, Human
uuucauaauccauuuagcaauccaggccucuguugaaaagauaauaugagggagaagggaacaca

SEQ ID NO: 534723 - RNA, 65 nt, Human
uuauaauguaauauauaaacuaaaauuuauggcacaaaagauaaauauggcuuugaaauuaaaga

SEQ ID NO: 534724 - RNA, 65 nt, Human
gauuacaguguaaagucuccauuuaaccuguuuauaaaagauacaaggccacacuaaacuacuca

SEQ ID NO: 534725 - RNA, 65 nt, Human
ccuguguacuuuuucuuuuuaugugaaaauuuaauaaaagauacccugucuuguaaacucuauuu

SEQ ID NO: 534726 - RNA, 65 nt, Human
agaagcauagccuugaaggaccugacagcaguaugaaaagauaaauaggccaggcaugguggcuc

SEQ ID NO: 534727 - RNA, 65 nt, Human
ccaaaaaggauuuugaagcugauccuauuuaguuaaaaagauaauuuugcuuucaacuguagguc

SEQ ID NO: 534728 - RNA, 65 nt, Human
aaguuagagaaaagauggauuuaaugagauaaaugaaaagauauuuaaccuaauauaucaaggca

SEQ ID NO: 534729 - RNA, 65 nt, Human
cgggcuuuugaacagaagaguaaauacagaauugaaaaagauaaacacucaaccaaacaauguga

SEQ ID NO: 534730 - RNA, 65 nt, Human
agccagaaaaguccccacuauuuuacuaacuuguuaaaagauaucuauauaauugccuggccuua

SEQ ID NO: 534731 - RNA, 65 nt, Human
ugcuugauuuguuaacuucuaccuccaacccacaaaaaagauauuugaucugaguuucuaucacu

SEQ ID NO: 534732 - RNA, 65 nt, Human
ccauuucuauagcaugauuucuucaaguaaaaggcaaaagauauaaauuuuauaauugacuugag

SEQ ID NO: 534733 - RNA, 65 nt, Human
aaagucuugcaaugacaagagguuucauggucuuaaaaagauacuuuaugugguugaagaugaaa

SEQ ID NO: 534734 - RNA, 65 nt, Human
auccaucuccuucugccacugaauuucacacuugaaaaagauaaggucaugggggcggaugaaug

SEQ ID NO: 534735 - RNA, 65 nt, Human
ggauaauucuauacauaaaaguuccuacuuguuaaaaaagauacaaaccuuguuuuuccagaagg

SEQ ID NO: 534736 - RNA, 65 nt, Human
ugagagacaaacaucuugucauuuucacuguuuguaaaagauaauucagauuguuugucuccuug

SEQ ID NO: 534737 - RNA, 65 nt, Human
ggcuaccacuguggucgcgugcuacagguuugacaaaaagauaucauguuucgauuuuuuugugu

SEQ ID NO: 534738 - RNA, 65 nt, Human
ucacaguauuuuauucagguuucugcaaaaaaauaaaaagauaacuuuuuuaaacaaacaugaau

SEQ ID NO: 534739 - RNA, 65 nt, Human
acaaguaaauauuacaagaagauaaccuugugguuaaaagauaaggaaaaauaugagauuaugag

SEQ ID NO: 534740 - RNA, 65 nt, Human
uaagagaauuauuauuaaggauugacuagaaccuuaaaagauauauguggauguuuguuuuguac

SEQ ID NO: 534741 - RNA, 65 nt, Human
gucauuugacauuuuuuguuugcugaagugaaaaaaaaagauaaagguuguacgguggucuuuga

SEQ ID NO: 534742 - RNA, 65 nt, Human
ucaaagcugcuuuauucaauaaaaaaaagaaaugaaaaagauauaugaauaugacaaaguauugc

SEQ ID NO: 534743 - RNA, 65 nt, Human
uaucccaaguccauuuuuuccuguacacuacaaacaaaagauauauuagagacuuuugaaaaaug

SEQ ID NO: 534744 - RNA, 65 nt, Human
uaauaauuuguugauaaguuuacauaaacagaaauaaaagauacuaucuuuaccguaguaguuca

SEQ ID NO: 534745 - RNA, 65 nt, Human
aaaugaauuguuuuuguaccuaaccauuguaauccaaaagauaagggugugguuuacaugcuuuu

SEQ ID NO: 534746 - RNA, 65 nt, Human
uugaauauauauucuaguguccacaagauuuagcaaaaagauaaagcuuggguggaauaucauuu

SEQ ID NO: 534747 - RNA, 65 nt, Human
aucuuugguuuuuguguuuugcugcacacaaaaacaaaagauauaaaaauggaucauaaacauuu

SEQ ID NO: 534748 - RNA, 65 nt, Human
auagaaugaaaucucaguaaugaauuaaagcaacaaaaagauauugauuggcaaaaagcaagaua

SEQ ID NO: 534749 - RNA, 65 nt, Human
acauuccuaaaaauguauuugaacauugguucuguaaaagauaauggacuaaaaaaguagagagg

SEQ ID NO: 534750 - RNA, 65 nt, Human
guugaauuacuguaucuuuuacuuuuuuuuuuuugaaaagauaaacuuguaaauagagugauuug

SEQ ID NO: 534751 - RNA, 65 nt, Human
ggucauuuguagauauauauuuccaaauauucuaaaaaagauacuguauaugucaaaaauauuuu

SEQ ID NO: 534752 - RNA, 65 nt, Human
gugagccaccgcacccggccugaaaauauuuucuaaaaagauaaaaaauauacauaacgaugaaa

SEQ ID NO: 534753 - RNA, 65 nt, Human
acucugcauuuuaaucuguuuaguagucauuuuuuaaaagauaaucaguuuuccaaauauaucua

SEQ ID NO: 534754 - RNA, 65 nt, Human
aaaacuguuuguuggcucacagaaguucugacaauaaaagauacuagcuaacacgcuguguguuu

SEQ ID NO: 534755 - RNA, 65 nt, Human
gcuauggaaauacaguguuguccaucuuaguaaauaaaagauaauuucagaaacaugaacaggau

SEQ ID NO: 534756 - RNA, 65 nt, Human
ggaaaccauuugugaauuuacagacuccaaaaacaaaaagauaauuuagagucucaaaguaagau

SEQ ID NO: 534757 - RNA, 65 nt, Human
guaucauacucuucuaaaacuugaguggcugucuuaaaagauauaaggggaaagauaauauuguc

SEQ ID NO: 534758 - RNA, 65 nt, Human
uaaaguacuguuucaguacauucagagaacuagauaaaagauauaacuuaagcuuugauaguggc

SEQ ID NO: 534759 - RNA, 65 nt, Human
acuuuaucaguauuuuaaaaauguuaaugcaggagaaaagauaucacaacucuauggaaaaugac

SEQ ID NO: 534760 - RNA, 65 nt, Human
agcuaaggaaagugaaauuucagugccaauuaauuaaaagauacacugucucucuucauaggacu

SEQ ID NO: 534761 - RNA, 65 nt, Human
uaaauuuaacuccaaguuucuccaugggcaaagucaaaagauaaugcuagguuaugucaauuuuu

SEQ ID NO: 534762 - RNA, 65 nt, Human
agugagugccauaagaaagucaauauauauuguuuaaaagauauuucagucuaggaaagauuuuc

SEQ ID NO: 534763 - RNA, 65 nt, Human
gcaaauuuuaccaaaagauggagaaaagcacauuaaaaagauaccaacauucagaaauucauuuc

SEQ ID NO: 534764 - RNA, 65 nt, Human
aaauuuuagauacuuaacauuuauuuaacuuaaauaaaagauaacugucagauaaaacuuuauuu

SEQ ID NO: 534765 - RNA, 65 nt, Human
agacuuuuugguuaaauaauugagauuuaauuuuuaaaagauauucuuacucauuugcuagguug

SEQ ID NO: 534766 - RNA, 65 nt, Human
aauaguugcagaaggcuuuauauaugcuuauaaugaaaagauauuuuuuguauauugacagcaua

SEQ ID NO: 534767 - RNA, 65 nt, Human
caaugaauugauguuuaguuugcuuuagucauuuaaaaagauauuguaccaggaugugcuauuaa

SEQ ID NO: 534768 - RNA, 65 nt, Human
cuccgucucaaaaaaaaaaaaaaaaaaaaaaaaaaaaaagauacuucuccaaaguguucucaugu

SEQ ID NO: 534769 - RNA, 65 nt, Human
ggugcgccuagacagguacgucuguuuuuuauuuuaaaagauaugcuauguagauauaaguugag

SEQ ID NO: 534770 - RNA, 65 nt, Human
uguccauuggauacuuuccuuuuuaucaucuuaaaaaaagauaacuaguacuaaucauuguagug

SEQ ID NO: 534771 - RNA, 65 nt, Human
agcaaaauguuuaaagacacaacggaauagacccaaaaagauaauuucuaucugauuugcuuuaa

SEQ ID NO: 534772 - RNA, 65 nt, Human
uaaguaucuguuuaaccuguucgugugguauaugaaaaagauaccuaagcacuagaauauccagc

SEQ ID NO: 534773 - RNA, 65 nt, Human
guuagcccccacauggggcugcucuugcuucuacuaaaagauacagcaguuacccccuuauccac

SEQ ID NO: 534774 - RNA, 65 nt, Human
aaaauauucagagccauuuuuuuuaagggaaaugaaaaagauacucuggguuuuuuauacucccc

SEQ ID NO: 534775 - RNA, 65 nt, Human
agcccucuuggggcuccaggauuugcugaaagagaaaaagauaugguuugugaacuggggcauca

SEQ ID NO: 534776 - RNA, 65 nt, Human
ugcucugugaugguaaauaaaauuggagcagacagaaaagauauagcaaaugaagaaauauuuua

SEQ ID NO: 534777 - RNA, 65 nt, Human
ugcuguaaugggcagagcauauuuuuuuuguauuuaaaagauaaacuucaauauggaaugcuaga

SEQ ID NO: 534778 - RNA, 65 nt, Human
ggauguggagcuuccuauucugugaaaaaccaagaaaaagauaugguuguauacucaaauuguac

SEQ ID NO: 534779 - RNA, 65 nt, Human
auaugcugaaaucaagcacgugagaguuuuuguuuaaaagauaagagacacagcauguauuaugc

SEQ ID NO: 534780 - RNA, 65 nt, Human
uaaaaauguguuuucaagcuguuguuuuaagaagcaaaagauaguucugcaaauucaaagauaca

SEQ ID NO: 534781 - RNA, 65 nt, Human
cauuugaagcaguugauauaauggguuuauacuuuaaaagauagacauggugccaugaaguuggg

SEQ ID NO: 534782 - RNA, 65 nt, Human
acacaguguuugucuuccacagggaagcuuaaaacaaaagauauuuuuaacccacugacagaaca

SEQ ID NO: 534783 - RNA, 65 nt, Human
agagaacucugcacuaugaacccaaacccagcucaaaaagauaaaaucuagucauuuaagauaau

SEQ ID NO: 534784 - RNA, 65 nt, Human
agaaacugaggggacauaaucaucacucaguagguaaaagauaccuuuuguaaaguugucaucuc

SEQ ID NO: 534785 - RNA, 65 nt, Human
cuuuacuguaauauaaaguauucaacaauuucaauaaaagauaaauuauuaauuggguguuacca

SEQ ID NO: 534786 - RNA, 65 nt, Human
acaugggugggaccagaaaucuuuaugaauaaaugaaaagauaagggauuuggaagccacagguu

SEQ ID NO: 534787 - RNA, 65 nt, Human
acguuuucuuugauuuuuaauuuuuuuuuuuuauuaaaagauaccaguaugagaugaaaacuucc

SEQ ID NO: 534788 - RNA, 65 nt, Human
ggggaaagagagagagaaaagagcagauuuuaaaaaaaagauaugacugagcauugcucagauca

SEQ ID NO: 534789 - RNA, 65 nt, Human
aggaauauaguuucauuucauugcaaaggcaguauaaaagauauauaaaauagcauaauaugaga

SEQ ID NO: 534790 - RNA, 65 nt, Human
uauuuuuuuaugagcaauaucaauuuggagugaccaaaagauacuuaaaaauggguuuauuuuga

SEQ ID NO: 534791 - RNA, 65 nt, Human
uagagauuuuguaauaucauucuaaauagauuaagaaaagauauaauuucuuuacugcaguuaaa

SEQ ID NO: 534792 - RNA, 64 nt, Human
cuuucuuuaucuccuuggaauuaaagagggcuuuuaaaagauaauuugacugauccaugcuucu

SEQ ID NO: 534793 - RNA, 65 nt, Human
ugcuauaaaaacacugaagacugcuuauuucuuuaaaaagauacaacucaucuuaccaagaccaa

SEQ ID NO: 534794 - RNA, 65 nt, Human
ucuacccuuucccaguuagguuugcuuuuugaccaaaaagauaacaaauaccagguauggcaagu

SEQ ID NO: 534795 - RNA, 65 nt, Human
aaauauguagaaacauuacuaugaaaucaguuuuuaaaagauauacuuucucuuuguccugaggu

SEQ ID NO: 534796 - RNA, 65 nt, Human
gggggacagagcaagacucuaucuccaaaaaacaaaaaagauaagcagcuuuagaauauggcgca

SEQ ID NO: 534797 - RNA, 65 nt, Human
auaugaaguaucuguuuuugaaauucacuuuauuuaaaagauaagcagcugacugggcacggugc

SEQ ID NO: 534798 - RNA, 65 nt, Human
aggagagggugcacauguuuuuauguggaguguuuaaaagauaaauuuauaccacuguaaugugc

SEQ ID NO: 534799 - RNA, 65 nt, Human
agaauauuacauuuauuucuggaaguguguuuucaaaaagauauuuacauagucuguaaacuaga

SEQ ID NO: 534800 - RNA, 65 nt, Human
caaggaagucugcucuguacaauugucccucauuuaaaagauauauuaagcuuuucuuuucuguu

SEQ ID NO: 534801 - RNA, 65 nt, Human
aaauauaguaaacacuuggaaaugguggugcuuuaaaaagauauuaauagauaauaugaaaaucu

SEQ ID NO: 534802 - RNA, 65 nt, Human
uuugacacugugcuaauaguuauauucaguacaugaaaagauacuacuguguugaaagcuuuuua

SEQ ID NO: 534803 - RNA, 65 nt, Human
agaguaucuuauucugcacuuaugcauuaguuaaaaaaagauaaaggauguaucagucaguucuu

SEQ ID NO: 534804 - RNA, 65 nt, Human
ccuuauuuaugucuuauuugaagaugaauagucuuaaaagauaaagacauaaaugggacaauugu

SEQ ID NO: 534805 - RNA, 65 nt, Human
uuccuguugcacugaaacucuuggccauguagaggaaaagauauggaguuauguggauuucauca

SEQ ID NO: 534806 - RNA, 65 nt, Human
uuaugugaaaaaaguugaauguuauaguaaaaaaaaaaagauauuuauguauguacaguuugcua

SEQ ID NO: 534807 - RNA, 65 nt, Human
aaaacaaaaagggagcuauuccagauuuuaaaaauaaaagauauaguaacuaaaagcaguugugg

SEQ ID NO: 534808 - RNA, 65 nt, Human
auaaauauaccugaugcgcuguagaaugaaaauguaaaagauaaccuguauguguuccgagcuuu

SEQ ID NO: 534809 - RNA, 65 nt, Human
aacaaguuaguauuaaugcguuggcccacguagcaaaaagauauuugauuaucuuaaaaauuguu

SEQ ID NO: 534810 - RNA, 65 nt, Human
cagauguuaaaauaaaugguuuggugcuuuuuauaaaaagauaaucucagugcuuuccuccuuca

SEQ ID NO: 534811 - RNA, 65 nt, Human
gcauauaccguaacauucuggcaaauaacaauuagaaaagauagguuuaacaaaaaaauuuacuu

SEQ ID NO: 534812 - RNA, 65 nt, Human
uguuuuaaaaaaccgaguugguuuuauugaauuuaaaaagauagguaacuaaguagcauuuaaaa

SEQ ID NO: 534813 - RNA, 65 nt, Human
uaaucccuucugucuuucuguucucacaaagauggaaaagauacaagagcuugccggaaauaaag

SEQ ID NO: 534814 - RNA, 65 nt, Human
guaugauaugaaaaaaucaccaauuuuuuacauauaaaagauaccuuuuuaaaaaaauagguuuu

SEQ ID NO: 534815 - RNA, 65 nt, Human
cauuaaaucucuauuuccuaaauaucauucuauacaaaagauauuuuuuaaacgguaaggauuaa

SEQ ID NO: 534816 - RNA, 65 nt, Human
ugagaagugccccuuagaaaguuaaaagaauguagaaaagauacucagucuuaauccuaugcaaa

SEQ ID NO: 534817 - RNA, 65 nt, Human
cuccaaagauugaaagcuuaauaaucuccuaccuaaaaagauaaaauuaauugcaaucuaccaua

SEQ ID NO: 534818 - RNA, 65 nt, Human
gauuauguaagcauuuguacaucuucuuuggaaauaaaagauaaaagagcgauacacaaagcuuu

SEQ ID NO: 534819 - RNA, 65 nt, Human
uuuuuuuuucacguuagaagacaugaagaaauuuuaaaagauaaacaucuauauugugaaccauc

SEQ ID NO: 534820 - RNA, 65 nt, Human
aaaagauaaacaucuauauugugaaccaucagcugaaaagauaaauuuguguucaauauauaggc

SEQ ID NO: 534821 - RNA, 61 nt, Human; identical to SEQ ID NO: 504012

SEQ ID NO: 534822 - RNA, 65 nt, Human
uuuguuuuaaguuuuacuaauuucuauauguaaauaaaagauauaaugauugugcaaauuuauau

SEQ ID NO: 534823 - RNA, 65 nt, Human
cuuuuauaugccuuuuuauauucugaaauuauaacaaaagauacuuucuaacaguaguauuuuua

SEQ ID NO: 534824 - RNA, 65 nt, Human
guggaagacauaauccuuuggaaacuguuaauacuaaaagauauguuucugauacaauagcaaac

SEQ ID NO: 534825 - RNA, 65 nt, Human
guauacugugcaaucaguucuuugaaaaaaaagucaaaagauagagaauacaagaaaaguuuuug

SEQ ID NO: 534826 - RNA, 65 nt, Human
uggauaagcagguuaucacauagcauagaauucuuaaaagauacauguggggaaaaguagucuca

SEQ ID NO: 534827 - RNA, 65 nt, Human
cuucugaaguggcacaaaccuguguuuauauauuuaaaagauacucuaggaugaucacuugugcu

SEQ ID NO: 534828 - RNA, 65 nt, Human
cuuccaagagccugagagugagguggaauuauuuuaaaagauaaauauuauauuauauauauaua

SEQ ID NO: 534829 - RNA, 65 nt, Human
gggaauggauaauuuagaaacaaaccaaaaaaaaaaaaagauauuugaaguguuuuuauaggaga

SEQ ID NO: 534830 - RNA, 65 nt, Human
auuauaaauuuuauaacagaauuaaaguagauuuuaaaagauaaaauguguaauuuuguuuauau

SEQ ID NO: 534831 - RNA, 65 nt, Human
agccaaaugguggaacuaauuuauuucuuuugaggaaaagauaauaaagaauguaauuaaauuua

SEQ ID NO: 534832 - RNA, 65 nt, Human
agauuaccucuugcccuugggugcuaucuagcaguaaaagauaaauuuguugaauauugguaauu

SEQ ID NO: 534833 - RNA, 65 nt, Human
ugaagguaauccaaaggcauccauuuucuaggcuuaaaagauauauuuuugauauauuuaauuau

SEQ ID NO: 534834 - RNA, 65 nt, Human
acuaagacugauauuuuaggccucuuguucacaucaaaagauauuggugucagaauaccagcauu

SEQ ID NO: 534835 - RNA, 65 nt, Human
aauccccgucuuuacaaaaacaaacaaacaaacaaaaaagauauugcaguuguguuguaagcguc

SEQ ID NO: 534836 - RNA, 65 nt, Human
aagaugucauucucuauauggcacuuuaaaggaagaaaagauauguuucucauucuaaaauaugc

SEQ ID NO: 534837 - RNA, 65 nt, Human
aaaaagaaguaaccucagcacuacuauucucucuuaaaagauaagcuauuuaaccccaaacauuu

SEQ ID NO: 534838 - RNA, 65 nt, Human
guauuucaagaucuaguccaaucuuuuucuagagaaaaagauaaucugaagcucacaaagaugaa

SEQ ID NO: 534839 - RNA, 65 nt, Human
caggcauaggcagccuauagggcccaaagaaggcaaaaagauaagauuuacucaaguagcauuug

SEQ ID NO: 534840 - RNA, 65 nt, Human
ugggacaagcaggcuuguuuccaccaauagugccaaaaagauauugccuaaugugcaccugugag

SEQ ID NO: 534841 - RNA, 65 nt, Human
uuugcaugauaggaaaauugagaaagaauacguauaaaagauagagaggcauaacaucaaugcag

SEQ ID NO: 534842 - RNA, 65 nt, Human
ucagaaaauaacagaugcuggugagguuguggagaaaaagauaugcuuauacacuguugguggaa

SEQ ID NO: 534843 - RNA, 65 nt, Human
cccacgaaaauacccagcgcagcaucuacacauucaaaagauaagcugaguguucccaccaggaa

SEQ ID NO: 534844 - RNA, 65 nt, Human
uuugguuuauguuaaauaaaaaaucaguaucauggaaaagauaugaccauaauuuagucuccuca

SEQ ID NO: 534845 - RNA, 65 nt, Human
uccagugcgucucuuuuguuccuggcuuugacaugaaaagauagguuugaguucaaauuuugcau

SEQ ID NO: 534846 - RNA, 65 nt, Human
uuuuaaaguaaagauguauuuauucugaagaaucuaaaagauaacagauuauuugcuuaugaaag

SEQ ID NO: 534847 - RNA, 65 nt, Human
aaaaauucagaacauagcaaauaccuuugaaguauaaaagauaaaauucauuuuuagugaacccu

SEQ ID NO: 534848 - RNA, 65 nt, Human
cucaaaugauauacauuuaaagggcagauuuuuuaaaaagauacuacuauaauaaacauuuccag

SEQ ID NO: 534849 - RNA, 65 nt, Human
aggccaacaguuuccuuauuuacauccuuaccucuaaaagauacuucaaagugacaaaaacgugu

SEQ ID NO: 534850 - RNA, 65 nt, Human
ggaacacauuccacacuuugaaaucuucguggaacaaaagauauuuguggaaccaaucuuugugg

SEQ ID NO: 534851 - RNA, 65 nt, Human
gaaaauuguaaaauagucuucuuuuauacuguaaaaaaagauauaccaaaaagucuuauaauagg

SEQ ID NO: 534852 - RNA, 65 nt, Human
ugaacccauccacucugggcagguaagagaaaagaaaaagauaaggaaagaagagagaagagaga

SEQ ID NO: 534853 - RNA, 65 nt, Human
auuuuucaaagaaaauuauucucaucucaaugccaaaaagauaguuucuacacaucaccugcuug

SEQ ID NO: 534854 - RNA, 65 nt, Human
aaggggacuucaaaaguucacgaaaaaauugaauuaaaagauaaaaauuaaaaaauguuuuauuu

SEQ ID NO: 534855 - RNA, 65 nt, Human
uuuuauguucuuccacaauugaucugauguucaggaaaagauaauaaaggcaaauuaguuagugg

SEQ ID NO: 534856 - RNA, 65 nt, Human
cuaagauuuacauugcacuaugacauaaucccgaaaaaagauacauauacuuaaauagaagugug

SEQ ID NO: 534857 - RNA, 65 nt, Human
acaggaccacaaaaaugaaagcaugucucaauaguaaaagauaacaagaucuuucaggaaagacg

SEQ ID NO: 534858 - RNA, 65 nt, Human
ugaugaaaucguaauucaugguugaguuucagaacaaaagauauucauugcacauuaaccauuua

SEQ ID NO: 534859 - RNA, 65 nt, Human
agccuggacagcuuagugagaucccgucuccgaagaaaagauauguauucuaauuggcagauugu

SEQ ID NO: 534860 - RNA, 65 nt, Human
gaguggggagagaagaagaaauuauuguucaugguaaaagauauuuagcaacuaugguauucuua

SEQ ID NO: 534861 - RNA, 65 nt, Human
uacaucucuacuuauuuaugaacagacuuuuuuuaaaaagauaaaaaaacagcuuuauugaggua

SEQ ID NO: 534862 - RNA, 65 nt, Human
ugauuuuauguacaaugauuuauacucuccuuuugaaaagauaccauaaagcacauaagcuagau

SEQ ID NO: 534863 - RNA, 65 nt, Human
ugaacucuacaacauucugugggauauauuguucaaaaagauauuguuguuuuccaugauuuagc

SEQ ID NO: 534864 - RNA, 65 nt, Human
gacacuuaucagaaucuuccucaagcacuugcuggaaaagauaucagauuggaacuucuuguuua

SEQ ID NO: 534865 - RNA, 65 nt, Human
aaacugggcugagagagcuugaaaguccuuuucauaaaagauaacuauuuccuuuucuuguugaa

SEQ ID NO: 534866 - RNA, 65 nt, Human
uuuauaaacuauauuagagggacuggguuuaaaaaaaaagauauaggguagaaauaagagcuaua

SEQ ID NO: 534867 - RNA, 65 nt, Human
cgaaauuguguuaugacugauagccuucagcuacaaaaagauaggacugaccugguuuaaagugu

SEQ ID NO: 534868 - RNA, 65 nt, Human
gcuaucuuaagaccaauaucucuuuguuuuuaaacaaaagauauuauuuuguguaugaaucuaaa

SEQ ID NO: 534869 - RNA, 65 nt, Human
cauacuguauaauuccauuuacaugaagcauccagaaaagauaaauguauagggacaaaaaguag

SEQ ID NO: 534870 - RNA, 65 nt, Human
uaucggcuuagaaacaugccucauuucuaggaaauaaaagauagaggugagagaugauuuacuuu

SEQ ID NO: 534871 - RNA, 65 nt, Human
aaauucugaccaccuuuuggcuuugaguauuuuccaaaagauauuugaaauccuaaugaggaaau

SEQ ID NO: 534872 - RNA, 65 nt, Human
uuuaaaaauaacuauaauugcauuguuuguaacacaaaagauaaaugcuugaggggaugaauacu

SEQ ID NO: 534873 - RNA, 65 nt, Human
cuguuauauuauaaggauaugcacguuuguucuggaaaagauagaauuugucucuaaaagacuug

SEQ ID NO: 534874 - RNA, 65 nt, Human
uuaauuuugauccugcccucuccagcugcuccuucaaaagauacaucaaaagauagaaacucugg

SEQ ID NO: 534875 - RNA, 65 nt, Human
cugcccucuccagcugcuccuucaaaagauacaucaaaagauagaaacucugggcugggcacagu

SEQ ID NO: 534876 - RNA, 65 nt, Human
ggcgacaagagcaaaacuccgucucaaaaaaaaaaaaaagauacaaagucugcauuugauauaau

SEQ ID NO: 534877 - RNA, 65 nt, Human
gaauuuugcuuaaaaucuauuuuucauaugaaaauaaaagauaacaaucaacuugggucuguccu

SEQ ID NO: 534878 - RNA, 65 nt, Human
aguguggagcauuaacuuguggaugauucagaguuaaaagauaaaaagacgccagaguucucgcu

SEQ ID NO: 534879 - RNA, 65 nt, Human
cucaccacaaagggacuccugugaaacugcugccaaaaagauaccaauaacacuaacaauaccga

SEQ ID NO: 534880 - RNA, 65 nt, Human
uuuuguagcuuuuuguaaauuauuuaaagugauguaaaagauauuuuuggaaaauacuguuguuc

SEQ ID NO: 534881 - RNA, 65 nt, Human
uuuuuacaguuacauccagcuguuagauaugcaggaaaagauaguuugcuggcuagcucuauuca

SEQ ID NO: 534882 - RNA, 65 nt, Human; identical to SEQ ID NO: 534870

SEQ ID NO: 534883 - RNA, 65 nt, Human; identical to SEQ ID NO: 534869

SEQ ID NO: 534884 - RNA, 65 nt, Human
uggcuaaauagacuagucauguccuuacaggucuuaaaagauaacauguaaauguuuuuaaaaug

SEQ ID NO: 534885 - RNA, 65 nt, Human
gcuuuuuccuuauuauaauuugauaaggugauuauaaaagauacauggaaggaaguggaaccaga

SEQ ID NO: 534886 - RNA, 65 nt, Human
ucauauuuacuucuaauucuacucucagaggugcaaaaagauacuuaucuaacuggacacuuuua

SEQ ID NO: 534887 - RNA, 65 nt, Human
ugcucugguuaaaacaguaauaggcacuugaaaaaaaaagauaaauuauugaaugaguaguauua

SEQ ID NO: 534888 - RNA, 65 nt, Human
guugacucuuuuggucaguuuuaacaauucuccuuaaaagauauuuuggagugaugaauguaguu

SEQ ID NO: 534889 - RNA, 65 nt, Human
guaauccuguaacuggguuugaaaaaauaaucaacaaaagauacaauucaaggguuagguugcag

SEQ ID NO: 534890 - RNA, 65 nt, Human
gcaccucugaacccaggcacuuuaaacuucuauagaaaagauaucguguacauaggaacuggugu

SEQ ID NO: 534891 - RNA, 65 nt, Human
gggaauauagagaggguucauguggcauuuuagagaaaagauaauuuauccucauucaacacagg

SEQ ID NO: 534892 - RNA, 65 nt, Human
uguaacucuuucugaggagcuguuacugaauauuaaaaagauagacuucaacuaugugucugaug

SEQ ID NO: 534893 - RNA, 65 nt, Human
gggucaggauagauucauuucuugcaacauaguggaaaagauauaagcugcaguaauuugcucuu

SEQ ID NO: 534894 - RNA, 65 nt, Human
augcauaacucuugggaaguugagcuuugcuaaauaaaagauauuucugcugaucaaagaugauc

SEQ ID NO: 534895 - RNA, 65 nt, Human
uacuucauuuuugcaguacuuuuuaauuuugauaaaaaagauacaaaguucauaauaucaaaaua

SEQ ID NO: 534896 - RNA, 65 nt, Human
guuugcuucaugugcagauaaccaaaaaucauuuuaaaagauaucaaacuuauugaugggcaauu

SEQ ID NO: 534897 - RNA, 65 nt, Human
acuuuugacaaaggaaugaagaacauacacuggggaaaagauaaugucuuuaauaaauggugcug

SEQ ID NO: 534898 - RNA, 65 nt, Human
ugagugauuuaaaaauaaaaccaaaacaaaacacaaaaagauauuccacaggacaugccacuuua

SEQ ID NO: 534899 - RNA, 65 nt, Human
cagguaauuuacuugacuguucuauuuguuuguccaaaagauaaaaugaugagagagauucgaga

SEQ ID NO: 534900 - RNA, 65 nt, Human
acaaacuagagaucaguugacaaaggagaagugacaaaagauaagcugcagaaggaccucagaag

SEQ ID NO: 534901 - RNA, 65 nt, Human
uugaucaccaguuguaccaaaacacuaauuuuugaaaaagauagguuaaaguauuugacaaaagu

SEQ ID NO: 534902 - RNA, 65 nt, Human
acagagcaagacucggucucaaaaacaaaauuuaaaaaagauauaaggcaguacuguaaauucag

SEQ ID NO: 534903 - RNA, 65 nt, Human
aguucucuuaccccacugccacauaccucuguuuuaaaagauaaguccacuaacugugaguaaaa

SEQ ID NO: 534904 - RNA, 65 nt, Human
ugcuccagaauaucuuugagaaugacaacuuaauuaaaagauacuuaggcacuuuuuuuuuuuuu

SEQ ID NO: 534905 - RNA, 65 nt, Human
guauuugcuuguugaaaaaaaaaacuggcaaagugaaaagauacagucaaaaaucuagaauuucu

SEQ ID NO: 534906 - RNA, 65 nt, Human
aagcaauaugauuuguuacuauaauuaaccuguauaaaagauacauuuuauggugguuucaguag

SEQ ID NO: 534907 - RNA, 65 nt, Human
uucguuuucuuuuucauggugccuuucuuucuaagaaaagauagaaagaauggggccagguucau

SEQ ID NO: 534908 - RNA, 65 nt, Human
cauuagguaccuagcagaugugcacaauauaaacaaaaagauaucuggccuaccuuacuacuaaa

SEQ ID NO: 534909 - RNA, 65 nt, Human
gcuagacaccuucgcuuguuaucuugucaagauagaaaagauaguaucauuucacccuugccagu

SEQ ID NO: 534910 - RNA, 65 nt, Human
ugaucuuuaauaacacaucccuauagaaaguggauaaaagauauaccaaaacuguaauacagaua

SEQ ID NO: 534911 - RNA, 65 nt, Human
caacacucugggaaugaggaacaagacuuuuucuaaaaagauaguggaaguucaagggauguacc

SEQ ID NO: 534912 - RNA, 65 nt, Human
gcuuuauucuaauguaucccaaaccuaaucuuuuuaaaagauagaagauacuuuuaagacaacuu

SEQ ID NO: 534913 - RNA, 65 nt, Human
uguccuuuccuucacugauuugcuuuaaaaaaaauaaaagauaaugauuuauugcagaauuauga

SEQ ID NO: 534914 - RNA, 65 nt, Human
gacuuuuucacaaugacuggcacagauuacucagcaaaagauagcaaaacgggugguugaagaua

SEQ ID NO: 534915 - RNA, 65 nt, Human
uguuggugaacaacaaaaaagagaucuauuucuuuaaaagauauuugugcagaaacugcauguaa

SEQ ID NO: 534916 - RNA, 65 nt, Human
uuuuuacugcaacccacaggcccacaguaugcuugaaaagauaaauuauaucaauuuccucauau

SEQ ID NO: 534917 - RNA, 65 nt, Human
aaugaaaugcaguuuuuuuucucguuuuuaauuuaaaaagauauuaaccucaucacuacuaacuc

SEQ ID NO: 534918 - RNA, 65 nt, Human
ucuuaaucuauauucuacccuuauaauaaaagaucaaaagauauaucuccuaugaacagauugga

SEQ ID NO: 534919 - RNA, 65 nt, Human
ccucagaacaugacuccuugggagauccccaucacaaaagauauugauggacuccuaagccaggc

SEQ ID NO: 534920 - RNA, 65 nt, Human
ccuugguuugguaguucuuguuuuuaauaaggggaaaaagauaaaauaaccccuauuuuuccugu

SEQ ID NO: 534921 - RNA, 65 nt, Human
uucacaaugaagcuuccagauagcaccguuuugcuaaaagauacauucucauuguuuuccaacag

SEQ ID NO: 534922 - RNA, 65 nt, Human
aauuuggcaagagaaacaguuuauuaauguuuuugaaaagauaagucauauucauacuuaauacc

SEQ ID NO: 534923 - RNA, 65 nt, Human
cucgguggugacucuucggccccuggggaaaaacaaaaagauauugcugagaugaccucuuuuaa

SEQ ID NO: 534924 - RNA, 65 nt, Human
uuuuuauauuguccuccaccuccaucauuuucaauaaaagauagggcuuuugcucccuuguucuu

SEQ ID NO: 534925 - RNA, 65 nt, Human
cucugucucaaaaaaaauaaaauaaaauaaauaaaaaaagauauaguauuaaugccuguauuuau

SEQ ID NO: 534926 - RNA, 65 nt, Human
uuuuuccuucagcuugaaagcuuuuuuuuaaaaggaaaagauaccaaaugccugcugcuaccacc

SEQ ID NO: 534927 - RNA, 65 nt, Human
auuauauuaaaauauggcuauaaauauauaaaaagaaaagauaaagaugaucuacucagaaauuu

SEQ ID NO: 534928 - RNA, 65 nt, Human
agucaauaugaggauggugguuuauucucagaagaaaaagauauguaaggucuuuuagcuccuua

SEQ ID NO: 534929 - RNA, 65 nt, Human
gggagacuccaucucaaaaaaaaaaaaaaaaaaaaaaaagauaaaaagucagaaaucugaaaagu

SEQ ID NO: 534930 - RNA, 65 nt, Human
gcaagcuaagaaaaaauucuguuuauaaaagaaggaaaagauaguuuauguuuuuagccuaagua

SEQ ID NO: 534931 - RNA, 65 nt, Human
auuggcaaauaagguuuggaagcagaagagcaaaaaaaagauauuguuaaaaugaggccuccaug

SEQ ID NO: 534932 - RNA, 65 nt, Human
aaauguucuuaaauguucucacuacaaaaaaagaaaaaagauaacuacgugaggugauggauaug

SEQ ID NO: 534933 - RNA, 65 nt, Human
ucuccaucaacaaccagggagacugcaccugauggaaaagauauaugacugcuucaugacauucc

SEQ ID NO: 534934 - RNA, 65 nt, Human
ucuuuauacagauaaggucaguagaguuccagaauaaaagauaugacuuuucugaguuauuuaug

SEQ ID NO: 534935 - RNA, 65 nt, Human
uaccucuuaggaaccaaagaaugccucuacaagcaaaaagauaguugaaaauaguuaagauccaa

SEQ ID NO: 534936 - RNA, 65 nt, Human
caguugauugcuccucuggcagagagaaggagcucaaaagauacuugaugucuuucauguaaguu

SEQ ID NO: 534937 - RNA, 65 nt, Human
ggugaacuauuugagggguauggggucuagaaguuaaaagauacgcaugucuucuguucuuuucc

SEQ ID NO: 534938 - RNA, 65 nt, Human
cccugagucaaaaggauagccaaggguggaguggaaaaagauauggugaaggcagaacugcucac

SEQ ID NO: 534939 - RNA, 65 nt, Human
ugguacaguuauuuaacaggcauacacaagcagggaaaagauaauccauuuagaucuuuaaugcu

SEQ ID NO: 534940 - RNA, 65 nt, Human
gucugacagcaacaacggucccacaaacaagucacaaaagauaccguuaaacuuuuuuuuuuuuu

SEQ ID NO: 534941 - RNA, 65 nt, Human
aaaaugauagcuuagaaaacacuagaguucauacuaaaagauauuuugcaaauacacuaaauggg

SEQ ID NO: 534942 - RNA, 65 nt, Human
gggaaagaauuccuacaauauauauucuggcugauaaaagauacauuuguauguugugaagaugu

SEQ ID NO: 534943 - RNA, 65 nt, Human
uuuaacccaaaagauuauuuuuugguuccuaaagaaaaagauauuuuuaaucugucaauuauuuc

SEQ ID NO: 534944 - RNA, 65 nt, Human
gaaaaaaaacuuuuuuuuaaauuaaaaaggaaaauaaaagauauugaggucuuccuaguguuacu

SEQ ID NO: 534945 - RNA, 65 nt, Human
ggccugcuaugucuucccaauguuuauugggcaauaaaagauaagugcagucacagagaacucac

SEQ ID NO: 534946 - RNA, 65 nt, Human
auacuaaaauguaacuuuuuaaucaucugguuuuuaaaagauaaacaguuuagcccaucucucca

SEQ ID NO: 534947 - RNA, 65 nt, Human
gaccgaagccuugugcauaaggauuuuuucccaggaaaagauagacuuuauaaacagugggagcc

SEQ ID NO: 534948 - RNA, 65 nt, Human
augauauguuucguggguugaauugugucccccauaaaagauauguugaaguucuaaccccaggu

SEQ ID NO: 534949 - RNA, 65 nt, Human
ugccuuccaagaguauauguuucuuuaaucaguuuaaaagauaaaggcauuuuggguuuuaagac

SEQ ID NO: 534950 - RNA, 65 nt, Human
aaaaaugccaaccuuagaaaagacaauaaaugcacaaaagauauaaacaggaacagcaaauauuu

SEQ ID NO: 534951 - RNA, 65 nt, Human
uccagcuaacagucccuauggaaagauggcaucaaaaaagauagaucuauauauauauauaaaua

SEQ ID NO: 534952 - RNA, 65 nt, Human
gugaggucccagcucccugauccuaugcucuauuuaaaagauaaccuuuggccuuagacuccguu

SEQ ID NO: 534953 - RNA, 65 nt, Human
aacacagcgagacuccgucucgaggaaaaaaaaagaaaagauacgugccugcggugaggaagcug

SEQ ID NO: 534954 - RNA, 65 nt, Human
cuuuggucagaagccaggaacuggugucauuccuuaaaagauacgugccggggccagguguggug

SEQ ID NO: 534955 - RNA, 65 nt, Human
guugggucuuggcugaaaaaaaaaaaugcuuuuaaaaaagauaaaaugaaaaggagagcucucuu

SEQ ID NO: 534956 - RNA, 65 nt, Human
gugcguuacagaugucugcugaccucacaagagugaaaagauaaacugugcauguguuuccacuu

SEQ ID NO: 534957 - RNA, 65 nt, Human
uguaacaauucaauugaauuuuaaaaugacaccugaaaagauacaucugauauuuucuauauaga

SEQ ID NO: 534958 - RNA, 65 nt, Human
guuuuauauguaguacuaacuaaggucccauaauaaaaagauaguaucuuuuaaaaugaaauguu

SEQ ID NO: 534959 - RNA, 65 nt, Human
accucacaccuguuagguuacaucugcuauugucaaaaagauaagagauagcaagugucagcaag

SEQ ID NO: 534960 - RNA, 65 nt, Human
guccucaggaguauucucuaaccugauauuuucuaaaaagauauguugauucaacuuuguuuagc

SEQ ID NO: 534961 - RNA, 65 nt, Human
accauauuuuaaaaguaccaauuuuguuuuuacagaaaagauaaaacucaaaagagaacagugua

SEQ ID NO: 534962 - RNA, 65 nt, Human
uuaggcuuuugggcauaugcuagucugagcuuccgaaaagauacauauauguuucccuuuucauu

SEQ ID NO: 534963 - RNA, 65 nt, Human
uuucugauggguaacuugcaggaauauucuauuggaaaagauaacaggaaguacaagugcuucuu

SEQ ID NO: 534964 - RNA, 65 nt, Human
auuuguuaaccauuucagagaguuuggcaauuuuuaaaagauaauaagguaucauuuuuaaguau

SEQ ID NO: 534965 - RNA, 65 nt, Human
uaaaauucauuugaaagucugauggcuuuuacaauaaaagauauuaagaauuguuauccuuaacu

SEQ ID NO: 534966 - RNA, 65 nt, Human
uaaaucuauuuuuuaacaaucuuuuuauuauuuguaaaagauauaaaaacaacucccaucaguag

SEQ ID NO: 534967 - RNA, 65 nt, Human
uuccugcaguauaugaaguauuguaccagaguauuaaaagauauguaauauuuuauugauaaauc

SEQ ID NO: 534968 - RNA, 65 nt, Human
cagauggcagguuugcaauccaagcaggaagaaggaaaagauacccaaaggucaagaacacagug

SEQ ID NO: 534969 - RNA, 65 nt, Human
acaggauaacacagauaagggcuuuauuguacaauaaaagauauguaugaaugcaucaguagcug

SEQ ID NO: 534970 - RNA, 65 nt, Human
cauugcuuuuaacugugggacuuaguuaauucuucaaaagauaaagaugaacaggaagaaaaaga

SEQ ID NO: 534971 - RNA, 65 nt, Human
uugagaagugcaaauguucgcauccuuuuguuuuuaaaagauaugaugucagaauaaaaugugga

SEQ ID NO: 534972 - RNA, 65 nt, Human
cuuuucucauuuuccugagaauuuaccagaaaaaaaaaagauacauagauuugucucuguguuuu

SEQ ID NO: 534973 - RNA, 65 nt, Human
caguuugugccuccuacacagucaaagaaagagaaaaaagauaaaguagaaaaagaaaaaaguga

SEQ ID NO: 534974 - RNA, 65 nt, Human
auauuauuauugucaucccaagaaaaaauauauuaaaaagauauuugaaauuucauuauaaaauc

SEQ ID NO: 534975 - RNA, 65 nt, Human
cuaucauguuaauacuauuauugucaucccaagaaaaaagauauuuuaaaaauuuauuugaaaag

SEQ ID NO: 534976 - RNA, 65 nt, Human
cuuuuucuauuggaaaugguuacaaguuauacuccaaaagauauuugaauuaucuugauuggaau

SEQ ID NO: 534977 - RNA, 65 nt, Human
caagccacugcagcuaaguauuaauccccagugcuaaaagauaccaggcaucuaguuuagcaaug

SEQ ID NO: 534978 - RNA, 65 nt, Human
gauagaaaggaauuuuaaauaguuugacacuugaaaaaagauacuauuuauaaguugaagaaagu

SEQ ID NO: 534979 - RNA, 65 nt, Human
gaaaauguaaaaugcucaugaagguuuugaaugccaaaagauauuuuagaaucaauuuauaaagg

SEQ ID NO: 534980 - RNA, 65 nt, Human
aaaaaugcauuuuggcauggugggauggauguugcaaaagauauccggagccuccagucugucau

SEQ ID NO: 534981 - RNA, 65 nt, Human
guauauaaaauacauaaaacaauagauuagaaaucaaaagauaucucuggccugcaauauuuuac

SEQ ID NO: 534982 - RNA, 65 nt, Human
ccuuuugaagacuauacaaggcuucaaaaaagacuaaaagauauacagagaagacauaaugaauu

SEQ ID NO: 534983 - RNA, 65 nt, Human
cacacaaccaaguucaugggaauuuuguguaaaauaaaagauaacaugccugagggagagccugg

SEQ ID NO: 534984 - RNA, 65 nt, Human
caucuaccuaccucaaaggggugguauaagguuuaaaaagauaaagauucagauuuuuuuuaccc

SEQ ID NO: 534985 - RNA, 65 nt, Human
uagacuuaaggcuucauugugggguuaaaaaaaaaaaaagauacaaagaaauaugucucaaaaaa

SEQ ID NO: 534986 - RNA, 65 nt, Human
gaaguucugaaaauggugaauauguggguaaauauaaaagauauuucucucuuuuuaaaaucuuu

SEQ ID NO: 534987 - RNA, 65 nt, Human
ugauaaacagaauacuuuuaaaacaccuugagaaaaaaagauaauacauacacaugaacaaagaa

SEQ ID NO: 534988 - RNA, 65 nt, Human
gagacugcaucucaaaaaagaaaaauaaacgaaguaaaagauauuuaucagagcuguuacaggaa

SEQ ID NO: 534989 - RNA, 65 nt, Human
cucagaauuuacacucacucgcagucauuuauuuaaaaagauaaaacaagauaauggguucuuug

SEQ ID NO: 534990 - RNA, 65 nt, Human
cugugggugggacugcacauucuuuuccucuuaguaaaagauaggcccacuuuauuccaagaaua

SEQ ID NO: 534991 - RNA, 65 nt, Human
guaagacaucucaugucauauaaaaguuaaauguaaaaagauacaguccauuuuguccugcacac

SEQ ID NO: 534992 - RNA, 65 nt, Human
agagauccuuuuucaauguaacaauuauauuuaugaaaagauauguuacacuaacuucucagaag

SEQ ID NO: 534993 - RNA, 65 nt, Human
ggaacauuuauccaggaauugauacguuuauuaggaaaagauauuuuuauaggcuuggauguuuu

SEQ ID NO: 534994 - RNA, 51 nt, Human; identical to SEQ ID NO: 504221

SEQ ID NO: 534995 - RNA, 65 nt, Human
agugaauuuauuuguguguucuuuacuuauauaaaaaaagauaacuuuaaggaugugcaaguaca

SEQ ID NO: 534996 - RNA, 65 nt, Human
ucaguauuccacaggcacaccuuaauuucauuguaaaaagauauauauauuuugucuauuuuugu

SEQ ID NO: 534997 - RNA, 65 nt, Human
uuucuuaauauacuauuauuagaauaguagaggauaaaagauaauguuauccaguuacaaaggaa

SEQ ID NO: 534998 - RNA, 65 nt, Human
ccauaauuucauuuuaauuaauuauaggaaagaagaaaagauaauacccauuuguucuaucaccc

SEQ ID NO: 534999 - RNA, 65 nt, Human
uaccuucaugucuuucaguugauuuguauuucugcaaaagauauuucaaggauuaucaagguaug

SEQ ID NO: 535000 - RNA, 65 nt, Human
acuguucacauuugucucuaaaagucuucaucgcuaaaagauaccauaauuugcugaggcuucuu

SEQ ID NO: 535001 - RNA, 65 nt, Human
agaugaccuugauggaaaaaaaauauuuuuuaaaaaaaagauauacuguggaaggggggagaauc

SEQ ID NO: 535002 - RNA, 65 nt, Human
uuccuucaaugcguguauguaaucuuuguuaguauaaaagauauuaaauauaggugccaagaauu

SEQ ID NO: 535003 - RNA, 65 nt, Human
ugguuguuuuaguauuagacuuuuuuuucaaugccaaaagauagaagauuaaauauucuugaaua

SEQ ID NO: 535004 - RNA, 65 nt, Human
cuguuaagugacuauaugccaugggauauauggaaaaaagauauuaaugcagauuaauuuauauu

SEQ ID NO: 535005 - RNA, 65 nt, Human
gcauccagaaaggccagauuuuaccuaccaagaaaaaaagauauuuuuccagagaguuagguaua

SEQ ID NO: 535006 - RNA, 65 nt, Human
guguucugauuagaaaugaccaauauuauacuaagaaaagauacgacuuuauuuucugguagaua

SEQ ID NO: 535007 - RNA, 65 nt, Human
ggaaagcaaagcagaaaacagugccccaaauggaaaaaagauacucacacagaacaaaacaguuc

SEQ ID NO: 535008 - RNA, 65 nt, Human
caucauggaaguauaacuuauuccagacuaaacauaaaagauaaucuugaccugaguagagaaga

SEQ ID NO: 535009 - RNA, 65 nt, Human
uucaggaaaacuauggggaaauaguuacauuucacaaaagauauuuuaaacucuuuguaaaacuu

SEQ ID NO: 535010 - RNA, 65 nt, Human
ucaguguucuuccucuuuucucccuuaugaaaaagaaaagauagcacaaaacuuaagacuuaccu

SEQ ID NO: 535011 - RNA, 65 nt, Human
gcccuuuaaggauuaacuaguuaaggauuaauagcaaaagauauuaaauaugcuaacauagcuau

SEQ ID NO: 535012 - RNA, 65 nt, Human
gggcgacagagcgagacuuugucucaaaaaagaagaaaagauauuauucccaucaugauuucuug

SEQ ID NO: 535013 - RNA, 65 nt, Human
agaaaagaaauuaaucacaacuaucucucuugccuaaaagauaaauauagguaaacccaaggaaa

SEQ ID NO: 535014 - RNA, 65 nt, Human
uuauuaaacuuuuucuaaaaagugaaaaaaaaaaaaaaagauauaagaacucaaggucccauacu

SEQ ID NO: 535015 - RNA, 65 nt, Human
uuggccuugcugcuguuuugauuuauggaauuugaaaaagauaauuauaaugccugcaauguguc

SEQ ID NO: 535016 - RNA, 65 nt, Human
uuuucuagcuccacaucugucugcacauaggaaggaaaagauaggacucuaaaccuagucaucuu

SEQ ID NO: 535017 - RNA, 65 nt, Human
uccaacuugugacucauagggucugaacucacuccaaaagauaauaacugcagucuaauuuuucc

SEQ ID NO: 535018 - RNA, 65 nt, Human
cuacugacccagaggggaaugagggcugaguuaugaaaagauaacuucaugaagacuuaacuggc

SEQ ID NO: 535019 - RNA, 65 nt, Human
uggucuagcugaaucuucagagugggaggucuccaaaaagauauuaccuuauugggcuuaacaau

SEQ ID NO: 535020 - RNA, 65 nt, Human
acuggcagagaugauucuagauuaacuaucccaguaaaagauaugauauuuuccauagauaccuc

SEQ ID NO: 535021 - RNA, 65 nt, Human
uaauuacaaacaugaggaaugauucacugaagaugaaaagauaggacggaugugauaugaaaaaa

SEQ ID NO: 535022 - RNA, 65 nt, Human
aggaauguugaaugucuuuggcucaguucauuuaaaaaagauaucuauuugaaaguucucagagu

SEQ ID NO: 535023 - RNA, 65 nt, Human
ugggacggucuuuucuaaacuuuaacaugagacuuaaaagauauaauaagggaaaagauaagcag

SEQ ID NO: 535024 - RNA, 65 nt, Human
aacuuuaacaugagacuuaaaagauauaauaagggaaaagauaagcagauuucgcaaccaaaaaa

SEQ ID NO: 535025 - RNA, 65 nt, Human
ugcacagaguuguuacauuuuuaagugcugcauuuaaaagauacaguuacucagaauucucuagu

SEQ ID NO: 535026 - RNA, 65 nt, Human
uacaaaguugagccacgguccuuacuuaaagauugaaaagauaacauguaggccaggcaggucac

SEQ ID NO: 535027 - RNA, 65 nt, Human
cacugguacaguccagccaguaaaaaacacuuccaaaaagauacacagaagaggaacuaaaugac

SEQ ID NO: 535028 - RNA, 65 nt, Human
cuugauuuuucaucucuuuaaccaaacuuguggccaaaagauauuugaccguuuccaaaauucag

SEQ ID NO: 535029 - RNA, 65 nt, Human
cacacuuugcuacaaucuugcuagugcguuuucuuaaaagauaaucuauuuacuguaaaaauaaa

SEQ ID NO: 535030 - RNA, 65 nt, Human
uacuuuuucuacuuuuccuacuuuuuuguagaaaaaaaagauaaugccucugcuucuauuucucu

SEQ ID NO: 535031 - RNA, 65 nt, Human
auucuguauuaauguaaauaagauuaucuauugcaaaaagauauuucaaaccuaaauugugguca

SEQ ID NO: 535032 - RNA, 65 nt, Human
cuuuaggagaaaaaacaauuugguuuacugauaacaaaagauaauuggaaacaugagaguauuug

SEQ ID NO: 535033 - RNA, 65 nt, Human
ucaaggacauuuggauuuacuuuuacagaauauugaaaagauaagacaaauuauaaauaaguucu

SEQ ID NO: 535034 - RNA, 65 nt, Human
auaaauuugccaacuaguaaugcauacuggaaaucaaaagauacugaaagaauggugaacuucuc

SEQ ID NO: 535035 - RNA, 65 nt, Human
uuuuucccaucacucuuuacaugguggugauguccaaaagauacccaaauuuuaauauuccagaa

SEQ ID NO: 535036 - RNA, 65 nt, Human
ccugacucuuaaaaaaaaaaaaaaaaaaaaaaaaaaaaagauaacuagaacuucuagaacaucuu

SEQ ID NO: 535037 - RNA, 65 nt, Human
auauguaccauugucagcuaugacuaaaaauuugaaaaagauaaaaauuucuagcaagccuuuga

SEQ ID NO: 535038 - RNA, 65 nt, Human
cuauaaacucaaccacauuuuaauguugaaccaaaaaaagauaauaaaauaaaaaaguauauguu

SEQ ID NO: 535039 - RNA, 65 nt, Human
uugauucccuuuaaagugcaaaauggucaccuucuaaaagauauauucauaguuauuaaugaccc

SEQ ID NO: 535040 - RNA, 65 nt, Human
uguaauugaaauucaugcaaggaaacaacucauagaaaagauaaauauggaugcccuucacaugu

SEQ ID NO: 535041 - RNA, 65 nt, Human
acauggguuauauucauuauuaggccaucagucauaaaagauaauuuuccaucuuuuuuuuuuuu

SEQ ID NO: 535042 - RNA, 65 nt, Human
ucuacaaaauugcauguaacuuuauaaauauuuuuaaaagauauaguuuuguaaauauuuaauau

SEQ ID NO: 535043 - RNA, 65 nt, Human
aaauuacucauccuuaaaguuuacuccacuuugacaaaagauacgcccuucucccugcacauaaa

SEQ ID NO: 535044 - RNA, 65 nt, Human
ucucccaggacuuggggguggggugaaaagcguacaaaagauacuuaaaagggcuccugggguac

SEQ ID NO: 535045 - RNA, 65 nt, Human
aucaaaaacuuuugcaaucuuaagcagagauaaauaaaagauagcaauaugagacacagguggac

SEQ ID NO: 535046 - RNA, 65 nt, Human
ggcacuucugccuugaguccccaggggaaaaaaaaaaaagauauuuaugaaauaaaugguaauuu

SEQ ID NO: 535047 - RNA, 65 nt, Human
guuuauugaaaaaaaaagaaaaagaaagcaagaaaaaaagauacuauggggucaaguguaacucc

SEQ ID NO: 535048 - RNA, 65 nt, Human
augaugcuggguaaguagaguaaguuaaacuugguaaaagauaaucuaaaaauuccauaguucuc

SEQ ID NO: 535049 - RNA, 65 nt, Human
uuaaaaaagacagcaaacuuuuuuuuuuauuuaaaaaaagauauauuaacaguuuuagaagucag

SEQ ID NO: 535050 - RNA, 65 nt, Human
auccuucaauuucuguauaaaagcagaucuuuuuaaaaagauacuucuguaacuuaagaaaccug

SEQ ID NO: 535051 - RNA, 65 nt, Human
guuguggcaccugaagacaucuucaaaauuggcagaaaagauaauaguuauaaaaauuuuaguuc

SEQ ID NO: 535052 - RNA, 65 nt, Human
uugauauuugugucuguuacuacuuuuuuaauacaaaaagauaaaaacgcccaggacuuugugga

SEQ ID NO: 535053 - RNA, 65 nt, Human
cccuggagaauggcaaaaugauuuaaagagaaaaaaaaagauauuuuaaauuugaugcucauuuu

SEQ ID NO: 535054 - RNA, 65 nt, Human
caaacaaggauuacagugaaugugaaaaaaaaaaaaaaagauaccugaauagacauuucuaugac

SEQ ID NO: 535055 - RNA, 65 nt, Human
uugaaugauuaguugggauuaccaaacauuuuuuaaaaagauauuaucaauaaauauuuuuuuaa

SEQ ID NO: 535056 - RNA, 65 nt, Human
gaaaguccuugcacagacaccagugagugaguucuaaaagauacccuuggaauuaucagacucag

SEQ ID NO: 535057 - RNA, 65 nt, Human
ucucuccauucuccagguccaaggcagagauccugaaaagauagggcuauuguccccugccuccu

SEQ ID NO: 535058 - RNA, 65 nt, Human
uugucagaacccugaaaguauuaguucuaaaaaaaaaaagauauauacuagaaguaauuguuuua

SEQ ID NO: 535059 - RNA, 65 nt, Human
uuuuucaucuuaauauguaccaguggcacuuaaccaaaagauacagugauauagccauguacugu

SEQ ID NO: 535060 - RNA, 65 nt, Human
ucuaaauaaaaaacuaauucauaacuaaugcauagaaaagauacauaaagcaaugugaaaguuuc

SEQ ID NO: 535061 - RNA, 65 nt, Human
cagagugcugaguuaaacgcaaauuucagguaaacaaaagauaauuuucuagcauuaauaugccc

SEQ ID NO: 535062 - RNA, 65 nt, Human
guggggucugaggcacaugggagugggaccagcagaaaagauacucaggucaguuaacuaaugag

SEQ ID NO: 535063 - RNA, 65 nt, Human
ugccgauggaaaggcaucugccauaaaagaaaagcaaaagauaaaaagcccaaccgaugugggga

SEQ ID NO: 535064 - RNA, 65 nt, Human
ggaauauccuggagugguccccagaagcauccaagaaaagauauuuggggacguagccuaacauu

SEQ ID NO: 535065 - RNA, 65 nt, Human
ggaagagagucugcagaaguugggggaaaacuuuuaaaagauacccucauugugucaaagagugu

SEQ ID NO: 535066 - RNA, 65 nt, Human
gguguuuauuaaaauucugaauuuuggggauuuucaaaagauaauauuuuacauacacuguaugu

SEQ ID NO: 535067 - RNA, 51 nt, Human; identical to SEQ ID NO: 504309

SEQ ID NO: 535068 - RNA, 65 nt, Human
uuuaauauaaaugcaaauaacaaaugccaaauuaaaaaagauaaacacaagauugguguuuuuuu

SEQ ID NO: 535069 - RNA, 65 nt, Human
uaggcacuguacuuaauacuaggauacagaaaugcaaaagauacggcccaugcaauuuuauuaaa

SEQ ID NO: 535070 - RNA, 65 nt, Human
gaaaggagccacagcugacgccaaaaagaaaagaaaaaagauauauauauauauauauauauaua

SEQ ID NO: 535071 - RNA, 65 nt, Human
cauggcgagucuccgugcugguguuuaagucauuaaaaagauacucaaagagaauggccugccug

SEQ ID NO: 535072 - RNA, 65 nt, Human
caacaagaguggcacuccaucucagaaaaaaaaaaaaaagauaauucauacugaaaagaaacucu

SEQ ID NO: 535073 - RNA, 65 nt, Human
cauaugugaaagcaugugacuaauuguugcugcauaaaagauaugagauucuuuuuuauuaggca

SEQ ID NO: 535074 - RNA, 65 nt, Human
uuuuuuauuaggcauuauuuaugaccuuuucuaugaaaagauaaggacauuaaaauguaagaugc

SEQ ID NO: 535075 - RNA, 65 nt, Human
accuaauaguauuuuugugaggaugaaaugcuaauaaaagauaaaaccuuuaaaagaguauuugg

SEQ ID NO: 535076 - RNA, 65 nt, Human
gcuugcugguuuauuauaaaagcaagguuuauuauaaaagauacuacaaaggauacagaugaaga

SEQ ID NO: 535077 - RNA, 65 nt, Human
aaaugcacagaugccuauacauacauauacaaauaaaaagauacgauucgcaauggagaauuuca

SEQ ID NO: 535078 - RNA, 65 nt, Human
gcauaaaguaauuacucaaaccauaauguaaaguaaaaagauaaccauacuauacauagaaagcc

SEQ ID NO: 535079 - RNA, 65 nt, Human
aguaccacaguauuuauguguaugaauuaaggauuaaaagauaauguggauaaauaaacuauuga

SEQ ID NO: 535080 - RNA, 65 nt, Human
auggaggacagaagcgacuuuugugccgggacuuaaaaagauaaggaggccaggugugguggcuc

SEQ ID NO: 535081 - RNA, 65 nt, Human
caaagccuuuaacuggcucuuaauccuuaugaaacaaaagauaauucauacuagagagaaacccu

SEQ ID NO: 535082 - RNA, 65 nt, Human
aaguuuuguuuuguuuuuuucuggaaaaaaaagaaaaaagauacgacucucagaagccuguuuaa

SEQ ID NO: 535083 - RNA, 65 nt, Human
gugcauaaggaucaagacagacaaugucgagggacaaaagauagaagauggaggaggaaagacau

SEQ ID NO: 535084 - RNA, 65 nt, Human
uguuuuauguaaguauugcuuauucaaguaguuuuaaaagauauguaauugguuguuguuucaug

SEQ ID NO: 535085 - RNA, 65 nt, Human
guacauaucuuuuuaaagaucgcuuuauaaaaacaaaaagauaacauuaacauuuauugaaacaa

SEQ ID NO: 535086 - RNA, 65 nt, Human
aagcuuuauccaggucucagagcucaauacgcaucaaaagauacaucuuugaugaagucacacaa

SEQ ID NO: 535087 - RNA, 65 nt, Human
augugaaguacuuuauucuuucauauuuuaaaaauaaaagauaauuauccaugagaaagcuacuc

SEQ ID NO: 535088 - RNA, 65 nt, Human
ugauagauaacauggcuuuuacuccuuacuguuugaaaagauaaguacuuuagcuucuuucugca

SEQ ID NO: 535089 - RNA, 65 nt, Human
uaggugguauuaaauauuaaguucuuauguaugucaaaagauaucauuuugaaauucauccaucu

SEQ ID NO: 535090 - RNA, 65 nt, Human
ggaagguagauaacuuuuaggaccuugaugugaggaaaagauaaaauuuaaacaauaaauuugcc

SEQ ID NO: 535091 - RNA, 65 nt, Human
aauuugccacuuagauuuucuagcagcaaaguccgaaaagauaguuauauacaaaauucuguuuu

SEQ ID NO: 535092 - RNA, 65 nt, Human
cccacagccaucugguuaugucuuauuuuuuuccuaaaagauaauguuuauuuuuaaaaaggaag

SEQ ID NO: 535093 - RNA, 65 nt, Human
uuggacguugugacucuugccuuuuaagaagaaaaaaaagauaggacaaaguauuugaagcucuu

SEQ ID NO: 535094 - RNA, 65 nt, Human
ggaaacuuucaaaauagugaaaugaauauuuaaauaaaagauauaaaugccaaagucuuuaccaa

SEQ ID NO: 535095 - RNA, 65 nt, Human
uccuccaaagacagacagaaucaccugaggcguucaaaagauauaaccaaauaaacaagucaucc

SEQ ID NO: 535096 - RNA, 65 nt, Human
caaaauauuuuuguccugaguagugucacugggccaaaagauagaucaggacgacagccuuuagu

SEQ ID NO: 535097 - RNA, 65 nt, Human
gaggcagcaagucuuaacaaaccaacaucuuugcgaaaagauaaaccuggagauauuauaaggga

SEQ ID NO: 535098 - RNA, 65 nt, Human
ugugugugucggggggacagagggaaccauuuaagaaaagauaccaaaguagaagucaaaagaaa

SEQ ID NO: 535099 - RNA, 65 nt, Human
gguggggauuaucuuggggagaggcugaaaagcacaaaagauagucuucccuguacguauuggug

SEQ ID NO: 535100 - RNA, 65 nt, Human
agccacauaaccuugcggcaagucugauggaaagaaaaagauaaaccauccgugggguagaugca

SEQ ID NO: 535101 - RNA, 65 nt, Human
cuuuaguaaaauuggagguagcaaacacuaaggugaaaagauaaugaucucauuguuuauuaacc

SEQ ID NO: 535102 - RNA, 65 nt, Human
uacagcccacugggugccaagcucagagggggaaaaaaagauagccagagagagaccuggcccuc

SEQ ID NO: 535103 - RNA, 65 nt, Human
cucacacuguugucuguuacugauuuuuuuugauaaaaagauaauaaaaccugguacuuucuaaa

SEQ ID NO: 535104 - RNA, 65 nt, Human
caaaggccccauuugucaggggugagagaaaagucaaaagauaaauuggggccuuguaaaaggcc

SEQ ID NO: 535105 - RNA, 65 nt, Human
ggaacacgcuuucuuuacaucacuaguguagacucaaaagauaugcaagugucaaauaugcaaaa

SEQ ID NO: 535106 - RNA, 65 nt, Human
cauuuugggcagaaugcugacuaguagacuaacauaaaagauauaaaaggcaauaacuauuguuu

SEQ ID NO: 535107 - RNA, 65 nt, Human
uaaauagucuugaagucaauuuaguuuauuuauuuaaaagauaaugcauccugaaagggaucauu

SEQ ID NO: 535108 - RNA, 65 nt, Human
uuaauguuuagggucaguuuguaguauucuugagaaaaagauaaaggguuauaauuugaauguga

SEQ ID NO: 535109 - RNA, 65 nt, Human
caguauugauuuauaucuuagacuacuuuagcaauaaaagauaaaucucaacuuuaauaaguuau

SEQ ID NO: 535110 - RNA, 65 nt, Human
uguuaugcaaagcaggugauuugucuuaaucagauaaaagauagaggcuaugggggccucaagau

SEQ ID NO: 535111 - RNA, 65 nt, Human
guaaacagagaaaaaggaaaguaaaaauauggcauaaaagauaagaauuggcucuccuguacagg

SEQ ID NO: 535112 - RNA, 65 nt, Human
agccuggccaacauggugaaaccccgucuccacgaaaaagauaaaaauaagcugggcgugguggc

SEQ ID NO: 535113 - RNA, 65 nt, Human
auuucaaaaaaauaaaaauuggaagaagagcuuaaaaaagauaagauuuuaaagagucccaaguu

SEQ ID NO: 535114 - RNA, 65 nt, Human
guuugacuuacacgggacauuuguguuuuuggaggaaaagauacccugauucuuugaaucuuccu

SEQ ID NO: 535115 - RNA, 65 nt, Human
uuuaucgugguuguuaauuugaaguaauaaaguagaaaagauaaagugaugcaggcagcccuuug

SEQ ID NO: 535116 - RNA, 65 nt, Human
uguaaaauuucugaauacuaaucuuagaaauguguaaaagauauuauuuugauuguuaaacaaau

SEQ ID NO: 535117 - RNA, 65 nt, Human
cuggucagucaagucccaauaaauggucagcacaaaaaagauauucuugaaaauugcucuuuauu

SEQ ID NO: 535118 - RNA, 65 nt, Human
aaaaaaaaaaaaaaaaaaaaaaaaaaaaaaaaaaaaaaagauacauuggucuuuaaacccaaacc

SEQ ID NO: 535119 - RNA, 65 nt, Human
uaugguaguacccacccgguauuccuaaaauccuaaaaagauacaccuugcaguagcagaggcaa

SEQ ID NO: 535120 - RNA, 65 nt, Human
uugccagguauuuucuaaaauuccaccugaaagccaaaagauaaaauaaauaaguugauuuuaau

SEQ ID NO: 535121 - RNA, 65 nt, Human
cuaauuauaaugacuuucugucuggaucuuauaggaaaagauacuuucuuuuuucuuccaucuuu

SEQ ID NO: 535122 - RNA, 65 nt, Human
uguauucauuuaugccuaaaucucuauaacagaugaaaagauaauuaauaaaauccuaauuaaaa

SEQ ID NO: 535123 - RNA, 65 nt, Human
uggagcugcaaggaaauacaaaaauuuuuaaaaagaaaagauauuggaugcuccuuguauucugu

SEQ ID NO: 535124 - RNA, 65 nt, Human
auaaucuaguuggagagauaagaaacguacaaaccaaaagauaacagaauaucugaagcauguac

SEQ ID NO: 535125 - RNA, 65 nt, Human
uuguauaauuaugaacaugcacaaguuucugcaugaaaagauauuaauauauuaaucacauguau

SEQ ID NO: 535126 - RNA, 65 nt, Human
uucuggauaggaacuacuugaaauaguaauuuguuaaaagauaugacaaaaugaaaaugcuuaaa

SEQ ID NO: 535127 - RNA, 65 nt, Human
aagaaauaaugccgcauuuuucccccauuguaccaaaaagauaaaaaaaugguaaacacugauca

SEQ ID NO: 535128 - RNA, 65 nt, Human
cuaucaaucuaucuaguagcuaucuauauauuuucaaaagauagcuuaugucuaaaacaguggug

SEQ ID NO: 535129 - RNA, 65 nt, Human
uauuggccauaagcaacaauuuucagauuugcacaaaaagauaccuuaaaauuugaaacauugcu

SEQ ID NO: 535130 - RNA, 65 nt, Human
agugugaauucaccgugaaauaggugagauaaauuaaaagauacuuaauucccgccuuaugccuc

SEQ ID NO: 535131 - RNA, 65 nt, Human
uuagcaauaacauacaugagauaacucaagaaaucaaaagauaguugauucuugccuuguaccuc

SEQ ID NO: 535132 - RNA, 65 nt, Human
cuucaaaauuuaaaaacuugugauuuaagaagaggaaaagauaagcuacagauugagaugaauuu

SEQ ID NO: 535133 - RNA, 65 nt, Human
auaacuuugaauguuuuaacagcaagaauuuuaagaaaagauaaacaccauuuuauuuauuuaua

SEQ ID NO: 535134 - RNA, 65 nt, Human
uaacuuaugaaguaaaguuucugauaguagucuuuaaaagauauaagacuuaauauguuuuauuc

SEQ ID NO: 535135 - RNA, 65 nt, Human
caucauucauugaaagugaucacuuuaccauuuugaaaagauauuucguguucuuucacugcaaa

SEQ ID NO: 535136 - RNA, 65 nt, Human
aauaauuuuaaggaaaucuuacaaguauuacauuaaaaagauacuaugacugccaccugccauuu

SEQ ID NO: 535137 - RNA, 65 nt, Human
gucuguauuugcuuuucacaguaggccugaugacuaaaagauaugcuuuauuacacgcuauuuuc

SEQ ID NO: 535138 - RNA, 65 nt, Human
uuugaauacauuuguauuuauguggcuguaaugacaaaagauacaaaagcuuuuuaaaauuuaga

SEQ ID NO: 535139 - RNA, 65 nt, Human
aaugagaugccaguaguguucaaaguuguauuuuuaaaagauaaauauuccuuuuuauaccucag

SEQ ID NO: 535140 - RNA, 65 nt, Human
ccuagauccuugagagggaccuggcuuuccuuuuuaaaagauauuuuacugaagagcuaaaaacu

SEQ ID NO: 535141 - RNA, 65 nt, Human
ugaaugagcaguaaaacugaugacauaaagaaauuaaaagauauuuaauucuugccuuauacuca

SEQ ID NO: 535142 - RNA, 65 nt, Human
caguaaaauacaugagauaaagaccucaagaaguuaaaagauacuuaauucuugccuuauaccuc

SEQ ID NO: 535143 - RNA, 65 nt, Human
cgaauuagcaguaaaauacaugauacaaggaacucaaaagauaguuaauucuugccuuauaccuc

SEQ ID NO: 535144 - RNA, 65 nt, Human; identical to SEQ ID NO: 535131

SEQ ID NO: 535145 - RNA, 65 nt, Human
cucuguuguagaaaaacuaugugaugaaacuuugaaaaagauauuuaugauguuaacauuucagg

SEQ ID NO: 535146 - RNA, 65 nt, Human
aaagcuuuagaagcuauuuuacuacauagguaaagaaaagauaaacuaacuuguaacaaagacca

SEQ ID NO: 535147 - RNA, 65 nt, Human
cugacucagucuguucacugguugagcuuugagugaaaagauaacacaggucuauugacucacac

SEQ ID NO: 535148 - RNA, 64 nt, Human; identical to SEQ ID NO: 381965

SEQ ID NO: 535149 - RNA, 64 nt, Human; identical to SEQ ID NO: 381966

SEQ ID NO: 535150 - RNA, 64 nt, Human; identical to SEQ ID NO: 381967

SEQ ID NO: 535151 - RNA, 64 nt, Human; identical to SEQ ID NO: 381968

SEQ ID NO: 535152 - RNA, 64 nt, Human; identical to SEQ ID NO: 381969

SEQ ID NO: 535153 - RNA, 64 nt, Human; identical to SEQ ID NO: 381970

SEQ ID NO: 535154 - RNA, 64 nt, Human; identical to SEQ ID NO: 381971

SEQ ID NO: 535155 - RNA, 64 nt, Human; identical to SEQ ID NO: 381972

SEQ ID NO: 535156 - RNA, 64 nt, Human; identical to SEQ ID NO: 381973

SEQ ID NO: 535157 - RNA, 64 nt, Human; identical to SEQ ID NO: 381974

SEQ ID NO: 535158 - RNA, 64 nt, Human; identical to SEQ ID NO: 381975

SEQ ID NO: 535159 - RNA, 64 nt, Human; identical to SEQ ID NO: 381976

SEQ ID NO: 535160 - RNA, 64 nt, Human; identical to SEQ ID NO: 381977

SEQ ID NO: 535161 - RNA, 64 nt, Human; identical to SEQ ID NO: 381981

SEQ ID NO: 535162 - RNA, 64 nt, Human; identical to SEQ ID NO: 381982

SEQ ID NO: 535163 - RNA, 64 nt, Human; identical to SEQ ID NO: 381983

SEQ ID NO: 535164 - RNA, 64 nt, Human; identical to SEQ ID NO: 381984

SEQ ID NO: 535165 - RNA, 64 nt, Human; identical to SEQ ID NO: 381985

SEQ ID NO: 535166 - RNA, 64 nt, Human; identical to SEQ ID NO: 381986

SEQ ID NO: 535167 - RNA, 64 nt, Human; identical to SEQ ID NO: 381987

SEQ ID NO: 535168 - RNA, 64 nt, Human; identical to SEQ ID NO: 381988

SEQ ID NO: 535169 - RNA, 64 nt, Human; identical to SEQ ID NO: 381989

SEQ ID NO: 535170 - RNA, 64 nt, Human; identical to SEQ ID NO: 381990

SEQ ID NO: 535171 - RNA, 64 nt, Human; identical to SEQ ID NO: 381991

SEQ ID NO: 535172 - RNA, 64 nt, Human; identical to SEQ ID NO: 381992

SEQ ID NO: 535173 - RNA, 64 nt, Human; identical to SEQ ID NO: 381993

SEQ ID NO: 535174 - RNA, 64 nt, Human; identical to SEQ ID NO: 381994

SEQ ID NO: 535175 - RNA, 64 nt, Human; identical to SEQ ID NO: 381995

SEQ ID NO: 535176 - RNA, 64 nt, Human; identical to SEQ ID NO: 381996

SEQ ID NO: 535177 - RNA, 64 nt, Human; identical to SEQ ID NO: 382000

SEQ ID NO: 535178 - RNA, 64 nt, Human; identical to SEQ ID NO: 382001

SEQ ID NO: 535179 - RNA, 64 nt, Human; identical to SEQ ID NO: 382002

SEQ ID NO: 535180 - RNA, 64 nt, Human; identical to SEQ ID NO: 382003

SEQ ID NO: 535181 - RNA, 64 nt, Human; identical to SEQ ID NO: 382004

SEQ ID NO: 535182 - RNA, 64 nt, Human; identical to SEQ ID NO: 382005

SEQ ID NO: 535183 - RNA, 64 nt, Human; identical to SEQ ID NO: 382006

SEQ ID NO: 535184 - RNA, 64 nt, Human; identical to SEQ ID NO: 382007

SEQ ID NO: 535185 - RNA, 64 nt, Human; identical to SEQ ID NO: 382008

SEQ ID NO: 535186 - RNA, 64 nt, Human; identical to SEQ ID NO: 382009

SEQ ID NO: 535187 - RNA, 64 nt, Human; identical to SEQ ID NO: 382010

SEQ ID NO: 535188 - RNA, 64 nt, Human; identical to SEQ ID NO: 382011

SEQ ID NO: 535189 - RNA, 64 nt, Human; identical to SEQ ID NO: 382012

SEQ ID NO: 535190 - RNA, 64 nt, Human; identical to SEQ ID NO: 382013

SEQ ID NO: 535191 - RNA, 64 nt, Human; identical to SEQ ID NO: 382014

SEQ ID NO: 535192 - RNA, 64 nt, Human; identical to SEQ ID NO: 382015

SEQ ID NO: 535193 - RNA, 64 nt, Human; identical to SEQ ID NO: 382019

SEQ ID NO: 535194 - RNA, 64 nt, Human; identical to SEQ ID NO: 382020

SEQ ID NO: 535195 - RNA, 64 nt, Human; identical to SEQ ID NO: 382021

SEQ ID NO: 535196 - RNA, 64 nt, Human; identical to SEQ ID NO: 382022

SEQ ID NO: 535197 - RNA, 64 nt, Human; identical to SEQ ID NO: 382023

SEQ ID NO: 535198 - RNA, 64 nt, Human; identical to SEQ ID NO: 382024

SEQ ID NO: 535199 - RNA, 64 nt, Human; identical to SEQ ID NO: 382025

SEQ ID NO: 535200 - RNA, 64 nt, Human; identical to SEQ ID NO: 382026

SEQ ID NO: 535201 - RNA, 64 nt, Human; identical to SEQ ID NO: 382027

SEQ ID NO: 535202 - RNA, 64 nt, Human; identical to SEQ ID NO: 382028

SEQ ID NO: 535203 - RNA, 64 nt, Human; identical to SEQ ID NO: 382029

SEQ ID NO: 535204 - RNA, 64 nt, Human; identical to SEQ ID NO: 382030

SEQ ID NO: 535205 - RNA, 64 nt, Human; identical to SEQ ID NO: 382031

SEQ ID NO: 535206 - RNA, 64 nt, Human; identical to SEQ ID NO: 382032

SEQ ID NO: 535207 - RNA, 64 nt, Human; identical to SEQ ID NO: 382033

SEQ ID NO: 535208 - RNA, 64 nt, Human; identical to SEQ ID NO: 382034

SEQ ID NO: 535209 - RNA, 64 nt, Human; identical to SEQ ID NO: 382038

SEQ ID NO: 535210 - RNA, 64 nt, Human; identical to SEQ ID NO: 382039

SEQ ID NO: 535211 - RNA, 64 nt, Human; identical to SEQ ID NO: 382040

SEQ ID NO: 535212 - RNA, 64 nt, Human; identical to SEQ ID NO: 382041

SEQ ID NO: 535213 - RNA, 63 nt, Human; identical to SEQ ID NO: 382042

SEQ ID NO: 535214 - RNA, 64 nt, Human; identical to SEQ ID NO: 382043

SEQ ID NO: 535215 - RNA, 52 nt, Human; identical to SEQ ID NO: 381978

SEQ ID NO: 535216 - RNA, 64 nt, Human; identical to SEQ ID NO: 382044

SEQ ID NO: 535217 - RNA, 64 nt, Human; identical to SEQ ID NO: 382045

SEQ ID NO: 535218 - RNA, 64 nt, Human; identical to SEQ ID NO: 382046

SEQ ID NO: 535219 - RNA, 64 nt, Human; identical to SEQ ID NO: 382047

SEQ ID NO: 535220 - RNA, 64 nt, Human; identical to SEQ ID NO: 382048

SEQ ID NO: 535221 - RNA, 64 nt, Human; identical to SEQ ID NO: 382049

SEQ ID NO: 535222 - RNA, 64 nt, Human; identical to SEQ ID NO: 382050

SEQ ID NO: 535223 - RNA, 64 nt, Human; identical to SEQ ID NO: 382051

SEQ ID NO: 535224 - RNA, 64 nt, Human; identical to SEQ ID NO: 382052

SEQ ID NO: 535225 - RNA, 64 nt, Human; identical to SEQ ID NO: 382053

SEQ ID NO: 535226 - RNA, 64 nt, Human; identical to SEQ ID NO: 382057

SEQ ID NO: 535227 - RNA, 64 nt, Human; identical to SEQ ID NO: 382058

SEQ ID NO: 535228 - RNA, 64 nt, Human; identical to SEQ ID NO: 382059

SEQ ID NO: 535229 - RNA, 64 nt, Human; identical to SEQ ID NO: 382060

SEQ ID NO: 535230 - RNA, 64 nt, Human; identical to SEQ ID NO: 382061

SEQ ID NO: 535231 - RNA, 64 nt, Human; identical to SEQ ID NO: 382062

SEQ ID NO: 535232 - RNA, 64 nt, Human; identical to SEQ ID NO: 382063

SEQ ID NO: 535233 - RNA, 64 nt, Human; identical to SEQ ID NO: 382064

SEQ ID NO: 535234 - RNA, 64 nt, Human; identical to SEQ ID NO: 382065

SEQ ID NO: 535235 - RNA, 64 nt, Human; identical to SEQ ID NO: 382066

SEQ ID NO: 535236 - RNA, 64 nt, Human; identical to SEQ ID NO: 382067

SEQ ID NO: 535237 - RNA, 64 nt, Human; identical to SEQ ID NO: 382068

SEQ ID NO: 535238 - RNA, 64 nt, Human; identical to SEQ ID NO: 382069

SEQ ID NO: 535239 - RNA, 64 nt, Human; identical to SEQ ID NO: 382070

SEQ ID NO: 535240 - RNA, 64 nt, Human; identical to SEQ ID NO: 382071

SEQ ID NO: 535241 - RNA, 64 nt, Human; identical to SEQ ID NO: 382072

SEQ ID NO: 535242 - RNA, 64 nt, Human; identical to SEQ ID NO: 382076

SEQ ID NO: 535243 - RNA, 64 nt, Human; identical to SEQ ID NO: 382077

SEQ ID NO: 535244 - RNA, 64 nt, Human; identical to SEQ ID NO: 382078

SEQ ID NO: 535245 - RNA, 64 nt, Human; identical to SEQ ID NO: 382079

SEQ ID NO: 535246 - RNA, 64 nt, Human; identical to SEQ ID NO: 382080

SEQ ID NO: 535247 - RNA, 64 nt, Human; identical to SEQ ID NO: 382081

SEQ ID NO: 535248 - RNA, 64 nt, Human; identical to SEQ ID NO: 382082

SEQ ID NO: 535249 - RNA, 64 nt, Human; identical to SEQ ID NO: 382083

SEQ ID NO: 535250 - RNA, 64 nt, Human; identical to SEQ ID NO: 382084

SEQ ID NO: 535251 - RNA, 64 nt, Human; identical to SEQ ID NO: 382085

SEQ ID NO: 535252 - RNA, 64 nt, Human; identical to SEQ ID NO: 382086

SEQ ID NO: 535253 - RNA, 64 nt, Human; identical to SEQ ID NO: 382087

SEQ ID NO: 535254 - RNA, 61 nt, Human; identical to SEQ ID NO: 382088

SEQ ID NO: 535255 - RNA, 64 nt, Human; identical to SEQ ID NO: 382089

SEQ ID NO: 535256 - RNA, 64 nt, Human; identical to SEQ ID NO: 382090

SEQ ID NO: 535257 - RNA, 64 nt, Human; identical to SEQ ID NO: 382091

SEQ ID NO: 535258 - RNA, 64 nt, Human; identical to SEQ ID NO: 382095

SEQ ID NO: 535259 - RNA, 64 nt, Human; identical to SEQ ID NO: 382096

SEQ ID NO: 535260 - RNA, 64 nt, Human; identical to SEQ ID NO: 382097

SEQ ID NO: 535261 - RNA, 64 nt, Human; identical to SEQ ID NO: 382098

SEQ ID NO: 535262 - RNA, 64 nt, Human; identical to SEQ ID NO: 382099

SEQ ID NO: 535263 - RNA, 64 nt, Human; identical to SEQ ID NO: 382100

SEQ ID NO: 535264 - RNA, 64 nt, Human; identical to SEQ ID NO: 382101

SEQ ID NO: 535265 - RNA, 64 nt, Human; identical to SEQ ID NO: 382102

SEQ ID NO: 535266 - RNA, 64 nt, Human; identical to SEQ ID NO: 382103

SEQ ID NO: 535267 - RNA, 64 nt, Human; identical to SEQ ID NO: 382104

SEQ ID NO: 535268 - RNA, 64 nt, Human; identical to SEQ ID NO: 382105

SEQ ID NO: 535269 - RNA, 64 nt, Human; identical to SEQ ID NO: 382106

SEQ ID NO: 535270 - RNA, 64 nt, Human; identical to SEQ ID NO: 382107

SEQ ID NO: 535271 - RNA, 64 nt, Human; identical to SEQ ID NO: 382108

SEQ ID NO: 535272 - RNA, 64 nt, Human; identical to SEQ ID NO: 382109

SEQ ID NO: 535273 - RNA, 64 nt, Human; identical to SEQ ID NO: 382110

SEQ ID NO: 535274 - RNA, 64 nt, Human; identical to SEQ ID NO: 380310

SEQ ID NO: 535275 - RNA, 64 nt, Human; identical to SEQ ID NO: 380311

SEQ ID NO: 535276 - RNA, 64 nt, Human; identical to SEQ ID NO: 380312

SEQ ID NO: 535277 - RNA, 64 nt, Human; identical to SEQ ID NO: 380313

SEQ ID NO: 535278 - RNA, 64 nt, Human; identical to SEQ ID NO: 380314

SEQ ID NO: 535279 - RNA, 64 nt, Human; identical to SEQ ID NO: 380315

SEQ ID NO: 535280 - RNA, 64 nt, Human; identical to SEQ ID NO: 380316

SEQ ID NO: 535281 - RNA, 64 nt, Human; identical to SEQ ID NO: 380317

SEQ ID NO: 535282 - RNA, 64 nt, Human; identical to SEQ ID NO: 380318

SEQ ID NO: 535283 - RNA, 64 nt, Human; identical to SEQ ID NO: 380319

SEQ ID NO: 535284 - RNA, 64 nt, Human; identical to SEQ ID NO: 380320

SEQ ID NO: 535285 - RNA, 64 nt, Human; identical to SEQ ID NO: 380321

SEQ ID NO: 535286 - RNA, 64 nt, Human; identical to SEQ ID NO: 380322

SEQ ID NO: 535287 - RNA, 64 nt, Human; identical to SEQ ID NO: 380323

SEQ ID NO: 535288 - RNA, 64 nt, Human; identical to SEQ ID NO: 380324

SEQ ID NO: 535289 - RNA, 64 nt, Human; identical to SEQ ID NO: 382114

SEQ ID NO: 535290 - RNA, 64 nt, Human; identical to SEQ ID NO: 382132

SEQ ID NO: 535291 - RNA, 64 nt, Human; identical to SEQ ID NO: 382133

SEQ ID NO: 535292 - RNA, 64 nt, Human; identical to SEQ ID NO: 382134

SEQ ID NO: 535293 - RNA, 64 nt, Human; identical to SEQ ID NO: 382135

SEQ ID NO: 535294 - RNA, 64 nt, Human; identical to SEQ ID NO: 382136

SEQ ID NO: 535295 - RNA, 64 nt, Human; identical to SEQ ID NO: 382137

SEQ ID NO: 535296 - RNA, 64 nt, Human; identical to SEQ ID NO: 382138

SEQ ID NO: 535297 - RNA, 64 nt, Human; identical to SEQ ID NO: 382139

SEQ ID NO: 535298 - RNA, 64 nt, Human; identical to SEQ ID NO: 382140

SEQ ID NO: 535299 - RNA, 64 nt, Human; identical to SEQ ID NO: 382141

SEQ ID NO: 535300 - RNA, 64 nt, Human; identical to SEQ ID NO: 382142

SEQ ID NO: 535301 - RNA, 64 nt, Human; identical to SEQ ID NO: 382143

SEQ ID NO: 535302 - RNA, 64 nt, Human; identical to SEQ ID NO: 382144

SEQ ID NO: 535303 - RNA, 64 nt, Human; identical to SEQ ID NO: 382145

SEQ ID NO: 535304 - RNA, 64 nt, Human; identical to SEQ ID NO: 382146

SEQ ID NO: 535305 - RNA, 64 nt, Human; identical to SEQ ID NO: 382147

SEQ ID NO: 535306 - RNA, 64 nt, Human; identical to SEQ ID NO: 382151

SEQ ID NO: 535307 - RNA, 64 nt, Human; identical to SEQ ID NO: 382152

SEQ ID NO: 535308 - RNA, 64 nt, Human; identical to SEQ ID NO: 382153

SEQ ID NO: 535309 - RNA, 64 nt, Human; identical to SEQ ID NO: 382154

SEQ ID NO: 535310 - RNA, 64 nt, Human; identical to SEQ ID NO: 382155

SEQ ID NO: 535311 - RNA, 64 nt, Human; identical to SEQ ID NO: 382156

SEQ ID NO: 535312 - RNA, 64 nt, Human; identical to SEQ ID NO: 382157

SEQ ID NO: 535313 - RNA, 64 nt, Human; identical to SEQ ID NO: 382158

SEQ ID NO: 535314 - RNA, 64 nt, Human; identical to SEQ ID NO: 382159

SEQ ID NO: 535315 - RNA, 64 nt, Human; identical to SEQ ID NO: 382160

SEQ ID NO: 535316 - RNA, 64 nt, Human; identical to SEQ ID NO: 382161

SEQ ID NO: 535317 - RNA, 54 nt, Human; identical to SEQ ID NO: 382162

SEQ ID NO: 535318 - RNA, 64 nt, Human; identical to SEQ ID NO: 382163

SEQ ID NO: 535319 - RNA, 64 nt, Human; identical to SEQ ID NO: 382164

SEQ ID NO: 535320 - RNA, 64 nt, Human; identical to SEQ ID NO: 382165

SEQ ID NO: 535321 - RNA, 64 nt, Human; identical to SEQ ID NO: 382166

SEQ ID NO: 535322 - RNA, 64 nt, Human; identical to SEQ ID NO: 382170

SEQ ID NO: 535323 - RNA, 64 nt, Human; identical to SEQ ID NO: 382171

SEQ ID NO: 535324 - RNA, 64 nt, Human; identical to SEQ ID NO: 382172

SEQ ID NO: 535325 - RNA, 64 nt, Human; identical to SEQ ID NO: 382173

SEQ ID NO: 535326 - RNA, 64 nt, Human; identical to SEQ ID NO: 382174

SEQ ID NO: 535327 - RNA, 64 nt, Human; identical to SEQ ID NO: 382175

SEQ ID NO: 535328 - RNA, 64 nt, Human; identical to SEQ ID NO: 382176

SEQ ID NO: 535329 - RNA, 64 nt, Human; identical to SEQ ID NO: 382177

SEQ ID NO: 535330 - RNA, 64 nt, Human; identical to SEQ ID NO: 382178

SEQ ID NO: 535331 - RNA, 64 nt, Human; identical to SEQ ID NO: 382179

SEQ ID NO: 535332 - RNA, 64 nt, Human; identical to SEQ ID NO: 382180

SEQ ID NO: 535333 - RNA, 64 nt, Human; identical to SEQ ID NO: 382181

SEQ ID NO: 535334 - RNA, 64 nt, Human; identical to SEQ ID NO: 382182

SEQ ID NO: 535335 - RNA, 64 nt, Human; identical to SEQ ID NO: 382183

SEQ ID NO: 535336 - RNA, 64 nt, Human; identical to SEQ ID NO: 382184

SEQ ID NO: 535337 - RNA, 64 nt, Human; identical to SEQ ID NO: 382185

SEQ ID NO: 535338 - RNA, 64 nt, Human; identical to SEQ ID NO: 382189

SEQ ID NO: 535339 - RNA, 64 nt, Human; identical to SEQ ID NO: 382190

SEQ ID NO: 535340 - RNA, 64 nt, Human; identical to SEQ ID NO: 382191

SEQ ID NO: 535341 - RNA, 65 nt, Human
gugccucaggcaggcccacacaacuggccaccucuucccguuaaugaccacagcagacagaauuu

SEQ ID NO: 535342 - RNA, 65 nt, Human
uuuugagcuugugaaagauuucugaacagugauugucccguuaauagccccucagaagauguucc

SEQ ID NO: 535343 - RNA, 65 nt, Human
uacacagauuaugcaaaguuaagaguuguaucuuaucccguuaguacaguauguaauaguggguc

SEQ ID NO: 535344 - RNA, 65 nt, Human
ggauccuaauaaggggaaaaugguaaaugcaaacgucccguuacaauuuuaccgccagugugcug

SEQ ID NO: 535345 - RNA, 65 nt, Human
uucaugggggaaucugcccccaugacccagaccccucccguuaggcuucaccuccaacacugagg

SEQ ID NO: 535346 - RNA, 65 nt, Human
acugggccaggggccccgggucgcagagagcacguucccguuauuuauuccccuccgcguccuac

SEQ ID NO: 535347 - RNA, 65 nt, Human
uucuuuuuuuuccccccugcuccacacuucaaaacucccguuagaucagcauucuacuacaagag

SEQ ID NO: 535348 - RNA, 65 nt, Human
ugugaaacacuaauaaauguguuuuuacuuuuuauucccguuaaaacugauguaaaacaggauaa

SEQ ID NO: 535349 - RNA, 65 nt, Human
aaguuggggcugaaguaccuaagugugaaugucucucccguuaaacugaguguagaaaucugaau

SEQ ID NO: 535350 - RNA, 65 nt, Human
auuccaguaacuucuuccauauuuucucacuaaucucccguuagccaaaauaugccagaaauggg

SEQ ID NO: 535351 - RNA, 65 nt, Human
caaggaggcaccuggaggugaaacccagcuccagcucccguuagccaggacuuguccccuggcag

SEQ ID NO: 535352 - RNA, 65 nt, Human
guagucaauguauuuucagugaaaugcaaaaauauucccguuaucuuugaccaguauuaauuuuu

SEQ ID NO: 535353 - RNA, 65 nt, Human
gccaccgggugaccggcuuacagggauauuuuuaaucccguuauggacucugucuccaggagagg

SEQ ID NO: 535354 - RNA, 65 nt, Human
caugaauuuaauaauaaacuaaacuuuuuuuugucucccguuauugaaaaguaccaaagcuucuu

SEQ ID NO: 535355 - RNA, 65 nt, Human
aguggagaugagugauugagugagguagauugcugucccguuaacauagugcugaaaccaaaggc

SEQ ID NO: 535356 - RNA, 65 nt, Human
acuaauuugaaagccaaguguuaagucggauguuuucccguuacacuacuacucagcccucuccu

SEQ ID NO: 535357 - RNA, 65 nt, Human
agggaagcaauauagcuuccauucuaaggcuguauucccguuaugaauuacuagcugauuacagu

SEQ ID NO: 535358 - RNA, 65 nt, Human
ggaagcaugagacccgcccacacuagccucuguguucccguuagggacaucacacccugucucac

SEQ ID NO: 535359 - RNA, 65 nt, Human
cacuuucuaauguuuaaaucccauaaagcuaaguuucccguuaaagggaagugcuuugaagaugu

SEQ ID NO: 535360 - RNA, 65 nt, Human
uucauuugaaaggacuuggcccuguucuugggucuucccguuaccugcccccugggugguaaguu

SEQ ID NO: 535361 - RNA, 65 nt, Human
uuucuagggaagguaggucgguuuccauguuucccucccguuauuuuuauuuuuuacuuuuugcc

SEQ ID NO: 535362 - RNA, 65 nt, Human
aggggaaaaaaguuuguaauuauuucauccaaaucucccguuauauaucugugaauaauaagaga

SEQ ID NO: 535363 - RNA, 65 nt, Human
uuaacgugucugagagccauaaaugaccuaacguuucccguuagucucugaacuaggugaucuca

SEQ ID NO: 535364 - RNA, 65 nt, Human
auccuuaagaaguauuuccuuuccuuuuuauauagucccguuaggguuuaaaaccauauugauca

SEQ ID NO: 535365 - RNA, 65 nt, Human
cuuuaccacuaacuagcuguguggccuugaguaaaucccguuaccucucugagccucgguuaccc

SEQ ID NO: 535366 - RNA, 65 nt, Human
auuuuuuucuauuaaaauacucaugcauuuaaccuucccguuauucaaccagucucuugguugca

SEQ ID NO: 535367 - RNA, 65 nt, Human
cccacuagcccagguugcugugagucagcggaagcucccguuaugcccuuugcuccuggugggag

SEQ ID NO: 535368 - RNA, 65 nt, Human
ucaacuucccagugaucuguucaguuaaguucuucucccguuaaccaggaagugcuuauucucuc

SEQ ID NO: 535369 - RNA, 65 nt, Human
cucaggcuccagggacuuguggggugggaggggcuucccguuauccacgaggauuuguggguguc

SEQ ID NO: 535370 - RNA, 65 nt, Human
uccgucaauucucaggaaaguuuugcaggaaucucucccguuacuugaaaccugggcggacagau

SEQ ID NO: 535371 - RNA, 65 nt, Human
uaguuuuuguuaaacccuuuguaaaauaccaagguucccguuaacaaauuacggccucugcuugc

SEQ ID NO: 535372 - RNA, 65 nt, Human
cagcuacuugggauauauauuuaauuuucuuaaauucccguuaaacucuauuuuaugguuuugau

SEQ ID NO: 535373 - RNA, 65 nt, Human
uauugauuuuucccucacgaugaugaacaauuaucucccguuacucaccuagcaguaucuaacug

SEQ ID NO: 535374 - RNA, 65 nt, Human
gcucugcucaggccuggaagugaaagccgccuccuucccguuaugccccccauacaggagccucg

SEQ ID NO: 535375 - RNA, 64 nt, Human Herpes Virus 1
gcucgcucguggggcgcacgucccugggacaacgcggccuuaccacgcuauacguccaccacga

SEQ ID NO: 535376 - RNA, 64 nt, Human Herpes Virus 1
caagugccccaucugcagugguuccgggacguggcggccuuagagucccccgcaggccugcccc

SEQ ID NO: 535377 - RNA, 64 nt, Human Herpes Virus 2
cccaaauggucccugcguacgacucgggaaccgcggucgagagcgcgccggccgcguccucgcu

SEQ ID NO: 535378 - RNA, 64 nt, Human Herpes Virus 2
acgccacgcugcgcgcgcaccugcgggaaaucaaggucgagaacgccgaugcccaguuuuacgu

SEQ ID NO: 535379 - RNA, 64 nt, Human Herpes Virus 2
acgaugacggccccggggcgcggccuuccgcgacggucgagauucucgcgggccgcgugucggg

SEQ ID NO: 535380 - RNA, 64 nt, Human Herpes Virus 2; identical to SEQ ID NO: 535377

SEQ ID NO: 535381 - RNA, 64 nt, Human Herpes Virus 2
gccgugccgcgccccggcgcgcucccaaccgcagacucccaaauggucccugcguacgacucgg

SEQ ID NO: 535382 - RNA, 64 nt, Human Herpes Virus 2; identical to SEQ ID NO: 535381

SEQ ID NO: 535383 - RNA, 64 nt, Human Herpes Virus 1
gcuagacccacgggggggugggggugggcauccagggagaaaccccagcauaccuaaauaaaua

SEQ ID NO: 535384 - RNA, 64 nt, Human Herpes Virus 1
gcagagccguucaacgccaaccaccgaucgaucggggagaaauuuaccuacccgcuuccguuuu

SEQ ID NO: 535385 - RNA, 64 nt, Human Herpes Virus 1
gccaggcgcacaugcgcggacgcgaucgcgaccugggagaaaugcugcgcgccacgaucgcgga

SEQ ID NO: 535386 - RNA, 64 nt, Human Herpes Virus 1
ccgacgggugcguuauuaccucuucgaucgcccuccucacaaacucucuacugggggccgagcc

SEQ ID NO: 535387 - RNA, 64 nt, Human Herpes Virus 1; identical to SEQ ID NO: 535383

SEQ ID NO: 535388 - RNA, 64 nt, Human Herpes Virus 1; identical to SEQ ID NO: 535384

SEQ ID NO: 535389 - RNA, 64 nt, Human Herpes Virus 1; identical to SEQ ID NO: 535385

SEQ ID NO: 535390 - RNA, 64 nt, Human Herpes Virus 1; identical to SEQ ID NO: 535386

SEQ ID NO: 535391 - RNA, 64 nt, Human Herpes Virus 2
aggcccugaaccccuacgacugucugauccacagcaccccgaacacgcucgucgagcgggggcu

SEQ ID NO: 535392 - RNA, 64 nt, Human Herpes Virus 2
ccggaucuccggauccagccgacggaccgccgcccaccccgaacccggaccgucgccccgccgc

SEQ ID NO: 535393 - RNA, 64 nt, Human Herpes Virus 2
gcagagcgucacgcgagaagccgcccagcucauccaccccgaagcccccaugcugaugcaggac

SEQ ID NO: 535394 - RNA, 64 nt, Human Herpes Virus 2
cccaacagcagcuggcccaggggccgguggcgggcaccccgaacguguuuuccagcgacgugcc

SEQ ID NO: 535395 - RNA, 64 nt, Human Herpes Virus 2
ccggcggaccugaccgccgccuguucgcccccgccaccccgacgcgagacuuaccugcaggacg

SEQ ID NO: 535396 - RNA, 64 nt, Human Herpes Virus 2; identical to SEQ ID NO: 535392

SEQ ID NO: 535397 - RNA, 64 nt, Human Herpes Virus 2
aggcgggcagcacggacacggagauguucgaggcgggccugauggacgcggccacgcccccggc

SEQ ID NO: 535398 - RNA, 64 nt, Human Herpes Virus 2
ggcaacagaaggugggcgucgacgaggcgucggcgggccugacgcucggcggcgaugcgcugcg

SEQ ID NO: 535399 - RNA, 64 nt, Human Herpes Virus 2
agaacuacgugcgauucagcgcggaucgccugcugggccugauccauaugcagccccuguauuc

SEQ ID NO: 535400 - RNA, 64 nt, Human Herpes Virus 2
ggccccagguguuugucgggggccacgcggcggcgggccugacggagcugugucagacccucgc

SEQ ID NO: 535401 - RNA, 64 nt, Human Herpes Virus 2
cgccgcaccacgcccccgccgcccccagcaacccgggccugaucaucggcgcgcuggccggcag

SEQ ID NO: 535402 - RNA, 64 nt, Human Herpes Virus 2
aggccgacugccagcucugggcccugcuucggcggggccugacgaccgccuccacgcugcggug

SEQ ID NO: 535403 - RNA, 64 nt, Human Herpes Virus 2; identical to SEQ ID NO: 535397

SEQ ID NO: 535404 - RNA, 64 nt, Human Herpes Virus 2; identical to SEQ ID NO: 535397

SEQ ID NO: 535405 - RNA, 64 nt, Human Herpes Virus 2; identical to SEQ ID NO: 535398

SEQ ID NO: 535406 - RNA, 64 nt, Human Herpes Virus 2; identical to SEQ ID NO: 535399

SEQ ID NO: 535407 - RNA, 64 nt, Human Herpes Virus 2; identical to SEQ ID NO: 535400

SEQ ID NO: 535408 - RNA, 64 nt, Human Herpes Virus 2; identical to SEQ ID NO: 535401

SEQ ID NO: 535409 - RNA, 64 nt, Human Herpes Virus 2; identical to SEQ ID NO: 535402

SEQ ID NO: 535410 - RNA, 64 nt, Human Herpes Virus 2; identical to SEQ ID NO: 535397

SEQ ID NO: 535411 - RNA, 64 nt, Human Herpes Virus 4 (Epstein Barr virus)
cggcaugccuaauggccguccucuggacgcugguacccgccaagcacgcggugagggccgucac

SEQ ID NO: 535412 - RNA, 64 nt, Human Herpes Virus 4 (Epstein Barr virus)
cggguccugcuaccaugcuguugcgccagugggcacccgccaccaugcagacaccaccgagagc

SEQ ID NO: 535413 - RNA, 64 nt, Human Herpes Virus 4 (Epstein Barr virus)
guucuacuuuaacgcggccgggauagcauguauuacccgccaucuacucaaccccuccuucuac

SEQ ID NO: 535414 - RNA, 64 nt, Human Herpes Virus 4 (Epstein Barr virus)
uccggagccugcuucccuccacgcgcgccgccucacccgccaccccccucgaggccgcccuggc

SEQ ID NO: 535415 - RNA, 64 nt, Human Herpes Virus 4 (Epstein Barr virus)
uaccugucugaccuagaggaucucccucugcgacacccgccaacugaagaagcggagagcgacu

SEQ ID NO: 535416 - RNA, 64 nt, Human Herpes Virus 4 (Epstein Barr virus)
ccgcgccagagaccaccccuauuaaaacauacacacccgccauggaccuaaauccggaacagau

SEQ ID NO: 535417 - RNA, 64 nt, Human Herpes Virus 4 (Epstein Barr virus)
uccgggauuacacauucgcccgccuguuccagccacccgccaucgacgccgagcgugccgaggc

SEQ ID NO: 535418 - RNA, 64 nt, Human Herpes Virus 4 (Epstein Barr virus)
gaugaauguucugaaucuggaugaugcccaagacacccgccaggccaaggcucagaggaaggag

SEQ ID NO: 535419 - RNA, 64 nt, Human Herpes Virus 4 (Epstein Barr virus)
acagcgcggcaugcgagcuggcggugagcuacgcacccgccaugcuggaggccucgcacgagac

SEQ ID NO: 535420 - RNA, 63 nt, Human Herpes Virus 1
uacauggcccuggugucugccauggagcgcacggaacacaaggccaagaagaagggcacgagc

SEQ ID NO: 535421 - RNA, 64 nt, Human Herpes Virus 2
ggcggcgugcuuugugcgcgggugucgaucgagccccuuccauuacgggaucgcaggcaccauc

SEQ ID NO: 535422 - RNA, 64 nt, Human Herpes Virus 2
cuucucauccaccaauuacaucaugaacgaccgccccuuccaccgucucaucgugcagguggaa

SEQ ID NO: 535423 - RNA, 60 nt, Human Herpes Virus 4 (Epstein Barr virus)
agguaaguggacuuuaauuuuuucugcuaagcccaacacuccaccacacccaggcacaca

SEQ ID NO: 535424 - RNA, 60 nt, Human Herpes Virus 4 (Epstein Barr virus); identical to SEQ ID NO: 535423

SEQ ID NO: 535425 - RNA, 60 nt, Human Herpes Virus 4 (Epstein Barr virus); identical to SEQ ID NO: 535423

SEQ ID NO: 535426 - RNA, 60 nt, Human Herpes Virus 4 (Epstein Barr virus)
gccccacuguauccaccgcggaugucaccagcccaacaccagccggcacaacgucaggcg

SEQ ID NO: 535427 - RNA, 60 nt, Human Herpes Virus 4 (Epstein Barr virus)
gcagcucuucuacuauauuggcaccaugcugcccaacacgcggccacacagcuaugucuu

SEQ ID NO: 535428 - RNA, 64 nt, Human Herpes Virus 2; identical to SEQ ID NO: 535391

SEQ ID NO: 535429 - RNA, 64 nt, Human Herpes Virus 2; identical to SEQ ID NO: 535392

SEQ ID NO: 535430 - RNA, 64 nt, Human Herpes Virus 2; identical to SEQ ID NO: 535393

SEQ ID NO: 535431 - RNA, 64 nt, Human Herpes Virus 2; identical to SEQ ID NO: 535394

SEQ ID NO: 535432 - RNA, 64 nt, Human Herpes Virus 2; identical to SEQ ID NO: 535395

SEQ ID NO: 535433 - RNA, 64 nt, Human Herpes Virus 2; identical to SEQ ID NO: 535392

SEQ ID NO: 535434 - RNA, 64 nt, Human Herpes Virus 2
gggcuggccgcccugugccuggacgcccaggcggggcggccacuggcgucgacgaggcgcgugg

SEQ ID NO: 535435 - RNA, 64 nt, Human Herpes Virus 2
cgguaaaccgccacuacaucuacgacacgcaaggggcggccaucgccggcuccaaccucugcac

SEQ ID NO: 535436 - RNA, 64 nt, Human Herpes Virus 2
cgacggacagcucuauccugaguccgggggcccuggcggccaucgagaacuacgugcgauucag

SEQ ID NO: 535437 - RNA, 64 nt, Human Herpes Virus 2
uuccaccgucuccaccgugaccuccgcggccgucggcggccagggccccccgcgcaccuucacc

SEQ ID NO: 535438 - RNA, 64 nt, Human Herpes Virus 2
acaaccccgggggcguuuccugcgcggucaacgaggcggccauggcccgccucggagccgagcu

SEQ ID NO: 535439 - RNA, 64 nt, Human Herpes Virus 2
caccgcguacgcccuggccgugcuggcgcaucugggcggccagggcggucgggggcggcggcgg

SEQ ID NO: 535440 - RNA, 64 nt, Human Herpes Virus 2
ggcggcgcuggacaugguggacgcccugaucaucggcggccaggcgacgucgcccgacgaucag

SEQ ID NO: 535441 - RNA, 64 nt, Human Herpes Virus 2
uuuaccgcuucuuucucgugcccggcacgcacguggcggccaacccgcagcuggaccgcgaggg

SEQ ID NO: 535442 - RNA, 64 nt, Human Herpes Virus 2
gccucggcuggagcgcggcgcguacgccagggccggcggccagagccgacauguuucgggucga

SEQ ID NO: 535443 - RNA, 64 nt, Human Herpes Virus 2
gcgguccggcucgcggcgcggcgagggccauggaggcggccaagggccgcguguucgcagcuca

SEQ ID NO: 535444 - RNA, 64 nt, Human Herpes Virus 2
cgccaagcaggcgcucggcgagguggagcugucgggcggccagcugagccgcgccauccuagcg

SEQ ID NO: 535445 - RNA, 64 nt, Human Herpes Virus 2
acaagcgcgucuucugcgccgcggucgggcgccuggcggccacgcacgcccggcuggcggcggu

SEQ ID NO: 535446 - RNA, 64 nt, Human Herpes Virus 2
cggagauccauaaaagggaacgggaggaccgagaggcggccagaacugcggugaccgacccgga

SEQ ID NO: 535447 - RNA, 64 nt, Human Herpes Virus 2
accccggcccggcacgagcucccgggcggaccccggccccgagcggccgccgcggcagaccccc

SEQ ID NO: 535448 - RNA, 64 nt, Human Herpes Virus 2
gaagugugccaggaagacgcgccacgcggagggcggccccgagcccggggcccgcgacccggcg

SEQ ID NO: 535449 - RNA, 64 nt, Human Herpes Virus 2
ucauggucgcggucaucauggccauuuaccuggcggccccgaccgggauccccccggccuuuuu

SEQ ID NO: 535450 - RNA, 64 nt, Human Herpes Virus 2
gcugcuggccuucaugaccuucgucaagcaguacggccccgaguucgugaccggguacaacauc

SEQ ID NO: 535451 - RNA, 64 nt, Human Herpes Virus 2
caugccccgggugcagcucgcguuucgguucaugggccccgaggacgccguucgcacgcggcgg

SEQ ID NO: 535452 - RNA, 64 nt, Human Herpes Virus 2
acccccuagauacccacgcgucgggggccggggcggccccgauuccggugugccccacccccga

SEQ ID NO: 535453 - RNA, 64 nt, Human Herpes Virus 2
cgguggauaucgagaucggguucauccgaucccaggccccgacggacagcucuauccugagucc

SEQ ID NO: 535454 - RNA, 64 nt, Human Herpes Virus 2
ccacagccugcgcuugccguauuucgccaagaucggccccgacggcuccgcgugcggccgguua

SEQ ID NO: 535455 - RNA, 64 nt, Human Herpes Virus 2
gugcgagcugcccugucugaacgccaggcguuacggccccgagugugauguuggcaaucucgag

SEQ ID NO: 535456 - RNA, 64 nt, Human Herpes Virus 2
gcgccccgcggcgcugacccgccggcccgccgagggccccgacccgcagggcggcuggcgccgc

SEQ ID NO: 535457 - RNA, 64 nt, Human Herpes Virus 2
ggccaacgugcgguaccgcgugcgcacgcgcuucggccccgacacgcuggugcccauguccccg

SEQ ID NO: 535458 - RNA, 64 nt, Human Herpes Virus 2
gaccccgcccgcgaccccgauagucccccgaagcggccccgacccaacagccuagaucuggcga

SEQ ID NO: 535459 - RNA, 64 nt, Human Herpes Virus 2
agacgcugcuggagcugcugguuagcguguacguggccccgagccugggcguccccgugacccg

SEQ ID NO: 535460 - RNA, 64 nt, Human Herpes Virus 2
ucguguuggacagccccgcggccuauggcgcgguggccccgagcgcggcccgccugaucgacgc

SEQ ID NO: 535461 - RNA, 64 nt, Human Herpes Virus 2
cggccggccccagguaucgcgucuuuguccugggggccccgacgcccgccgacaacggcucggc

SEQ ID NO: 535462 - RNA, 64 nt, Human Herpes Virus 2
cuccgacuguccgcugguggccaucgucgagagcggccccgacggcugcaucggaccccgcucg

SEQ ID NO: 535463 - RNA, 64 nt, Human Herpes Virus 2
cgcggggacgcccgcgagcgaggacggggagcgcggccccgagccaggggcgcaggggccggag

SEQ ID NO: 535464 - RNA, 64 nt, Human Herpes Virus 2
cgggggccgguucgugagccugcuucgggccgcgggccccgaggccaucuucaagcacauguuc

SEQ ID NO: 535465 - RNA, 64 nt, Human Herpes Virus 2
gccaccgcggagcugguccggacguccucgaaucggccccgacgcagcgaggacgcgcuggucg

SEQ ID NO: 535466 - RNA, 64 nt, Human Herpes Virus 2
ccgaccggccccccgaggccgcccgcccgcccugggccccgagggacacaccgcaggcggggca

SEQ ID NO: 535467 - RNA, 64 nt, Human Herpes Virus 2
cucggccggcuaucaggccgcacgcgcggccacgggccccgagcggguggccgaguucguucag

SEQ ID NO: 535468 - RNA, 64 nt, Human Herpes Virus 2
gcucagcgcgggaggggccgcgcccccccaccccggccccgacgccgcggucuuucgcaguucg

SEQ ID NO: 535469 - RNA, 64 nt, Human Herpes Virus 2; identical to SEQ ID NO: 535448

SEQ ID NO: 535470 - RNA, 64 nt, Human Herpes Virus 2; identical to SEQ ID NO: 535447

SEQ ID NO: 535471 - RNA, 64 nt, Human Herpes Virus 2; identical to SEQ ID NO: 535457

SEQ ID NO: 535472 - RNA, 64 nt, Human Herpes Virus 2; identical to SEQ ID NO: 535456

SEQ ID NO: 535473 - RNA, 64 nt, Human Herpes Virus 1
gcugcaccgauguauuuacgcgguacgccccaccggcaccaacaacgacaccgcccucgugugg

SEQ ID NO: 535474 - RNA, 64 nt, Human Herpes Virus 4 (Epstein Barr virus)
cucccccggccgcaaauucugccccccucugcucccuguuaaacauauauaaugaccucagggc

SEQ ID NO: 535475 - RNA, 64 nt, Human Herpes Virus 4 (Epstein Barr virus)
gugcccccaccacucccaccaccccccccaccaccacccccaccacccccaccacccccaccac

SEQ ID NO: 535476 - RNA, 64 nt, Human Herpes Virus 4 (Epstein Barr virus)
ccacucccaccaccccccccaccaccacccccaccacccccaccacccccaccacccccaccac

SEQ ID NO: 535477 - RNA, 64 nt, Human Herpes Virus 4 (Epstein Barr virus)
ccaccccccccaccaccacccccaccacccccaccacccccaccacccccaccacccccaccac

SEQ ID NO: 535478 - RNA, 64 nt, Human Herpes Virus 4 (Epstein Barr virus)
ccaccaccacccccaccacccccaccacccccaccacccccaccacccccaccaccuccaccac

SEQ ID NO: 535479 - RNA, 64 nt, Human Herpes Virus 4 (Epstein Barr virus)
cccccaccacccccaccacccccaccacccccaccacccccaccaccuccaccaccuucaccac

SEQ ID NO: 535480 - RNA, 64 nt, Human Herpes Virus 4 (Epstein Barr virus)
ccuccaccaccuucaccaccacccccgcccccaccacccccaccaccucagcgcagggaugccu

SEQ ID NO: 535481 - RNA, 64 nt, Human Herpes Virus 4 (Epstein Barr virus)
cgucguggcccucgucuccucgaucgucacccugcacccccacuuggaggaggugaagguagcc

SEQ ID NO: 535482 - RNA, 64 nt, Human Herpes Virus 4 (Epstein Barr virus)
ggcagacauuggagcagcaccugauccgugaaaucacccccaucgugacgcaucgagaggcaaa

SEQ ID NO: 535483 - RNA, 64 nt, Human Herpes Virus 4 (Epstein Barr virus)
ccucaggcaccauuaugagaaaugucagauucgccacccccaucguccggcucuugugccaagg

SEQ ID NO: 535484 - RNA, 64 nt, Human Herpes Virus 4 (Epstein Barr virus)
gggugccuucuuggcgauggacgcucacaccuaccacccccacccacaccccccuccggccuac

SEQ ID NO: 535485 - RNA, 64 nt, Human Herpes Virus 4 (Epstein Barr virus)
cugcguccggaguggcucagucuaaggagcccaccacccccaaggccaagucugugucagccca

SEQ ID NO: 535486 - RNA, 64 nt, Human Herpes Virus 4 (Epstein Barr virus)
cccaauauccaucugcuucuggcucuucugggaacacccccaccccaccgaacgaugaggaacg

SEQ ID NO: 535487 - RNA, 64 nt, Human Herpes Virus 4 (Epstein Barr virus)
uugagcugggcaaagauuuucugcgugagaugaacacccccauacaugucucagaggccguguu

SEQ ID NO: 535488 - RNA, 64 nt, Human Herpes Virus 4 (Epstein Barr virus)
ccaacuucugcuucaaguccauguggcccagaaccacccccacuuuucuuacccucccuggacc

SEQ ID NO: 535489 - RNA, 64 nt, Human Herpes Virus 4 (Epstein Barr virus)
caacagaaaaaacaucaucucgugcgaaaagaagcacccccaucaucugccggacgugcaguuc

SEQ ID NO: 535490 - RNA, 64 nt, Human Herpes Virus 4 (Epstein Barr virus)
uuugucuccucucaauaucugcagcugcccugcccacccccacaggucagggucguugcucccc

SEQ ID NO: 535491 - RNA, 64 nt, Human Herpes Virus 4 (Epstein Barr virus)
ccgccauggaccuaaauccggaacagaucacagucacccccagaagccccucgguucucgccgc

SEQ ID NO: 535492 - RNA, 64 nt, Human Herpes Virus 4 (Epstein Barr virus)
cccccagauggaggaggacaagggucccaucaaccacccccaguaccccggggacgugggccug

SEQ ID NO: 535493 - RNA, 64 nt, Human Herpes Virus 4 (Epstein Barr virus)
gggccaaccggccccugccugccucuuuggcucccacccccacaggaccuguccaugaaccggu

SEQ ID NO: 535494 - RNA, 64 nt, Human Herpes Virus 4 (Epstein Barr virus)
uaacaacaaucacgacaguaugucaucaaagccacacccccauaauucgaagugguguggccga

SEQ ID NO: 535495 - RNA, 64 nt, Human Herpes Virus 4 (Epstein Barr virus)
ucccugccuggcaccaggguccggccugggagcgcacccccauccccgccggagcggggcagcg

SEQ ID NO: 535496 - RNA, 64 nt, Human Herpes Virus 4 (Epstein Barr virus)
gcugaaggcggacugcgccgccgccuucacggcgcacccccaguaccgggccauccugcaaaag

SEQ ID NO: 535497 - RNA, 64 nt, Human Herpes Virus 4 (Epstein Barr virus)
ggggcucuuccaugcggaagaaguuugucuuugccacccccacccuaggguugaccgugaagcg

SEQ ID NO: 535498 - RNA, 64 nt, Human Herpes Virus 4 (Epstein Barr virus)
guaagaucuaacauucccuaggaauuauuuaccacacccccacuuuuccaacccuaacacucuu

SEQ ID NO: 535499 - RNA, 64 nt, Human Herpes Virus 4 (Epstein Barr virus)
uugcccccgaggacauugugaagguaugugccggucuaacaacaaucacgacaguaugucauca

SEQ ID NO: 535500 - RNA, 64 nt, Human Herpes Virus 1
ucuguuuuugcggggcguacauuucgacgcccucagggcccagcgcgaucuacgggagcugcgg

SEQ ID NO: 535501 - RNA, 64 nt, Human Herpes Virus 1
gcggccuccuagggucaauucgcgcgagcuguacagggcccaacgcgcggcgcgcggcucgucu

SEQ ID NO: 535502 - RNA, 64 nt, Human Herpes Virus 1
ggcgcggcagugagcagcccgacccacccggaggccagcggacacggggcgugcgccaagcacc

SEQ ID NO: 535503 - RNA, 63 nt, Human Herpes Virus 4 (Epstein Barr virus)
gaaacuuggaacagauuuauaacacacaccgaacauguggaucuggauuuuaacucaguauuu

SEQ ID NO: 535504 - RNA, 63 nt, Human Herpes Virus 2
cgccgcgccugccgccgccugccccccgccgccgccgcgcaaggagcgcgggccgcagcgccc

SEQ ID NO: 535505 - RNA, 63 nt, Human Herpes Virus 2
cuccagauguucguuuugugcaagcgcgccaacgccgcgcaggugcgcgagcagcugcgggcg

SEQ ID NO: 535506 - RNA, 63 nt, Human Herpes Virus 2
cgagcagcugcgggcgguuauucggucgcgcaagccgcgcaaguauuacacgcgguccucgga

SEQ ID NO: 535507 - RNA, 63 nt, Human Herpes Virus 2
ccggaaguucgcggccgccccaccgucggggcggccgcgcacgagggcggacagcgggacccc

SEQ ID NO: 535508 - RNA, 63 nt, Human Herpes Virus 2
ccccccgcgugcgaggacguuccggcguucgucgccgcgcacgccgacccgcggcgcuuccac

SEQ ID NO: 535509 - RNA, 63 nt, Human Herpes Virus 2
cuaccucaugggcuacugccggacccgccuggggccgcgcacguggggccgccugcugcagau

SEQ ID NO: 535510 - RNA, 63 nt, Human Herpes Virus 2
ugcccggagccagcggccauccuccuguuccgggccgcgcagccccccccgacguccggaccu

SEQ ID NO: 535511 - RNA, 63 nt, Human Herpes Virus 2
guguucgggccgggggucuucgcgcgcguggaggccgcgcacgcgcgccuguaccccgacgcg

SEQ ID NO: 535512 - RNA, 63 nt, Human Herpes Virus 2
gggcuguucaacguggaccccggggacgcggacgccgcgcacggcgcgauccaggacgcccgc

SEQ ID NO: 535513 - RNA, 63 nt, Human Herpes Virus 2
cuggggcuguucaacccggccauggagcgcuucgccgcgcacgccggggaccuggugcccgcc

SEQ ID NO: 535514 - RNA, 63 nt, Human Herpes Virus 2
cgaugacgcuccugcggaggccgggcugguggcgccgcgcaugucguuucucuccgcgggaca

SEQ ID NO: 535515 - RNA, 63 nt, Human Herpes Virus 2; identical to SEQ ID NO: 535504

SEQ ID NO: 535516 - RNA, 63 nt, Human Herpes Virus 2; identical to SEQ ID NO: 535511

SEQ ID NO: 535517 - RNA, 63 nt, Human Herpes Virus 2
gaggauguguucuccuggacgcgguauuguacccccgacgacgugcgcgugguuaucaucggg

SEQ ID NO: 535518 - RNA, 63 nt, Human Herpes Virus 2
uacauccagcgccacggccuguacguucccgcgcccgacgaaccgacguuggccgaugccaug

SEQ ID NO: 535519 - RNA, 63 nt, Human Herpes Virus 2
gacguuccccgagacaccagcacccgcgugaaccccgacgacguggcccaccgcgacgacguc

SEQ ID NO: 535520 - RNA, 63 nt, Human Herpes Virus 2
gcggaaccgaccgcccccgcaaccacuacuccccccgacgagauggccacacaagccgcaacg

SEQ ID NO: 535521 - RNA, 63 nt, Human Herpes Virus 2
gucguggagcccgccccugugccgaccccgacccccgacgacuacgacgaagaagacgacgcg

SEQ ID NO: 535522 - RNA, 63 nt, Human Herpes Virus 2
cgcgagaacgcggcgcugaccggggcgcgaacccccgacgacggcggcgacgccaaccgccac

SEQ ID NO: 535523 - RNA, 63 nt, Human Herpes Virus 2
cugggcccgcgggacgggggcccggacgacuuccccgacgacgaccuugacguuaucuucgcc

SEQ ID NO: 535524 - RNA, 63 nt, Human Herpes Virus 2
gacgcccugaucaucggcggccaggcgacgucgcccgacgaucagaucgaggcgcugauacgc

SEQ ID NO: 535525 - RNA, 63 nt, Human Herpes Virus 2
gccggccuacgagcgccuuugaccugcauguuucccgacgacuggcgccaagggcgccgagcg

SEQ ID NO: 535526 - RNA, 63 nt, Human Herpes Virus 2
ccgcccccggaccaacgcgcuggccaacgacggcccgacgaacgucgccgcccucagcgcccu

SEQ ID NO: 535527 - RNA, 63 nt, Human Herpes Virus 2
gaaccggaccagauggaaaacacguaucugcugcccgacgaugacgccgccaugcccgcgggc

SEQ ID NO: 535528 - RNA, 63 nt, Human Herpes Virus 2
cuccagacggucgugcccagcggccuggacauccccgacgacccggcgggcgacugcgacccc

SEQ ID NO: 535529 - RNA, 63 nt, Human Herpes Virus 2; identical to SEQ ID NO: 535522

SEQ ID NO: 535530 - RNA, 64 nt, Human Herpes Virus 2
acagcgcgcgcgggcgccggcgaugcggacgcggggcggcgacgcggcgcuaugcgcccccgag

SEQ ID NO: 535531 - RNA, 64 nt, Human Herpes Virus 2
uccgguccagcgaggccgccacccgacagcugcaggcggcgaucuuccacgcgcuccucaacgc

SEQ ID NO: 535532 - RNA, 64 nt, Human Herpes Virus 2
gggcgucgacgaggcgucggcgggccugacgcucggcggcgaugcgcugcgcgucccuuuuuug

SEQ ID NO: 535533 - RNA, 64 nt, Human Herpes Virus 2
gcaaagccucccggaaagaccacuagcccgcagaggcggcgauugaacccaaggcagagguacg

SEQ ID NO: 535534 - RNA, 64 nt, Human Herpes Virus 2
acaggaaccccgggagcccgaggucgcccccccuggcggcgaccacguguuuugcaggaaaguc

SEQ ID NO: 535535 - RNA, 64 nt, Human Herpes Virus 2
gguuugcggcgggggugcuggugcggccgcggauggcggcgagccggcggucggggugaucgcc

SEQ ID NO: 535536 - RNA, 64 nt, Human Herpes Virus 2
cccccgucgaccaaggcaccgcauccccgaggcgggcggcgaggucgccgccggggccgggguc

SEQ ID NO: 535537 - RNA, 64 nt, Human Herpes Virus 2
gcccauccuccuucggcaguauggagggugucgcggcggcgagccgccguccccaaagacgugc

SEQ ID NO: 535538 - RNA, 64 nt, Human Herpes Virus 2
cgccgcggagacauucgaguaccagaucgaacucggcggcgagcugcacgugggucuguugugg

SEQ ID NO: 535539 - RNA, 64 nt, Human Herpes Virus 2
cgcggcgcugaccggggcgcgaacccccgacgacggcggcgacgccaaccgccacgacggcgac

SEQ ID NO: 535540 - RNA, 64 nt, Human Herpes Virus 2
ccgucgccccccgcccgcuuaugggauuuuacgaggcggcgacgcaaaaccaggccgacugcca

SEQ ID NO: 535541 - RNA, 64 nt, Human Herpes Virus 2
cgaguggcuggaccgcgggugggaagcucuggccggcggcgaccggcccgacuggcuguggagc

SEQ ID NO: 535542 - RNA, 64 nt, Human Herpes Virus 2
cuucuucgcgggcguggccgacgucgagcuucccggcggcgaaguccccccggccgguccgggg

SEQ ID NO: 535543 - RNA, 64 nt, Human Herpes Virus 2
acaugauuccggccgcgcuaaguccgggcagggcggcggcgacgggggaucgcgauaucguggu

SEQ ID NO: 535544 - RNA, 64 nt, Human Herpes Virus 2; identical to SEQ ID NO: 535539

SEQ ID NO: 535545 - RNA, 64 nt, Human Herpes Virus 2
gcacucgcuuccgaccgacgggcccccgcaccggggcggcgaccaugauccggcggcggggaaa

SEQ ID NO: 535546 - RNA, 64 nt, Human Hepatitis C Virus (M1LE)
gcuccaacucaagcauuguguaugaggcagcggacaucaucaugcauacccccgggugcgugcc

SEQ ID NO: 535547 - RNA, 64 nt, Human Hepatitis C Virus (M1LE)
cuuacucccaacagacgcggggccuacucgguugcaucaucaccagccucacaggucgggacaa

SEQ ID NO: 535548 - RNA, 64 nt, Human Hepatitis C Virus (M1LE)
gcaacguguccgggauauaccaugucacgaacgacugcuccaacucaagcauuguguaugaggc

SEQ ID NO: 535549 - RNA, 64 nt, Human Herpes Virus 2
ggccagcacgagcuuuuuguacaaccuccgcggggccgccgacgagcugcucaacguggucacc

SEQ ID NO: 535550 - RNA, 64 nt, Human Herpes Virus 2
ggccgcggcggcccuggagaacgccgcccuccaggccgccgagcugcccgucgacaucgagcgc

SEQ ID NO: 535551 - RNA, 64 nt, Human Herpes Virus 2
ggacccggcgacgcgcgagggggugcgacgcgaggccgccgaggccgagcucgcgcuggccggg

SEQ ID NO: 535552 - RNA, 64 nt, Human Herpes Virus 2
ggaggcccagaucgccgcgcuggugggggccaucgccgccgaccgccaggcgggugggcuuccg

SEQ ID NO: 535553 - RNA, 64 nt, Human Herpes Virus 2
gccggagaccacgggauccgggggucggcgaagcgccgccgacacgagguggagcagccggagu

SEQ ID NO: 535554 - RNA, 64 nt, Human Herpes Virus 2
cagcgcggcccacgugaacguggacacggcccgggccgccgaucuguuugugucacagaugaug

SEQ ID NO: 535555 - RNA, 64 nt, Human Herpes Virus 2
ggacgccguucgcacgcggcggauccugugucgcgccgccgagcaggcccucgcccgucgccgc

SEQ ID NO: 535556 - RNA, 64 nt, Human Herpes Virus 2
ggccgcgugcgccgccgccuacgaugcgcgcgacgccgccgaggcgguccgggcccacaucacg

SEQ ID NO: 535557 - RNA, 64 nt, Human Herpes Virus 2
ugggguuccuccgcgccccccccgcguucgcccggccgccgacgcgugugugcgcguggcugag

SEQ ID NO: 535558 - RNA, 64 nt, Human Herpes Virus 2
cgcuggguuuccgcuguauguggagcgccgcaucgccgccgacguacgcgagaccggcgcgcug

SEQ ID NO: 535559 - RNA, 64 nt, Human Herpes Virus 2
cgcaauccgggaggucgaggcgcauuuugaacccgccgccgagcccgugugcgagcugcccugu

SEQ ID NO: 535560 - RNA, 64 nt, Human Herpes Virus 2
gccggaggagaacgaagacgaggccgacgacgccgccgccgaugccgaugccgacgaggcggcc

SEQ ID NO: 535561 - RNA, 64 nt, Human Herpes Virus 2
uggaggugguggggaccgccgcggggcuggccacgccgccgaggcgcgagcccguggacaugga

SEQ ID NO: 535562 - RNA, 64 nt, Human Herpes Virus 2
acgccgggacgccgccggcgcaucggcaaccagggccgccgacaccagcgaccgcucuccgggg

SEQ ID NO: 535563 - RNA, 64 nt, Human Herpes Virus 2
gggcuggcccacguuuaccgugccggccgccgccgccgccgagucggcgcgugaccuggugcgg

SEQ ID NO: 535564 - RNA, 64 nt, Human Herpes Virus 2
cugccaggaccccgacacgucccugucggcccaggccgccgagacggaggaggugggccuuuuc

SEQ ID NO: 535565 - RNA, 64 nt, Human Herpes Virus 2
ccucuggcgccugacgcgccgcgcccccccguccgccgccgaagccgucgccccccgcccgcuu

SEQ ID NO: 535566 - RNA, 64 nt, Human Herpes Virus 2
gacggcgccgucuccggagcccgccccgggucccgccgccgauccagcuuccgggagcggcuuc

SEQ ID NO: 535567 - RNA, 64 nt, Human Herpes Virus 2
agcugccucccccccggaggaaacccccgaccccgccgccgaacagcucgcggacgagcccgug

SEQ ID NO: 535568 - RNA, 64 nt, Human Herpes Virus 2
cuccgagcuggccacggcccugacggaggccugugccgccgagcgcgucgugcgcccccaccag

SEQ ID NO: 535569 - RNA, 64 nt, Human Herpes Virus 2
gcugcugcacaacacccaggcccgcgcggccgacgccgccgacgaccggccgcaccggccggcc

SEQ ID NO: 535570 - RNA, 64 nt, Human Herpes Virus 2
ccgggaggggucgcacaccgagcacaccagcuacgccgccgaccgcuucaagcaggucgacggc

SEQ ID NO: 535571 - RNA, 64 nt, Human Herpes Virus 2
ccaauccggccccggcccuucacccggcccauuggccgccgaccuccguccccacgucccagua

SEQ ID NO: 535572 - RNA, 64 nt, Human Herpes Virus 2
uuccgacggacguccucgaauucucgcggcgagcgccgccgacguacgugcugaccgucgugaa

SEQ ID NO: 535573 - RNA, 64 nt, Human Herpes Virus 2
acgggggcgggcuguccccccggcguuccacgccgccgccgaaagcgcugcggcaggcgagggc

SEQ ID NO: 535574 - RNA, 64 nt, Human Herpes Virus 2
gcggcagggccccgugcccgcccuggggucggcggccgccgacccaggcgcggcuggaggacgu

SEQ ID NO: 535575 - RNA, 64 nt, Human Herpes Virus 2
caugcccgcgggcgucgggcuuggcgccacccccgccgccgacaccaccgccgccgccgccugg

SEQ ID NO: 535576 - RNA, 64 nt, Human Herpes Virus 2
uguucgucgcgcucgucgcgggcgugcccggggagccgccgaacgcggcaggcgcacgcggcgu

SEQ ID NO: 535577 - RNA, 64 nt, Human Herpes Virus 2; identical to SEQ ID NO: 535561

SEQ ID NO: 535578 - RNA, 64 nt, Human Herpes Virus 2; identical to SEQ ID NO: 535560

SEQ ID NO: 535579 - RNA, 64 nt, Human Herpes Virus 4 (Epstein Barr virus)
gggcuggccugccuggaucugagcuauguggaaaugagggaauuugugguuuggggcaggcccc

SEQ ID NO: 535580 - RNA, 64 nt, Human Herpes Virus 4 (Epstein Barr virus)
cuauguugggugcaaaaggccaacccagcccuggugagggaacacgaccacgagaaucaaacga

SEQ ID NO: 535581 - RNA, 64 nt, Human Herpes Virus 4 (Epstein Barr virus)
accggcugcugcgacaucuggcgcgugcgccucgugagggaaauaaccaggaucaccacccccg

SEQ ID NO: 535582 - RNA, 60 nt, Human Herpes Virus 4 (Epstein Barr virus)
uagcuccacccagcucuccuucuucaacaauguccacaagauaauacccaacaagaccuu

SEQ ID NO: 535583 - RNA, 60 nt, Human Herpes Virus 4 (Epstein Barr virus)
cuccaucuccucgccucccuugccccccuuuguccacaacgccacaggcagcucccucga

SEQ ID NO: 535584 - RNA, 60 nt, Human Herpes Virus 4 (Epstein Barr virus)
cggccaaacggcgcgcgcggauccggccuauguccacagccccuucuucccggccgccuu

SEQ ID NO: 535585 - RNA, 60 nt, Human Herpes Virus 4 (Epstein Barr virus)
ccugucuguuagaucaucaccauggaggccuguccacacauacgcuacgccuuccagaau

SEQ ID NO: 535586 - RNA, 55 nt, Human Herpes Virus 4 (Epstein Barr virus)
gccaaacgcaugagagagcuauggauguccacauugacaaccaaguguugagugg

SEQ ID NO: 535587 - RNA, 60 nt, Human Herpes Virus 4 (Epstein Barr virus)
cuguagccaaacgcaugagagagcuauggauguccacauugacaaccaaguguugagugg

SEQ ID NO: 535588 - RNA, 63 nt, Human Herpes Virus 2
cgggggacagcuggugggggcgcacgacgcgcucggcggcacaggccuccgucagggccgugg

SEQ ID NO: 535589 - RNA, 63 nt, Human Herpes Virus 2
cugcgugaccgcuggagccuuguggccgagcggcggcggcaggccgggaucgccggacacacg

SEQ ID NO: 535590 - RNA, 63 nt, Human Herpes Virus 2
cauccguggagucgucgccacuccccgccgcggcggcggcaacgcccggggccgggcacacga

SEQ ID NO: 535591 - RNA, 63 nt, Human Herpes Virus 2
gcugaugcgccugcgcggggaccugcgcguggccggcggcagcgaggccgccguggccgccgu

SEQ ID NO: 535592 - RNA, 63 nt, Human Herpes Virus 2
acccggguguucgcguucgcggaggagcugcggcggcggcacgcgacggccggcguggccgag

SEQ ID NO: 535593 - RNA, 63 nt, Human Herpes Virus 2
gcagacggccagcucggugaaguuugcggucugcggcggcaccggggcugcguucugggggcu

SEQ ID NO: 535594 - RNA, 63 nt, Human Herpes Virus 2
cuaaaacucaacgcgcuccaggugcgcgugcugcggcggcaccugcggccggggcuggaggcu

SEQ ID NO: 535595 - RNA, 63 nt, Human Herpes Virus 2
ggcgggccggacgccgcccuguuuccgccgcagcggcggcaguucgagacgugggccgucggc

SEQ ID NO: 535596 - RNA, 63 nt, Human Herpes Virus 2
ccgcgcccacccacguccagccgccccgggcgccggcggcaggcgaggccccccggggggccu

SEQ ID NO: 535597 - RNA, 63 nt, Human Herpes Virus 2
ccuggcccaccugugggagaccggcaagcgcagcggcggcacguacgggaucguggacgccau

SEQ ID NO: 535598 - RNA, 63 nt, Human Herpes Virus 2; identical to SEQ ID NO: 535591

SEQ ID NO: 535599 - RNA, 64 nt, Human Herpes Virus 4 (Epstein Barr virus)
augugcugaccugccaugccagcggccguguguacugcuccaacugcggcucugcggcgguggg

SEQ ID NO: 535600 - RNA, 64 nt, Human Herpes Virus 4 (Epstein Barr virus)
cucagaccccgaggcugauguccuggccgggcgccugcuccaccgccuuaaggccgagucaguu

SEQ ID NO: 535601 - RNA, 64 nt, Human Herpes Virus 4 (Epstein Barr virus)
acuacuuugagcaccuaaccucccagacggugugcugcuccacgcccuuuaugcgcuuugccgg

SEQ ID NO: 535602 - RNA, 64 nt, Human Herpes Virus 4 (Epstein Barr virus)
gagaugccacccagugugccaccuuugugguggccugcuccauucuucagggaucccccacuua

SEQ ID NO: 535603 - RNA, 64 nt, Human Herpes Virus 4 (Epstein Barr virus)
cugccuggccaauaacuacauaaguagggaugagcugcuccacacccgcgcugccucccuguua

SEQ ID NO: 535604 - RNA, 64 nt, Human Herpes Virus 4 (Epstein Barr virus)
gggggugccugugccucgucuaccucuguuccuucugcuccagugccuccgccugagccgcuua

SEQ ID NO: 535605 - RNA, 64 nt, Human Herpes Virus 4 (Epstein Barr virus)
ugguuaguucucucagcaccauguucugccucuucugcuccaggcaccaggcccgcgcaagguc

SEQ ID NO: 535606 - RNA, 64 nt, Human Herpes Virus 4 (Epstein Barr virus)
cacaaauggaaaagggcgccuaaucaugcaucuccugcuccagggcaccucccuucacauccca

SEQ ID NO: 535607 - RNA, 64 nt, Human Herpes Virus 4 (Epstein Barr virus)
cguucccguggccguggaucauuauuucgacaagcugcuccaaggagcggccaacauccuccag

SEQ ID NO: 535608 - RNA, 63 nt, Human Herpes Virus 4 (Epstein Barr virus)
cugauauugucccccuagccccgggcccagcccuccucagaaaacucugcauggagaagcugg

SEQ ID NO: 535609 - RNA, 63 nt, Human Herpes Virus 4 (Epstein Barr virus)
uggagucugagaauaaggcucugaagcaacagguccucagagggggugccugugccucgucua

SEQ ID NO: 535610 - RNA, 63 nt, Human Herpes Virus 4 (Epstein Barr virus)
gccguuuuggacuccuccccauucuccuucuccuccucagacuuuuccgaccaggacgaggga

SEQ ID NO: 535611 - RNA, 63 nt, Human Herpes Virus 4 (Epstein Barr virus)
agcgaagaacacuccacagauggagagauuucauccucagaggaggaggaugaagauccaacu

SEQ ID NO: 535612 - RNA, 63 nt, Human Herpes Virus 4 (Epstein Barr virus)
gggcgugaccggauguuuuaaaggguccaguccuccucagaucucaaacaaugauggaaacac

SEQ ID NO: 535613 - RNA, 64 nt, Human Hepatitis C Virus
cuacaucaaggcccgggcagccugucgagccgcagggcuccaggacugcaccaugcucgugugu

SEQ ID NO: 535614 - RNA, 64 nt, Human Herpes Virus 2
gccgaggcggucaucggaccgugccuggagcccgaggcccgagcucgggcccgagcccgagccc

SEQ ID NO: 535615 - RNA, 64 nt, Human Herpes Virus 2
uaugcucuggggcgcccaugcccagaacgcgaucaggcccgacccucgccaacacuacguccuc

SEQ ID NO: 535616 - RNA, 64 nt, Human Herpes Virus 2
acgcgccugcgccccuuucugcagugcuaccugaaggcccgaggccugugcgggcuggacgacc

SEQ ID NO: 535617 - RNA, 64 nt, Human Herpes Virus 2
gaggccccccagaucgugcgcggggcuucggacgaggcccgaaagcacacguacaaccugacca

SEQ ID NO: 535618 - RNA, 64 nt, Human Herpes Virus 2
gaggggggcggguuugacgaggccaaguuggccgaggcccgagaaaugauccgauauauggcuu

SEQ ID NO: 535619 - RNA, 64 nt, Human Herpes Virus 2; identical to SEQ ID NO: 535614

SEQ ID NO: 535620 - RNA, 64 nt, Human Herpes Virus 4 (Epstein Barr virus)
gaauuugacauuuuuauuaacuacauagaagcauacaugacaauuaaagccaggugauaauucc

SEQ ID NO: 535621 - RNA, 64 nt, Human Herpes Virus 1
guaugacagcggggacucgggcgaguuggcauuggauccggauacggugcgggcggcccugccu

SEQ ID NO: 535622 - RNA, 64 nt, Human Herpes Virus 1
uuuaccgcauccuggggguucuggugcaccugcggauccggacccgggaggccuccuuugagga

SEQ ID NO: 535623 - RNA, 64 nt, Human Herpes Virus 1
ccaggacuccgcgucggacgcggucagccacggcgauccggaagaccucgauggcgcugcccgg

SEQ ID NO: 535624 - RNA, 64 nt, Human Herpes Virus 1
gggcaucaaucucgccgccagcucacaaccuuuggauccggaaggcccgaucgccguuacuccc

SEQ ID NO: 535625 - RNA, 64 nt, Human Herpes Virus 1
uccgaucgcccugaucauuacccccguccgcaucgauccggagaucuauaaggccauccagcga

SEQ ID NO: 535626 - RNA, 62 nt, Human Herpes Virus 2
cgaacagccccccgagcgagggcggggggaaggcgccggaggccccgcacgccgcgccugcc

SEQ ID NO: 535627 - RNA, 62 nt, Human Herpes Virus 2
gaucccggucgcccgggagaacgccgaggggugcgccggaccagggcuggggcgucgaacgc

SEQ ID NO: 535628 - RNA, 62 nt, Human Herpes Virus 2
gggcgguggcgcgccugcgguuucgggagugcgcgccggaggacgccgugccccaacgcaac

SEQ ID NO: 535629 - RNA, 62 nt, Human Herpes Virus 2
cuccaggccgccgagcugcccgucgacaucgagcgccggauacgcccgaucgagcagcaggu

SEQ ID NO: 535630 - RNA, 62 nt, Human Herpes Virus 2
aauuuaaaauauggggggcggagucugccccugcgccggagcgcggguauaaaaccggcgcc

SEQ ID NO: 535631 - RNA, 62 nt, Human Herpes Virus 2
guacuaccuacuccaggcuccgcgcuuggggggcgccggagccacguacgaucugcaggccg

SEQ ID NO: 535632 - RNA, 62 nt, Human Herpes Virus 2
ccucgggcgcgggcgacgccauggcgcccggcgcgccggacuucugcgaggacgaggcgcac

SEQ ID NO: 535633 - RNA, 62 nt, Human Herpes Virus 2
ugcggucccgggccuggguaacauucgcggccgcgccggaccgcgaggggcuuacguucccg

SEQ ID NO: 535634 - RNA, 62 nt, Human Herpes Virus 2
cgcgccaggcgccgcgccgaacgacgggcgcggcgccggagcuuuggcccagggggguuguu

SEQ ID NO: 535635 - RNA, 62 nt, Human Herpes Virus 2; identical to SEQ ID NO: 535626

SEQ ID NO: 535636 - RNA, 62 nt, Human Herpes Virus 2; identical to SEQ ID NO: 535632

SEQ ID NO: 535637 - RNA, 64 nt, Human Herpes Virus 4 (Epstein Barr virus)
ccuacagaucaucaacuauacccagcucauuuuggaaaauaaacaguaguugcuuuuaacucuu

SEQ ID NO: 535638 - RNA, 64 nt, Human Herpes Virus 4 (Epstein Barr virus)
gacauuuagugcuacugacgguuggaggaggucugccuucaauuaccguggcucuagccucccc

SEQ ID NO: 535639 - RNA, 64 nt, Human Herpes Virus 4 (Epstein Barr virus)
uguuaugcgcaauccucagcagcgggccguggaagccuucaaccggccagagcagcucuuugca

SEQ ID NO: 535640 - RNA, 64 nt, Human Herpes Virus 4 (Epstein Barr virus)
gaccaacacaaccgugggcauagagcucccggacgccuucaagugcaucgaagagcaggugaac

SEQ ID NO: 535641 - RNA, 64 nt, Human Herpes Virus 4 (Epstein Barr virus)
cucugccuaccugggggcgguggcaauaaccgaggccuucaaggagcgacucuacagcggaaac

SEQ ID NO: 535642 - RNA, 64 nt, Human Herpes Virus 1
cgacgucgaguuuaacuguacggcggacaaccuggccaucgaggggggcaugagcgaccuaccg

SEQ ID NO: 535643 - RNA, 64 nt, Human Herpes Virus 1
ggacagccauauccugagcccggcggcgcuggcggccaucgaaaacuacgugcgauucagcgcg

SEQ ID NO: 535644 - RNA, 64 nt, Human Herpes Virus 1
ugcggcuuccggggugaucgaggacgcccggcgggccaucgagacggccgugggagccgugcuu

SEQ ID NO: 535645 - RNA, 64 nt, Human Herpes Virus 1
ggggcuuuuggacaccgggcccuuuuccgcggcggccaucgacaccuucgcgcuggaccggccc

SEQ ID NO: 535646 - RNA, 64 nt, Human Herpes Virus 1
cccccgccguugagccccucgcccguccucgcccgccaucgagccaacgcccugaccaacgacg

SEQ ID NO: 535647 - RNA, 61 nt, Human Herpes Virus 1
agccggcggagagccgccgcgacgaccuggaaucggacagcagcggggaguguuccucguc

SEQ ID NO: 535648 - RNA, 61 nt, Human Herpes Virus 1
gcguggccuuacaaaucugcaagugccccaaaucggacacgggccuguaauauaccaacau

SEQ ID NO: 535649 - RNA, 64 nt, Human Herpes Virus 4 (Epstein Barr virus)
cuuuaacauugaugaacuggucaccagcuucgagagccacgacauugaucacuacuacaccgag

SEQ ID NO: 535650 - RNA, 64 nt, Human Herpes Virus 4 (Epstein Barr virus)
uccgugguccugaggggcggcagcucccaccaucagccacgacaggcggagaucuuuggccucg

SEQ ID NO: 535651 - RNA, 64 nt, Human Herpes Virus 4 (Epstein Barr virus)
ucccacccagacagacgccuuucaguccuccuuuagccacgagacccagguaaacaagauucgc

SEQ ID NO: 535652 - RNA, 64 nt, Human Herpes Virus 1
ccacgcccugguguauuuuguaugucgcaacgccgcaggggagggucgcgcgcgcuuugcggag

SEQ ID NO: 535653 - RNA, 64 nt, Human Herpes Virus 4 (Epstein Barr virus)
ccacuucuucuccuggagcacauucaugcugucauggccaaacaaugccacacuccgggagauc

SEQ ID NO: 535654 - RNA, 64 nt, Human Herpes Virus 4 (Epstein Barr virus)
ccccccaaaaugcaacgucgccccaggcccccaguggccaaaagacggcgguucccacggucac

SEQ ID NO: 535655 - RNA, 64 nt, Human Herpes Virus 4 (Epstein Barr virus)
cucgccaaauguuacagugacugccuuuugggccuggccaaacaacacugaaacugacuuuaag

SEQ ID NO: 535656 - RNA, 64 nt, Human Herpes Virus 4 (Epstein Barr virus)
gacgccgcccuagaggaacuccagcggcgggaccuggccaaauacuggccgguacucuccgaca

SEQ ID NO: 535657 - RNA, 63 nt, Human Herpes Virus 4 (Epstein Barr virus)
ucacgggacauuaaccucaaccacaaaauggggguuggagaaaguaaccacauauacuggaga

SEQ ID NO: 535658 - RNA, 63 nt, Human Herpes Virus 4 (Epstein Barr virus)
uaaguaccgucagcucuucucagaggaugaucuguuggagacugacgguuuuacugaacgagc

SEQ ID NO: 535659 - RNA, 63 nt, Human Herpes Virus 4 (Epstein Barr virus)
gaugugcuccguauggacucacuuggguauggcguuggagaagacccuagcauuguucagccg

SEQ ID NO: 535660 - RNA, 64 nt, Human Herpes Virus 2
gcggaugcuccaaagccuguccacguaugccgugccgccggaaccgcagacccggcggucgcgg

SEQ ID NO: 535661 - RNA, 64 nt, Human Herpes Virus 2
gccgccgaccgccaggcgggugggcuuccggcggccgccggagaccacgggauccgggggucgg

SEQ ID NO: 535662 - RNA, 64 nt, Human Herpes Virus 2
ggacgacugggcccgcgugacgcgggacgcgcgcccgccggaagcgaccguggucgcggacgcg

SEQ ID NO: 535663 - RNA, 64 nt, Human Herpes Virus 2
ccguagacccgacaagagacaggaggcguccgucccgccggagacaaacacggccccggccuuc

SEQ ID NO: 535664 - RNA, 64 nt, Human Herpes Virus 2
cggccccaagcccccguacaccagcacccugcugccgccggagcuguccgacaccaccaacgcc

SEQ ID NO: 535665 - RNA, 64 nt, Human Herpes Virus 2
gcugagacgaauccuccggcggccggccgccggcccgccggaggaggccgugugcgcggcccgg

SEQ ID NO: 535666 - RNA, 64 nt, Human Herpes Virus 2
cacuacgccacgggcgucauccccacgaucaacgccgccggagagcuggagcuuguggcccuac

SEQ ID NO: 535667 - RNA, 64 nt, Human Herpes Virus 2
gggacccagcgccgggacgucgcgugcgcaggucccgccggacgggcccaggcccuggcggcgg

SEQ ID NO: 535668 - RNA, 61 nt, Human Herpes Virus 2
ggaaauguucaaguucuuuuuccaccgccucuacgaccaccagaucgugccguccaccccc

SEQ ID NO: 535669 - RNA, 61 nt, Human Herpes Virus 2
cccccuccggcgguucaagacggccuucgacuacgaccaggaacugcugaucgaccugugu

SEQ ID NO: 535670 - RNA, 61 nt, Human Herpes Virus 2
cgcccauagcagcgccaucuuccggcggcuuuacgaccacuacgccacgggcgucaucccc

SEQ ID NO: 535671 - RNA, 61 nt, Human Herpes Virus 2
ggacaaggagggggacgucauagcccucauguacgaccacggccagagcgacccggcgcgg

SEQ ID NO: 535672 - RNA, 61 nt, Human Herpes Virus 2
cgaucagaucgaggcgcugauacgcgcgugcuacgaccaccaccugacgacgccgcugcug

SEQ ID NO: 535673 - RNA, 64 nt, Human Herpes Virus 1
uccccgucgauaucgagcgccgguuacgcccgaucgaacggaacgugcacgagaucgcaggcgc

SEQ ID NO: 535674 - RNA, 64 nt, Human Herpes Virus 1
cgcccccccggccccaucugcgaccgggggucuacgaacggacuucguguggcaggagcgcgcg

SEQ ID NO: 535675 - RNA, 64 nt, Human Herpes Virus 4 (Epstein Barr virus)
ugguaagaggcaccuagaacauuuccagauguuucgcuuggauuuuuuggccagucuuaauuga

SEQ ID NO: 535676 - RNA, 64 nt, Human Herpes Virus 4 (Epstein Barr virus)
aauaaaauuuuaugcaucaucuucuaaucugugccgcuuggagggaaacaugaccaccugaagu

SEQ ID NO: 535677 - RNA, 64 nt, Human Herpes Virus 4 (Epstein Barr virus)
gagacucugaucguggugcaggccugccagccgccgcuuggaggcucccuggagccccccgugg

SEQ ID NO: 535678 - RNA, 64 nt, Human Herpes Virus 4 (Epstein Barr virus)
cgccccgucacggugacguagucugucuugaggagauguagacuuguagacacugcaaaaccuc

SEQ ID NO: 535679 - RNA, 64 nt, Human Herpes Virus 4 (Epstein Barr virus)
cccuauauagucacgaccccaccgaaccaggcaugauguagaauaaaauuuuaugcaucaucuu

SEQ ID NO: 535680 - RNA, 64 nt, Human Herpes Virus 4 (Epstein Barr virus)
gcucgcccacacagcgccagcagggcacagaggugauguagaggcgcgggucugggaugggacu

SEQ ID NO: 535681 - RNA, 64 nt, Human Herpes Virus 1
uugguugcagaccccuuucuccccccucuuccgaggccagcaggggggcaggacuuugugaggc

SEQ ID NO: 535682 - RNA, 64 nt, Human Herpes Virus 1
ggcggguauuaacaucacccgcaccaucuacgacggccagcagauccgcgucuuuacgugccug

SEQ ID NO: 535683 - RNA, 64 nt, Human Herpes Virus 1
aggggcggcucggccuggaugcccggccgaugauggccagcauguggaucagcugcuuugugcg

SEQ ID NO: 535684 - RNA, 64 nt, Human Herpes Virus 1
cagggcuccccagggggucgggaccccggagggcggccagcacgcugugguugcuuggccugga

SEQ ID NO: 535685 - RNA, 64 nt, Human Herpes Virus 1
uucgggccgugacgacccacgaccccaaccccgcggccagcacggagcagcccucgccccuggg

SEQ ID NO: 535686 - RNA, 64 nt, Human Herpes Virus 1
gcgcggcaugcgagcagcuuucuaccggcccacgggccagcacgacugugucggggcugcgagc

SEQ ID NO: 535687 - RNA, 64 nt, Human Herpes Virus 1
ggacuccgccuuccagcgucuagaugcggcccugggccagcagcacgaaacgcucggccccccc

SEQ ID NO: 535688 - RNA, 64 nt, Human Herpes Virus 1; identical to SEQ ID NO: 535681

SEQ ID NO: 535689 - RNA, 64 nt, Human Hepatitis C Virus (M1LE)
acgaccgugccccaagacgcgguaucgcgcucacagcggcgagguaggacuggcagggguaggg

SEQ ID NO: 535690 - RNA, 64 nt, Human Hepatitis C Virus (M1LE)
gguggcuggcgcacucguagcuuuuaagaucaugagcggcgagaugcccuccaccgaggaccug

SEQ ID NO: 535691 - RNA, 64 nt, Human Hepatitis C Virus (M1LE)
ucgacuucagcuuggaucccaccuucaccauugaaacgacgaccgugccccaagacgcgguauc

SEQ ID NO: 535692 - RNA, 64 nt, Human Herpes Virus 2
gcgcccuuccgcguccgcgaugaccucccggcccgccgaccaagacucggugcguuccagcgcg

SEQ ID NO: 535693 - RNA, 64 nt, Human Herpes Virus 2
guuuugcgcgcgaauacaccacccuggcguuuccgccgaccaggaaggagggcgccuucgcgga

SEQ ID NO: 535694 - RNA, 64 nt, Human Herpes Virus 2
cgcugcagcggugcgagggucgaguggucuuucugccgaccauccgccgccagcuggcgcucgc

SEQ ID NO: 535695 - RNA, 64 nt, Human Herpes Virus 2
cuacguccugcccguccacgcgcuguuugcgggcgccgaccacguggccaacgcgcccaacuuc

SEQ ID NO: 535696 - RNA, 64 nt, Human Herpes Virus 2
ccaggccguccugggggcguuugagcgcggcacggccgaccagaugcugcacgugcuguuggag

SEQ ID NO: 535697 - RNA, 64 nt, Human Herpes Virus 2
agucgaccccuggguccuguuuggccacccccgcgccgaccaucgcgacgagcugcagcuucac

SEQ ID NO: 535698 - RNA, 64 nt, Human Herpes Virus 2
auccggccccggcccuucuuccggcccauuggccgccgaccaccguccccacgucccaguacgc

SEQ ID NO: 535699 - RNA, 64 nt, Human Herpes Virus 2
aacugugccugacgcucuuccuccccgggacccagccgaccacggccgcccugcgcgacgucgu

SEQ ID NO: 535700 - RNA, 64 nt, Human Herpes Virus 2
ccuuccucgcggugcuggcccgguggcggagaucgccgaccagggcgacucggcuggcccugga

SEQ ID NO: 535701 - RNA, 64 nt, Human Herpes Virus 2
uccgaccgagccaccgggcggguccguggggccggccgaccaaccccgcgugcaaagcucgcgc

SEQ ID NO: 535702 - RNA, 64 nt, Human Herpes Virus 4 (Epstein Barr virus)
guaccucaagcacguagugcuaaagagucugaaucuggagaauauagugcaggacuuugaggcc

SEQ ID NO: 535703 - RNA, 64 nt, Human Herpes Virus 4 (Epstein Barr virus)
cggaggaagcggccggggccucaugcccaccgugcuggagaaccgaugccauccguucggcccu

SEQ ID NO: 535704 - RNA, 64 nt, Human Herpes Virus 4 (Epstein Barr virus)
ucucuuugagcaggaggucucugaggugcagcgccuggagaauauuugcacccuccuggaccug

SEQ ID NO: 535705 - RNA, 64 nt, Human Herpes Virus 4 (Epstein Barr virus)
gcgcguccgacgggugggcaagcugguggagcugcuggagaagcagagccugcaggaccaggcc

SEQ ID NO: 535706 - RNA, 64 nt, Human Herpes Virus 2
ucuguuuaugguaucuucgaucgacgaacuggggcgccgccagcucacggauacgauccguaag

SEQ ID NO: 535707 - RNA, 64 nt, Human Herpes Virus 2
cgccacgacguaccgggaccuggaggaggacuggcgccgccacgugguggcccgcggccuccag

SEQ ID NO: 535708 - RNA, 64 nt, Human Herpes Virus 2
uggccgaccccacgcccgccgaugagggaacggccgccgccauccucaaacaggccaucgccgg

SEQ ID NO: 535709 - RNA, 64 nt, Human Herpes Virus 2
ugcgcguguuggugggcccccaccucggggccaucgccgccaccggcaucgucggccuggccug

SEQ ID NO: 535710 - RNA, 64 nt, Human Herpes Virus 2
ggccgcgcacgagggcggacagcgggacccccgccgccgccaggcacucgcuggagaugaugac

SEQ ID NO: 535711 - RNA, 64 nt, Human Herpes Virus 2
uccucaucgagggcgucuuuuuugccgccucguucgccgccaucgcguaccugcgcaccaacaa

SEQ ID NO: 535712 - RNA, 64 nt, Human Herpes Virus 2
ccgacacccucagugccgcguccuugaccucguucgccgccaucacucgguucuguugcacgag

SEQ ID NO: 535713 - RNA, 64 nt, Human Herpes Virus 2
gcccgccgagggccccgacccgcagggcggcuggcgccgccagccgccggggcccagccacacg

SEQ ID NO: 535714 - RNA, 64 nt, Human Herpes Virus 2
cgcgcugguccagcgggccgugcaggacgucacccgccgccacccgguccgcgcgcgccccaag

SEQ ID NO: 535715 - RNA, 64 nt, Human Herpes Virus 2
gugcgagggucgaguggucuuucugccgaccauccgccgccagcuggcgcucgcggacguggcg

SEQ ID NO: 535716 - RNA, 64 nt, Human Herpes Virus 2
uggucuuccuggaggcccuggagagacgcaucuacgccgccaccaacgugcccuacccccuggu

SEQ ID NO: 535717 - RNA, 64 nt, Human Herpes Virus 2
gcgggcggccggucgacggggugcuggucaccaccgccgccaucaaacagcgccuccugcaguc

SEQ ID NO: 535718 - RNA, 64 nt, Human Herpes Virus 2
gcgcccguucucugggaaucgccugcgcggccggcgccgccauguggguggcggcggcggacug

SEQ ID NO: 535719 - RNA, 64 nt, Human Herpes Virus 2
ccgacaucgacacggucauccgcgccgacgccaacgccgccauguucgcggggcugugcgcguu

SEQ ID NO: 535720 - RNA, 64 nt, Human Herpes Virus 2
cccagaagcaacccaggccgacgcccuccccgggcgccgccaaggugcaguacuccaacuauuc

SEQ ID NO: 535721 - RNA, 64 nt, Human Herpes Virus 2
uggccgccgcgacccaccgcaccgccgccgcggccgccgccagaauggaccugguucuggccgc

SEQ ID NO: 535722 - RNA, 64 nt, Human Herpes Virus 2
gacgcggccuucgucccggcaugcuccccccgcucgccgccauccgggggcgggcugucccccg

SEQ ID NO: 535723 - RNA, 64 nt, Human Herpes Virus 2
acgagccggcguuucuguccgcggccaaacugcacgccgccacggcggcguuucuguugucggg

SEQ ID NO: 535724 - RNA, 64 nt, Human Herpes Virus 2
ggucgcggaacaccgcggcuaugucgccggacgucgccgccacgucauccacgacgccccggag

SEQ ID NO: 535725 - RNA, 64 nt, Human Herpes Virus 2
agauggaaaacacguaucugcugcccgacgaugacgccgccaugcccgcgggcgucgggcuugg

SEQ ID NO: 535726 - RNA, 64 nt, Human Herpes Virus 2; identical to SEQ ID NO: 535713

SEQ ID NO: 535727 - RNA, 64 nt, Human Herpes Virus 2
ccacgugcacagccuggccgugcccccccucguucugcugcaccggcucuccuuguuucgcccc

SEQ ID NO: 535728 - RNA, 64 nt, Human Herpes Virus 2
cacgggcaugaagcagcugcgccacucccugaagcugcugcagucgcucgcgccuccgggggac

SEQ ID NO: 535729 - RNA, 64 nt, Human Herpes Virus 2
cguucgccgggccgucauuaaggacgacuggguccugcugcagcugauccccggccgcggcgcc

SEQ ID NO: 535730 - RNA, 64 nt, Human Herpes Virus 2
ccggacccgccuggggccgcgcacguggggccgccugcugcagaucucgggcggaaccugggac

SEQ ID NO: 535731 - RNA, 64 nt, Human Herpes Virus 2
auuacgugcuggugccggccuucucgcgggggcgcugcugcaccgcggggguccgcuucgaccg

SEQ ID NO: 535732 - RNA, 64 nt, Human Herpes Virus 2
ggcgacggccgacuuuaaccgcaacgacggccggcugcugcacaacacccaggcccgcgcggcc

SEQ ID NO: 535733 - RNA, 64 nt, Human Herpes Virus 2
guucgaggaccgcagcuacccggcgguguuuuaccugcugcaagccgcgauucacggcaacgag

SEQ ID NO: 535734 - RNA, 64 nt, Human Herpes Virus 2
gucgcuggacccguacaccugcgggccgugcccccugcugcagcuccucgcgcggcgguccaac

SEQ ID NO: 535735 - RNA, 64 nt, Human Herpes Virus 2
acugcaccgagggcaagcgcgggggcggagacagcugcugcacgcgcgccgccgcccgcaacgg

SEQ ID NO: 535736 - RNA, 64 nt, Human Herpes Virus 2
aggcccugcaggccagcgaccuggguucgggggccugcugcacggccucggccgcggucgugcc

SEQ ID NO: 535737 - RNA, 64 nt, Human Herpes Virus 2
gcccuccgccggggcccagcaacggcuccucgcgcugcugcagcagacgugggcuuugguccag

SEQ ID NO: 535738 - RNA, 64 nt, Human Herpes Virus 2
ggcgcuggccaucuuccguccggccgucaccggccugcugcagcuaggggagccgcccuccgcc

SEQ ID NO: 535739 - RNA, 64 nt, Human Herpes Virus 2
caccggcuacauuccgacgauucacugccgcgaccugcugcaguacuucaagaugaguuacccg

SEQ ID NO: 535740 - RNA, 64 nt, Human Herpes Virus 4 (Epstein Barr virus)
caguggccagcucauaugccgcugcacaaaggaaacugcugacaccggugacagugcuuacugc

SEQ ID NO: 535741 - RNA, 64 nt, Human Herpes Virus 4 (Epstein Barr virus)
aaguucucacggaccugcccgguguucccaagcuacugcugaagcacaggagauucucagugac

SEQ ID NO: 535742 - RNA, 64 nt, Human Herpes Virus 4 (Epstein Barr virus)
ucucugcgcccaaagcccugaaaaggggagcacuacugcugaauauuguggccaugacacuuuu

SEQ ID NO: 535743 - RNA, 64 nt, Human Herpes Virus 4 (Epstein Barr virus)
guccuccaaagggacguccaaugccacaaaaacaacugcugagcuucccaccguuccagaugag

SEQ ID NO: 535744 - RNA, 64 nt, Human Herpes Virus 4 (Epstein Barr virus)
ccugccccaucuucacccagcuguuuuaccgcucacugcugaccauccugcaggacaucucccu

SEQ ID NO: 535745 - RNA, 64 nt, Human Herpes Virus 4 (Epstein Barr virus)
cguuucaccaauacaugaaccggagucccauaauagcccagaggcucccauucucuuccccgau

SEQ ID NO: 535746 - RNA, 64 nt, Human Herpes Virus 4 (Epstein Barr virus)
cccugggaugagcguuugggagagcugauucugcagcccagagaguagucucagggcauccucu

SEQ ID NO: 535747 - RNA, 64 nt, Human Herpes Virus 4 (Epstein Barr virus)
cccugacgcuguggccgaguggcagaaucaccagagcccagaggaggccccggccgccguguca

SEQ ID NO: 535748 - RNA, 64 nt, Human Herpes Virus 4 (Epstein Barr virus)
acugcgaccucccaccuagccacccacuccugacagcccagagggggcuguuccuggcaagagu

SEQ ID NO: 535749 - RNA, 64 nt, Human Herpes Virus 4 (Epstein Barr virus)
gcgccccaucguucuacgcacgagggcuuccgagagcccagaccgcgagagauggggguuuggg

SEQ ID NO: 535750 - RNA, 64 nt, Human Herpes Virus 4 (Epstein Barr virus)
gggaaaggccaucggauaucgacaccgcggcccgagcccagaagguugagaccuccugcccccg

SEQ ID NO: 535751 - RNA, 64 nt, Human Herpes Virus 4 (Epstein Barr virus)
gcccaagccaccgugccagucccgccaacgucccagcccagauucucaaaccucuccaugcuag

SEQ ID NO: 535752 - RNA, 64 nt, Human Herpes Virus 4 (Epstein Barr virus)
auggaccgaacugauggcaaaggucccaggccuuagcccagaggcgcuguggagagaggcaaau

SEQ ID NO: 535753 - RNA, 64 nt, Human Herpes Virus 1
gcgccaguggcuccacguucccgaguccgcguccgacgacgacgaugacgacgacuggccggac

SEQ ID NO: 535754 - RNA, 64 nt, Human Herpes Virus 1
ccaguggcuccacguucccgaguccgcguccgacgacgacgaugacgacgacuggccggacagc

SEQ ID NO: 535755 - RNA, 64 nt, Human Herpes Virus 1
ccacguucccgaguccgcguccgacgacgacgaugacgacgacuggccggacagccccccgccc

SEQ ID NO: 535756 - RNA, 64 nt, Human Herpes Virus 1
cgaagugggggggcggggggacgccgaccaccaugacgacgacuccgccuccgaggcggacagc

SEQ ID NO: 535757 - RNA, 64 nt, Human Herpes Virus 1
gcccacccacccggagcccaccacggacgaggaugacgacgaccuggacgacggugaggcgggg

SEQ ID NO: 535758 - RNA, 64 nt, Human Herpes Virus 1
ugccgcgcgggucguuaacaagguguugggggaggacgacgagaccaaggccgggucggccgcc

SEQ ID NO: 535759 - RNA, 64 nt, Human Herpes Virus 1
cgacuaugacauuaucgacgucagcaaguccauggacgacgacacguacgucgccaacagcuuu

SEQ ID NO: 535760 - RNA, 64 nt, Human Herpes Virus 1
cacacucauguucaugguguacguaaaaccguucgacgacgaguucguccugccccacugguac

SEQ ID NO: 535761 - RNA, 64 nt, Human Herpes Virus 1
guacgccaagauacaacacccgcggcaccugcccgacgacgaucccaucuaugacaccguuggg

SEQ ID NO: 535762 - RNA, 64 nt, Human Herpes Virus 1
gucgcccgccccacgccacggaguucucguaggagacgacgacgaagcgcugcuugguuccgua

SEQ ID NO: 535763 - RNA, 64 nt, Human Herpes Virus 1
gcccgccccacgccacggaguucucguaggagacgacgacgaagcgcugcuugguuccguagug

SEQ ID NO: 535764 - RNA, 64 nt, Human Herpes Virus 1
aggccccguuucgcacgcugguucagcgcauauggacgacgacguccgacggcgaggccguuga

SEQ ID NO: 535765 - RNA, 64 nt, Human Herpes Virus 1
ggcguccguggguuccggcagcggacucggcaacgacgacgacggggacugguuucccugcuac

SEQ ID NO: 535766 - RNA, 64 nt, Human Herpes Virus 1
cccgggcgccauggacacaucccacgaucccccggacgacgagguugccuacuuugaccugugc

SEQ ID NO: 535767 - RNA, 64 nt, Human Herpes Virus 1
ggccucgccgccccggacccccgccuuucgagccgacgacgaugacggggacgaguacgacgac

SEQ ID NO: 535768 - RNA, 64 nt, Human Herpes Virus 1
auccucuucguccucgucguccgacgaggacgaggacgacgacggcaacgacgcggccgaccac

SEQ ID NO: 535769 - RNA, 64 nt, Human Herpes Virus 1
cgacgaccccgacgccgcccgccacgccgacgccgacgacgacgccgggcgccgcgcccaggcc

SEQ ID NO: 535770 - RNA, 64 nt, Human Herpes Virus 1
cgcccccgccgcccaggccgcgugcggcggcggcgacgacgacgauaacccccacccccacggg

SEQ ID NO: 535771 - RNA, 64 nt, Human Herpes Virus 1
ccccgccgcccaggccgcgugcggcggcggcgacgacgacgauaacccccacccccacggggcc

SEQ ID NO: 535772 - RNA, 64 nt, Human Herpes Virus 1
gagggacuuuugcgcccgcgcccugcuggagcccgacgacgacgcccccccgcuggugcugcgc

SEQ ID NO: 535773 - RNA, 64 nt, Human Herpes Virus 1
cgacgacgacgcccccccgcuggugcugcgcggcgacgacgacggcccgggggcccugccgccg

SEQ ID NO: 535774 - RNA, 64 nt, Human Herpes Virus 1
ggggccgcgggacgggggcccggacgauuuucccgacgacgaccucgacguuauuuucgcgggg

SEQ ID NO: 535775 - RNA, 64 nt, Human Herpes Virus 1
gggagauccucugggggccgggcgucccauuggggacgacgagugcgaacaguacacgucgagc

SEQ ID NO: 535776 - RNA, 64 nt, Human Herpes Virus 1
cgcggcggacgcgcccaagggcggcgcgggccccgacgacgacggggaccgugucgccguagag

SEQ ID NO: 535777 - RNA, 64 nt, Human Herpes Virus 1
ggcauccgguguaccagcgccccuguaugucucugacgacgaaggucccaaacccgacccccgg

SEQ ID NO: 535778 - RNA, 64 nt, Human Herpes Virus 1
cgagggggcgccucauuccaacacccccgucgaggacgacgagaugaucccggaggacaccguc

SEQ ID NO: 535779 - RNA, 64 nt, Human Herpes Virus 1
aauucuaacccaacagaucgccggcggauacgaagacgacgaggaccucccccuggauccccgg

SEQ ID NO: 535780 - RNA, 64 nt, Human Herpes Virus 1
cgccucggcccgcgaacggcacgcccccuacgaggacgacgagucaauauacgagacggugagc

SEQ ID NO: 535781 - RNA, 64 nt, Human Herpes Virus 1
gauggaagccacguaucugacggccgacgacgacgacgacgacgcccgccgcaaagccacccac

SEQ ID NO: 535782 - RNA, 64 nt, Human Herpes Virus 1
ccagauggaagccacguaucugacggccgacgacgacgacgacgacgcccgccgcaaagccacc

SEQ ID NO: 535783 - RNA, 64 nt, Human Herpes Virus 1
cgaccagauggaagccacguaucugacggccgacgacgacgacgacgacgcccgccgcaaagcc

SEQ ID NO: 535784 - RNA, 64 nt, Human Herpes Virus 1
acccgaccagauggaagccacguaucugacggccgacgacgacgacgacgacgcccgccgcaaa

SEQ ID NO: 535785 - RNA, 64 nt, Human Herpes Virus 1
cgggucuaccaucgagggccugcucgaucucccggacgacgacgcccccgaagaggcggggcug

SEQ ID NO: 535786 - RNA, 64 nt, Human Herpes Virus 1
ggauuaugcccucuacgggggcucgucauccgaagacgacgaacacccggaggucccccggacg

SEQ ID NO: 535787 - RNA, 64 nt, Human Herpes Virus 1; identical to SEQ ID NO: 535757

SEQ ID NO: 535788 - RNA, 64 nt, Human Herpes Virus 1; identical to SEQ ID NO: 535756

SEQ ID NO: 535789 - RNA, 64 nt, Human Herpes Virus 1; identical to SEQ ID NO: 535755

SEQ ID NO: 535790 - RNA, 64 nt, Human Herpes Virus 1; identical to SEQ ID NO: 535754

SEQ ID NO: 535791 - RNA, 64 nt, Human Herpes Virus 1; identical to SEQ ID NO: 535753

SEQ ID NO: 535792 - RNA, 64 nt, Human Herpes Virus 1; identical to SEQ ID NO: 535773

SEQ ID NO: 535793 - RNA, 64 nt, Human Herpes Virus 1; identical to SEQ ID NO: 535772

SEQ ID NO: 535794 - RNA, 64 nt, Human Herpes Virus 1; identical to SEQ ID NO: 535771

SEQ ID NO: 535795 - RNA, 64 nt, Human Herpes Virus 1; identical to SEQ ID NO: 535770

SEQ ID NO: 535796 - RNA, 64 nt, Human Herpes Virus 1; identical to SEQ ID NO: 535769

SEQ ID NO: 535797 - RNA, 64 nt, Human Herpes Virus 1; identical to SEQ ID NO: 535768

SEQ ID NO: 535798 - RNA, 64 nt, Human Herpes Virus 1; identical to SEQ ID NO: 535767

SEQ ID NO: 535799 - RNA, 64 nt, Human Herpes Virus 1
ggucagggggugcgucacgcuccggagguggacgaucgcgcaguagcggcgcucgcgguuaaag

SEQ ID NO: 535800 - RNA, 64 nt, Human Herpes Virus 1
caaaaccagaggccaagcgcagcacacgcgggacaucgcgcagcugggcgguggcccugaaggg

SEQ ID NO: 535801 - RNA, 64 nt, Human Herpes Virus 1
cgguggacagagcgaccccaggucgcuguccauggcccagcaguagaucuggccgcuggggagg

SEQ ID NO: 535802 - RNA, 64 nt, Human Herpes Virus 1
ccccacgucgucucggaaauggaguccacgguaggcccagcauguccgccgggacgcaccguga

SEQ ID NO: 535803 - RNA, 64 nt, Human Herpes Virus 1
agccacccgauccgagaccccggucgaaguccuggcccagcagacccacggccucgccucgacc

SEQ ID NO: 535804 - RNA, 64 nt, Human Herpes Virus 1
ccugcugcagcucggggagcagcccuccgccggcgcccagcagcggcugcuggcucugcugcag

SEQ ID NO: 535805 - RNA, 64 nt, Human Herpes Virus 2
cgggacuggcucgauucccgcgccgccggcgaaaaaaggcgaugcuccgccccggaucgggcgc

SEQ ID NO: 535806 - RNA, 64 nt, Human Herpes Virus 2
gucgacucggucucgcagcggccgcgggguauguaaaggcgacucgugcccgccgccccgggcg

SEQ ID NO: 535807 - RNA, 64 nt, Human Herpes Virus 2
ccgaguuuccucgggaccccgggcagcugcuuuacaucccaaagaccuaucugcucggccggcc

SEQ ID NO: 535808 - RNA, 64 nt, Human Herpes Virus 1
ccuccgccucuuccuccucugccucuuccuccucggccccgacccccgcgggggccgccucuuc

SEQ ID NO: 535809 - RNA, 64 nt, Human Herpes Virus 1
cguaucugcgucaggugcacggccugauggagcuggccccgacccaucaucgcgucgucggccc

SEQ ID NO: 535810 - RNA, 64 nt, Human Herpes Virus 1
ccuacuggccucggagggggccgacgcgggcucgggccccgagcuucucuucuaccacugcgag

SEQ ID NO: 535811 - RNA, 64 nt, Human Herpes Virus 1
aaccgggccggaacaacacgcuagcccagccggcggccccgauggccuucgggacauccagcga

SEQ ID NO: 535812 - RNA, 64 nt, Human Herpes Virus 1
gcuguuggccuucaugacccuugugaaacaguacggccccgaguucgugaccggguacaacauc

SEQ ID NO: 535813 - RNA, 64 nt, Human Herpes Virus 1
caugccccgcgugcagcucgcguuucgguucaugggccccgaagaugccggacggacgagacgg

SEQ ID NO: 535814 - RNA, 64 nt, Human Herpes Virus 1
ggaugaaaaugaaccagacccuauuguuucugggggccccgacgcacccccccaacgggggcug

SEQ ID NO: 535815 - RNA, 64 nt, Human Herpes Virus 1
gcgccccguggccgugucgcgccggcccgccgagggccccgacccccugggcggcuggcggcgg

SEQ ID NO: 535816 - RNA, 64 nt, Human Herpes Virus 1
ggacucggcggccgggggaucugggaggaccuucggccccgaugacgugcuggaccuacugacc

SEQ ID NO: 535817 - RNA, 64 nt, Human Herpes Virus 1
gcgucccugggcccuggccgaggacaccccucguggccccgacagcccccccaagcgcccccgc

SEQ ID NO: 535818 - RNA, 64 nt, Human Herpes Virus 1
cccgcgaaucucacagcgccugcgcuaugacuuuggccccgaccaacgcgcgugguugggggag

SEQ ID NO: 535819 - RNA, 64 nt, Human Herpes Virus 1
ggggggcgcggcggacgcgcccaagggcggcgcgggccccgacgacgacggggaccgugucgcc

SEQ ID NO: 535820 - RNA, 64 nt, Human Herpes Virus 1
uucacggcggccggcaccuggaccccagcacccaggccccgaaccugacgcgacuuugcgagcg

SEQ ID NO: 535821 - RNA, 64 nt, Human Herpes Virus 1
cuuaccugcaggacgaagcggcccacccccccugggccccgaggacgcacccccugcggggcga

SEQ ID NO: 535822 - RNA, 64 nt, Human Herpes Virus 1
acugagcgcggggggguuaguguccccccaauccggccccgacgccgcgguguuccgcagcucg

SEQ ID NO: 535823 - RNA, 64 nt, Human Herpes Virus 1; identical to SEQ ID NO: 535808

SEQ ID NO: 535824 - RNA, 64 nt, Human Herpes Virus 1; identical to SEQ ID NO: 535815

SEQ ID NO: 535825 - RNA, 64 nt, Human Herpes Virus 1
gaaacugacccucugaucgccguucgcggcgaacggccccgacuuccucacaucugcuauccgg

SEQ ID NO: 535826 - RNA, 60 nt, Human Herpes Virus 4 (Epstein Barr virus)
aaacagcugccccacgccaguggccaaugccccugcgaccuaucccuaugcgccccuugc

SEQ ID NO: 535827 - RNA, 60 nt, Human Herpes Virus 4 (Epstein Barr virus)
cgggcaacccccugccugcagcaccggaaacccugcgagacuacuuggaagcuuuccgaa

SEQ ID NO: 535828 - RNA, 60 nt, Human Herpes Virus 4 (Epstein Barr virus)
cggcugguucacggauaucgaacagagucucccugcgacccuggacgcuuggcccgccac

SEQ ID NO: 535829 - RNA, 64 nt, Human Herpes Virus 1
uccaggaccgcaccaucacggacuuuccccugaccacccgcagugccgacuuucgggacggccg

SEQ ID NO: 535830 - RNA, 64 nt, Human Herpes Virus 1
uggugcgccucaccgcccuggaacucaucaaccgcacccgcacaaaccccaccccuguggggga

SEQ ID NO: 535831 - RNA, 64 nt, Human Herpes Virus 1
ucucggccgucgcgcgcuuggcggguauuaacaucacccgcaccaucuacgacggccagcagau

SEQ ID NO: 535832 - RNA, 64 nt, Human Herpes Virus 1
caccaauaacucucaguuuaucauggauaacaaccacccgcacccccagggcacccaaggggcc

SEQ ID NO: 535833 - RNA, 64 nt, Human Herpes Virus 1
gcgggcacuacauggaguccgucuuccagauguacacccgcaucgccggcuuuuuggccugccg

SEQ ID NO: 535834 - RNA, 64 nt, Human Herpes Virus 1
cgcgggugcagauccgaugccgguuucggaauuccacccgcauggaguuccgccuccagauaug

SEQ ID NO: 535835 - RNA, 64 nt, Human Herpes Virus 1
gcggccccaaaaggggcccgugcgacagucagaucacccgcaucauccgacaggcccaggucca

SEQ ID NO: 535836 - RNA, 64 nt, Human Herpes Virus 1
ugccgagaugcgaauauacgaaucgugucuguaucacccgcagcucccagaaugucuguccccg

SEQ ID NO: 535837 - RNA, 64 nt, Human Herpes Virus 1
cccacagcgcggcgcggauuuggccgagcccacccacccgcacgucggggccccuccccacgcg

SEQ ID NO: 535838 - RNA, 64 nt, Human Herpes Virus 1
cgaggugugcgaggugggccugcggccacgcgggcacccgcaacgagucacggcacgggugcug

SEQ ID NO: 535839 - RNA, 64 nt, Human Herpes Virus 1
cguugcuggaggccugucuccgcguucccauggccacccgcagcagcgccauauuucggcggau

SEQ ID NO: 535840 - RNA, 64 nt, Human Herpes Virus 1
cgugcucgacagccacuuccccgacugccccccccacccgcaucuggugacguuuaucggcagg

SEQ ID NO: 535841 - RNA, 64 nt, Human Herpes Virus 1
gcaaaaacgcgugcccgcuccuuauuuuugaccgcacccgcaaguucguccuggccuguccccg

SEQ ID NO: 535842 - RNA, 64 nt, Human Herpes Virus 1
ccaguggcucucgguggucgugggggcgcgccugcacccgcacgugcaccaccccgccuuugcg

SEQ ID NO: 535843 - RNA, 64 nt, Human Herpes Virus 1
caaggcgcuggccgaagaggugcgggaguuucacgccaccaagaucugcggcacgcuguugacg

SEQ ID NO: 535844 - RNA, 64 nt, Human Herpes Virus 1
uaagaggaucgcggcgcucuucugcgugcccguggccaccaagaccaaaccccgagccgccucc

SEQ ID NO: 535845 - RNA, 64 nt, Human Herpes Virus 1
cguccgggcgcuuggcaugcgcgggcucgucuuggccaccaauaacucucaguuuaucauggau

SEQ ID NO: 535846 - RNA, 64 nt, Human Herpes Virus 1
gcccgcccccgcguauugcggggccguggacuccgccaccaaaaugauggggcguuuggcggac

SEQ ID NO: 535847 - RNA, 64 nt, Human Herpes Virus 1
cuuucuggaggcccuggagaagcgcaucuacgccgccaccaacguucccuacccccuggugggc

SEQ ID NO: 535848 - RNA, 64 nt, Human Herpes Virus 1
gaccuucaguccggacgggcuuuuccacuuuaucgccaccaaccaaaugcugccgcccaccgau

SEQ ID NO: 535849 - RNA, 64 nt, Human Herpes Virus 2
cgcugcgccccaacacgcucuugcugaaggaacucgagcgcacguucggcgggaagcggcuccu

SEQ ID NO: 535850 - RNA, 64 nt, Human Herpes Virus 2
cgguucugcgauccauauccgagcgcgcggcggucgagcgcaucagcgaaagcuuuggacgcag

SEQ ID NO: 535851 - RNA, 64 nt, Human Herpes Virus 2
ugcucacgcugcaggugcuggcgcacaacauggccgagcgcacgacggcgcugcugugcuccgc

SEQ ID NO: 535852 - RNA, 61 nt, Human Herpes Virus 2
ugggcgccuccgccgcgcccacggccgauuccccccucaccgccucgccccccgcuaccgc

SEQ ID NO: 535853 - RNA, 61 nt, Human Herpes Virus 2
ccccacucauccguuccgggggcuuugccgucccccucaucgugggggggcugugucucau

SEQ ID NO: 535854 - RNA, 61 nt, Human Herpes Virus 2
accuacagcgcaucgacgacgccgcccugaccccccucacgcgggcccuguuuacgcuggc

SEQ ID NO: 535855 - RNA, 64 nt, Human Herpes Virus 2
cggaccccggccccgagcggccgccgcggcagacccccggcacggugagagggcgacccccggg

SEQ ID NO: 535856 - RNA, 64 nt, Human Herpes Virus 2
gcgccugggggcguuucucaggcagcacacgcugccccggcagcuggccacggucgccggggcc

SEQ ID NO: 535857 - RNA, 64 nt, Human Herpes Virus 2
ccagccacucgaccagcgaucgcggcuuggcgguccccggcacgagggugagcacgucguugag

SEQ ID NO: 535858 - RNA, 64 nt, Human Herpes Virus 2
ucgggcugugcaugcaggcguucaacgacgccagccccggcaccgccagcaucaugccggcccu

SEQ ID NO: 535859 - RNA, 64 nt, Human Herpes Virus 2
agguggccgucgcgucccagacaucgugcgggcgccccggcaccgccacgauccgcuccacccu

SEQ ID NO: 535860 - RNA, 64 nt, Human Herpes Virus 2
cugaacauggucaacaaacgcgccguggauuuuaccccggcagaaugcggggacuccgaauggg

SEQ ID NO: 535861 - RNA, 64 nt, Human Herpes Virus 2
gccuccugcaaguacgcucucccccugcgcauccccccggcagcgugccucaccucgaaggccu

SEQ ID NO: 535862 - RNA, 58 nt, Human Herpes Virus 2
caacccccgggcgucguggcauggaagcccccggcaucguuuggguggaggagagcgu

SEQ ID NO: 535863 - RNA, 64 nt, Human Herpes Virus 2
cgcccccggccacccggagccccgcgcguucccuccccggcagcuguuuuuuuggggaaaggac

SEQ ID NO: 535864 - RNA, 64 nt, Human Herpes Virus 2
ccacguacgggggccacaugcuguacgucaucuuccccggcacgucggcccaccugcacuaccg

SEQ ID NO: 535865 - RNA, 64 nt, Human Herpes Virus 2; identical to SEQ ID NO: 535855

SEQ ID NO: 535866 - RNA, 64 nt, Human Herpes Virus 1
cgccaacagcuuucagcacccguacaucccuucguacgcccaggaccuggagcgccugucgcgc

SEQ ID NO: 535867 - RNA, 64 nt, Human Herpes Virus 1
cguaaaaaacuuccuguugaucgauacggggguguacgcccacggccacagccugcgcuugccg

SEQ ID NO: 535868 - RNA, 64 nt, Human Herpes Virus 1
uggacggcuccggggcgcgcucggagcccgucuuuacgcccaugcuccuuaaucacguggucag

SEQ ID NO: 535869 - RNA, 64 nt, Human Herpes Virus 1
ccgcgugggcggcuacccggaggagggcacgaacuacgcccaguuccugucgcgggcauacgcg

SEQ ID NO: 535870 - RNA, 64 nt, Human Herpes Virus 1
aggcgcggcggaucugugugugccguuucucgaauacgcccaaaaaauccggcucgggguaaga

SEQ ID NO: 535871 - RNA, 64 nt, Human Herpes Virus 2
cgcgggggacaaggagggggacgucauagcccucauguacgaccacggccagagcgacccggcg

SEQ ID NO: 535872 - RNA, 64 nt, Human Herpes Virus 1
ccggggacgcgccgccgggggcguuuacgcgggggacaaggagggggaugucaccgcccucaug

SEQ ID NO: 535873 - RNA, 64 nt, Human Herpes Virus 4 (Epstein Barr virus)
gauugucgcuggcauacucuucauucuugcuauccugaccgaauggggcaguggaaauagaaca

SEQ ID NO: 535874 - RNA, 64 nt, Human Herpes Virus 4 (Epstein Barr virus)
gccucccuguuauacaauagcaugacagccaaggcugaccgaccaagggccaccuggauccagg

SEQ ID NO: 535875 - RNA, 64 nt, Human Herpes Virus 4 (Epstein Barr virus)
cuuacugacuugucaccuuugcacauuuggucagcugaccgaugcucgccacuuccugggucau

SEQ ID NO: 535876 - RNA, 64 nt, Human Herpes Virus 4 (Epstein Barr virus)
ccaaaaaguaccugaugaacucuucucggagcugcugaccgaggaccaucgauaacuacauugc

SEQ ID NO: 535877 - RNA, 64 nt, Human Herpes Virus 4 (Epstein Barr virus)
cgucgagcggcgcagcgccucggcccgcagacgccugaccgaccuugggcaaagauagccccca

SEQ ID NO: 535878 - RNA, 64 nt, Human Herpes Virus 4 (Epstein Barr virus)
uuaccugucucucuuugagggggccaaaagggcucugaccgacgggcaucuuaucagagaggcc

SEQ ID NO: 535879 - RNA, 64 nt, Human Herpes Virus 4 (Epstein Barr virus)
gcugcaguccugccuggcgcaacagagcgagacccugaccgagacccugugccugcgcgucugg

SEQ ID NO: 535880 - RNA, 62 nt, Human Herpes Virus 4 (Epstein Barr virus)
augaguuaaaggucaaggccaacucagaccccgaggcugauguccuggccgggcgccugcuc

SEQ ID NO: 535881 - RNA, 62 nt, Human Herpes Virus 4 (Epstein Barr virus)
ccaucuucaccuccccgucugauaccaucagugaggcugaaaccaaggccuuugagaagcug

SEQ ID NO: 535882 - RNA, 62 nt, Human Herpes Virus 4 (Epstein Barr virus)
uggucgggcgcgcggaggccacagccauccuugaggcugaugccacuugguggcucuacgaa

SEQ ID NO: 535883 - RNA, 62 nt, Human Herpes Virus 4 (Epstein Barr virus)
ugggggaggagggcuuccccacggccaccaacgaggcugaccugauccugcagauauccugc

SEQ ID NO: 535884 - RNA, 62 nt, Human Herpes Virus 4 (Epstein Barr virus)
aaguccgccaggcggggcucgggcaccuguuggaggcugaggagaaggcgaggccgggcggc

SEQ ID NO: 535885 - RNA, 64 nt, Human Herpes Virus 1
ggugcagccaauccuuaagcgcauccgagagcucucgcaacaacagcucgacggagcgcaagug

SEQ ID NO: 535886 - RNA, 64 nt, Human Herpes Virus 1
acgugggccucacccacgccggcaccguuaaccuucgcaacaccucccccguagaucucuguaa

SEQ ID NO: 535887 - RNA, 64 nt, Human Herpes Virus 1
ccucggggcguuugagcgcggcacggccgaccagaugcugcacgugcugcuggaaaaggcgccg

SEQ ID NO: 535888 - RNA, 62 nt, Human Herpes Virus 4 (Epstein Barr virus)
uggccucccuccacccagacauaccccaaaccaccgcagauggaggcaagcuguccuucuuu

SEQ ID NO: 535889 - RNA, 62 nt, Human Herpes Virus 4 (Epstein Barr virus)
ggaccuauuugaccuuucauuuagaacccgagaccgcagacucuuguccgccgccagggugg

SEQ ID NO: 535890 - RNA, 62 nt, Human Herpes Virus 4 (Epstein Barr virus)
auagugacuuuauucaaguuuuggccacguuuaccgcagacccgggggacaccauagucugg

SEQ ID NO: 535891 - RNA, 60 nt, Human Herpes Virus 4 (Epstein Barr virus)
gaggccggaacaggaaccuccacgggugugacuagcaaugucaccaccagguccuccucc

SEQ ID NO: 535892 - RNA, 64 nt, Human Herpes Virus 2
gggaaaccaucucguucucguucccggacggcucgcgcagcacgaucguguuugccuccagcca

SEQ ID NO: 535893 - RNA, 64 nt, Human Herpes Virus 2
gcgugugggacaucggccagagccacuuucagaagcgcagcaagaucaaggugaacgggauggu

SEQ ID NO: 535894 - RNA, 64 nt, Human Herpes Virus 2
gcguucgcggggcgcgucccuucagccacuuuaagcgcagcauguaccgggccggccgcuuuca

SEQ ID NO: 535895 - RNA, 64 nt, Human Herpes Virus 2
ggcgcccgugugggcgcccgagcugggcgacgcggcgcagcaguacgcccugaucacgcggcug

SEQ ID NO: 535896 - RNA, 64 nt, Human Herpes Virus 2
ucgccacccacaccgaguccagggcgcuguuucagcgcagcaaccccggccuuuuccggcucug

SEQ ID NO: 535897 - RNA, 64 nt, Human Herpes Virus 2
gcggcgacgacgggcccgcgucgacgcggcgcucgcgcagcagcgagacgcugggggcccgccg

SEQ ID NO: 535898 - RNA, 64 nt, Human Herpes Virus 2
gucgccgccgagguccccgccuggaagagcuggcgcgcagcauccacggucccucccgcaccgg

SEQ ID NO: 535899 - RNA, 64 nt, Human Herpes Virus 2; identical to SEQ ID NO: 535895

SEQ ID NO: 535900 - RNA, 64 nt, Human Herpes Virus 2
cggccgacaucacggccaaacaucgcugccuggagcgucucaucguggaaacgggaucggcggu

SEQ ID NO: 535901 - RNA, 64 nt, Human Herpes Virus 2
gucaggggguguacaacgucguccgguccagcgaggccgccacccgacagcugcaggcggcgau

SEQ ID NO: 535902 - RNA, 64 nt, Human Herpes Virus 2
uucagaaaaucgcggcgcuuuuuugcgugccgguggccgccaagagcagaccccggaccaaaac

SEQ ID NO: 535903 - RNA, 64 nt, Human Herpes Virus 2
ucgcgugcgugcagcuggagcgcguccucgagacggccgccagcgccgcuauuuuugagcgccg

SEQ ID NO: 535904 - RNA, 64 nt, Human Herpes Virus 2
cccccgaggaggccguccuccucgacaagcaacaggccgccaucaagguggugugcaacucggu

SEQ ID NO: 535905 - RNA, 64 nt, Human Herpes Virus 2
gggugcagcacggucuucugcccugccugcacguggccgccaccgugacgaccaucggccgcga

SEQ ID NO: 535906 - RNA, 64 nt, Human Herpes Virus 2
uucugaccagcgcgcugaagaaggcgggccaagcggccgccaacgccaagacggucuacgggga

SEQ ID NO: 535907 - RNA, 64 nt, Human Herpes Virus 2
ccaucgcucggggguucgcgcaucucuggcuccaggccgccacgcugggcuucguggggucugu

SEQ ID NO: 535908 - RNA, 64 nt, Human Herpes Virus 2
ugcuggagggccagccguuuaaggcgacgugcacggccgccaccuacuacccgggcaaccgcgc

SEQ ID NO: 535909 - RNA, 64 nt, Human Herpes Virus 2
gcugcagcgcgccggccacccuuaucccccgugcggccgccaagcaccuggccgcucugacacg

SEQ ID NO: 535910 - RNA, 64 nt, Human Herpes Virus 2
agaccugcggaaucgucaagcgccuccucaagcuggccgccacggagcagcagggcacgacgcc

SEQ ID NO: 535911 - RNA, 64 nt, Human Herpes Virus 2
ccgccucgccccccgcuaccgcgccggggcccucggccgccaacguuucggucgccgcgaccac

SEQ ID NO: 535912 - RNA, 64 nt, Human Herpes Virus 2
cggcagaagccuacuacucggaaagcgaagacgaggccgccaacgacuuccucgugcgcauggg

SEQ ID NO: 535913 - RNA, 64 nt, Human Herpes Virus 2
agacgaggccgccaacgacuuccucgugcgcaugggccgccagcagucgguccuaaggcgccga

SEQ ID NO: 535914 - RNA, 64 nt, Human Herpes Virus 2
agcaccccggcgcgcgguuggcgugggcgcgccuggccgccauucgcgacagcccccagugcgc

SEQ ID NO: 535915 - RNA, 64 nt, Human Herpes Virus 2
guacacaagauccuagguuuguuggcgccuuuauggccgccaaggcggcccacuuggaauugga

SEQ ID NO: 535916 - RNA, 64 nt, Human Herpes Virus 2
guuucgugacgcccggggccuggagcucggcguuggccgccacgccauggcgccggcuaccaua

SEQ ID NO: 535917 - RNA, 64 nt, Human Herpes Virus 2
gaugggcaaggccgugcggagccuggacgacgugggccgccaccugcuggauaugcaggaggag

SEQ ID NO: 535918 - RNA, 64 nt, Human Herpes Virus 2
ucgcgcaucugcacaacgcauccgugaccuggcuggccgccaggggccugcuacggacuccggg

SEQ ID NO: 535919 - RNA, 64 nt, Human Herpes Virus 2
uguuguucgcgggcgcgagcgccaacgcguccgaggccgccaaggcgcgggucgccagccucca

SEQ ID NO: 535920 - RNA, 64 nt, Human Herpes Virus 2
gcacuacagcccguccguuuacgucuuucacggcggccgccaccuggcccccagcacccaggcc

SEQ ID NO: 535921 - RNA, 64 nt, Human Herpes Virus 2
gcggcguuggagcgcguggacucagcgacgcccaggccgccaacguacgccgaguaugucgccu

SEQ ID NO: 535922 - RNA, 64 nt, Human Herpes Virus 2
augcgcucgucccugucguuguccaccccaauguggccgccacggccccgcgacgugcuguccg

SEQ ID NO: 535923 - RNA, 64 nt, Human Herpes Virus 2
acccgcacuacgacuacauccggcacuacgcgucggccgccaagcaggcgcucggcgaggugga

SEQ ID NO: 535924 - RNA, 64 nt, Human Herpes Virus 2
acagggaguccucgccgcuguggcccuggcggacggccgccaugaauuuuaucgccgcggcugc

SEQ ID NO: 535925 - RNA, 64 nt, Human Hepatitis C Virus (HCV-N)
uaaacaccaauggcaguuggcacaucaacaggacugcccugaacugcaaugacucccuccagac

SEQ ID NO: 535926 - RNA, 64 nt, Human Hepatitis C Virus (HCV-N)
ucgucugcugcucaauguccuacacauggacaggugcccugaucacgccaugcgccgcggaaga

SEQ ID NO: 535927 - RNA, 64 nt, Human Hepatitis C Virus (HCV-N)
ucuuuacaccugggccgucucagagaauccagcuuauaaacaccaauggcaguuggcacaucaa

SEQ ID NO: 535928 - RNA, 63 nt, Human Herpes Virus 1
ggggaucaagaucggcuacacggcgcacauccgcaaggcgaccgagccgguguuugaggagau

SEQ ID NO: 535929 - RNA, 63 nt, Human Herpes Virus 1
cugcuaccugguaaacccccaggccaccacaaacaaggcgacccugcgggccaucaccagcaa

SEQ ID NO: 535930 - RNA, 63 nt, Human Herpes Virus 1
acuaaaaacagggauguacuacugcaagguucgcaaggcgaccaacagcggggucuuuggcgg

SEQ ID NO: 535931 - RNA, 63 nt, Human Herpes Virus 1
ccagccccacgcggugauggagggucagccguucaaggcgacgugcacggccgccgccuacua

SEQ ID NO: 535932 - RNA, 63 nt, Human Herpes Virus 1
uacggaucgguguauaaauuaccagcacacacacaaggcgauacugucgucgguggcgcugcc

SEQ ID NO: 535933 - RNA, 63 nt, Human Herpes Virus 1
cacgccucggcgaguggcuuccgcgggauacgucaaggcgacuggacacccuuuuugcccccg

SEQ ID NO: 535934 - RNA, 64 nt, Human Herpes Virus 2
gccucuaccgcacauucgcagccaacccgcgggccgcgucgacagccaaggccaugcgcgacug

SEQ ID NO: 535935 - RNA, 64 nt, Human Herpes Virus 2
cuuuguguuggucauccuggcccgccucgccaaccgcgucgagcgcggcgugucggagaucgac

SEQ ID NO: 535936 - RNA, 64 nt, Human Herpes Virus 2
ccaacuguacucgccgacgaugcagcagcugggccgcgucgacgcguugaugcugcgccugcug

SEQ ID NO: 535937 - RNA, 64 nt, Human Herpes Virus 2
ggccguuccgaucgcccugaucaucacccccguccgcgucgagccggggaucuaccgggacauc

SEQ ID NO: 535938 - RNA, 64 nt, Human Herpes Virus 2
ugugcuccgcggcgcccgacgcgggcgccaacaccgcgucgacggccaacaugcgcaucuucga

SEQ ID NO: 535939 - RNA, 64 nt, Human Herpes Virus 2
cuucaccaccaaccugaccgaguacucgcucucgcgcgucgaccugggcgacugcaucggccgg

SEQ ID NO: 535940 - RNA, 64 nt, Human Herpes Virus 2
gcgcgacgaccgcugcucgguugauacucggcgccgcgucgacgggguucgggggccugcugca

SEQ ID NO: 535941 - RNA, 64 nt, Human Herpes Virus 2
gccagccccuagaugcccccaggcggcgcuggaccgcgucgagaguccugaccgacgccgcgac

SEQ ID NO: 535942 - RNA, 64 nt, Human Herpes Virus 2
ugauggcaugcgccuucuggugcuguuuggcgcacgcgucgacguguuccuacgcgggguuaua

SEQ ID NO: 535943 - RNA, 64 nt, Human Herpes Virus 1; identical to SEQ ID NO: 535808

SEQ ID NO: 535944 - RNA, 64 nt, Human Herpes Virus 1; identical to SEQ ID NO: 535809

SEQ ID NO: 535945 - RNA, 64 nt, Human Herpes Virus 1; identical to SEQ ID NO: 535810

SEQ ID NO: 535946 - RNA, 64 nt, Human Herpes Virus 1; identical to SEQ ID NO: 535811

SEQ ID NO: 535947 - RNA, 64 nt, Human Herpes Virus 1; identical to SEQ ID NO: 535812

SEQ ID NO: 535948 - RNA, 64 nt, Human Herpes Virus 1; identical to SEQ ID NO: 535813

SEQ ID NO: 535949 - RNA, 64 nt, Human Herpes Virus 1; identical to SEQ ID NO: 535814

SEQ ID NO: 535950 - RNA, 64 nt, Human Herpes Virus 1; identical to SEQ ID NO: 535815

SEQ ID NO: 535951 - RNA, 64 nt, Human Herpes Virus 1; identical to SEQ ID NO: 535816

SEQ ID NO: 535952 - RNA, 64 nt, Human Herpes Virus 1; identical to SEQ ID NO: 535817

SEQ ID NO: 535953 - RNA, 64 nt, Human Herpes Virus 1; identical to SEQ ID NO: 535818

SEQ ID NO: 535954 - RNA, 64 nt, Human Herpes Virus 1; identical to SEQ ID NO: 535819

SEQ ID NO: 535955 - RNA, 64 nt, Human Herpes Virus 1; identical to SEQ ID NO: 535820

SEQ ID NO: 535956 - RNA, 64 nt, Human Herpes Virus 1; identical to SEQ ID NO: 535821

SEQ ID NO: 535957 - RNA, 64 nt, Human Herpes Virus 1; identical to SEQ ID NO: 535822

SEQ ID NO: 535958 - RNA, 64 nt, Human Herpes Virus 1; identical to SEQ ID NO: 535808

SEQ ID NO: 535959 - RNA, 64 nt, Human Herpes Virus 1; identical to SEQ ID NO: 535815

SEQ ID NO: 535960 - RNA, 64 nt, Human Herpes Virus 1; identical to SEQ ID NO: 535825

SEQ ID NO: 535961 - RNA, 64 nt, Human Herpes Virus 2
ucaccggcgacaccacacuaaauuuuucgugcgcaugcgcgacacccggcaccgcgcccauucg

SEQ ID NO: 535962 - RNA, 64 nt, Human Herpes Virus 2
uuuguuugugcgggugcccauggcgucggcggaaaugcgcgagcgguuggaggcgccucugccc

SEQ ID NO: 535963 - RNA, 64 nt, Human Herpes Virus 2
agccaacccgcgggccgcgucgacagccaaggccaugcgcgacugcgugcugcgccaggaaaau

SEQ ID NO: 535964 - RNA, 64 nt, Human Herpes Virus 2
ccgcggggccgcguacgccgcggcggccgagguuaugcgcgacgcgcugagacgaauccuccgg

SEQ ID NO: 535965 - RNA, 64 nt, Human Herpes Virus 2
gggcgggcaggcucaggccgagcugaaucaccugaugcgcgacccggcgcugcugccgccccuc

SEQ ID NO: 535966 - RNA, 64 nt, Human Herpes Virus 2
cagcgaguccugggaagcgcaccgcggggcgcgcaugcgcgacgcggccccgcguuuugcgcag

SEQ ID NO: 535967 - RNA, 64 nt, Human Herpes Virus 2
acccccugcggggcgagauccggaggcccgcgagaugcgcgaggggugugguccccagggggga

SEQ ID NO: 535968 - RNA, 64 nt, Human Herpes Virus 2
gugguuacuacgugguggagcagcaguggccgggggcccagacgggaguccgcgucgcccuggc

SEQ ID NO: 535969 - RNA, 64 nt, Human Herpes Virus 2
cggguaugcuguucgcgggccccaguccccuggaggcccagaucgccgcgcuggugggggccau

SEQ ID NO: 535970 - RNA, 64 nt, Human Herpes Virus 2
cguccaucaaggaccggaucccguacgugaucguggcccagacccgcgagguagaggagacggu

SEQ ID NO: 535971 - RNA, 64 nt, Human Herpes Virus 2
gccaguucaucgcgcucaugcccaccgccgccucggcccagaucucggacgucagcgagggcuu

SEQ ID NO: 535972 - RNA, 64 nt, Human Herpes Virus 2
ucugguucgaggacggucgccggguguucgauccggcccagauacacacgcagacgcaggagaa

SEQ ID NO: 535973 - RNA, 64 nt, Human Herpes Virus 2
ggaucgcgcacgcgcaccggcgcucugcucgccaggcccagaugcggagcggagccgccuggac

SEQ ID NO: 535974 - RNA, 64 nt, Human Herpes Virus 2
aggcugcgcgccugugucagcugcaggagaucuuggcccagaugcacagcgacgaggacuaccc

SEQ ID NO: 535975 - RNA, 64 nt, Human Herpes Virus 2
agcgcgucgugcgcccccaccagcugucccccgcggcccagacggcgcugcugcgucgcuuucc

SEQ ID NO: 535976 - RNA, 64 nt, Human Herpes Virus 2
gcgacggcaagucccgcggcgcgcgcgagcgccgggcccagaucgcauggcgcccuggcggacg

SEQ ID NO: 535977 - RNA, 64 nt, Human Herpes Virus 2
ccccuacucgccauccaacccgcccucgagaugugccuuccaguuccacggccaggaugggucc

SEQ ID NO: 535978 - RNA, 58 nt, Human Herpes Virus 2
cgcacccuugcccggucgcgauggcggggauggggaagcccuacggcggccgcccggg

SEQ ID NO: 535979 - RNA, 63 nt, Human Herpes Virus 2
ggcgggagcggcgaacacugccucggaggggaugauggggacgacgggcgcccccgccucgcc

SEQ ID NO: 535980 - RNA, 63 nt, Human Herpes Virus 2
cuuguccagacggacagcaccaaccggaaugccgauggggacuggcaagcggccguagcuauu

SEQ ID NO: 535981 - RNA, 63 nt, Human Herpes Virus 2
gccagcgaccccgcccugcuacgcagcgcccgcgauggggaggcccacgcgcgagagacccac

SEQ ID NO: 535982 - RNA, 64 nt, Human Herpes Virus 2; identical to SEQ ID NO: 535977

SEQ ID NO: 535983 - RNA, 58 nt, Human Herpes Virus 2; identical to SEQ ID NO: 535978

SEQ ID NO: 535984 - RNA, 63 nt, Human Herpes Virus 2; identical to SEQ ID NO: 535979

SEQ ID NO: 535985 - RNA, 63 nt, Human Herpes Virus 2; identical to SEQ ID NO: 535980

SEQ ID NO: 535986 - RNA, 63 nt, Human Herpes Virus 2; identical to SEQ ID NO: 535981

SEQ ID NO: 535987 - RNA, 64 nt, Human Herpes Virus 2
agaccgacacccaagcacagagucugggccgggcaggcgcgaccgacgcgcgcgggucgggagg

SEQ ID NO: 535988 - RNA, 64 nt, Human Herpes Virus 2
gguggggaccgccgcggggcuggccacgccgccgaggcgcgagcccguggacauggacgcggag

SEQ ID NO: 535989 - RNA, 64 nt, Human Herpes Virus 2; identical to SEQ ID NO: 535987

SEQ ID NO: 535990 - RNA, 64 nt, Human Herpes Virus 2; identical to SEQ ID NO: 535988

SEQ ID NO: 535991 - RNA, 64 nt, Human Herpes Virus 2
acgcgcaccgcgcgccccggucgcgcaugacccaggcucagaccgacacccaagcacagagucu

SEQ ID NO: 535992 - RNA, 64 nt, Human Herpes Virus 2; identical to SEQ ID NO: 535991

SEQ ID NO: 535993 - RNA, 64 nt, Human Herpes Virus 2
ggucgggcgggggucgggcgggggucgggcgggggucgggcacuaaccgggggcucccgucucu

SEQ ID NO: 535994 - RNA, 64 nt, Human Herpes Virus 2
gaucggcgaguauugugugcaggacucgcugcuggucgggcagcuguucuucaaguuucugccg

SEQ ID NO: 535995 - RNA, 64 nt, Human Herpes Virus 2
ugcggcgggaaauccacggguuccuggccaucgugucgggcauccacgccagggcgucaaaguu

SEQ ID NO: 535996 - RNA, 64 nt, Human Herpes Virus 2; identical to SEQ ID NO: 535993

SEQ ID NO: 535997 - RNA, 64 nt, Human Herpes Virus 2
aagacaugcaaaucgauuucuuccggggacacggccagcaaacgcgaacagcggaccacgggca

SEQ ID NO: 535998 - RNA, 64 nt, Human Herpes Virus 2
ccccgcccccguauccccaacggcgggcgaguucccagcaaacacaacagaccuacuggucgag

SEQ ID NO: 535999 - RNA, 64 nt, Human Herpes Virus 4 (Epstein Barr virus)
agagacacuaucacguguaacuugacgugcaaggauggaagagaggggcagggaaacgcaaaug

SEQ ID NO: 536000 - RNA, 50 nt, Human Herpes Virus 4 (Epstein Barr virus)
guguaacuugacgugcaaggauggaagagaggggcagggaaacgcaaaug

SEQ ID NO: 536001 - RNA, 64 nt, Human Herpes Virus 4 (Epstein Barr virus)
cagauugccuucuguuaaggcuguugacaugagcauggaagacauggccgcccgccuggcucgc

SEQ ID NO: 536002 - RNA, 64 nt, Human Herpes Virus 4 (Epstein Barr virus)
aguacguggaucggacgcuacgcccaaagcccugauggaagacccaggcuaaccugccuccucc

SEQ ID NO: 536003 - RNA, 64 nt, Human Herpes Virus 4 (Epstein Barr virus)
caaaucagcuuguccacccgccgacccggauaauauggaagaugugcuccccuuuugcauaugc

SEQ ID NO: 536004 - RNA, 64 nt, Human Herpes Virus 4 (Epstein Barr virus)
gcucguuaaaccaauagcaugucagcuccacgcaaagucagauugccuucuguuaaggcuguug

SEQ ID NO: 536005 - RNA, 64 nt, Human Herpes Virus 4 (Epstein Barr virus)
aacaguauacggcaggcccgcgguguuugaccgaaagucagaugcaaaaucaaccaaaaaaugc

SEQ ID NO: 536006 - RNA, 64 nt, Human Herpes Virus 4 (Epstein Barr virus)
gcugcgcacaaacuccauggccggugguucagccaagucagacuccagaugacccaacgaaaca

SEQ ID NO: 536007 - RNA, 64 nt, Human Herpes Virus 1
uugcccacggguuggucgccugcuuugcgccgggcggcccgagcggcccgucaagcuuccccaa

SEQ ID NO: 536008 - RNA, 64 nt, Human Herpes Virus 1
gagaucgacgccugccugcggggcugguucgguucggcccgaguggaccacguuaaaggggaaa

SEQ ID NO: 536009 - RNA, 64 nt, Human Herpes Virus 1
ccgguacacacagcgccacggccuguacgucccucggcccgacgacccagucuuggccgaugcc

SEQ ID NO: 536010 - RNA, 64 nt, Human Herpes Virus 1
gccggccgaugaggucgcaccggccagggucgcgcggcccgaaaacgucugggugcccgugguc

SEQ ID NO: 536011 - RNA, 64 nt, Human Herpes Virus 1
ccagacgggucuccugggaaaccuuggucgcccacggcccgagccucuaucgcacuuuugccgg

SEQ ID NO: 536012 - RNA, 64 nt, Human Herpes Virus 1
uuucguugcuuccagcuccggggccuacggggcgcggcccgacccagaaacuacuaugggccgu

SEQ ID NO: 536013 - RNA, 64 nt, Human Herpes Virus 1
ucggcggugauguucgggcgggugaacgagccgacggcccgaagccugcuguuucgcuacugcg

SEQ ID NO: 536014 - RNA, 64 nt, Human Herpes Virus 1
ggugcaguucgagcagccgcgccgcugcccgacccggcccgagggucagaacuacacggagggc

SEQ ID NO: 536015 - RNA, 64 nt, Human Herpes Virus 1
ucgcccgccaucgagccaacgcccugaccaacgacggcccgaccaacgucgccgcccugagcgc

SEQ ID NO: 536016 - RNA, 64 nt, Human Herpes Virus 1
gauccuaugggccgcguacgccgagcagaugaugcggcccgaccuguuugacugccucuguugc

SEQ ID NO: 536017 - RNA, 64 nt, Human Herpes Virus 1
uggauucggcaagggcggaaacagccgcgggucugcgggccaggaccagggggggcgggcgccg

SEQ ID NO: 536018 - RNA, 64 nt, Human Herpes Virus 1
ggucgggggcggggucggggggcgcgggcgccaagcgggccaccgucagcgaguucgugcaagu

SEQ ID NO: 536019 - RNA, 64 nt, Human Herpes Virus 1
uaaacccccaggccaccacaaacaaggcgacccugcgggccaucaccagcaacgucagugccau

SEQ ID NO: 536020 - RNA, 64 nt, Human Herpes Virus 1
ccagguccagauccuguccaacgcgcucaccaaggcgggccaggcggccgccaacgccaagacg

SEQ ID NO: 536021 - RNA, 64 nt, Human Herpes Virus 1
ucccgccgcgaauagccccugggccccggugcuggcgggccaaggagggcccuuugacgccgag

SEQ ID NO: 536022 - RNA, 64 nt, Human Herpes Virus 1
cggaugcggcuuccggggugaucgaggacgcccggcgggccaucgagacggccgugggagccgu

SEQ ID NO: 536023 - RNA, 64 nt, Human Herpes Virus 1
gcuuuacgaggcgcucgucgccuggcugacccacgcgggccaacuaggagacaccuuggcccug

SEQ ID NO: 536024 - RNA, 64 nt, Human Herpes Virus 1
aagcuucugcgagacgagcuuuuuccugggcaaggcgggccaccgccgggaggccgucgaggcc

SEQ ID NO: 536025 - RNA, 64 nt, Human Herpes Virus 1
cgacagcccuccgguggaagugauggugguccccgcgggccagacgcuagaucgggucggggac

SEQ ID NO: 536026 - RNA, 64 nt, Human Herpes Virus 1
gccgcgccccgccggcgacaacgcgaccgucgccgcgggccacgccacccugcgcgagcaccug

SEQ ID NO: 536027 - RNA, 64 nt, Human Herpes Virus 1
acgcccucgcucgcgggguccgcgggaaagccucgcgggccacgccccucggcguaaugcccgc

SEQ ID NO: 536028 - RNA, 64 nt, Human Herpes Virus 1
guccccgccuccguuccggagcgcugcggcaggcgcgggccaugcgacccggccgggccgccgg

SEQ ID NO: 536029 - RNA, 64 nt, Human Herpes Virus 1
gucacuggacccccccgagucgcucucagacccggcgggccauccgccgggaacacaccagcuc

SEQ ID NO: 536030 - RNA, 64 nt, Human Herpes Virus 1; identical to SEQ ID NO: 536007

SEQ ID NO: 536031 - RNA, 64 nt, Human Herpes Virus 1; identical to SEQ ID NO: 536008

SEQ ID NO: 536032 - RNA, 64 nt, Human Herpes Virus 1; identical to SEQ ID NO: 536009

SEQ ID NO: 536033 - RNA, 64 nt, Human Herpes Virus 1; identical to SEQ ID NO: 536010

SEQ ID NO: 536034 - RNA, 64 nt, Human Herpes Virus 1; identical to SEQ ID NO: 536011

SEQ ID NO: 536035 - RNA, 64 nt, Human Herpes Virus 1; identical to SEQ ID NO: 536012

SEQ ID NO: 536036 - RNA, 64 nt, Human Herpes Virus 1; identical to SEQ ID NO: 536013

SEQ ID NO: 536037 - RNA, 64 nt, Human Herpes Virus 1; identical to SEQ ID NO: 536014

SEQ ID NO: 536038 - RNA, 64 nt, Human Herpes Virus 1; identical to SEQ ID NO: 536015

SEQ ID NO: 536039 - RNA, 64 nt, Human Herpes Virus 1; identical to SEQ ID NO: 536016

SEQ ID NO: 536040 - RNA, 64 nt, Human Herpes Virus 1; identical to SEQ ID NO: 536017

SEQ ID NO: 536041 - RNA, 64 nt, Human Herpes Virus 1; identical to SEQ ID NO: 536018

SEQ ID NO: 536042 - RNA, 64 nt, Human Herpes Virus 1; identical to SEQ ID NO: 536019

SEQ ID NO: 536043 - RNA, 64 nt, Human Herpes Virus 1; identical to SEQ ID NO: 536020

SEQ ID NO: 536044 - RNA, 64 nt, Human Herpes Virus 1; identical to SEQ ID NO: 536021

SEQ ID NO: 536045 - RNA, 64 nt, Human Herpes Virus 1; identical to SEQ ID NO: 536022

SEQ ID NO: 536046 - RNA, 64 nt, Human Herpes Virus 1; identical to SEQ ID NO: 536023

SEQ ID NO: 536047 - RNA, 64 nt, Human Herpes Virus 1; identical to SEQ ID NO: 536024

SEQ ID NO: 536048 - RNA, 64 nt, Human Herpes Virus 1; identical to SEQ ID NO: 536025

SEQ ID NO: 536049 - RNA, 64 nt, Human Herpes Virus 1; identical to SEQ ID NO: 536026

SEQ ID NO: 536050 - RNA, 64 nt, Human Herpes Virus 1; identical to SEQ ID NO: 536027

SEQ ID NO: 536051 - RNA, 64 nt, Human Herpes Virus 1; identical to SEQ ID NO: 536028

SEQ ID NO: 536052 - RNA, 64 nt, Human Herpes Virus 1; identical to SEQ ID NO: 536029

SEQ ID NO: 536053 - RNA, 64 nt, Human Herpes Virus 4 (Epstein Barr virus)
ugguuccgccagugcaccgggagacccaaagcagccaagccaugguuaagagcgcauccugucg

SEQ ID NO: 536054 - RNA, 64 nt, Human Herpes Virus 4 (Epstein Barr virus)
ugaaaaaggcaccggagcccccaccuccggagccccaagccaccuucgaugccacccccuaugc

SEQ ID NO: 536055 - RNA, 64 nt, Human Herpes Virus 4 (Epstein Barr virus)
gcuggacuuuuacgagcccaccgguuaccacagcccaagccaccgugccagucccgccaacguc

SEQ ID NO: 536056 - RNA, 64 nt, Human Herpes Virus 4 (Epstein Barr virus)
ccaggggcccgagguuggagccagcgggcacccgaggucccagcacccggucccuccggggggc

SEQ ID NO: 536057 - RNA, 64 nt, Human Herpes Virus 4 (Epstein Barr virus); identical to SEQ ID NO: 536056

SEQ ID NO: 536058 - RNA, 64 nt, Human Herpes Virus 4 (Epstein Barr virus); identical to SEQ ID NO: 536056

SEQ ID NO: 536059 - RNA, 64 nt, Human Herpes Virus 4 (Epstein Barr virus)
ucgaggauacgggcgccagagucacagguggaggaggucccaggccuggcgucacgcacucggg

SEQ ID NO: 536060 - RNA, 64 nt, Human Herpes Virus 4 (Epstein Barr virus)
gacucuggggucucacugcgagaucugcaucaauaggucccagguucaugugccucaggaguuu

SEQ ID NO: 536061 - RNA, 64 nt, Human Herpes Virus 4 (Epstein Barr virus)
acucccuuggaugugggcccucuucuacggccccaggucccacugcgaagagcgucacugcguu

SEQ ID NO: 536062 - RNA, 64 nt, Human Herpes Virus 4 (Epstein Barr virus)
cguguccugcaggggguucuugcuaaugggaaagaggucccauguacagcacaaccuuggaccc

SEQ ID NO: 536063 - RNA, 64 nt, Human Herpes Virus 4 (Epstein Barr virus)
cauuacaccaucccauggaccgaacugauggcaaaggucccaggccuuagcccagaggcgcugu

SEQ ID NO: 536064 - RNA, 64 nt, Human Herpes Virus 4 (Epstein Barr virus)
ccgggcccggacggucgcccucagccccccagacagaccccagggucuccaggcaggguccggc

SEQ ID NO: 536065 - RNA, 64 nt, Human Herpes Virus 4 (Epstein Barr virus)
ucccccugcuccucuccaaccuucgcuccacccuagaccccagcuucuggccuccccgggucca

SEQ ID NO: 536066 - RNA, 64 nt, Human Herpes Virus 4 (Epstein Barr virus); identical to SEQ ID NO: 536064

SEQ ID NO: 536067 - RNA, 64 nt, Human Herpes Virus 4 (Epstein Barr virus); identical to SEQ ID NO: 536065

SEQ ID NO: 536068 - RNA, 64 nt, Human Herpes Virus 4 (Epstein Barr virus); identical to SEQ ID NO: 536064

SEQ ID NO: 536069 - RNA, 64 nt, Human Herpes Virus 4 (Epstein Barr virus); identical to SEQ ID NO: 536065

SEQ ID NO: 536070 - RNA, 64 nt, Human Herpes Virus 4 (Epstein Barr virus); identical to SEQ ID NO: 536064

SEQ ID NO: 536071 - RNA, 64 nt, Human Herpes Virus 4 (Epstein Barr virus); identical to SEQ ID NO: 536065

SEQ ID NO: 536072 - RNA, 64 nt, Human Herpes Virus 4 (Epstein Barr virus); identical to SEQ ID NO: 536064

SEQ ID NO: 536073 - RNA, 64 nt, Human Herpes Virus 4 (Epstein Barr virus); identical to SEQ ID NO: 536065

SEQ ID NO: 536074 - RNA, 64 nt, Human Herpes Virus 4 (Epstein Barr virus); identical to SEQ ID NO: 536064

SEQ ID NO: 536075 - RNA, 64 nt, Human Herpes Virus 4 (Epstein Barr virus); identical to SEQ ID NO: 536065

SEQ ID NO: 536076 - RNA, 64 nt, Human Herpes Virus 4 (Epstein Barr virus); identical to SEQ ID NO: 536064

SEQ ID NO: 536077 - RNA, 64 nt, Human Herpes Virus 4 (Epstein Barr virus); identical to SEQ ID NO: 536065

SEQ ID NO: 536078 - RNA, 64 nt, Human Herpes Virus 4 (Epstein Barr virus); identical to SEQ ID NO: 536064

SEQ ID NO: 536079 - RNA, 64 nt, Human Herpes Virus 4 (Epstein Barr virus); identical to SEQ ID NO: 536065

SEQ ID NO: 536080 - RNA, 64 nt, Human Herpes Virus 4 (Epstein Barr virus)
aggaucagggccaagacauagagaugguguccggagaccccaaaaacguccaaguugcauuggc

SEQ ID NO: 536081 - RNA, 64 nt, Human Herpes Virus 4 (Epstein Barr virus)
caucuaguggauacucuguaccacgccucuccgcagaccccauuucugacacgcagcggugcuc

SEQ ID NO: 536082 - RNA, 64 nt, Human Herpes Virus 4 (Epstein Barr virus)
cugcuagccgcccuggcgugccgucucggugcgcagaccccagagcagcccgcaccccccgcca

SEQ ID NO: 536083 - RNA, 64 nt, Human Herpes Virus 2
cccccgcccgcuuaugggauuuuacgaggcggcgacgcaaaaccaggccgacugccagcucugg

SEQ ID NO: 536084 - RNA, 64 nt, Human Herpes Virus 1
uguguugugcaaacgcgcccacgccgcucgagugcgagagcagcuucgggucguuauucagucc

SEQ ID NO: 536085 - RNA, 64 nt, Human Herpes Virus 1
cccccagccuaacggccggccagacggcccccgccgagagcagcuucgagggcgacguugcccg

SEQ ID NO: 536086 - RNA, 64 nt, Human Herpes Virus 4 (Epstein Barr virus)
aaagucacgagcgcaaacgagccaaacccccugaccggaaaaagacuguccagcugcccccuca

SEQ ID NO: 536087 - RNA, 64 nt, Human Herpes Virus 4 (Epstein Barr virus)
guuugagcauuucauggcuaggaucguggacucaccggaaaaagccggaagcaccaagucugac

SEQ ID NO: 536088 - RNA, 64 nt, Human Herpes Virus 4 (Epstein Barr virus)
gucgccuuaccuccccuauauagucacgaccccaccgaaccaggcaugauguagaauaaaauuu

SEQ ID NO: 536089 - RNA, 64 nt, Human Herpes Virus 4 (Epstein Barr virus)
gcaguguaguccugucaaucuccugaacauguugguccacaagcuuguggcuuuacguggucau

SEQ ID NO: 536090 - RNA, 64 nt, Human Herpes Virus 4 (Epstein Barr virus)
guuuagcuccacccagcucuccuucuucaacaauguccacaagauaauacccaacaagaccuuc

SEQ ID NO: 536091 - RNA, 64 nt, Human Herpes Virus 4 (Epstein Barr virus)
cagccgccaaguggauccggaguucuugggccugguccacaacccuuuccgaaggagcccuggc

SEQ ID NO: 536092 - RNA, 64 nt, Human Herpes Virus 4 (Epstein Barr virus)
ucacuccaucuccucgccuccagugccccccuuuguccacaacgccacaggcagcucccucgaa

SEQ ID NO: 536093 - RNA, 64 nt, Human Herpes Virus 4 (Epstein Barr virus)
ccggcagggccuccuucuugauaaaguuagccucguccacaaacaagaggugaaaugucugccc

SEQ ID NO: 536094 - RNA, 64 nt, Human Herpes Virus 1
cuuugacuauucgcgcacccgccgcuguguagggcgacaggauuugggaccuaccaacggaacg

SEQ ID NO: 536095 - RNA, 64 nt, Human Herpes Virus 1
gggccuccaucccggguuuggguucaccgucguccgacaggaccgcuuugugacugagaacgug

SEQ ID NO: 536096 - RNA, 64 nt, Human Herpes Virus 1
ugcgggccucccugccggcgucgcauucgugacccgacaggaccguucggggggcgcccccuga

SEQ ID NO: 536097 - RNA, 59 nt, Human Herpes Virus 4 (Epstein Barr virus)
gucuucaggacauucgacguggacccuugguugcggagggcgguguggguuggcgacau

SEQ ID NO: 536098 - RNA, 59 nt, Human Herpes Virus 4 (Epstein Barr virus)
ucuaccccacguaugaucugggcuccauaguugcggacauggugacuuaugaagaugag

SEQ ID NO: 536099 - RNA, 64 nt, Human Herpes Virus 2
gcuucggugcacgcgcgccuaccuguaucaccggcgacaccacacuaaauuuuucgugcgcaug

SEQ ID NO: 536100 - RNA, 64 nt, Human Herpes Virus 2
ccaucgggcggcgccuuggaaccaucgucaccuacgacaccagccuagacgcggccaucgcucc

SEQ ID NO: 536101 - RNA, 64 nt, Human Herpes Virus 2
gcgccccggucccggagcgaaaggcgcccucugccgacaccaucgaccccgccguucgggcggu

SEQ ID NO: 536102 - RNA, 64 nt, Human Herpes Virus 2
aggugggggccacgggguucaccccggaagagcucgacaccauggaccgggaggcacuucgggc

SEQ ID NO: 536103 - RNA, 64 nt, Human Herpes Virus 2
cguacaccagcacccugcugccgccggagcuguccgacaccaccaacgccacgcaacccgaacu

SEQ ID NO: 536104 - RNA, 64 nt, Human Herpes Virus 2
ggccagccugucgccgcgacccccggcgccccgccgacaccaccaccaccaccaccaccgccgc

SEQ ID NO: 536105 - RNA, 64 nt, Human Herpes Virus 2
gggacgccgccggcgcaucggcaaccagggccgccgacaccagcgaccgcucuccgggggagcg

SEQ ID NO: 536106 - RNA, 64 nt, Human Herpes Virus 2
ccucagcgcccuguugacgaagcucaaacgcggccgacaccagagccauuaaaaaaaugcgacc

SEQ ID NO: 536107 - RNA, 64 nt, Human Herpes Virus 2
ccgcgggcgucgggcuuggcgccacccccgccgccgacaccaccgccgccgccgccuggccggc

SEQ ID NO: 536108 - RNA, 64 nt, Human Herpes Virus 2; identical to SEQ ID NO: 536104

SEQ ID NO: 536109 - RNA, 64 nt, Human Herpes Virus 2
gcuuaaaaaucgccggguggcacggccccaagcccccguacaccagcacccugcugccgccgga

SEQ ID NO: 536110 - RNA, 64 nt, Human Herpes Virus 2
gcgggaaucacguccaggcccagcuggggcagcacccguacacccuggccagcagccccgccuc

SEQ ID NO: 536111 - RNA, 64 nt, Human Herpes Virus 2
ugccggucgcgugcgacgcccaaggcguguacgacccguacacggucgcggcgcugcgccuggc

SEQ ID NO: 536112 - RNA, 64 nt, Human Herpes Virus 2
agggcaucgcgguggucuucaaggagaacaucgccccguacaaauucaaggccaccauguacua

SEQ ID NO: 536113 - RNA, 64 nt, Human Herpes Virus 2
ccgaggccaaccacgccaugucgcugucgcuggacccguacaccugcgggccgugcccccugcu

SEQ ID NO: 536114 - RNA, 64 nt, Human Herpes Virus 2
ccguccccacgucccaguacaauuuggccccuugcccguacagggcuacggcucgcgaaacacg

SEQ ID NO: 536115 - RNA, 64 nt, Human Herpes Virus 2
gcggggccgcccugccgggagacgccccggacuccccguacaucgaggcggaaaauccccugua

SEQ ID NO: 536116 - RNA, 64 nt, Human Herpes Virus 2
ggccaccacuaaccaggccacccuccgggccaucaccggcaacgugagcgccauccucgcccgc

SEQ ID NO: 536117 - RNA, 64 nt, Human Herpes Virus 2
gcuccgggaguuuccguucgcggcguaucucaucaccggcaacgccggauccggaaagaguacg

SEQ ID NO: 536118 - RNA, 64 nt, Human Herpes Virus 2
gggccaccugacgcgccuggcccaccugugggagaccggcaagcgcagcggcggcacguacggg

SEQ ID NO: 536119 - RNA, 64 nt, Human Herpes Virus 2
cgucggaguggaacagccucuggaugaccccggugggcaacaugcucuuugaccagggcacccu

SEQ ID NO: 536120 - RNA, 64 nt, Human Herpes Virus 2
ccggggcguuucgcagcguucgcguggcggucgagggcaacagcagccaggacucggccguggc

SEQ ID NO: 536121 - RNA, 64 nt, Human Herpes Virus 2; identical to SEQ ID NO: 536119

SEQ ID NO: 536122 - RNA, 64 nt, Human Herpes Virus 2
agcacguuugugcucguggucagacgcaacgcagagaaaccagcggacgcggaaauuccgaccg

SEQ ID NO: 536123 - RNA, 64 nt, Human Herpes Virus 2
ggacgagccgccgccgccgcccccgaccgcccuggccgcccagaugcgccagcacggccagggc

SEQ ID NO: 536124 - RNA, 64 nt, Human Herpes Virus 2
gucaccuuaauaugcgaaguggaccucgggccgcgccgcccagacugcaucugcguguucgaau

SEQ ID NO: 536125 - RNA, 64 nt, Human Herpes Virus 2
ccuggagcacguggaacacgcguacagcaugcgcgccgcccagcuccacgagcgauuuauggac

SEQ ID NO: 536126 - RNA, 64 nt, Human Herpes Virus 2
gcggccccggaucuccggauccagccgacggaccgccgcccaccccgaacccggaccgucgccc

SEQ ID NO: 536127 - RNA, 64 nt, Human Herpes Virus 2
ggugcugcuggaggccugucuucgcguccccauggccgcccauagcagcgccaucuuccggcgg

SEQ ID NO: 536128 - RNA, 64 nt, Human Herpes Virus 2
cgcgcuccugcagaugcagagcgucacgcgagaagccgcccagcucauccaccccgaagccccc

SEQ ID NO: 536129 - RNA, 64 nt, Human Herpes Virus 2
caugggcggcgcggcccugugcgcccugguggcggccgcccaugagacguucagucccgacggg

SEQ ID NO: 536130 - RNA, 64 nt, Human Herpes Virus 2
cgaccaccaaggcccggaagcggaaaaccaaaaagccgcccaagcggcccgaggcgaccccgcc

SEQ ID NO: 536131 - RNA, 64 nt, Human Herpes Virus 2
gcgugcccggaacguggacgccguggcccgcgcggccgcccaccuggcguucgacgaaaaccac

SEQ ID NO: 536132 - RNA, 64 nt, Human Herpes Virus 2
ucggaugcugaccgcgugccccggcuaccgguucgccgcccacguguggcagagcacguuugug

SEQ ID NO: 536133 - RNA, 64 nt, Human Herpes Virus 2
ugcauguuucccgacgacuacguccucccgaccagccgcccaccccuccuggccgcacgccugg

SEQ ID NO: 536134 - RNA, 64 nt, Human Herpes Virus 2
ugcggccgcuguccuacacggccuggcggacguggccgcccaccauggggcucuaccgggacgg

SEQ ID NO: 536135 - RNA, 64 nt, Human Herpes Virus 2
ccggucggcugagucaggcccagcugaugcccucgccgcccaugcccgucccccccgcggcccu

SEQ ID NO: 536136 - RNA, 64 nt, Human Herpes Virus 2; identical to SEQ ID NO: 536126

SEQ ID NO: 536137 - RNA, 64 nt, Human Herpes Virus 1
cgcuguggccucaccugaccaaccuuuacacgggggcccggaacgggaggccacagcgccgucu

SEQ ID NO: 536138 - RNA, 64 nt, Human Herpes Virus 1
ggcgcugugagauucgcgggccgcccugaagcgcggcccggauggccuggcccagggcccggag

SEQ ID NO: 536139 - RNA, 64 nt, Human Herpes Virus 1
cgcccugaagcgcggcccggauggccuggcccagggcccggaggcacgccagauguaugcgcgc

SEQ ID NO: 536140 - RNA, 64 nt, Human Herpes Virus 1
gugcaagcuuccuuguuuggagaccagacgguacggcccggagugugaucuuaguaaucucgag

SEQ ID NO: 536141 - RNA, 64 nt, Human Herpes Virus 1
cggcaacgugcgcuaccgcgugcgcacgcgcuucggcccggacacgccggugcccauguccccg

SEQ ID NO: 536142 - RNA, 64 nt, Human Herpes Virus 1
guuugauuuuaagcaacuggggccgcgggacgggggcccggacgauuuucccgacgacgaccuc

SEQ ID NO: 536143 - RNA, 64 nt, Human Herpes Virus 1
cagcgugcgauacuucgcgcccgggcgcguccccggcccggaggaggcucucgucacgcaagac

SEQ ID NO: 536144 - RNA, 64 nt, Human Herpes Virus 1
ccuggcccagcugguugaugacuuuacccugaccggcccggagcugggcgggcaggcgcaagcc

SEQ ID NO: 536145 - RNA, 64 nt, Human Herpes Virus 1
gcgcgcgggcgcucuccguguuggaccaugcgcuggcccggaccgcggggggcgacgggcagcc

SEQ ID NO: 536146 - RNA, 64 nt, Human Herpes Virus 1
cauucgccccccgcuuccgaggagggcucguuggggcccggaagccgucacggccauguacguc

SEQ ID NO: 536147 - RNA, 64 nt, Human Herpes Virus 1
cgcucgucgcuguccuuucucucaucgagaacggggcccggacgucgcgacguccuguccgcgg

SEQ ID NO: 536148 - RNA, 64 nt, Human Herpes Virus 1
ccccccuguuccccacgaugaccgcccccagcugggcccggauggaguugagcaucaaggcuug

SEQ ID NO: 536149 - RNA, 64 nt, Human Herpes Virus 1
gcccaagguggagguucuggagggacgcgugccgggcccggagcuccgggcggcauucccguug

SEQ ID NO: 536150 - RNA, 64 nt, Human Herpes Virus 1; identical to SEQ ID NO: 536141

SEQ ID NO: 536151 - RNA, 64 nt, Human Herpes Virus 4 (Epstein Barr virus)
cagcuucuacagcguacccgggggcucacuggcaucuagccagcaaauucugugccgggcgcug

SEQ ID NO: 536152 - RNA, 64 nt, Human Herpes Virus 4 (Epstein Barr virus)
ccgaccgcacuugcaugcggccggugguccugcggggggugacggucaggcagcuccuguauuu

SEQ ID NO: 536153 - RNA, 64 nt, Human Herpes Virus 4 (Epstein Barr virus)
uguacuauugucgcauugagaaggccgccgaucugggggugauggaguguaaggccagcgcggc

SEQ ID NO: 536154 - RNA, 64 nt, Human Herpes Virus 4 (Epstein Barr virus)
agaaggcuccggcggcaguggaccucaaagaagagggggugauaaccauggacgaggacgggga

SEQ ID NO: 536155 - RNA, 64 nt, Human Herpes Virus 4 (Epstein Barr virus)
ggccgcggauggggcugggggcgauggacugcuggggggugaggaagucggagugguaagcucc

SEQ ID NO: 536156 - RNA, 64 nt, Human Herpes Virus 4 (Epstein Barr virus)
ccugugcuucuaccaagacucccugacggugguggggggugacgaggauggaaagggcaugugg

SEQ ID NO: 536157 - RNA, 64 nt, Human Herpes Virus 4 (Epstein Barr virus)
gggugcaguaacagguaaucucugguagugauuuggacccgaaaucugacacuuuagagcucug

SEQ ID NO: 536158 - RNA, 64 nt, Human Herpes Virus 4 (Epstein Barr virus); identical to SEQ ID NO: 536157

SEQ ID NO: 536159 - RNA, 64 nt, Human Herpes Virus 4 (Epstein Barr virus)
cucccgccucuuggaugccaucauccccugcuugggacccgaccgcacuugcaugcggccggug

SEQ ID NO: 536160 - RNA, 64 nt, Human Herpes Virus 4 (Epstein Barr virus)
ggcggcacccucgccggcgcgccuguccucccagggacccgagacgaaggcccgucuguagagg

SEQ ID NO: 536161 - RNA, 64 nt, Human Herpes Virus 2
cuccgcggaccacuucgaggcggaggugguggagcgcgccgacguguacuauuacgaaacgcgc

SEQ ID NO: 536162 - RNA, 64 nt, Human Herpes Virus 2
ccgcucgccuucuccgccgcggacccccuccaugcgcgccgauuauggcgaggagaacgacgac

SEQ ID NO: 536163 - RNA, 64 nt, Human Herpes Virus 2
cgaccugcgcuuugccgacaucgacacggucauccgcgccgacgccaacgccgccauguucgcg

SEQ ID NO: 536164 - RNA, 64 nt, Human Herpes Virus 2
cuucgaggaguacgcguacucucaccagcugagucgcgccgacgucaccaccgucagcaccuuc

SEQ ID NO: 536165 - RNA, 64 nt, Human Herpes Virus 2
caugaccaaguggcaggagguggacgagaugcuccgcgccgaguacggcggcuccuuccgcuuc

SEQ ID NO: 536166 - RNA, 64 nt, Human Herpes Virus 2
ggaagucgaccccuggguccuguuuggccacccccgcgccgaccaucgcgacgagcugcagcuu

SEQ ID NO: 536167 - RNA, 64 nt, Human Herpes Virus 2
agcuggcgcgcagcauccacgggacuuccgcaagcgcgccgagccgcagcucggggcuggccga

SEQ ID NO: 536168 - RNA, 64 nt, Human Herpes Virus 2
augcccccgaggaccuggcgaccgcgucgagaaccgcgccgagugccgcgacccaggggcucau

SEQ ID NO: 536169 - RNA, 64 nt, Human Herpes Virus 2
cggccuuugaccaacacacggcgccacgcgacgccgcgccgacgcucccccccccgcccccccu

SEQ ID NO: 536170 - RNA, 64 nt, Human Herpes Virus 2
ggcggcccggggggugcugcaggagcucgccgagcgcgccgacccccugguccgccagcuggag

SEQ ID NO: 536171 - RNA, 64 nt, Human Herpes Virus 2
gcuccucagcgcggccgugggcguccugcggcagcgcgccgacgaccugcagccggcguuucug

SEQ ID NO: 536172 - RNA, 64 nt, Human Herpes Virus 2
cgccuccacccggucccaugccccguccgcgcaucgcgccgacucgcccguggaggacgagccc

SEQ ID NO: 536173 - RNA, 64 nt, Human Herpes Virus 2
cgccgccuggcgggccgcucggcgcgccaggcgccgcgccgaacgacgggcgcggcgccggagc

SEQ ID NO: 536174 - RNA, 64 nt, Human Herpes Virus 2; identical to SEQ ID NO: 536162

SEQ ID NO: 536175 - RNA, 63 nt, Human Herpes Virus 2
acguggcaggccgaaaacgcccugcacacgaccaaaacggaccccgcgugccuggccgcgcgg

SEQ ID NO: 536176 - RNA, 64 nt, Human Herpes Virus 4 (Epstein Barr virus)
cggaggacgcguggcacagcagcccgggguagguccccuggaccugccgcuggcggacuacgcc

SEQ ID NO: 536177 - RNA, 64 nt, Human Herpes Virus 4 (Epstein Barr virus)
uuccccccgccuuugggcaccccacggggugcucccccuggacacuuauguuucaagcagcuca

SEQ ID NO: 536178 - RNA, 64 nt, Human Herpes Virus 4 (Epstein Barr virus)
ugccagacgccuuggccucuaaggcccucgggucccccuggaccccggccucagcaacccugcu

SEQ ID NO: 536179 - RNA, 64 nt, Human Herpes Virus 4 (Epstein Barr virus); identical to SEQ ID NO: 536178

SEQ ID NO: 536180 - RNA, 64 nt, Human Herpes Virus 4 (Epstein Barr virus); identical to SEQ ID NO: 536178

SEQ ID NO: 536181 - RNA, 64 nt, Human Herpes Virus 4 (Epstein Barr virus)
cuuacaccauugagucgucuccccuuuggaauggccccuggacccggcccacaaccuggcccgc

SEQ ID NO: 536182 - RNA, 64 nt, Human Herpes Virus 4 (Epstein Barr virus)
cccccgugaacggggcgcgcugggccgcggcugcccccuggaccccuaggccugugccaugggg

SEQ ID NO: 536183 - RNA, 64 nt, Human Herpes Virus 4 (Epstein Barr virus)
cucuuccuccucagcagcaggcgguauccccuggccccuggagcccuccuccugcucagcagcu

SEQ ID NO: 536184 - RNA, 64 nt, Human Herpes Virus 4 (Epstein Barr virus)
ugcggcugggcuaaugauguccgccaagaacaagccccuggacgaagcccugcucacgaaugcc

SEQ ID NO: 536185 - RNA, 64 nt, Human Herpes Virus 4 (Epstein Barr virus)
gcugguuaccgagucuggugccaggucagucgcgccccuggauuguuggauuuugcaugaucgc

SEQ ID NO: 536186 - RNA, 64 nt, Human Herpes Virus 4 (Epstein Barr virus)
ccccgaugcggaggacugcauccaacgcuuccacccccuggagccagcgcugggggugucaaca

SEQ ID NO: 536187 - RNA, 64 nt, Human Herpes Virus 2
cgccacgcugcgcgcgcaccugcgggaaaucaaggucgagaacgccgaugcccaguuuuacgug

SEQ ID NO: 536188 - RNA, 64 nt, Human Herpes Virus 2
cgcccagccccccaacaccgcgcuguacuacagcgucgagaacguggggcuccugccgcaccuc

SEQ ID NO: 536189 - RNA, 64 nt, Human Herpes Virus 2
ggacguccgcauggagcugugcuuccugcaugaugucgagaauuuucucaagcagcugaacuac

SEQ ID NO: 536190 - RNA, 64 nt, Human Herpes Virus 2
agccccuagaugcccccgagcggcgcuggaccgcgucgagaacccugaccgacgccgcgaccca

SEQ ID NO: 536191 - RNA, 64 nt, Human Herpes Virus 1
guuugucggacccccgccggcgugcccccagaaccaaucgcaacccugggggaccccgccccgg

SEQ ID NO: 536192 - RNA, 64 nt, Human Herpes Virus 4 (Epstein Barr virus)
ugucaugcaggcucccgggaacgcagacaugcucgauguacacaugcaucuuggcucuguuuca

SEQ ID NO: 536193 - RNA, 64 nt, Human Herpes Virus 4 (Epstein Barr virus)
gcaaccacgcgguggccguggaaagccugcaaaagauguacaaugacacucaguccccauaccc

SEQ ID NO: 536194 - RNA, 64 nt, Human Herpes Virus 4 (Epstein Barr virus)
gccaccccccacccggagcggggcagcggcccagcggacccaccggcggccgcccggcugcccc

SEQ ID NO: 536195 - RNA, 64 nt, Human Herpes Virus 4 (Epstein Barr virus); identical to SEQ ID NO: 536194

SEQ ID NO: 536196 - RNA, 64 nt, Human Herpes Virus 4 (Epstein Barr virus); identical to SEQ ID NO: 536194

SEQ ID NO: 536197 - RNA, 64 nt, Human Herpes Virus 4 (Epstein Barr virus); identical to SEQ ID NO: 536194

SEQ ID NO: 536198 - RNA, 64 nt, Human Herpes Virus 4 (Epstein Barr virus); identical to SEQ ID NO: 536194

SEQ ID NO: 536199 - RNA, 64 nt, Human Herpes Virus 4 (Epstein Barr virus); identical to SEQ ID NO: 536194

SEQ ID NO: 536200 - RNA, 64 nt, Human Herpes Virus 4 (Epstein Barr virus); identical to SEQ ID NO: 536194

SEQ ID NO: 536201 - RNA, 64 nt, Human Herpes Virus 4 (Epstein Barr virus); identical to SEQ ID NO: 536194

SEQ ID NO: 536202 - RNA, 64 nt, Human Herpes Virus 4 (Epstein Barr virus); identical to SEQ ID NO: 536194

SEQ ID NO: 536203 - RNA, 64 nt, Human Herpes Virus 4 (Epstein Barr virus); identical to SEQ ID NO: 536194

SEQ ID NO: 536204 - RNA, 64 nt, Human Herpes Virus 4 (Epstein Barr virus); identical to SEQ ID NO: 536194

SEQ ID NO: 536205 - RNA, 64 nt, Human Herpes Virus 4 (Epstein Barr virus); identical to SEQ ID NO: 536194

SEQ ID NO: 536206 - RNA, 64 nt, Human Herpes Virus 4 (Epstein Barr virus)
uccgaccggacugucuggggagagggugccgugccggacccaggcugccgugacaucuaauacu

SEQ ID NO: 536207 - RNA, 64 nt, Human Herpes Virus 4 (Epstein Barr virus)
cugcagccggccaccccccgccggagcggggcagcggacccagcggacccggugggccacccgg

SEQ ID NO: 536208 - RNA, 64 nt, Human Herpes Virus 4 (Epstein Barr virus); identical to SEQ ID NO: 536207

SEQ ID NO: 536209 - RNA, 64 nt, Human Herpes Virus 4 (Epstein Barr virus); identical to SEQ ID NO: 536207

SEQ ID NO: 536210 - RNA, 64 nt, Human Herpes Virus 4 (Epstein Barr virus); identical to SEQ ID NO: 536207

SEQ ID NO: 536211 - RNA, 64 nt, Human Herpes Virus 4 (Epstein Barr virus); identical to SEQ ID NO: 536207

SEQ ID NO: 536212 - RNA, 64 nt, Human Herpes Virus 4 (Epstein Barr virus); identical to SEQ ID NO: 536207

SEQ ID NO: 536213 - RNA, 64 nt, Human Herpes Virus 4 (Epstein Barr virus); identical to SEQ ID NO: 536207

SEQ ID NO: 536214 - RNA, 64 nt, Human Herpes Virus 4 (Epstein Barr virus); identical to SEQ ID NO: 536207

SEQ ID NO: 536215 - RNA, 64 nt, Human Herpes Virus 4 (Epstein Barr virus); identical to SEQ ID NO: 536207

SEQ ID NO: 536216 - RNA, 64 nt, Human Herpes Virus 4 (Epstein Barr virus); identical to SEQ ID NO: 536207

SEQ ID NO: 536217 - RNA, 64 nt, Human Herpes Virus 4 (Epstein Barr virus); identical to SEQ ID NO: 536207

SEQ ID NO: 536218 - RNA, 64 nt, Human Herpes Virus 4 (Epstein Barr virus); identical to SEQ ID NO: 536207

SEQ ID NO: 536219 - RNA, 64 nt, Human Herpes Virus 4 (Epstein Barr virus); identical to SEQ ID NO: 536207

SEQ ID NO: 536220 - RNA, 64 nt, Human Herpes Virus 4 (Epstein Barr virus); identical to SEQ ID NO: 536207

SEQ ID NO: 536221 - RNA, 64 nt, Human Herpes Virus 4 (Epstein Barr virus); identical to SEQ ID NO: 536207

SEQ ID NO: 536222 - RNA, 64 nt, Human Herpes Virus 4 (Epstein Barr virus); identical to SEQ ID NO: 536207

SEQ ID NO: 536223 - RNA, 64 nt, Human Herpes Virus 4 (Epstein Barr virus); identical to SEQ ID NO: 536207

SEQ ID NO: 536224 - RNA, 64 nt, Human Herpes Virus 4 (Epstein Barr virus); identical to SEQ ID NO: 536207

SEQ ID NO: 536225 - RNA, 64 nt, Human Herpes Virus 4 (Epstein Barr virus); identical to SEQ ID NO: 536207

SEQ ID NO: 536226 - RNA, 64 nt, Human Herpes Virus 4 (Epstein Barr virus); identical to SEQ ID NO: 536207

SEQ ID NO: 536227 - RNA, 64 nt, Human Herpes Virus 4 (Epstein Barr virus); identical to SEQ ID NO: 536207

SEQ ID NO: 536228 - RNA, 64 nt, Human Herpes Virus 4 (Epstein Barr virus); identical to SEQ ID NO: 536207

SEQ ID NO: 536229 - RNA, 64 nt, Human Herpes Virus 4 (Epstein Barr virus); identical to SEQ ID NO: 536207

SEQ ID NO: 536230 - RNA, 64 nt, Human Herpes Virus 4 (Epstein Barr virus); identical to SEQ ID NO: 536207

SEQ ID NO: 536231 - RNA, 64 nt, Human Herpes Virus 4 (Epstein Barr virus)
ggagcgcacccccauccccgccggagcggggcagcggacccagcggacccggugggccacccgg

SEQ ID NO: 536232 - RNA, 64 nt, Human Herpes Virus 4 (Epstein Barr virus)
ugccacccccacccuaggguugaccgugaagcgccggacccaagccgcgaccacauaugagauu

SEQ ID NO: 536233 - RNA, 64 nt, Human Herpes Virus 4 (Epstein Barr virus); identical to SEQ ID NO: 536194

SEQ ID NO: 536234 - RNA, 64 nt, Human Herpes Virus 4 (Epstein Barr virus); identical to SEQ ID NO: 536194

SEQ ID NO: 536235 - RNA, 64 nt, Human Herpes Virus 4 (Epstein Barr virus); identical to SEQ ID NO: 536194

SEQ ID NO: 536236 - RNA, 64 nt, Human Herpes Virus 4 (Epstein Barr virus); identical to SEQ ID NO: 536194

SEQ ID NO: 536237 - RNA, 64 nt, Human Herpes Virus 4 (Epstein Barr virus); identical to SEQ ID NO: 536194

SEQ ID NO: 536238 - RNA, 64 nt, Human Herpes Virus 4 (Epstein Barr virus); identical to SEQ ID NO: 536194

SEQ ID NO: 536239 - RNA, 64 nt, Human Herpes Virus 4 (Epstein Barr virus); identical to SEQ ID NO: 536194

SEQ ID NO: 536240 - RNA, 64 nt, Human Herpes Virus 4 (Epstein Barr virus); identical to SEQ ID NO: 536194

SEQ ID NO: 536241 - RNA, 64 nt, Human Herpes Virus 4 (Epstein Barr virus); identical to SEQ ID NO: 536194

SEQ ID NO: 536242 - RNA, 64 nt, Human Herpes Virus 4 (Epstein Barr virus); identical to SEQ ID NO: 536194

SEQ ID NO: 536243 - RNA, 64 nt, Human Herpes Virus 4 (Epstein Barr virus); identical to SEQ ID NO: 536194

SEQ ID NO: 536244 - RNA, 64 nt, Human Herpes Virus 4 (Epstein Barr virus); identical to SEQ ID NO: 536194

SEQ ID NO: 536245 - RNA, 64 nt, Human Herpes Virus 4 (Epstein Barr virus); identical to SEQ ID NO: 536206

SEQ ID NO: 536246 - RNA, 64 nt, Human Herpes Virus 4 (Epstein Barr virus); identical to SEQ ID NO: 536207

SEQ ID NO: 536247 - RNA, 64 nt, Human Herpes Virus 4 (Epstein Barr virus); identical to SEQ ID NO: 536207

SEQ ID NO: 536248 - RNA, 64 nt, Human Herpes Virus 4 (Epstein Barr virus); identical to SEQ ID NO: 536207

SEQ ID NO: 536249 - RNA, 64 nt, Human Herpes Virus 4 (Epstein Barr virus); identical to SEQ ID NO: 536207

SEQ ID NO: 536250 - RNA, 64 nt, Human Herpes Virus 4 (Epstein Barr virus); identical to SEQ ID NO: 536207

SEQ ID NO: 536251 - RNA, 64 nt, Human Herpes Virus 4 (Epstein Barr virus); identical to SEQ ID NO: 536207

SEQ ID NO: 536252 - RNA, 64 nt, Human Herpes Virus 4 (Epstein Barr virus); identical to SEQ ID NO: 536207

SEQ ID NO: 536253 - RNA, 64 nt, Human Herpes Virus 4 (Epstein Barr virus); identical to SEQ ID NO: 536207

SEQ ID NO: 536254 - RNA, 64 nt, Human Herpes Virus 4 (Epstein Barr virus); identical to SEQ ID NO: 536207

SEQ ID NO: 536255 - RNA, 64 nt, Human Herpes Virus 4 (Epstein Barr virus); identical to SEQ ID NO: 536207

SEQ ID NO: 536256 - RNA, 64 nt, Human Herpes Virus 4 (Epstein Barr virus); identical to SEQ ID NO: 536207

SEQ ID NO: 536257 - RNA, 64 nt, Human Herpes Virus 4 (Epstein Barr virus); identical to SEQ ID NO: 536207

SEQ ID NO: 536258 - RNA, 64 nt, Human Herpes Virus 4 (Epstein Barr virus); identical to SEQ ID NO: 536207

SEQ ID NO: 536259 - RNA, 64 nt, Human Herpes Virus 4 (Epstein Barr virus); identical to SEQ ID NO: 536207

SEQ ID NO: 536260 - RNA, 64 nt, Human Herpes Virus 4 (Epstein Barr virus); identical to SEQ ID NO: 536207

SEQ ID NO: 536261 - RNA, 64 nt, Human Herpes Virus 4 (Epstein Barr virus); identical to SEQ ID NO: 536207

SEQ ID NO: 536262 - RNA, 64 nt, Human Herpes Virus 4 (Epstein Barr virus); identical to SEQ ID NO: 536207

SEQ ID NO: 536263 - RNA, 64 nt, Human Herpes Virus 4 (Epstein Barr virus); identical to SEQ ID NO: 536207

SEQ ID NO: 536264 - RNA, 64 nt, Human Herpes Virus 4 (Epstein Barr virus); identical to SEQ ID NO: 536207

SEQ ID NO: 536265 - RNA, 64 nt, Human Herpes Virus 4 (Epstein Barr virus); identical to SEQ ID NO: 536207

SEQ ID NO: 536266 - RNA, 64 nt, Human Herpes Virus 4 (Epstein Barr virus); identical to SEQ ID NO: 536207

SEQ ID NO: 536267 - RNA, 64 nt, Human Herpes Virus 4 (Epstein Barr virus); identical to SEQ ID NO: 536207

SEQ ID NO: 536268 - RNA, 64 nt, Human Herpes Virus 4 (Epstein Barr virus); identical to SEQ ID NO: 536207

SEQ ID NO: 536269 - RNA, 64 nt, Human Herpes Virus 4 (Epstein Barr virus); identical to SEQ ID NO: 536207

SEQ ID NO: 536270 - RNA, 64 nt, Human Herpes Virus 4 (Epstein Barr virus); identical to SEQ ID NO: 536231

SEQ ID NO: 536271 - RNA, 64 nt, Human Herpes Virus 4 (Epstein Barr virus); identical to SEQ ID NO: 536232

SEQ ID NO: 536272 - RNA, 64 nt, Human Herpes Virus 4 (Epstein Barr virus); identical to SEQ ID NO: 536194

SEQ ID NO: 536273 - RNA, 64 nt, Human Herpes Virus 4 (Epstein Barr virus); identical to SEQ ID NO: 536194

SEQ ID NO: 536274 - RNA, 64 nt, Human Herpes Virus 4 (Epstein Barr virus); identical to SEQ ID NO: 536194

SEQ ID NO: 536275 - RNA, 64 nt, Human Herpes Virus 4 (Epstein Barr virus); identical to SEQ ID NO: 536194

SEQ ID NO: 536276 - RNA, 64 nt, Human Herpes Virus 4 (Epstein Barr virus); identical to SEQ ID NO: 536194

SEQ ID NO: 536277 - RNA, 64 nt, Human Herpes Virus 4 (Epstein Barr virus); identical to SEQ ID NO: 536194

SEQ ID NO: 536278 - RNA, 64 nt, Human Herpes Virus 4 (Epstein Barr virus); identical to SEQ ID NO: 536194

SEQ ID NO: 536279 - RNA, 64 nt, Human Herpes Virus 4 (Epstein Barr virus); identical to SEQ ID NO: 536194

SEQ ID NO: 536280 - RNA, 64 nt, Human Herpes Virus 4 (Epstein Barr virus); identical to SEQ ID NO: 536194

SEQ ID NO: 536281 - RNA, 64 nt, Human Herpes Virus 4 (Epstein Barr virus); identical to SEQ ID NO: 536194

SEQ ID NO: 536282 - RNA, 64 nt, Human Herpes Virus 4 (Epstein Barr virus); identical to SEQ ID NO: 536194

SEQ ID NO: 536283 - RNA, 64 nt, Human Herpes Virus 4 (Epstein Barr virus); identical to SEQ ID NO: 536194

SEQ ID NO: 536284 - RNA, 64 nt, Human Herpes Virus 4 (Epstein Barr virus); identical to SEQ ID NO: 536206

SEQ ID NO: 536285 - RNA, 64 nt, Human Herpes Virus 4 (Epstein Barr virus); identical to SEQ ID NO: 536207

SEQ ID NO: 536286 - RNA, 64 nt, Human Herpes Virus 4 (Epstein Barr virus); identical to SEQ ID NO: 536207

SEQ ID NO: 536287 - RNA, 64 nt, Human Herpes Virus 4 (Epstein Barr virus); identical to SEQ ID NO: 536207

SEQ ID NO: 536288 - RNA, 64 nt, Human Herpes Virus 4 (Epstein Barr virus); identical to SEQ ID NO: 536207

SEQ ID NO: 536289 - RNA, 64 nt, Human Herpes Virus 4 (Epstein Barr virus); identical to SEQ ID NO: 536207

SEQ ID NO: 536290 - RNA, 64 nt, Human Herpes Virus 4 (Epstein Barr virus); identical to SEQ ID NO: 536207

SEQ ID NO: 536291 - RNA, 64 nt, Human Herpes Virus 4 (Epstein Barr virus); identical to SEQ ID NO: 536207

SEQ ID NO: 536292 - RNA, 64 nt, Human Herpes Virus 4 (Epstein Barr virus); identical to SEQ ID NO: 536207

SEQ ID NO: 536293 - RNA, 64 nt, Human Herpes Virus 4 (Epstein Barr virus); identical to SEQ ID NO: 536207

SEQ ID NO: 536294 - RNA, 64 nt, Human Herpes Virus 4 (Epstein Barr virus); identical to SEQ ID NO: 536207

SEQ ID NO: 536295 - RNA, 64 nt, Human Herpes Virus 4 (Epstein Barr virus); identical to SEQ ID NO: 536207

SEQ ID NO: 536296 - RNA, 64 nt, Human Herpes Virus 4 (Epstein Barr virus); identical to SEQ ID NO: 536207

SEQ ID NO: 536297 - RNA, 64 nt, Human Herpes Virus 4 (Epstein Barr virus); identical to SEQ ID NO: 536207

SEQ ID NO: 536298 - RNA, 64 nt, Human Herpes Virus 4 (Epstein Barr virus); identical to SEQ ID NO: 536207

SEQ ID NO: 536299 - RNA, 64 nt, Human Herpes Virus 4 (Epstein Barr virus); identical to SEQ ID NO: 536207

SEQ ID NO: 536300 - RNA, 64 nt, Human Herpes Virus 4 (Epstein Barr virus); identical to SEQ ID NO: 536207

SEQ ID NO: 536301 - RNA, 64 nt, Human Herpes Virus 4 (Epstein Barr virus); identical to SEQ ID NO: 536207

SEQ ID NO: 536302 - RNA, 64 nt, Human Herpes Virus 4 (Epstein Barr virus); identical to SEQ ID NO: 536207

SEQ ID NO: 536303 - RNA, 64 nt, Human Herpes Virus 4 (Epstein Barr virus); identical to SEQ ID NO: 536207

SEQ ID NO: 536304 - RNA, 64 nt, Human Herpes Virus 4 (Epstein Barr virus); identical to SEQ ID NO: 536207

SEQ ID NO: 536305 - RNA, 64 nt, Human Herpes Virus 4 (Epstein Barr virus); identical to SEQ ID NO: 536207

SEQ ID NO: 536306 - RNA, 64 nt, Human Herpes Virus 4 (Epstein Barr virus); identical to SEQ ID NO: 536207

SEQ ID NO: 536307 - RNA, 64 nt, Human Herpes Virus 4 (Epstein Barr virus); identical to SEQ ID NO: 536207

SEQ ID NO: 536308 - RNA, 64 nt, Human Herpes Virus 4 (Epstein Barr virus); identical to SEQ ID NO: 536207

SEQ ID NO: 536309 - RNA, 64 nt, Human Herpes Virus 4 (Epstein Barr virus); identical to SEQ ID NO: 536231

SEQ ID NO: 536310 - RNA, 64 nt, Human Herpes Virus 4 (Epstein Barr virus); identical to SEQ ID NO: 536232

SEQ ID NO: 536311 - RNA, 64 nt, Human Herpes Virus 4 (Epstein Barr virus); identical to SEQ ID NO: 536194

SEQ ID NO: 536312 - RNA, 64 nt, Human Herpes Virus 4 (Epstein Barr virus); identical to SEQ ID NO: 536194

SEQ ID NO: 536313 - RNA, 64 nt, Human Herpes Virus 4 (Epstein Barr virus); identical to SEQ ID NO: 536194

SEQ ID NO: 536314 - RNA, 64 nt, Human Herpes Virus 4 (Epstein Barr virus); identical to SEQ ID NO: 536194

SEQ ID NO: 536315 - RNA, 64 nt, Human Herpes Virus 4 (Epstein Barr virus); identical to SEQ ID NO: 536194

SEQ ID NO: 536316 - RNA, 64 nt, Human Herpes Virus 4 (Epstein Barr virus); identical to SEQ ID NO: 536194

SEQ ID NO: 536317 - RNA, 64 nt, Human Herpes Virus 4 (Epstein Barr virus); identical to SEQ ID NO: 536194

SEQ ID NO: 536318 - RNA, 64 nt, Human Herpes Virus 4 (Epstein Barr virus); identical to SEQ ID NO: 536194

SEQ ID NO: 536319 - RNA, 64 nt, Human Herpes Virus 4 (Epstein Barr virus); identical to SEQ ID NO: 536194

SEQ ID NO: 536320 - RNA, 64 nt, Human Herpes Virus 4 (Epstein Barr virus); identical to SEQ ID NO: 536194

SEQ ID NO: 536321 - RNA, 64 nt, Human Herpes Virus 4 (Epstein Barr virus); identical to SEQ ID NO: 536194

SEQ ID NO: 536322 - RNA, 64 nt, Human Herpes Virus 4 (Epstein Barr virus); identical to SEQ ID NO: 536194

SEQ ID NO: 536323 - RNA, 64 nt, Human Herpes Virus 4 (Epstein Barr virus); identical to SEQ ID NO: 536206

SEQ ID NO: 536324 - RNA, 64 nt, Human Herpes Virus 4 (Epstein Barr virus); identical to SEQ ID NO: 536207

SEQ ID NO: 536325 - RNA, 64 nt, Human Herpes Virus 4 (Epstein Barr virus); identical to SEQ ID NO: 536207

SEQ ID NO: 536326 - RNA, 64 nt, Human Herpes Virus 4 (Epstein Barr virus); identical to SEQ ID NO: 536207

SEQ ID NO: 536327 - RNA, 64 nt, Human Herpes Virus 4 (Epstein Barr virus); identical to SEQ ID NO: 536207

SEQ ID NO: 536328 - RNA, 64 nt, Human Herpes Virus 4 (Epstein Barr virus); identical to SEQ ID NO: 536207

SEQ ID NO: 536329 - RNA, 64 nt, Human Herpes Virus 4 (Epstein Barr virus); identical to SEQ ID NO: 536207

SEQ ID NO: 536330 - RNA, 64 nt, Human Herpes Virus 4 (Epstein Barr virus); identical to SEQ ID NO: 536207

SEQ ID NO: 536331 - RNA, 64 nt, Human Herpes Virus 4 (Epstein Barr virus); identical to SEQ ID NO: 536207

SEQ ID NO: 536332 - RNA, 64 nt, Human Herpes Virus 4 (Epstein Barr virus); identical to SEQ ID NO: 536207

SEQ ID NO: 536333 - RNA, 64 nt, Human Herpes Virus 4 (Epstein Barr virus); identical to SEQ ID NO: 536207

SEQ ID NO: 536334 - RNA, 64 nt, Human Herpes Virus 4 (Epstein Barr virus); identical to SEQ ID NO: 536207

SEQ ID NO: 536335 - RNA, 64 nt, Human Herpes Virus 4 (Epstein Barr virus); identical to SEQ ID NO: 536207

SEQ ID NO: 536336 - RNA, 64 nt, Human Herpes Virus 4 (Epstein Barr virus); identical to SEQ ID NO: 536207

SEQ ID NO: 536337 - RNA, 64 nt, Human Herpes Virus 4 (Epstein Barr virus); identical to SEQ ID NO: 536207

SEQ ID NO: 536338 - RNA, 64 nt, Human Herpes Virus 4 (Epstein Barr virus); identical to SEQ ID NO: 536207

SEQ ID NO: 536339 - RNA, 64 nt, Human Herpes Virus 4 (Epstein Barr virus); identical to SEQ ID NO: 536207

SEQ ID NO: 536340 - RNA, 64 nt, Human Herpes Virus 4 (Epstein Barr virus); identical to SEQ ID NO: 536207

SEQ ID NO: 536341 - RNA, 64 nt, Human Herpes Virus 4 (Epstein Barr virus); identical to SEQ ID NO: 536207

SEQ ID NO: 536342 - RNA, 64 nt, Human Herpes Virus 4 (Epstein Barr virus); identical to SEQ ID NO: 536207

SEQ ID NO: 536343 - RNA, 64 nt, Human Herpes Virus 4 (Epstein Barr virus); identical to SEQ ID NO: 536207

SEQ ID NO: 536344 - RNA, 64 nt, Human Herpes Virus 4 (Epstein Barr virus); identical to SEQ ID NO: 536207

SEQ ID NO: 536345 - RNA, 64 nt, Human Herpes Virus 4 (Epstein Barr virus); identical to SEQ ID NO: 536207

SEQ ID NO: 536346 - RNA, 64 nt, Human Herpes Virus 4 (Epstein Barr virus); identical to SEQ ID NO: 536207

SEQ ID NO: 536347 - RNA, 64 nt, Human Herpes Virus 4 (Epstein Barr virus); identical to SEQ ID NO: 536207

SEQ ID NO: 536348 - RNA, 64 nt, Human Herpes Virus 4 (Epstein Barr virus); identical to SEQ ID NO: 536231

SEQ ID NO: 536349 - RNA, 64 nt, Human Herpes Virus 4 (Epstein Barr virus); identical to SEQ ID NO: 536232

SEQ ID NO: 536350 - RNA, 64 nt, Human Herpes Virus 1
gugcuuacguucgugucggucaaggaguuugacgaauaccgacggcugacacaccagcccggcc

SEQ ID NO: 536351 - RNA, 64 nt, Human Herpes Virus 2
gggcggcguggugggucuggugugugcagguggcgacguucaucgucucggccaucugcgucgu

SEQ ID NO: 536352 - RNA, 64 nt, Human Herpes Virus 2
auuacuucucgcaccugcugggggcggccugcgugacguucaaggcccuguuuggaaauaacgc

SEQ ID NO: 536353 - RNA, 64 nt, Human Herpes Virus 2
cggcccugugcgcccugguggcggccgcccaugagacguucagucccgacgggcuuuuccauug

SEQ ID NO: 536354 - RNA, 64 nt, Human Herpes Virus 4 (Epstein Barr virus)
ggucauuggaugucugccacgggcaacccccugccugcagcaccggaaacccugcgagacuacu

SEQ ID NO: 536355 - RNA, 64 nt, Human Herpes Virus 4 (Epstein Barr virus)
cgggaguggaggcucggcccauccccuuccccgacugcagcagcgcaaccaggcccacugcaag

SEQ ID NO: 536356 - RNA, 64 nt, Human Herpes Virus 4 (Epstein Barr virus)
uuccagaaaaugccgggccaaguuuaagcaacugcugcagcacuaccgugaggucaguauauac

SEQ ID NO: 536357 - RNA, 64 nt, Human Herpes Virus 4 (Epstein Barr virus)
uguaugagacgauagaggacaagucccugaaccucugcagcauccgugacuauggcauuagcuc

SEQ ID NO: 536358 - RNA, 64 nt, Human Herpes Virus 1
gccuucgagggucucguucagcgaauucggcuuaucgucccaucuacguugcggggcggggacg

SEQ ID NO: 536359 - RNA, 64 nt, Human Herpes Virus 1
guaacguaaccgacggacuucugcucucggaggaagccgucaagcgcgucgccgacgcccuaag

SEQ ID NO: 536360 - RNA, 64 nt, Human Herpes Virus 4 (Epstein Barr virus)
cgcuuacagcucgacagcgagagguaaugauuacgcaggccacgggccguuuggcgucucaggc

SEQ ID NO: 536361 - RNA, 64 nt, Human Herpes Virus 4 (Epstein Barr virus)
caaacgaggagauugaucuggccuaugcccgcgggcaggccaugaauauugaggcuccuagacu

SEQ ID NO: 536362 - RNA, 64 nt, Human Herpes Virus 4 (Epstein Barr virus)
auguuaauggagcuccaggacucugccacggccagcaggccaccugugagauuaucguaacacc

SEQ ID NO: 536363 - RNA, 64 nt, Human Herpes Virus 4 (Epstein Barr virus)
cacugucacuggccucccuccacccagacauaccccaaaccaccgcagauggaggcaagcuguc

SEQ ID NO: 536364 - RNA, 64 nt, Human Herpes Virus 4 (Epstein Barr virus)
gggcggguggcagccgcggccaucaccuggguacccaaaccaaauguagaggucuggccggugg

SEQ ID NO: 536365 - RNA, 64 nt, Human Herpes Virus 4 (Epstein Barr virus)
uguaccucauagacacaccuaaauuuagcacgucccaaaccaugacaucacagaggaggcuggu

SEQ ID NO: 536366 - RNA, 64 nt, Human Herpes Virus 2
ccguucgcggcguaucucaucaccggcaacgccggauccggaaagaguacgugcgugcagaccc

SEQ ID NO: 536367 - RNA, 64 nt, Human Herpes Virus 2
uagccaucgccagggggccuccggagcccgcggggauccggagcugcccacgcugcugcggguu

SEQ ID NO: 536368 - RNA, 64 nt, Human Herpes Virus 2; identical to SEQ ID NO: 536366

SEQ ID NO: 536369 - RNA, 64 nt, Human Herpes Virus 2; identical to SEQ ID NO: 536367

SEQ ID NO: 536370 - RNA, 64 nt, Human Herpes Virus 4 (Epstein Barr virus)
ccucguguuucacggccucaguuaguaccguugugaccgccaccggcuuggcccucucacuucu

SEQ ID NO: 536371 - RNA, 64 nt, Human Herpes Virus 4 (Epstein Barr virus)
augcaauagcaucaucgcugggcugguacuaccagaccgccaccggccccggagcagaugccag

SEQ ID NO: 536372 - RNA, 64 nt, Human Herpes Virus 4 (Epstein Barr virus)
ccucuggagccugaccugugaucgucgcaucauagaccgccaguagaccugggagcagauucac

SEQ ID NO: 536373 - RNA, 64 nt, Human Herpes Virus 4 (Epstein Barr virus)
ucgaggcccugaugcucgucuacacgcucugcgagaccgccaaccuggccgaggcggccacccg

SEQ ID NO: 536374 - RNA, 64 nt, Human Herpes Virus 4 (Epstein Barr virus)
aaugucuuccuucccucguuucaaucaguggaaugaccgccaugcacaucaagaugucccccau

SEQ ID NO: 536375 - RNA, 64 nt, Human Herpes Virus 4 (Epstein Barr virus)
cugcauuccaagaggcccgggggcagcaguuugagaccgccacaucucuggcccacguggugga

SEQ ID NO: 536376 - RNA, 64 nt, Human Herpes Virus 4 (Epstein Barr virus)
gggagagcgugcucaagggggucaguaccuacacgaccgccaaggggggagagccagugggggg

SEQ ID NO: 536377 - RNA, 64 nt, Human Herpes Virus 4 (Epstein Barr virus)
cuguaagcgaaacucugcaaagaugcuggcucaucugaaucagguuaccaggaucccccccugu

SEQ ID NO: 536378 - RNA, 64 nt, Human Herpes Virus 4 (Epstein Barr virus)
cuccucgcaacuuaugauagcagaagacuccugccugaaucagaucgcccccuuuuccgcauca

SEQ ID NO: 536379 - RNA, 64 nt, Human Herpes Virus 4 (Epstein Barr virus)
ggaaggugccccuggugugggaaagacuacuaugcugaaucauuugaaggcugucuuuggggac

SEQ ID NO: 536380 - RNA, 63 nt, Human Herpes Virus 2
gccagcacgagcuuuuuguacaaccuccgcggggccgccgacgagcugcucaacguggucacc

SEQ ID NO: 536381 - RNA, 63 nt, Human Herpes Virus 2
gccgcggcggcccuggagaacgccgcccuccaggccgccgagcugcccgucgacaucgagcgc

SEQ ID NO: 536382 - RNA, 63 nt, Human Herpes Virus 2
gacccggcgacgcgcgagggggugcgacgcgaggccgccgaggccgagcucgcgcuggccggg

SEQ ID NO: 536383 - RNA, 63 nt, Human Herpes Virus 2
gaggcccagaucgccgcgcuggugggggccaucgccgccgaccgccaggcgggugggcuuccg

SEQ ID NO: 536384 - RNA, 63 nt, Human Herpes Virus 2
ccggagaccacgggauccgggggucggcgaagcgccgccgacacgagguggagcagccggagu

SEQ ID NO: 536385 - RNA, 63 nt, Human Herpes Virus 2
agcgcggcccacgugaacguggacacggcccgggccgccgaucuguuugugucacagaugaug

SEQ ID NO: 536386 - RNA, 63 nt, Human Herpes Virus 2
gacgccguucgcacgcggcggauccugugucgcgccgccgagcaggcccucgcccgucgccgc

SEQ ID NO: 536387 - RNA, 63 nt, Human Herpes Virus 2
gccgcgugcgccgccgccuacgaugcgcgcgacgccgccgaggcgguccgggcccacaucacg

SEQ ID NO: 536388 - RNA, 63 nt, Human Herpes Virus 2
gggguuccuccgcgccccccccgcguucgcccggccgccgacgcgugugugcgcguggcugag

SEQ ID NO: 536389 - RNA, 63 nt, Human Herpes Virus 2
gcuggguuuccgcuguauguggagcgccgcaucgccgccgacguacgcgagaccggcgcgcug

SEQ ID NO: 536390 - RNA, 63 nt, Human Herpes Virus 2
gcaauccgggaggucgaggcgcauuuugaacccgccgccgagcccgugugcgagcugcccugu

SEQ ID NO: 536391 - RNA, 63 nt, Human Herpes Virus 2
ccggaggagaacgaagacgaggccgacgacgccgccgccgaugccgaugccgacgaggcggcc

SEQ ID NO: 536392 - RNA, 63 nt, Human Herpes Virus 2
ggaggugguggggaccgccgcggggcuggccacgccgccgaggcgcgagcccguggacaugga

SEQ ID NO: 536393 - RNA, 63 nt, Human Herpes Virus 2
cgccgggacgccgccggcgcaucggcaaccagggccgccgacaccagcgaccgcucuccgggg

SEQ ID NO: 536394 - RNA, 63 nt, Human Herpes Virus 2
ggcuggcccacguuuaccgugccggccgccgccgccgccgagucggcgcgugaccuggugcgg

SEQ ID NO: 536395 - RNA, 63 nt, Human Herpes Virus 2
ugccaggaccccgacacgucccugucggcccaggccgccgagacggaggaggugggccuuuuc

SEQ ID NO: 536396 - RNA, 63 nt, Human Herpes Virus 2
cucuggcgccugacgcgccgcgcccccccguccgccgccgaagccgucgccccccgcccgcuu

SEQ ID NO: 536397 - RNA, 63 nt, Human Herpes Virus 2
acggcgccgucuccggagcccgccccgggucccgccgccgauccagcuuccgggagcggcuuc

SEQ ID NO: 536398 - RNA, 63 nt, Human Herpes Virus 2
gcugccucccccccggaggaaacccccgaccccgccgccgaacagcucgcggacgagcccgug

SEQ ID NO: 536399 - RNA, 63 nt, Human Herpes Virus 2
uccgagcuggccacggcccugacggaggccugugccgccgagcgcgucgugcgcccccaccag

SEQ ID NO: 536400 - RNA, 63 nt, Human Herpes Virus 2
cugcugcacaacacccaggcccgcgcggccgacgccgccgacgaccggccgcaccggccggcc

SEQ ID NO: 536401 - RNA, 63 nt, Human Herpes Virus 2
cgggaggggucgcacaccgagcacaccagcuacgccgccgaccgcuucaagcaggucgacggc

SEQ ID NO: 536402 - RNA, 63 nt, Human Herpes Virus 2
caauccggccccggcccuucacccggcccauuggccgccgaccuccguccccacgucccagua

SEQ ID NO: 536403 - RNA, 63 nt, Human Herpes Virus 2
uccgacggacguccucgaauucucgcggcgagcgccgccgacguacgugcugaccgucgugaa

SEQ ID NO: 536404 - RNA, 63 nt, Human Herpes Virus 2
cgggggcgggcugucccccgggcguuccacgccgccgccgaaagcgcugcggcaggcgagggc

SEQ ID NO: 536405 - RNA, 63 nt, Human Herpes Virus 2
cggcagggccccgugcccgcccuggggucggcggccgccgacccaggcgcggcuggaggacgu

SEQ ID NO: 536406 - RNA, 63 nt, Human Herpes Virus 2
augcccgcgggcgucgggcuuggcgccacccccgccgccgacaccaccgccgccgccgccugg

SEQ ID NO: 536407 - RNA, 63 nt, Human Herpes Virus 2
guucgucgcgcucgucgcgggcgugcccggggagccgccgaacgcggcaggcgcacgcggcgu

SEQ ID NO: 536408 - RNA, 63 nt, Human Herpes Virus 2; identical to SEQ ID NO: 536392

SEQ ID NO: 536409 - RNA, 63 nt, Human Herpes Virus 2; identical to SEQ ID NO: 536391

SEQ ID NO: 536410 - RNA, 64 nt, Human Herpes Virus 4 (Epstein Barr virus)
gucacaccccaccgugggaagcaaggagcacuuggucaggcacacggacagggucagcggagga

SEQ ID NO: 536411 - RNA, 64 nt, Human Herpes Virus 4 (Epstein Barr virus)
uugcaugcggccggugguccugcggggggugacggucaggcagcuccuguauuuaacuuugcgg

SEQ ID NO: 536412 - RNA, 64 nt, Human Herpes Virus 4 (Epstein Barr virus)
gcuugagggcaccacccaggacuuuuucucagacgucaggcaccugccagaccuccaggcugcc

SEQ ID NO: 536413 - RNA, 64 nt, Human Herpes Virus 4 (Epstein Barr virus)
uugugugcuuuaguaggucuauguauucagcgcagucaggcaggguaauggcauccgugaccuc

SEQ ID NO: 536414 - RNA, 64 nt, Human Herpes Virus 4 (Epstein Barr virus)
cccuggcucucgcuggagucaugccucacaagcauccugucacaccccaccgugggaagcaagg

SEQ ID NO: 536415 - RNA, 64 nt, Human Herpes Virus 4 (Epstein Barr virus)
ccauuaccaauuguuaagcagaggcguuggaagcuccugucaucuugcagauccuggcguaugg

SEQ ID NO: 536416 - RNA, 64 nt, Human Herpes Virus 4 (Epstein Barr virus)
ucccuaggauaauaccacacacuaagcaguguaguccugucaaucuccugaacauguuggucca

SEQ ID NO: 536417 - RNA, 64 nt, Human Herpes Virus 1
cgcccaggaccuggagcgccugucgcgccucugggagcacgagcuggugcgcuguuuuaaaauu

SEQ ID NO: 536418 - RNA, 64 nt, Human Herpes Virus 1
ggcccuggauuuuggccugacggaaaggcuucgcgagcacgaagcccagcuggugauccuggcc

SEQ ID NO: 536419 - RNA, 64 nt, Human Herpes Virus 1
ccucgggugcauauccugggauccgacccccauggagcacgagcaggcggucggcggcuguagc

SEQ ID NO: 536420 - RNA, 64 nt, Human Herpes Virus 1
cccaacggguaaucgugaaggcggggugguacacgagcacgagccacgaggcgcgacugcugag

SEQ ID NO: 536421 - RNA, 64 nt, Human Herpes Virus 1
cugggccauuuuuauuaacaacaaacggugcgucgagcacgaguucgguaaccucaugaaggug

SEQ ID NO: 536422 - RNA, 64 nt, Human Herpes Virus 1
ccugccccugggaagccccgcggucgugggggccgagcacgaggcgcugggcgacaccgcagcg

SEQ ID NO: 536423 - RNA, 64 nt, Human Herpes Virus 2
cuuuuuuggauuuugccaccgcgacgcccaagcgccaccagaccguggucccgggcgucgggac

SEQ ID NO: 536424 - RNA, 64 nt, Human Herpes Virus 2
acgugacccggaaggcacggcgggucauccggccccaccagagagcgacccccccuccccaggg

SEQ ID NO: 536425 - RNA, 64 nt, Human Herpes Virus 2
aaauguucaaguucuuuuuccaccgccucuacgaccaccagaucgugccguccacccccgccau

SEQ ID NO: 536426 - RNA, 64 nt, Human Herpes Virus 2
gcaucuuccagcgccugcgcuacgacuuuggcccccaccagagcgaguggcuaggggaggugac

SEQ ID NO: 536427 - RNA, 64 nt, Human Herpes Virus 2
acgccgaucuccgggccgcgcuagccaggaccgaccaccagaaaaaccucuucuggcucccgga

SEQ ID NO: 536428 - RNA, 64 nt, Human Herpes Virus 2
cgcggccgccccaccgucggggcggccgcgcacgagggcggacagcgggacccccgccgccgcc

SEQ ID NO: 536429 - RNA, 64 nt, Human Herpes Virus 1
gguccgaagacucauuuggauccggcgggagccacccgacaacagcccccggguuuucccacgc

SEQ ID NO: 536430 - RNA, 64 nt, Human Herpes Virus 1
gcgcggcacacggggugggcgccgcgccuccacccccgacaaccgccugccccgggacggccga

SEQ ID NO: 536431 - RNA, 64 nt, Human Herpes Virus 1
ggaaggccagaugaccccggagcaguuuaugcagcccgacaacgccaaccuggcucuugagcug

SEQ ID NO: 536432 - RNA, 64 nt, Human Herpes Virus 1
guuccacggggaugacccguuuggggaggggccccccgacaaaaagggagaccugacguuggau

SEQ ID NO: 536433 - RNA, 64 nt, Human Herpes Virus 1
gcgggucgccagccuccagagcgccuaccagaagcccgacaagcgcguggacauccuccucgga

SEQ ID NO: 536434 - RNA, 64 nt, Human Herpes Virus 1
guuaucgcgcgugggggucaugcacuucgccucccccgacaaccccgcgguguuuuuccgccaa

SEQ ID NO: 536435 - RNA, 64 nt, Human Herpes Virus 2
ccaacugguguaugacagcgcccccaaccgaacggacccgcacgugaucugggcggagggcgcc

SEQ ID NO: 536436 - RNA, 64 nt, Human Herpes Virus 2
cccacgacuccggggccccaaacaaccccucccggacccgcaaccccggguccggugggcgccu

SEQ ID NO: 536437 - RNA, 64 nt, Human Herpes Virus 2
cgcggcgcugacccgccggcccgccgagggccccgacccgcagggcggcuggcgccgccagccg

SEQ ID NO: 536438 - RNA, 64 nt, Human Herpes Virus 2
gugggcccucuucgucccgcugcgccugggcugggacccgcagacgggucuggucgugaggguc

SEQ ID NO: 536439 - RNA, 64 nt, Human Herpes Virus 2
accucaccacgaaggcccgggccacgucgccgacgacccgcaacuugcugacgacccccaaguu

SEQ ID NO: 536440 - RNA, 64 nt, Human Herpes Virus 2
ccucgcgacgacccacggcccaacagcugcagcggacccgcaggcgcggaugccgcgcuuccuc

SEQ ID NO: 536441 - RNA, 64 nt, Human Herpes Virus 2
aaauggcccaggcgggcgacagggccacgaggucgacccgcagcguggggcgccuggcggacga

SEQ ID NO: 536442 - RNA, 64 nt, Human Herpes Virus 2
ccccgagagccugaucguagacgggcucgccagcgacccgcacuacgacuacauccggcacuac

SEQ ID NO: 536443 - RNA, 64 nt, Human Herpes Virus 2
cccuuggucucuccaccucggcucuggccggagggacccgcaccgcggggcuuggagcgaccga

SEQ ID NO: 536444 - RNA, 64 nt, Human Herpes Virus 2; identical to SEQ ID NO: 536437

SEQ ID NO: 536445 - RNA, 64 nt, Human Herpes Virus 4 (Epstein Barr virus)
aaguggacuuuaauuuuuucugcuaagcccaacacuccaccacacccaggcacacacuacacac

SEQ ID NO: 536446 - RNA, 64 nt, Human Herpes Virus 4 (Epstein Barr virus); identical to SEQ ID NO: 536445

SEQ ID NO: 536447 - RNA, 64 nt, Human Herpes Virus 4 (Epstein Barr virus); identical to SEQ ID NO: 536445

SEQ ID NO: 536448 - RNA, 64 nt, Human Herpes Virus 4 (Epstein Barr virus)
ccaccacccccaccacccccaccacccccaccaccuccaccaccuucaccaccacccccgcccc

SEQ ID NO: 536449 - RNA, 64 nt, Human Herpes Virus 4 (Epstein Barr virus)
aguuuccagcccugggccaaaagacccuccccaccuccaccaccggccugcuaaaccuccucuc

SEQ ID NO: 536450 - RNA, 64 nt, Human Herpes Virus 4 (Epstein Barr virus)
ccgccuguuuuguuugugccacaacgccucgccccuccaccacguggcggguucucucguggaa

SEQ ID NO: 536451 - RNA, 64 nt, Human Herpes Virus 4 (Epstein Barr virus)
ugagacccaguucaaacccagagacacucagccccuccaccagugacaauucaacgucacauau

SEQ ID NO: 536452 - RNA, 64 nt, Human Herpes Virus 4 (Epstein Barr virus)
acgagccucuccuucacggccuccuggacuacgccuccaccaccgagaacuacacgcuucuggg

SEQ ID NO: 536453 - RNA, 64 nt, Human Herpes Virus 4 (Epstein Barr virus)
ggcgggggcuggcaagagcaccagcguuagcugccuccaccacacgauggacugccuggucacg

SEQ ID NO: 536454 - RNA, 64 nt, Human Herpes Virus 4 (Epstein Barr virus)
cgggugugacuagcaaugucaccaccagguccuccuccaccaccagugcuacuacccguauuac

SEQ ID NO: 536455 - RNA, 55 nt, Human Herpes Virus 4 (Epstein Barr virus)
gucuggcucugaccagcaagaugcucuccaccauggcccccggguccaccguggg

SEQ ID NO: 536456 - RNA, 64 nt, Human Herpes Virus 4 (Epstein Barr virus)
accagaagagucauacucaagagaucagcaaccuugggggcaaagcaggggugaugaaaacaga

SEQ ID NO: 536457 - RNA, 64 nt, Human Herpes Virus 4 (Epstein Barr virus)
cguggccagacaacaggcugaauuaggaaggcgcugggggcacguuuuggcgcuguugacagcg

SEQ ID NO: 536458 - RNA, 64 nt, Human Herpes Virus 4 (Epstein Barr virus)
uaccuggaugaccacaagagcgccgccuucgugcugggggcaaucgcccacuaccuggcccucu

SEQ ID NO: 536459 - RNA, 64 nt, Human Hepatitis C Virus (M1LE)
acaucauggcaugcaugucggcugaccuggaggucgucaccagcacuugggugcugguaggcgg

SEQ ID NO: 536460 - RNA, 64 nt, Human Hepatitis C Virus (M1LE)
gcugcccaucaacccguugagcaacucccugcugcgucaccacaauauggucuacgccacaaca

SEQ ID NO: 536461 - RNA, 64 nt, Human Herpes Virus 2
uuguuggaguuugggucguaucgugccuggcggcagcacccagaacguccuggaaacggguaac

SEQ ID NO: 536462 - RNA, 64 nt, Human Herpes Virus 2
uuacgucuuucacggcggccgccaccuggcccccagcacccaggcccccaaccugacgcggcuc

SEQ ID NO: 536463 - RNA, 64 nt, Human Herpes Virus 2
cgcgcgacgccgccgaggcgguccgggcccacaucacgaccaacuacggcgggacgcgggccgg

SEQ ID NO: 536464 - RNA, 64 nt, Human Herpes Virus 2
ugaaugccacguggcaggccgaaaacgcccugcacacgaccaaaacggaccccgcgugccuggc

SEQ ID NO: 536465 - RNA, 64 nt, Human Herpes Virus 2
ccccccccaaaccccgacgccguucgucgucguccacgaccaugccuucccuaacgucgauagc

SEQ ID NO: 536466 - RNA, 55 nt, Human Hepatitis C Virus (M1LE)
gccagcccccggauugggggcgacacuccaccauagaucacuccccugugaggaa

SEQ ID NO: 536467 - RNA, 60 nt, Human Herpes Virus 4 (Epstein Barr virus)
ugccauuaccccccucacaauugccaccaccagcagcaccagcacagccaccuccagggg

SEQ ID NO: 536468 - RNA, 60 nt, Human Herpes Virus 4 (Epstein Barr virus)
cuguuccuggcaagagucuugcaggcuguacagcagcacaagcugcuggaagacaccauc

SEQ ID NO: 536469 - RNA, 60 nt, Human Herpes Virus 4 (Epstein Barr virus)
ucaccacagaacacagggggcuggauuuggcagcagcacuugugcuuuuguugauuuuua

SEQ ID NO: 536470 - RNA, 60 nt, Human Herpes Virus 4 (Epstein Barr virus)
gcgccagagcggcauccucaucuuccuccucagcagcagcuugacggacgugcccagcuc

SEQ ID NO: 536471 - RNA, 60 nt, Human Herpes Virus 4 (Epstein Barr virus)
cccugagcuggacgagguccacuucuuccucagcagcagcgaugcccucaugcgccagag

SEQ ID NO: 536472 - RNA, 60 nt, Human Herpes Virus 4 (Epstein Barr virus)
cguccucuaccuggucaagaacuucuuccucagcagcagccugaccucccgcccugagcu

SEQ ID NO: 536473 - RNA, 60 nt, Human Herpes Virus 4 (Epstein Barr virus)
ggcccacugcaaguuuggccuccuccaacucagcagcagcgucagcaacugcguccucua

SEQ ID NO: 536474 - RNA, 60 nt, Human Herpes Virus 4 (Epstein Barr virus)
ggaggcucggcccuccgcauuccccgacugcagcagcagcaccaggcccacugcaaguuu

SEQ ID NO: 536475 - RNA, 60 nt, Human Herpes Virus 4 (Epstein Barr virus)
aaccuggagacaauucuacuguucaaacagcagcagcagugguguuugcuugccccgggg

SEQ ID NO: 536476 - RNA, 60 nt, Human Herpes Virus 4 (Epstein Barr virus)
cucaaccuggagacaauucuacuguucaaacagcagcagcagugguguuugcuugccccg

SEQ ID NO: 536477 - RNA, 60 nt, Human Herpes Virus 4 (Epstein Barr virus)
ccaaagcgccgacugcggugacagcaguuccagcagcagugacucgggcaacagugacac

SEQ ID NO: 536478 - RNA, 64 nt, Human Herpes Virus 1
cgacgcagggacaggacuccguuacgacggaggagagccacagugcguuggcggaaucgaugug

SEQ ID NO: 536479 - RNA, 64 nt, Human Herpes Virus 1
ccgccgggcugacggccgugggcgacaagauggcgagccacaucucgcgcgcgcuguuucugcc

SEQ ID NO: 536480 - RNA, 64 nt, Human Herpes Virus 4 (Epstein Barr virus)
ugugaaugaguuacagcacacgcuacaggcccugcgccgggagacgcuguccuacggccacacc

SEQ ID NO: 536481 - RNA, 64 nt, Human Herpes Virus 4 (Epstein Barr virus)
aacauccauguucauugggaccccaaauguuagccgccgggaggccaggguggacgcgguaacc

SEQ ID NO: 536482 - RNA, 64 nt, Human Herpes Virus 4 (Epstein Barr virus)
caggcucauaaucucuguuauucuaccaugauaacgccgggagaagagcacaggcuagccggcc

SEQ ID NO: 536483 - RNA, 64 nt, Human Herpes Virus 2
ucacggauacgauccguaaggaccugcggcugucgcuggccaaguucagcaucgcguguaccaa

SEQ ID NO: 536484 - RNA, 64 nt, Human Herpes Virus 2
gggcguuucucaggcagcacacgcugccccggcagcuggccacggucgccggggccgcggagcg

SEQ ID NO: 536485 - RNA, 64 nt, Human Herpes Virus 2
uaguccugccccacugguacauggcccacuaccugcuggccaacaauccgccccccguccucuc

SEQ ID NO: 536486 - RNA, 64 nt, Human Herpes Virus 2
uagccgucccccuccgguuggacacgcagagccugcuggccacguacgcaauuacgucuacgcu

SEQ ID NO: 536487 - RNA, 64 nt, Human Herpes Virus 2
gcgagagccugcugagcauccugcugcgcgacuggcuggccaugcgaaagcagauccgcucgcg

SEQ ID NO: 536488 - RNA, 64 nt, Human Herpes Virus 2
uguggggccugcuguggguggguguggucguggugcuggccaaugccucccccggacgcacgau

SEQ ID NO: 536489 - RNA, 64 nt, Human Herpes Virus 2
cguuucccgccgcgaacagccccugggcucccgugcuggccacccaagcggggggguuugacgc

SEQ ID NO: 536490 - RNA, 64 nt, Human Herpes Virus 2
gcggcggcguggaggugguggggaccgccgcggggcuggccacgccgccgaggcgcgagcccgu

SEQ ID NO: 536491 - RNA, 64 nt, Human Herpes Virus 2
ucagugaguuugucgagucgaucgacuccacggagcuggccauggccaucaacgccgacuacgg

SEQ ID NO: 536492 - RNA, 64 nt, Human Herpes Virus 2
ucaagaucaucuggggcgaacuguucggggugcagcuggccaagagcacgcagacguuucccgg

SEQ ID NO: 536493 - RNA, 64 nt, Human Herpes Virus 2
ggcgacgcgcccgccccccgcggcuguccuccgagcuggccacggcccugacggaggccugugc

SEQ ID NO: 536494 - RNA, 64 nt, Human Herpes Virus 2
ucgaucucgccgagggcggguucauccuggacgcgcuggccauggccacccgauccgacauccc

SEQ ID NO: 536495 - RNA, 64 nt, Human Herpes Virus 2
ggcggcuguacgcggaccgccugaccaagcggucgcuggccagccucgggcgcugcgugcgcga

SEQ ID NO: 536496 - RNA, 64 nt, Human Herpes Virus 2
accuggccaugcugugcggguucucuccggcccugcuggccaagaugcuguuuuaccuggagcg

SEQ ID NO: 536497 - RNA, 64 nt, Human Herpes Virus 2
gcugcugccccgcgugcagcgcgggcgacgggcggcuggccaccgucagccgcgaggcccucau

SEQ ID NO: 536498 - RNA, 64 nt, Human Herpes Virus 2
agacguaccagguauuugugccgaagcccaccgcgcuggccacauuuguccgcgaggccggcgc

SEQ ID NO: 536499 - RNA, 64 nt, Human Herpes Virus 2
ugcugugcaaucuguugcuggugcgggccuacuggcuggccaugcgacgccugagggcguccgu

SEQ ID NO: 536500 - RNA, 64 nt, Human Herpes Virus 2
ucgaccccgacgugccguuucugagugcgucggcgcuggccaucuuccguccggccgucaccgg

SEQ ID NO: 536501 - RNA, 64 nt, Human Herpes Virus 2
ugucgcccaugcccgcccgcccccggaccaacgcgcuggccaacgacggcccgacgaacgucgc

SEQ ID NO: 536502 - RNA, 64 nt, Human Herpes Virus 2; identical to SEQ ID NO: 536490

SEQ ID NO: 536503 - RNA, 64 nt, Human Herpes Virus 4 (Epstein Barr virus)
auguguaugccuacggaccagacuggauggcaaggccuuccacaugguccgcggaaauccagca

SEQ ID NO: 536504 - RNA, 64 nt, Human Herpes Virus 4 (Epstein Barr virus)
aggaccacgccccucccucacugccccccccccugccuuccaggugcaccggaccagcagaccc

SEQ ID NO: 536505 - RNA, 64 nt, Human Herpes Virus 4 (Epstein Barr virus)
caucaccauggaggccuguccacacauacgcuacgccuuccagaaugacaagcuguugcuccag

SEQ ID NO: 536506 - RNA, 64 nt, Human Herpes Virus 4 (Epstein Barr virus)
acguuuaccagugugccaguguacugcgaugagggccuuccagagcucuacaaccccuuccacg

SEQ ID NO: 536507 - RNA, 64 nt, Human Herpes Virus 4 (Epstein Barr virus)
cugcucggggcaugcugcccggacggccuagccaucggggcacguuuaccagugugccagugua

SEQ ID NO: 536508 - RNA, 64 nt, Human Herpes Virus 4 (Epstein Barr virus)
cgggucucacgagggucugccgcguguuugcugcucggggcaugcugcccggacggccuagcca

SEQ ID NO: 536509 - RNA, 64 nt, Human Herpes Virus 4 (Epstein Barr virus)
ggguccugagacccaaagggacagggggagacuuucggggcauugguguaacaauaaacuggcu

SEQ ID NO: 536510 - RNA, 64 nt, Human Herpes Virus 1
ggccgccagcgcggcggggcccggccaaccagcguccgccgagucuucggggcccggcccauug

SEQ ID NO: 536511 - RNA, 64 nt, Human Herpes Virus 1
aacgcgggacgcucgccuggccgaagcggucguguccgccgaagcggcggcgcaccccgaccac

SEQ ID NO: 536512 - RNA, 64 nt, Human Herpes Virus 1
gcugcgccaagaaaauuucaucgaggcgcuggccuccgccgacgagacgcuggcguggugcaag

SEQ ID NO: 536513 - RNA, 64 nt, Human Herpes Virus 1
cggcggcggggccucgggggggccgccggagugguccgccgagcgcggcgggcuguccugccug

SEQ ID NO: 536514 - RNA, 64 nt, Human Herpes Virus 1
cgcuauuugcgcgcgaauaccagacucuugcguuuccgccgaucaagaaggagggcgcguucgg

SEQ ID NO: 536515 - RNA, 64 nt, Human Herpes Virus 1
ccacgcuauucaccgacgcccauucagugcguuauccgccgaugcgcaugugggcauggauuca

SEQ ID NO: 536516 - RNA, 64 nt, Human Herpes Virus 1; identical to SEQ ID NO: 536510

SEQ ID NO: 536517 - RNA, 64 nt, Human Herpes Virus 1; identical to SEQ ID NO: 536513

SEQ ID NO: 536518 - RNA, 64 nt, Human Herpes Virus 1
cuauauaaauaaccuguuuggaaccaucgagcgccugcgcgagaccaacgcgggccuggcgacc

SEQ ID NO: 536519 - RNA, 64 nt, Human Herpes Virus 1
cggggccgguccagaucgcggucgcccggaagaacugcgcgaggcgcgccggaccagggcgggg

SEQ ID NO: 536520 - RNA, 64 nt, Human Herpes Virus 1
cccacgagaucucugcgagcgcauggccgcggcccugcgcgaguccccgggcgcgucguuccgc

SEQ ID NO: 536521 - RNA, 64 nt, Human Herpes Virus 1
gccgcacgccgacgcgccccgccugcgcgcguggcugcgcgagcugcgguucgugcgcgacgcg

SEQ ID NO: 536522 - RNA, 64 nt, Human Herpes Virus 1
cgaugacgucauuagugagcacauacuaucggcucugcgcgauccgaacguggucauugucuau

SEQ ID NO: 536523 - RNA, 64 nt, Human Herpes Virus 1
gaacgugcucacguaccucaucugcaaccgcacgcugcgcgaguacgcccgccucucguauagc

SEQ ID NO: 536524 - RNA, 64 nt, Human Herpes Virus 1
ccccguggacugcgcucaucaccugcgcgaaauccugcgcgagauugaguugguguuuaccggg

SEQ ID NO: 536525 - RNA, 64 nt, Human Herpes Virus 1
ccuugugcucccccccguggacugcgcucaucaccugcgcgaaauccugcgcgagauugaguug

SEQ ID NO: 536526 - RNA, 64 nt, Human Herpes Virus 1
uugcccucuuuuucuuuaaccgcgagcgccgcuacugcgcgaucguccaccuccggagcgugac

SEQ ID NO: 536527 - RNA, 64 nt, Human Herpes Virus 1
ccacguggcgaacgcgcccaauuuccccccggcccugcgcgaccugucgcggcaggucccccug

SEQ ID NO: 536528 - RNA, 64 nt, Human Herpes Virus 1
cgacaacgcgaccgucgccgcgggccacgccacccugcgcgagcaccugcgggacaucaaggcg

SEQ ID NO: 536529 - RNA, 64 nt, Human Herpes Virus 1
ucgcagccauucaccgcauccggggccccuggugcugcgcgagggcggccgacacguacgccga

SEQ ID NO: 536530 - RNA, 64 nt, Human Herpes Virus 1
ucccaauaacaccuacgccuccguggaggaugugcugcgcgaaugucacuggacccccccgagu

SEQ ID NO: 536531 - RNA, 64 nt, Human Herpes Virus 1
cguggcggccaaguacgccgccaccguggccggccugcgcgacgcccuccaucggauucagcag

SEQ ID NO: 536532 - RNA, 64 nt, Human Herpes Virus 1; identical to SEQ ID NO: 536521

SEQ ID NO: 536533 - RNA, 64 nt, Human Herpes Virus 1
agccccccgggugguuggugauccuggccaggagccaucccagauggcgggcccugcuucccgg

SEQ ID NO: 536534 - RNA, 64 nt, Human Herpes Virus 1
cggcccgggcgagccuggggguccgguaauuuugccaucccacccaagcggcuuuuuggguuuu

SEQ ID NO: 536535 - RNA, 64 nt, Human Herpes Virus 1
ccccgcccccggcccucacccucaucuucgaccgccaucccaucgccgcccuccugugcuaccc

SEQ ID NO: 536536 - RNA, 64 nt, Human Herpes Virus 1
uccuggcccucuuuguccgcugccacaccgaccuccaucccaauaacaccuacgccuccgugga

SEQ ID NO: 536537 - RNA, 64 nt, Human Herpes Virus 2
gcccgcgcggacgccccccggccacgggcucagcgagauccagcagcucuuugggugcauugcc

SEQ ID NO: 536538 - RNA, 64 nt, Human Herpes Virus 2
gugcacacaccggacguauggcgaugucugcgcggagauccauaaaagggaacgggaggaccga

SEQ ID NO: 536539 - RNA, 64 nt, Human Herpes Virus 2
ucuacggaacgugcuggcggcgguuaaaaauuguuaccccgacgcgcgcaugagcggccgcggc

SEQ ID NO: 536540 - RNA, 64 nt, Human Herpes Virus 2
cuucgcgcgcguggaggccgcgcacgcgcgccuguaccccgacgcgccgccgcugcgccucugc

SEQ ID NO: 536541 - RNA, 64 nt, Human Herpes Virus 2
cucggcgcuggacgcccuccggcggguggccggcuaccccgaggagagcacgaacuacgcccag

SEQ ID NO: 536542 - RNA, 64 nt, Human Herpes Virus 2; identical to SEQ ID NO: 536540

SEQ ID NO: 536543 - RNA, 64 nt, Human Herpes Virus 1
cccauugggcgggaguuaccgcccaaugggccgggccgcccacuucccgguaugguaauuaaaa

SEQ ID NO: 536544 - RNA, 64 nt, Human Herpes Virus 1
aagcgggccugcagccgaagccccucaccacgccgccgcccaucaucgccacgucggaccccac

SEQ ID NO: 536545 - RNA, 64 nt, Human Herpes Virus 1
ccgccgaaacccgccgcgucuguugaaauggccagccgcccagccgcauccucucccgucgaag

SEQ ID NO: 536546 - RNA, 64 nt, Human Herpes Virus 1
uuuuggauuccccugacggggcggggccuuggcggccgcccaacucucgcaccaucccggguua

SEQ ID NO: 536547 - RNA, 64 nt, Human Herpes Virus 1
agcgccccggcuccccgggccccaccgacgggccgccgcccaccccgagcccagaccgcgacga

SEQ ID NO: 536548 - RNA, 64 nt, Human Herpes Virus 1
cucgaucgccgcgcggugcgccgggcccgcccccgccgcccaggccgcgugcggcggcggcgac

SEQ ID NO: 536549 - RNA, 62 nt, Human Herpes Virus 1
gucgcccgcaggguggcggaauggaccgagaugccgcccacgcggcccugcgccgacgccug

SEQ ID NO: 536550 - RNA, 64 nt, Human Herpes Virus 1
cgcucuacugcagaugcagagugucacgcgggaggccgcccagcucauucaccccgaagccccg

SEQ ID NO: 536551 - RNA, 64 nt, Human Herpes Virus 1
ggcuuuuccacuuuaucgccaccaaccaaaugcugccgcccaccgauccccugcgcacacgggc

SEQ ID NO: 536552 - RNA, 64 nt, Human Herpes Virus 1
uuugggaggcacggcccugugugccuuguucgccgccgcccacgagaccuucaguccggacggg

SEQ ID NO: 536553 - RNA, 64 nt, Human Herpes Virus 1
gcugcucgcgacgucggguuuugcuuucgugaacgccgcccacgcaaacggcgcggucugccuc

SEQ ID NO: 536554 - RNA, 64 nt, Human Herpes Virus 1
ucgagucuaucgugucgauggccgucuuugacgagccgcccaccgacaucuccgcguggccgcu

SEQ ID NO: 536555 - RNA, 64 nt, Human Herpes Virus 1
gcgaugccgaaacguggacgccguggcccgcgcggccgcccaccuggcguuugacgaaaaccac

SEQ ID NO: 536556 - RNA, 64 nt, Human Herpes Virus 1
gcauguguucgaucgucgaggccuggccgacguggccgcccaucggggcgcgcggcggacugcg

SEQ ID NO: 536557 - RNA, 64 nt, Human Herpes Virus 1
gggcgaggcgucggagcggggccgcucacgccaagccgcccagcgagccgcucggcgcgcccgg

SEQ ID NO: 536558 - RNA, 64 nt, Human Herpes Virus 1; identical to SEQ ID NO: 536543

SEQ ID NO: 536559 - RNA, 64 nt, Human Herpes Virus 1; identical to SEQ ID NO: 536548

SEQ ID NO: 536560 - RNA, 64 nt, Human Herpes Virus 1; identical to SEQ ID NO: 536547

SEQ ID NO: 536561 - RNA, 64 nt, Human Herpes Virus 4 (Epstein Barr virus)
auagaggagcuaaccuucggggcgguugccugucuggggacauuuagugcuacugacgguugga

SEQ ID NO: 536562 - RNA, 64 nt, Human Herpes Virus 4 (Epstein Barr virus)
agacuuaugcuaacauuuuaaacaugcucuuugauggggacagggcggcgaugaacgccuacgc

SEQ ID NO: 536563 - RNA, 64 nt, Human Herpes Virus 4 (Epstein Barr virus)
cgguuaacuuuaacaagacggccgagcaggaguauggggacaaagagguaaaacugccacauug

SEQ ID NO: 536564 - RNA, 64 nt, Human Herpes Virus 4 (Epstein Barr virus)
cuagagauuggggagguuuugcgggggcuagcccuggggacagagagcgggcucuucucaccgu

SEQ ID NO: 536565 - RNA, 64 nt, Human Herpes Virus 2
acccccugacgccccuccgacccccgugucuccccgcccgcaggugugcuucucgccgcgcgug

SEQ ID NO: 536566 - RNA, 64 nt, Human Herpes Virus 2
gacaaacacagccagacgcgagugugggacgacacgcccgcagccccccccccgccauggcggg

SEQ ID NO: 536567 - RNA, 64 nt, Human Herpes Virus 2
gcgucuggccgcgguaaucggcgacgagagcggacgcccgcaguaccgcuaccgcgacgacaag

SEQ ID NO: 536568 - RNA, 64 nt, Human Herpes Virus 2
uccgggccaucaccggcaacgugagcgccauccucgcccgcaacgggggcaucgggcugugcau

SEQ ID NO: 536569 - RNA, 64 nt, Human Herpes Virus 2
uggcucucaccguggccaucguccacaacgcccccgcccgcaucggcagcggcagcaccgcccc

SEQ ID NO: 536570 - RNA, 64 nt, Human Herpes Virus 2
cccccagcgccagcccgagcccgucgagcccacccgcccgcacgugagagccccccaucccgcg

SEQ ID NO: 536571 - RNA, 64 nt, Human Herpes Virus 2
ggcccccaaccugacgcggcucugcgagcgggcgcgcccgcauuuuggcuucgcggacuacgcg

SEQ ID NO: 536572 - RNA, 64 nt, Human Herpes Virus 2
gcgggggcggagacagcugcugcacgcgcgccgccgcccgcaacggggaguucgaggccgccgc

SEQ ID NO: 536573 - RNA, 64 nt, Human Herpes Virus 2
ucgggggggcgggggccgggguccgcccgcggcccgcccgcagaccccacggcagagggacucu

SEQ ID NO: 536574 - RNA, 64 nt, Human Herpes Virus 2
uucgagacgcacccgcuaagaccccgcaucccgacgcccgcauccccccuggcgcggcacgccg

SEQ ID NO: 536575 - RNA, 64 nt, Human Herpes Virus 2; identical to SEQ ID NO: 536565

SEQ ID NO: 536576 - RNA, 64 nt, Human Herpes Virus 2
ggcuccucacaacaaaccccgccccgcaucaucccgcccgcauccggcgacccaccccacgcag

SEQ ID NO: 536577 - RNA, 64 nt, Human Herpes Virus 1
guucgaccuucuccccccaaaggacgugccggugggaagcgacgugcaggccgacagcaccgcu

SEQ ID NO: 536578 - RNA, 64 nt, Human Herpes Virus 1
cgggaaaaacuaccgcgcugauccgcuggcugcgggaagcgauccacucuccggacacgagugu

SEQ ID NO: 536579 - RNA, 61 nt, Human Herpes Virus 1
ccugggggggcacacggugagggcccugucgcccacccacccggagcccaccacggacgag

SEQ ID NO: 536580 - RNA, 61 nt, Human Herpes Virus 1
cccaaggggccccgggucgacccgacccacacccacccacccacauacacacacaaccaga

SEQ ID NO: 536581 - RNA, 61 nt, Human Herpes Virus 1
aggggccccgggucgacccgacccacacccacccacccacauacacacacaaccagacgcg

SEQ ID NO: 536582 - RNA, 61 nt, Human Herpes Virus 1
ggcgagccuggggguccgguaauuuugccaucccacccaagcggcuuuuuggguuuuucuc

SEQ ID NO: 536583 - RNA, 61 nt, Human Herpes Virus 1
guccguggcgcaggcgcucccgugccuggagcccacccacccccuccggcgauucaagacc

SEQ ID NO: 536584 - RNA, 61 nt, Human Herpes Virus 1
ccguucuagaacaccacggcagucaccagcccccacccagggaccccaccgagcggcaggu

SEQ ID NO: 536585 - RNA, 61 nt, Human Herpes Virus 1
ccucccacagcgcggcgcggauuuggccgagcccacccacccgcacgucggggccccuccc

SEQ ID NO: 536586 - RNA, 61 nt, Human Herpes Virus 1
cgcuagcgggcgccuucccccggccaccucgcccacccacuccuccccgcgccguuggccc

SEQ ID NO: 536587 - RNA, 61 nt, Human Herpes Virus 1
aaacaacacuaaccccgggggcuguucgaggcccacccaaaggucucuggccagcagggca

SEQ ID NO: 536588 - RNA, 61 nt, Human Herpes Virus 1
ggcgccugagccaggcccagcucaugcccuccccacccaugcccgucccccccgccgcccu

SEQ ID NO: 536589 - RNA, 61 nt, Human Herpes Virus 1
aaaagcccgauaucgucuuucccguaucaaccccacccaauggaccucuuggucgacgagc

SEQ ID NO: 536590 - RNA, 61 nt, Human Herpes Virus 1; identical to SEQ ID NO: 536579

SEQ ID NO: 536591 - RNA, 61 nt, Human Herpes Virus 1
uggcugcggucccugauugcucugcacaaaccccacccagcuaccccaggcccccuuacga

SEQ ID NO: 536592 - RNA, 64 nt, Human Herpes Virus 2
ugagcagccgcgccgcugcccgacgcgcccggaggggcagaacuacacggagggcaucgcggug

SEQ ID NO: 536593 - RNA, 64 nt, Human Herpes Virus 2
ucacggccgcgggccugguggccaugggcgacaagauggcgagccacaucucgcgcgcgcuguu

SEQ ID NO: 536594 - RNA, 64 nt, Human Herpes Virus 2
agcuuccgggagcggcuucgcgcgggacugucccgauggcgagugagccgcucgucucgucgcc

SEQ ID NO: 536595 - RNA, 64 nt, Human Herpes Virus 2
uggacgacgacagcgaggucgaggccgcgggggagauggcgagcgaagagccgcccccgcgccg

SEQ ID NO: 536596 - RNA, 64 nt, Human Herpes Virus 4 (Epstein Barr virus)
gggcucggagaaauggggccggccagggccacgggaccuggaaugcagcaguuugucagcagcu

SEQ ID NO: 536597 - RNA, 64 nt, Human Herpes Virus 4 (Epstein Barr virus)
ggacugguaccuguuugaccccaaggacgccggggaccuggagaggcucuacggggaggaguuu

SEQ ID NO: 536598 - RNA, 64 nt, Human Herpes Virus 4 (Epstein Barr virus)
ggacgaggaugguucggaggauggggaauuuucagaccuggaucugucugacagcgaccaugaa

SEQ ID NO: 536599 - RNA, 64 nt, Human Herpes Virus 4 (Epstein Barr virus)
gugugaaucaugucugacgaggggccagguacaggaccuggaaauggccuaggagagaagggag

SEQ ID NO: 536600 - RNA, 64 nt, Human Herpes Virus 4 (Epstein Barr virus)
caggacgcugcuguccacccuggucaaguaccacgaccuggaggagggggcugccacccccggg

SEQ ID NO: 536601 - RNA, 64 nt, Human Herpes Virus 4 (Epstein Barr virus)
cauccagcagugcaaggccggggacagaccgggggaccuggagaucauucuacagaguaacggc

SEQ ID NO: 536602 - RNA, 64 nt, Human Herpes Virus 4 (Epstein Barr virus)
ugaccaccuggccagggcggaggagauccgccaggaccuggaugcuguaguggccuucucugau

SEQ ID NO: 536603 - RNA, 64 nt, Human Herpes Virus 4 (Epstein Barr virus)
uacagaccuugcguggguccugaagcacuuuagugaccuggaaccgucuaucgccgcccagauu

SEQ ID NO: 536604 - RNA, 64 nt, Human Herpes Virus 4 (Epstein Barr virus)
ugucgacgaagaugccaucuacgaggccaucaaggaccuggaauguggggaugagcugcgccua

SEQ ID NO: 536605 - RNA, 64 nt, Human Herpes Virus 4 (Epstein Barr virus)
agccuaccguuuucguuaagugaauuuucugcaggaccuggacgcuccucaucacgauuucggc

SEQ ID NO: 536606 - RNA, 64 nt, Human Herpes Virus 4 (Epstein Barr virus)
ccgcucccuccacgccaccaacgauggaaaauuugaccuggaggcagacucccaagaggaaaaa

SEQ ID NO: 536607 - RNA, 64 nt, Human Herpes Virus 4 (Epstein Barr virus)
gguauaguccugcaaagaccagguccccacgcuggaccuggagcucugcggccccggccucugc

SEQ ID NO: 536608 - RNA, 64 nt, Human Herpes Virus 4 (Epstein Barr virus)
uaauccccggcuuccggucugcaaccuggucuuggaccuggaucuaaagaucaagggggccccc

SEQ ID NO: 536609 - RNA, 64 nt, Human Herpes Virus 4 (Epstein Barr virus)
ccaggaaauggugccggaugagauagcccggauagaccuggaugaccugucaguggcggaugau

SEQ ID NO: 536610 - RNA, 64 nt, Human Herpes Virus 4 (Epstein Barr virus)
cucacgggacgaacagcgugccuccaacgucuuugaccuggagggcaucuuccgggaguacaac

SEQ ID NO: 536611 - RNA, 64 nt, Human Herpes Virus 4 (Epstein Barr virus)
gguggugcauggggagcccaccugcgaccugccagaccuggacgcggcccugcagggccgggug

SEQ ID NO: 536612 - RNA, 64 nt, Human Herpes Virus 4 (Epstein Barr virus)
cugauacacgccagcuccuucaacaacgccgaggccacuggaacgccccuuuuccaauucaagc

SEQ ID NO: 536613 - RNA, 64 nt, Human Herpes Virus 4 (Epstein Barr virus)
cuuugccagugauuacagucaaggugcauuuaccccacuggacauuaaugccaccacgccaaaa

SEQ ID NO: 536614 - RNA, 64 nt, Human Herpes Virus 4 (Epstein Barr virus)
augguggacgcugugggaaauuaccgggaagccuccacuggaacuaccguacucuaccccacgu

SEQ ID NO: 536615 - RNA, 64 nt, Human Hepatitis C Virus (HCV-N)
cggcaaauaccucuucaacugggcaguaaagaccaagcucaaacucacuccaaucccggcugcg

SEQ ID NO: 536616 - RNA, 64 nt, Human Hepatitis C Virus (HCV-N)
cuucacaggccucacccauauagaugcccacuuccugucccagaccaagcaggcaggagauaac

SEQ ID NO: 536617 - RNA, 64 nt, Human Hepatitis C Virus (HCV-N)
gagacaucgggccaggagcguccgcgcuaaacuacugucccagggggggagggccgccacuugc

SEQ ID NO: 536618 - RNA, 63 nt, Human Herpes Virus 4 (Epstein Barr virus)
agcguuacucgcaaggcacagaggcuagagggcaccgcccaguugugugacugugccaauuuu

SEQ ID NO: 536619 - RNA, 63 nt, Human Herpes Virus 4 (Epstein Barr virus)
caauacggacucagccgcggggcuuuuuacgagaccgcccagcaacacggacaucuuggacuc

SEQ ID NO: 536620 - RNA, 63 nt, Human Herpes Virus 4 (Epstein Barr virus)
ugcuucgccggucgcuguggggccaaucaaccgaccgcccauuucuccaucagcgugcccgcc

SEQ ID NO: 536621 - RNA, 63 nt, Human Herpes Virus 4 (Epstein Barr virus)
uuuuucucagaucugguuaaauuugaaaaugucaccgcccaugcaggugcuagagugaaucuc

SEQ ID NO: 536622 - RNA, 63 nt, Human Herpes Virus 4 (Epstein Barr virus)
ugcgaccaaugggugcugcgcccgcgcguguggaccgcccacucgcccauaaaaaugacaguc

SEQ ID NO: 536623 - RNA, 63 nt, Human Herpes Virus 4 (Epstein Barr virus)
acaaggccaagaaggagcguguccccguggaggaccgcccaccgacuccgaugcccaccagcc

SEQ ID NO: 536624 - RNA, 63 nt, Human Herpes Virus 2
auucugcacuccaccgagacgacgggacugucccucggagaccuggacgacgucaaggggcgc

SEQ ID NO: 536625 - RNA, 63 nt, Human Herpes Virus 2
gccaccgucggccggcgggugagcgcgcgcaugcucggagacgucauggccgucuccacgugc

SEQ ID NO: 536626 - RNA, 63 nt, Human Herpes Virus 2
caugcgacgccugagggcguccgucguccgcuacucggagaacaacaccagccucuucgacug

SEQ ID NO: 536627 - RNA, 63 nt, Human Herpes Virus 2
ggugcggugggcgggcgccaucuguacgcacgccucggagaguccgggggccguggcgccggc

SEQ ID NO: 536628 - RNA, 63 nt, Human Herpes Virus 2
cggugggccgcgcgacggcgcccggucguccuccucggagauacucaccccgcccgagcucgu

SEQ ID NO: 536629 - RNA, 64 nt, Human Herpes Virus 4 (Epstein Barr virus)
cugccaaaucaucugaaaaugacaggcugcgccuccuguugaagcagaugugcccaagccugga

SEQ ID NO: 536630 - RNA, 64 nt, Human Herpes Virus 4 (Epstein Barr virus)
ccgaggcagacaaggccccgccaucccacgaccaccuguugacccugguccgcgaccugacccg

SEQ ID NO: 536631 - RNA, 64 nt, Human Herpes Virus 4 (Epstein Barr virus)
cucgggggaugaugggcgggaccaacaacccccaccuguugauggcuucggguccgagauggag

SEQ ID NO: 536632 - RNA, 64 nt, Human Herpes Virus 4 (Epstein Barr virus)
ccucguuuggcacgcgggagaaucacacggagggccuguugaugguguuuaaagacaacauuau

SEQ ID NO: 536633 - RNA, 64 nt, Human Herpes Virus 2
ggugggggcgauccuagcccccgucaucccggcgcacccggaccuccugccgcgcguccccagc

SEQ ID NO: 536634 - RNA, 64 nt, Human Herpes Virus 2
cgcgcacgccggggaccuggugcccgcccccggccacccggagccccgcgcguucccuccccgg

SEQ ID NO: 536635 - RNA, 64 nt, Human Herpes Virus 2
guucccgcggggagacgacggggcgaccgagaggcacccggacggccgacgcaacgcgccgccc

SEQ ID NO: 536636 - RNA, 64 nt, Human Herpes Virus 2
ucucggcccugaagcgcgcggacggguccgagaacacccggaccaucaugcaggagacguaccg

SEQ ID NO: 536637 - RNA, 64 nt, Human Herpes Virus 2
ugaccgccgcggcccugcacccgccaccccgacgcacccggagccugcaggacgaaccguucgu

SEQ ID NO: 536638 - RNA, 64 nt, Human Herpes Virus 1
ugucaaagggcggcaggacggggcgcggguggcgcaggggcaccucgagcgcgggaaagcguag

SEQ ID NO: 536639 - RNA, 64 nt, Human Herpes Virus 1
cccuggcgcgcgaaaucguggcgcggcucguggccaggggcauccgggaccugaaccccagccc

SEQ ID NO: 536640 - RNA, 62 nt, Human Herpes Virus 2
cgcaugccgaccccccgggaggcgcguccaagccccgcaagcugcugguguccgagcuggcg

SEQ ID NO: 536641 - RNA, 62 nt, Human Herpes Virus 2
ccgccccccgaaccacacccacgcccccccaaccccgcaaggcgacgaaaaguaaggccucc

SEQ ID NO: 536642 - RNA, 62 nt, Human Herpes Virus 2
augcgucagacggcugguugguugacacacccccccgcaaauccaagcgaccccgaaucaac

SEQ ID NO: 536643 - RNA, 62 nt, Human Herpes Virus 2
cccucagucgacccaagcgcggaaccgaccgcccccgcaaccacuacuccccccgacgagau

SEQ ID NO: 536644 - RNA, 62 nt, Human Herpes Virus 2
gcggggcugcuggagacgcacugcgcaugcugccccgcaaaagccggccccugggccaugcg

SEQ ID NO: 536645 - RNA, 62 nt, Human Herpes Virus 2
cgcauauggccggggcgcccccgcgccucccgccccgcaaccccgcgccccccgagcagcgg

SEQ ID NO: 536646 - RNA, 64 nt, Human Herpes Virus 1; identical to SEQ ID NO: 535753

SEQ ID NO: 536647 - RNA, 64 nt, Human Herpes Virus 1; identical to SEQ ID NO: 535754

SEQ ID NO: 536648 - RNA, 64 nt, Human Herpes Virus 1; identical to SEQ ID NO: 535755

SEQ ID NO: 536649 - RNA, 64 nt, Human Herpes Virus 1; identical to SEQ ID NO: 535756

SEQ ID NO: 536650 - RNA, 64 nt, Human Herpes Virus 1; identical to SEQ ID NO: 535757

SEQ ID NO: 536651 - RNA, 64 nt, Human Herpes Virus 1; identical to SEQ ID NO: 535758

SEQ ID NO: 536652 - RNA, 64 nt, Human Herpes Virus 1; identical to SEQ ID NO: 535759

SEQ ID NO: 536653 - RNA, 64 nt, Human Herpes Virus 1; identical to SEQ ID NO: 535760

SEQ ID NO: 536654 - RNA, 64 nt, Human Herpes Virus 1; identical to SEQ ID NO: 535761

SEQ ID NO: 536655 - RNA, 64 nt, Human Herpes Virus 1; identical to SEQ ID NO: 535762

SEQ ID NO: 536656 - RNA, 64 nt, Human Herpes Virus 1; identical to SEQ ID NO: 535763

SEQ ID NO: 536657 - RNA, 64 nt, Human Herpes Virus 1; identical to SEQ ID NO: 535764

SEQ ID NO: 536658 - RNA, 64 nt, Human Herpes Virus 1; identical to SEQ ID NO: 535765

SEQ ID NO: 536659 - RNA, 64 nt, Human Herpes Virus 1; identical to SEQ ID NO: 535766

SEQ ID NO: 536660 - RNA, 64 nt, Human Herpes Virus 1; identical to SEQ ID NO: 535767

SEQ ID NO: 536661 - RNA, 64 nt, Human Herpes Virus 1; identical to SEQ ID NO: 535768

SEQ ID NO: 536662 - RNA, 64 nt, Human Herpes Virus 1; identical to SEQ ID NO: 535769

SEQ ID NO: 536663 - RNA, 64 nt, Human Herpes Virus 1; identical to SEQ ID NO: 535770

SEQ ID NO: 536664 - RNA, 64 nt, Human Herpes Virus 1; identical to SEQ ID NO: 535771

SEQ ID NO: 536665 - RNA, 64 nt, Human Herpes Virus 1; identical to SEQ ID NO: 535772

SEQ ID NO: 536666 - RNA, 64 nt, Human Herpes Virus 1; identical to SEQ ID NO: 535773

SEQ ID NO: 536667 - RNA, 64 nt, Human Herpes Virus 1; identical to SEQ ID NO: 535774

SEQ ID NO: 536668 - RNA, 64 nt, Human Herpes Virus 1; identical to SEQ ID NO: 535775

SEQ ID NO: 536669 - RNA, 64 nt, Human Herpes Virus 1; identical to SEQ ID NO: 535776

SEQ ID NO: 536670 - RNA, 64 nt, Human Herpes Virus 1; identical to SEQ ID NO: 535777

SEQ ID NO: 536671 - RNA, 64 nt, Human Herpes Virus 1; identical to SEQ ID NO: 535778

SEQ ID NO: 536672 - RNA, 64 nt, Human Herpes Virus 1; identical to SEQ ID NO: 535779

SEQ ID NO: 536673 - RNA, 64 nt, Human Herpes Virus 1; identical to SEQ ID NO: 535780

SEQ ID NO: 536674 - RNA, 64 nt, Human Herpes Virus 1; identical to SEQ ID NO: 535781

SEQ ID NO: 536675 - RNA, 64 nt, Human Herpes Virus 1; identical to SEQ ID NO: 535782

SEQ ID NO: 536676 - RNA, 64 nt, Human Herpes Virus 1; identical to SEQ ID NO: 535783

SEQ ID NO: 536677 - RNA, 64 nt, Human Herpes Virus 1; identical to SEQ ID NO: 535784

SEQ ID NO: 536678 - RNA, 64 nt, Human Herpes Virus 1; identical to SEQ ID NO: 535785

SEQ ID NO: 536679 - RNA, 64 nt, Human Herpes Virus 1; identical to SEQ ID NO: 535786

SEQ ID NO: 536680 - RNA, 64 nt, Human Herpes Virus 1; identical to SEQ ID NO: 535757

SEQ ID NO: 536681 - RNA, 64 nt, Human Herpes Virus 1; identical to SEQ ID NO: 535756

SEQ ID NO: 536682 - RNA, 64 nt, Human Herpes Virus 1; identical to SEQ ID NO: 535755

SEQ ID NO: 536683 - RNA, 64 nt, Human Herpes Virus 1; identical to SEQ ID NO: 535754

SEQ ID NO: 536684 - RNA, 64 nt, Human Herpes Virus 1; identical to SEQ ID NO: 535753

SEQ ID NO: 536685 - RNA, 64 nt, Human Herpes Virus 1; identical to SEQ ID NO: 535773

SEQ ID NO: 536686 - RNA, 64 nt, Human Herpes Virus 1; identical to SEQ ID NO: 535772

SEQ ID NO: 536687 - RNA, 64 nt, Human Herpes Virus 1; identical to SEQ ID NO: 535771

SEQ ID NO: 536688 - RNA, 64 nt, Human Herpes Virus 1; identical to SEQ ID NO: 535770

SEQ ID NO: 536689 - RNA, 64 nt, Human Herpes Virus 1; identical to SEQ ID NO: 535769

SEQ ID NO: 536690 - RNA, 64 nt, Human Herpes Virus 1; identical to SEQ ID NO: 535768

SEQ ID NO: 536691 - RNA, 64 nt, Human Herpes Virus 1; identical to SEQ ID NO: 535767

SEQ ID NO: 536692 - RNA, 64 nt, Human Herpes Virus 2
cgcacgccugggggaugcucaacgacaugcaguggcucgccagcagcgacucggaggaggagac

SEQ ID NO: 536693 - RNA, 64 nt, Human Herpes Virus 2
ucuuccggggaucgcgcacgcgcaccggcgcucugcucgccaggcccagaugcggagcggagcc

SEQ ID NO: 536694 - RNA, 64 nt, Human Herpes Virus 2
acgcacccacacggacccgcggacgcuccccccggcucgccagcccccccaccccccgaacauc

SEQ ID NO: 536695 - RNA, 64 nt, Human Herpes Virus 2
ucguggaugcggcgugcaugcgcgccccggaaccgcucgccauagcauacagucccccguuccc

SEQ ID NO: 536696 - RNA, 64 nt, Human Herpes Virus 2
uccggcgaaacagccgccuggccuucgacgauacgcucgccaaguuaugggccucgcguucucc

SEQ ID NO: 536697 - RNA, 64 nt, Human Herpes Virus 2
auaacaccguccccgagagccugaucguagacgggcucgccagcgacccgcacuacgacuacau

SEQ ID NO: 536698 - RNA, 64 nt, Human Herpes Virus 2
acgaggcgcugggcgacaccgcggcgcgccgccugcucgccaccagcgggcugaacgccgugcu

SEQ ID NO: 536699 - RNA, 64 nt, Human Herpes Virus 2; identical to SEQ ID NO: 536692

SEQ ID NO: 536700 - RNA, 64 nt, Human Herpes Virus 2
cucggcggcacaggccuccgucagggccguggccagcucggaggacagccgcggggggcgggcg

SEQ ID NO: 536701 - RNA, 64 nt, Human Herpes Virus 1
gaaacuaccccagggguguuccggacucaaccgccgaacccaggaacccgccgcuccugguguu

SEQ ID NO: 536702 - RNA, 64 nt, Human Herpes Virus 1
aggccggcgccgacacgcggcgcuuuaucuuccacgaacccagcgaccucgccgaagagaacgu

SEQ ID NO: 536703 - RNA, 64 nt, Human Herpes Virus 1
cggacgcacacccaccaccgccccccgggccccccgaacccagcggguggcgacuaaggccccc

SEQ ID NO: 536704 - RNA, 64 nt, Human Herpes Virus 1
uugggguuguugaagcggaggcggggcggccgaggggccggacgggcccccuugucaacagacc

SEQ ID NO: 536705 - RNA, 64 nt, Human Herpes Virus 1
gguucgucaccuucggcugguaccgucucaaaccgggccggaacaacacgcuagcccagccggc

SEQ ID NO: 536706 - RNA, 64 nt, Human Herpes Virus 1
cgcccgcgacccagggaauguauuacuuggccuggggccggauggacagcccgcacgaguacgg

SEQ ID NO: 536707 - RNA, 64 nt, Human Herpes Virus 1
cgcgcagagucccuucugguuucuuagcaaauucgggccggacgaaaaaagccuggugcucacc

SEQ ID NO: 536708 - RNA, 64 nt, Human Herpes Virus 1
cugccugcuggcggcccuggccaaccggcugugcgggccggacacggccgccugggcgggcaau

SEQ ID NO: 536709 - RNA, 64 nt, Human Herpes Virus 1
ggucccccggggaccuugccccggccggauucccgggccggagcucgcggcacgcgcgauagag

SEQ ID NO: 536710 - RNA, 64 nt, Human Herpes Virus 1
ggcugcgggacgagguggugacucacgcgcucgcgggccggacguuugacacccuggggggccu

SEQ ID NO: 536711 - RNA, 64 nt, Human Herpes Virus 1
gcaguacgaggaggacgacuacccggaagccgucgggccggaggacggcggcggggcccguucc

SEQ ID NO: 536712 - RNA, 64 nt, Human Herpes Virus 1
gcgcgggcgccuccgccacccgcuggguccggaggggccggacgcacacccaccaccgcccccc

SEQ ID NO: 536713 - RNA, 64 nt, Human Herpes Virus 1; identical to SEQ ID NO: 536704

SEQ ID NO: 536714 - RNA, 64 nt, Human Herpes Virus 1; identical to SEQ ID NO: 536708

SEQ ID NO: 536715 - RNA, 64 nt, Human Herpes Virus 2
uggccaucaacgccgacuacggcaucagcuccaaacucgcgaugaccaucacgcgcucccaggg

SEQ ID NO: 536716 - RNA, 64 nt, Human Herpes Virus 2
guacauggccaagcuccacgccuaccuaaaggugacucgcgagggggaguuuguuguguuuacc

SEQ ID NO: 536717 - RNA, 64 nt, Human Herpes Virus 1
gcgggggccgaggaagugugcccggaagacgcgccacgcggagacuuccggggccguccccgcg

SEQ ID NO: 536718 - RNA, 64 nt, Human Herpes Virus 1
caccuacuuucuggccgccgugcuccucggggaccacgcggagcaggucaacacguuccugcgu

SEQ ID NO: 536719 - RNA, 64 nt, Human Herpes Virus 1
ggcagggagacgaacaaccccccggcgcuggacgcacgcggaaggaggccagggugugccggca

SEQ ID NO: 536720 - RNA, 64 nt, Human Herpes Virus 1
caccacggucgugcagccaucccuccgcaugcuccacgcggacgccgggcccgcggccugcuau

SEQ ID NO: 536721 - RNA, 64 nt, Human Herpes Virus 1
ggccaucaacgggugggugugcgggacgcgccuucacgcggaggcgcgcgggucugaccuggac

SEQ ID NO: 536722 - RNA, 64 nt, Human Herpes Virus 1; identical to SEQ ID NO: 536717

SEQ ID NO: 536723 - RNA, 64 nt, Human Herpes Virus 1; identical to SEQ ID NO: 536717

SEQ ID NO: 536724 - RNA, 64 nt, Human Herpes Virus 1; identical to SEQ ID NO: 536718

SEQ ID NO: 536725 - RNA, 64 nt, Human Herpes Virus 1; identical to SEQ ID NO: 536719

SEQ ID NO: 536726 - RNA, 64 nt, Human Herpes Virus 1; identical to SEQ ID NO: 536720

SEQ ID NO: 536727 - RNA, 64 nt, Human Herpes Virus 1; identical to SEQ ID NO: 536721

SEQ ID NO: 536728 - RNA, 64 nt, Human Herpes Virus 1; identical to SEQ ID NO: 536717

SEQ ID NO: 536729 - RNA, 64 nt, Human Herpes Virus 2
ggcgaacagccccccgagcgagggcggggggaaggcgccggaggccccgcacgccgcgccugcc

SEQ ID NO: 536730 - RNA, 64 nt, Human Herpes Virus 2
ccgaucccggucgcccgggagaacgccgaggggugcgccggaccagggcuggggcgucgaacgc

SEQ ID NO: 536731 - RNA, 64 nt, Human Herpes Virus 2
gcgggcgguggcgcgccugcgguuucgggagugcgcgccggaggacgccgugccccaacgcaac

SEQ ID NO: 536732 - RNA, 64 nt, Human Herpes Virus 2
cccuccaggccgccgagcugcccgucgacaucgagcgccggauacgcccgaucgagcagcaggu

SEQ ID NO: 536733 - RNA, 64 nt, Human Herpes Virus 2
aaaauuuaaaauauggggggcggagucugccccugcgccggagcgcggguauaaaaccggcgcc

SEQ ID NO: 536734 - RNA, 64 nt, Human Herpes Virus 2
agguacuaccuacuccaggcuccgcgcuuggggggcgccggagccacguacgaucugcaggccg

SEQ ID NO: 536735 - RNA, 64 nt, Human Herpes Virus 2
cgccucgggcgcgggcgacgccauggcgcccggcgcgccggacuucugcgaggacgaggcgcac

SEQ ID NO: 536736 - RNA, 64 nt, Human Herpes Virus 2
guugcggucccgggccuggguaacauucgcggccgcgccggaccgcgaggggcuuacguucccg

SEQ ID NO: 536737 - RNA, 64 nt, Human Herpes Virus 2
ggcgcgccaggcgccgcgccgaacgacgggcgcggcgccggagcuuuggcccagggggguuguu

SEQ ID NO: 536738 - RNA, 64 nt, Human Herpes Virus 2; identical to SEQ ID NO: 536729

SEQ ID NO: 536739 - RNA, 64 nt, Human Herpes Virus 2; identical to SEQ ID NO: 536735

SEQ ID NO: 536740 - RNA, 64 nt, Human Herpes Virus 1
cgcgcccccuggggcgcugacccccaacgacgauaccgaacaggcccuggacaagauccugcgg

SEQ ID NO: 536741 - RNA, 64 nt, Human Herpes Virus 1
ggccacccccccggaggaaacccccgacccaaccaccgaacagcucgcggaggagccagugguc

SEQ ID NO: 536742 - RNA, 64 nt, Human Herpes Virus 1
guccccguuuuacggcuaccgggaggggucgcacaccgaacacaccagcuacgccgccgaccgc

SEQ ID NO: 536743 - RNA, 64 nt, Human Herpes Virus 1
cccaaccuaugccacugucguggccguucguucgaccgaacagccguccggggcuuuggcgccc

SEQ ID NO: 536744 - RNA, 64 nt, Human Herpes Virus 1
agcgcgggaaagcguagcagcagcuccgccugcccagcgggagacagcuggugggggcgcacga

SEQ ID NO: 536745 - RNA, 64 nt, Human Herpes Virus 1
agggcgaggacgaaagucucgccggcacucccgccagcgggaccccccggcucccgccuccccc

SEQ ID NO: 536746 - RNA, 64 nt, Human Herpes Virus 1
gcagccguucuuggcuggcguccccucggcggugcagcgggaacgcgcccgccggagccuucug

SEQ ID NO: 536747 - RNA, 64 nt, Human Herpes Virus 1
uccaggccgcgacgcgcgcgcggggcugcgagcccagcgggacugcgggccacgagggcagguu

SEQ ID NO: 536748 - RNA, 64 nt, Human Hepatitis C Virus (M1LE)
cgcgcgacuaggaagacuuccgagcggucgcaaccucguggaaggcgacaaccuauccccaagg

SEQ ID NO: 536749 - RNA, 64 nt, Human Herpes Virus 2
gccgcggcggagacgaccggcggccccggaucuccggauccagccgacggaccgccgcccaccc

SEQ ID NO: 536750 - RNA, 64 nt, Human Herpes Virus 2
gcccacccgacacaccgcagggcuggaggacgugcggauccagggaugaugugugggcagcagc

SEQ ID NO: 536751 - RNA, 64 nt, Human Herpes Virus 2
ucuacggggccagcgagacuagccgcuucuccaucggauccagggagcggcgcguggccaucac

SEQ ID NO: 536752 - RNA, 64 nt, Human Herpes Virus 2
cgggcacuacgccggcuacgugaaaacguuccggcggauccagggcgccagcgagcacacgcac

SEQ ID NO: 536753 - RNA, 64 nt, Human Herpes Virus 2; identical to SEQ ID NO: 536749

SEQ ID NO: 536754 - RNA, 64 nt, Human Herpes Virus 4 (Epstein Barr virus)
ggaggccaggcagaagcagaagcaccccaagaaagugaagcaggccuuuaacccccucauuuaa

SEQ ID NO: 536755 - RNA, 64 nt, Human Herpes Virus 4 (Epstein Barr virus)
gccacccgacgugcccgcucccgcucccggggacgugaagcaaagaaagugcaaauuucugauu

SEQ ID NO: 536756 - RNA, 64 nt, Human Herpes Virus 4 (Epstein Barr virus)
ucgagggcauggcccagaacaccugcgcgacuuugugaagcaggagguuggcucuggccacguu

SEQ ID NO: 536757 - RNA, 64 nt, Human Herpes Virus 4 (Epstein Barr virus)
aaacaaggugguggagacccugagcagcucauaugugaagcagccccucugucucuuggcagca

SEQ ID NO: 536758 - RNA, 64 nt, Human Herpes Virus 4 (Epstein Barr virus)
cugcuuccuuccuaacacgcgagacuacaacuuugugaagcaacucuucuacaucaccugugcc

SEQ ID NO: 536759 - RNA, 64 nt, Human Herpes Virus 2
cccgugggccgugcgccgccccccgacccucugggggggcgagggaggcagggaggagcccgag

SEQ ID NO: 536760 - RNA, 64 nt, Human Herpes Virus 2
gcccgugggugaggaggaagcggaagcgggaggggggggcgacgugugugccgugugcacggac

SEQ ID NO: 536761 - RNA, 64 nt, Human Herpes Virus 2
cccgaagagcgccccggcgcgggggcggcggugcgggggcgacccgcggaaccucccagcccgc

SEQ ID NO: 536762 - RNA, 64 nt, Human Herpes Virus 2
ccuggugccggcgcaacucagggggcgugacuuugggggcgaccacacggccaagcuggaguuc

SEQ ID NO: 536763 - RNA, 64 nt, Human Herpes Virus 2
ccucgacaucaccaagcgggcccuggcggcgcacgggggcgaagacgcgcgaaacgaguuccac

SEQ ID NO: 536764 - RNA, 64 nt, Human Herpes Virus 2
cggcguuugccgccuacgugccggcggaugcggugggggcgauccuagcccccgucaucccggc

SEQ ID NO: 536765 - RNA, 64 nt, Human Herpes Virus 2
cuacucgcuggucucguacaucgugaccuaccucgggggcgaccuccccgaggagugcauggcc

SEQ ID NO: 536766 - RNA, 64 nt, Human Herpes Virus 2
agcuucccggcggcgaaguccccccggccgguccgggggcgauccaggccaccuggcgcguggu

SEQ ID NO: 536767 - RNA, 64 nt, Human Herpes Virus 2
cgcaacccgggcccucaucgggacccuggccuccgggggcgaugacggggcgggggcgggggcg

SEQ ID NO: 536768 - RNA, 64 nt, Human Herpes Virus 2
cgggccagcacguggccguggagcggucguccccgggggcgacccccgccgcgcgcguuacggc

SEQ ID NO: 536769 - RNA, 64 nt, Human Herpes Virus 2
agauccagcagcucuuugggugcauugcccuugcgggggcgaacguguucgggcucgcgcggga

SEQ ID NO: 536770 - RNA, 64 nt, Human Herpes Virus 2; identical to SEQ ID NO: 536761

SEQ ID NO: 536771 - RNA, 64 nt, Human Herpes Virus 2; identical to SEQ ID NO: 536760

SEQ ID NO: 536772 - RNA, 64 nt, Human Herpes Virus 2; identical to SEQ ID NO: 536759

SEQ ID NO: 536773 - RNA, 64 nt, Human Herpes Virus 2
cacggagggggggcccuccccggccggccgggagaacccggaauccgcguccggcggggcuauc

SEQ ID NO: 536774 - RNA, 64 nt, Human Herpes Virus 2
uccggauccagccgacggaccgccgcccaccccgaacccggaccgucgccccgccgcgcggccc

SEQ ID NO: 536775 - RNA, 64 nt, Human Herpes Virus 2; identical to SEQ ID NO: 536774

SEQ ID NO: 536776 - RNA, 64 nt, Human Herpes Virus 4 (Epstein Barr virus)
ggaggucuucucugacaaauucuacgaugaggaauucuuccagaugcaccgggaugagcuggag

SEQ ID NO: 536777 - RNA, 64 nt, Human Herpes Virus 4 (Epstein Barr virus)
acccaagacguugggggucucggguaggccaugauucuuccaggcauagguuacaaccagucac

SEQ ID NO: 536778 - RNA, 64 nt, Human Herpes Virus 4 (Epstein Barr virus)
aggcuccccucgaggccgccccaccggcuucaucuucuuccaggggcucauggcccuaccggaa

SEQ ID NO: 536779 - RNA, 64 nt, Human Herpes Virus 4 (Epstein Barr virus)
cgaguucccaucggagcuggacaugcucuacgccuucuuccagcucaucagagaccucagcgug

SEQ ID NO: 536780 - RNA, 64 nt, Human Herpes Virus 4 (Epstein Barr virus)
ucuuccgugccucgggccucaacguccgugagagccuacccaugaccaacaugagggcaccgau

SEQ ID NO: 536781 - RNA, 64 nt, Human Herpes Virus 4 (Epstein Barr virus)
ccucuggagaccugcuauguggcuagacguauggccuacccaagacguugggggucucggguag

SEQ ID NO: 536782 - RNA, 64 nt, Human Herpes Virus 4 (Epstein Barr virus)
uccuaucuuccagccaacgcggaagaaggcauagccuacccaccacucguccacaccuacgagu

SEQ ID NO: 536783 - RNA, 64 nt, Human Herpes Virus 4 (Epstein Barr virus)
ggcuguuggacuuggccaucaugucaguuaucaggcaguugacgguaguucuuguucuguaagu

SEQ ID NO: 536784 - RNA, 64 nt, Human Herpes Virus 1
ucaggauguccucgcccccgggcccguggggcgcuggggccacaaagcggcccccgccgggggg

SEQ ID NO: 536785 - RNA, 64 nt, Human Herpes Virus 1
gccaggccggcagaccgagcggcugggcgaggccuggggccagcugauggaggcgaccgcccug

SEQ ID NO: 536786 - RNA, 64 nt, Human Herpes Virus 1
cccccgguauacgacgacgcagccgggaugagauuggggccacgggauuuaccgcggaagagcu

SEQ ID NO: 536787 - RNA, 64 nt, Human Herpes Virus 1
gugugugguguacgucaacgaccauauucacgccuggggccacauuaccaucagcaccgcggcg

SEQ ID NO: 536788 - RNA, 64 nt, Human Herpes Virus 1
ucacucgcucaccccccucggggacgugaccacguggggccaauaccgcgugguuauauacacg

SEQ ID NO: 536789 - RNA, 61 nt, Human Herpes Virus 1
cccgucgccgccgcggcggcgccgcccgggggucugcgagcagaccgaaaaggucacacuc

SEQ ID NO: 536790 - RNA, 61 nt, Human Herpes Virus 1
agacacgcaccgccaggaguguucgagucgugucugcgaguugacggccagucacaucguc

SEQ ID NO: 536791 - RNA, 61 nt, Human Herpes Virus 1
ggaggccguccccuccacagccccacgcagggucugcgagcaauaccugcccggggaaagc

SEQ ID NO: 536792 - RNA, 61 nt, Human Herpes Virus 1
acuccuuggcaucaccaccauccgcgugacggucugcgagggcaaaaaccugcuucagcgc

SEQ ID NO: 536793 - RNA, 64 nt, Human Herpes Virus 1
ggaagccacugugguccuccgggacguuuucuggauggccgacauuuccccaggcgcuuuugcg

SEQ ID NO: 536794 - RNA, 64 nt, Human Herpes Virus 1
cagcaaauaugccuugguggaugccucucucaagauggccgaccccaaucgcuuucgcggcaaa

SEQ ID NO: 536795 - RNA, 64 nt, Human Herpes Virus 1
caaaucuucgggggugccgacgcaggcgucgguaauggccgacgcaggcgcccccggcgagcgu

SEQ ID NO: 536796 - RNA, 64 nt, Human Herpes Virus 1
cgccaugcucacgcugcaggugcuggcccacaacauggccgaacgcacaacggcgcugcucugc

SEQ ID NO: 536797 - RNA, 64 nt, Human Herpes Virus 1
gcaggagacguaccgcgcggcgaccgagcgcgucauggccgaacucgagacccugcaguacgug

SEQ ID NO: 536798 - RNA, 64 nt, Human Herpes Virus 1
gcgcggccccgccggccaauccuuccuagcggccauggccgacacuucuggagcgcucgcaggc

SEQ ID NO: 536799 - RNA, 64 nt, Human Herpes Virus 1
aaggcaaaacccccgucgggcagaggccacgcgcauggccgagggagccuguccucgccucggc

SEQ ID NO: 536800 - RNA, 64 nt, Human Herpes Virus 1
ggccgcccggggcggccucggccccacuaugcagauggccgacaacauagagcagcugcuccgg

SEQ ID NO: 536801 - RNA, 64 nt, Human Herpes Virus 1
cccccacgacuccgcccccuacggcgcucuggauauggccgacuucgaguuugagcagauguuu

SEQ ID NO: 536802 - RNA, 64 nt, Human Herpes Virus 1
cgcggaugugcucgucucccaggcuauucggagcauggccgagagugacguggucauggaggau

SEQ ID NO: 536803 - RNA, 64 nt, Human Herpes Virus 1
aggccccccagauuguccgcggggccuccgaagacguccggaaacaacccuacaaccugaccau

SEQ ID NO: 536804 - RNA, 64 nt, Human Herpes Virus 1
agcuggcucugcuggccuccaugguagaggaggccguccggacgaucccgacgcccgaccccgc

SEQ ID NO: 536805 - RNA, 64 nt, Human Herpes Virus 1; identical to SEQ ID NO: 536804

SEQ ID NO: 536806 - RNA, 64 nt, Human Herpes Virus 4 (Epstein Barr virus)
acuuuaauuuuuucugcuaagcccaacacuccaccacacccaggcacacacuacacacacccac

SEQ ID NO: 536807 - RNA, 64 nt, Human Herpes Virus 4 (Epstein Barr virus)
cccaacacuccaccacacccaggcacacacuacacacacccacccgucucaggguccccucgga

SEQ ID NO: 536808 - RNA, 64 nt, Human Herpes Virus 4 (Epstein Barr virus); identical to SEQ ID NO: 536806

SEQ ID NO: 536809 - RNA, 64 nt, Human Herpes Virus 4 (Epstein Barr virus); identical to SEQ ID NO: 536807

SEQ ID NO: 536810 - RNA, 64 nt, Human Herpes Virus 4 (Epstein Barr virus); identical to SEQ ID NO: 536806

SEQ ID NO: 536811 - RNA, 64 nt, Human Herpes Virus 4 (Epstein Barr virus); identical to SEQ ID NO: 536807

SEQ ID NO: 536812 - RNA, 64 nt, Human Herpes Virus 4 (Epstein Barr virus)
cugggcaccauggucucaagauccugugcaugggcacacccaggguccaugggaucccagggca

SEQ ID NO: 536813 - RNA, 64 nt, Human Herpes Virus 4 (Epstein Barr virus)
gcugccgucccagggccggaaccugagccugagccacacccaccuaugccaauccaugccaaug

SEQ ID NO: 536814 - RNA, 64 nt, Human Herpes Virus 4 (Epstein Barr virus)
caggguggcggccaucacuacugacauggguauccacacccaagacuucuuuagcgucuuuccg

SEQ ID NO: 536815 - RNA, 64 nt, Human Herpes Virus 4 (Epstein Barr virus)
acccggcccgggccccccgguaucgggccagagguaaguggacuuuaauuuuuucugcuaagcc

SEQ ID NO: 536816 - RNA, 64 nt, Human Herpes Virus 4 (Epstein Barr virus); identical to SEQ ID NO: 536815

SEQ ID NO: 536817 - RNA, 64 nt, Human Herpes Virus 4 (Epstein Barr virus); identical to SEQ ID NO: 536815

SEQ ID NO: 536818 - RNA, 64 nt, Human Herpes Virus 2
cgucguggguggcgcuguggcccccccgacgggugcucgagacggucguggaugcggcgugcau

SEQ ID NO: 536819 - RNA, 64 nt, Human Herpes Virus 2
gccucgggcgcugcgugcgcgagcagcgcggggagcucgagaagaugcugcgggucagcgucca

SEQ ID NO: 536820 - RNA, 64 nt, Human Herpes Virus 2
cagggggaucgcgauaucguucgucgccguccgugcucgagacgcgcgaccgaucuggagccgg

SEQ ID NO: 536821 - RNA, 63 nt, Human Herpes Virus 2
cccauguuuuccgcggccccgcgggagauccgcguccuccacagccugggcggggacuauguc

SEQ ID NO: 536822 - RNA, 64 nt, Human Herpes Virus 1
ccggggccguccccgcgggcggccucacgcgcuaccugcccaucucgggggucucuagcguggu

SEQ ID NO: 536823 - RNA, 64 nt, Human Herpes Virus 1
cgccuuacgugaacaagacuaucacgggggacugccugcccauccuggacauggagacggggaa

SEQ ID NO: 536824 - RNA, 64 nt, Human Herpes Virus 1
accucgagcgcgggaaagcguagcagcagcuccgccugcccagcgggagacagcuggugggggc

SEQ ID NO: 536825 - RNA, 64 nt, Human Herpes Virus 1
ccgaaucccaccugaacgagcuggcggccaggggccugcccacgcccgugguucuggaauucga

SEQ ID NO: 536826 - RNA, 64 nt, Human Herpes Virus 1
gcgaccaccccgggcuggcuacgguccgguccacccugcccauuucguacgacuacagcgagua

SEQ ID NO: 536827 - RNA, 64 nt, Human Herpes Virus 1
aguucgguaaccucaugaaggugcuggaguacggccugcccaucaccgaggagcacaugcaguu

SEQ ID NO: 536828 - RNA, 64 nt, Human Herpes Virus 1; identical to SEQ ID NO: 536823

SEQ ID NO: 536829 - RNA, 64 nt, Human Herpes Virus 1; identical to SEQ ID NO: 536822

SEQ ID NO: 536830 - RNA, 64 nt, Human Herpes Virus 1; identical to SEQ ID NO: 536822

SEQ ID NO: 536831 - RNA, 64 nt, Human Herpes Virus 1; identical to SEQ ID NO: 536823

SEQ ID NO: 536832 - RNA, 64 nt, Human Herpes Virus 1; identical to SEQ ID NO: 536824

SEQ ID NO: 536833 - RNA, 64 nt, Human Herpes Virus 1; identical to SEQ ID NO: 536825

SEQ ID NO: 536834 - RNA, 64 nt, Human Herpes Virus 1; identical to SEQ ID NO: 536826

SEQ ID NO: 536835 - RNA, 64 nt, Human Herpes Virus 1; identical to SEQ ID NO: 536827

SEQ ID NO: 536836 - RNA, 64 nt, Human Herpes Virus 1; identical to SEQ ID NO: 536823

SEQ ID NO: 536837 - RNA, 64 nt, Human Herpes Virus 1; identical to SEQ ID NO: 536822

SEQ ID NO: 536838 - RNA, 64 nt, Human Herpes Virus 4 (Epstein Barr virus)
ccuuguggccucaaacacugacauugcggaggccauccucgaugccauccucucgcggccugac

SEQ ID NO: 536839 - RNA, 64 nt, Human Herpes Virus 4 (Epstein Barr virus)
agccuucagccaccauuuuaccagggacgaggacauccucgacaauuuggagaaugggacgcuc

SEQ ID NO: 536840 - RNA, 64 nt, Human Herpes Virus 4 (Epstein Barr virus)
gcuggcggccugcgaggauccgcgccaaaggaccauccucgacaagcagcagcuggccaucaag

SEQ ID NO: 536841 - RNA, 64 nt, Human Herpes Virus 2
gggaacggccgccgccauccucaaacaggccaucgccggggaccgcagucuggucgagguggcg

SEQ ID NO: 536842 - RNA, 64 nt, Human Herpes Virus 2
ggucaucauccauggcccagcaguauaugcggccgccggggaggugccaccaggcccccggacc

SEQ ID NO: 536843 - RNA, 64 nt, Human Herpes Virus 2
ggcggcggugguggcgggccucgggacaaccgccgccggggacagcuuuuccaaggccuguccc

SEQ ID NO: 536844 - RNA, 64 nt, Human Herpes Virus 2
ggagguucugggccgcuacgaugugcggcccgacgccggggagaccguggagggguucgcguca

SEQ ID NO: 536845 - RNA, 64 nt, Human Herpes Virus 2
aggcaccaucgauacaaacgcccccgagguccuggccggggauccguacacccagguaaucgac

SEQ ID NO: 536846 - RNA, 64 nt, Human Herpes Virus 2
cgaacaucgcggcggacccgaggaguuugagggcgccggggacggcgaaccccccgaggacgac

SEQ ID NO: 536847 - RNA, 64 nt, Human Herpes Virus 2
cgaucgcccugaucaucacccccguccgcgucgagccggggaucuaccgggacauccggcgaaa

SEQ ID NO: 536848 - RNA, 64 nt, Human Herpes Virus 2
gcgaggacguccucaacgacgugcucacccucgugccggggaccgccaagccgcgaucgcuggu

SEQ ID NO: 536849 - RNA, 64 nt, Human Herpes Virus 2
guucaacccggccauggagcgcuucgccgcgcacgccggggaccuggugcccgcccccggccac

SEQ ID NO: 536850 - RNA, 64 nt, Human Herpes Virus 2
ccucgugggggccguguuucugcgcuacaccccggccggggaggucaugucggugcugcuggug

SEQ ID NO: 536851 - RNA, 64 nt, Human Herpes Virus 2
cacgcagcaccgucuggaccgcggcgagauaucggccggggaggcggcggugguaaugaccagc

SEQ ID NO: 536852 - RNA, 64 nt, Human Herpes Virus 2
ugaucgugcagaacucgaugcgcgucagcucgcggccggggacgugcuacagccgcccccuggu

SEQ ID NO: 536853 - RNA, 64 nt, Human Herpes Virus 2
cgaggcggaggcccuggucagccagcucggcgccgccggggagguguuuaacuuuggggauuuc

SEQ ID NO: 536854 - RNA, 64 nt, Human Herpes Virus 2
gccacgacugucgguuucacacgccgaagggacggccggggaccaugguccaguugcuggaauc

SEQ ID NO: 536855 - RNA, 64 nt, Human Herpes Virus 1
cgagagguacuucuacaccucccagugucccgacauuaaccaccugcgcucccucagcauccuu

SEQ ID NO: 536856 - RNA, 64 nt, Human Herpes Virus 1
cgacgaucccaucuaugacaccguugggggguacgaccccgagcccgccgaggaccccguguac

SEQ ID NO: 536857 - RNA, 64 nt, Human Herpes Virus 1
ggcggaccuggcgauccagauuccaaagugccccgaccccgagagguacuucuacaccucccag

SEQ ID NO: 536858 - RNA, 64 nt, Human Herpes Virus 1
ugcgguucagcuccuguuucccgcggcccgcguggaccccgacgcauaucccuguuauuuuuuc

SEQ ID NO: 536859 - RNA, 64 nt, Human Herpes Virus 1
cacggggacggaaacggaugcgucggugucggacgaccccgacgacacguccgacuggucuuau

SEQ ID NO: 536860 - RNA, 64 nt, Human Herpes Virus 1
ugggggcggugcuguuugcggguuggcacaaaaagaccccgauccgcgucugugguguuuuugg

SEQ ID NO: 536861 - RNA, 64 nt, Human Herpes Virus 1
ccccaacgccacgcagccagaacucgccccggaagaccccgaggauucggcccucuuggaggac

SEQ ID NO: 536862 - RNA, 64 nt, Human Herpes Virus 1
cggguggggcgcggagacggaggagggcggggacgaccccgaccacgaccccgaccacccccac

SEQ ID NO: 536863 - RNA, 64 nt, Human Herpes Virus 1
ggagacggaggagggcggggacgaccccgaccacgaccccgaccacccccacgaccucgacgac

SEQ ID NO: 536864 - RNA, 64 nt, Human Herpes Virus 1
guccgccgcgcccgccucccccgcggggggcgacgaccccgacgccgcccgccacgccgacgcc

SEQ ID NO: 536865 - RNA, 64 nt, Human Herpes Virus 1
gcgccgcauggcggccuggaugcgccagauccccgaccccgaggacgugcgcgugguggugcug

SEQ ID NO: 536866 - RNA, 64 nt, Human Herpes Virus 1
uucccgggccuggguaacguuuucggccgucccugaccccgaggcccugacguucccgcgggga

SEQ ID NO: 536867 - RNA, 64 nt, Human Herpes Virus 1
cuguaucguacccgucgucgaccagcucgaggcugaccccgagacgcagcccggggacgggggc

SEQ ID NO: 536868 - RNA, 64 nt, Human Herpes Virus 1; identical to SEQ ID NO: 536865

SEQ ID NO: 536869 - RNA, 64 nt, Human Herpes Virus 1; identical to SEQ ID NO: 536864

SEQ ID NO: 536870 - RNA, 64 nt, Human Herpes Virus 1; identical to SEQ ID NO: 536863

SEQ ID NO: 536871 - RNA, 64 nt, Human Herpes Virus 1; identical to SEQ ID NO: 536862

SEQ ID NO: 536872 - RNA, 64 nt, Human Herpes Virus 2
guucgucaaggugucggcgugguugggggucguggcccgccacgcgucucccuucgagcgcguc

SEQ ID NO: 536873 - RNA, 64 nt, Human Herpes Virus 2
ggcuggcaaagcgccccccgccgggcggcuccaggcccgccagcaccgccuccgcguccgacgc

SEQ ID NO: 536874 - RNA, 64 nt, Human Herpes Virus 2
gucgacgaggcgcgugguggauaugucgucgggcgcccgccaggcggcgcucgugcgccucacc

SEQ ID NO: 536875 - RNA, 64 nt, Human Herpes Virus 2
uccggagcgcccgggccgggggucgccgccucgggcccgccagcgccgcccggacggggaccgg

SEQ ID NO: 536876 - RNA, 64 nt, Human Herpes Virus 2
ggcccugcggcaccccaccgaccucccccaccuggcccgccaucgggcuccgcccggccggcag

SEQ ID NO: 536877 - RNA, 64 nt, Human Herpes Virus 2
gccugcuggcggcccugggcaaccggcucugcgggcccgccacggccgccugggcgggcaacug

SEQ ID NO: 536878 - RNA, 64 nt, Human Herpes Virus 2
cccgcguccccggcccucucugaggccucauccggcccgccaacccccgacauuccccucucgc

SEQ ID NO: 536879 - RNA, 64 nt, Human Herpes Virus 2
ugaccuggggucgcucugucccccgggcagccgggcccgccauuuaggauggcugcuauccagg

SEQ ID NO: 536880 - RNA, 64 nt, Human Herpes Virus 2
gucggaggcguacuuucugggccagcuccagguggcccgccacgaaacgggcgggggggucaac

SEQ ID NO: 536881 - RNA, 64 nt, Human Herpes Virus 2
gcauguuccacaacgggcgcgucgucgucgacgggcccgccaugcucacgcugcaggugcuggc

SEQ ID NO: 536882 - RNA, 64 nt, Human Herpes Virus 2
cgagcugcgcuucuggcuggcguccggcgaucgcgcccgccacuccaccauggacgccuucgcc

SEQ ID NO: 536883 - RNA, 64 nt, Human Herpes Virus 2
cgccugcgcgcacacgacgcugaugcggcugcgggcccgccaccccaaguucgcgagcgccgcc

SEQ ID NO: 536884 - RNA, 64 nt, Human Herpes Virus 2
cacguguccgggaggcgcgcgaccgggcugggcggcccgccacgcccauaggcgccuccccaua

SEQ ID NO: 536885 - RNA, 64 nt, Human Herpes Virus 2
uucgcgcccacggcgacguggcguuccccacccugcccgccacccgcgacgagcugccuucgua

SEQ ID NO: 536886 - RNA, 64 nt, Human Herpes Virus 2; identical to SEQ ID NO: 536877

SEQ ID NO: 536887 - RNA, 64 nt, Human Herpes Virus 2
acgccggcaacgacgacgcagagugggcgaacagccccccgagcgagggcggggggaaggcgcc

SEQ ID NO: 536888 - RNA, 64 nt, Human Herpes Virus 2
aagcggucgggggacccccgugggccgugcgccgccccccgacccucugggggggcgagggagg

SEQ ID NO: 536889 - RNA, 64 nt, Human Herpes Virus 2
cugucucccucugcaguggacuacgucccgcccgccccccgaagagcgccccggcgcgggggcg

SEQ ID NO: 536890 - RNA, 64 nt, Human Herpes Virus 2
ccugcuccccgagcacgcgcgcaacugcgugaggccccccgacuacccgacgccccccgcgucg

SEQ ID NO: 536891 - RNA, 64 nt, Human Herpes Virus 2
uucguggccccguauuucgaguacgugcuucgcgccccccgagcgggcgcgcucaucaccggcu

SEQ ID NO: 536892 - RNA, 64 nt, Human Herpes Virus 2
cguuccgggccucuagucucgcggagacuacgggccccccgaagaaacgggccaagguggacgu

SEQ ID NO: 536893 - RNA, 64 nt, Human Herpes Virus 2
accgugaggcaccgaaaaaucuuaagccgcucguccccccgaacgacgcgccacacgaagacag

SEQ ID NO: 536894 - RNA, 64 nt, Human Herpes Virus 2
agcccggccgcgggaacgcgccggcccaaccgcgccccccgacggcguucggaaccucgagcga

SEQ ID NO: 536895 - RNA, 64 nt, Human Herpes Virus 2
agauggcgagccacaucucgcgcgcgcuguuccuccccccgaucaagcucgagugcgaaaaaac

SEQ ID NO: 536896 - RNA, 64 nt, Human Herpes Virus 2
gccgcccccuccgcguccccgcggaacgcauccgccccccgaaccacacccacgcccccccaac

SEQ ID NO: 536897 - RNA, 64 nt, Human Herpes Virus 2
gggucgacgugacguuucuggacauccgggccacccccccgacccucaccgagccgagcucccu

SEQ ID NO: 536898 - RNA, 64 nt, Human Herpes Virus 2
gcucgucgcggggacccacgcccuccccuggaucccccccgacaacauccacgaggacggcgca

SEQ ID NO: 536899 - RNA, 64 nt, Human Herpes Virus 2
gccuaccccagagggguuccggacgcgaccgccaccccccgagacccgccgauuuugguguuua

SEQ ID NO: 536900 - RNA, 64 nt, Human Herpes Virus 2
cagcggccauccuccuguuccgggccgcgcagccccccccgacguccggaccugcgacacgggu

SEQ ID NO: 536901 - RNA, 64 nt, Human Herpes Virus 2
acagaccccgagggggucgaccccgacguucgggccccccgaaccgggcggcgccucauggccu

SEQ ID NO: 536902 - RNA, 64 nt, Human Herpes Virus 2
aagcgcggaaccgaccgcccccgcaaccacuacuccccccgacgagauggccacacaagccgca

SEQ ID NO: 536903 - RNA, 64 nt, Human Herpes Virus 2
cgcggacgcuccccccggcucgccagcccccccaccccccgaacaucgcggcggacccgaggag

SEQ ID NO: 536904 - RNA, 64 nt, Human Herpes Virus 2
acccgaggaguuugagggcgccggggacggcgaaccccccgaggacgacgacagcgccaccggc

SEQ ID NO: 536905 - RNA, 64 nt, Human Herpes Virus 2
cccaccccuccacggacaacgacacccccguccuccccccgagacccgacccccgcccccgggg

SEQ ID NO: 536906 - RNA, 64 nt, Human Herpes Virus 2
gguccccugcgcccgucguggguggcgcuguggcccccccgacgggugcucgagacggucgugg

SEQ ID NO: 536907 - RNA, 64 nt, Human Herpes Virus 2
ccccccaaccccccccccgucguccccccgucgcccccccgacgcacccucguguuauccccga

SEQ ID NO: 536908 - RNA, 64 nt, Human Herpes Virus 2
ccccggccagggcgccgccgggcggcgccccgcgccccccgaagaagagccgcgcggacgcccc

SEQ ID NO: 536909 - RNA, 64 nt, Human Herpes Virus 2
caucgaguccgaagaagaggguaacuucuacgugccccccgacgugcgcguggucacccgggcg

SEQ ID NO: 536910 - RNA, 64 nt, Human Herpes Virus 2
agccgccgggcguccggacgcccaagcggccccuccccccgagacggcgccgucuccggagccc

SEQ ID NO: 536911 - RNA, 64 nt, Human Herpes Virus 2
gggagccgcggccccgccgggucaccggggcgccccccccgacgcgcgcgcccccgacccgggg

SEQ ID NO: 536912 - RNA, 64 nt, Human Herpes Virus 2
caaaaagccgcccaagcggcccgaggcgaccccgccccccgacgccaacgcgaccgucgccgcc

SEQ ID NO: 536913 - RNA, 64 nt, Human Herpes Virus 2
uucucaagcagcugaacuacugccaccucaucacccccccgagcggcgccacggccgcgcugga

SEQ ID NO: 536914 - RNA, 64 nt, Human Herpes Virus 2
guccaucgugucgauggcggucuuugacgagccgccccccgacaucaccacguggccccugcuu

SEQ ID NO: 536915 - RNA, 64 nt, Human Herpes Virus 2
gugucguccgacaucgagacucuccgggccuugcccccccgacccgaucucaacccgaucgaaa

SEQ ID NO: 536916 - RNA, 64 nt, Human Herpes Virus 2
cggcccaggcccuggcggcgcccgggccuccgccccccccgaggcugccgagcgccgcuuuggc

SEQ ID NO: 536917 - RNA, 64 nt, Human Herpes Virus 2
cccggcccccuggcgcggcauuuuuggacggaggccccccgaccugauacucggcgccgcgucg

SEQ ID NO: 536918 - RNA, 64 nt, Human Herpes Virus 2
ggcgcccccgcgccucccgccccgcaaccccgcgccccccgagcagcggccggcagccgcggcg

SEQ ID NO: 536919 - RNA, 64 nt, Human Herpes Virus 2
gagcugcaggcggcauucccccuggaccgccugaccccccgagucgccgcgugggacgaguccg

SEQ ID NO: 536920 - RNA, 64 nt, Human Herpes Virus 2; identical to SEQ ID NO: 536890

SEQ ID NO: 536921 - RNA, 64 nt, Human Herpes Virus 2; identical to SEQ ID NO: 536889

SEQ ID NO: 536922 - RNA, 64 nt, Human Herpes Virus 2; identical to SEQ ID NO: 536888

SEQ ID NO: 536923 - RNA, 64 nt, Human Herpes Virus 2; identical to SEQ ID NO: 536887

SEQ ID NO: 536924 - RNA, 64 nt, Human Herpes Virus 2; identical to SEQ ID NO: 536908

SEQ ID NO: 536925 - RNA, 63 nt, Human Herpes Virus 2
gccgccccacauacgcaggacaccgcgugcgugcacggcgagcugcucgcccgaaagcgcgaa

SEQ ID NO: 536926 - RNA, 63 nt, Human Herpes Virus 2
gaccgggacaccagcaugucgcucgccgacuuucacggcgaggaguucgagaagcuguacgag

SEQ ID NO: 536927 - RNA, 63 nt, Human Herpes Virus 2
cacggaguuccgccuccagaucuggcguuaugccacggcgacggacgccgagaucggaacggc

SEQ ID NO: 536928 - RNA, 63 nt, Human Herpes Virus 2
uacgcgggcgagcuaacgcaggugaccaccgagcacggcgacugcgugcacgaggcgcccgcc

SEQ ID NO: 536929 - RNA, 63 nt, Human Herpes Virus 2
gcgucggcgcggacggacggccccggcgccacccacggcgaggcgcggcgcggaggggagcag

SEQ ID NO: 536930 - RNA, 63 nt, Human Herpes Virus 2
gcguaccccuuugacuccugggucagcucaucgcacggcgaaagcguccggagugcgacggcc

SEQ ID NO: 536931 - RNA, 63 nt, Human Herpes Virus 2
cgaggccaucgaggccuggcucguggaccugaccacggcgacgcagccguccguggccgugcc

SEQ ID NO: 536932 - RNA, 63 nt, Human Herpes Virus 2
ggggagcucgagaagaugcugcgggucagcguccacggcgaggugcugcccgcgaccuucgcc

SEQ ID NO: 536933 - RNA, 63 nt, Human Herpes Virus 2
ggggcggccggcgucgcccgaaagcgggcguuucacggcgacgauccguuuggggagggacca

SEQ ID NO: 536934 - RNA, 63 nt, Human Herpes Virus 2
guccccgagcgcuccccgaucgacauucgcgcccacggcgacguggcguuccccacccugccc

SEQ ID NO: 536935 - RNA, 62 nt, Human Herpes Virus 4 (Epstein Barr virus)
aauaggucccagguucaugugccucaggaguuuagcuccacccagcucuccuucuucaacaa

SEQ ID NO: 536936 - RNA, 62 nt, Human Herpes Virus 4 (Epstein Barr virus)
accgaugagauccucucugaaaacauauuguuuagcuccagggccucaacauccauguucau

SEQ ID NO: 536937 - RNA, 64 nt, Human Herpes Virus 2
gggaggcgacacggccaccgcggaggacguguccaucacgcaagagaacgaggagauccucgcg

SEQ ID NO: 536938 - RNA, 64 nt, Human Herpes Virus 2; identical to SEQ ID NO: 535901

SEQ ID NO: 536939 - RNA, 64 nt, Human Herpes Virus 2; identical to SEQ ID NO: 535902

SEQ ID NO: 536940 - RNA, 64 nt, Human Herpes Virus 2; identical to SEQ ID NO: 535903

SEQ ID NO: 536941 - RNA, 64 nt, Human Herpes Virus 2; identical to SEQ ID NO: 535904

SEQ ID NO: 536942 - RNA, 64 nt, Human Herpes Virus 2; identical to SEQ ID NO: 535905

SEQ ID NO: 536943 - RNA, 64 nt, Human Herpes Virus 2; identical to SEQ ID NO: 535906

SEQ ID NO: 536944 - RNA, 64 nt, Human Herpes Virus 2; identical to SEQ ID NO: 535907

SEQ ID NO: 536945 - RNA, 64 nt, Human Herpes Virus 2; identical to SEQ ID NO: 535908

SEQ ID NO: 536946 - RNA, 64 nt, Human Herpes Virus 2; identical to SEQ ID NO: 535909

SEQ ID NO: 536947 - RNA, 64 nt, Human Herpes Virus 2; identical to SEQ ID NO: 535910

SEQ ID NO: 536948 - RNA, 64 nt, Human Herpes Virus 2; identical to SEQ ID NO: 535911

SEQ ID NO: 536949 - RNA, 64 nt, Human Herpes Virus 2; identical to SEQ ID NO: 535912

SEQ ID NO: 536950 - RNA, 64 nt, Human Herpes Virus 2; identical to SEQ ID NO: 535913

SEQ ID NO: 536951 - RNA, 64 nt, Human Herpes Virus 2; identical to SEQ ID NO: 535914

SEQ ID NO: 536952 - RNA, 64 nt, Human Herpes Virus 2; identical to SEQ ID NO: 535915

SEQ ID NO: 536953 - RNA, 64 nt, Human Herpes Virus 2; identical to SEQ ID NO: 535916

SEQ ID NO: 536954 - RNA, 64 nt, Human Herpes Virus 2; identical to SEQ ID NO: 535917

SEQ ID NO: 536955 - RNA, 64 nt, Human Herpes Virus 2; identical to SEQ ID NO: 535918

SEQ ID NO: 536956 - RNA, 64 nt, Human Herpes Virus 2; identical to SEQ ID NO: 535919

SEQ ID NO: 536957 - RNA, 64 nt, Human Herpes Virus 2; identical to SEQ ID NO: 535920

SEQ ID NO: 536958 - RNA, 64 nt, Human Herpes Virus 2; identical to SEQ ID NO: 535921

SEQ ID NO: 536959 - RNA, 64 nt, Human Herpes Virus 2; identical to SEQ ID NO: 535922

SEQ ID NO: 536960 - RNA, 64 nt, Human Herpes Virus 2; identical to SEQ ID NO: 535923

SEQ ID NO: 536961 - RNA, 64 nt, Human Herpes Virus 2; identical to SEQ ID NO: 535924

SEQ ID NO: 536962 - RNA, 64 nt, Human Herpes Virus 2
ucccggguacgccaucgcccggggcguuccgcucaacacggacuauuacuucucgcaccugcug

SEQ ID NO: 536963 - RNA, 64 nt, Human Herpes Virus 2
cggguccacccgaaaacaacgaucgagcggcagcaacacggacccgucaccuucccggacgcga

SEQ ID NO: 536964 - RNA, 64 nt, Human Herpes Virus 2
acguauucgcccuggcccaggcgcaccucccccggcucccgagcucgcuggagccccuggugag

SEQ ID NO: 536965 - RNA, 64 nt, Human Herpes Virus 2
accccagccugcacgugcugcugcggcccacccugcucccgaagcugcuggugcgcgccccguu

SEQ ID NO: 536966 - RNA, 61 nt, Human Herpes Virus 4 (Epstein Barr virus)
ccuaccaaagaacuccaucauuaugcugggccaggaugacuucauuaaguucaaaagcccc

SEQ ID NO: 536967 - RNA, 61 nt, Human Herpes Virus 4 (Epstein Barr virus)
cgcagacgcgccaggcccuguuggucccccgcaggaugaccgcgguggucaacacggaucu

SEQ ID NO: 536968 - RNA, 61 nt, Human Herpes Virus 4 (Epstein Barr virus)
auccagagcugagugcccagggcagacugcacaggaugacagcugucacccaugccucccc

SEQ ID NO: 536969 - RNA, 64 nt, Human Herpes Virus 4 (Epstein Barr virus)
ucuagaucuccaugggcuggaaaaucagagccuagucagagagaaccgaagcggggucuuuugg

SEQ ID NO: 536970 - RNA, 64 nt, Human Herpes Virus 4 (Epstein Barr virus)
cccccaaaaguagaggcucaggccaugcgcgcccugucaccaggccugccaaagagccagaucu

SEQ ID NO: 536971 - RNA, 64 nt, Human Herpes Virus 4 (Epstein Barr virus); identical to SEQ ID NO: 536970

SEQ ID NO: 536972 - RNA, 64 nt, Human Herpes Virus 4 (Epstein Barr virus)
accaugcagacaccaccgagagcgcccacucccaugucaccaccugaggugccacccguucccc

SEQ ID NO: 536973 - RNA, 64 nt, Human Herpes Virus 4 (Epstein Barr virus)
ugcgugcuguugguguauuucuggccaucugucuugucaccauuuucguccucccaacaugggg

SEQ ID NO: 536974 - RNA, 64 nt, Human Herpes Virus 4 (Epstein Barr virus)
aaauaagugccuagcacaucacguaggcaccaggugucaccagggcuacuugccucggcaucuc

SEQ ID NO: 536975 - RNA, 64 nt, Human Herpes Virus 4 (Epstein Barr virus)
uaguugugcccacugguguuuauccggucccaaaugucaccacagaacacagggggcuggauuu

SEQ ID NO: 536976 - RNA, 64 nt, Human Herpes Virus 4 (Epstein Barr virus)
aggaacgcgagcaagcgccgggccagccgggaccugucaccaccgccccacggcagguggcgug

SEQ ID NO: 536977 - RNA, 64 nt, Human Herpes Virus 4 (Epstein Barr virus)
acaguuccacauccacaaaaccgggggagguuaaugucaccaaaggcacgcccccccaaaaugc

SEQ ID NO: 536978 - RNA, 64 nt, Human Herpes Virus 4 (Epstein Barr virus)
cugcaagcacaggccccacuguauccaccgcggaugucaccagcccaacaccagccggcacaac

SEQ ID NO: 536979 - RNA, 64 nt, Human Herpes Virus 4 (Epstein Barr virus)
ccggaacaggaaccuccacgggugugacuagcaaugucaccaccagguccuccuccaccaccag

SEQ ID NO: 536980 - RNA, 64 nt, Human Herpes Virus 4 (Epstein Barr virus)
cagucccaacaacuuccaacgcauccaccaucaaugucaccacuaagguuacugcacagaacau

SEQ ID NO: 536981 - RNA, 64 nt, Human Herpes Virus 1
gguuucuucucgguguuuguguuguaucgugcuuggcgggaacgcccaaaacguccuggagacg

SEQ ID NO: 536982 - RNA, 64 nt, Human Herpes Virus 1
cugggggcggaggcgggcuuggccacgcccccgcggcgggaaguuguggacugggaaggcgccu

SEQ ID NO: 536983 - RNA, 64 nt, Human Herpes Virus 1
acgcggcagccguguaccugcggaacgcggucguggcgggaaaccgccuggggccggcccagcc

SEQ ID NO: 536984 - RNA, 64 nt, Human Herpes Virus 1
gggugcgaugccgcgcuggugcgcgcgcgcuacgggcgggaauucauggggcucgugauaucca

SEQ ID NO: 536985 - RNA, 64 nt, Human Herpes Virus 1; identical to SEQ ID NO: 536982

SEQ ID NO: 536986 - RNA, 64 nt, Human Herpes Virus 4 (Epstein Barr virus)
ggaaaagagcguuucauccuccccccgccacuacuccacggaccuccagacgcuaaagagcguc

SEQ ID NO: 536987 - RNA, 64 nt, Human Herpes Virus 4 (Epstein Barr virus)
ggcgacggaagaggaggaggaggcggugguagcggugaaggaaaagagcguuucauccuccccc

SEQ ID NO: 536988 - RNA, 63 nt, Human Herpes Virus 4 (Epstein Barr virus)
uuggcauguguacuuguccucaucgucgacgcuguuuugcagcugaguccccuccuuggagcu

SEQ ID NO: 536989 - RNA, 63 nt, Human Herpes Virus 4 (Epstein Barr virus)
ggccugcaauuuacuaaccucgggaugccauauguuuugcagaaugcccaccagaucgccugc

SEQ ID NO: 536990 - RNA, 63 nt, Human Herpes Virus 4 (Epstein Barr virus)
guauucggcuuguccgcuauuuuuuuguggcuaguuuugcacccacaacauguaagggcccgc

SEQ ID NO: 536991 - RNA, 63 nt, Human Herpes Virus 4 (Epstein Barr virus)
ggugucuggcccggauuacccucccuuggccguguuuugcauggacugcgguuacugcuugaa

SEQ ID NO: 536992 - RNA, 63 nt, Human Herpes Virus 4 (Epstein Barr virus)
aagauugugcaggcgccuauuuucuacccacccguuuugcagcccauacagguuauggggcaa

SEQ ID NO: 536993 - RNA, 63 nt, Human Herpes Virus 4 (Epstein Barr virus)
cucgccuuguuucucagagagcauuucaggccgguuuugcagucgcugcugcagcuauggggu

SEQ ID NO: 536994 - RNA, 64 nt, Human Herpes Virus 2
ucgggccgugcucagaaugaagggcguccucgccggcgaggaggcccagcgcugcgacaacauc

SEQ ID NO: 536995 - RNA, 64 nt, Human Herpes Virus 2
ccgggacaccagcaugucgcucgccgacuuucacggcgaggaguucgagaagcuguacgagcac

SEQ ID NO: 536996 - RNA, 64 nt, Human Herpes Virus 2
agcacccagaacguccuggaaacggguaaccucgggcgaggacgugguguugcuuccggcgccc

SEQ ID NO: 536997 - RNA, 64 nt, Human Herpes Virus 2
uccgccgcggacccccuccaugcgcgccgauuauggcgaggagaacgacgacgacgacgacgac

SEQ ID NO: 536998 - RNA, 64 nt, Human Herpes Virus 2
cgugcgcguggugauccucuacucgccgcugccgggcgaggaccuggccgcgggccgcgccggg

SEQ ID NO: 536999 - RNA, 64 nt, Human Herpes Virus 2
gcgcuuugccagccgggggggcccccgggccgcgggcgaggacguccucaacgacgugcucacc

SEQ ID NO: 537000 - RNA, 64 nt, Human Herpes Virus 2
cucguggaccgaaauucuggcccaacagaucgcgggcgaggacgacuacgaagaagaccccccc

SEQ ID NO: 537001 - RNA, 64 nt, Human Herpes Virus 2
cuccgaggacgcagauuccauuuacgagucggugggcgaggauggggggcgcgucuacgaggag

SEQ ID NO: 537002 - RNA, 64 nt, Human Herpes Virus 2
cgacgucagccugggagacgaacuccgccuggacggcgaggagguggauaugacgcccgccgac

SEQ ID NO: 537003 - RNA, 64 nt, Human Herpes Virus 2; identical to SEQ ID NO: 536998

SEQ ID NO: 537004 - RNA, 64 nt, Human Herpes Virus 2; identical to SEQ ID NO: 536997

SEQ ID NO: 537005 - RNA, 64 nt, Human Hepatitis C Virus (HCV-N)
uccaaaaugaggucacccucacacaccccauaaccaaauacaucauggcaugcaugucggccga

SEQ ID NO: 537006 - RNA, 64 nt, Human Hepatitis C Virus (HCV-N)
cgggccaacgccccugcuguauaggcuaggggccguccaaaaugaggucacccucacacacccc

SEQ ID NO: 537007 - RNA, 63 nt, Human Herpes Virus 1
uucucgaggagaauggggaagcgccuggucaccucccccaaccacgcgcguuggucggggcca

SEQ ID NO: 537008 - RNA, 63 nt, Human Herpes Virus 1
cucgagcagcuaaauaaccucaccgaaaccgucucccccaacacugacguccguacguauucc

SEQ ID NO: 537009 - RNA, 63 nt, Human Herpes Virus 1
gacacuaucguccauaccgaccacaccgacgaaucccccaagggggaggggccauuuuacgag

SEQ ID NO: 537010 - RNA, 63 nt, Human Herpes Virus 1
ggcggugcgacccccacaucggacgggggaagcucccccaacugaagcugaacgcgcuucagg

SEQ ID NO: 537011 - RNA, 64 nt, Human Herpes Virus 2
agcccagggaaccgcgaguuccacgaucucccagagaacccagggucccgcgcauacccaggga

SEQ ID NO: 537012 - RNA, 64 nt, Human Herpes Virus 2
caccacguguccccagggagccccggguuccccgagagcccagggaaccgcgaguuccacgauc

SEQ ID NO: 537013 - RNA, 64 nt, Human Herpes Virus 1
gggacuuuuggaugucgcccgucuuuaaccucccccgggagacggcggcggagcagguggucgu

SEQ ID NO: 537014 - RNA, 64 nt, Human Herpes Virus 1
agucucugugggugcgcgcauggcagccgaugccccgggagaccggauggaggagccccugccc

SEQ ID NO: 537015 - RNA, 64 nt, Human Herpes Virus 1
cccccgcggcccugcccuccccggccaagcgcccccgggagacgccgucgccugccgacccccc

SEQ ID NO: 537016 - RNA, 64 nt, Human Herpes Virus 1
auaucggggaguacgucaaacacaacgugaccccccgggagaccguccuggauggcgauacggc

SEQ ID NO: 537017 - RNA, 64 nt, Human Herpes Virus 1
auuuucacgccccgcccaccuaucucgcuuccccccgggagauccguguccugcacagccuggg

SEQ ID NO: 537018 - RNA, 64 nt, Human Herpes Virus 1
uaccgacgaucugcgaccuggcgcgcacguuugcccgggagaugggggaggcuaacugaaacac

SEQ ID NO: 537019 - RNA, 64 nt, Human Herpes Virus 1
gcggcgacuuugacgaggccaagcuagccgaggcccgggagaugauacgguacauggcccuggu

SEQ ID NO: 537020 - RNA, 64 nt, Human Herpes Virus 1
acucgccgcucgcccgagccguggcccgcgacgcccgggagaagguucgaggcccacccaaacg

SEQ ID NO: 537021 - RNA, 64 nt, Human Herpes Virus 1
ugguggcucuccccgaggcccccgaccaggccuuccgggagauggaggucaucaaggacaccau

SEQ ID NO: 537022 - RNA, 64 nt, Human Hepatitis C Virus (M1LE)
gcuggagcgcggcucgucgugcucgccaccgcuacgccuccaggaucggucaccgugccgcacc

SEQ ID NO: 537023 - RNA, 64 nt, Human Hepatitis C Virus (M1LE)
uugggcaucggcacaguccuggaucaagcggagacggcuggagcgcggcucgucgugcucgcca

SEQ ID NO: 537024 - RNA, 64 nt, Human Herpes Virus 4 (Epstein Barr virus)
ggggagaucauucgguggcaucccugaaggagacccuccauaaaugcccgugggaucugcuggc

SEQ ID NO: 537025 - RNA, 64 nt, Human Herpes Virus 4 (Epstein Barr virus)
gcccugcucucgaugauugagaaugccaagagccccuccauaggccucugccgggaggugcugg

SEQ ID NO: 537026 - RNA, 64 nt, Human Herpes Virus 4 (Epstein Barr virus)
gagauuugggguaggcggagccucaggaggguccccuccauaggguugaaccaggagggggagg

SEQ ID NO: 537027 - RNA, 64 nt, Human Herpes Virus 4 (Epstein Barr virus)
uuagcaacgggaggugaacccagaggugaugcuacuagugaaacgagcagugaugaggacaccg

SEQ ID NO: 537028 - RNA, 64 nt, Human Herpes Virus 4 (Epstein Barr virus)
gcuuuguguuagguuaguaugggcuggguauucacuagugaaggcaacuaacacaguuagacgu

SEQ ID NO: 537029 - RNA, 64 nt, Human Herpes Virus 4 (Epstein Barr virus)
cuuuggcaggucgggccuggccaugcaggguauucuagugaagcccugcagguggcgccggggu

SEQ ID NO: 537030 - RNA, 64 nt, Human Herpes Virus 1
gcgccugcgccugcgacgcgcgggcggggagggggcgccggagccccccgcgacccccgcgacc

SEQ ID NO: 537031 - RNA, 64 nt, Human Herpes Virus 1
cagaucgcggucgcccggaagaacugcgcgaggcgcgccggaccagggcgggggcaucgggcac

SEQ ID NO: 537032 - RNA, 64 nt, Human Herpes Virus 1
ggccucggggaccaccgacgccauggcgcccggcgcgccggacuucugcgaggaggaggcccac

SEQ ID NO: 537033 - RNA, 64 nt, Human Herpes Virus 1
cggcgggucccgaccgaacgggcgucaccaugcagcgccggacgcgcggcgcgagcucccugcg

SEQ ID NO: 537034 - RNA, 64 nt, Human Herpes Virus 1
ggcgcgcccggcgccgcgccgaacgacgugcgcagcgccggaguuuuggcccuggcggguuauu

SEQ ID NO: 537035 - RNA, 64 nt, Human Herpes Virus 1; identical to SEQ ID NO: 537030

SEQ ID NO: 537036 - RNA, 64 nt, Human Herpes Virus 1; identical to SEQ ID NO: 537032

SEQ ID NO: 537037 - RNA, 64 nt, Human Herpes Virus 1
ucgucuugauaacggcguacggccucgugcucgugugguacaccgucuucggugccaguccgcu

SEQ ID NO: 537038 - RNA, 64 nt, Human Herpes Virus 1
cagauuacccccaacggguaaucgugaaggcggggugguacacgagcacgagccacgaggcgcg

SEQ ID NO: 537039 - RNA, 64 nt, Human Herpes Virus 2
guuauuuguggauccccgccucucauuacaaucagcucgucaccgggcaauccgcgccccgcca

SEQ ID NO: 537040 - RNA, 64 nt, Human Herpes Virus 2
ucgcgcccgggcgcguuccgggcccggaggaggcgcucgucacccaagaccgggacuggcucga

SEQ ID NO: 537041 - RNA, 64 nt, Human Herpes Virus 2
cccugcuccccagcaucacccaucgcuucuucgagcucgucaacgggccccuguucgaccacuc

SEQ ID NO: 537042 - RNA, 64 nt, Human Herpes Virus 2
acgaccaccaccugacgacgccgcugcugcggcggcucgucagccccgagcagugcgacgagga

SEQ ID NO: 537043 - RNA, 64 nt, Human Herpes Virus 4 (Epstein Barr virus)
caucccggcccucuuccgugccucgggccucaacguccgugagagccuacccaugaccaacaug

SEQ ID NO: 537044 - RNA, 64 nt, Human Herpes Virus 4 (Epstein Barr virus)
accacgcugcccaccucccggugcccagggucaucacauacaccgacugcccggguuccauaaa

SEQ ID NO: 537045 - RNA, 64 nt, Human Herpes Virus 4 (Epstein Barr virus)
ccugccccucuaaucuguaugcugcaugaaaaaccacauacacgugauguaaguuuagccaguu

SEQ ID NO: 537046 - RNA, 64 nt, Human Herpes Virus 2
gucagcggacaaggccgggucccguagccgccccgcgacagaaccggaguccgacggcacgcgc

SEQ ID NO: 537047 - RNA, 64 nt, Human Herpes Virus 2
cggcccccagccgcgcgacguagcgacaaaaguggcgacagaggcgcaugaggcgcgcgccguc

SEQ ID NO: 537048 - RNA, 64 nt, Human Herpes Virus 2
cgugcgggugugguuuuccccgagguguggagaagcgacagaccuauccgcgcggcgcaacccc

SEQ ID NO: 537049 - RNA, 64 nt, Human Herpes Virus 2
ccggagguugcgucggucccagucacccacgccggcgacagaucccccguucgccccgggcccg

SEQ ID NO: 537050 - RNA, 64 nt, Human Herpes Virus 2
ucccguacgugaucguggcccagacccgcgagguagaggagacggucgcgcggcuggccgcccu

SEQ ID NO: 537051 - RNA, 64 nt, Human Herpes Virus 1
cgagcuggaugugauuaacacgaacgacguggaagugcuggacgaaugucuggccgaguacugc

SEQ ID NO: 537052 - RNA, 64 nt, Human Herpes Virus 1
cgaaugcgaugaauuucgauucaucgccccgcgggugcuggacgaggaugcccccccggagaag

SEQ ID NO: 537053 - RNA, 64 nt, Human Herpes Virus 1
cccccaggaccccauuaucgggacgaccgcggcugugcuggauaaccucgccacgcgccugcgg

SEQ ID NO: 537054 - RNA, 64 nt, Human Herpes Virus 1
gugcgucgagcacgaguucgguaaccucaugaaggugcuggaguacggccugcccaucaccgag

SEQ ID NO: 537055 - RNA, 64 nt, Human Herpes Virus 1
cgggggaucugggaggaccuucggccccgaugacgugcuggaccuacugaccccccacuacgac

SEQ ID NO: 537056 - RNA, 64 nt, Human Herpes Virus 1
ggcauuacacgcgcugggcuaucagcuggccuucgugcuggauagccccucggcguacgacgca

SEQ ID NO: 537057 - RNA, 64 nt, Human Herpes Virus 1
aggcucuacaggccagcgacccgacguggaggccgugcuggaccgcuucggccgccgucgugcc

SEQ ID NO: 537058 - RNA, 64 nt, Human Herpes Virus 1
acuuccucgaguacccagggcccucguccagcacgugcuggacguucucgcgcguauacggcga

SEQ ID NO: 537059 - RNA, 64 nt, Human Herpes Virus 1
cguuuugacgcgggaggccgccuuccuggggcgcgugcuggaugugcuggcggugauggcggag

SEQ ID NO: 537060 - RNA, 64 nt, Human Herpes Virus 1
ccggaagaacugcgcgaggcgcgccggaccagggcgggggcaucgggcaccgggauggccgccg

SEQ ID NO: 537061 - RNA, 64 nt, Human Herpes Virus 1
cgcgguuaaagaaaaagagggcaaagaagguguucgggggcaaccgcagcgccuuggggcgcgu

SEQ ID NO: 537062 - RNA, 64 nt, Human Herpes Virus 1
ucaccagcaacgucagugccauccucgcccgcaacgggggcaucgggcuaugcgugcaggcguu

SEQ ID NO: 537063 - RNA, 64 nt, Human Herpes Virus 1
gcaugcgggcggugcuccggcgacugcaggucggcgggggcacccucaaguucuuccucacgac

SEQ ID NO: 537064 - RNA, 64 nt, Human Herpes Virus 1
gggcccggcgaccgucuugcucccccgagcagcacgggggcaagguggcccgccuccaaccccc

SEQ ID NO: 537065 - RNA, 64 nt, Human Herpes Virus 1
ccucgucacccucaacuccaacuccacgaucgcccgggggcaguuuugccuccaggagccggac

SEQ ID NO: 537066 - RNA, 64 nt, Human Herpes Virus 1
cggagcuggagcugugucuccaucugcgcgcccccgggggcauugggccggacgccgccuugcg

SEQ ID NO: 537067 - RNA, 64 nt, Human Herpes Virus 2
gcccccgcgcugcugcgccgcgggggccgaggaagugugccaggaagacgcgccacgcggaggg

SEQ ID NO: 537068 - RNA, 64 nt, Human Herpes Virus 2; identical to SEQ ID NO: 537067

SEQ ID NO: 537069 - RNA, 64 nt, Human Hepatitis C Virus
ccaaguuuggcuauggggcaaaagacguccguugccaugccagaaaggccguagcccacaucaa

SEQ ID NO: 537070 - RNA, 64 nt, Human Herpes Virus 4 (Epstein Barr virus)
gcuacuacugccuuacacuggaaagugaggagcgcccaccgaccccauaucgcaacacuguaua

SEQ ID NO: 537071 - RNA, 64 nt, Human Herpes Virus 4 (Epstein Barr virus)
cggagaggggccucuuugggcccucaaguccagccccaccgagacccgaguggcccggaucccc

SEQ ID NO: 537072 - RNA, 64 nt, Human Herpes Virus 4 (Epstein Barr virus); identical to SEQ ID NO: 537071

SEQ ID NO: 537073 - RNA, 64 nt, Human Herpes Virus 4 (Epstein Barr virus); identical to SEQ ID NO: 537071

SEQ ID NO: 537074 - RNA, 64 nt, Human Herpes Virus 4 (Epstein Barr virus); identical to SEQ ID NO: 537071

SEQ ID NO: 537075 - RNA, 64 nt, Human Herpes Virus 4 (Epstein Barr virus); identical to SEQ ID NO: 537071

SEQ ID NO: 537076 - RNA, 64 nt, Human Herpes Virus 4 (Epstein Barr virus); identical to SEQ ID NO: 537071

SEQ ID NO: 537077 - RNA, 64 nt, Human Herpes Virus 4 (Epstein Barr virus); identical to SEQ ID NO: 537071

SEQ ID NO: 537078 - RNA, 64 nt, Human Herpes Virus 4 (Epstein Barr virus); identical to SEQ ID NO: 537071

SEQ ID NO: 537079 - RNA, 64 nt, Human Herpes Virus 4 (Epstein Barr virus)
uaccagggaaaggaggggaguggggccuaugccucccaccgauauuccgccgucuaaacgagcg

SEQ ID NO: 537080 - RNA, 64 nt, Human Herpes Virus 4 (Epstein Barr virus)
auaugucgccuuaccuccccuauauagucacgaccccaccgaaccaggcaugauguagaauaaa

SEQ ID NO: 537081 - RNA, 64 nt, Human Herpes Virus 4 (Epstein Barr virus)
caucugcuucuggcucuucugggaacacccccaccccaccgaacgaugaggaacgugaaucuaa

SEQ ID NO: 537082 - RNA, 64 nt, Human Herpes Virus 4 (Epstein Barr virus)
ccccgugacagauauagcucucaagugcgggcugcccaccgaagacuuccuccacccguccaau

SEQ ID NO: 537083 - RNA, 64 nt, Human Herpes Virus 4 (Epstein Barr virus)
aggccaagaaggagcguguccccguggaggaccgcccaccgacuccgaugcccaccagccagcg

SEQ ID NO: 537084 - RNA, 64 nt, Human Herpes Virus 4 (Epstein Barr virus)
ccccaacggccauggccgccucagcggugacacaggcacccacggaauauaccagggaaaggag

SEQ ID NO: 537085 - RNA, 64 nt, Human Herpes Virus 4 (Epstein Barr virus)
aacauggucaacgaguacagccagcgacuuggagggcacccagccaccagcaacacagaggugc

SEQ ID NO: 537086 - RNA, 64 nt, Human Herpes Virus 1
cggaugcgguccagacgauuaugggcuuucucaaccaggccaacugcaagauuaucuucguguc

SEQ ID NO: 537087 - RNA, 64 nt, Human Herpes Virus 1
uggccgauuccuucaugcaggagaucaucgggggccaggccagggagaccggcgacgaccggcc

SEQ ID NO: 537088 - RNA, 64 nt, Human Herpes Virus 1
acuacuacaccuccagcugcuaccugguaaacccccaggccaccacaaacaaggcgacccugcg

SEQ ID NO: 537089 - RNA, 64 nt, Human Herpes Virus 1
cgcgcauacaucuggcgugccuccgggcccugggccaggccauccgggccgcgcuucagggcgg

SEQ ID NO: 537090 - RNA, 64 nt, Human Herpes Virus 1
ggggggacguucccccggccggcccgggggagauccaggccaccuggcgcguggugaacggcaa

SEQ ID NO: 537091 - RNA, 64 nt, Human Herpes Virus 2
ggccgaggacaugacgcccccucccccgaaccgaaacguugacuuuccgcucgccgucccggcc

SEQ ID NO: 537092 - RNA, 64 nt, Human Herpes Virus 4 (Epstein Barr virus)
ccuucugguggccgggccagagaccgcugacacgaggccggaccuccgcaagcugaaugagugg

SEQ ID NO: 537093 - RNA, 64 nt, Human Herpes Virus 4 (Epstein Barr virus)
cuacgcgggucucagggcagcccugcagcgggccaggccggagauugagagugacauggaggug

SEQ ID NO: 537094 - RNA, 64 nt, Human Herpes Virus 4 (Epstein Barr virus)
ugccccgcuccggcggggaugggggugcgcucccaggccggacccuggugccaggcagggaccc

SEQ ID NO: 537095 - RNA, 64 nt, Human Herpes Virus 4 (Epstein Barr virus)
acuaagguuacugcacagaacaucacugccaccgaggccggaacaggaaccuccacggguguga

SEQ ID NO: 537096 - RNA, 64 nt, Human Herpes Virus 4 (Epstein Barr virus)
gugguggcgccagcgugcccaagagggcacggcaaggccggaggcagacacccacggaagcccu

SEQ ID NO: 537097 - RNA, 64 nt, Human Herpes Virus 1
gguaggccgcgauguuaauggugaacgcaaagccgccgggaaagacaacuaugccacagaggcg

SEQ ID NO: 537098 - RNA, 64 nt, Human Herpes Virus 1
guguggaggucguuuucaugcccggucucgcuuugccgggaacgcuagccgaucccucgcgagg

SEQ ID NO: 537099 - RNA, 64 nt, Human Herpes Virus 1
aucgcgccucaccucgcgcuaccgcucccgcgcggccgggaacaaucgcccgccguacacccga

SEQ ID NO: 537100 - RNA, 64 nt, Human Herpes Virus 1
cuacggcauggccggcaacgaccguguguuucaggccgggaacugggccagccugaugggcggc

SEQ ID NO: 537101 - RNA, 64 nt, Human Herpes Virus 1
cccccgagucgcucucagacccggcgggccauccgccgggaacacaccagcucgcgcuccacgg

SEQ ID NO: 537102 - RNA, 64 nt, Human Herpes Virus 1
gcugcaggccccccgccguccuugcaucacggaccgucugcaagaggucgucgggggacggugc

SEQ ID NO: 537103 - RNA, 64 nt, Human Herpes Virus 1
ccuggagaucgaggugggggggcgacggcuguucuucgucaaggcucacgugcgagagagccuc

SEQ ID NO: 537104 - RNA, 64 nt, Human Herpes Virus 1
gcgucaguuggcgggucuguuccagcccuucauguucgucaacggagcgcucaccguccgggga

SEQ ID NO: 537105 - RNA, 64 nt, Human Herpes Virus 2
ggcgcuccuuuuggcccugcggcaccccaccgaccucccccaccuggcccgccaucgggcuccg

SEQ ID NO: 537106 - RNA, 64 nt, Human Herpes Virus 2
caugaaacgcgaguugacgagcuucgcgguacuacucccccagggcgaccccgacguccagcug

SEQ ID NO: 537107 - RNA, 64 nt, Human Herpes Virus 2
ccgcccgcgcucaacacgacgccugcgaaucaugcucccccauccccacccccggguucacgga

SEQ ID NO: 537108 - RNA, 64 nt, Human Herpes Virus 2
ccgccgcgcucagauggcccccaagcgccuacgucucccccacauccgggaugacgacgcgccc

SEQ ID NO: 537109 - RNA, 64 nt, Human Herpes Virus 2
ggcgcaguaccggaacgcggugguggaacagcaccucccccagcgccagcccgagcccgucgag

SEQ ID NO: 537110 - RNA, 64 nt, Human Herpes Virus 2
caccguccgcaaccccguuacggacaugggcaaccucccccaaaacuuuuaccucggccgcggg

SEQ ID NO: 537111 - RNA, 64 nt, Human Herpes Virus 2
guacuuuuacaugaacaaggcggagguggaucggcaccugcagugccgugccccgcgcgaucuc

SEQ ID NO: 537112 - RNA, 64 nt, Human Herpes Virus 2
ggcagccggaucugcgggggcgcccuaccgcacgcaccugcacauacgccgccuucgcagagcu

SEQ ID NO: 537113 - RNA, 61 nt, Human Herpes Virus 2
cgacgcagauggccgagacgaugaacgucgccaccugcacacaccagacccaccacgccgc

SEQ ID NO: 537114 - RNA, 64 nt, Human Herpes Virus 2
gcggcaggcgacccgccgcccgcgcaucacggcccaccugcacgaggucgucgugggccgggac

SEQ ID NO: 537115 - RNA, 64 nt, Human Herpes Virus 2
caugcuguacgucaucuuccccggcacgucggcccaccugcacuaccggcucaucgaucggaug

SEQ ID NO: 537116 - RNA, 64 nt, Human Herpes Virus 2
cgaguuguacccucucaacgcccaggcccuggcgcaccugcagaugcugcccgcggaccaccgg

SEQ ID NO: 537117 - RNA, 64 nt, Human Herpes Virus 4 (Epstein Barr virus)
gcuaagggccuggcugcagaugugcaccccgcaagacuuccacaagcaccuguucugcgacccc

SEQ ID NO: 537118 - RNA, 64 nt, Human Herpes Virus 4 (Epstein Barr virus)
aaggccggaggcagacacccacggaagcccucuggacuuccaugucuacgacauacucgagacg

SEQ ID NO: 537119 - RNA, 64 nt, Human Herpes Virus 1
ccgguccgagcgcggaccgggcgugcggccuguggcguugcaucggggcuacgccagggcgccc

SEQ ID NO: 537120 - RNA, 64 nt, Human Herpes Virus 1
cgcguccaccaccaacaugcgcauauucgacggggcguugcacgccggaauccugcugauggcc

SEQ ID NO: 537121 - RNA, 64 nt, Human Herpes Virus 2
ggaguccgccccgcgccgccgccgcccccguggugucugcgagcgcggacgcggccgggcccgc

SEQ ID NO: 537122 - RNA, 64 nt, Human Herpes Virus 2
gacagaaccggaguccgacggcacgcgcgacggggucugcgaggcugagguacgccgcgguguu

SEQ ID NO: 537123 - RNA, 64 nt, Human Herpes Virus 2
cauggagggcagccccuccacugccccacacagggucugcgagcaauaccuuccgggagagagc

SEQ ID NO: 537124 - RNA, 64 nt, Human Herpes Virus 2
cgagcuccucgaccucaccaccauucgcgugacggucugcgagggcaagaaccuccugcagcgc

SEQ ID NO: 537125 - RNA, 64 nt, Human Herpes Virus 2; identical to SEQ ID NO: 537121

SEQ ID NO: 537126 - RNA, 64 nt, Human Herpes Virus 4 (Epstein Barr virus)
aaaaaccagcgaucccugagaacgcuccagguagaguuuccagcccugggccaaaagacccucc

SEQ ID NO: 537127 - RNA, 59 nt, Human Herpes Virus 4 (Epstein Barr virus)
agaaaccuugccuacgggcgcaccuguguccugggcaaggagcuguuuggcucggcugu

SEQ ID NO: 537128 - RNA, 59 nt, Human Herpes Virus 4 (Epstein Barr virus)
guauauuuccuccaugaaacccuuggaccccugggcaagaccgugcuguuuaucucaau

SEQ ID NO: 537129 - RNA, 59 nt, Human Herpes Virus 4 (Epstein Barr virus)
aaggucucaacauccauguuauaggcaccccugggcaccauggucucaagauccugugc

SEQ ID NO: 537130 - RNA, 59 nt, Human Herpes Virus 4 (Epstein Barr virus)
agcacccgaaagagugcccagcagaaguuccugggcaacaaccacuuuguccucgcuaa

SEQ ID NO: 537131 - RNA, 59 nt, Human Herpes Virus 4 (Epstein Barr virus)
cuggucuucucgcucagcguguuccuggcccugggcaacagcuuuuacuuuaugguggg

SEQ ID NO: 537132 - RNA, 59 nt, Human Herpes Virus 4 (Epstein Barr virus)
acccuucuaaucaaaugguuggacacggcccugggcagggaggccaccuuuuacgcgug

SEQ ID NO: 537133 - RNA, 59 nt, Human Herpes Virus 4 (Epstein Barr virus)
gcagcccccgccaucagccggcuccucuaccugggcaccuccuccucagcagcagcccc

SEQ ID NO: 537134 - RNA, 59 nt, Human Herpes Virus 4 (Epstein Barr virus)
cgccuaugaauaccggagcacugugaaucccugggcaucucagcuggguucucugggug

SEQ ID NO: 537135 - RNA, 59 nt, Human Herpes Virus 4 (Epstein Barr virus)
ccggugccccccacggcccccgggaagucccugggcacccucaacaaucccgccaccgu

SEQ ID NO: 537136 - RNA, 64 nt, Human Herpes Virus 2; identical to SEQ ID NO: 535421

SEQ ID NO: 537137 - RNA, 64 nt, Human Herpes Virus 2; identical to SEQ ID NO: 535422

SEQ ID NO: 537138 - RNA, 64 nt, Human Herpes Virus 1
cgcagguggugcauguuuuugaguacggcacccgcgcgaucaugguacggggccgggagcgcca

SEQ ID NO: 537139 - RNA, 64 nt, Human Herpes Virus 1; identical to SEQ ID NO: 537138

SEQ ID NO: 537140 - RNA, 64 nt, Human Herpes Virus 2
ccuaaccgcgcgccuccucgcggaguaugaccgucggugccagaccgaagaggugcugccgccg

SEQ ID NO: 537141 - RNA, 64 nt, Human Herpes Virus 1
gcgcgauuguaugcgcuggcugcggucccugauugcucugcacaaaccccacccagcuacccca

SEQ ID NO: 537142 - RNA, 64 nt, Human Herpes Virus 1
acccccggcgaucgcggcgcuuauccguaaugcggcggugcagacuccccugcccgucuaccgg

SEQ ID NO: 537143 - RNA, 64 nt, Human Herpes Virus 1
ccuccggcagccguucuuggcuggcguccccucggcggugcagcgggaacgcgcccgccggagc

SEQ ID NO: 537144 - RNA, 64 nt, Human Herpes Virus 4 (Epstein Barr virus)
gagaaauuuauuuguauugcauggcagaacaguuuucuaagacauguuuugugugcuuuaguag

SEQ ID NO: 537145 - RNA, 64 nt, Human Herpes Virus 4 (Epstein Barr virus)
ugacugcuacgcuaggaugugaugagggcacgcggcaugcaacaacguacagugcuggcauugu

SEQ ID NO: 537146 - RNA, 64 nt, Human Herpes Virus 4 (Epstein Barr virus)
aucaucggcauauguuauggggccacugucaagggcaugcaauccuacgggcuggagcgcuugg

SEQ ID NO: 537147 - RNA, 64 nt, Human Herpes Virus 4 (Epstein Barr virus)
aagcuaccgaugauucuggccaugaaucugacucuaacuccaacgagggcagacaccaccugcu

SEQ ID NO: 537148 - RNA, 64 nt, Human Herpes Virus 2
cugacgacgaccuucaccgcgacuccaccuccgaggcgggcagcacggacacggagauguucga

SEQ ID NO: 537149 - RNA, 64 nt, Human Herpes Virus 2
ugccgcaccuggagcuuuccgccgucgcgcgccuggcgggcaucaacaucacccgcaccaucua

SEQ ID NO: 537150 - RNA, 64 nt, Human Herpes Virus 2
gcugaaguacgaagaguuuuaccucaagcgcuucggcgggcacuacauggaguccgucuuccag

SEQ ID NO: 537151 - RNA, 64 nt, Human Herpes Virus 2
gcaaccggcucugcgggcccgccacggccgccugggcgggcaacuggaccggcgcccccgacgu

SEQ ID NO: 537152 - RNA, 64 nt, Human Herpes Virus 2
gguggacgacuuuacccugccgggcccggagcugggcgggcaggcucaggccgagcugaaucac

SEQ ID NO: 537153 - RNA, 64 nt, Human Herpes Virus 2
ccgcgcugggggucguuaugauuaccgcggcccuggcgggcauccuuagggugguccgaacgug

SEQ ID NO: 537154 - RNA, 64 nt, Human Herpes Virus 2
augccacccaacagcagcuggcccaggggccgguggcgggcaccccgaacguguuuuccagcga

SEQ ID NO: 537155 - RNA, 64 nt, Human Herpes Virus 2
gccgcgacccaggggcucaucgccugcaggcgcuggcgggcacgggcgcgcagcauccacggca

SEQ ID NO: 537156 - RNA, 64 nt, Human Herpes Virus 2
accuccgccggccgcccucccccucgagcgagccggcgggcagcgcggacgagccggcguuucu

SEQ ID NO: 537157 - RNA, 64 nt, Human Herpes Virus 2
gucacgggcgacgcgauccucgaccugacggaucggcgggcaaaaaccagccccucccgcgcga

SEQ ID NO: 537158 - RNA, 64 nt, Human Herpes Virus 2; identical to SEQ ID NO: 537148

SEQ ID NO: 537159 - RNA, 64 nt, Human Herpes Virus 2; identical to SEQ ID NO: 537151

SEQ ID NO: 537160 - RNA, 64 nt, Human Herpes Virus 2
ggguuuccccggcccacccccaaaccccgguuggggcgggcagccgagaccuuuccuuaaaagg

SEQ ID NO: 537161 - RNA, 64 nt, Human Herpes Virus 2
ccgagcgcggcgggcuguccugccugcuggcggcccugggcaaccggcucugcgggcccgccac

SEQ ID NO: 537162 - RNA, 64 nt, Human Herpes Virus 2
agcugaagcggagcuuuugcgacacgagcuucuuccugggcaaggcgggccaucgccgcgaggc

SEQ ID NO: 537163 - RNA, 64 nt, Human Herpes Virus 2
acguggagcaggaggcgcuguuucgcgcccugccccugggcagccccggggucguggcggccga

SEQ ID NO: 537164 - RNA, 64 nt, Human Herpes Virus 2; identical to SEQ ID NO: 537161

SEQ ID NO: 537165 - RNA, 64 nt, Human Herpes Virus 1
ccaccugacgguguauuacaagcucauggcccgccgcgcgcaggucccguccaucaaggaccgg

SEQ ID NO: 537166 - RNA, 64 nt, Human Herpes Virus 1
cgcuggaccaggccugcuuccggaucucgggcgccgcgcgcaacagcagcuccuucaucaccgg

SEQ ID NO: 537167 - RNA, 64 nt, Human Herpes Virus 1
ggcggccgccguggccaugagccgccgauacgaccgcgcgcagaagggcuuccugcugaccagc

SEQ ID NO: 537168 - RNA, 64 nt, Human Herpes Virus 1
gagucgacgaccuggggacggacgucgacucuaucgcgcgcauugucaacuccgucuuugugug

SEQ ID NO: 537169 - RNA, 64 nt, Human Herpes Virus 1
cgcccuuugacaucgccgccgaggucgccuuuaccgcgcgcauacaucuggcgugccuccgggc

SEQ ID NO: 537170 - RNA, 64 nt, Human Herpes Virus 1
acgcgugcguccuccgagcgacccagccccuguacgcgcgcaccacccccgccaaguucugggc

SEQ ID NO: 537171 - RNA, 64 nt, Human Herpes Virus 1; identical to SEQ ID NO: 537167

SEQ ID NO: 537172 - RNA, 64 nt, Human Herpes Virus 1; identical to SEQ ID NO: 537166

SEQ ID NO: 537173 - RNA, 64 nt, Human Hepatitis C Virus
ccauauaacgggucaucgcauggcaugggauaugaugaugaacugguccccuacggcagcguug

SEQ ID NO: 537174 - RNA, 63 nt, Human Hepatitis C Virus
gacgacgcaagacugcaauuguucuaucuaucccggccauauaacgggucaucgcauggcaug

SEQ ID NO: 537175 - RNA, 62 nt, Human Herpes Virus 1
cuucgagggucucguucagcgaauucggcuuaucgucccaucuacguugcggggcggggacg

SEQ ID NO: 537176 - RNA, 64 nt, Human Herpes Virus 2
cggaccugcugcgggccgcggcccccgcguggagccgccgcacccugcuccccgagcacgcgcg

SEQ ID NO: 537177 - RNA, 64 nt, Human Herpes Virus 2
ggggacggccgcgcgccagcgcaagcgcggagcaccgccgcaacgcacaugcguaccacgcagc

SEQ ID NO: 537178 - RNA, 64 nt, Human Herpes Virus 2
accccgcuaccccgccaaggccgucuaucugccgccgccgcacaucgcccccccggggccuccu

SEQ ID NO: 537179 - RNA, 64 nt, Human Herpes Virus 2
cgcgcgucggccgacuccgauuccgcggcccacgccgccgcaccccaggcggacguggcgccgg

SEQ ID NO: 537180 - RNA, 64 nt, Human Herpes Virus 2
gcccccgcgcccggggcccgcgggcgcggccgccccgccgcacgccgacgcgccccgccugcgc

SEQ ID NO: 537181 - RNA, 64 nt, Human Herpes Virus 2
cacaacggucgugacggugggccuuagcuucgauccgccgcacuuugacagcauguucgccuac

SEQ ID NO: 537182 - RNA, 57 nt, Human Herpes Virus 2
cucuucggcugcucguaaaaauggcggccgccgcaacacccggcgccaagcgccccg

SEQ ID NO: 537183 - RNA, 64 nt, Human Herpes Virus 2
caaaacacggggcgcgugccuugauccgcgcaugccgccgcauagcccucgccacccacaccga

SEQ ID NO: 537184 - RNA, 64 nt, Human Herpes Virus 2
cucgcgccccggcgggccggcgcggccgcgguuuccgccgcagccguccgacaucgagacgugg

SEQ ID NO: 537185 - RNA, 64 nt, Human Herpes Virus 2; identical to SEQ ID NO: 537176

SEQ ID NO: 537186 - RNA, 64 nt, Human Herpes Virus 2; identical to SEQ ID NO: 537180

SEQ ID NO: 537187 - RNA, 64 nt, Human Herpes Virus 2; identical to SEQ ID NO: 537176

SEQ ID NO: 537188 - RNA, 64 nt, Human Herpes Virus 2; identical to SEQ ID NO: 537177

SEQ ID NO: 537189 - RNA, 64 nt, Human Herpes Virus 2; identical to SEQ ID NO: 537178

SEQ ID NO: 537190 - RNA, 64 nt, Human Herpes Virus 2; identical to SEQ ID NO: 537179

SEQ ID NO: 537191 - RNA, 64 nt, Human Herpes Virus 2; identical to SEQ ID NO: 537180

SEQ ID NO: 537192 - RNA, 64 nt, Human Herpes Virus 2; identical to SEQ ID NO: 537181

SEQ ID NO: 537193 - RNA, 57 nt, Human Herpes Virus 2; identical to SEQ ID NO: 537182

SEQ ID NO: 537194 - RNA, 64 nt, Human Herpes Virus 2; identical to SEQ ID NO: 537183

SEQ ID NO: 537195 - RNA, 64 nt, Human Herpes Virus 2; identical to SEQ ID NO: 537184

SEQ ID NO: 537196 - RNA, 64 nt, Human Herpes Virus 2; identical to SEQ ID NO: 537176

SEQ ID NO: 537197 - RNA, 64 nt, Human Herpes Virus 2; identical to SEQ ID NO: 537180

SEQ ID NO: 537198 - RNA, 63 nt, Human Herpes Virus 1
cgacuccgcgccccccacgaaaggcaugaccggggcgcggacggcguggugggucuggugugu

SEQ ID NO: 537199 - RNA, 63 nt, Human Herpes Virus 1
gagcgccucgagaaacagaggcaacuuaaggugggcgcggacgaggcgucggcgggccucacc

SEQ ID NO: 537200 - RNA, 63 nt, Human Herpes Virus 1
cccuggaacacucgcaauucagucgguaucgcuggcgcggacccacggcggcguuccugucuc

SEQ ID NO: 537201 - RNA, 63 nt, Human Herpes Virus 1
gcgcuuuaagcacggccgggcgagucgcgccacggcgcggacauucgucgcgcugagcgucgg

SEQ ID NO: 537202 - RNA, 63 nt, Human Herpes Virus 1
aacgcggugguggaacagccccucccacagcgcggcgcggauuuggccgagcccacccacccg

SEQ ID NO: 537203 - RNA, 63 nt, Human Herpes Virus 1
ccagaccgcgacgagcggggggcccucggguggggcgcggagacggaggagggcggggacgac

SEQ ID NO: 537204 - RNA, 63 nt, Human Herpes Virus 1
ggcggcccgcgacccccgaagacgaagaagagcggcgcggacgcccccggcucggacgcccgc

SEQ ID NO: 537205 - RNA, 63 nt, Human Herpes Virus 1
gccguccgcgccccggucaugccuuucguggggggcgcggagucgggagauccucugggggcc

SEQ ID NO: 537206 - RNA, 63 nt, Human Herpes Virus 1
gaccgucugcaagaggucgucgggggacggugcggcgcggacaacauccccccgaccagcgcc

SEQ ID NO: 537207 - RNA, 63 nt, Human Herpes Virus 1
gcgggggggcgggcgacggaggggguucgggcgggcgcggaggaccccgcaacccgcccccgg

SEQ ID NO: 537208 - RNA, 63 nt, Human Herpes Virus 1; identical to SEQ ID NO: 537204

SEQ ID NO: 537209 - RNA, 63 nt, Human Herpes Virus 1; identical to SEQ ID NO: 537203

SEQ ID NO: 537210 - RNA, 64 nt, Human Herpes Virus 4 (Epstein Barr virus)
uguugaccuaccaaagaacuccaucauuaugcugggccaggaugacuucauuaaguucaaaagc

SEQ ID NO: 537211 - RNA, 64 nt, Human Herpes Virus 4 (Epstein Barr virus)
gcgagccgggguggguguaggggugacgggggcuggccaggaugggaaacacaucagccuccug

SEQ ID NO: 537212 - RNA, 64 nt, Human Herpes Virus 4 (Epstein Barr virus)
ucucccaccucagugggauggaucugcaggacauggccaggaucaggucucccaguucccacau

SEQ ID NO: 537213 - RNA, 64 nt, Human Herpes Virus 4 (Epstein Barr virus)
uugcgaccccucugauauuaaggugguuauuuugggccaggaccccuaucacgggggucaagca

SEQ ID NO: 537214 - RNA, 64 nt, Human Herpes Virus 4 (Epstein Barr virus)
gcaacaaucuggacucucuguuucuguacaauggggccaggacgcugcuguccacccuggucaa

SEQ ID NO: 537215 - RNA, 64 nt, Human Herpes Virus 4 (Epstein Barr virus)
aggagcaacagccugcggagguucggccgccgcgggccaggaccucaucagcgucccccgcaac

SEQ ID NO: 537216 - RNA, 64 nt, Human Herpes Virus 4 (Epstein Barr virus)
gaaguacgaggccguccaggaucguuacacgaagggccaggaagccauuacauauuuuauaacg

SEQ ID NO: 537217 - RNA, 56 nt, Human Herpes Virus 4 (Epstein Barr virus)
cacccuagaucuagugaaucauggcgagcccggaagagaggcuccuagacgagcuc

SEQ ID NO: 537218 - RNA, 64 nt, Human Herpes Virus 4 (Epstein Barr virus)
cuaccaccgguggaaagcacaccacaggacauggagcccggacaaguacagagcccaccacaga

SEQ ID NO: 537219 - RNA, 64 nt, Human Herpes Virus 4 (Epstein Barr virus)
ugaaucucuuccaggaaauggugccggaugagauagcccggauagaccuggaugaccugucagu

SEQ ID NO: 537220 - RNA, 64 nt, Human Herpes Virus 4 (Epstein Barr virus)
guugggccgaggcgaggaggaggcgucccgggagagcccggaggugccccggccggcuggggca

SEQ ID NO: 537221 - RNA, 64 nt, Human Hepatitis C Virus (HCV-N)
gcaugguugacuacccauacaggcucuggcacuaccccugcacugucaacuucuccaucuuuaa

SEQ ID NO: 537222 - RNA, 64 nt, Human Hepatitis C Virus (HCV-N)
auggaacauuccccaucaacgcguacaccacgggccccugcacgccuuccccggcgccaaacua

SEQ ID NO: 537223 - RNA, 64 nt, Human Hepatitis C Virus (HCV-N)
ggaucaucgggccgaaaaccugcagcaacacguggcauggaacauuccccaucaacgcguacac

SEQ ID NO: 537224 - RNA, 64 nt, Human Herpes Virus 4 (Epstein Barr virus); identical to SEQ ID NO: 536194

SEQ ID NO: 537225 - RNA, 64 nt, Human Herpes Virus 4 (Epstein Barr virus); identical to SEQ ID NO: 536194

SEQ ID NO: 537226 - RNA, 64 nt, Human Herpes Virus 4 (Epstein Barr virus); identical to SEQ ID NO: 536194

SEQ ID NO: 537227 - RNA, 64 nt, Human Herpes Virus 4 (Epstein Barr virus); identical to SEQ ID NO: 536194

SEQ ID NO: 537228 - RNA, 64 nt, Human Herpes Virus 4 (Epstein Barr virus); identical to SEQ ID NO: 536194

SEQ ID NO: 537229 - RNA, 64 nt, Human Herpes Virus 4 (Epstein Barr virus); identical to SEQ ID NO: 536194

SEQ ID NO: 537230 - RNA, 64 nt, Human Herpes Virus 4 (Epstein Barr virus); identical to SEQ ID NO: 536194

SEQ ID NO: 537231 - RNA, 64 nt, Human Herpes Virus 4 (Epstein Barr virus); identical to SEQ ID NO: 536194

SEQ ID NO: 537232 - RNA, 64 nt, Human Herpes Virus 4 (Epstein Barr virus); identical to SEQ ID NO: 536194

SEQ ID NO: 537233 - RNA, 64 nt, Human Herpes Virus 4 (Epstein Barr virus); identical to SEQ ID NO: 536194

SEQ ID NO: 537234 - RNA, 64 nt, Human Herpes Virus 4 (Epstein Barr virus); identical to SEQ ID NO: 536194

SEQ ID NO: 537235 - RNA, 64 nt, Human Herpes Virus 4 (Epstein Barr virus); identical to SEQ ID NO: 536194

SEQ ID NO: 537236 - RNA, 64 nt, Human Herpes Virus 4 (Epstein Barr virus); identical to SEQ ID NO: 536206

SEQ ID NO: 537237 - RNA, 64 nt, Human Herpes Virus 4 (Epstein Barr virus); identical to SEQ ID NO: 536207

SEQ ID NO: 537238 - RNA, 64 nt, Human Herpes Virus 4 (Epstein Barr virus); identical to SEQ ID NO: 536207

SEQ ID NO: 537239 - RNA, 64 nt, Human Herpes Virus 4 (Epstein Barr virus); identical to SEQ ID NO: 536207

SEQ ID NO: 537240 - RNA, 64 nt, Human Herpes Virus 4 (Epstein Barr virus); identical to SEQ ID NO: 536207

SEQ ID NO: 537241 - RNA, 64 nt, Human Herpes Virus 4 (Epstein Barr virus); identical to SEQ ID NO: 536207

SEQ ID NO: 537242 - RNA, 64 nt, Human Herpes Virus 4 (Epstein Barr virus); identical to SEQ ID NO: 536207

SEQ ID NO: 537243 - RNA, 64 nt, Human Herpes Virus 4 (Epstein Barr virus); identical to SEQ ID NO: 536207

SEQ ID NO: 537244 - RNA, 64 nt, Human Herpes Virus 4 (Epstein Barr virus); identical to SEQ ID NO: 536207

SEQ ID NO: 537245 - RNA, 64 nt, Human Herpes Virus 4 (Epstein Barr virus); identical to SEQ ID NO: 536207

SEQ ID NO: 537246 - RNA, 64 nt, Human Herpes Virus 4 (Epstein Barr virus); identical to SEQ ID NO: 536207

SEQ ID NO: 537247 - RNA, 64 nt, Human Herpes Virus 4 (Epstein Barr virus); identical to SEQ ID NO: 536207

SEQ ID NO: 537248 - RNA, 64 nt, Human Herpes Virus 4 (Epstein Barr virus); identical to SEQ ID NO: 536207

SEQ ID NO: 537249 - RNA, 64 nt, Human Herpes Virus 4 (Epstein Barr virus); identical to SEQ ID NO: 536207

SEQ ID NO: 537250 - RNA, 64 nt, Human Herpes Virus 4 (Epstein Barr virus); identical to SEQ ID NO: 536207

SEQ ID NO: 537251 - RNA, 64 nt, Human Herpes Virus 4 (Epstein Barr virus); identical to SEQ ID NO: 536207

SEQ ID NO: 537252 - RNA, 64 nt, Human Herpes Virus 4 (Epstein Barr virus); identical to SEQ ID NO: 536207

SEQ ID NO: 537253 - RNA, 64 nt, Human Herpes Virus 4 (Epstein Barr virus); identical to SEQ ID NO: 536207

SEQ ID NO: 537254 - RNA, 64 nt, Human Herpes Virus 4 (Epstein Barr virus); identical to SEQ ID NO: 536207

SEQ ID NO: 537255 - RNA, 64 nt, Human Herpes Virus 4 (Epstein Barr virus); identical to SEQ ID NO: 536207

SEQ ID NO: 537256 - RNA, 64 nt, Human Herpes Virus 4 (Epstein Barr virus); identical to SEQ ID NO: 536207

SEQ ID NO: 537257 - RNA, 64 nt, Human Herpes Virus 4 (Epstein Barr virus); identical to SEQ ID NO: 536207

SEQ ID NO: 537258 - RNA, 64 nt, Human Herpes Virus 4 (Epstein Barr virus); identical to SEQ ID NO: 536207

SEQ ID NO: 537259 - RNA, 64 nt, Human Herpes Virus 4 (Epstein Barr virus); identical to SEQ ID NO: 536207

SEQ ID NO: 537260 - RNA, 64 nt, Human Herpes Virus 4 (Epstein Barr virus); identical to SEQ ID NO: 536207

SEQ ID NO: 537261 - RNA, 64 nt, Human Herpes Virus 4 (Epstein Barr virus); identical to SEQ ID NO: 536231

SEQ ID NO: 537262 - RNA, 64 nt, Human Herpes Virus 4 (Epstein Barr virus); identical to SEQ ID NO: 536232

SEQ ID NO: 537263 - RNA, 64 nt, Human Herpes Virus 4 (Epstein Barr virus); identical to SEQ ID NO: 536194

SEQ ID NO: 537264 - RNA, 64 nt, Human Herpes Virus 4 (Epstein Barr virus); identical to SEQ ID NO: 536194

SEQ ID NO: 537265 - RNA, 64 nt, Human Herpes Virus 4 (Epstein Barr virus); identical to SEQ ID NO: 536194

SEQ ID NO: 537266 - RNA, 64 nt, Human Herpes Virus 4 (Epstein Barr virus); identical to SEQ ID NO: 536194

SEQ ID NO: 537267 - RNA, 64 nt, Human Herpes Virus 4 (Epstein Barr virus); identical to SEQ ID NO: 536194

SEQ ID NO: 537268 - RNA, 64 nt, Human Herpes Virus 4 (Epstein Barr virus); identical to SEQ ID NO: 536194

SEQ ID NO: 537269 - RNA, 64 nt, Human Herpes Virus 4 (Epstein Barr virus); identical to SEQ ID NO: 536194

SEQ ID NO: 537270 - RNA, 64 nt, Human Herpes Virus 4 (Epstein Barr virus); identical to SEQ ID NO: 536194

SEQ ID NO: 537271 - RNA, 64 nt, Human Herpes Virus 4 (Epstein Barr virus); identical to SEQ ID NO: 536194

SEQ ID NO: 537272 - RNA, 64 nt, Human Herpes Virus 4 (Epstein Barr virus); identical to SEQ ID NO: 536194

SEQ ID NO: 537273 - RNA, 64 nt, Human Herpes Virus 4 (Epstein Barr virus); identical to SEQ ID NO: 536194

SEQ ID NO: 537274 - RNA, 64 nt, Human Herpes Virus 4 (Epstein Barr virus); identical to SEQ ID NO: 536194

SEQ ID NO: 537275 - RNA, 64 nt, Human Herpes Virus 4 (Epstein Barr virus); identical to SEQ ID NO: 536206

SEQ ID NO: 537276 - RNA, 64 nt, Human Herpes Virus 4 (Epstein Barr virus); identical to SEQ ID NO: 536207

SEQ ID NO: 537277 - RNA, 64 nt, Human Herpes Virus 4 (Epstein Barr virus); identical to SEQ ID NO: 536207

SEQ ID NO: 537278 - RNA, 64 nt, Human Herpes Virus 4 (Epstein Barr virus); identical to SEQ ID NO: 536207

SEQ ID NO: 537279 - RNA, 64 nt, Human Herpes Virus 4 (Epstein Barr virus); identical to SEQ ID NO: 536207

SEQ ID NO: 537280 - RNA, 64 nt, Human Herpes Virus 4 (Epstein Barr virus); identical to SEQ ID NO: 536207

SEQ ID NO: 537281 - RNA, 64 nt, Human Herpes Virus 4 (Epstein Barr virus); identical to SEQ ID NO: 536207

SEQ ID NO: 537282 - RNA, 64 nt, Human Herpes Virus 4 (Epstein Barr virus); identical to SEQ ID NO: 536207

SEQ ID NO: 537283 - RNA, 64 nt, Human Herpes Virus 4 (Epstein Barr virus); identical to SEQ ID NO: 536207

SEQ ID NO: 537284 - RNA, 64 nt, Human Herpes Virus 4 (Epstein Barr virus); identical to SEQ ID NO: 536207

SEQ ID NO: 537285 - RNA, 64 nt, Human Herpes Virus 4 (Epstein Barr virus); identical to SEQ ID NO: 536207

SEQ ID NO: 537286 - RNA, 64 nt, Human Herpes Virus 4 (Epstein Barr virus); identical to SEQ ID NO: 536207

SEQ ID NO: 537287 - RNA, 64 nt, Human Herpes Virus 4 (Epstein Barr virus); identical to SEQ ID NO: 536207

SEQ ID NO: 537288 - RNA, 64 nt, Human Herpes Virus 4 (Epstein Barr virus); identical to SEQ ID NO: 536207

SEQ ID NO: 537289 - RNA, 64 nt, Human Herpes Virus 4 (Epstein Barr virus); identical to SEQ ID NO: 536207

SEQ ID NO: 537290 - RNA, 64 nt, Human Herpes Virus 4 (Epstein Barr virus); identical to SEQ ID NO: 536207

SEQ ID NO: 537291 - RNA, 64 nt, Human Herpes Virus 4 (Epstein Barr virus); identical to SEQ ID NO: 536207

SEQ ID NO: 537292 - RNA, 64 nt, Human Herpes Virus 4 (Epstein Barr virus); identical to SEQ ID NO: 536207

SEQ ID NO: 537293 - RNA, 64 nt, Human Herpes Virus 4 (Epstein Barr virus); identical to SEQ ID NO: 536207

SEQ ID NO: 537294 - RNA, 64 nt, Human Herpes Virus 4 (Epstein Barr virus); identical to SEQ ID NO: 536207

SEQ ID NO: 537295 - RNA, 64 nt, Human Herpes Virus 4 (Epstein Barr virus); identical to SEQ ID NO: 536207

SEQ ID NO: 537296 - RNA, 64 nt, Human Herpes Virus 4 (Epstein Barr virus); identical to SEQ ID NO: 536207

SEQ ID NO: 537297 - RNA, 64 nt, Human Herpes Virus 4 (Epstein Barr virus); identical to SEQ ID NO: 536207

SEQ ID NO: 537298 - RNA, 64 nt, Human Herpes Virus 4 (Epstein Barr virus); identical to SEQ ID NO: 536207

SEQ ID NO: 537299 - RNA, 64 nt, Human Herpes Virus 4 (Epstein Barr virus); identical to SEQ ID NO: 536207

SEQ ID NO: 537300 - RNA, 64 nt, Human Herpes Virus 4 (Epstein Barr virus); identical to SEQ ID NO: 536231

SEQ ID NO: 537301 - RNA, 64 nt, Human Herpes Virus 4 (Epstein Barr virus); identical to SEQ ID NO: 536232

SEQ ID NO: 537302 - RNA, 64 nt, Human Herpes Virus 4 (Epstein Barr virus)
ccugauucagaugucccgggacagggcccccuuuguggaccagagccaaucucacagccuguuu

SEQ ID NO: 537303 - RNA, 61 nt, Human Herpes Virus 1
gccgcgggggccgaggaagugugcccggaagacgcgccacgcggagacuuccggggccguc

SEQ ID NO: 537304 - RNA, 61 nt, Human Herpes Virus 1
ggcuccgggggggucuucgcggggaccagauacgcgccauccagcucgccgaccacuggcu

SEQ ID NO: 537305 - RNA, 61 nt, Human Herpes Virus 1
aaagaucuugagccgcucguccgcccgaacgacgcgccacacaaagacggaguugacaaug

SEQ ID NO: 537306 - RNA, 61 nt, Human Herpes Virus 1
cgaaguugccauggcugggcgggaggggcgcacgcgccagcgaacuuuacgggacacaauc

SEQ ID NO: 537307 - RNA, 61 nt, Human Herpes Virus 1
gggguguacguguuacgcguaugggucggugacgcgccaaacgccagccuguuuguccugg

SEQ ID NO: 537308 - RNA, 61 nt, Human Herpes Virus 1
cgacgugcccuguaaccuaugcaccuucgacacgcgccacgccugcguacacacgacgcuc

SEQ ID NO: 537309 - RNA, 61 nt, Human Herpes Virus 1
cugcacuuuagcaccgcccccccaaaccccgacgcgccauggaccccccggguggccggcu

SEQ ID NO: 537310 - RNA, 61 nt, Human Herpes Virus 1; identical to SEQ ID NO: 537303

SEQ ID NO: 537311 - RNA, 64 nt, Human Herpes Virus 4 (Epstein Barr virus)
cagcuauuucuggucgcaucagagcgccaggaguccacacaaauguaagagggggucuucuacc

SEQ ID NO: 537312 - RNA, 64 nt, Human Herpes Virus 4 (Epstein Barr virus); identical to SEQ ID NO: 537311

SEQ ID NO: 537313 - RNA, 64 nt, Human Herpes Virus 4 (Epstein Barr virus); identical to SEQ ID NO: 537311

SEQ ID NO: 537314 - RNA, 64 nt, Human Herpes Virus 4 (Epstein Barr virus)
gacucguuaauuacgcuuguguacauauuuaaauccacacaaguggccagagugggcaaaacaa

SEQ ID NO: 537315 - RNA, 64 nt, Human Herpes Virus 4 (Epstein Barr virus)
augaacaaguggcgguggaacacggcaccgucagccacacaaucagccgggaggaagauggcgu

SEQ ID NO: 537316 - RNA, 64 nt, Human Herpes Virus 2; identical to SEQ ID NO: 536773

SEQ ID NO: 537317 - RNA, 64 nt, Human Herpes Virus 2; identical to SEQ ID NO: 536774

SEQ ID NO: 537318 - RNA, 64 nt, Human Herpes Virus 2; identical to SEQ ID NO: 536774

SEQ ID NO: 537319 - RNA, 64 nt, Human Herpes Virus 4 (Epstein Barr virus)
gaggccaccguggcccgcagacacauucgggugaaggcucgacgcgggcccgggugccuacuga

SEQ ID NO: 537320 - RNA, 64 nt, Human Herpes Virus 4 (Epstein Barr virus)
ugcguggcaucuccccgccuacaaaugcguggacaggcucgacaaaguucugaugauuaucccg

SEQ ID NO: 537321 - RNA, 64 nt, Human Herpes Virus 4 (Epstein Barr virus)
cguugaacaggauguggcacccuaagaggacgcaggcauacaagguuauuacccaguccuugua

SEQ ID NO: 537322 - RNA, 64 nt, Human Herpes Virus 1
gugcaccaagaccuccucguuuucgggaaacgccccgcgccaccacagacgcggggcguuccag

SEQ ID NO: 537323 - RNA, 64 nt, Human Herpes Virus 1
caccaugcgcgggggggcggcccugaucggcuccccgcgccaucaucuaacccgccaagugauc

SEQ ID NO: 537324 - RNA, 64 nt, Human Herpes Virus 1
gcaugagcugcgcgcugugaccgacaaacccccuccgcgccaggcccgccgccacugucgucgc

SEQ ID NO: 537325 - RNA, 64 nt, Human Herpes Virus 1
aguacguggccgguaccaucaaccacccggccauccgcgccaagguggacugguuggaagcgcg

SEQ ID NO: 537326 - RNA, 64 nt, Human Herpes Virus 1
ggccgcuguucgagggccaggacacggccgcggcccgcgccaacgccgucggggcguaccuggc

SEQ ID NO: 537327 - RNA, 64 nt, Human Herpes Virus 1
gagcguccucgggcgcaugugcuaaccucgggucccgcgccaaccucuuuggaccugcauguuu

SEQ ID NO: 537328 - RNA, 64 nt, Human Herpes Virus 1
ugggcgagguggagcugcccggcggccaguugagccgcgccauccucacgcaguacuggaagua

SEQ ID NO: 537329 - RNA, 64 nt, Human Herpes Virus 1
cgggccguuuuuuguggggcugaucgccugcgugcagcuggagcgcguccucgagacggccgcc

SEQ ID NO: 537330 - RNA, 64 nt, Human Herpes Virus 1
cgagcgucgcggugugcgaagagucccccggcagcagcuggaaggcgggggcguucgagcgcgc

SEQ ID NO: 537331 - RNA, 64 nt, Human Herpes Virus 1
uccgggcaggggucacccugggugucgcugggcccagcuggaauguggcgugcguggcggcgcu

SEQ ID NO: 537332 - RNA, 64 nt, Human Herpes Virus 1
cgccuuccagcgucgaagaccggcccugggccagcagcuggacacgcucggcccccccugccaa

SEQ ID NO: 537333 - RNA, 64 nt, Human Herpes Virus 1
ccgggcccugggguacgccuacauuaacucgggucagcuggaggcggacgaugccugcgccaac

SEQ ID NO: 537334 - RNA, 64 nt, Human Herpes Virus 2
cgucaccgucuuccacguguacgacauccuggagcacguggaacacgcguacagcaugcgcgcc

SEQ ID NO: 537335 - RNA, 64 nt, Human Herpes Virus 2
agcggguggccgaguucguucaggaacuccacgacacguggaagggccugcagacggagcgcgc

SEQ ID NO: 537336 - RNA, 64 nt, Human Herpes Virus 2
caaauuuugggcggacgugcgcgccgccgcggaacacguggaccuucgccccgcguccucggcg

SEQ ID NO: 537337 - RNA, 64 nt, Human Herpes Virus 4 (Epstein Barr virus)
uauacuggagaugauucaugggcuggggguucccggacaauacacccaucuggaguucaaccua

SEQ ID NO: 537338 - RNA, 64 nt, Human Herpes Virus 4 (Epstein Barr virus)
accgacaggcggcauauccacccggcacauucgcggacaauaagauuuacaaccuguuuguggg

SEQ ID NO: 537339 - RNA, 64 nt, Human Herpes Virus 1; identical to SEQ ID NO: 535500

SEQ ID NO: 537340 - RNA, 64 nt, Human Herpes Virus 1; identical to SEQ ID NO: 535501

SEQ ID NO: 537341 - RNA, 64 nt, Human Herpes Virus 1
gcacgcuacaacccacgccccagugcacccgcggcaacgacaaccugcgguccaugggaaucgg

SEQ ID NO: 537342 - RNA, 64 nt, Human Herpes Virus 1
gcgugccaucacggccaaggcgcgggaugcuccgcaacgacagccaccgggccguguccccgga

SEQ ID NO: 537343 - RNA, 64 nt, Human Herpes Virus 1
gauguauuuacgcgguacgccccaccggcaccaacaacgacaccgcccucguguggaugaaaau

SEQ ID NO: 537344 - RNA, 64 nt, Human Herpes Virus 1
cggcuucaucgcgccccucggguucucgcugcaacaacgacagauaguguuccccgcguacgac

SEQ ID NO: 537345 - RNA, 64 nt, Human Herpes Virus 4 (Epstein Barr virus)
ccaccaaggccuacccguccuaccacucugccacccacaccacuacucacgguacuacaaaggc

SEQ ID NO: 537346 - RNA, 64 nt, Human Herpes Virus 4 (Epstein Barr virus)
cucacgguacuacaaaggccuaccgaacuucaacccacaccaucaccaccacgcaugcaucucc

SEQ ID NO: 537347 - RNA, 64 nt, Human Herpes Virus 4 (Epstein Barr virus)
gggccgugcaccugccaucgggacagauugucuuccacaccauccacagccccacucuugccuc

SEQ ID NO: 537348 - RNA, 64 nt, Human Herpes Virus 4 (Epstein Barr virus)
cgaguucuugggccugguccgggaggcauagcucccacaccaucgagccugcaugcugcuccuc

SEQ ID NO: 537349 - RNA, 64 nt, Human Herpes Virus 4 (Epstein Barr virus)
agagccggggcaucgcggaucacccccucugggcccacaccagcgagccccugcguccggaucu

SEQ ID NO: 537350 - RNA, 64 nt, Human Herpes Virus 4 (Epstein Barr virus)
cagccacuaccauagcccccaccacauuagucucccacaccacaagcaccagucacaggcccca

SEQ ID NO: 537351 - RNA, 64 nt, Human Herpes Virus 4 (Epstein Barr virus)
gcgagacccugcgcuuugccgaugcccuggccgcccacaccacccggagccuguuuguggcccc

SEQ ID NO: 537352 - RNA, 64 nt, Human Herpes Virus 4 (Epstein Barr virus)
ggccacccucagaaggcgccuccuggugccggcccucagggagagccggggcaucgcggaucac

SEQ ID NO: 537353 - RNA, 64 nt, Human Herpes Virus 4 (Epstein Barr virus)
caccuuucuuccucccguuaaaaggaagaagggccucagggauagccgggaagguauguuccug

SEQ ID NO: 537354 - RNA, 64 nt, Human Herpes Virus 4 (Epstein Barr virus)
cgaggacauccucgacaauuuggagaaugggacgcucagggaucugcuggagaucuccgaccuc

SEQ ID NO: 537355 - RNA, 64 nt, Human Herpes Virus 2
cuccuccuccgagccggacgcgggcgaccgcggcgccccagaagaagaaggccucgagggccag

SEQ ID NO: 537356 - RNA, 64 nt, Human Herpes Virus 2
ccuacccgccccgggcgcgugucgcgcaacggaagccccagaacgcgaggacgggugccgaaaa

SEQ ID NO: 537357 - RNA, 64 nt, Human Herpes Virus 2
gccccacgucaccgggggccccggguucccauuggccccagagccccccacgugggcaacccga

SEQ ID NO: 537358 - RNA, 62 nt, Human Herpes Virus 1
ggguacuucgccgccgcgacccgccacccggugugcgcgauguuuggucagcagcuggcguc

SEQ ID NO: 537359 - RNA, 62 nt, Human Herpes Virus 1
cccgaucgcacgcuguucgcgcacgucgcgcugugcgcgaucgggcggcgccucggcacuau

SEQ ID NO: 537360 - RNA, 62 nt, Human Herpes Virus 1
gccugcgcgcguggcugcgcgagcugcgguucgugcgcgacgcgcuggugcucaugcgccug

SEQ ID NO: 537361 - RNA, 62 nt, Human Herpes Virus 1; identical to SEQ ID NO: 537360

SEQ ID NO: 537362 - RNA, 62 nt, Human Herpes Virus 1
uggucgaggugucucgcaugugcgcugcaaacgugcgcgaucccccgcccccggcuacaggg

SEQ ID NO: 537363 - RNA, 64 nt, Human Herpes Virus 2
cggcgcacggaugucgugaucacgggcacccgcgcccccagaccgauggccgggaccggggccg

SEQ ID NO: 537364 - RNA, 64 nt, Human Herpes Virus 2
ggcuggccaugcgaaagcagauccgcucgcggaucccccagagcacccccgaggaggccguccu

SEQ ID NO: 537365 - RNA, 64 nt, Human Herpes Virus 2
cccccggggacgacgcggggggcggcacugccgccccccagaccugcggaaucgucaagcgccu

SEQ ID NO: 537366 - RNA, 64 nt, Human Herpes Virus 2
gccgcagcgugcuccuacaugccccaucggaggccccccagaucgugcgcggggcuucggacga

SEQ ID NO: 537367 - RNA, 58 nt, Human Herpes Virus 2
cacccccacccccccgagacauggggaacccccagacgaccaucgcguacagccuaca

SEQ ID NO: 537368 - RNA, 64 nt, Human Herpes Virus 2
gccccagggacccucacggcuaccuggcccccgccccccagaccccccuggccuucuacgaggu

SEQ ID NO: 537369 - RNA, 64 nt, Human Herpes Virus 2
cgaaccgggagacgcuggaugaacucgaaagcgccccccagacaacgcgcgugcgcgcggaucu

SEQ ID NO: 537370 - RNA, 64 nt, Human Herpes Virus 2
uuuuccauccucuacucgguccugcagcaccucgcccccagacuagcgggcggcgggagcgacg

SEQ ID NO: 537371 - RNA, 64 nt, Human Herpes Virus 2
acguuuuucagcuagagcugcuucgacgaugcgacccccagaucggccuggggaagcucgccca

SEQ ID NO: 537372 - RNA, 64 nt, Human Herpes Virus 2
ccgaugagcccuccuggcagacgggggacgaugacccccagaaccccgggcccccgcuggccgu

SEQ ID NO: 537373 - RNA, 64 nt, Human Herpes Virus 4 (Epstein Barr virus)
ccggaaacagcugccccacgccaguggccaaugccccugcgaccuaucccuaugcgccccuugc

SEQ ID NO: 537374 - RNA, 64 nt, Human Herpes Virus 4 (Epstein Barr virus)
gccacgggcaacccccugccugcagcaccggaaacccugcgagacuacuuggaagcuuuccgaa

SEQ ID NO: 537375 - RNA, 64 nt, Human Herpes Virus 4 (Epstein Barr virus)
aacccggcugguucacggauuggaaacagagucucccugcgacccuggacgcuuggcccgccac

SEQ ID NO: 537376 - RNA, 64 nt, Human Herpes Virus 4 (Epstein Barr virus); identical to SEQ ID NO: 537373

SEQ ID NO: 537377 - RNA, 64 nt, Human Herpes Virus 4 (Epstein Barr virus); identical to SEQ ID NO: 537374

SEQ ID NO: 537378 - RNA, 64 nt, Human Herpes Virus 4 (Epstein Barr virus); identical to SEQ ID NO: 537375

SEQ ID NO: 537379 - RNA, 64 nt, Human Herpes Virus 4 (Epstein Barr virus)
caccaagcugcgcacaaacuccauggccggugguucagccaagucagacuccagaugacccaac

SEQ ID NO: 537380 - RNA, 64 nt, Human Herpes Virus 4 (Epstein Barr virus)
ccauaucugacguguucgaggggcgagaggugugucagccaaagaggaucaggcccuuccaucc

SEQ ID NO: 537381 - RNA, 64 nt, Human Herpes Virus 4 (Epstein Barr virus)
ccuucugcuaccacaucgcggaugaugggcgugacuaucuaauccagaggacccgcgagacccu

SEQ ID NO: 537382 - RNA, 64 nt, Human Herpes Virus 4 (Epstein Barr virus)
gagcggagucccgcugagcagaugccgccucgucccauggaaccggcgcagguugcggggccgg

SEQ ID NO: 537383 - RNA, 64 nt, Human Herpes Virus 4 (Epstein Barr virus)
gaugagguagaaauuuugcauauuuucagacccaccauggaaucauuugaaggacagggggacu

SEQ ID NO: 537384 - RNA, 55 nt, Human Herpes Virus 4 (Epstein Barr virus)
gaaauuuugcauauuuucagacccaccauggaaucauuugaaggacagggggacu

SEQ ID NO: 537385 - RNA, 64 nt, Human Herpes Virus 4 (Epstein Barr virus)
ccaggaccuggcgguagugcagugucccugcugcccauggaaugcucagaccccggguuggugg

SEQ ID NO: 537386 - RNA, 64 nt, Human Herpes Virus 4 (Epstein Barr virus)
uccugauuugcucuucgugcucuucauguccacugagcaagauccuucuggcacgacuguuccu

SEQ ID NO: 537387 - RNA, 64 nt, Human Herpes Virus 4 (Epstein Barr virus)
cuacaugacuagcaucaagcaaacuaauuucuuugagcaagagaguuccgauuacaccaugcug

SEQ ID NO: 537388 - RNA, 64 nt, Human Herpes Virus 4 (Epstein Barr virus)
caccguguggacaccaccccaugcuggaccaagagagcaagaaagauacgcucgggaagccgag

SEQ ID NO: 537389 - RNA, 64 nt, Human Herpes Virus 4 (Epstein Barr virus)
gaaaguuauggcaagcgccgacaccugcccccgggagcaagagcgcccagagccccaagggccc

SEQ ID NO: 537390 - RNA, 64 nt, Human Herpes Virus 1
gcacggaugugguuaucacgggccgccgcgccccacgacccaucgccgggucgggggcgggguc

SEQ ID NO: 537391 - RNA, 64 nt, Human Herpes Virus 1
acacagcgccacggccuguacgucccucggcccgacgacccagucuuggccgaugccaucaacg

SEQ ID NO: 537392 - RNA, 64 nt, Human Herpes Virus 1
cuaucgcccucaggugggggagccggaaccaacaacgacccacccggcccuuugucccccggag

SEQ ID NO: 537393 - RNA, 64 nt, Human Herpes Virus 1
ccccccgcgccuagccacgcaucuucgggccgugacgacccacgaccccaaccccgcggccagc

SEQ ID NO: 537394 - RNA, 64 nt, Human Herpes Virus 1
acacguccgacuggucuuaugacgacauucccccacgacccaagcgggcccggguaaaccugcg

SEQ ID NO: 537395 - RNA, 64 nt, Human Herpes Virus 1
caaacgucagacgagcgcgcuuguccccgaacaaacgacccaccaauaaaauuaugguauccua

SEQ ID NO: 537396 - RNA, 64 nt, Human Herpes Virus 1
gacgggccccgggguuuuaaggagcggcaguuugacgacccacccccugaccuacccccccgua

SEQ ID NO: 537397 - RNA, 64 nt, Human Herpes Virus 1
ucccccuuccccgcgcuaguccggcucguaggccgguacacacagcgccacggccuguacgucc

SEQ ID NO: 537398 - RNA, 64 nt, Human Herpes Virus 1
guccacgaggcaguuaacugucuggagacccuaugguacacacgggugcgucugguggucguag

SEQ ID NO: 537399 - RNA, 64 nt, Human Herpes Virus 4 (Epstein Barr virus)
ucccgucguacguauguuuaugagggagcgacagcucccccaguccaccggccguaaaccucag

SEQ ID NO: 537400 - RNA, 64 nt, Human Herpes Virus 4 (Epstein Barr virus)
agcuggcuuauuucuuagagcugcuaagcuacuacucccccaaggaugaacagcgugacaucgc

SEQ ID NO: 537401 - RNA, 64 nt, Human Herpes Virus 4 (Epstein Barr virus)
uacgcggagcugcaccggagccugccggaguuuucucccccagaucacggcugucuagacgcgu

SEQ ID NO: 537402 - RNA, 64 nt, Human Herpes Virus 4 (Epstein Barr virus)
ggcggccacccggcgucuacaccuaucgucccugcucccccaggcaaugcagcggcgcaagccu

SEQ ID NO: 537403 - RNA, 64 nt, Human Herpes Virus 4 (Epstein Barr virus)
gccacucaagagcuuccugcucguguccaauauccucccccaggacaacaggcccuggcacgag

SEQ ID NO: 537404 - RNA, 64 nt, Human Herpes Virus 4 (Epstein Barr virus)
cggaugauguuaaggacgggcucggagaaauggggccggccagggccacgggaccuggaaugca

SEQ ID NO: 537405 - RNA, 64 nt, Human Herpes Virus 4 (Epstein Barr virus)
cgcucagcuccuccuguuggccuccuguguggccgccggccaggcugucaccgcuuucuugggu

SEQ ID NO: 537406 - RNA, 64 nt, Human Herpes Virus 4 (Epstein Barr virus)
gacagacgucgaggcauacugccggucccugagggccggccaaacggcgcgcgcggauccggcc

SEQ ID NO: 537407 - RNA, 64 nt, Human Herpes Virus 4 (Epstein Barr virus)
auacccccccacgcuucaaggguuucuaugcuuggccggccaggccaccugccggggccagugg

SEQ ID NO: 537408 - RNA, 60 nt, Human Herpes Virus 4 (Epstein Barr virus)
agacagguaacucacuaaacauugcaccuugccggccaccuuugcuaucuuugcugaaga

SEQ ID NO: 537409 - RNA, 64 nt, Human Herpes Virus 4 (Epstein Barr virus)
uguuagacagguaacucacuaaacauugcaccuugccggccaccuuugcuaucuuugcugaaga

SEQ ID NO: 537410 - RNA, 64 nt, Human Herpes Virus 4 (Epstein Barr virus)
gagcuccagggccggaaccccggacccggcugcagccggccaccccccgccggagcggggcagc

SEQ ID NO: 537411 - RNA, 64 nt, Human Herpes Virus 4 (Epstein Barr virus); identical to SEQ ID NO: 537410

SEQ ID NO: 537412 - RNA, 64 nt, Human Herpes Virus 4 (Epstein Barr virus); identical to SEQ ID NO: 537410

SEQ ID NO: 537413 - RNA, 64 nt, Human Herpes Virus 4 (Epstein Barr virus); identical to SEQ ID NO: 537410

SEQ ID NO: 537414 - RNA, 64 nt, Human Herpes Virus 4 (Epstein Barr virus); identical to SEQ ID NO: 537410

SEQ ID NO: 537415 - RNA, 64 nt, Human Herpes Virus 4 (Epstein Barr virus); identical to SEQ ID NO: 537410

SEQ ID NO: 537416 - RNA, 64 nt, Human Herpes Virus 4 (Epstein Barr virus); identical to SEQ ID NO: 537410

SEQ ID NO: 537417 - RNA, 64 nt, Human Herpes Virus 4 (Epstein Barr virus); identical to SEQ ID NO: 537410

SEQ ID NO: 537418 - RNA, 64 nt, Human Herpes Virus 4 (Epstein Barr virus); identical to SEQ ID NO: 537410

SEQ ID NO: 537419 - RNA, 64 nt, Human Herpes Virus 4 (Epstein Barr virus); identical to SEQ ID NO: 537410

SEQ ID NO: 537420 - RNA, 64 nt, Human Herpes Virus 4 (Epstein Barr virus); identical to SEQ ID NO: 537410

SEQ ID NO: 537421 - RNA, 64 nt, Human Herpes Virus 4 (Epstein Barr virus); identical to SEQ ID NO: 537410

SEQ ID NO: 537422 - RNA, 64 nt, Human Herpes Virus 4 (Epstein Barr virus); identical to SEQ ID NO: 537410

SEQ ID NO: 537423 - RNA, 64 nt, Human Herpes Virus 4 (Epstein Barr virus); identical to SEQ ID NO: 537410

SEQ ID NO: 537424 - RNA, 64 nt, Human Herpes Virus 4 (Epstein Barr virus); identical to SEQ ID NO: 537410

SEQ ID NO: 537425 - RNA, 64 nt, Human Herpes Virus 4 (Epstein Barr virus); identical to SEQ ID NO: 537410

SEQ ID NO: 537426 - RNA, 64 nt, Human Herpes Virus 4 (Epstein Barr virus); identical to SEQ ID NO: 537410

SEQ ID NO: 537427 - RNA, 64 nt, Human Herpes Virus 4 (Epstein Barr virus); identical to SEQ ID NO: 537410

SEQ ID NO: 537428 - RNA, 64 nt, Human Herpes Virus 4 (Epstein Barr virus); identical to SEQ ID NO: 537410

SEQ ID NO: 537429 - RNA, 64 nt, Human Herpes Virus 4 (Epstein Barr virus); identical to SEQ ID NO: 537410

SEQ ID NO: 537430 - RNA, 64 nt, Human Herpes Virus 4 (Epstein Barr virus); identical to SEQ ID NO: 537410

SEQ ID NO: 537431 - RNA, 64 nt, Human Herpes Virus 4 (Epstein Barr virus); identical to SEQ ID NO: 537410

SEQ ID NO: 537432 - RNA, 64 nt, Human Herpes Virus 4 (Epstein Barr virus); identical to SEQ ID NO: 537410

SEQ ID NO: 537433 - RNA, 64 nt, Human Herpes Virus 4 (Epstein Barr virus); identical to SEQ ID NO: 537410

SEQ ID NO: 537434 - RNA, 64 nt, Human Herpes Virus 4 (Epstein Barr virus); identical to SEQ ID NO: 537404

SEQ ID NO: 537435 - RNA, 64 nt, Human Herpes Virus 4 (Epstein Barr virus); identical to SEQ ID NO: 537405

SEQ ID NO: 537436 - RNA, 64 nt, Human Herpes Virus 4 (Epstein Barr virus); identical to SEQ ID NO: 537406

SEQ ID NO: 537437 - RNA, 64 nt, Human Herpes Virus 4 (Epstein Barr virus); identical to SEQ ID NO: 537407

SEQ ID NO: 537438 - RNA, 60 nt, Human Herpes Virus 4 (Epstein Barr virus); identical to SEQ ID NO: 537408

SEQ ID NO: 537439 - RNA, 64 nt, Human Herpes Virus 4 (Epstein Barr virus); identical to SEQ ID NO: 537409

SEQ ID NO: 537440 - RNA, 64 nt, Human Herpes Virus 4 (Epstein Barr virus); identical to SEQ ID NO: 537410

SEQ ID NO: 537441 - RNA, 64 nt, Human Herpes Virus 4 (Epstein Barr virus); identical to SEQ ID NO: 537410

SEQ ID NO: 537442 - RNA, 64 nt, Human Herpes Virus 4 (Epstein Barr virus); identical to SEQ ID NO: 537410

SEQ ID NO: 537443 - RNA, 64 nt, Human Herpes Virus 4 (Epstein Barr virus); identical to SEQ ID NO: 537410

SEQ ID NO: 537444 - RNA, 64 nt, Human Herpes Virus 4 (Epstein Barr virus); identical to SEQ ID NO: 537410

SEQ ID NO: 537445 - RNA, 64 nt, Human Herpes Virus 4 (Epstein Barr virus); identical to SEQ ID NO: 537410

SEQ ID NO: 537446 - RNA, 64 nt, Human Herpes Virus 4 (Epstein Barr virus); identical to SEQ ID NO: 537410

SEQ ID NO: 537447 - RNA, 64 nt, Human Herpes Virus 4 (Epstein Barr virus); identical to SEQ ID NO: 537410

SEQ ID NO: 537448 - RNA, 64 nt, Human Herpes Virus 4 (Epstein Barr virus); identical to SEQ ID NO: 537410

SEQ ID NO: 537449 - RNA, 64 nt, Human Herpes Virus 4 (Epstein Barr virus); identical to SEQ ID NO: 537410

SEQ ID NO: 537450 - RNA, 64 nt, Human Herpes Virus 4 (Epstein Barr virus); identical to SEQ ID NO: 537410

SEQ ID NO: 537451 - RNA, 64 nt, Human Herpes Virus 4 (Epstein Barr virus); identical to SEQ ID NO: 537410

SEQ ID NO: 537452 - RNA, 64 nt, Human Herpes Virus 4 (Epstein Barr virus); identical to SEQ ID NO: 537410

SEQ ID NO: 537453 - RNA, 64 nt, Human Herpes Virus 4 (Epstein Barr virus); identical to SEQ ID NO: 537410

SEQ ID NO: 537454 - RNA, 64 nt, Human Herpes Virus 4 (Epstein Barr virus); identical to SEQ ID NO: 537410

SEQ ID NO: 537455 - RNA, 64 nt, Human Herpes Virus 4 (Epstein Barr virus); identical to SEQ ID NO: 537410

SEQ ID NO: 537456 - RNA, 64 nt, Human Herpes Virus 4 (Epstein Barr virus); identical to SEQ ID NO: 537410

SEQ ID NO: 537457 - RNA, 64 nt, Human Herpes Virus 4 (Epstein Barr virus); identical to SEQ ID NO: 537410

SEQ ID NO: 537458 - RNA, 64 nt, Human Herpes Virus 4 (Epstein Barr virus); identical to SEQ ID NO: 537410

SEQ ID NO: 537459 - RNA, 64 nt, Human Herpes Virus 4 (Epstein Barr virus); identical to SEQ ID NO: 537410

SEQ ID NO: 537460 - RNA, 64 nt, Human Herpes Virus 4 (Epstein Barr virus); identical to SEQ ID NO: 537410

SEQ ID NO: 537461 - RNA, 64 nt, Human Herpes Virus 4 (Epstein Barr virus); identical to SEQ ID NO: 537410

SEQ ID NO: 537462 - RNA, 64 nt, Human Herpes Virus 4 (Epstein Barr virus); identical to SEQ ID NO: 537410

SEQ ID NO: 537463 - RNA, 64 nt, Human Herpes Virus 4 (Epstein Barr virus); identical to SEQ ID NO: 537410

SEQ ID NO: 537464 - RNA, 64 nt, Human Herpes Virus 4 (Epstein Barr virus); identical to SEQ ID NO: 537404

SEQ ID NO: 537465 - RNA, 64 nt, Human Herpes Virus 4 (Epstein Barr virus); identical to SEQ ID NO: 537405

SEQ ID NO: 537466 - RNA, 64 nt, Human Herpes Virus 4 (Epstein Barr virus); identical to SEQ ID NO: 537406

SEQ ID NO: 537467 - RNA, 64 nt, Human Herpes Virus 4 (Epstein Barr virus); identical to SEQ ID NO: 537407

SEQ ID NO: 537468 - RNA, 60 nt, Human Herpes Virus 4 (Epstein Barr virus); identical to SEQ ID NO: 537408

SEQ ID NO: 537469 - RNA, 64 nt, Human Herpes Virus 4 (Epstein Barr virus); identical to SEQ ID NO: 537409

SEQ ID NO: 537470 - RNA, 64 nt, Human Herpes Virus 4 (Epstein Barr virus); identical to SEQ ID NO: 537410

SEQ ID NO: 537471 - RNA, 64 nt, Human Herpes Virus 4 (Epstein Barr virus); identical to SEQ ID NO: 537410

SEQ ID NO: 537472 - RNA, 64 nt, Human Herpes Virus 4 (Epstein Barr virus); identical to SEQ ID NO: 537410

SEQ ID NO: 537473 - RNA, 64 nt, Human Herpes Virus 4 (Epstein Barr virus); identical to SEQ ID NO: 537410

SEQ ID NO: 537474 - RNA, 64 nt, Human Herpes Virus 4 (Epstein Barr virus); identical to SEQ ID NO: 537410

SEQ ID NO: 537475 - RNA, 64 nt, Human Herpes Virus 4 (Epstein Barr virus); identical to SEQ ID NO: 537410

SEQ ID NO: 537476 - RNA, 64 nt, Human Herpes Virus 4 (Epstein Barr virus); identical to SEQ ID NO: 537410

SEQ ID NO: 537477 - RNA, 64 nt, Human Herpes Virus 4 (Epstein Barr virus); identical to SEQ ID NO: 537410

SEQ ID NO: 537478 - RNA, 64 nt, Human Herpes Virus 4 (Epstein Barr virus); identical to SEQ ID NO: 537410

SEQ ID NO: 537479 - RNA, 64 nt, Human Herpes Virus 4 (Epstein Barr virus); identical to SEQ ID NO: 537410

SEQ ID NO: 537480 - RNA, 64 nt, Human Herpes Virus 4 (Epstein Barr virus); identical to SEQ ID NO: 537410

SEQ ID NO: 537481 - RNA, 64 nt, Human Herpes Virus 4 (Epstein Barr virus); identical to SEQ ID NO: 537410

SEQ ID NO: 537482 - RNA, 64 nt, Human Herpes Virus 4 (Epstein Barr virus); identical to SEQ ID NO: 537410

SEQ ID NO: 537483 - RNA, 64 nt, Human Herpes Virus 4 (Epstein Barr virus); identical to SEQ ID NO: 537410

SEQ ID NO: 537484 - RNA, 64 nt, Human Herpes Virus 4 (Epstein Barr virus); identical to SEQ ID NO: 537410

SEQ ID NO: 537485 - RNA, 64 nt, Human Herpes Virus 4 (Epstein Barr virus); identical to SEQ ID NO: 537410

SEQ ID NO: 537486 - RNA, 64 nt, Human Herpes Virus 4 (Epstein Barr virus); identical to SEQ ID NO: 537410

SEQ ID NO: 537487 - RNA, 64 nt, Human Herpes Virus 4 (Epstein Barr virus); identical to SEQ ID NO: 537410

SEQ ID NO: 537488 - RNA, 64 nt, Human Herpes Virus 4 (Epstein Barr virus); identical to SEQ ID NO: 537410

SEQ ID NO: 537489 - RNA, 64 nt, Human Herpes Virus 4 (Epstein Barr virus); identical to SEQ ID NO: 537410

SEQ ID NO: 537490 - RNA, 64 nt, Human Herpes Virus 4 (Epstein Barr virus); identical to SEQ ID NO: 537410

SEQ ID NO: 537491 - RNA, 64 nt, Human Herpes Virus 4 (Epstein Barr virus); identical to SEQ ID NO: 537410

SEQ ID NO: 537492 - RNA, 64 nt, Human Herpes Virus 4 (Epstein Barr virus); identical to SEQ ID NO: 537410

SEQ ID NO: 537493 - RNA, 64 nt, Human Herpes Virus 4 (Epstein Barr virus); identical to SEQ ID NO: 537410

SEQ ID NO: 537494 - RNA, 64 nt, Human Herpes Virus 4 (Epstein Barr virus); identical to SEQ ID NO: 537404

SEQ ID NO: 537495 - RNA, 64 nt, Human Herpes Virus 4 (Epstein Barr virus); identical to SEQ ID NO: 537405

SEQ ID NO: 537496 - RNA, 64 nt, Human Herpes Virus 4 (Epstein Barr virus); identical to SEQ ID NO: 537406

SEQ ID NO: 537497 - RNA, 64 nt, Human Herpes Virus 4 (Epstein Barr virus); identical to SEQ ID NO: 537407

SEQ ID NO: 537498 - RNA, 60 nt, Human Herpes Virus 4 (Epstein Barr virus); identical to SEQ ID NO: 537408

SEQ ID NO: 537499 - RNA, 64 nt, Human Herpes Virus 4 (Epstein Barr virus); identical to SEQ ID NO: 537409

SEQ ID NO: 537500 - RNA, 64 nt, Human Herpes Virus 4 (Epstein Barr virus); identical to SEQ ID NO: 537410

SEQ ID NO: 537501 - RNA, 64 nt, Human Herpes Virus 4 (Epstein Barr virus); identical to SEQ ID NO: 537410

SEQ ID NO: 537502 - RNA, 64 nt, Human Herpes Virus 4 (Epstein Barr virus); identical to SEQ ID NO: 537410

SEQ ID NO: 537503 - RNA, 64 nt, Human Herpes Virus 4 (Epstein Barr virus); identical to SEQ ID NO: 537410

SEQ ID NO: 537504 - RNA, 64 nt, Human Herpes Virus 4 (Epstein Barr virus); identical to SEQ ID NO: 537410

SEQ ID NO: 537505 - RNA, 64 nt, Human Herpes Virus 4 (Epstein Barr virus); identical to SEQ ID NO: 537410

SEQ ID NO: 537506 - RNA, 64 nt, Human Herpes Virus 4 (Epstein Barr virus); identical to SEQ ID NO: 537410

SEQ ID NO: 537507 - RNA, 64 nt, Human Herpes Virus 4 (Epstein Barr virus); identical to SEQ ID NO: 537410

SEQ ID NO: 537508 - RNA, 64 nt, Human Herpes Virus 4 (Epstein Barr virus); identical to SEQ ID NO: 537410

SEQ ID NO: 537509 - RNA, 64 nt, Human Herpes Virus 4 (Epstein Barr virus); identical to SEQ ID NO: 537410

SEQ ID NO: 537510 - RNA, 64 nt, Human Herpes Virus 4 (Epstein Barr virus); identical to SEQ ID NO: 537410

SEQ ID NO: 537511 - RNA, 64 nt, Human Herpes Virus 4 (Epstein Barr virus); identical to SEQ ID NO: 537410

SEQ ID NO: 537512 - RNA, 64 nt, Human Herpes Virus 4 (Epstein Barr virus); identical to SEQ ID NO: 537410

SEQ ID NO: 537513 - RNA, 64 nt, Human Herpes Virus 4 (Epstein Barr virus); identical to SEQ ID NO: 537410

SEQ ID NO: 537514 - RNA, 64 nt, Human Herpes Virus 4 (Epstein Barr virus); identical to SEQ ID NO: 537410

SEQ ID NO: 537515 - RNA, 64 nt, Human Herpes Virus 4 (Epstein Barr virus); identical to SEQ ID NO: 537410

SEQ ID NO: 537516 - RNA, 64 nt, Human Herpes Virus 4 (Epstein Barr virus); identical to SEQ ID NO: 537410

SEQ ID NO: 537517 - RNA, 64 nt, Human Herpes Virus 4 (Epstein Barr virus); identical to SEQ ID NO: 537410

SEQ ID NO: 537518 - RNA, 64 nt, Human Herpes Virus 4 (Epstein Barr virus); identical to SEQ ID NO: 537410

SEQ ID NO: 537519 - RNA, 64 nt, Human Herpes Virus 4 (Epstein Barr virus); identical to SEQ ID NO: 537410

SEQ ID NO: 537520 - RNA, 64 nt, Human Herpes Virus 4 (Epstein Barr virus); identical to SEQ ID NO: 537410

SEQ ID NO: 537521 - RNA, 64 nt, Human Herpes Virus 4 (Epstein Barr virus); identical to SEQ ID NO: 537410

SEQ ID NO: 537522 - RNA, 64 nt, Human Herpes Virus 4 (Epstein Barr virus); identical to SEQ ID NO: 537410

SEQ ID NO: 537523 - RNA, 64 nt, Human Herpes Virus 4 (Epstein Barr virus); identical to SEQ ID NO: 537410

SEQ ID NO: 537524 - RNA, 64 nt, Human Herpes Virus 4 (Epstein Barr virus); identical to SEQ ID NO: 537404

SEQ ID NO: 537525 - RNA, 64 nt, Human Herpes Virus 4 (Epstein Barr virus); identical to SEQ ID NO: 537405

SEQ ID NO: 537526 - RNA, 64 nt, Human Herpes Virus 4 (Epstein Barr virus); identical to SEQ ID NO: 537406

SEQ ID NO: 537527 - RNA, 64 nt, Human Herpes Virus 4 (Epstein Barr virus); identical to SEQ ID NO: 537407

SEQ ID NO: 537528 - RNA, 60 nt, Human Herpes Virus 4 (Epstein Barr virus); identical to SEQ ID NO: 537408

SEQ ID NO: 537529 - RNA, 64 nt, Human Herpes Virus 4 (Epstein Barr virus); identical to SEQ ID NO: 537409

SEQ ID NO: 537530 - RNA, 64 nt, Human Herpes Virus 4 (Epstein Barr virus); identical to SEQ ID NO: 537410

SEQ ID NO: 537531 - RNA, 64 nt, Human Herpes Virus 4 (Epstein Barr virus); identical to SEQ ID NO: 537410

SEQ ID NO: 537532 - RNA, 64 nt, Human Herpes Virus 4 (Epstein Barr virus); identical to SEQ ID NO: 537410

SEQ ID NO: 537533 - RNA, 64 nt, Human Herpes Virus 4 (Epstein Barr virus); identical to SEQ ID NO: 537410

SEQ ID NO: 537534 - RNA, 64 nt, Human Herpes Virus 4 (Epstein Barr virus); identical to SEQ ID NO: 537410

SEQ ID NO: 537535 - RNA, 64 nt, Human Herpes Virus 4 (Epstein Barr virus); identical to SEQ ID NO: 537410

SEQ ID NO: 537536 - RNA, 64 nt, Human Herpes Virus 4 (Epstein Barr virus); identical to SEQ ID NO: 537410

SEQ ID NO: 537537 - RNA, 64 nt, Human Herpes Virus 4 (Epstein Barr virus); identical to SEQ ID NO: 537410

SEQ ID NO: 537538 - RNA, 64 nt, Human Herpes Virus 4 (Epstein Barr virus); identical to SEQ ID NO: 537410

SEQ ID NO: 537539 - RNA, 64 nt, Human Herpes Virus 4 (Epstein Barr virus); identical to SEQ ID NO: 537410

SEQ ID NO: 537540 - RNA, 64 nt, Human Herpes Virus 4 (Epstein Barr virus); identical to SEQ ID NO: 537410

SEQ ID NO: 537541 - RNA, 64 nt, Human Herpes Virus 4 (Epstein Barr virus); identical to SEQ ID NO: 537410

SEQ ID NO: 537542 - RNA, 64 nt, Human Herpes Virus 4 (Epstein Barr virus); identical to SEQ ID NO: 537410

SEQ ID NO: 537543 - RNA, 64 nt, Human Herpes Virus 4 (Epstein Barr virus); identical to SEQ ID NO: 537410

SEQ ID NO: 537544 - RNA, 64 nt, Human Herpes Virus 4 (Epstein Barr virus); identical to SEQ ID NO: 537410

SEQ ID NO: 537545 - RNA, 64 nt, Human Herpes Virus 4 (Epstein Barr virus); identical to SEQ ID NO: 537410

SEQ ID NO: 537546 - RNA, 64 nt, Human Herpes Virus 4 (Epstein Barr virus); identical to SEQ ID NO: 537410

SEQ ID NO: 537547 - RNA, 64 nt, Human Herpes Virus 4 (Epstein Barr virus); identical to SEQ ID NO: 537410

SEQ ID NO: 537548 - RNA, 64 nt, Human Herpes Virus 4 (Epstein Barr virus); identical to SEQ ID NO: 537410

SEQ ID NO: 537549 - RNA, 64 nt, Human Herpes Virus 4 (Epstein Barr virus); identical to SEQ ID NO: 537410

SEQ ID NO: 537550 - RNA, 64 nt, Human Herpes Virus 4 (Epstein Barr virus); identical to SEQ ID NO: 537410

SEQ ID NO: 537551 - RNA, 64 nt, Human Herpes Virus 4 (Epstein Barr virus); identical to SEQ ID NO: 537410

SEQ ID NO: 537552 - RNA, 64 nt, Human Herpes Virus 4 (Epstein Barr virus); identical to SEQ ID NO: 537410

SEQ ID NO: 537553 - RNA, 64 nt, Human Herpes Virus 4 (Epstein Barr virus); identical to SEQ ID NO: 537410

SEQ ID NO: 537554 - RNA, 64 nt, Human Herpes Virus 2
ggucgccggggccgcggagcgcgccggcccggggcuucuggaucuggccgucgcguucgacucc

SEQ ID NO: 537555 - RNA, 64 nt, Human Herpes Virus 2
ccaggagcuucaucacccccgaguucccccgggacuucuggauguugcccguguucaacauccc

SEQ ID NO: 537556 - RNA, 64 nt, Human Herpes Virus 2
cgaccgaggcauccuuguacauaacgcgauuuucggcgagcagguguuucugccccucgaccau

SEQ ID NO: 537557 - RNA, 64 nt, Human Herpes Virus 2
ucccgccggagacaaacacggccccggccuucccggcgagcaccuuuuauacccccgcggagga

SEQ ID NO: 537558 - RNA, 64 nt, Human Herpes Virus 2
ggcgccccucgucggcggaacccaggaguucgccggcgagcaccuggccaugcugugcggguuc

SEQ ID NO: 537559 - RNA, 64 nt, Human Herpes Virus 4 (Epstein Barr virus)
ucgggucuuggcacggcccccaagacacucauuaucacacgaacggcuaccaaugccaccacaa

SEQ ID NO: 537560 - RNA, 64 nt, Human Herpes Virus 4 (Epstein Barr virus)
uucucaccgugcuaccucagccuacgauuugaccucacacgagacaagcugcugagcauggccc

SEQ ID NO: 537561 - RNA, 64 nt, Human Herpes Virus 4 (Epstein Barr virus)
uguugcgggugccggcccuuacaacagguuuuggcaacgagagcaauacacaauuaggcuaaaa

SEQ ID NO: 537562 - RNA, 64 nt, Human Herpes Virus 4 (Epstein Barr virus)
agcagguggccacgguucugcucucggccgggcucaacgagaccguggcgggggacuacgccau

SEQ ID NO: 537563 - RNA, 64 nt, Human Herpes Virus 4 (Epstein Barr virus)
gccaggcgaccagccaguacuacuuccaguccggcaacgagauccacgucuacaacgacuacca

SEQ ID NO: 537564 - RNA, 64 nt, Human Herpes Virus 4 (Epstein Barr virus)
acaccaagaccuacgagggacagcugggcaccgacaacgagaucuuccucacaaaaaagaugac

SEQ ID NO: 537565 - RNA, 64 nt, Human Herpes Virus 4 (Epstein Barr virus)
accccuaugugaucucgggggccucgggcuccuacaacgagacggacuuuuugggcaacuuucu

SEQ ID NO: 537566 - RNA, 62 nt, Human Herpes Virus 1
ccggcacgcucucugucuccauggcccgccgccgccgccaucgcggcccccgccgcccccgg

SEQ ID NO: 537567 - RNA, 64 nt, Human Herpes Virus 1
ucaucgccacgucggaccccaccccgcgacgggacgccgccacaaaaagcagacgccgacgacc

SEQ ID NO: 537568 - RNA, 64 nt, Human Herpes Virus 1
cacagcucgcccccgagccccacgcaaggcgcagcgccgccacggcguacgggucauagacgcc

SEQ ID NO: 537569 - RNA, 64 nt, Human Herpes Virus 1
cccagcgcacagcggcugccgcugcccuggagaacgccgccaugcaggcggccgagcuccccgu

SEQ ID NO: 537570 - RNA, 64 nt, Human Herpes Virus 1
ucggcacuaucgucaccuacgacaccggucucgacgccgccaucgcgcccuuucgccaccuguc

SEQ ID NO: 537571 - RNA, 64 nt, Human Herpes Virus 1
gcgccccucuaccgacggagcccgcguucccccccgccgccaccggaucccaaccggaggcauc

SEQ ID NO: 537572 - RNA, 64 nt, Human Herpes Virus 1
ccccggacaccgcgugugugcacggcgagcugcucgccgccaagcgggaaagauucgcggcggu

SEQ ID NO: 537573 - RNA, 64 nt, Human Herpes Virus 1
cgcugugaccgacaaacccccuccgcgccaggcccgccgccacugucgucgccgucccacgcuc

SEQ ID NO: 537574 - RNA, 64 nt, Human Herpes Virus 1
uggcgcacgggaccccgcuacaaccggaccacaucgccgccacccuggacgcggaggccacguu

SEQ ID NO: 537575 - RNA, 64 nt, Human Herpes Virus 1
agcccuggucauuugcggaauuguguacuggaugcgccgccacacucaaaaagccccaaagcgc

SEQ ID NO: 537576 - RNA, 64 nt, Human Herpes Virus 1
gucuguauacccccguagcgaugggcaucaaucucgccgccagcucacaaccuuuggauccgga

SEQ ID NO: 537577 - RNA, 64 nt, Human Herpes Virus 1
cgcguugguucagcgggcagugcaggacgucacccgccgccacccgguccgagcgcggaccggg

SEQ ID NO: 537578 - RNA, 64 nt, Human Herpes Virus 1
ucguggagacggguucggcgguguccacggccaccgccgccagcgacguacaguuuaagcgccc

SEQ ID NO: 537579 - RNA, 64 nt, Human Herpes Virus 1
gccccugcuuuaaguucuuuacgucggccgacaucgccgccaaacaucgcugccuggagcgccu

SEQ ID NO: 537580 - RNA, 64 nt, Human Herpes Virus 1
uggucuuucuggaggcccuggagaagcgcaucuacgccgccaccaacguucccuacccccuggu

SEQ ID NO: 537581 - RNA, 64 nt, Human Herpes Virus 1
ccgacaucgacacggucauccacgccgacgccaacgccgccauguuugcgggccugggcgcguu

SEQ ID NO: 537582 - RNA, 64 nt, Human Herpes Virus 1
ggccccgaaccugacgcgacuuugcgagcgggcacgccgccauuuuggcuuuucggacuacacc

SEQ ID NO: 537583 - RNA, 64 nt, Human Herpes Virus 1
gcugucccgcgugcaacgcgggagacgggcgguucgccgccaccagccgcgaggcccuaauccu

SEQ ID NO: 537584 - RNA, 64 nt, Human Herpes Virus 1
cgccggggcgaggcguaccuggcgaggacguccucgccgccagcccuggugcugcgcgaggcca

SEQ ID NO: 537585 - RNA, 64 nt, Human Herpes Virus 1
gcccugcaggacaccaccaagucgccgugccggccgccgccaccgcgggacuacgagcgccuuc

SEQ ID NO: 537586 - RNA, 64 nt, Human Herpes Virus 1
uccgcccccaagacccccgcuccguccugacggacgccgccaaccgacgacaugcggguccugg

SEQ ID NO: 537587 - RNA, 64 nt, Human Herpes Virus 1
gccaagcgcccgaaucgggcgacaucgcgcagcgcgccgccauuccugaaggguaccccaccca

SEQ ID NO: 537588 - RNA, 64 nt, Human Herpes Virus 1
acgacccggcguuucuggccacggccaagcugcgcgccgccauggcggcguuucuguugucggg

SEQ ID NO: 537589 - RNA, 64 nt, Human Herpes Virus 1
ccccguucaagagcggggccguggcggccaaguacgccgccaccguggccggccugcgcgacgc

SEQ ID NO: 537590 - RNA, 62 nt, Human Herpes Virus 1; identical to SEQ ID NO: 537566

SEQ ID NO: 537591 - RNA, 62 nt, Human Herpes Virus 1
uuuuuucuccgcgcgcucacgggcucggcccccgccgacaucgcccgcugcgucguccacag

SEQ ID NO: 537592 - RNA, 62 nt, Human Herpes Virus 1
ugcucggcuggccaggucacgaacccccaguucgccgacaggcuguaccgcuggcagccgga

SEQ ID NO: 537593 - RNA, 62 nt, Human Herpes Virus 1
cgcgccccggccccggagcgaaaggcgcccgccgccgacaccaucgacgccaccacgcgguu

SEQ ID NO: 537594 - RNA, 62 nt, Human Herpes Virus 1
gugggccgcgcggacgacggcggcgaggccggcgccgacacgcggcgcuuuaucuuccacga

SEQ ID NO: 537595 - RNA, 62 nt, Human Herpes Virus 1
ccgcaagccccuagccccgcccccuuuguccccgccgacaagccgcgauuccgagggccggg

SEQ ID NO: 537596 - RNA, 62 nt, Human Herpes Virus 1
cagcgccgcaaccagcugcacgaccugcgcuucgccgacaucgacacggucauccacgccga

SEQ ID NO: 537597 - RNA, 62 nt, Human Herpes Virus 1
gaggaguacgcguacucccaccagcugagccgcgccgacaucaccaccgucagcaccuucau

SEQ ID NO: 537598 - RNA, 62 nt, Human Herpes Virus 1
uuugacgaaaaccacgagggcgccgcccuccccgccgacauuacguucacggccuucgaagc

SEQ ID NO: 537599 - RNA, 62 nt, Human Herpes Virus 1
cugguucgccaacacgaguagggucgcgcgcgcgccgacaccgcguuucagaacgcagcaga

SEQ ID NO: 537600 - RNA, 62 nt, Human Herpes Virus 1
acgcaagccacuggacgagcggccgacacguacgccgacauguaacgaccaacaggcgcgcc

SEQ ID NO: 537601 - RNA, 62 nt, Human Herpes Virus 1
aucgugacccggcauaucacggccccugauaucgccgacagguuucuggagcaguugcggac

SEQ ID NO: 537602 - RNA, 64 nt, Human Herpes Virus 1
ccgcuggcaacucgccccacgacccgacucaccucaaagggacgacccuugguuccgacgccuc

SEQ ID NO: 537603 - RNA, 62 nt, Human Herpes Virus 2
accgccuccgcguccgacgcgcccagggcucccccgcugacggccugguggaccagggcgcc

SEQ ID NO: 537604 - RNA, 62 nt, Human Herpes Virus 2
ccccuggucagcuuucgguacgaagaccagggcccgcugaucgaggggcagcugggcgagaa

SEQ ID NO: 537605 - RNA, 62 nt, Human Herpes Virus 2
gagccccagccccagcccgaccuggaccugggcccgcugauggccaccgugcugaagcacgg

SEQ ID NO: 537606 - RNA, 64 nt, Human Herpes Virus 1
cugcgaccgagaccugccggacagcagcgacucugaggcggagaccgaagugggggggcggggg

SEQ ID NO: 537607 - RNA, 64 nt, Human Herpes Virus 1
ggacgccgaccaccaugacgacgacuccgccuccgaggcggacagcacggacacggaacuguuc

SEQ ID NO: 537608 - RNA, 64 nt, Human Herpes Virus 1
cgcgcuccucaacgccaccacuuaccgggaccucgaggcggacuggcucggccacguggcggcc

SEQ ID NO: 537609 - RNA, 64 nt, Human Herpes Virus 1
ccaacggcugguucgccgguacaggaacgcccgggaggcggauaucgccgggguggccgagcgg

SEQ ID NO: 537610 - RNA, 64 nt, Human Herpes Virus 1
ggaggcgcuggagacggcggcggccgccgccgaagaggcggaugccgcgcgcggggaugagccg

SEQ ID NO: 537611 - RNA, 64 nt, Human Herpes Virus 1
cgcgucguuccgcggcaucuccgcggaccacuucgaggcggaggugguggagcgcaccgacgug

SEQ ID NO: 537612 - RNA, 64 nt, Human Herpes Virus 1
augcaaugcuacggcgcucggugcgccaggcccagaggcggagcagcgcacgauggacccccga

SEQ ID NO: 537613 - RNA, 64 nt, Human Herpes Virus 1
gggcgacagccgcccgggccucuggggggcgcccgaggcggaggaggcgcgacgccgguucgag

SEQ ID NO: 537614 - RNA, 64 nt, Human Herpes Virus 1
gauacgucaaggcgacucggcucucgaggaggccgaggcggaguaucgcccagcucacgaccuu

SEQ ID NO: 537615 - RNA, 64 nt, Human Herpes Virus 1
auccauaccugacguauuacaagagauuaggguggaggcggaggugggcgggagccaugguguu

SEQ ID NO: 537616 - RNA, 64 nt, Human Herpes Virus 1
ccugggguacgccuacauuaacucgggucagcuggaggcggacgaugccugcgccaaccucuau

SEQ ID NO: 537617 - RNA, 64 nt, Human Herpes Virus 1
cacggcgaaugcagcgccggccuccccguacauugaggcggaaaauccccuguacgacuggggg

SEQ ID NO: 537618 - RNA, 64 nt, Human Herpes Virus 1
auaugagaugauccgcgcggccguuccgcccucggaggcggagccgcggcugcaggaggcccug

SEQ ID NO: 537619 - RNA, 64 nt, Human Herpes Virus 1; identical to SEQ ID NO: 537607

SEQ ID NO: 537620 - RNA, 64 nt, Human Herpes Virus 1; identical to SEQ ID NO: 537606

SEQ ID NO: 537621 - RNA, 64 nt, Human Herpes Virus 1; identical to SEQ ID NO: 537613

SEQ ID NO: 537622 - RNA, 64 nt, Human Herpes Virus 4 (Epstein Barr virus)
caauuuuagaugagguagaaauuuugcauauuuucagacccaccauggaaucauuugaaggaca

SEQ ID NO: 537623 - RNA, 64 nt, Human Herpes Virus 4 (Epstein Barr virus)
gacaaggcacuucagagcccaccaccggccuccacagacccagccaccaugcuaucagguaacg

SEQ ID NO: 537624 - RNA, 64 nt, Human Herpes Virus 4 (Epstein Barr virus)
gguucucgccgccuuugcucgcacggcccggguccagacccaccaccucgugccggcccuaacc

SEQ ID NO: 537625 - RNA, 64 nt, Human Herpes Virus 4 (Epstein Barr virus)
ccgggcacucaucgaugaguuuaugucugucaaacagacccacgcccccauccauuacggacac

SEQ ID NO: 537626 - RNA, 64 nt, Human Herpes Virus 4 (Epstein Barr virus)
gaggcucaacaacgccauccugaaggcgugcggccagacccaguucuacaucagccugauucag

SEQ ID NO: 537627 - RNA, 64 nt, Human Herpes Virus 1
ccaacaacgacaccgcccucguguggaugaaaaugaaccagacccuauuguuucugggggcccc

SEQ ID NO: 537628 - RNA, 64 nt, Human Herpes Virus 4 (Epstein Barr virus)
aaagaaugucugaggggagccacccucggggcccaggccccagaguccagaggucaggggcacc

SEQ ID NO: 537629 - RNA, 64 nt, Human Herpes Virus 4 (Epstein Barr virus); identical to SEQ ID NO: 537628

SEQ ID NO: 537630 - RNA, 64 nt, Human Herpes Virus 4 (Epstein Barr virus); identical to SEQ ID NO: 537628

SEQ ID NO: 537631 - RNA, 64 nt, Human Herpes Virus 4 (Epstein Barr virus); identical to SEQ ID NO: 537628

SEQ ID NO: 537632 - RNA, 64 nt, Human Herpes Virus 4 (Epstein Barr virus); identical to SEQ ID NO: 537628

SEQ ID NO: 537633 - RNA, 64 nt, Human Herpes Virus 4 (Epstein Barr virus); identical to SEQ ID NO: 537628

SEQ ID NO: 537634 - RNA, 64 nt, Human Herpes Virus 4 (Epstein Barr virus); identical to SEQ ID NO: 537628

SEQ ID NO: 537635 - RNA, 64 nt, Human Herpes Virus 4 (Epstein Barr virus); identical to SEQ ID NO: 537628

SEQ ID NO: 537636 - RNA, 64 nt, Human Herpes Virus 4 (Epstein Barr virus)
cagagaccugcuugaaacuguuaugugaaaacauaggccccaccuacgagcuggccguggaccu

SEQ ID NO: 537637 - RNA, 64 nt, Human Herpes Virus 4 (Epstein Barr virus)
ccuuccucggucggccccuaaaacgcaagcacaaaggccccaagcuguuuaaccugaagacccu

SEQ ID NO: 537638 - RNA, 64 nt, Human Herpes Virus 4 (Epstein Barr virus)
acgugccuaccaaccucaccgcaccugcaagcacaggccccacuguauccaccgcggaugucac

SEQ ID NO: 537639 - RNA, 64 nt, Human Herpes Virus 4 (Epstein Barr virus)
cacauuagucucccacaccacaagcaccagucacaggccccauaggcggccuguuucuaaacgu

SEQ ID NO: 537640 - RNA, 64 nt, Human Herpes Virus 4 (Epstein Barr virus)
ccaaucucaacagaggccccaacaugugcagggaaggccccaccaaaggcaugcacacggccgu

SEQ ID NO: 537641 - RNA, 64 nt, Human Herpes Virus 4 (Epstein Barr virus)
ucauuaccaugggccccgacgccaaucucaacagaggccccaacaugugcagggaaggccccac

SEQ ID NO: 537642 - RNA, 64 nt, Human Herpes Virus 4 (Epstein Barr virus)
ucgggaggcucaaagaaguuaccugguauuucugacaucccaguucugcuacgaagaguacgug

SEQ ID NO: 537643 - RNA, 64 nt, Human Herpes Virus 4 (Epstein Barr virus)
aucaugcaucuccugcuccagggcaccucccuucacaucccagagaccugcuugaaacuguuau

SEQ ID NO: 537644 - RNA, 64 nt, Human Herpes Virus 4 (Epstein Barr virus)
cauaaauagggcugaggccagucaagacagcacuacaucccagcuagcccgucguagagacaga

SEQ ID NO: 537645 - RNA, 64 nt, Human Herpes Virus 4 (Epstein Barr virus)
cauggcggacugcgccuuuaggcguaacuugucuacaucccauaccuacaccaccccaccauau

SEQ ID NO: 537646 - RNA, 60 nt, Human immunodeficiency virus type 1 (BAL)
gaacaacugcuugucacacccuaugagccugcaugggauggaugacccggagaaagaagu

SEQ ID NO: 537647 - RNA, 64 nt, Human Herpes Virus 2
cuaggcguggcgggccgcccggagacccgggcuacgcggaaacccccuacgcgagcguguccca

SEQ ID NO: 537648 - RNA, 64 nt, Human Herpes Virus 2
cccaccugcacgaggucgucgugggccgggacggcgcggaaagcgucauccgcccgaccagcgc

SEQ ID NO: 537649 - RNA, 64 nt, Human Herpes Virus 2
gggcgggggggucaacuucacgcucacccagccgcgcggaaacguggaccugggugugggcuac

SEQ ID NO: 537650 - RNA, 64 nt, Human Herpes Virus 2
ucguggucagacgcaacgcagagaaaccagcggacgcggaaauuccgaccgugucggccgcaga

SEQ ID NO: 537651 - RNA, 64 nt, Human Herpes Virus 2
gcucgcguccuuccgggggaucaagauaggcuacacggcccacauccgcaaggcgaccgagccc

SEQ ID NO: 537652 - RNA, 64 nt, Human Herpes Virus 2
uauccugcggcaggcgacccgccgcccgcgcaucacggcccaccugcacgaggucgucgugggc

SEQ ID NO: 537653 - RNA, 64 nt, Human Herpes Virus 2
cgaccccccgggaggaggcggcgccugcgccccgacggcccacaucgauuccgccaacgcgcug

SEQ ID NO: 537654 - RNA, 64 nt, Human Herpes Virus 2
uguguucggggccaaggcgauccuggcccgcacgacggcccagugccgcacggacgaggaggcc

SEQ ID NO: 537655 - RNA, 64 nt, Human Herpes Virus 2
gccgcgcgccagcgcaagcgcggagcaccgccgcaacgcacaugcguaccacgcagcaacaaga

SEQ ID NO: 537656 - RNA, 64 nt, Human Herpes Virus 2
cagguucugccggcaguuuacggaccgcgugcugcugcuccacucgcucaccccgcccggcgac

SEQ ID NO: 537657 - RNA, 64 nt, Human Herpes Virus 2
ggcccaccuggaccccaccguccugcugcgggaccugcuccagcggcgagaggcccgcccccaa

SEQ ID NO: 537658 - RNA, 62 nt, Human Herpes Virus 2
ggcccccggccgagcgccagggcagccccacgcccgccgacgcgcagggauccugugggggu

SEQ ID NO: 537659 - RNA, 62 nt, Human Herpes Virus 2
acgcggcucugccccggccccccuccccaacccccgccgauuuccgggcgagcgcguccccg

SEQ ID NO: 537660 - RNA, 62 nt, Human Herpes Virus 2
gggcgucgaacgcagggauggccgaccccacgcccgccgaugagggaacggccgccgccauc

SEQ ID NO: 537661 - RNA, 62 nt, Human Herpes Virus 2
cguguuguguccccgagcgucucuuccgcccccccgccgagcgcccccgacgcgagucugcc

SEQ ID NO: 537662 - RNA, 62 nt, Human Herpes Virus 2
gggacgcggccgucugguucgaggacaugacccccgccgaacuagagguuauauucccgacc

SEQ ID NO: 537663 - RNA, 62 nt, Human Herpes Virus 2
gggguuccggacgcgaccgccaccccccgagacccgccgauuuugguguuuacgaacgaguu

SEQ ID NO: 537664 - RNA, 62 nt, Human Herpes Virus 2
augaagauaaaccagacgcuguuguuucugggcccgccgaccgccccccccggcggggcaug

SEQ ID NO: 537665 - RNA, 62 nt, Human Herpes Virus 2
agcgcccuuccgcguccgcgaugaccucccggcccgccgaccaagacucggugcguuccagc

SEQ ID NO: 537666 - RNA, 62 nt, Human Herpes Virus 2
cauggccagccugucgccgcgacccccggcgccccgccgacaccaccaccaccaccaccacc

SEQ ID NO: 537667 - RNA, 62 nt, Human Herpes Virus 2
gccgccccucccgcgggggccgcgccccccgccccgccgacgccgccgccgcggccgccgcg

SEQ ID NO: 537668 - RNA, 62 nt, Human Herpes Virus 2
ggccgccgcgccccgcggcgcugacccgccggcccgccgagggccccgacccgcagggcggc

SEQ ID NO: 537669 - RNA, 62 nt, Human Herpes Virus 2
ucgucgucaacgccgugcgcgccgcggacuggcccgccgacgggcccguggucucgcggcag

SEQ ID NO: 537670 - RNA, 62 nt, Human Herpes Virus 2
gguaucgcgucuuuguccugggggccccgacgcccgccgacaacggcucggcgcuggacgcc

SEQ ID NO: 537671 - RNA, 62 nt, Human Herpes Virus 2
agcuccccgaggcggggcccacgucccguccccccgccgaggugacccagcucaagggacug

SEQ ID NO: 537672 - RNA, 62 nt, Human Herpes Virus 2
cggcgggcggcggggccagggccggcccgccgcccgccgauagcucuucuguccgcgaggag

SEQ ID NO: 537673 - RNA, 62 nt, Human Herpes Virus 2
gcgcccccagccuaacggccggccagacggcccccgccgagagcagcuucgagggcgacguu

SEQ ID NO: 537674 - RNA, 62 nt, Human Herpes Virus 2
cguucgacgaaaaccacgagggcgcggcccuccccgccgacauuacguucacggccuucgag

SEQ ID NO: 537675 - RNA, 62 nt, Human Herpes Virus 2
uccgacgacgccggcggcccccgcacuugccccccgccgacgcuucuucccccccccgccac

SEQ ID NO: 537676 - RNA, 62 nt, Human Herpes Virus 2
ccccacgcccucuaccgaccaucccgccuccgcccgccgaagcuggccgccgcgacccaccg

SEQ ID NO: 537677 - RNA, 62 nt, Human Herpes Virus 2
cggcggacaaguacgugugucgccgccugggccccgccgaucgccgguucguggcgcucagc

SEQ ID NO: 537678 - RNA, 62 nt, Human Herpes Virus 2
uccgccuggacggcgaggagguggauaugacgcccgccgacgcccuggacgacuucgacuug

SEQ ID NO: 537679 - RNA, 62 nt, Human Herpes Virus 2; identical to SEQ ID NO: 537658

SEQ ID NO: 537680 - RNA, 62 nt, Human Herpes Virus 2; identical to SEQ ID NO: 537669

SEQ ID NO: 537681 - RNA, 62 nt, Human Herpes Virus 2; identical to SEQ ID NO: 537668

SEQ ID NO: 537682 - RNA, 62 nt, Human Herpes Virus 2; identical to SEQ ID NO: 537667

SEQ ID NO: 537683 - RNA, 62 nt, Human Herpes Virus 2; identical to SEQ ID NO: 537666

SEQ ID NO: 537684 - RNA, 61 nt, Human Herpes Virus 2
gucccuguucgaccgggacaccagcaugucgcucgccgacuuucacggcgaggaguucgag

SEQ ID NO: 537685 - RNA, 61 nt, Human Herpes Virus 2
acgaagucaugucgacguugggccaacuguacucgccgacgaugcagcagcugggccgcgu

SEQ ID NO: 537686 - RNA, 61 nt, Human Herpes Virus 2
cgggcgcuucgucuuucaccaacccggggaccucgccgaggagaacgugcacgcgugcggg

SEQ ID NO: 537687 - RNA, 61 nt, Human Herpes Virus 2
uuccccaugcgcagcuucccugcgcuucgaucucgccgagggcggguucauccuggacgcg

SEQ ID NO: 537688 - RNA, 61 nt, Human Herpes Virus 2
caucgcguaccagccccuccucagcaacacgcucgccgagcuguacgugcgggaguacaug

SEQ ID NO: 537689 - RNA, 61 nt, Human Herpes Virus 2
gccgcgcgcguuacggccauacagcgggucccucgccgacagcuccucggcgcgcccgucg

SEQ ID NO: 537690 - RNA, 61 nt, Human Herpes Virus 2
uguucggucgcuucgugcgcaccagcgcccccucgccgacggccucgauggacgcggcggc

SEQ ID NO: 537691 - RNA, 61 nt, Human Herpes Virus 2
ggccccuggugcugcgugagccgagcgcccucucgccgacgccguucgccaccagcuuuuu

SEQ ID NO: 537692 - RNA, 61 nt, Human Herpes Virus 2
cgcccuggcggcccggggggugcugcaggagcucgccgagcgcgccgacccccugguccgc

SEQ ID NO: 537693 - RNA, 61 nt, Human Herpes Virus 2
cccggcccuggagggcauccaccccaacguccucgccgacccgggguucgucccuuacgug

SEQ ID NO: 537694 - RNA, 64 nt, Human Herpes Virus 1
cgcgccccccgugacgggcggggcgucucacgcagccccccagccggccgcggcucggacagcg

SEQ ID NO: 537695 - RNA, 64 nt, Human Herpes Virus 1
gacgcccggcccccagaggaucucccgacuccgcgccccccacgaaaggcaugaccggggcgcg

SEQ ID NO: 537696 - RNA, 64 nt, Human Herpes Virus 1
uccgucagcgcggggucgccuuguccccgguacugccccccaugaaccccguuccgacaucggg

SEQ ID NO: 537697 - RNA, 64 nt, Human Herpes Virus 1
cacccggcccuuugucccccggaggccguguaucgccccccaccacacagcgcccccuacgguc

SEQ ID NO: 537698 - RNA, 64 nt, Human Herpes Virus 1
agauggcgagccacaucucgcgcgcgcuguuucugccccccaucaaacucgagugcgaaaagac

SEQ ID NO: 537699 - RNA, 64 nt, Human Herpes Virus 1
acacaaaacaaaaccacccccaccgagccggccagccccccaacaacccccaagcccaccucca

SEQ ID NO: 537700 - RNA, 64 nt, Human Herpes Virus 1
ccgccccggggcgggguggacggacggccccggcgccccccauggcgaggcguggcgcggcagu

SEQ ID NO: 537701 - RNA, 64 nt, Human Herpes Virus 1
caccaccagcuggcaugguauaaaucaccggugcgccccccaaaccauguccggcagggggaug

SEQ ID NO: 537702 - RNA, 64 nt, Human Herpes Virus 1
accacauccaggcgggccuaccggacccguuccagccccccagccucccgaucacgguuuacua

SEQ ID NO: 537703 - RNA, 64 nt, Human Herpes Virus 1
cugccgcagcgugcuccuaaacgcaccgucggaggccccccagauuguccgcggggccuccgaa

SEQ ID NO: 537704 - RNA, 64 nt, Human Herpes Virus 1
gcggccccuuacacccgucgugggucucgcugaugccccccaagcaggugcccgagacggucgu

SEQ ID NO: 537705 - RNA, 64 nt, Human Herpes Virus 1
uucgggugucccccuuugaggccagcgaccccuugccccccacugccuuccgcggcggcgccuu

SEQ ID NO: 537706 - RNA, 64 nt, Human Herpes Virus 1
ucaacgucaccggagagcuggagcucguggcccugccccccacccugaacguaacccccgucug

SEQ ID NO: 537707 - RNA, 64 nt, Human Herpes Virus 1
cgacggggcguugcacgccggaauccugcugauggccccccagcaucuggaccauaccauccaa

SEQ ID NO: 537708 - RNA, 64 nt, Human Herpes Virus 1
ccugaaccggcagacgcuggacgagcucgagagcgccccccagacgacgcgcgugcgcgcggau

SEQ ID NO: 537709 - RNA, 64 nt, Human Herpes Virus 1
cccucuuugaucacuccacccacagcuucgcccagccccccaacaccgcgcuguauuacagcgu

SEQ ID NO: 537710 - RNA, 64 nt, Human Herpes Virus 1
cgcacccccgcggcgcgcguccgacgucaggcccgccccccacaggcagugcuccugggcgcgc

SEQ ID NO: 537711 - RNA, 64 nt, Human Herpes Virus 1; identical to SEQ ID NO: 537694

SEQ ID NO: 537712 - RNA, 64 nt, Human Herpes Virus 1
acccgcccgaucgugcgcacuagguccugucgcugccccccaaacaccaccacgggccuguuug

SEQ ID NO: 537713 - RNA, 64 nt, Human Herpes Virus 1
agcgaccgcaacuucccacccggagcuuucuuccggccucgaugacgucccggcucuccgaucc

SEQ ID NO: 537714 - RNA, 64 nt, Human Herpes Virus 1
ggcgaccggcccucauguuugacccgcgggcccuggccucgaucgccgcgcggugcgccgggcc

SEQ ID NO: 537715 - RNA, 64 nt, Human Herpes Virus 1
gcacacgggcccuggggauagccugcgcggccggggccucgauguggguggcggcggcggacag

SEQ ID NO: 537716 - RNA, 64 nt, Human Herpes Virus 1
gauccccagguagguacguguauuucuccccgucggccucgacguggcccgugggcaucuggac

SEQ ID NO: 537717 - RNA, 64 nt, Human Herpes Virus 1
ggaagcguggcgcuggaccucaggcgagauggggggccucgaugcgcggugcgcaacgacccgg

SEQ ID NO: 537718 - RNA, 64 nt, Human Herpes Virus 1
cugucggaagacuugggggggacacccuggagucggccucgaccgccguuuuuucaaaagggcu

SEQ ID NO: 537719 - RNA, 64 nt, Human Herpes Virus 1
ccccgggggcccuggugcccuuuuauguaggcauggccucgaugggcguguguauuaucgcaca

SEQ ID NO: 537720 - RNA, 64 nt, Human Herpes Virus 1; identical to SEQ ID NO: 537714

SEQ ID NO: 537721 - RNA, 64 nt, Human Hepatitis C Virus
caggacagcggguugaauuccucgugcaagcguggaaguccaagaagaccccgaugggguucuc

SEQ ID NO: 537722 - RNA, 64 nt, Human Herpes Virus 2
aguucgugcaagugaagcacaucgaccguguuguguccccgagcgucucuuccgcccccccgcc

SEQ ID NO: 537723 - RNA, 64 nt, Human Herpes Virus 2
auuccaggucgugaaccacgggcugauguuugugguccccgacaucgccguauacgcgaugcug

SEQ ID NO: 537724 - RNA, 64 nt, Human Herpes Virus 2
uccaaaccccccugcccguguacaggauuaccauguccccgaccggccaggcguuugccgcggc

SEQ ID NO: 537725 - RNA, 64 nt, Human Herpes Virus 2
uagcggcguugucucggaggugcuucuguuuggcguccccgaccuugagcgucgcaccaucucu

SEQ ID NO: 537726 - RNA, 64 nt, Human Herpes Virus 2
ggaggcccuggggccgcgcgacaauaucgucuacguccccgagccgaugacuuacuggcaggug

SEQ ID NO: 537727 - RNA, 64 nt, Human Herpes Virus 2
accugaccaccccggcguacagccugcucuucccguccccgaucgugcaagagggucuccgguu

SEQ ID NO: 537728 - RNA, 64 nt, Human Herpes Virus 2
cagcguccggcuggcggcgcggcaccauaacaccguccccgagagccugaucguagacgggcuc

SEQ ID NO: 537729 - RNA, 64 nt, Human Herpes Virus 2
gccggccaaccucauccgcggcgccaacgcgggcguccccgagcggcgcaucuucgccgggugu

SEQ ID NO: 537730 - RNA, 64 nt, Human Herpes Virus 2
gcccagcgacgugaucgacuggggggaugcgcacguccccgagcgcuccccgaucgacauucgc

SEQ ID NO: 537731 - RNA, 64 nt, Human Herpes Virus 2
cuggguuuuuugccccccacaacccccggggagccacccagacggcaccgccgccuugccgccg

SEQ ID NO: 537732 - RNA, 64 nt, Human Herpes Virus 2
acgaggccguaaacugcuuggaggcccucugggacacccagaugcgccugguggucgucgguug

SEQ ID NO: 537733 - RNA, 64 nt, Human Herpes Virus 2
guuggaguuugggucguaucgugccuggcggcagcacccagaacguccuggaaacggguaaccu

SEQ ID NO: 537734 - RNA, 64 nt, Human Herpes Virus 2
gugccguggaguggaucgaccgcuggcggaccgucacccagagcugccuggccaugaacccgcg

SEQ ID NO: 537735 - RNA, 64 nt, Human Herpes Virus 4 (Epstein Barr virus)
ugguucggaggauggggaauuuucagaccuggaucugucugacagcgaccaugaaggggaugag

SEQ ID NO: 537736 - RNA, 64 nt, Human Herpes Virus 4 (Epstein Barr virus)
uggcaauuuaagaugugguuaauuaaccauuuuccugucugacaccacugcaugggcaaccggg

SEQ ID NO: 537737 - RNA, 64 nt, Human Herpes Virus 4 (Epstein Barr virus)
ggguggcccaguucauccucgccucguccgcuaccugucugaccgccaucaucaucgagacaga

SEQ ID NO: 537738 - RNA, 64 nt, Human Herpes Virus 4 (Epstein Barr virus)
gacggucccggacuacguguccauguacaacuaccugucugauugcacccuggccgugcuggau

SEQ ID NO: 537739 - RNA, 63 nt, Human Herpes Virus 1
ccccggccaggcgcacggacuugcguuuagcgugcgcgcgaacgugccgccucccccgagucu

SEQ ID NO: 537740 - RNA, 63 nt, Human Herpes Virus 1
aacgacgcgccacacaaagacggaguugacaaugcgcgcgauagagucgacguccguccccag

SEQ ID NO: 537741 - RNA, 63 nt, Human Herpes Virus 1
ucugcgagcagaccgaaaaggucacacucuggggcgcgcgacccgcccgagucagcggcccgc

SEQ ID NO: 537742 - RNA, 63 nt, Human Herpes Virus 1
uuccugguggcggcgugugccgccucguacgacgcgcgcgacgccgccgaugcgguacgggcc

SEQ ID NO: 537743 - RNA, 63 nt, Human Herpes Virus 1
accagccugcgccgcgccuacgcgccccuguuggcgcgcgagaacgcggcgcugacgggggcc

SEQ ID NO: 537744 - RNA, 63 nt, Human Herpes Virus 1
accguuaacaucaccaccggaaccgcgcuauuugcgcgcgaauaccagacucuugcguuuccg

SEQ ID NO: 537745 - RNA, 63 nt, Human Herpes Virus 1
aaagucccgcgcgcgcuuagagaugaugcgacagcgcgcgaccuguguuaaaauucgcgugga

SEQ ID NO: 537746 - RNA, 63 nt, Human Herpes Virus 1
uugcgguuucccguuccgcuuccaucgccccuggcgcgcgaaaucguggcgcggcucguggcc

SEQ ID NO: 537747 - RNA, 63 nt, Human Herpes Virus 1
uggcggggggguaaacuucacgcucacccagccgcgcgcgaacguggaccugggcgugggcua

SEQ ID NO: 537748 - RNA, 63 nt, Human Herpes Virus 1
gccgaccgcuucaagcaggucgacggcuucuacgcgcgcgaccucaccaccaaggcccgggcc

SEQ ID NO: 537749 - RNA, 63 nt, Human Herpes Virus 1
cgccgucucgaacgccaucaccagacggagaaggcgcgcgagcacggcagacccugcgucgac

SEQ ID NO: 537750 - RNA, 63 nt, Human Herpes Virus 1
ggggcaguaccgagaugcccggaggugcuggccgcgcgcgagcgcgacggcucugucuggcuu

SEQ ID NO: 537751 - RNA, 63 nt, Human Herpes Virus 1
ccauggaugccgccaagcuggggccgacgcgcggcgcgcgaucgcgugcccguuugcgggagc

SEQ ID NO: 537752 - RNA, 63 nt, Human Herpes Virus 1
cggaggaucgccagaugcgcuccaggccgcgacgcgcgcgacccggggucgacgcggucucac

SEQ ID NO: 537753 - RNA, 63 nt, Human Herpes Virus 1
ggccgccgcccugcgggcgcacgugucggggaggcgcgcgaccgggcugggaggcccgccacg

SEQ ID NO: 537754 - RNA, 63 nt, Human Herpes Virus 1; identical to SEQ ID NO: 537743

SEQ ID NO: 537755 - RNA, 64 nt, Human Herpes Virus 1
ccaugugacccccugacuuuauauauacagacccccaacacauacacauggccccuuugacuca

SEQ ID NO: 537756 - RNA, 64 nt, Human Herpes Virus 1
ggagcaaaacgccucccccugagccgcuuuccuaccaacacaacggcaugccucugcgggcauc

SEQ ID NO: 537757 - RNA, 64 nt, Human Herpes Virus 1
gcuguucuugccgccacccaucggggaccugcggccaacacaacggaccccuuaacgcacgccc

SEQ ID NO: 537758 - RNA, 64 nt, Human Herpes Virus 1; identical to SEQ ID NO: 537755

SEQ ID NO: 537759 - RNA, 63 nt, Human Herpes Virus 4 (Epstein Barr virus)
uucuaagcacccgcgcuuguguuuugcuuuaucugccgccaucaugccuacauucuaucuugc

SEQ ID NO: 537760 - RNA, 63 nt, Human Herpes Virus 4 (Epstein Barr virus)
uguccggccaucuuuuagacacggaagacaaugugccgccaugguugccuccacacgacauca

SEQ ID NO: 537761 - RNA, 63 nt, Human Herpes Virus 4 (Epstein Barr virus)
ggggcgcguuguuguuauugauuccucuuugugugccgccagucacguucaggacguuaucac

SEQ ID NO: 537762 - RNA, 63 nt, Human Herpes Virus 4 (Epstein Barr virus)
uuugugaacagcuuuuccaugaucaaguucaucugccgccaccugggaaauaacgccaucucc

SEQ ID NO: 537763 - RNA, 64 nt, Human Herpes Virus 4 (Epstein Barr virus)
ggcccccugguggagaauauaaagagcaccuaucugaauaaaaucaccacggugguccacgggc

SEQ ID NO: 537764 - RNA, 64 nt, Human Herpes Virus 4 (Epstein Barr virus)
gcccaccucaaguccaucuuuugcgaggaauugcugaauaaacgcguggcuugaaaguaaacuu

SEQ ID NO: 537765 - RNA, 62 nt, Human Herpes Virus 4 (Epstein Barr virus)
ugcccuaaagaacucacgcgcacuacugguuuacugaauaaaacaacagacaugcagacucc

SEQ ID NO: 537766 - RNA, 64 nt, Human Herpes Virus 4 (Epstein Barr virus)
gaggauauagcuccucccuuugacguuagccgccugaauaaaauggcaaaacagcucugccugc

SEQ ID NO: 537767 - RNA, 64 nt, Human Herpes Virus 4 (Epstein Barr virus)
cucagcagcucucucuuucucucccccguuauaaugaauaaauguucgcagggugcuguggcug

SEQ ID NO: 537768 - RNA, 62 nt, Human Herpes Virus 4 (Epstein Barr virus)
gccagccugacugacuuccugaaaucuuuguaaaugaauaaacaguggguguugcgugauga

SEQ ID NO: 537769 - RNA, 64 nt, Human Herpes Virus 2
caucaacaugaagggcaugcgccacgugggcgacaucaacgacacgguacgcgccuacuuggac

SEQ ID NO: 537770 - RNA, 64 nt, Human Herpes Virus 2
ccuugucggcuccuucgcgcgcuucgcccugaccaucaacgacauccaccggcauuucuuucuc

SEQ ID NO: 537771 - RNA, 64 nt, Human Herpes Virus 2
ccgccuccuccccgacgcccgcagcauccacggcaucaacgaccccggauacccccccgcaguc

SEQ ID NO: 537772 - RNA, 64 nt, Human Herpes Virus 2
ggaggaggagaccgaggugggaaucucugacgacgaccuucaccgcgacuccaccuccgaggcg

SEQ ID NO: 537773 - RNA, 64 nt, Human Herpes Virus 2
agcgacggcuccacagccagucgggccggucgccgccggccagagcuucccacccgcgguccag

SEQ ID NO: 537774 - RNA, 64 nt, Human Herpes Virus 2
cauguaccucggcgcguuccugggcguguuguacgccggccacggacgccuggccgcggccacg

SEQ ID NO: 537775 - RNA, 64 nt, Human Herpes Virus 2
ucgagcacgagcaggcggucggcggcugcagcgcgccggccacccuuaucccccgugcggccgc

SEQ ID NO: 537776 - RNA, 64 nt, Human Herpes Virus 2
gggcgcucgcgaccgccgggggggcgguggcccugccggccagacggcgcgggggaucgcuggu

SEQ ID NO: 537777 - RNA, 62 nt, Human Herpes Virus 2
aacgccuuguagaagcggguauggcuucucacgccggccaacagcacgcgccugcguucggu

SEQ ID NO: 537778 - RNA, 64 nt, Human Herpes Virus 2
gaccccgccccccgacgccaacgcgaccgucgccgccggccacgccacgcugcgcgcgcaccug

SEQ ID NO: 537779 - RNA, 64 nt, Human Herpes Virus 2
ggagggggcggcuaucugcgcccccagccuaacggccggccagacggcccccgccgagagcagc

SEQ ID NO: 537780 - RNA, 64 nt, Human Herpes Virus 2
uauuacgcccacgaccgccccugcgcgccgccccgccggccaaugguguuuuuugugcccuccg

SEQ ID NO: 537781 - RNA, 64 nt, Human Herpes Virus 2
gggggaguuugagacggccgagcgccgcuucagcgccggccagcccagccuccugcgcgagacg

SEQ ID NO: 537782 - RNA, 64 nt, Human Herpes Virus 2
cggccgaccggggucccgagcccugcgccggccggccggccacguauuacacgcauauggccgg

SEQ ID NO: 537783 - RNA, 64 nt, Human Herpes Virus 2
gcgcgagcucccugcggcuggcgcggugccugacgccggccaaccucauccgcggcgccaacgc

SEQ ID NO: 537784 - RNA, 64 nt, Human Herpes Virus 2
cugcgaggcugagguacgccgcgguguuaaugguaaacgcaaagccucccggaaagaccacuag

SEQ ID NO: 537785 - RNA, 64 nt, Human Herpes Virus 2
cucucccaacaccgacguccgcauguacuccggaaaacgcaacggugccgcggacgaccucaug

SEQ ID NO: 537786 - RNA, 64 nt, Human Herpes Virus 2
agaucucgggcggaaccugggacgugcgccugcgaaacgcaauccgggaggucgaggcgcauuu

SEQ ID NO: 537787 - RNA, 64 nt, Human Herpes Virus 4 (Epstein Barr virus)
cugagaccgaagacgaggcgaguuacgcuccuuggagggacaaagacucguggucggaauccga

SEQ ID NO: 537788 - RNA, 64 nt, Human Herpes Virus 4 (Epstein Barr virus)
ucgccucauccuggcccccaaccccuauauccuagagggacagcugacggugggcaugacacag

SEQ ID NO: 537789 - RNA, 64 nt, Human Herpes Virus 4 (Epstein Barr virus)
caggcccuccgugugauucucccgcgugccaaacgagggacacuggauguccgaggagaagcgg

SEQ ID NO: 537790 - RNA, 64 nt, Human Herpes Virus 4 (Epstein Barr virus)
gcaggaucaaggaccgcccccaggucuuguuguagagggacacgguuaggacggccucgcgcag

SEQ ID NO: 537791 - RNA, 64 nt, Human Herpes Virus 4 (Epstein Barr virus)
gccccccaccguggagaaugucugcgccaugauagagggacaucugggccuggaucucgucgcc

SEQ ID NO: 537792 - RNA, 64 nt, Human Herpes Virus 4 (Epstein Barr virus)
aauguucucuaacugugucccacuccaccugccggagggacaguaccacaagcuccggcugccc

SEQ ID NO: 537793 - RNA, 64 nt, Human Herpes Virus 4 (Epstein Barr virus)
guccuucagcuuuaucaacgacaccaagaccuacgagggacagcugggcaccgacaacgagauc

SEQ ID NO: 537794 - RNA, 64 nt, Human Herpes Virus 4 (Epstein Barr virus)
gacccccgaacuuaaugaaaucuuggauacauuucuaaaugaugaaugucugcugcaugccaug

SEQ ID NO: 537795 - RNA, 62 nt, Human Herpes Virus 4 (Epstein Barr virus)
guuaagccugucuccaagauuacauuugucaccuugcccagcccccuggccucucugacccu

SEQ ID NO: 537796 - RNA, 64 nt, Human Herpes Virus 4 (Epstein Barr virus)
cgcgaggaaaaggacaucgucggaggccaggcagaagcagaagcaccccaagaaagugaagcag

SEQ ID NO: 537797 - RNA, 64 nt, Human Herpes Virus 2
auaucaauaaucucuuuggaaccauagaacgccugcgagagacgaacgcgggucuggcgaccca

SEQ ID NO: 537798 - RNA, 64 nt, Human Herpes Virus 2
ugcuacgcagcgcccgcgauggggaggcccacgcgcgagagacccacuuuacgcaguaucucau

SEQ ID NO: 537799 - RNA, 59 nt, Human immunodeficiency virus type 1 (BLAI)
guguuucaauuguggcaaagaagggcacauagccagaaauugcagggccccuaggaaaa

SEQ ID NO: 537800 - RNA, 64 nt, Human Herpes Virus 2
uccagcgccacggccuguacguucccgcgcccgacgaaccgacguuggccgaugccaugaacgg

SEQ ID NO: 537801 - RNA, 64 nt, Human Herpes Virus 2
auucacggggccgaggacaugacgcccccucccccgaaccgaaacguugacuuuccgcucgccg

SEQ ID NO: 537802 - RNA, 64 nt, Human Herpes Virus 4 (Epstein Barr virus)
ucuggacgcugguacccgccaagcacgcggugagggccgucacuccagccaucaugcugaauau

SEQ ID NO: 537803 - RNA, 64 nt, Human Herpes Virus 4 (Epstein Barr virus)
acgccaucaagagcuggugggagagguugugcguggccgucauggagggcauggaggcauagcc

SEQ ID NO: 537804 - RNA, 64 nt, Human Herpes Virus 4 (Epstein Barr virus)
ccuacgcccugcuucaaggauguguuggccuuuaggccgucauuggugaccaacugcaccgcgc

SEQ ID NO: 537805 - RNA, 64 nt, Human Herpes Virus 4 (Epstein Barr virus)
ggcugguggccuuugccuucuccgagaggacccgggccgucacccagugucucuuucacgccau

SEQ ID NO: 537806 - RNA, 64 nt, Human Herpes Virus 4 (Epstein Barr virus)
ggccccccugagcuccaagauuacggccguugucgugucccacuccuccaacccggucuucuac

SEQ ID NO: 537807 - RNA, 64 nt, Human Herpes Virus 4 (Epstein Barr virus)
gagauagggaccagaggacuaauguucucuaacugugucccacuccaccugccggagggacagu

SEQ ID NO: 537808 - RNA, 64 nt, Human Herpes Virus 1
gcacgccaccuacuuucuggccgccgugcuccucggggaccacgcggagcaggucaacacguuc

SEQ ID NO: 537809 - RNA, 64 nt, Human Herpes Virus 1
cgcagcacgcgcccggcuccgggggggucuucgcggggaccagauacgcgccauccagcucgcc

SEQ ID NO: 537810 - RNA, 64 nt, Human Herpes Virus 1
ccggcccgggaauccggccggggcaagguccccgggggaccaggcggcgccaggggccgccggg

SEQ ID NO: 537811 - RNA, 64 nt, Human Herpes Virus 1
cgaauccgagacagcaucggauucgaccgagucuggggaccaggaugaagccccccgcaucggu

SEQ ID NO: 537812 - RNA, 64 nt, Human Herpes Virus 1
agaccugcuuauucucggggagcuucgcuuugugggggaccaggucccccacaccaccuacuac

SEQ ID NO: 537813 - RNA, 64 nt, Human Herpes Virus 1
ugcugccggcgcuggacggccgggcggcggccucggggaccaccgacgccauggcgcccggcgc

SEQ ID NO: 537814 - RNA, 64 nt, Human Herpes Virus 1
gcguaaugcccgccccggccccgaagggacggccggggaccacucgcccacccccccugggccc

SEQ ID NO: 537815 - RNA, 64 nt, Human Herpes Virus 1; identical to SEQ ID NO: 537813

SEQ ID NO: 537816 - RNA, 64 nt, Human Herpes Virus 1
cccagacccgcauggaggccgaggaggccgucagggcgggcacggccguggacuuuaucuggac

SEQ ID NO: 537817 - RNA, 64 nt, Human Herpes Virus 1
ucucccugagggccgacgcaguggcgcaccuggaggcgggcaaggacuaccuggagaucgaggu

SEQ ID NO: 537818 - RNA, 64 nt, Human Herpes Virus 1
auucuggaaggcgugguguggcgccccggcgaguggcgggcaugcgcgugagcguagcaaacgc

SEQ ID NO: 537819 - RNA, 64 nt, Human Herpes Virus 1
ccugaaguaugaggaguuuuaccuaaagcguuuuggcgggcacuacauggaguccgucuuccag

SEQ ID NO: 537820 - RNA, 64 nt, Human Herpes Virus 1
gacggccucguguuacaucuacaacaacuaccucggcgggcacgccaagcccccgcccgaccgc

SEQ ID NO: 537821 - RNA, 64 nt, Human Herpes Virus 1
ucgacgacgcccggcgggacgggagggcccccgcggcgggcaccgacgccggcgaggacgccgg

SEQ ID NO: 537822 - RNA, 64 nt, Human Herpes Virus 1
ccaaccggcugugcgggccggacacggccgccugggcgggcaauuggaccggcgcccccgacgu

SEQ ID NO: 537823 - RNA, 64 nt, Human Herpes Virus 1
gguugaugacuuuacccugaccggcccggagcugggcgggcaggcgcaagccgagcugaaucac

SEQ ID NO: 537824 - RNA, 64 nt, Human Herpes Virus 1
gugguccagcugcucgaguccgccugcaggcgcuggcgggcacggcgggacaucgcgcagcgcg

SEQ ID NO: 537825 - RNA, 64 nt, Human Herpes Virus 1; identical to SEQ ID NO: 537816

SEQ ID NO: 537826 - RNA, 64 nt, Human Herpes Virus 1; identical to SEQ ID NO: 537822

SEQ ID NO: 537827 - RNA, 64 nt, Human Herpes Virus 1; identical to SEQ ID NO: 537821

SEQ ID NO: 537828 - RNA, 64 nt, Human Herpes Virus 1
cgcaggacucgcagccccccgggugguuggugauccuggccaggagccaucccagauggcgggc

SEQ ID NO: 537829 - RNA, 64 nt, Human Herpes Virus 1
uguaccugaucaccaacuaccugcccucggucucccuggccacaaaacgccuggggggcgaggc

SEQ ID NO: 537830 - RNA, 64 nt, Human Herpes Virus 1
ccagcgacgucgaguuuaacuguacggcggacaaccuggccaucgaggggggcaugagcgaccu

SEQ ID NO: 537831 - RNA, 64 nt, Human Herpes Virus 1
ccgagcgcggcgggcuguccugccugcuggcggcccuggccaaccggcugugcgggccggacac

SEQ ID NO: 537832 - RNA, 64 nt, Human Herpes Virus 1
caccgggaagcagggcccgccaucugggauggcuccuggccaggaucaccaaccacccgggggg

SEQ ID NO: 537833 - RNA, 64 nt, Human Herpes Virus 1
uguugccgaugcaacgauaccuggacaacggccgccuggccaccaggguggcccgggcgacccu

SEQ ID NO: 537834 - RNA, 64 nt, Human Herpes Virus 1
uuaucgaccgccgggcccugaacgccgccuucagccuggccaccgaggccaucgcccugcucac

SEQ ID NO: 537835 - RNA, 64 nt, Human Herpes Virus 1
ugggggcccuuccggaggacagacacaucgaccgccuggccaaacgccagcgccccggcgagcg

SEQ ID NO: 537836 - RNA, 64 nt, Human Herpes Virus 1
cgacgcacaucaaggugggccagccgcaguacuaccuggccaaugggggcuuucugaucgcgua

SEQ ID NO: 537837 - RNA, 64 nt, Human Herpes Virus 1
ucgucggcggaacccaggaauuugccggcgagcaccuggccaugcuguguggguuuuccccggc

SEQ ID NO: 537838 - RNA, 64 nt, Human Herpes Virus 1
cccaggcccccccacccgcguucuacaaggacguccuggccaaauucugggacgaguagcccaa

SEQ ID NO: 537839 - RNA, 64 nt, Human Herpes Virus 1
gcguggccgcccgcuaugccggccgcaugacguaccuggccaccggggcccugcucgcccgcuu

SEQ ID NO: 537840 - RNA, 64 nt, Human Herpes Virus 1; identical to SEQ ID NO: 537831

SEQ ID NO: 537841 - RNA, 64 nt, Human Herpes Virus 1; identical to SEQ ID NO: 536784

SEQ ID NO: 537842 - RNA, 64 nt, Human Herpes Virus 1; identical to SEQ ID NO: 536785

SEQ ID NO: 537843 - RNA, 64 nt, Human Herpes Virus 1; identical to SEQ ID NO: 536786

SEQ ID NO: 537844 - RNA, 64 nt, Human Herpes Virus 1; identical to SEQ ID NO: 536787

SEQ ID NO: 537845 - RNA, 64 nt, Human Herpes Virus 1; identical to SEQ ID NO: 536788

SEQ ID NO: 537846 - RNA, 64 nt, Human Herpes Virus 1
uccgggaugguccagacccacgucaccaccccaggcuccauaccgacgaucugcgaccuggcgc

SEQ ID NO: 537847 - RNA, 64 nt, Human Herpes Virus 1
gaguggcgggcaugcgcgugagcguagcaaacgccccgcccacacaacgcuccgcccccaaccc

SEQ ID NO: 537848 - RNA, 64 nt, Human Herpes Virus 1
uuuuaauaucuauauaguuugguccccccucuaucccgcccaccgcugggcgcuauaaagccgc

SEQ ID NO: 537849 - RNA, 64 nt, Human Herpes Virus 1
cgcacgccgacccgcggcgcuuccauuuucacgccccgcccaccuaucucgcuuccccccggga

SEQ ID NO: 537850 - RNA, 64 nt, Human Herpes Virus 1
ccaccaacgccgauguauguuuggcgucgugagucccgcccacaagaugguggccccggccacc

SEQ ID NO: 537851 - RNA, 64 nt, Human Herpes Virus 1
gccccccuccacgcccccggggcccgagcccgcccccgcccagcccgcggcgccccgggccgcc

SEQ ID NO: 537852 - RNA, 64 nt, Human Herpes Virus 1
ccuuggcccggccccacgcgggggcgcccgcagacccgcccaucgucggggcguccgacccccc

SEQ ID NO: 537853 - RNA, 64 nt, Human Herpes Virus 1
augcccagcguaccuuugagugggaaagcugagucccgcccaggggcgacggcccgggccuccu

SEQ ID NO: 537854 - RNA, 64 nt, Human Herpes Virus 1
ucuugaccugacggaucgucgaacaaaaaccagccccgcccaggcgaugagcuuuuuggcggau

SEQ ID NO: 537855 - RNA, 64 nt, Human Herpes Virus 1
ccgucgggccggaggacggcggcggggcccguuccccgcccaagguggagguucuggagggacg

SEQ ID NO: 537856 - RNA, 64 nt, Human Herpes Virus 1
gcccgcgagcccgacgacggcgcgcgucggaagccccgcccacaucccaucgccgagcgucccg

SEQ ID NO: 537857 - RNA, 64 nt, Human Herpes Virus 1; identical to SEQ ID NO: 537851

SEQ ID NO: 537858 - RNA, 64 nt, Human Herpes Virus 1
gggcccgcgucgggauccacaccgcgguucgcgucccgcccaccggaagcccaacccacacgca

SEQ ID NO: 537859 - RNA, 64 nt, Human Herpes Virus 2
gggcgcgggcggcguggugggucuggugugugcagguggcgacguucaucgucucggccaucug

SEQ ID NO: 537860 - RNA, 64 nt, Human Herpes Virus 2
gccgcccgucugugcgggcgacgggcccucggccgguggcgacgacggcgacggggacugguuc

SEQ ID NO: 537861 - RNA, 64 nt, Human Herpes Virus 2
cguacguugugcacggcucccugacgaugcgugggguggcgagggugauccagcaggcggugcu

SEQ ID NO: 537862 - RNA, 64 nt, Human Herpes Virus 2
gcgcgauggguuuucugguggacgccaucgugcggguggcgaucaacgggugggucugcgggac

SEQ ID NO: 537863 - RNA, 64 nt, Human Herpes Virus 2
uggcucgccagcagcgacucggaggaggagaccgaggugggaaucucugacgacgaccuucacc

SEQ ID NO: 537864 - RNA, 64 nt, Human Herpes Virus 2; identical to SEQ ID NO: 537863

SEQ ID NO: 537865 - RNA, 64 nt, Human Herpes Virus 2; identical to SEQ ID NO: 537863

SEQ ID NO: 537866 - RNA, 64 nt, Human Herpes Virus 2; identical to SEQ ID NO: 537863

SEQ ID NO: 537867 - RNA, 64 nt, Human Herpes Virus 1
auguuuguguugugcaaacgcgcccacgccgcucgagugcgagagcagcuucgggucguuauuc

SEQ ID NO: 537868 - RNA, 64 nt, Human Herpes Virus 1
cucgcgcgcgcuguuucugccccccaucaaacucgagugcgaaaagacguucaccaagcugcug

SEQ ID NO: 537869 - RNA, 64 nt, Human Herpes Virus 1
uccucugggggccgggcgucccauuggggacgacgagugcgaacaguacacgucgagcguaucg

SEQ ID NO: 537870 - RNA, 64 nt, Human Herpes Virus 1
ggcggccagcacgcugugguugcuuggccuggacggcacagacgcgcccccuggggcgcugacc

SEQ ID NO: 537871 - RNA, 64 nt, Human Herpes Virus 1; identical to SEQ ID NO: 537867

SEQ ID NO: 537872 - RNA, 64 nt, Human Herpes Virus 1; identical to SEQ ID NO: 537868

SEQ ID NO: 537873 - RNA, 64 nt, Human Herpes Virus 1; identical to SEQ ID NO: 537869

SEQ ID NO: 537874 - RNA, 64 nt, Human Herpes Virus 1; identical to SEQ ID NO: 537870

SEQ ID NO: 537875 - RNA, 64 nt, Human Herpes Virus 2
acacgccuugggcgucgcacgcgaccggcagggagacgaacagcccgcccgcgcuggggacgcg

SEQ ID NO: 537876 - RNA, 64 nt, Human Herpes Virus 2
cgacgacgaccuugacguuaucuucgccgggcuggacgaacagcagcuggacguguucuacugc

SEQ ID NO: 537877 - RNA, 64 nt, Human Herpes Virus 2
cuuacuggcaggugcugggggccuccgagacccugacgaacaucuacaacacgcagcaccgucu

SEQ ID NO: 537878 - RNA, 64 nt, Human Herpes Virus 2
gaguucccguggaggcccggcgacugcgggagcuaaaccacauucgcgagcaccugaaccuccc

SEQ ID NO: 537879 - RNA, 64 nt, Human Herpes Virus 4 (Epstein Barr virus)
ccugcuggacaaacaggcuggcgacagccuggcccugauggagauggagaagguggccacggcg

SEQ ID NO: 537880 - RNA, 64 nt, Human Herpes Virus 4 (Epstein Barr virus)
aauuauaacaaaacuguuguaggguaacgaagaccugauggaagugguauuguugccguugaaa

SEQ ID NO: 537881 - RNA, 64 nt, Human Herpes Virus 4 (Epstein Barr virus)
gcgaguacguggaucggacgcugcgcccaaagcccugauggaagggccaggcuaaccugccucc

SEQ ID NO: 537882 - RNA, 64 nt, Human Herpes Virus 1; identical to SEQ ID NO: 536543

SEQ ID NO: 537883 - RNA, 64 nt, Human Herpes Virus 1; identical to SEQ ID NO: 536544

SEQ ID NO: 537884 - RNA, 64 nt, Human Herpes Virus 1; identical to SEQ ID NO: 536545

SEQ ID NO: 537885 - RNA, 64 nt, Human Herpes Virus 1; identical to SEQ ID NO: 536546

SEQ ID NO: 537886 - RNA, 64 nt, Human Herpes Virus 1; identical to SEQ ID NO: 536547

SEQ ID NO: 537887 - RNA, 64 nt, Human Herpes Virus 1; identical to SEQ ID NO: 536548

SEQ ID NO: 537888 - RNA, 62 nt, Human Herpes Virus 1; identical to SEQ ID NO: 536549

SEQ ID NO: 537889 - RNA, 64 nt, Human Herpes Virus 1; identical to SEQ ID NO: 536550

SEQ ID NO: 537890 - RNA, 64 nt, Human Herpes Virus 1; identical to SEQ ID NO: 536551

SEQ ID NO: 537891 - RNA, 64 nt, Human Herpes Virus 1; identical to SEQ ID NO: 536552

SEQ ID NO: 537892 - RNA, 64 nt, Human Herpes Virus 1; identical to SEQ ID NO: 536553

SEQ ID NO: 537893 - RNA, 64 nt, Human Herpes Virus 1; identical to SEQ ID NO: 536554

SEQ ID NO: 537894 - RNA, 64 nt, Human Herpes Virus 1; identical to SEQ ID NO: 536555

SEQ ID NO: 537895 - RNA, 64 nt, Human Herpes Virus 1; identical to SEQ ID NO: 536556

SEQ ID NO: 537896 - RNA, 64 nt, Human Herpes Virus 1; identical to SEQ ID NO: 536557

SEQ ID NO: 537897 - RNA, 64 nt, Human Herpes Virus 1; identical to SEQ ID NO: 536543

SEQ ID NO: 537898 - RNA, 64 nt, Human Herpes Virus 1; identical to SEQ ID NO: 536548

SEQ ID NO: 537899 - RNA, 64 nt, Human Herpes Virus 1; identical to SEQ ID NO: 536547

SEQ ID NO: 537900 - RNA, 64 nt, Human Herpes Virus 2
gagccugcgccggcggcggccccccgcguccccgcccgcggacgcgccgcgcgggaagguacgc

SEQ ID NO: 537901 - RNA, 64 nt, Human Herpes Virus 2
ccgagcccgagcccgggcccacgaagacggcggacccgcggaggaggaggaggcggcggcggcg

SEQ ID NO: 537902 - RNA, 64 nt, Human Herpes Virus 2
ccggcacggccguggacuuuaucuggacgggcaacccgcggacggccccgcgcucccugucgcu

SEQ ID NO: 537903 - RNA, 64 nt, Human Herpes Virus 2
gcgccccggcgcgggggcggcggugcgggggcgacccgcggaaccucccagcccgccgcgaccc

SEQ ID NO: 537904 - RNA, 64 nt, Human Herpes Virus 2
agcccgccgcgacccgaccggcgcccccuggcgccccgcggagcagcagcagcggcggcgcccc

SEQ ID NO: 537905 - RNA, 64 nt, Human Herpes Virus 2
gggggacauacuaagagugccuugcaugcggacccccgcggacgauguuucuuggcgcuacgag

SEQ ID NO: 537906 - RNA, 64 nt, Human Herpes Virus 2
gcacuuuuuccuccgcgcgcucacgggaucggcccccgcggacaucgcccgcugcgucgugcac

SEQ ID NO: 537907 - RNA, 64 nt, Human Herpes Virus 2
auuuaucgccccgcguucgcuggacgaggacgcccccgcggagcagcgcaccgggguccacgac

SEQ ID NO: 537908 - RNA, 64 nt, Human Herpes Virus 2
gacggccaguacgauguggcugcuggggaucgaccccgcggagucgucuccgggaacgcgcgcu

SEQ ID NO: 537909 - RNA, 64 nt, Human Herpes Virus 2
aaccaagcggaggcaccccggggccgaaguuguccccgcggacgacgccaccaagcgcccgaag

SEQ ID NO: 537910 - RNA, 64 nt, Human Herpes Virus 2
gggggaacgcgagcaaugccgcccccuccgcguccccgcggaacgcauccgccccccgaaccac

SEQ ID NO: 537911 - RNA, 64 nt, Human Herpes Virus 2
ggccccggccuucccggcgagcaccuuuuauacccccgcggaggaugcguaccuggcccccggg

SEQ ID NO: 537912 - RNA, 64 nt, Human Herpes Virus 2
ccccccaacggacccaaagacgcacccacacggacccgcggacgcuccccccggcucgccagcc

SEQ ID NO: 537913 - RNA, 64 nt, Human Herpes Virus 2
aaccucgggcgaggacgugguguugcuuccggcgcccgcggaacgcacccgggcccacaaacua

SEQ ID NO: 537914 - RNA, 64 nt, Human Herpes Virus 2
cugacgcggggucgagcgcgccaggaccgccugccccgcggaggcguggugauacaacacaccc

SEQ ID NO: 537915 - RNA, 64 nt, Human Herpes Virus 2
gaccuggucgaggugugcgaggucggccugcggccccgcggacacccgcagcgggucacggcgc

SEQ ID NO: 537916 - RNA, 64 nt, Human Herpes Virus 2
ucgacgcguugaugcugcgccugcugcgcacgugcccgcggaucaucgccauggacgccaccgc

SEQ ID NO: 537917 - RNA, 64 nt, Human Herpes Virus 2
cgagguuaagugccgagccaaguacgcguucgaccccgcggaccccggcgcccccgcggccucc

SEQ ID NO: 537918 - RNA, 64 nt, Human Herpes Virus 2
aauggcggccgccgcaacacccggcgccaagcgccccgcggaccccgcccgcgaccccgauagu

SEQ ID NO: 537919 - RNA, 64 nt, Human Herpes Virus 2
ucggcacgcggcuggccgacccacaccgaguccccccgcggaugaccgacccgcuggcgcccug

SEQ ID NO: 537920 - RNA, 64 nt, Human Herpes Virus 2
ggcggaccgucacccagagcugccuggccaugaacccgcggaccucccuggaggcccucgggga

SEQ ID NO: 537921 - RNA, 64 nt, Human Herpes Virus 2
ccgguucguggcgcucagcgggagucuggaggcgcccgcggagacguuugcgcgccaccuggac

SEQ ID NO: 537922 - RNA, 64 nt, Human Herpes Virus 2
cgacagaucccccguucgccccgggcccgugccccccgcggacccuacaccggacccacgucau

SEQ ID NO: 537923 - RNA, 64 nt, Human Herpes Virus 2; identical to SEQ ID NO: 537904

SEQ ID NO: 537924 - RNA, 64 nt, Human Herpes Virus 2; identical to SEQ ID NO: 537903

SEQ ID NO: 537925 - RNA, 64 nt, Human Herpes Virus 2; identical to SEQ ID NO: 537902

SEQ ID NO: 537926 - RNA, 64 nt, Human Herpes Virus 2; identical to SEQ ID NO: 537901

SEQ ID NO: 537927 - RNA, 64 nt, Human Herpes Virus 2; identical to SEQ ID NO: 537900

SEQ ID NO: 537928 - RNA, 64 nt, Human Herpes Virus 2
caacgcccaggcccuggcgcaccugcagaugcugcccgcggaccaccgggccuuuuuucggacg

SEQ ID NO: 537929 - RNA, 64 nt, Human Herpes Virus 4 (Epstein Barr virus)
ggcgggaauggccgccacccucccccugccccguugcaccgauagcauggccgccagaguucca

SEQ ID NO: 537930 - RNA, 64 nt, Human Herpes Virus 4 (Epstein Barr virus)
aggccacaaaaggcgacgcggagagguccauggcugcaccgaugaaaguuauggcaagcgccga

SEQ ID NO: 537931 - RNA, 64 nt, Human Herpes Virus 4 (Epstein Barr virus)
ccgcaacugggcccucuucaucaacaacaagcgcugcaccgacguccaguuuggacaccucaug

SEQ ID NO: 537932 - RNA, 64 nt, Human Hepatitis C Virus (M1LE)
gcaggcuuauccacucugccugggaaccccgcgauagcaucacugauggcauuuacagccucua

SEQ ID NO: 537933 - RNA, 62 nt, Human Hepatitis C Virus (M1LE)
accuucugggcgaagcacauguggaauuucaucagcgggauacaguauuuagcaggcuuauc

SEQ ID NO: 537934 - RNA, 64 nt, Human Hepatitis C Virus (HCV-N)
cuccagccuuaccaucacccagcugcugaagaggcuccaccaguggauuaaugaggacuguucu

SEQ ID NO: 537935 - RNA, 64 nt, Human Herpes Virus 2
gagaacgccgaggggugcgccggaccagggcuggggcgucgaacgcagggauggccgaccccac

SEQ ID NO: 537936 - RNA, 64 nt, Human Herpes Virus 2
ggagcgccuggagaaacagaggcaacagaaggugggcgucgacgaggcgucggcgggccugacg

SEQ ID NO: 537937 - RNA, 64 nt, Human Herpes Virus 2
cccugugccuggacgcccaggcggggcggccacuggcgucgacgaggcgcgugguggauauguc

SEQ ID NO: 537938 - RNA, 64 nt, Human Herpes Virus 2
caacuuuugccccgcgaucaggaaguacgaggggggcgucgacgccaccacccgguuuauccug

SEQ ID NO: 537939 - RNA, 64 nt, Human Herpes Virus 2
uccuggccugccccagggccggguuugugugcgcggcgucgagucucgggggcggggcccacga

SEQ ID NO: 537940 - RNA, 64 nt, Human Herpes Virus 2
ugcgggaccugcuccagcggagcgcugggccgccggcgucgagggaccuggcggccuggcucuc

SEQ ID NO: 537941 - RNA, 64 nt, Human Herpes Virus 2
gcgccuggcccgacggggguccugggcgcgcgagcgggccgaccgcgaccgguuccggcgccgc

SEQ ID NO: 537942 - RNA, 64 nt, Human Herpes Virus 2
aggcgcgggccgcccggcggaggcggaucuucuccgggccgacuacgacauuaucgacgucagc

SEQ ID NO: 537943 - RNA, 64 nt, Human Herpes Virus 2
cccgcccaaggacgugccgguggggagcgacgcgcgggccgacagcgccgcccugcugcgcuuu

SEQ ID NO: 537944 - RNA, 64 nt, Human Herpes Virus 2
ccagcuccuggaggccuccgcccugggguccgggcgggccgagagcggcugcgcgcgcgcgggc

SEQ ID NO: 537945 - RNA, 64 nt, Human Herpes Virus 2
accggagcucucgguaaaguaccucaacaacgagcgggccgaguuuaacaaccgcccccugaag

SEQ ID NO: 537946 - RNA, 64 nt, Human Herpes Virus 2
ggcccugcgccgacguuuggccgagacgcaccuccgggccgagguguacagggaccagacccug

SEQ ID NO: 537947 - RNA, 64 nt, Human Herpes Virus 2
acuuuguggggcuaaaggcggccuggacgccauccgggccgacgcgggccucccugcccgcggg

SEQ ID NO: 537948 - RNA, 64 nt, Human Herpes Virus 2; identical to SEQ ID NO: 537941

SEQ ID NO: 537949 - RNA, 64 nt, Human Herpes Virus 1
gggaauccgaggccaggacuuuaaccugcucuuugucgacgaggccaacuuuauucgcccggau

SEQ ID NO: 537950 - RNA, 64 nt, Human Herpes Virus 1
cgcuggcugcgagguggggcgggugcuggccguggucgacgacccccgcgggccguuuuuugug

SEQ ID NO: 537951 - RNA, 64 nt, Human Herpes Virus 1
cggggaaaauacccaucgcaccuucucuguggucgucgacgauugcagcaugcgggcggugcuc

SEQ ID NO: 537952 - RNA, 64 nt, Human Herpes Virus 1
ccgggccguguccccggaggacggccagggacgggucgacgacggacggccacaccucgcgugc

SEQ ID NO: 537953 - RNA, 64 nt, Human Herpes Virus 1
agaggacgaccccagcgcggaugccgcggacgaugucgacgaggacgccccggacgacguggcc

SEQ ID NO: 537954 - RNA, 64 nt, Human Herpes Virus 1
uucccgggccggagcucgcggcacgcgcgauagagucgacgaccuggggacggacgucgacucu

SEQ ID NO: 537955 - RNA, 64 nt, Human Herpes Virus 1
gcgggaugaccuuccucugguggaucgagaucuggucgacgaggccgccuucgggggggaggag

SEQ ID NO: 537956 - RNA, 64 nt, Human Herpes Virus 1
gccgucgcuagaccacgccccuuucccccuguuugucgacgagauuuaauaaaaauaaccaaaa

SEQ ID NO: 537957 - RNA, 64 nt, Human Herpes Virus 1
uuucccguaucaaccccacccaauggaccucuuggucgacgagcuguuugccgacaugaacgcg

SEQ ID NO: 537958 - RNA, 64 nt, Human Herpes Virus 1
ccuaagacggggucgcccaccgcacccccgcccgcagauccagucccccuggacacggaggacg

SEQ ID NO: 537959 - RNA, 64 nt, Human Hepatitis C Virus (M1LE)
uguauguggggggcauugagcacaggcucgaugcugcaugcaauuggacucgaggagagcgcug

SEQ ID NO: 537960 - RNA, 64 nt, Human Hepatitis C Virus (M1LE)
ugccguacuucguacgcgcucaagggcucauucgugcaugcauguuggugcggaaagccgccgg

SEQ ID NO: 537961 - RNA, 64 nt, Human Herpes Virus 1
cuccacgcgccugagccuggcgccgaucacgccccgaucauagcucguccagcacgugcuggac

SEQ ID NO: 537962 - RNA, 63 nt, Human Herpes Virus 2
ggaaaccaucucguucucguucccggacggcucgcgcagcacgaucguguuugccuccagcca

SEQ ID NO: 537963 - RNA, 63 nt, Human Herpes Virus 2
cgugugggacaucggccagagccacuuucagaagcgcagcaagaucaaggugaacgggauggu

SEQ ID NO: 537964 - RNA, 63 nt, Human Herpes Virus 2
cguucgcggggcgcgucccuucagccacuuuaagcgcagcauguaccgggccggccgcuuuca

SEQ ID NO: 537965 - RNA, 63 nt, Human Herpes Virus 2
gcgcccgugugggcgcccgagcugggcgacgcggcgcagcaguacgcccugaucacgcggcug

SEQ ID NO: 537966 - RNA, 63 nt, Human Herpes Virus 2
cgccacccacaccgagucccgggcgcuguuucagcgcagcaaccccggccuuuuccggcucug

SEQ ID NO: 537967 - RNA, 63 nt, Human Herpes Virus 2
cggcgacgacgggcccgcgacgacgcggcgcucgcgcagcagcgagacgcugggggcccgccg

SEQ ID NO: 537968 - RNA, 63 nt, Human Herpes Virus 2
ucgccgccgagguccccgccuggaagagcuggcgcgcagcauccacggucccucccgcaccgg

SEQ ID NO: 537969 - RNA, 63 nt, Human Herpes Virus 2; identical to SEQ ID NO: 537965

SEQ ID NO: 537970 - RNA, 64 nt, Human Hepatitis C Virus (HCV-N)
ccacgcucgcggccaggaaugcuaccauccccacuacgacaauacgacaccacgucgauuugcu

SEQ ID NO: 537971 - RNA, 64 nt, Human Hepatitis C Virus
cgcagcuucgacgucauaucgaucugcuugucgggagcgccacccucugcucggcccucuacgu

SEQ ID NO: 537972 - RNA, 64 nt, Human Herpes Virus 1
ccuuugaacacuuuauuaaaaaguuuaacuccgggggcgucauggccucccaggagaucguuuc

SEQ ID NO: 537973 - RNA, 64 nt, Human Herpes Virus 1
caacgugaucgucaucgacgaggccgggcuccuugggcgucaccuccucacggccgugguguau

SEQ ID NO: 537974 - RNA, 64 nt, Human Herpes Virus 1
ccauauuucggcggaucuaugaccacuacgccacgggcgucauccccacgaucaacgucaccgg

SEQ ID NO: 537975 - RNA, 64 nt, Human Herpes Virus 1
uuuacaaggaccagacccugcagcugcaccgggagggcgucagcacccaagauccucgguuugu

SEQ ID NO: 537976 - RNA, 64 nt, Human Herpes Virus 1
cggcauaacuccgaccggcgggucccgaccgaacgggcgucaccaugcagcgccggacgcgcgg

SEQ ID NO: 537977 - RNA, 64 nt, Human Herpes Virus 1
ccccgcgcuaguccggcucguaggccgguacacacagcgccacggccuguacgucccucggccc

SEQ ID NO: 537978 - RNA, 64 nt, Human Herpes Virus 1
gucccugcaggcgugcggccggcuguaugugggccagcgccacuauuccgccuucgagugcgcc

SEQ ID NO: 537979 - RNA, 64 nt, Human Herpes Virus 1
agucgggacgcaacagaagccgaccgggccaacccagcgccauacguacuauagcgaaugcgau

SEQ ID NO: 537980 - RNA, 64 nt, Human Herpes Virus 1
acaccgcagauaucguguggguggaggagagcgucagcgccauuacccuuuacgcgguauggcu

SEQ ID NO: 537981 - RNA, 64 nt, Human Herpes Virus 1
ccgcgugggggcgcuguuugcgcacgcacucauccagcgccaaccccaacgcugacaucauccu

SEQ ID NO: 537982 - RNA, 64 nt, Human Herpes Virus 1
aggccugucuccgcguucccauggccacccgcagcagcgccauauuucggcggaucuaugacca

SEQ ID NO: 537983 - RNA, 64 nt, Human Herpes Virus 1
acaaggccaagaagaagggcacgagcgcgcugcucagcgccaaggucaccgacauggucaugcg

SEQ ID NO: 537984 - RNA, 64 nt, Human Herpes Virus 1
guucgccaggcugcaguuuacguacaaccacauacagcgccaugucaacgauauguugggccgc

SEQ ID NO: 537985 - RNA, 64 nt, Human Herpes Virus 1
agcccccaaaccccacgcccccgccgcccggggccagcgccaacgcguccguggagcgcaucaa

SEQ ID NO: 537986 - RNA, 64 nt, Human Herpes Virus 1
ggcgaggcguaccugcgagugacguccucgccgccagcgccaccgcugcgcgaggccaccagua

SEQ ID NO: 537987 - RNA, 64 nt, Human Herpes Virus 1
agcggggccagacgcuggacacacccccgagaaccagcgccacccucuccguccugacggacgc

SEQ ID NO: 537988 - RNA, 64 nt, Human Herpes Virus 1
ccccgggaggggguagggggcggggggccguauacagcgccaagcgcccagucgccgccaccga

SEQ ID NO: 537989 - RNA, 64 nt, Human Herpes Virus 2
ccagcauuuccucgccgcgaaucgcuaccucgaaacccgggacauuaugccgaucgacuggucg

SEQ ID NO: 537990 - RNA, 64 nt, Human Herpes Virus 2
cauccuggggguucugguccaccugcgcauccguacccgggaggccuccuuugaggaauggaug

SEQ ID NO: 537991 - RNA, 64 nt, Human Herpes Virus 2
cgcgcacuuugccaacgagguccaauacgaucucacccgggacccgagcagccccgccucgcug

SEQ ID NO: 537992 - RNA, 64 nt, Human Herpes Virus 2
cucuucuccccucggcgggccacacgcgccccggacccgggacuaagccugucgcccaugcccg

SEQ ID NO: 537993 - RNA, 64 nt, Human Herpes Virus 2
ugcauggucaaccucgagaggcuggcgcgccaccacccgggacucgagggcuccaccaucgacg

SEQ ID NO: 537994 - RNA, 64 nt, Human Herpes Virus 4 (Epstein Barr virus); identical to SEQ ID NO: 537321

SEQ ID NO: 537995 - RNA, 64 nt, Human Herpes Virus 4 (Epstein Barr virus)
aacguugcaucccagaagaugcacgcuuaaccccgccuacaaccgugacguagcuguuuaccag

SEQ ID NO: 537996 - RNA, 64 nt, Human Herpes Virus 4 (Epstein Barr virus)
gugucugcugaacgugccugccgcggguccccgggccuacaaguguuucagaucccacgccucc

SEQ ID NO: 537997 - RNA, 64 nt, Human Herpes Virus 4 (Epstein Barr virus)
aagaaccaaguucacaccugcaguccgccacucagccuacaacgccucgcccaucaugggcccc

SEQ ID NO: 537998 - RNA, 64 nt, Human Herpes Virus 4 (Epstein Barr virus)
aaauuguggguggauucgugcggauguccagagugccuacaaugucuuaagggauugaaggcaa

SEQ ID NO: 537999 - RNA, 64 nt, Human Herpes Virus 4 (Epstein Barr virus)
cgggguggacuuucagcacguggcccagacccuggccuacaacgggccagccuucagccaccau

SEQ ID NO: 538000 - RNA, 64 nt, Human Herpes Virus 4 (Epstein Barr virus)
ggagcgagaagacagggaugcguggcaucuccccgccuacaaaugcguggacaggcucgacaaa

SEQ ID NO: 538001 - RNA, 64 nt, Human Herpes Virus 4 (Epstein Barr virus)
ccucauuggaggcgccacaucugugcuucucucggccuacaaccgccacccccuuuuccagccc

SEQ ID NO: 538002 - RNA, 64 nt, Human Herpes Virus 4 (Epstein Barr virus)
cugcuuuucaacggagcucagccgcaagcucucagccuacaagagcacccagaugccucaccug

SEQ ID NO: 538003 - RNA, 64 nt, Human Hepatitis C Virus (M1LE)
acgcucgcagccaggaacaucagcguccccacuacgacaauacgacgccaugucgacuugcucg

SEQ ID NO: 538004 - RNA, 64 nt, Human Herpes Virus 4 (Epstein Barr virus)
gccugguggagauggcccuggccgggcagcggggagugaccaucacuaugccgguggccuccga

SEQ ID NO: 538005 - RNA, 64 nt, Human Herpes Virus 4 (Epstein Barr virus)
caccuauggucacucaggcacggucgccccuccgagugaccagucaccuuccagacuaugcaua

SEQ ID NO: 538006 - RNA, 64 nt, Human Herpes Virus 4 (Epstein Barr virus)
ccggggugggguggacgucagccugaccaacuuuagugaccagaccguguuccuuaacaaguac

SEQ ID NO: 538007 - RNA, 64 nt, Human Herpes Virus 4 (Epstein Barr virus)
ccuacucguuuaagguccgcuccuacaccaagauagugaccaacauucucaucuacaauggcug

SEQ ID NO: 538008 - RNA, 64 nt, Human Herpes Virus 4 (Epstein Barr virus)
aggucugcaaggcccguccgguugucacgcugccagugaccaucaacaaguacacgggggucaa

SEQ ID NO: 538009 - RNA, 64 nt, Human Herpes Virus 4 (Epstein Barr virus)
caacuuugucaacgaccuggcguccccgguuuccaccgccgagaugauggaugauuucucuccc

SEQ ID NO: 538010 - RNA, 64 nt, Human Herpes Virus 4 (Epstein Barr virus)
uuaugacacugcuucagaccaaccuggacaacaaaccgccgaggcagaccccgcuacccuacgc

SEQ ID NO: 538011 - RNA, 64 nt, Human Herpes Virus 4 (Epstein Barr virus)
cagaaggggggcgacaaggcguccuccccgccccaccgccgaagaugaguaacggcgacugggg

SEQ ID NO: 538012 - RNA, 64 nt, Human Herpes Virus 4 (Epstein Barr virus)
acgccccacccaaggacgccugccuucaccuggauccccucaccgucaagagccagcucccucu

SEQ ID NO: 538013 - RNA, 64 nt, Human Herpes Virus 4 (Epstein Barr virus)
cgagaacccaagguggaggcucugcacgccuggcuccccucacugucacuggccucccuccacc

SEQ ID NO: 538014 - RNA, 64 nt, Human Herpes Virus 4 (Epstein Barr virus)
ggcggcuuccgcaggggggagcagacaccccaccuccccucagcauggacgacauccuguaucu

SEQ ID NO: 538015 - RNA, 64 nt, Human Herpes Virus 4 (Epstein Barr virus)
ucguucaugagaggcguguggaaguacgagaucuuccccucauacguccgcgucaccaacaagc

SEQ ID NO: 538016 - RNA, 64 nt, Human Herpes Virus 1; identical to SEQ ID NO: 537606

SEQ ID NO: 538017 - RNA, 64 nt, Human Herpes Virus 1; identical to SEQ ID NO: 537607

SEQ ID NO: 538018 - RNA, 64 nt, Human Herpes Virus 1; identical to SEQ ID NO: 537608

SEQ ID NO: 538019 - RNA, 64 nt, Human Herpes Virus 1; identical to SEQ ID NO: 537609

SEQ ID NO: 538020 - RNA, 64 nt, Human Herpes Virus 1; identical to SEQ ID NO: 537610

SEQ ID NO: 538021 - RNA, 64 nt, Human Herpes Virus 1; identical to SEQ ID NO: 537611

SEQ ID NO: 538022 - RNA, 64 nt, Human Herpes Virus 1; identical to SEQ ID NO: 537612

SEQ ID NO: 538023 - RNA, 64 nt, Human Herpes Virus 1; identical to SEQ ID NO: 537613

SEQ ID NO: 538024 - RNA, 64 nt, Human Herpes Virus 1; identical to SEQ ID NO: 537614

SEQ ID NO: 538025 - RNA, 64 nt, Human Herpes Virus 1; identical to SEQ ID NO: 537615

SEQ ID NO: 538026 - RNA, 64 nt, Human Herpes Virus 1; identical to SEQ ID NO: 537616

SEQ ID NO: 538027 - RNA, 64 nt, Human Herpes Virus 1; identical to SEQ ID NO: 537617

SEQ ID NO: 538028 - RNA, 64 nt, Human Herpes Virus 1; identical to SEQ ID NO: 537618

SEQ ID NO: 538029 - RNA, 64 nt, Human Herpes Virus 1; identical to SEQ ID NO: 537607

SEQ ID NO: 538030 - RNA, 64 nt, Human Herpes Virus 1; identical to SEQ ID NO: 537606

SEQ ID NO: 538031 - RNA, 64 nt, Human Herpes Virus 1; identical to SEQ ID NO: 537613

SEQ ID NO: 538032 - RNA, 64 nt, Human Herpes Virus 2
ucgguacauccagcgccacggccuguacguucccgcgcccgacgaaccgacguuggccgaugcc

SEQ ID NO: 538033 - RNA, 64 nt, Human Herpes Virus 2
ugguggagcgcgccgacguguacuauuacgaaacgcgcccgacccuguacuaccgcgucuucgu

SEQ ID NO: 538034 - RNA, 64 nt, Human Herpes Virus 2
ggccucccuccugacguacgccgggccuauaaaagcgcccgacggccccgccgccccacauacg

SEQ ID NO: 538035 - RNA, 64 nt, Human Herpes Virus 2
gggccgaaguuguccccgcggacgacgccaccaagcgcccgaagacgggcgugcccgccgcccc

SEQ ID NO: 538036 - RNA, 64 nt, Human Herpes Virus 2
gccggaagcgaccguggucgcggacgcggcggcggcgcccgagcccggcgcgcucggccggcgg

SEQ ID NO: 538037 - RNA, 64 nt, Human Herpes Virus 2
cgggcugggcgacagccgccccggccucuggggggcgcccgaggcggaggaggcgcgggcccgg

SEQ ID NO: 538038 - RNA, 64 nt, Human Herpes Virus 2
guucgaggccucgggcgccccggcgcccgugugggcgcccgagcugggcgacgcggcgcagcag

SEQ ID NO: 538039 - RNA, 64 nt, Human Herpes Virus 2
ggccgagcgcacgacggcgcugcugugcuccgcggcgcccgacgcgggcgccaacaccgcgucg

SEQ ID NO: 538040 - RNA, 64 nt, Human Herpes Virus 2
cgagcugcaaccugcugcggcccgugauggccgcgcgcccgauggucgugcugggccucagcau

SEQ ID NO: 538041 - RNA, 64 nt, Human Herpes Virus 2
acgacuuccgccgcggcgcuggcccgaugcgcgcgcgcccgaggggcgagguucgcuuucucca

SEQ ID NO: 538042 - RNA, 64 nt, Human Herpes Virus 2; identical to SEQ ID NO: 538038

SEQ ID NO: 538043 - RNA, 64 nt, Human Herpes Virus 2; identical to SEQ ID NO: 538037

SEQ ID NO: 538044 - RNA, 64 nt, Human Herpes Virus 2
ggcuggaccgguuuuccgaaugccugcgcgccaugguccacacgcacguguuuccccacgaggu

SEQ ID NO: 538045 - RNA, 64 nt, Human Herpes Virus 4 (Epstein Barr virus); identical to SEQ ID NO: 536194

SEQ ID NO: 538046 - RNA, 64 nt, Human Herpes Virus 4 (Epstein Barr virus); identical to SEQ ID NO: 536194

SEQ ID NO: 538047 - RNA, 64 nt, Human Herpes Virus 4 (Epstein Barr virus); identical to SEQ ID NO: 536194

SEQ ID NO: 538048 - RNA, 64 nt, Human Herpes Virus 4 (Epstein Barr virus); identical to SEQ ID NO: 536194

SEQ ID NO: 538049 - RNA, 64 nt, Human Herpes Virus 4 (Epstein Barr virus); identical to SEQ ID NO: 536194

SEQ ID NO: 538050 - RNA, 64 nt, Human Herpes Virus 4 (Epstein Barr virus); identical to SEQ ID NO: 536194

SEQ ID NO: 538051 - RNA, 64 nt, Human Herpes Virus 4 (Epstein Barr virus); identical to SEQ ID NO: 536194

SEQ ID NO: 538052 - RNA, 64 nt, Human Herpes Virus 4 (Epstein Barr virus); identical to SEQ ID NO: 536194

SEQ ID NO: 538053 - RNA, 64 nt, Human Herpes Virus 4 (Epstein Barr virus); identical to SEQ ID NO: 536194

SEQ ID NO: 538054 - RNA, 64 nt, Human Herpes Virus 4 (Epstein Barr virus); identical to SEQ ID NO: 536194

SEQ ID NO: 538055 - RNA, 64 nt, Human Herpes Virus 4 (Epstein Barr virus); identical to SEQ ID NO: 536194

SEQ ID NO: 538056 - RNA, 64 nt, Human Herpes Virus 4 (Epstein Barr virus); identical to SEQ ID NO: 536194

SEQ ID NO: 538057 - RNA, 64 nt, Human Herpes Virus 4 (Epstein Barr virus); identical to SEQ ID NO: 536206

SEQ ID NO: 538058 - RNA, 64 nt, Human Herpes Virus 4 (Epstein Barr virus); identical to SEQ ID NO: 536207

SEQ ID NO: 538059 - RNA, 64 nt, Human Herpes Virus 4 (Epstein Barr virus); identical to SEQ ID NO: 536207

SEQ ID NO: 538060 - RNA, 64 nt, Human Herpes Virus 4 (Epstein Barr virus); identical to SEQ ID NO: 536207

SEQ ID NO: 538061 - RNA, 64 nt, Human Herpes Virus 4 (Epstein Barr virus); identical to SEQ ID NO: 536207

SEQ ID NO: 538062 - RNA, 64 nt, Human Herpes Virus 4 (Epstein Barr virus); identical to SEQ ID NO: 536207

SEQ ID NO: 538063 - RNA, 64 nt, Human Herpes Virus 4 (Epstein Barr virus); identical to SEQ ID NO: 536207

SEQ ID NO: 538064 - RNA, 64 nt, Human Herpes Virus 4 (Epstein Barr virus); identical to SEQ ID NO: 536207

SEQ ID NO: 538065 - RNA, 64 nt, Human Herpes Virus 4 (Epstein Barr virus); identical to SEQ ID NO: 536207

SEQ ID NO: 538066 - RNA, 64 nt, Human Herpes Virus 4 (Epstein Barr virus); identical to SEQ ID NO: 536207

SEQ ID NO: 538067 - RNA, 64 nt, Human Herpes Virus 4 (Epstein Barr virus); identical to SEQ ID NO: 536207

SEQ ID NO: 538068 - RNA, 64 nt, Human Herpes Virus 4 (Epstein Barr virus); identical to SEQ ID NO: 536207

SEQ ID NO: 538069 - RNA, 64 nt, Human Herpes Virus 4 (Epstein Barr virus); identical to SEQ ID NO: 536207

SEQ ID NO: 538070 - RNA, 64 nt, Human Herpes Virus 4 (Epstein Barr virus); identical to SEQ ID NO: 536207

SEQ ID NO: 538071 - RNA, 64 nt, Human Herpes Virus 4 (Epstein Barr virus); identical to SEQ ID NO: 536207

SEQ ID NO: 538072 - RNA, 64 nt, Human Herpes Virus 4 (Epstein Barr virus); identical to SEQ ID NO: 536207

SEQ ID NO: 538073 - RNA, 64 nt, Human Herpes Virus 4 (Epstein Barr virus); identical to SEQ ID NO: 536207

SEQ ID NO: 538074 - RNA, 64 nt, Human Herpes Virus 4 (Epstein Barr virus); identical to SEQ ID NO: 536207

SEQ ID NO: 538075 - RNA, 64 nt, Human Herpes Virus 4 (Epstein Barr virus); identical to SEQ ID NO: 536207

SEQ ID NO: 538076 - RNA, 64 nt, Human Herpes Virus 4 (Epstein Barr virus); identical to SEQ ID NO: 536207

SEQ ID NO: 538077 - RNA, 64 nt, Human Herpes Virus 4 (Epstein Barr virus); identical to SEQ ID NO: 536207

SEQ ID NO: 538078 - RNA, 64 nt, Human Herpes Virus 4 (Epstein Barr virus); identical to SEQ ID NO: 536207

SEQ ID NO: 538079 - RNA, 64 nt, Human Herpes Virus 4 (Epstein Barr virus); identical to SEQ ID NO: 536207

SEQ ID NO: 538080 - RNA, 64 nt, Human Herpes Virus 4 (Epstein Barr virus); identical to SEQ ID NO: 536207

SEQ ID NO: 538081 - RNA, 64 nt, Human Herpes Virus 4 (Epstein Barr virus); identical to SEQ ID NO: 536207

SEQ ID NO: 538082 - RNA, 64 nt, Human Herpes Virus 4 (Epstein Barr virus); identical to SEQ ID NO: 536231

SEQ ID NO: 538083 - RNA, 64 nt, Human Herpes Virus 4 (Epstein Barr virus); identical to SEQ ID NO: 536232

SEQ ID NO: 538084 - RNA, 64 nt, Human Herpes Virus 4 (Epstein Barr virus); identical to SEQ ID NO: 536194

SEQ ID NO: 538085 - RNA, 64 nt, Human Herpes Virus 4 (Epstein Barr virus); identical to SEQ ID NO: 536194

SEQ ID NO: 538086 - RNA, 64 nt, Human Herpes Virus 4 (Epstein Barr virus); identical to SEQ ID NO: 536194

SEQ ID NO: 538087 - RNA, 64 nt, Human Herpes Virus 4 (Epstein Barr virus); identical to SEQ ID NO: 536194

SEQ ID NO: 538088 - RNA, 64 nt, Human Herpes Virus 4 (Epstein Barr virus); identical to SEQ ID NO: 536194

SEQ ID NO: 538089 - RNA, 64 nt, Human Herpes Virus 4 (Epstein Barr virus); identical to SEQ ID NO: 536194

SEQ ID NO: 538090 - RNA, 64 nt, Human Herpes Virus 4 (Epstein Barr virus); identical to SEQ ID NO: 536194

SEQ ID NO: 538091 - RNA, 64 nt, Human Herpes Virus 4 (Epstein Barr virus); identical to SEQ ID NO: 536194

SEQ ID NO: 538092 - RNA, 64 nt, Human Herpes Virus 4 (Epstein Barr virus); identical to SEQ ID NO: 536194

SEQ ID NO: 538093 - RNA, 64 nt, Human Herpes Virus 4 (Epstein Barr virus); identical to SEQ ID NO: 536194

SEQ ID NO: 538094 - RNA, 64 nt, Human Herpes Virus 4 (Epstein Barr virus); identical to SEQ ID NO: 536194

SEQ ID NO: 538095 - RNA, 64 nt, Human Herpes Virus 4 (Epstein Barr virus); identical to SEQ ID NO: 536194

SEQ ID NO: 538096 - RNA, 64 nt, Human Herpes Virus 4 (Epstein Barr virus); identical to SEQ ID NO: 536206

SEQ ID NO: 538097 - RNA, 64 nt, Human Herpes Virus 4 (Epstein Barr virus); identical to SEQ ID NO: 536207

SEQ ID NO: 538098 - RNA, 64 nt, Human Herpes Virus 4 (Epstein Barr virus); identical to SEQ ID NO: 536207

SEQ ID NO: 538099 - RNA, 64 nt, Human Herpes Virus 4 (Epstein Barr virus); identical to SEQ ID NO: 536207

SEQ ID NO: 538100 - RNA, 64 nt, Human Herpes Virus 4 (Epstein Barr virus); identical to SEQ ID NO: 536207

SEQ ID NO: 538101 - RNA, 64 nt, Human Herpes Virus 4 (Epstein Barr virus); identical to SEQ ID NO: 536207

SEQ ID NO: 538102 - RNA, 64 nt, Human Herpes Virus 4 (Epstein Barr virus); identical to SEQ ID NO: 536207

SEQ ID NO: 538103 - RNA, 64 nt, Human Herpes Virus 4 (Epstein Barr virus); identical to SEQ ID NO: 536207

SEQ ID NO: 538104 - RNA, 64 nt, Human Herpes Virus 4 (Epstein Barr virus); identical to SEQ ID NO: 536207

SEQ ID NO: 538105 - RNA, 64 nt, Human Herpes Virus 4 (Epstein Barr virus); identical to SEQ ID NO: 536207

SEQ ID NO: 538106 - RNA, 64 nt, Human Herpes Virus 4 (Epstein Barr virus); identical to SEQ ID NO: 536207

SEQ ID NO: 538107 - RNA, 64 nt, Human Herpes Virus 4 (Epstein Barr virus); identical to SEQ ID NO: 536207

SEQ ID NO: 538108 - RNA, 64 nt, Human Herpes Virus 4 (Epstein Barr virus); identical to SEQ ID NO: 536207

SEQ ID NO: 538109 - RNA, 64 nt, Human Herpes Virus 4 (Epstein Barr virus); identical to SEQ ID NO: 536207

SEQ ID NO: 538110 - RNA, 64 nt, Human Herpes Virus 4 (Epstein Barr virus); identical to SEQ ID NO: 536207

SEQ ID NO: 538111 - RNA, 64 nt, Human Herpes Virus 4 (Epstein Barr virus); identical to SEQ ID NO: 536207

SEQ ID NO: 538112 - RNA, 64 nt, Human Herpes Virus 4 (Epstein Barr virus); identical to SEQ ID NO: 536207

SEQ ID NO: 538113 - RNA, 64 nt, Human Herpes Virus 4 (Epstein Barr virus); identical to SEQ ID NO: 536207

SEQ ID NO: 538114 - RNA, 64 nt, Human Herpes Virus 4 (Epstein Barr virus); identical to SEQ ID NO: 536207

SEQ ID NO: 538115 - RNA, 64 nt, Human Herpes Virus 4 (Epstein Barr virus); identical to SEQ ID NO: 536207

SEQ ID NO: 538116 - RNA, 64 nt, Human Herpes Virus 4 (Epstein Barr virus); identical to SEQ ID NO: 536207

SEQ ID NO: 538117 - RNA, 64 nt, Human Herpes Virus 4 (Epstein Barr virus); identical to SEQ ID NO: 536207

SEQ ID NO: 538118 - RNA, 64 nt, Human Herpes Virus 4 (Epstein Barr virus); identical to SEQ ID NO: 536207

SEQ ID NO: 538119 - RNA, 64 nt, Human Herpes Virus 4 (Epstein Barr virus); identical to SEQ ID NO: 536207

SEQ ID NO: 538120 - RNA, 64 nt, Human Herpes Virus 4 (Epstein Barr virus); identical to SEQ ID NO: 536207

SEQ ID NO: 538121 - RNA, 64 nt, Human Herpes Virus 4 (Epstein Barr virus); identical to SEQ ID NO: 536231

SEQ ID NO: 538122 - RNA, 64 nt, Human Herpes Virus 4 (Epstein Barr virus); identical to SEQ ID NO: 536232

SEQ ID NO: 538123 - RNA, 64 nt, Human Herpes Virus 4 (Epstein Barr virus)
gccaugagugaauuugacauuuuuauuaacuacauagaagcauacaugacaauuaaagccaggu

SEQ ID NO: 538124 - RNA, 64 nt, Human Herpes Virus 4 (Epstein Barr virus)
cucgucaccccccaccaccgucagggagucuugguagaagcacagggggggcugaggcccccgc

SEQ ID NO: 538125 - RNA, 64 nt, Human Herpes Virus 4 (Epstein Barr virus)
cagcagcuacacucuggggucucaggccucccagucuauccaggaggaggacgugagugacacu

SEQ ID NO: 538126 - RNA, 64 nt, Human Herpes Virus 4 (Epstein Barr virus)
gugcucuuguuuaauuacaccaagaucaccacccucuauccauaucccacaauugauaaaccuc

SEQ ID NO: 538127 - RNA, 64 nt, Human Herpes Virus 4 (Epstein Barr virus)
cccggguacgcuguagaagcuguugaaggaggucucuauccagucgcucggcucgaugccuggc

SEQ ID NO: 538128 - RNA, 64 nt, Human Herpes Virus 4 (Epstein Barr virus)
cggcuccagcaguugggaggggaucccccuccucucuauccaccggggagcacuacugcugaau

SEQ ID NO: 538129 - RNA, 64 nt, Human Herpes Virus 4 (Epstein Barr virus)
uccugcgcggccucacgccgcucaccgcggaccgucuauccaccuaccuagaucgcgcgggggc

SEQ ID NO: 538130 - RNA, 64 nt, Human Herpes Virus 2
gggcguuuucuguccaugguuucggccgccccccugcccggagccagcggccauccuccuguuc

SEQ ID NO: 538131 - RNA, 64 nt, Human Herpes Virus 2
aagaacguucacguggucaucggggaguacgccaugcccggauuuucggcgcgccguugucugu

SEQ ID NO: 538132 - RNA, 64 nt, Human Herpes Virus 2
aggcggucgucgggcccgccgccguggcccugcgugcccggaacguggacgccguggcccgcgc

SEQ ID NO: 538133 - RNA, 64 nt, Human Herpes Virus 2
cccgcgccugucggcgcucagugcgguugggucgugcccggaggggcccccgugccugguccuc

SEQ ID NO: 538134 - RNA, 64 nt, Human Herpes Virus 2
gcaggagaucaucggggggcaggcccgcgagaccggcgacgaccggcccguccuaacaaagucg

SEQ ID NO: 538135 - RNA, 64 nt, Human Herpes Virus 2
gccgcgcuaccuggcgcgucuggccgcgguaaucggcgacgagagcggacgcccgcaguaccgc

SEQ ID NO: 538136 - RNA, 64 nt, Human Herpes Virus 2
gguucgcaaggcgaccaacagcgggguguucgccggcgacgacaacaucgucugcacaagcugc

SEQ ID NO: 538137 - RNA, 64 nt, Human Herpes Virus 2
cccgaaccacacccacgcccccccaaccccgcaaggcgacgaaaaguaaggccuccaccgccaa

SEQ ID NO: 538138 - RNA, 64 nt, Human Herpes Virus 2
gcccgucugugcgggcgacgggcccucggccgguggcgacgacggcgacggggacugguucccc

SEQ ID NO: 538139 - RNA, 64 nt, Human Herpes Virus 2
cgacggggacugguuccccgacgccgguggucccggcgacgaggagugggaggaggacacggac

SEQ ID NO: 538140 - RNA, 64 nt, Human Herpes Virus 2
gcucgccauagcauacagucccccguuccccgcgggcgacgagggacuguauucggaguuggcg

SEQ ID NO: 538141 - RNA, 64 nt, Human Herpes Virus 2
ccccgacgacggcggcgacgccaaccgccacgacggcgacgacgcccgcgggaagcccgccgcc

SEQ ID NO: 538142 - RNA, 64 nt, Human Herpes Virus 2
ggcggccggcgucgcccgaaagcgggcguuucacggcgacgauccguuuggggagggaccaccg

SEQ ID NO: 538143 - RNA, 64 nt, Human Herpes Virus 2
cgccgccggggagguguuuaacuuuggggauuucggcgacgaggaugaccacgcggcgucguuc

SEQ ID NO: 538144 - RNA, 64 nt, Human Herpes Virus 2
ugauuccggccgcgcuaccuccgggcagggcggcggcgacgacggaucgcgauaucguggucac

SEQ ID NO: 538145 - RNA, 64 nt, Human Herpes Virus 2
ggacaucauggcgcaguuucggaaacugcucaugggcgacgaggagaccgccgcccuccgggcg

SEQ ID NO: 538146 - RNA, 64 nt, Human Herpes Virus 2; identical to SEQ ID NO: 538141

SEQ ID NO: 538147 - RNA, 64 nt, Human Herpes Virus 2
ugacccccagaaccccgggcccccgcuggccguuggcgacgaguggccuccgucaucccacguu

SEQ ID NO: 538148 - RNA, 64 nt, Human Herpes Virus 2
gcaggacaccgcgugcgugcacggcgagcugcucgcccgaaagcgcgaacgguucgcggcgguc

SEQ ID NO: 538149 - RNA, 64 nt, Human Herpes Virus 2
gaucuccgcgggucugcggcgacggggccgcacggcccgaaaacaucuggguucccguggugac

SEQ ID NO: 538150 - RNA, 64 nt, Human Herpes Virus 2
ggccccccagaucgugcgcggggcuucggacgaggcccgaaagcacacguacaaccugaccauc

SEQ ID NO: 538151 - RNA, 64 nt, Human Herpes Virus 2
ggcggugauguucgggcgggugaacgagccgacggcccgaaaccugcuguuucgcuacugcgug

SEQ ID NO: 538152 - RNA, 64 nt, Human Herpes Virus 2
cgguuuggcggcggcggcgggggcggccggcgucgcccgaaagcgggcguuucacggcgacgau

SEQ ID NO: 538153 - RNA, 64 nt, Human Herpes Virus 4 (Epstein Barr virus)
uugccugucuggggacauuuagugcuacugacgguuggaggaggucugccuucaauuaccgugg

SEQ ID NO: 538154 - RNA, 64 nt, Human Herpes Virus 4 (Epstein Barr virus)
gucugacuacucagaugaagacgaggagauugauuuggaggaagaguaccccagugacgaagac

SEQ ID NO: 538155 - RNA, 64 nt, Human Herpes Virus 4 (Epstein Barr virus)
ccucgucuccucgaucgucacccugcacccccacuuggaggaggugaagguagccguggagggc

SEQ ID NO: 538156 - RNA, 64 nt, Human Herpes Virus 4 (Epstein Barr virus)
ggcccccgcaguaacccccgaggcaagucaucuguuggaggacccugaugaagaaaccagucag

SEQ ID NO: 538157 - RNA, 59 nt, Human immunodeficiency virus type 1 (BLAI); identical to SEQ ID NO: 537799

SEQ ID NO: 538158 - RNA, 64 nt, Human Herpes Virus 4 (Epstein Barr virus)
ucauucuacgcuuuuaacgcggcgaaaacgacgcuggggagauggcuggucaccguauacgcgg

SEQ ID NO: 538159 - RNA, 64 nt, Human Herpes Virus 4 (Epstein Barr virus)
gcucugaaagacaggauaagaagcgaggcacuauuggggagagagaauuuggagaauugcugag

SEQ ID NO: 538160 - RNA, 64 nt, Human Herpes Virus 4 (Epstein Barr virus)
acuggccccccuugauggcuccgaccggacugucuggggagagggugccgugccggacccaggc

SEQ ID NO: 538161 - RNA, 64 nt, Human Herpes Virus 4 (Epstein Barr virus)
acccccgccuacacaccaacuauagcaaaccccgccccgucacggugacguagucugucuugag

SEQ ID NO: 538162 - RNA, 64 nt, Human Herpes Virus 4 (Epstein Barr virus)
uuagccuccgauauccccacgcggcccucaccauccccgucauaagaugaaguguucuccaaca

SEQ ID NO: 538163 - RNA, 64 nt, Human Herpes Virus 4 (Epstein Barr virus)
acacgcucuucuuuaggcugagggaccgcuucccccccgucauguccacgcagcggagggaccc

SEQ ID NO: 538164 - RNA, 64 nt, Human Herpes Virus 2
gccgcguuagccgagcgccccgcagaggaguggcuggcgcgaccccugcccgagggacugcagg

SEQ ID NO: 538165 - RNA, 64 nt, Human Herpes Virus 2
cgcgggcgacgagggacuguauucggaguuggcguggcgcgaucgcguagccguggucaacgag

SEQ ID NO: 538166 - RNA, 64 nt, Human Herpes Virus 2
guuuuugcacggucugggguuggcccgcacguacuggcgcgacacaaacaccgggcgucugugg

SEQ ID NO: 538167 - RNA, 64 nt, Human Herpes Virus 2
gucggucacccuggaguugcuccuggaguacgcguggcgcgagggggagcggcuccugggccac

SEQ ID NO: 538168 - RNA, 64 nt, Human Herpes Virus 4 (Epstein Barr virus)
uugcauacgacgcccguguccugacgccugacuuucacgaaaucccugaccucgaugacuccga

SEQ ID NO: 538169 - RNA, 64 nt, Human Herpes Virus 4 (Epstein Barr virus)
cuucaugcccuccaggauucuugccauugacauccagcuucacuuuuacauuugccggugcuuc

SEQ ID NO: 538170 - RNA, 64 nt, Human Herpes Virus 4 (Epstein Barr virus)
cgagaggucucaggcaucaucuccgagacuaucucagcuucagagcgggcggcggaagcaccac

SEQ ID NO: 538171 - RNA, 64 nt, Human Herpes Virus 4 (Epstein Barr virus)
ccuccaccacguggcggguucucucguggaacugcagcuucaccugcccaagaagcggcugacc

SEQ ID NO: 538172 - RNA, 64 nt, Human Herpes Virus 4 (Epstein Barr virus)
auucaguccaacauuguguucucugaugagauuccagcuucacaggacaugccgacaaacacca

SEQ ID NO: 538173 - RNA, 64 nt, Human Herpes Virus 4 (Epstein Barr virus)
agcugccucccugccccucggugggccagauacucagcuucaaguuaccuucuuucuccuucaa

SEQ ID NO: 538174 - RNA, 64 nt, Human Herpes Virus 4 (Epstein Barr virus)
uggucuucacgggggagaaugccgcccuccagaacagcuucaucaaguccacuaccaggaggga

SEQ ID NO: 538175 - RNA, 64 nt, Human Herpes Virus 1
auccaauacgaacaggggcuuggccugcuggcgcagcaggcacgcauuggcuugggcuccaaca

SEQ ID NO: 538176 - RNA, 64 nt, Human Herpes Virus 2
cucucgggccggcccgaccgacagccaggacuccuccuccgagccggacgcgggcgaccgcggc

SEQ ID NO: 538177 - RNA, 64 nt, Human Herpes Virus 2
cgggcggcgccucauggccuugaccgaggacacguccuccgauucgccuacguccgcuccggag

SEQ ID NO: 538178 - RNA, 64 nt, Human Herpes Virus 2
guggggcgggcgacgcgcccgccccccgcggcuguccuccgagcuggccacggcccugacggag

SEQ ID NO: 538179 - RNA, 64 nt, Human Herpes Virus 2
gcuccgcgccgaguacggcggcuccuuccgcuucuccuccgacgccaucucgaccaccuucacc

SEQ ID NO: 538180 - RNA, 64 nt, Human Herpes Virus 2
acccggggguccucgcccccagacgcugcacaucuccuccgaugggcgagcccguccccccucg

SEQ ID NO: 538181 - RNA, 64 nt, Human Herpes Virus 2
uguugcuggcggcggccguguacgccgcggugggcgcggugaccucgcgcuacgagcgcgcgcu

SEQ ID NO: 538182 - RNA, 64 nt, Human Herpes Virus 2
ggaacgacaucacguacguccucaacagccaggucgcggugaccgcgcgccuccgaaagauggu

SEQ ID NO: 538183 - RNA, 64 nt, Human Herpes Virus 2
gccuggggcccuggcgccccgaggccaugggcgacgcggugagccaguacugcggcauguauca

SEQ ID NO: 538184 - RNA, 64 nt, Human Herpes Virus 2
gccuucguacuacgaggccauggcgcaguuuuuccgcggugagcugcgggcgcgggaggagagc

SEQ ID NO: 538185 - RNA, 64 nt, Human Herpes Virus 2
acggugccgcggacgaccucauggucgcggucaucauggccauuuaccuggcggccccgaccgg

SEQ ID NO: 538186 - RNA, 64 nt, Human Herpes Virus 2
cgacguccgcgguccgcggggcguacccggaccccauggccagccugucgccgcgacccccggc

SEQ ID NO: 538187 - RNA, 64 nt, Human Herpes Virus 2
aguuugucgagucgaucgacuccacggagcuggccauggccaucaacgccgacuacggcaucag

SEQ ID NO: 538188 - RNA, 64 nt, Human Herpes Virus 2
ggcuguucucgucccacaaggaggucagcgcguacauggccaagcuccacgccuaccuaaaggu

SEQ ID NO: 538189 - RNA, 64 nt, Human Herpes Virus 2
ucgccgagggcggguucauccuggacgcgcuggccauggccacccgauccgacaucccggcgga

SEQ ID NO: 538190 - RNA, 64 nt, Human Herpes Virus 2
cccccaauaacgugagcgaacuggccauguacuacauggccaaccagaucuugagguacugcga

SEQ ID NO: 538191 - RNA, 64 nt, Human Herpes Virus 2
aucgggacaagaugcgccgccuggcggacacgugcauggccaccauccugcagauguacauguc

SEQ ID NO: 538192 - RNA, 64 nt, Human Herpes Virus 2; identical to SEQ ID NO: 538186

SEQ ID NO: 538193 - RNA, 64 nt, Human Herpes Virus 1
cuacgaccgcguguauaucuacuacaaccaccgccggggcgacuggcucgugcgagaccccauc

SEQ ID NO: 538194 - RNA, 64 nt, Human Herpes Virus 1
accagggccaagagacgucgaucucguacuccagcggggcgaucgccgcauucgucgcccccua

SEQ ID NO: 538195 - RNA, 64 nt, Human Herpes Virus 1
ccaggguacacugggccaucuuggcccacagacacggggcgacgcagggacaggacuccguuac

SEQ ID NO: 538196 - RNA, 64 nt, Human Herpes Virus 1
ccguggaucugcuacacaugguguacgcgggccgcggggcgaccggcucgucgggggugguguu

SEQ ID NO: 538197 - RNA, 64 nt, Human Herpes Virus 1
uggggccagcugauggaggcgaccgcccuggggucggggcgagccgagagcgggugcacgcgcg

SEQ ID NO: 538198 - RNA, 64 nt, Human Herpes Virus 1
ucgucccuaacaggaagaugagucaguggggauccggggcgauccuuguccagccggacagcuu

SEQ ID NO: 538199 - RNA, 64 nt, Human Herpes Virus 1
ccggcccccaagaacgcagacaaggccgccgccccggggcgauccaaggggcugucgggcgucu

SEQ ID NO: 538200 - RNA, 64 nt, Human Herpes Virus 1
caacgcgcaguugguggacuuccugugcggucuccggggcgaaaaaaacgugcauguggugguc

SEQ ID NO: 538201 - RNA, 64 nt, Human Herpes Virus 1
uuaacccauacacccccgagagaugcugcgccgccggggcgaggccgcucgcagccauucaccg

SEQ ID NO: 538202 - RNA, 64 nt, Human Herpes Virus 1
ugcaggcguuuaacgacuccggccccgggaccgccagcgucaugcccgcccucaagguccuuga

SEQ ID NO: 538203 - RNA, 64 nt, Human Herpes Virus 1
aaucguguacgucguccgcacaucacagucgcggcagcgucaucggcgguaacgcaagaccccc

SEQ ID NO: 538204 - RNA, 64 nt, Human Herpes Virus 1
cgaauaccgagcgacccugcagcgacccgcuuaacagcgucaacagcgugccgcagaucuuggu

SEQ ID NO: 538205 - RNA, 64 nt, Human Herpes Virus 4 (Epstein Barr virus)
gccgcuguucaccuaaagugacgcaaggucugucagccgccaggguccguuuaccaggcuuuca

SEQ ID NO: 538206 - RNA, 64 nt, Human Herpes Virus 4 (Epstein Barr virus)
cugcucccaggucuacuggccggaaaucccuggcagccgccaagucaggcuccagaggaugccc

SEQ ID NO: 538207 - RNA, 64 nt, Human Herpes Virus 4 (Epstein Barr virus)
aggaggcggcggggagccgggcauccuucucuccagccgccaucgagcagguggccacgguucu

SEQ ID NO: 538208 - RNA, 64 nt, Human Herpes Virus 4 (Epstein Barr virus)
cugcccaaccgucuauagcgccuuuggguucaagagccgccacauaaauaugacgcagcggguc

SEQ ID NO: 538209 - RNA, 64 nt, Human Herpes Virus 4 (Epstein Barr virus)
ugaaggauauguuuucccgagccgucaccaugacagccgccagcuacgcucgcuacguucucca

SEQ ID NO: 538210 - RNA, 64 nt, Human Herpes Virus 4 (Epstein Barr virus)
gccuaagaagccccagcugcggaaguuauucuauuggaacaacguccuccaggccacgggggac

SEQ ID NO: 538211 - RNA, 64 nt, Human Herpes Virus 4 (Epstein Barr virus)
guuugauggggaccuuaugcgaauugcgcuggccuggaacaaagaugagguuauaggucaggcc

SEQ ID NO: 538212 - RNA, 64 nt, Human Herpes Virus 4 (Epstein Barr virus)
gaagcucauagcuaaggcaaucgaugcuggauuucugagaaaccgcguggagacucugaggcag

SEQ ID NO: 538213 - RNA, 64 nt, Human Herpes Virus 4 (Epstein Barr virus)
cagacuggaaaaggcgccucuuaccggccgggcccugagaaaucgaggcccaggaagaguccca

SEQ ID NO: 538214 - RNA, 64 nt, Human Herpes Virus 4 (Epstein Barr virus)
acggucaagauggaggagcugggucaccugacuacugagaaacaggaguacgcgcugagguuag

SEQ ID NO: 538215 - RNA, 64 nt, Human Herpes Virus 4 (Epstein Barr virus)
ugcgcaugcagguuacuacacgugcaaugugacacugagaaauugcaguguggccuccgggguc

SEQ ID NO: 538216 - RNA, 64 nt, Human Herpes Virus 2
acguccgggcgcucggcaugcgcgggcucguguuggccaccaacaacgcucaguucaucaugga

SEQ ID NO: 538217 - RNA, 64 nt, Human Herpes Virus 2
acuacacguccagcugcuaccugguaaacccccaggccaccacuaaccaggccacccuccgggc

SEQ ID NO: 538218 - RNA, 64 nt, Human Herpes Virus 2
uccaggaccuggcguacgccaucgugcgcagcgcggccaccaccggaagccccuucaucauguu

SEQ ID NO: 538219 - RNA, 64 nt, Human Herpes Virus 2
ccuuucgggaagcggucgcgcgguggcaccccacggccaccaccauccaacuacucgacccccc

SEQ ID NO: 538220 - RNA, 64 nt, Human Herpes Virus 2
ucuucaaggagaacaucgccccguacaaauucaaggccaccauguacuacaaagacgugaccgu

SEQ ID NO: 538221 - RNA, 64 nt, Human Herpes Virus 2
cgccuagccacgcccccucgguucaccuggccgcggccaccaagauccgcuucccggcccugga

SEQ ID NO: 538222 - RNA, 64 nt, Human Herpes Virus 2
agaucgacccggcuaucaugaucccgccccucgaggccaccaaaaugguucgcagucgcgagga

SEQ ID NO: 538223 - RNA, 64 nt, Human Herpes Virus 2
gggacaagaugcgccgccuggcggacacgugcauggccaccauccugcagauguacaugucggu

SEQ ID NO: 538224 - RNA, 64 nt, Human Hepatitis C Virus (HCV-N)
ggaugagaaugaaauauccauugcggcggagauccugcggaaguccaagaaguuccccgcggcg

SEQ ID NO: 538225 - RNA, 64 nt, Human Hepatitis C Virus (M1LE)
ccaggacccccccucccgggagagccauaguggucugcggaaccggugaguacaccggaauugc

SEQ ID NO: 538226 - RNA, 64 nt, Human Hepatitis C Virus (M1LE)
ggaugagagggagguauccguugcggcggagauccugcggaaauccaggaaguuccccccugcg

SEQ ID NO: 538227 - RNA, 64 nt, Human Hepatitis C Virus
ggaugagcgggaggucuccguacccgcagaaauucugcggaagucucggagauucgcccgggcc

SEQ ID NO: 538228 - RNA, 64 nt, Human Hepatitis C Virus
uauuccuggacaggcgcacucgucaccccgugcgcugcggaagaacaaaaacugcccaucaacg

SEQ ID NO: 538229 - RNA, 64 nt, Human Herpes Virus 1
gaucuggccgcuggggaggugccaccaggcccccgggcccaaggcgcagcacgcgcccggcucc

SEQ ID NO: 538230 - RNA, 64 nt, Human Herpes Virus 1
cgccguauacagcuugaagaucgccggguggcacgggcccaaggccccauacacgagcacccug

SEQ ID NO: 538231 - RNA, 64 nt, Human Herpes Virus 1
cggccuccuagggucaauucgcgcgagcuguacagggcccaacgcgcggcgcgcggcucgucug

SEQ ID NO: 538232 - RNA, 64 nt, Human Herpes Virus 2
gcagcgccgacuuucgagacgggcgcauguccaagaccuucaugaccgcgcugguccugucucu

SEQ ID NO: 538233 - RNA, 64 nt, Human Herpes Virus 4 (Epstein Barr virus)
gugacacaggcacccacggaauauaccagggaaaggaggggaguggggccuaugccucccaccg

SEQ ID NO: 538234 - RNA, 64 nt, Human Herpes Virus 4 (Epstein Barr virus)
uggaguccaacgccggggaguccagcaguugggaggaggggagacccaaagcccugauggaaga

SEQ ID NO: 538235 - RNA, 64 nt, Human Herpes Virus 4 (Epstein Barr virus)
cuccucagacuuuuccgaccaggacgagggagagggaggggaggcagaucucaggggcgugccg

SEQ ID NO: 538236 - RNA, 64 nt, Human Herpes Virus 4 (Epstein Barr virus)
uggacaggaauccccuauccgagaugaucacuggggaggggaaccccgcgagcggcuacaucgu

SEQ ID NO: 538237 - RNA, 64 nt, Human Herpes Virus 4 (Epstein Barr virus)
guuucuacaugacccacggccuggggacccugcaggaggggaccugggaccccugccgccgacc

SEQ ID NO: 538238 - RNA, 64 nt, Human Herpes Virus 1
acgaggucaugcgguuuuucggggggcuggugucgugggucacccaggacgagcuagcgagcgu

SEQ ID NO: 538239 - RNA, 64 nt, Human Herpes Virus 1
caccgcccuaaccacagccaacuuucacacccuggugggucacggguauaaccagcccccggag

SEQ ID NO: 538240 - RNA, 64 nt, Human Herpes Virus 1; identical to SEQ ID NO: 538238

SEQ ID NO: 538241 - RNA, 64 nt, Human Herpes Virus 1; identical to SEQ ID NO: 538239

SEQ ID NO: 538242 - RNA, 64 nt, Human Herpes Virus 1
gggacgaggccgugcacacgacggccucguguuacaucuacaacaacuaccucggcgggcacgc

SEQ ID NO: 538243 - RNA, 64 nt, Human Herpes Virus 1
cggcaugcgacacgucgcuggggcgggggucgcgcaucuacaacaaauuccguuacaaacacua

SEQ ID NO: 538244 - RNA, 64 nt, Human Herpes Virus 1
ggcggguguugggggcuuccgagacaaucgcgaacaucuacaccacacaacaccgccucgacca

SEQ ID NO: 538245 - RNA, 64 nt, Human Herpes Virus 1
ucgaggggcgugucugcauagcguugcgugcccucaucuacaccuucaagacguaucagguauu

SEQ ID NO: 538246 - RNA, 64 nt, Human Herpes Virus 4 (Epstein Barr virus)
ggccacccgccgcuuucuggucucgggugagacccucucggaggacaucucgcgcuugacgggg

SEQ ID NO: 538247 - RNA, 64 nt, Human Herpes Virus 4 (Epstein Barr virus)
uauggagacguucucccccgaguuugacccggagcucucggagccccccuuccugcccuuuuca

SEQ ID NO: 538248 - RNA, 64 nt, Human Herpes Virus 4 (Epstein Barr virus)
aucucaccugcagcguuccuagcaaugagucggucucucggaucgaguugggccggggauacac

SEQ ID NO: 538249 - RNA, 64 nt, Human Herpes Virus 4 (Epstein Barr virus)
ggcuggggcacgagagcccggcccguccggcgcccucucggacgcgcucaagcgcaaggagcag

SEQ ID NO: 538250 - RNA, 64 nt, Human Herpes Virus 4 (Epstein Barr virus)
cgucuucucgacagugcccccggagguggcggagcucucggagcuccucuauuggaacucuggc

SEQ ID NO: 538251 - RNA, 64 nt, Human Herpes Virus 2
ggcugcgcgagcugcgguucgugcgcgacgcgcuggugcugaugcgccugcgcggggaccugcg

SEQ ID NO: 538252 - RNA, 64 nt, Human Herpes Virus 2
auucgggagacggacgccuucccgccuucgugguggugcugaagucugcagcugcgcgccgccc

SEQ ID NO: 538253 - RNA, 64 nt, Human Herpes Virus 2; identical to SEQ ID NO: 538251

SEQ ID NO: 538254 - RNA, 64 nt, Human Herpes Virus 4 (Epstein Barr virus); identical to SEQ ID NO: 536194

SEQ ID NO: 538255 - RNA, 64 nt, Human Herpes Virus 4 (Epstein Barr virus); identical to SEQ ID NO: 536194

SEQ ID NO: 538256 - RNA, 64 nt, Human Herpes Virus 4 (Epstein Barr virus); identical to SEQ ID NO: 536194

SEQ ID NO: 538257 - RNA, 64 nt, Human Herpes Virus 4 (Epstein Barr virus); identical to SEQ ID NO: 536194

SEQ ID NO: 538258 - RNA, 64 nt, Human Herpes Virus 4 (Epstein Barr virus); identical to SEQ ID NO: 536194

SEQ ID NO: 538259 - RNA, 64 nt, Human Herpes Virus 4 (Epstein Barr virus); identical to SEQ ID NO: 536194

SEQ ID NO: 538260 - RNA, 64 nt, Human Herpes Virus 4 (Epstein Barr virus); identical to SEQ ID NO: 536194

SEQ ID NO: 538261 - RNA, 64 nt, Human Herpes Virus 4 (Epstein Barr virus); identical to SEQ ID NO: 536194

SEQ ID NO: 538262 - RNA, 64 nt, Human Herpes Virus 4 (Epstein Barr virus); identical to SEQ ID NO: 536194

SEQ ID NO: 538263 - RNA, 64 nt, Human Herpes Virus 4 (Epstein Barr virus); identical to SEQ ID NO: 536194

SEQ ID NO: 538264 - RNA, 64 nt, Human Herpes Virus 4 (Epstein Barr virus); identical to SEQ ID NO: 536194

SEQ ID NO: 538265 - RNA, 64 nt, Human Herpes Virus 4 (Epstein Barr virus); identical to SEQ ID NO: 536194

SEQ ID NO: 538266 - RNA, 64 nt, Human Herpes Virus 4 (Epstein Barr virus); identical to SEQ ID NO: 536206

SEQ ID NO: 538267 - RNA, 64 nt, Human Herpes Virus 4 (Epstein Barr virus); identical to SEQ ID NO: 536207

SEQ ID NO: 538268 - RNA, 64 nt, Human Herpes Virus 4 (Epstein Barr virus); identical to SEQ ID NO: 536207

SEQ ID NO: 538269 - RNA, 64 nt, Human Herpes Virus 4 (Epstein Barr virus); identical to SEQ ID NO: 536207

SEQ ID NO: 538270 - RNA, 64 nt, Human Herpes Virus 4 (Epstein Barr virus); identical to SEQ ID NO: 536207

SEQ ID NO: 538271 - RNA, 64 nt, Human Herpes Virus 4 (Epstein Barr virus); identical to SEQ ID NO: 536207

SEQ ID NO: 538272 - RNA, 64 nt, Human Herpes Virus 4 (Epstein Barr virus); identical to SEQ ID NO: 536207

SEQ ID NO: 538273 - RNA, 64 nt, Human Herpes Virus 4 (Epstein Barr virus); identical to SEQ ID NO: 536207

SEQ ID NO: 538274 - RNA, 64 nt, Human Herpes Virus 4 (Epstein Barr virus); identical to SEQ ID NO: 536207

SEQ ID NO: 538275 - RNA, 64 nt, Human Herpes Virus 4 (Epstein Barr virus); identical to SEQ ID NO: 536207

SEQ ID NO: 538276 - RNA, 64 nt, Human Herpes Virus 4 (Epstein Barr virus); identical to SEQ ID NO: 536207

SEQ ID NO: 538277 - RNA, 64 nt, Human Herpes Virus 4 (Epstein Barr virus); identical to SEQ ID NO: 536207

SEQ ID NO: 538278 - RNA, 64 nt, Human Herpes Virus 4 (Epstein Barr virus); identical to SEQ ID NO: 536207

SEQ ID NO: 538279 - RNA, 64 nt, Human Herpes Virus 4 (Epstein Barr virus); identical to SEQ ID NO: 536207

SEQ ID NO: 538280 - RNA, 64 nt, Human Herpes Virus 4 (Epstein Barr virus); identical to SEQ ID NO: 536207

SEQ ID NO: 538281 - RNA, 64 nt, Human Herpes Virus 4 (Epstein Barr virus); identical to SEQ ID NO: 536207

SEQ ID NO: 538282 - RNA, 64 nt, Human Herpes Virus 4 (Epstein Barr virus); identical to SEQ ID NO: 536207

SEQ ID NO: 538283 - RNA, 64 nt, Human Herpes Virus 4 (Epstein Barr virus); identical to SEQ ID NO: 536207

SEQ ID NO: 538284 - RNA, 64 nt, Human Herpes Virus 4 (Epstein Barr virus); identical to SEQ ID NO: 536207

SEQ ID NO: 538285 - RNA, 64 nt, Human Herpes Virus 4 (Epstein Barr virus); identical to SEQ ID NO: 536207

SEQ ID NO: 538286 - RNA, 64 nt, Human Herpes Virus 4 (Epstein Barr virus); identical to SEQ ID NO: 536207

SEQ ID NO: 538287 - RNA, 64 nt, Human Herpes Virus 4 (Epstein Barr virus); identical to SEQ ID NO: 536207

SEQ ID NO: 538288 - RNA, 64 nt, Human Herpes Virus 4 (Epstein Barr virus); identical to SEQ ID NO: 536207

SEQ ID NO: 538289 - RNA, 64 nt, Human Herpes Virus 4 (Epstein Barr virus); identical to SEQ ID NO: 536207

SEQ ID NO: 538290 - RNA, 64 nt, Human Herpes Virus 4 (Epstein Barr virus); identical to SEQ ID NO: 536207

SEQ ID NO: 538291 - RNA, 64 nt, Human Herpes Virus 4 (Epstein Barr virus); identical to SEQ ID NO: 536231

SEQ ID NO: 538292 - RNA, 64 nt, Human Herpes Virus 4 (Epstein Barr virus); identical to SEQ ID NO: 536232

SEQ ID NO: 538293 - RNA, 64 nt, Human Herpes Virus 2
ggacgagcuggcuagcgucaccgccgucugcagcggaccccaggaggccacacacaccggccac

SEQ ID NO: 538294 - RNA, 64 nt, Human Herpes Virus 2
ccuccacgggaacccaaggacccccgaaccccaaggaccccaggcuguccccccgcccccuccu

SEQ ID NO: 538295 - RNA, 64 nt, Human Herpes Virus 2
uagagcaccacggcagccaccagcccccgccgcgggaccccaccgagcggcaggugauccgggc

SEQ ID NO: 538296 - RNA, 64 nt, Human Herpes Virus 2
gcuggcaggaauucaacgcgggaugcgucgcgugggaccccacccccgucgagcacgagcaggc

SEQ ID NO: 538297 - RNA, 64 nt, Human Herpes Virus 2
gacgucgccgugcuccaagacgcccugggccgcgggaccccauugcucccggcccacgucacag

SEQ ID NO: 538298 - RNA, 64 nt, Human Herpes Virus 2
guggucccggcgacgaggagugggaggaggacacggaccccauggacacgacccacggcccccu

SEQ ID NO: 538299 - RNA, 64 nt, Human Herpes Virus 2
cggagacgacguccgcgguccgcggggcguacccggaccccauggccagccugucgccgcgacc

SEQ ID NO: 538300 - RNA, 64 nt, Human Herpes Virus 2
ggagcugcccacgcugcugcggguuuauauagacggaccccacgggguggggaagaccaccacc

SEQ ID NO: 538301 - RNA, 64 nt, Human Herpes Virus 2
uccaccugaccgagguggacgacgccgggccggcggaccccaaggaccacagcaagcccuccuu

SEQ ID NO: 538302 - RNA, 64 nt, Human Herpes Virus 2
ggggggcgugcgacccccgguuucuuuuuuacccggaccccacguacgggggccacaugcugua

SEQ ID NO: 538303 - RNA, 64 nt, Human Herpes Virus 2; identical to SEQ ID NO: 538299

SEQ ID NO: 538304 - RNA, 64 nt, Human Herpes Virus 2; identical to SEQ ID NO: 538293

SEQ ID NO: 538305 - RNA, 64 nt, Human Herpes Virus 2; identical to SEQ ID NO: 538294

SEQ ID NO: 538306 - RNA, 64 nt, Human Herpes Virus 2; identical to SEQ ID NO: 538295

SEQ ID NO: 538307 - RNA, 64 nt, Human Herpes Virus 2; identical to SEQ ID NO: 538296

SEQ ID NO: 538308 - RNA, 64 nt, Human Herpes Virus 2; identical to SEQ ID NO: 538297

SEQ ID NO: 538309 - RNA, 64 nt, Human Herpes Virus 2; identical to SEQ ID NO: 538298

SEQ ID NO: 538310 - RNA, 64 nt, Human Herpes Virus 2; identical to SEQ ID NO: 538299

SEQ ID NO: 538311 - RNA, 64 nt, Human Herpes Virus 2; identical to SEQ ID NO: 538300

SEQ ID NO: 538312 - RNA, 64 nt, Human Herpes Virus 2; identical to SEQ ID NO: 538301

SEQ ID NO: 538313 - RNA, 64 nt, Human Herpes Virus 2; identical to SEQ ID NO: 538302

SEQ ID NO: 538314 - RNA, 64 nt, Human Herpes Virus 2; identical to SEQ ID NO: 538299

SEQ ID NO: 538315 - RNA, 64 nt, Human Herpes Virus 2
gucgagcggggcgcacgcguccgcgaacguuacgggacgcgauccccgacugcgcgcugcgguc

SEQ ID NO: 538316 - RNA, 64 nt, Human Herpes Virus 2
aacucgagcgcacguucggcgggaagcggcuccuggacgcgauggacgggcucgaggccaagca

SEQ ID NO: 538317 - RNA, 64 nt, Human Herpes Virus 2
uucccggcggugcggccgccgccccccuuucggaggacgcgaucccgucgccgcgcgagcggac

SEQ ID NO: 538318 - RNA, 64 nt, Human Herpes Virus 2
acggcgcauuccgggccuaccccagagggguuccggacgcgaccgccaccccccgagacccgcc

SEQ ID NO: 538319 - RNA, 64 nt, Human Herpes Virus 2
uucacuuuuacaacuuucuccagcgccccggccuggacgcgacccagaggacccuggccuacgg

SEQ ID NO: 538320 - RNA, 64 nt, Human Herpes Virus 2
ucgagcggcagcaacacggacccgucaccuucccggacgcgagcgccccgacggcccggugcgu

SEQ ID NO: 538321 - RNA, 64 nt, Human Herpes Virus 2
ccaauauggcccagcgcacccuggccguccggggggacgcgagccugugucagcuccucuucgg

SEQ ID NO: 538322 - RNA, 64 nt, Human Herpes Virus 2
uccaaucgcaguggugauugacggugacgucaauggacgcgagcagaguaaaugucgcuucaug

SEQ ID NO: 538323 - RNA, 64 nt, Human Herpes Virus 2
ccgagcgcgccgacccccugguccgccagcuggaggacgcgaucgugcugcugcggcugcacau

SEQ ID NO: 538324 - RNA, 64 nt, Human Herpes Virus 1; identical to SEQ ID NO: 536137

SEQ ID NO: 538325 - RNA, 64 nt, Human Herpes Virus 1; identical to SEQ ID NO: 536138

SEQ ID NO: 538326 - RNA, 64 nt, Human Herpes Virus 1; identical to SEQ ID NO: 536139

SEQ ID NO: 538327 - RNA, 64 nt, Human Herpes Virus 1; identical to SEQ ID NO: 536140

SEQ ID NO: 538328 - RNA, 64 nt, Human Herpes Virus 1; identical to SEQ ID NO: 536141

SEQ ID NO: 538329 - RNA, 64 nt, Human Herpes Virus 1; identical to SEQ ID NO: 536142

SEQ ID NO: 538330 - RNA, 64 nt, Human Herpes Virus 1; identical to SEQ ID NO: 536143

SEQ ID NO: 538331 - RNA, 64 nt, Human Herpes Virus 1; identical to SEQ ID NO: 536144

SEQ ID NO: 538332 - RNA, 64 nt, Human Herpes Virus 1; identical to SEQ ID NO: 536145

SEQ ID NO: 538333 - RNA, 64 nt, Human Herpes Virus 1; identical to SEQ ID NO: 536146

SEQ ID NO: 538334 - RNA, 64 nt, Human Herpes Virus 1; identical to SEQ ID NO: 536147

SEQ ID NO: 538335 - RNA, 64 nt, Human Herpes Virus 1; identical to SEQ ID NO: 536148

SEQ ID NO: 538336 - RNA, 64 nt, Human Herpes Virus 1; identical to SEQ ID NO: 536149

SEQ ID NO: 538337 - RNA, 64 nt, Human Herpes Virus 1; identical to SEQ ID NO: 536141

SEQ ID NO: 538338 - RNA, 64 nt, Human Herpes Virus 4 (Epstein Barr virus)
acccagucuuaguucagguagacacccaguuaugcagugccaccaauuccaaccauuuuuaaac

SEQ ID NO: 538339 - RNA, 64 nt, Human Herpes Virus 4 (Epstein Barr virus)
guuuuaucaagauucuuuauugaccaagcauuuccagugccagaccguccuccagaccuugaga

SEQ ID NO: 538340 - RNA, 64 nt, Human Herpes Virus 4 (Epstein Barr virus)
cuagucaccaggugucaccggaggcuacuugccucagugccacuuuuaccuucucaaaucuaua

SEQ ID NO: 538341 - RNA, 64 nt, Human Herpes Virus 4 (Epstein Barr virus)
gacaucacauaugugggugacaaugcuaccuauucagugccaauggucacuucugaggacgcaa

SEQ ID NO: 538342 - RNA, 64 nt, Human Herpes Virus 4 (Epstein Barr virus)
gaaaugcaaaaccccguguaccugauaccagaaacagugccauacauaaagugggauaacugua

SEQ ID NO: 538343 - RNA, 64 nt, Human Herpes Virus 4 (Epstein Barr virus)
gggaagguauguuccugccaaagccggaagcgggcagugccauaucugacguguucgaggggcg

SEQ ID NO: 538344 - RNA, 64 nt, Human Herpes Virus 4 (Epstein Barr virus)
cgucaccaacaagcagguauugcagcuggacgcgcagugccaagagcugccucccugccccucg

SEQ ID NO: 538345 - RNA, 64 nt, Human Herpes Virus 4 (Epstein Barr virus)
cccccaaacuuuguccagauguccagggguccccgagggugaggcccagcccccucccgccccu

SEQ ID NO: 538346 - RNA, 64 nt, Human Herpes Virus 4 (Epstein Barr virus); identical to SEQ ID NO: 538345

SEQ ID NO: 538347 - RNA, 64 nt, Human Herpes Virus 4 (Epstein Barr virus)
cugguuuccaccuaugguggaaggggcugccgcggagggugaugacggagaugacggagaugaa

SEQ ID NO: 538348 - RNA, 64 nt, Human Herpes Virus 4 (Epstein Barr virus)
cggagaugacggagaugaaggaggugauggagaugagggugaggaagggcaggagugauguaac

SEQ ID NO: 538349 - RNA, 64 nt, Human Herpes Virus 4 (Epstein Barr virus)
acguggccacgugacacacacuguugggaugggagagggugaucuugugguagucgccggcaug

SEQ ID NO: 538350 - RNA, 64 nt, Human Herpes Virus 4 (Epstein Barr virus)
ugggugagcgagucacccugaccuccuacuggaggagggugagccucgguccagagauugaggu

SEQ ID NO: 538351 - RNA, 64 nt, Human Herpes Virus 4 (Epstein Barr virus)
gacaagguggccucggcggccuauugggaauaacgagggugaggggacccaagccucccaacag

SEQ ID NO: 538352 - RNA, 64 nt, Human Herpes Virus 4 (Epstein Barr virus)
gguggagcacagugggggcggggccggcgggggagagggugaagaaagcggugguggucucuuu

SEQ ID NO: 538353 - RNA, 64 nt, Human Herpes Virus 4 (Epstein Barr virus)
ccgugaccuccugauuugcggccacgcucucccagagggugaggagaggccugcuguguugaaa

SEQ ID NO: 538354 - RNA, 64 nt, Human Herpes Virus 4 (Epstein Barr virus)
ggaaguuaauguccagagaucaccucugauucuggcccccaacgccucuggcauguuugagucc

SEQ ID NO: 538355 - RNA, 64 nt, Human Herpes Virus 4 (Epstein Barr virus)
uugccccccuggcggcccagcccgacccccgggcgcccccaaacuuuguccagauguccagggg

SEQ ID NO: 538356 - RNA, 64 nt, Human Herpes Virus 4 (Epstein Barr virus)
cccgccccuguccacugccccgguccccccagaagcccccaaaaguagaggcucaggccaugcg

SEQ ID NO: 538357 - RNA, 64 nt, Human Herpes Virus 4 (Epstein Barr virus); identical to SEQ ID NO: 538355

SEQ ID NO: 538358 - RNA, 64 nt, Human Herpes Virus 4 (Epstein Barr virus); identical to SEQ ID NO: 538356

SEQ ID NO: 538359 - RNA, 64 nt, Human Herpes Virus 4 (Epstein Barr virus)
ggcaccgaucaucucgcuggcucgccucauccuggcccccaaccccuauauccuagagggacag

SEQ ID NO: 538360 - RNA, 64 nt, Human Herpes Virus 4 (Epstein Barr virus)
uccaucuuugcacgccaggccccgcaaucccauugcccccaaugcgaggccagggccgccaaac

SEQ ID NO: 538361 - RNA, 64 nt, Human Herpes Virus 4 (Epstein Barr virus)
uuuugaggcggccguggcggugcauuggcaccgcgcccccaaaacucucuuugucuccucucaa

SEQ ID NO: 538362 - RNA, 64 nt, Human Herpes Virus 4 (Epstein Barr virus)
ggccgaugccauccguucgggaccccagccggacgcccccaagcugcaguccccggacaugaaa

SEQ ID NO: 538363 - RNA, 64 nt, Human Herpes Virus 4 (Epstein Barr virus)
gccugaccgaccugcucucgccuuucuggacacugcccccaacaggaggaggagaacccgagga

SEQ ID NO: 538364 - RNA, 64 nt, Human Herpes Virus 4 (Epstein Barr virus)
ccucuuacaucacucacugcacgugggcuggccggcccccaaaaccuucugcuaccacaucgcg

SEQ ID NO: 538365 - RNA, 64 nt, Human Herpes Virus 4 (Epstein Barr virus)
gacauuugacauuacugucucgggucuuggcacggcccccaagacacucauuaucacacgaacg

SEQ ID NO: 538366 - RNA, 64 nt, Human Herpes Virus 4 (Epstein Barr virus); identical to SEQ ID NO: 538345

SEQ ID NO: 538367 - RNA, 64 nt, Human Herpes Virus 4 (Epstein Barr virus); identical to SEQ ID NO: 538345

SEQ ID NO: 538368 - RNA, 64 nt, Human Herpes Virus 4 (Epstein Barr virus); identical to SEQ ID NO: 538347

SEQ ID NO: 538369 - RNA, 64 nt, Human Herpes Virus 4 (Epstein Barr virus); identical to SEQ ID NO: 538348

SEQ ID NO: 538370 - RNA, 64 nt, Human Herpes Virus 4 (Epstein Barr virus); identical to SEQ ID NO: 538349

SEQ ID NO: 538371 - RNA, 64 nt, Human Herpes Virus 4 (Epstein Barr virus); identical to SEQ ID NO: 538350

SEQ ID NO: 538372 - RNA, 64 nt, Human Herpes Virus 4 (Epstein Barr virus); identical to SEQ ID NO: 538351

SEQ ID NO: 538373 - RNA, 64 nt, Human Herpes Virus 4 (Epstein Barr virus); identical to SEQ ID NO: 538352

SEQ ID NO: 538374 - RNA, 64 nt, Human Herpes Virus 4 (Epstein Barr virus); identical to SEQ ID NO: 538353

SEQ ID NO: 538375 - RNA, 64 nt, Human Herpes Virus 4 (Epstein Barr virus); identical to SEQ ID NO: 538354

SEQ ID NO: 538376 - RNA, 64 nt, Human Herpes Virus 4 (Epstein Barr virus); identical to SEQ ID NO: 538355

SEQ ID NO: 538377 - RNA, 64 nt, Human Herpes Virus 4 (Epstein Barr virus); identical to SEQ ID NO: 538356

SEQ ID NO: 538378 - RNA, 64 nt, Human Herpes Virus 4 (Epstein Barr virus); identical to SEQ ID NO: 538355

SEQ ID NO: 538379 - RNA, 64 nt, Human Herpes Virus 4 (Epstein Barr virus); identical to SEQ ID NO: 538356

SEQ ID NO: 538380 - RNA, 64 nt, Human Herpes Virus 4 (Epstein Barr virus); identical to SEQ ID NO: 538359

SEQ ID NO: 538381 - RNA, 64 nt, Human Herpes Virus 4 (Epstein Barr virus); identical to SEQ ID NO: 538360

SEQ ID NO: 538382 - RNA, 64 nt, Human Herpes Virus 4 (Epstein Barr virus); identical to SEQ ID NO: 538361

SEQ ID NO: 538383 - RNA, 64 nt, Human Herpes Virus 4 (Epstein Barr virus); identical to SEQ ID NO: 538362

SEQ ID NO: 538384 - RNA, 64 nt, Human Herpes Virus 4 (Epstein Barr virus); identical to SEQ ID NO: 538363

SEQ ID NO: 538385 - RNA, 64 nt, Human Herpes Virus 4 (Epstein Barr virus); identical to SEQ ID NO: 538364

SEQ ID NO: 538386 - RNA, 64 nt, Human Herpes Virus 4 (Epstein Barr virus); identical to SEQ ID NO: 538365

SEQ ID NO: 538387 - RNA, 64 nt, Human Herpes Virus 1
caacgcgggccuggcgacccaauugcaggagcgcgaccgcgagcuccggcgcgcaacagcgggg

SEQ ID NO: 538388 - RNA, 64 nt, Human Herpes Virus 1
gcgaugcccuacgagugcccuuuuuagauuucgcgaccgcgacccccaagcgccaccagaccgu

SEQ ID NO: 538389 - RNA, 64 nt, Human Herpes Virus 1
ccccaccgacgggccgccgcccaccccgagcccagaccgcgacgagcggggggcccucgggugg

SEQ ID NO: 538390 - RNA, 64 nt, Human Herpes Virus 1
gcauacgguggugaacaacgucaggcaggucguggaccgcgagguggagcagcugaugcgcaac

SEQ ID NO: 538391 - RNA, 64 nt, Human Herpes Virus 1
gcccgggacccacguggcggccaacccacagguggaccgcgagggacacguggugcccggguuc

SEQ ID NO: 538392 - RNA, 64 nt, Human Herpes Virus 1
cgcucgcaacggggaauucgagacggucgccggggaccgcgagccggaggagucgccggauacg

SEQ ID NO: 538393 - RNA, 64 nt, Human Herpes Virus 1
gccggaggccuaugggcacggcccacgccaggcggaccgcgagggggcgccucauuccaacacc

SEQ ID NO: 538394 - RNA, 64 nt, Human Herpes Virus 1
gguggucaaauaucagcgccgauaccccaguuacgaccgcgaggccauuacgcuacacugccuc

SEQ ID NO: 538395 - RNA, 64 nt, Human Herpes Virus 1
ccugcuguacuggcccggggugcgcgcgcugcuggaccgcgacugucgcguggccgcccgcuau

SEQ ID NO: 538396 - RNA, 64 nt, Human Herpes Virus 1; identical to SEQ ID NO: 538389

SEQ ID NO: 538397 - RNA, 64 nt, Human Herpes Virus 1
gacggcgcucuuggccgagaaccuccccggguugcucguacaccgcuuggugguggcucucccc

SEQ ID NO: 538398 - RNA, 64 nt, Human Herpes Virus 4 (Epstein Barr virus)
cuugaguguuauagcuuccucuuaacuuaagcaagagcuccaggauguuagcuuuuuugguggg

SEQ ID NO: 538399 - RNA, 64 nt, Human Herpes Virus 4 (Epstein Barr virus)
ccaggucggacuagcggaugcagcauccccggaugagcuccaggaccaggcaagcggggcacgc

SEQ ID NO: 538400 - RNA, 64 nt, Human Herpes Virus 4 (Epstein Barr virus)
ccagcaacagaucuugcugagguuucaauuuugggagcuccagagagggaguuucgcuuccuca

SEQ ID NO: 538401 - RNA, 64 nt, Human Herpes Virus 4 (Epstein Barr virus)
aggacauaccuggcagguaugacuaauguuaauggagcuccaggacucugccacggccagcagg

SEQ ID NO: 538402 - RNA, 64 nt, Human Herpes Virus 4 (Epstein Barr virus)
acaucaccucccaggaaguccaaaacuccaucuugagcuccaacuacuuugauuuugacaaccu

SEQ ID NO: 538403 - RNA, 64 nt, Human Herpes Virus 4 (Epstein Barr virus)
cccagcggacccggugggccacccggccgcccccgagcuccagggcuggguccugagacccaaa

SEQ ID NO: 538404 - RNA, 64 nt, Human Herpes Virus 4 (Epstein Barr virus)
ccagcggacccggugggccacccggccgccccccgagcuccagggccggaaccccggacccggc

SEQ ID NO: 538405 - RNA, 64 nt, Human Herpes Virus 4 (Epstein Barr virus); identical to SEQ ID NO: 538404

SEQ ID NO: 538406 - RNA, 64 nt, Human Herpes Virus 4 (Epstein Barr virus); identical to SEQ ID NO: 538404

SEQ ID NO: 538407 - RNA, 64 nt, Human Herpes Virus 4 (Epstein Barr virus); identical to SEQ ID NO: 538404

SEQ ID NO: 538408 - RNA, 64 nt, Human Herpes Virus 4 (Epstein Barr virus); identical to SEQ ID NO: 538404

SEQ ID NO: 538409 - RNA, 64 nt, Human Herpes Virus 4 (Epstein Barr virus); identical to SEQ ID NO: 538404

SEQ ID NO: 538410 - RNA, 64 nt, Human Herpes Virus 4 (Epstein Barr virus); identical to SEQ ID NO: 538404

SEQ ID NO: 538411 - RNA, 64 nt, Human Herpes Virus 4 (Epstein Barr virus); identical to SEQ ID NO: 538404

SEQ ID NO: 538412 - RNA, 64 nt, Human Herpes Virus 4 (Epstein Barr virus); identical to SEQ ID NO: 538404

SEQ ID NO: 538413 - RNA, 64 nt, Human Herpes Virus 4 (Epstein Barr virus); identical to SEQ ID NO: 538404

SEQ ID NO: 538414 - RNA, 64 nt, Human Herpes Virus 4 (Epstein Barr virus); identical to SEQ ID NO: 538404

SEQ ID NO: 538415 - RNA, 64 nt, Human Herpes Virus 4 (Epstein Barr virus); identical to SEQ ID NO: 538404

SEQ ID NO: 538416 - RNA, 64 nt, Human Herpes Virus 4 (Epstein Barr virus); identical to SEQ ID NO: 538404

SEQ ID NO: 538417 - RNA, 64 nt, Human Herpes Virus 4 (Epstein Barr virus); identical to SEQ ID NO: 538404

SEQ ID NO: 538418 - RNA, 64 nt, Human Herpes Virus 4 (Epstein Barr virus); identical to SEQ ID NO: 538404

SEQ ID NO: 538419 - RNA, 64 nt, Human Herpes Virus 4 (Epstein Barr virus); identical to SEQ ID NO: 538404

SEQ ID NO: 538420 - RNA, 64 nt, Human Herpes Virus 4 (Epstein Barr virus); identical to SEQ ID NO: 538404

SEQ ID NO: 538421 - RNA, 64 nt, Human Herpes Virus 4 (Epstein Barr virus); identical to SEQ ID NO: 538404

SEQ ID NO: 538422 - RNA, 64 nt, Human Herpes Virus 4 (Epstein Barr virus); identical to SEQ ID NO: 538404

SEQ ID NO: 538423 - RNA, 64 nt, Human Herpes Virus 4 (Epstein Barr virus); identical to SEQ ID NO: 538404

SEQ ID NO: 538424 - RNA, 64 nt, Human Herpes Virus 4 (Epstein Barr virus); identical to SEQ ID NO: 538404

SEQ ID NO: 538425 - RNA, 64 nt, Human Herpes Virus 4 (Epstein Barr virus); identical to SEQ ID NO: 538404

SEQ ID NO: 538426 - RNA, 64 nt, Human Herpes Virus 4 (Epstein Barr virus); identical to SEQ ID NO: 538404

SEQ ID NO: 538427 - RNA, 64 nt, Human Herpes Virus 4 (Epstein Barr virus); identical to SEQ ID NO: 538404

SEQ ID NO: 538428 - RNA, 64 nt, Human Herpes Virus 4 (Epstein Barr virus)
agcuggaauacaacaacaccuacgaggccccccugagcuccaagauuacggccguugucguguc

SEQ ID NO: 538429 - RNA, 64 nt, Human Herpes Virus 2; identical to SEQ ID NO: 536887

SEQ ID NO: 538430 - RNA, 64 nt, Human Herpes Virus 2; identical to SEQ ID NO: 536888

SEQ ID NO: 538431 - RNA, 64 nt, Human Herpes Virus 2; identical to SEQ ID NO: 536889

SEQ ID NO: 538432 - RNA, 64 nt, Human Herpes Virus 2; identical to SEQ ID NO: 536890

SEQ ID NO: 538433 - RNA, 64 nt, Human Herpes Virus 2; identical to SEQ ID NO: 536891

SEQ ID NO: 538434 - RNA, 64 nt, Human Herpes Virus 2; identical to SEQ ID NO: 536892

SEQ ID NO: 538435 - RNA, 64 nt, Human Herpes Virus 2; identical to SEQ ID NO: 536893

SEQ ID NO: 538436 - RNA, 64 nt, Human Herpes Virus 2; identical to SEQ ID NO: 536894

SEQ ID NO: 538437 - RNA, 64 nt, Human Herpes Virus 2; identical to SEQ ID NO: 536895

SEQ ID NO: 538438 - RNA, 64 nt, Human Herpes Virus 2; identical to SEQ ID NO: 536896

SEQ ID NO: 538439 - RNA, 64 nt, Human Herpes Virus 2; identical to SEQ ID NO: 536897

SEQ ID NO: 538440 - RNA, 64 nt, Human Herpes Virus 2; identical to SEQ ID NO: 536898

SEQ ID NO: 538441 - RNA, 64 nt, Human Herpes Virus 2; identical to SEQ ID NO: 536899

SEQ ID NO: 538442 - RNA, 64 nt, Human Herpes Virus 2; identical to SEQ ID NO: 536900

SEQ ID NO: 538443 - RNA, 64 nt, Human Herpes Virus 2; identical to SEQ ID NO: 536901

SEQ ID NO: 538444 - RNA, 64 nt, Human Herpes Virus 2; identical to SEQ ID NO: 536902

SEQ ID NO: 538445 - RNA, 64 nt, Human Herpes Virus 2; identical to SEQ ID NO: 536903

SEQ ID NO: 538446 - RNA, 64 nt, Human Herpes Virus 2; identical to SEQ ID NO: 536904

SEQ ID NO: 538447 - RNA, 64 nt, Human Herpes Virus 2; identical to SEQ ID NO: 536905

SEQ ID NO: 538448 - RNA, 64 nt, Human Herpes Virus 2; identical to SEQ ID NO: 536906

SEQ ID NO: 538449 - RNA, 64 nt, Human Herpes Virus 2; identical to SEQ ID NO: 536907

SEQ ID NO: 538450 - RNA, 64 nt, Human Herpes Virus 2; identical to SEQ ID NO: 536908

SEQ ID NO: 538451 - RNA, 64 nt, Human Herpes Virus 2; identical to SEQ ID NO: 536909

SEQ ID NO: 538452 - RNA, 64 nt, Human Herpes Virus 2; identical to SEQ ID NO: 536910

SEQ ID NO: 538453 - RNA, 64 nt, Human Herpes Virus 2; identical to SEQ ID NO: 536911

SEQ ID NO: 538454 - RNA, 64 nt, Human Herpes Virus 2; identical to SEQ ID NO: 536912

SEQ ID NO: 538455 - RNA, 64 nt, Human Herpes Virus 2; identical to SEQ ID NO: 536913

SEQ ID NO: 538456 - RNA, 64 nt, Human Herpes Virus 2; identical to SEQ ID NO: 536914

SEQ ID NO: 538457 - RNA, 64 nt, Human Herpes Virus 2; identical to SEQ ID NO: 536915

SEQ ID NO: 538458 - RNA, 64 nt, Human Herpes Virus 2; identical to SEQ ID NO: 536916

SEQ ID NO: 538459 - RNA, 64 nt, Human Herpes Virus 2; identical to SEQ ID NO: 536917

SEQ ID NO: 538460 - RNA, 64 nt, Human Herpes Virus 2; identical to SEQ ID NO: 536918

SEQ ID NO: 538461 - RNA, 64 nt, Human Herpes Virus 2; identical to SEQ ID NO: 536919

SEQ ID NO: 538462 - RNA, 64 nt, Human Herpes Virus 2; identical to SEQ ID NO: 536890

SEQ ID NO: 538463 - RNA, 64 nt, Human Herpes Virus 2; identical to SEQ ID NO: 536889

SEQ ID NO: 538464 - RNA, 64 nt, Human Herpes Virus 2; identical to SEQ ID NO: 536888

SEQ ID NO: 538465 - RNA, 64 nt, Human Herpes Virus 2; identical to SEQ ID NO: 536887

SEQ ID NO: 538466 - RNA, 64 nt, Human Herpes Virus 2; identical to SEQ ID NO: 536908

SEQ ID NO: 538467 - RNA, 64 nt, Human Herpes Virus 1
gcgugcgcggggggacacggaagcgcugugcucccccgaggacggcuggguaaagguucacccc

SEQ ID NO: 538468 - RNA, 64 nt, Human Herpes Virus 1
ugggugccgguugcgguucguucuggacgggagucccgaggacgccuaugugacgucggaggau

SEQ ID NO: 538469 - RNA, 64 nt, Human Herpes Virus 1
aaagcagauccgcucgcggauuccccagagcagccccgaggaggccgugcuccuggacaagcag

SEQ ID NO: 538470 - RNA, 64 nt, Human Herpes Virus 1
uacguacgccgccuuugcagagcucggcaugaugcccgaggauaguccccgcugccugcaccgc

SEQ ID NO: 538471 - RNA, 64 nt, Human Herpes Virus 1
cgacauuaagaccgaaaauauuuuuauuaacacccccgaggacauuugccugggggacuuuggc

SEQ ID NO: 538472 - RNA, 64 nt, Human Herpes Virus 1
caacgccacgcagccagaacucgccccggaagaccccgaggauucggcccucuuggaggacccc

SEQ ID NO: 538473 - RNA, 64 nt, Human Herpes Virus 1
ccgcauggcggccuggaugcgccagauccccgaccccgaggacgugcgcgugguggugcuguac

SEQ ID NO: 538474 - RNA, 64 nt, Human Herpes Virus 1
cucguacgucgugaccuaccucgggggagaccuucccgaggagugcauggccguguaccgggac

SEQ ID NO: 538475 - RNA, 64 nt, Human Herpes Virus 1
ccgccgacccacccuccgcgagacgcuggacgcccccgaggacccccaagacccccgccgcaga

SEQ ID NO: 538476 - RNA, 64 nt, Human Herpes Virus 1
cgccgcggccauccgagagguaauggcgcaugcgcccgaggacgcccccccgcaaagccccgcg

SEQ ID NO: 538477 - RNA, 64 nt, Human Herpes Virus 1
ccugcagacgguggugcccagcggccuggacguccccgaggaccccgugggcgacugcgacccc

SEQ ID NO: 538478 - RNA, 64 nt, Human Herpes Virus 1
ucuucucggggcuauauguggcuggggagcgcgccccgaggaacaauaugagaugauccgcgcg

SEQ ID NO: 538479 - RNA, 64 nt, Human Herpes Virus 1; identical to SEQ ID NO: 538473

SEQ ID NO: 538480 - RNA, 64 nt, Human Herpes Virus 1
gacaaaaccuaaggacagcggcccgcgcgacgggguccgagaggcuaagguaggccgcgauguu

SEQ ID NO: 538481 - RNA, 64 nt, Human Herpes Virus 1
ccccauacacgagcacccugcugcccccggagcuguccgagacccccaacgccacgcagccaga

SEQ ID NO: 538482 - RNA, 64 nt, Human Herpes Virus 1
ggccgugguuaaccggagucugguuauucacgggguccgagagacggacagcggccuguauacc

SEQ ID NO: 538483 - RNA, 64 nt, Human Herpes Virus 1
cauccugaacgacguucuaacccuuaccccugguaccgcaaagccgcggucgcuggucgagugg

SEQ ID NO: 538484 - RNA, 64 nt, Human Herpes Virus 1
cgguuuguuggcagcgaggcguucgguuccgggcaccgcaaaacgggcggcgaggacguccucg

SEQ ID NO: 538485 - RNA, 64 nt, Human Herpes Virus 1
uaacgaugccucgacggaaacccguccggguucggggggcgaaccggccgccugucgcucguca

SEQ ID NO: 538486 - RNA, 64 nt, Human Herpes Virus 1
ccuggugccggcgcaacuaaaggggcgugauuucgggggcgaccacacggccaagcuggaauuc

SEQ ID NO: 538487 - RNA, 64 nt, Human Herpes Virus 1
ggcggaugccgcgcgcggggaugagccggcgggugggggcgacgggggggcgcccccgggucug

SEQ ID NO: 538488 - RNA, 64 nt, Human Herpes Virus 1
ccugcccucggucucccuggccacaaaacgccuggggggcgaggcgcaccccgaucgcacgcug

SEQ ID NO: 538489 - RNA, 64 nt, Human Herpes Virus 1
ggagggggaggacgaggacgaacgcgaggagggcgggggcgagcgggagccggagggcgcgcgg

SEQ ID NO: 538490 - RNA, 64 nt, Human Herpes Virus 1
gaggcgggcaaggacuaccuggagaucgaggugggggggcgacggcuguucuucgucaaggcuc

SEQ ID NO: 538491 - RNA, 64 nt, Human Herpes Virus 1
gcgggucacucccacgaccaagcgggggcgcucggggggcgaggaugcgcgcgcggacacggcc

SEQ ID NO: 538492 - RNA, 64 nt, Human Herpes Virus 1
cggccgcccuggccgcggcgguguuggcgggcccgggggcgaccaccgccagggacugcuuuuc

SEQ ID NO: 538493 - RNA, 64 nt, Human Herpes Virus 1
ggggcggcuguccgccgcgcccgccucccccgcggggggcgacgaccccgacgccgcccgccac

SEQ ID NO: 538494 - RNA, 64 nt, Human Herpes Virus 1
uuuggaccucacgaagcgcgcccuggccgccuccgggggcgaggaguugcggaacgaguuucgc

SEQ ID NO: 538495 - RNA, 64 nt, Human Herpes Virus 1
ggagacggccagcucggugaaguucgcggucugcgggggcgaugggggugcguucugggguguc

SEQ ID NO: 538496 - RNA, 64 nt, Human Herpes Virus 1
cacguucuuuggggagcuggaagcgcgccuuggcgggggcgauaacaucugcauuuuuucgucg

SEQ ID NO: 538497 - RNA, 64 nt, Human Herpes Virus 1
gggccgcuuuguggccccagcgccccacgggcccgggggcgaggacauccugaacgacguucua

SEQ ID NO: 538498 - RNA, 64 nt, Human Herpes Virus 1
acgccguggcggcgcugcgccuugcguggggcucgggggcgagcugugcccgcgugauucuguu

SEQ ID NO: 538499 - RNA, 64 nt, Human Herpes Virus 1
ggaaggggcacggggguugggagcucccgggggcgggggcgaggacgaagaccgucgccgcggg

SEQ ID NO: 538500 - RNA, 64 nt, Human Herpes Virus 1
cuccguguuggaccaugcgcuggcccggaccgcggggggcgacgggcagccccacccgucgccc

SEQ ID NO: 538501 - RNA, 64 nt, Human Herpes Virus 1
ucuguuucgaggaacugugugugacggcgaaccagggggcgacgaucgcccgccgccuggcgga

SEQ ID NO: 538502 - RNA, 64 nt, Human Herpes Virus 1
ugccacccgggcccucaucggaaccuuggccuccgggggcgaggagggggcggggucggcggcg

SEQ ID NO: 538503 - RNA, 64 nt, Human Herpes Virus 1
ugggaaagcugagucccgccgcacgguuuugcccgggggcgaaacucgggcgcaugugucuccc

SEQ ID NO: 538504 - RNA, 64 nt, Human Herpes Virus 1; identical to SEQ ID NO: 538493

SEQ ID NO: 538505 - RNA, 64 nt, Human Herpes Virus 2; identical to SEQ ID NO: 535377

SEQ ID NO: 538506 - RNA, 64 nt, Human Herpes Virus 2; identical to SEQ ID NO: 535378

SEQ ID NO: 538507 - RNA, 64 nt, Human Herpes Virus 2; identical to SEQ ID NO: 535379

SEQ ID NO: 538508 - RNA, 64 nt, Human Herpes Virus 2; identical to SEQ ID NO: 535377

SEQ ID NO: 538509 - RNA, 64 nt, Human Herpes Virus 2; identical to SEQ ID NO: 535381

SEQ ID NO: 538510 - RNA, 64 nt, Human Herpes Virus 2; identical to SEQ ID NO: 535381

SEQ ID NO: 538511 - RNA, 64 nt, Human Herpes Virus 4 (Epstein Barr virus)
cagugcggugcuaccgacccgaggucaagucccgggggaggagaagagaggcuucccgccuaga

SEQ ID NO: 538512 - RNA, 64 nt, Human Herpes Virus 4 (Epstein Barr virus)
cucugagggggggagaaagacgggcgggggcguaggggaggagcucgugggggccggggggccc

SEQ ID NO: 538513 - RNA, 64 nt, Human Herpes Virus 4 (Epstein Barr virus)
ccccaaggacgccggggaccuggagaggcucuacggggaggaguuugagcgcgaguacuaucgg

SEQ ID NO: 538514 - RNA, 64 nt, Human Herpes Virus 4 (Epstein Barr virus)
aagaacugggaugaacccuggggcaacagacugcggggaggaggggggcagugauaagucauga

SEQ ID NO: 538515 - RNA, 64 nt, Human Herpes Virus 4 (Epstein Barr virus)
ggaccugguguaccggaucgccaaccagaucuuuggggaggaugugccccccuucucaucucac

SEQ ID NO: 538516 - RNA, 64 nt, Human Herpes Virus 4 (Epstein Barr virus)
cgaggaggaugaagaaggcggggggcuauucccgggggaggacgccacccucuaccgcaaggac

SEQ ID NO: 538517 - RNA, 64 nt, Human Herpes Virus 4 (Epstein Barr virus)
caggaggguccccuccauaggguugaaccaggagggggaggaucgggcuccgccccgauauacc

SEQ ID NO: 538518 - RNA, 64 nt, Human Herpes Virus 4 (Epstein Barr virus)
ccacguuugcacgcgggaaggcggcgagggagggggggaggacgagacgacgguggucgggcgc

SEQ ID NO: 538519 - RNA, 64 nt, Human Herpes Virus 4 (Epstein Barr virus)
gagccacacccaccuaugccaauccaugccaaugggggaggagagaccaagaccaauacccagg

SEQ ID NO: 538520 - RNA, 64 nt, Human Herpes Virus 4 (Epstein Barr virus)
gauccugcagauauccugcguccucuggucgacaggggaggaggccgggcgcuauaggcgcauc

SEQ ID NO: 538521 - RNA, 64 nt, Human Herpes Virus 4 (Epstein Barr virus)
cuaccaggcccuggccuucgauaucgagugucugggggaggagggcuuccccacggccaccaac

SEQ ID NO: 538522 - RNA, 64 nt, Human Herpes Virus 2
uggugguccgggggacaggccccaaagaccgcauggucgccaacuacguacgaagcgagcuccg

SEQ ID NO: 538523 - RNA, 64 nt, Human Herpes Virus 2
ccggcgcgucuccagaaacgcccacaaccaagggggucgccaccccgcgucggcgcggacggac

SEQ ID NO: 538524 - RNA, 64 nt, Human Herpes Virus 2
ccaucacgcgcucccaggggcucagucuggacaaggucgccauaugcuucacgcccggaaaccu

SEQ ID NO: 538525 - RNA, 64 nt, Human Herpes Virus 2
accacgagaccgacauggagcucaagccggcgaaggucgccacgcgcacgagccggggguggca

SEQ ID NO: 538526 - RNA, 64 nt, Human Herpes Virus 2
uccacggcgaggugcugcccgcgaccuucgccgcggucgccaacggcuucgcggcgcgcgcgcg

SEQ ID NO: 538527 - RNA, 64 nt, Human Herpes Virus 2
agcuccggggcaucauugcggagggcggggcggcggucgccagcagcguguuuguggcgaccgu

SEQ ID NO: 538528 - RNA, 64 nt, Human Herpes Virus 2
cgagcgccaacgcguccgaggccgccaaggcgcgggucgccagccuccagagcgccuaccagaa

SEQ ID NO: 538529 - RNA, 64 nt, Human Herpes Virus 2
uuugacccgcacggccugccgcuaagcugguccuggucgccaggcaaggugcgggcgggcgacg

SEQ ID NO: 538530 - RNA, 64 nt, Human Herpes Virus 2
gcggcgcggucggcgggagcugccgggacaagauacaacggacccggcgcgacaacgcaccccc

SEQ ID NO: 538531 - RNA, 64 nt, Human Herpes Virus 2
guggaucacggccaacgccagucgcaucaccaacuacucccagagucaggaccaggacgcgggg

SEQ ID NO: 538532 - RNA, 64 nt, Human Herpes Virus 2
cgugaccgugucgcaggugugguucggccaccgcuacucccaguuuauggggauauucgaggac

SEQ ID NO: 538533 - RNA, 64 nt, Human Herpes Virus 4 (Epstein Barr virus)
ugaaauucaugagcuaacaccccgcuggagggcccggucgcauucccagaacuccauggauggc

SEQ ID NO: 538534 - RNA, 64 nt, Human Herpes Virus 1; identical to SEQ ID NO: 537972

SEQ ID NO: 538535 - RNA, 64 nt, Human Herpes Virus 1; identical to SEQ ID NO: 537973

SEQ ID NO: 538536 - RNA, 64 nt, Human Herpes Virus 1; identical to SEQ ID NO: 537974

SEQ ID NO: 538537 - RNA, 64 nt, Human Herpes Virus 1; identical to SEQ ID NO: 537975

SEQ ID NO: 538538 - RNA, 64 nt, Human Herpes Virus 1; identical to SEQ ID NO: 537976

SEQ ID NO: 538539 - RNA, 64 nt, Human Herpes Virus 2
cgcaccucccccggcucccgagcucgcuggagccccuggugagcggccuguuugacggcauucc

SEQ ID NO: 538540 - RNA, 64 nt, Human Herpes Virus 2
gcuuucuguuugccuuccugucggccgcggacgaccuggugacggaaaaccugggcggccucuc

SEQ ID NO: 538541 - RNA, 64 nt, Human Herpes Virus 2
cguacacccagguaaucgacaucuggagcgccggccuggugaucuuugagaccgccguccacac

SEQ ID NO: 538542 - RNA, 64 nt, Human Herpes Virus 2
acagccacuuucccgacugcccccugcaaccgcaccuggugacguuccucggcaggcaccgcgc

SEQ ID NO: 538543 - RNA, 64 nt, Human Herpes Virus 2
ugucgcuccggccggccguccuggccgacuuuagccuggugacccugaacuccaacuccacgau

SEQ ID NO: 538544 - RNA, 64 nt, Human Herpes Virus 2
aggagaucgccaucgugcgcucgcucuccgugccccuggugaagacgacccccgugucgcuccc

SEQ ID NO: 538545 - RNA, 64 nt, Human Herpes Virus 4 (Epstein Barr virus)
gggccccucccgccgccucacccugcugccagacaauacggacugccguccgguccaagaaugc

SEQ ID NO: 538546 - RNA, 64 nt, Human Herpes Virus 4 (Epstein Barr virus)
guccgcuuuuuggcgcuguucccacuucgcccgaugacuggaacucccgccgccucagugcccc

SEQ ID NO: 538547 - RNA, 64 nt, Human Herpes Virus 4 (Epstein Barr virus)
ccagguguguguaugcccuguacuuggacgugcgugacuggaagggugaggauauagcuccucc

SEQ ID NO: 538548 - RNA, 64 nt, Human Herpes Virus 4 (Epstein Barr virus)
uggcgcuacuguuuuggcuguacaucguuaugagugacuggacuggaggagcccuccuuguccu

SEQ ID NO: 538549 - RNA, 64 nt, Human Herpes Virus 1
cccagguaaccuccacgcccaacucggaacccgcggucaggagcgcgcccgcggccgccccgcc

SEQ ID NO: 538550 - RNA, 64 nt, Human Herpes Virus 1; identical to SEQ ID NO: 538549

SEQ ID NO: 538551 - RNA, 64 nt, Human Herpes Virus 1; identical to SEQ ID NO: 538549

SEQ ID NO: 538552 - RNA, 64 nt, Human Herpes Virus 1; identical to SEQ ID NO: 538549

SEQ ID NO: 538553 - RNA, 64 nt, Human Herpes Virus 2
cgcagaaaagggcacgcucggggucgggguccggaagggccaccuggcacagcggcucggugag

SEQ ID NO: 538554 - RNA, 64 nt, Human Herpes Virus 2
ggaggaguuaugggaggcggucuuuaagaaaacccgccugcagacguaccugacagacgucgcg

SEQ ID NO: 538555 - RNA, 64 nt, Human Herpes Virus 2
cauggcgucccaggagcucgucuccgugacggugcgccugcagaccgacccggucgaguaucug

SEQ ID NO: 538556 - RNA, 64 nt, Human Herpes Virus 2
gaacggcaacguguacgcggaccgccucgacaaccgccugcagcugggcaugcugaucccggga

SEQ ID NO: 538557 - RNA, 64 nt, Human Herpes Virus 2
ucagcagugcuuugccacuaaaugcgauaacaaccgccugcacacgcuguuuaccgucgaugcg

SEQ ID NO: 538558 - RNA, 64 nt, Human Herpes Virus 2
cucgcagcagcagcucgacgucacgcaggugccgcgccugcagugguuccgggacguggcggcc

SEQ ID NO: 538559 - RNA, 64 nt, Human Herpes Virus 2
cgguccugaccgacgccgcguggucgagcugcgccgccugcaggccccuggaagagcuggcgcg

SEQ ID NO: 538560 - RNA, 64 nt, Human Herpes Virus 2
gacgguccaguggcucucgguggucgugggggcgcgccugcacccgcacuccgcccaccccgcg

SEQ ID NO: 538561 - RNA, 64 nt, Human Herpes Virus 2
gcggguggcgaucaacgggugggucugcgggacgcgccugcacacggaggggcgcggcucggag

SEQ ID NO: 538562 - RNA, 64 nt, Human Herpes Virus 2
ucgugaaggcgcgcgcccuggcccgcacauaccacgccugcauggucaaccucgagaggcuggc

SEQ ID NO: 538563 - RNA, 64 nt, Human Herpes Virus 1
cggcccccgcgagguccgaagacucauuuggauccggcgggagccacccgacaacagcccccgg

SEQ ID NO: 538564 - RNA, 64 nt, Human Herpes Virus 1
caccuacggauuggcccccccgcgcucguuuuggcggcgggacucguccugggggccgcuauuu

SEQ ID NO: 538565 - RNA, 64 nt, Human Herpes Virus 1
ucguugcggugacaaacaucggagccggcagcgacggcgggaccgccgucguggcauucggggg

SEQ ID NO: 538566 - RNA, 64 nt, Human Herpes Virus 1
acgauuaaggacgucucuggguccggcgcguccucggcgggagaguacacgauaaacgggaucg

SEQ ID NO: 538567 - RNA, 64 nt, Human Herpes Virus 1
ccggguaaaccugcggcucacgagcucucccgaucggcgggaugggguuauuuuuccuaagaug

SEQ ID NO: 538568 - RNA, 64 nt, Human Herpes Virus 1
cgaccccgaccacccccacgaccucgacgacgcccggcgggacgggagggcccccgcggcgggc

SEQ ID NO: 538569 - RNA, 64 nt, Human Herpes Virus 1
gcugggggcggaggcgggcuuggccacgcccccgcggcgggaaguuguggacugggaaggcgcc

SEQ ID NO: 538570 - RNA, 64 nt, Human Herpes Virus 1
gcaaggagcgccggcggucgcgcuccucugcggccggcgggacucugggcguggugcgucgggc

SEQ ID NO: 538571 - RNA, 64 nt, Human Herpes Virus 1
uuggccuccgggggcgaggagggggcggggucggcggcgggauccggcacgcagccgucgcuca

SEQ ID NO: 538572 - RNA, 64 nt, Human Herpes Virus 1
gcgggccuguuguuugucuugcucgucgccuuagcggcgggagacgcgggcccgcgcggggagc

SEQ ID NO: 538573 - RNA, 64 nt, Human Herpes Virus 1; identical to SEQ ID NO: 538569

SEQ ID NO: 538574 - RNA, 64 nt, Human Herpes Virus 1; identical to SEQ ID NO: 538568

SEQ ID NO: 538575 - RNA, 64 nt, Human Herpes Virus 1
ggccaugaggaaacacccgggacggcuuugucuccggcgggacggccuccuccuuccuccugcc

SEQ ID NO: 538576 - RNA, 64 nt, Human Herpes Virus 1
ccaacgcauccuuggguguggcacaucgaagaaccggcgggaccgugaccgacaguccccguaa

SEQ ID NO: 538577 - RNA, 64 nt, Human Herpes Virus 4 (Epstein Barr virus); identical to SEQ ID NO: 538161

SEQ ID NO: 538578 - RNA, 64 nt, Human Herpes Virus 4 (Epstein Barr virus); identical to SEQ ID NO: 538162

SEQ ID NO: 538579 - RNA, 64 nt, Human Herpes Virus 4 (Epstein Barr virus); identical to SEQ ID NO: 538163

SEQ ID NO: 538580 - RNA, 64 nt, Human Herpes Virus 4 (Epstein Barr virus)
cccacaacauguaagggcccgcuaccccuacaacacaaaacaaacuaucuccccuaaccauccu

SEQ ID NO: 538581 - RNA, 64 nt, Human Herpes Virus 4 (Epstein Barr virus)
ugacugcgcugaauacauagaccuacuaaagcacacaaaacaugucuuagaaaacuguucugcc

SEQ ID NO: 538582 - RNA, 64 nt, Human Herpes Virus 2
cguggccgagcagcuccucauguucgaccuccucccgcccaaggacgugccgguggggagcgac

SEQ ID NO: 538583 - RNA, 64 nt, Human Herpes Virus 2
cccuaccaccacccccacgcagacacggagacccccgcccaaccaccccgcuaccccgccaagg

SEQ ID NO: 538584 - RNA, 64 nt, Human Herpes Virus 2
ucauaugcaaagcccuuaccuuugacgcggcgcuccgcccaagcgccgcggaguugcugcgccu

SEQ ID NO: 538585 - RNA, 64 nt, Human Herpes Virus 2
cuugggccgcucgcccccaacacgccucgcccccccgcccaagcucccgcuaaggacaugcccu

SEQ ID NO: 538586 - RNA, 64 nt, Human Herpes Virus 2
agggacgcccgcgcccgcgagcggcgagauagccccgcccaauuccacgcgaucggccagcgaa

SEQ ID NO: 538587 - RNA, 64 nt, Human Herpes Virus 2
gaccaccaaggcccggaagcggaaaaccaaaaagccgcccaagcggcccgaggcgaccccgccc

SEQ ID NO: 538588 - RNA, 64 nt, Human Herpes Virus 4 (Epstein Barr virus)
ggucuacauacacgcgcgucagcccaucuuuugucaucuugaccgcguuguagcacugguagau

SEQ ID NO: 538589 - RNA, 64 nt, Human Herpes Virus 4 (Epstein Barr virus)
ccuauaagccccucugccuuuugagcaagugcuacaucuugaggggggcugggcacaucccuga

SEQ ID NO: 538590 - RNA, 64 nt, Human Herpes Virus 4 (Epstein Barr virus)
caaccuacaucaccucccaggaaguccaaaacuccaucuugagcuccaacuacuuugauuuuga

SEQ ID NO: 538591 - RNA, 64 nt, Human Herpes Virus 4 (Epstein Barr virus)
ugccuguggaggcuauuuaucccgcggccgugucaaacuggaacucgacucuagaucuccaugg

SEQ ID NO: 538592 - RNA, 64 nt, Human Herpes Virus 4 (Epstein Barr virus)
caguuucuaggaaaguacaucaaggucaagaaggaaacuggaauguacacacuggucaagcuuu

SEQ ID NO: 538593 - RNA, 64 nt, Human Herpes Virus 1
uugcgauucuagccucguggggcuggacguucgacacgccaaaccacgagucggggauaucgcc

SEQ ID NO: 538594 - RNA, 64 nt, Human Herpes Virus 1
cucguguuacaucuacaacaacuaccucggcgggcacgccaagcccccgcccgaccgcguguac

SEQ ID NO: 538595 - RNA, 64 nt, Human Herpes Virus 1
gcaccccccccaaaucccggcgccggucgucacgcacgccaaugcccucccugacggccaucgc

SEQ ID NO: 538596 - RNA, 64 nt, Human Herpes Virus 1
ggucauguggcagcuaaccucagcccccaaggugcacgccaacgguccuucaaggauuggcucg

SEQ ID NO: 538597 - RNA, 64 nt, Human Herpes Virus 1
uccggagagggcgaggcgucggagcggggccgcucacgccaagccgcccagcgagccgcucggc

SEQ ID NO: 538598 - RNA, 64 nt, Human Herpes Virus 2
auaagcucaagcggcacggccgcucgcgcggcagaacagcgacgccacaaaaucaaaaucaaaa

SEQ ID NO: 538599 - RNA, 64 nt, Human Herpes Virus 2
cgggucggguguccccggaccaauuaauccccccaacagcgauguuguuuucccgggagguucc

SEQ ID NO: 538600 - RNA, 64 nt, Human Herpes Virus 4 (Epstein Barr virus)
cuccugauugcggugcguugcggggauggcaagauccagggagggucgcuguuugagcagcucu

SEQ ID NO: 538601 - RNA, 64 nt, Human Herpes Virus 4 (Epstein Barr virus)
caggggcaggggcaggggcaggggcaagggcaaguccagggacaagcaacgcaagcccggugga

SEQ ID NO: 538602 - RNA, 64 nt, Human Herpes Virus 4 (Epstein Barr virus)
cugcuccauucuucagggaucccccacuuaugauuccagggauauggccuccaugggccucggg

SEQ ID NO: 538603 - RNA, 64 nt, Human Herpes Virus 4 (Epstein Barr virus)
auggaaugcccucccaacaucugguagacaauccuccagggacgauuuaaucccagccgccgug

SEQ ID NO: 538604 - RNA, 64 nt, Human Herpes Virus 4 (Epstein Barr virus)
guuggaggcacgcuguucgucccgugaguacagcuccagggaggcaaagucaauguucucgaug

SEQ ID NO: 538605 - RNA, 64 nt, Human Herpes Virus 1
acggcgagaagaacgucacauggacccuguucgaccgggacaccagcaugucgcucgccgacuu

SEQ ID NO: 538606 - RNA, 64 nt, Human Herpes Virus 1
cgggcaucggaacacgccuaccggccccugggccccgggacaccccccaugcgggcucggcucc

SEQ ID NO: 538607 - RNA, 64 nt, Human Herpes Virus 1
ggcucccauuuuacccgaagaucggcugcuauccccgggacauggaucgcggggcggugguggg

SEQ ID NO: 538608 - RNA, 64 nt, Human Herpes Virus 1
gucgcgccgaauuuugugccuaccgcuuuauaggccgggacagcaaccagaagcucgaacgcgg

SEQ ID NO: 538609 - RNA, 64 nt, Human Herpes Virus 1
agccgguacgaauaccaguacggcgugguacugcccgggacaaacggacgggagcgcgauugua

SEQ ID NO: 538610 - RNA, 64 nt, Human Herpes Virus 1
cgggccugcagccgaagccccucaccacgccgccgcccaucaucgccacgucggaccccacccc

SEQ ID NO: 538611 - RNA, 64 nt, Human Herpes Virus 1
uugagucagugcuucgggccccccggguaggcgcgcccaucacgggcuccgaugucauccuggg

SEQ ID NO: 538612 - RNA, 64 nt, Human Herpes Virus 1
ugcgggucuuucccagcauuacccuccccacgucgcccaucaguaucccggggugcuguucucg

SEQ ID NO: 538613 - RNA, 64 nt, Human Herpes Virus 1
ucgguaaccucaugaaggugcuggaguacggccugcccaucaccgaggagcacaugcaguucgu

SEQ ID NO: 538614 - RNA, 64 nt, Human Herpes Virus 1
guucgaggcccccacgaucgacggggccguggcggcccaucaggacaagaugcggcgccuggcg

SEQ ID NO: 538615 - RNA, 64 nt, Human Herpes Virus 1
ccgccuggcgcgccgcggcucgugggcccgcgagcgggccgaccgggcucgguuccggcgccgg

SEQ ID NO: 538616 - RNA, 64 nt, Human Herpes Virus 1
augcggcagccgcccugcgggggcggaccugcuccgggccgacuaugacauuaucgacgucagc

SEQ ID NO: 538617 - RNA, 64 nt, Human Herpes Virus 1
ggcgcuaugugccaauuacgugcuuccgcuguaccgggccgacccggcggucgagcugacccag

SEQ ID NO: 538618 - RNA, 64 nt, Human Herpes Virus 1
cccggagcuguuggugaaauaccuuaacaacgaacgggccgaauuuaccaaccaccgccugaag

SEQ ID NO: 538619 - RNA, 64 nt, Human Herpes Virus 1
uggauacggacaacacacagcagcaaaucgccgccgggccgacggagggcgccccaagcguguu

SEQ ID NO: 538620 - RNA, 64 nt, Human Herpes Virus 1
agcgaccaacgccgaccuccggaccgcgcuggcccgggccgaccaccagaaaacccucuuuugg

SEQ ID NO: 538621 - RNA, 64 nt, Human Herpes Virus 1
ccgguaucgggucuuuguccuagggucccugacgcgggccgacaacggcuccgcgcuggacgcc

SEQ ID NO: 538622 - RNA, 64 nt, Human Herpes Virus 1
ugcggcaggcgcgggccauggccuggacgcccuccgggccgacgcucgcccccgaugcgcgugc

SEQ ID NO: 538623 - RNA, 64 nt, Human Herpes Virus 1
acacgcgggacaucgcgcaggggacuuccgaaagcgggccgaacccgaucgcgaccagccccac

SEQ ID NO: 538624 - RNA, 64 nt, Human Herpes Virus 1; identical to SEQ ID NO: 538615

SEQ ID NO: 538625 - RNA, 64 nt, Human Herpes Virus 1
cgaggguggggucgacgccaccacccgguucauccuggacaaccccggguucgucaccuucggc

SEQ ID NO: 538626 - RNA, 64 nt, Human Herpes Virus 1
gauuccccagagcagccccgaggaggccgugcuccuggacaagcagcaggccgccaucaagguc

SEQ ID NO: 538627 - RNA, 64 nt, Human Herpes Virus 1
ggcgcugacccccaacgacgauaccgaacaggcccuggacaagauccugcggggcaccaugcgc

SEQ ID NO: 538628 - RNA, 64 nt, Human Herpes Virus 1
ugccaugaccaucacgcgcucccagggccuuagccuggacaaggucgccaucugcuuuacgccc

SEQ ID NO: 538629 - RNA, 64 nt, Human Herpes Virus 1
aaacuuuuaccugggccgcggggcucccccucuccuggacaacgcggcagccguguaccugcgg

SEQ ID NO: 538630 - RNA, 64 nt, Human Herpes Virus 1
gccccuggcuuuguuguugccgaugcaacgauaccuggacaacggccgccuggccaccagggug

SEQ ID NO: 538631 - RNA, 64 nt, Human Herpes Virus 4 (Epstein Barr virus)
ucucucuggggguuuacauuccaggaggcggcgugcgaccaaugggugcugcgcccgcgcgugu

SEQ ID NO: 538632 - RNA, 64 nt, Human Herpes Virus 2
cgggcgcggagggaggacccggggucccccgcggcaccaacacccccggugccgccccccacgc

SEQ ID NO: 538633 - RNA, 64 nt, Human Herpes Virus 2
gggagcgguuucugcuguaccgccccuccaccaccaccaacagcggccugauggcccccgagcu

SEQ ID NO: 538634 - RNA, 64 nt, Human Herpes Virus 2
ucaccgccgaacugagcagacacccgcgcgcguacaccaacaagcgccuggcccaccugacggu

SEQ ID NO: 538635 - RNA, 64 nt, Human Herpes Virus 2
uccgggcgcucggcaugcgcgggcucguguuggccaccaacaacgcucaguucaucauggauaa

SEQ ID NO: 538636 - RNA, 64 nt, Human Herpes Virus 2
uugccgccucguucgccgccaucgcguaccugcgcaccaacaaccuccugcgggucaccugcca

SEQ ID NO: 538637 - RNA, 64 nt, Human Herpes Virus 2
aggcuccuagucccccacggcuggcccgcguucgcaccaacaacccccggggacgacgcggggg

SEQ ID NO: 538638 - RNA, 64 nt, Human Herpes Virus 2
agaagggcacgagcgcccugcucagcuccaaggucaccaacaugguucugcgcaagcgcaacaa

SEQ ID NO: 538639 - RNA, 64 nt, Human Herpes Virus 2
gccgacgaacuugaggccgcgcccugcaggacaccaccaacacgggcggcccagcgcgcccggg

SEQ ID NO: 538640 - RNA, 64 nt, Human Herpes Virus 2; identical to SEQ ID NO: 538632

SEQ ID NO: 538641 - RNA, 64 nt, Human Herpes Virus 4 (Epstein Barr virus)
uccaaauugaguugggggugcuauuuucacuauggaauuaaauuacugacauuagacaguggac

SEQ ID NO: 538642 - RNA, 64 nt, Human Herpes Virus 1
ggccagucacgugauaggugugccgcccgucgguacgcucgacgaggacgucgccgccgacgug

SEQ ID NO: 538643 - RNA, 64 nt, Human Herpes Virus 1
ggcggucguuaacgcgcuacuucccgcccccaucacgcucgaugacgcccuggggucccuggac

SEQ ID NO: 538644 - RNA, 64 nt, Human Herpes Virus 4 (Epstein Barr virus); identical to SEQ ID NO: 536194

SEQ ID NO: 538645 - RNA, 64 nt, Human Herpes Virus 4 (Epstein Barr virus); identical to SEQ ID NO: 536194

SEQ ID NO: 538646 - RNA, 64 nt, Human Herpes Virus 4 (Epstein Barr virus); identical to SEQ ID NO: 536194

SEQ ID NO: 538647 - RNA, 64 nt, Human Herpes Virus 4 (Epstein Barr virus); identical to SEQ ID NO: 536194

SEQ ID NO: 538648 - RNA, 64 nt, Human Herpes Virus 4 (Epstein Barr virus); identical to SEQ ID NO: 536194

SEQ ID NO: 538649 - RNA, 64 nt, Human Herpes Virus 4 (Epstein Barr virus); identical to SEQ ID NO: 536194

SEQ ID NO: 538650 - RNA, 64 nt, Human Herpes Virus 4 (Epstein Barr virus); identical to SEQ ID NO: 536194

SEQ ID NO: 538651 - RNA, 64 nt, Human Herpes Virus 4 (Epstein Barr virus); identical to SEQ ID NO: 536194

SEQ ID NO: 538652 - RNA, 64 nt, Human Herpes Virus 4 (Epstein Barr virus); identical to SEQ ID NO: 536194

SEQ ID NO: 538653 - RNA, 64 nt, Human Herpes Virus 4 (Epstein Barr virus); identical to SEQ ID NO: 536194

SEQ ID NO: 538654 - RNA, 64 nt, Human Herpes Virus 4 (Epstein Barr virus); identical to SEQ ID NO: 536194

SEQ ID NO: 538655 - RNA, 64 nt, Human Herpes Virus 4 (Epstein Barr virus); identical to SEQ ID NO: 536194

SEQ ID NO: 538656 - RNA, 64 nt, Human Herpes Virus 4 (Epstein Barr virus); identical to SEQ ID NO: 536206

SEQ ID NO: 538657 - RNA, 64 nt, Human Herpes Virus 4 (Epstein Barr virus); identical to SEQ ID NO: 536207

SEQ ID NO: 538658 - RNA, 64 nt, Human Herpes Virus 4 (Epstein Barr virus); identical to SEQ ID NO: 536207

SEQ ID NO: 538659 - RNA, 64 nt, Human Herpes Virus 4 (Epstein Barr virus); identical to SEQ ID NO: 536207

SEQ ID NO: 538660 - RNA, 64 nt, Human Herpes Virus 4 (Epstein Barr virus); identical to SEQ ID NO: 536207

SEQ ID NO: 538661 - RNA, 64 nt, Human Herpes Virus 4 (Epstein Barr virus); identical to SEQ ID NO: 536207

SEQ ID NO: 538662 - RNA, 64 nt, Human Herpes Virus 4 (Epstein Barr virus); identical to SEQ ID NO: 536207

SEQ ID NO: 538663 - RNA, 64 nt, Human Herpes Virus 4 (Epstein Barr virus); identical to SEQ ID NO: 536207

SEQ ID NO: 538664 - RNA, 64 nt, Human Herpes Virus 4 (Epstein Barr virus); identical to SEQ ID NO: 536207

SEQ ID NO: 538665 - RNA, 64 nt, Human Herpes Virus 4 (Epstein Barr virus); identical to SEQ ID NO: 536207

SEQ ID NO: 538666 - RNA, 64 nt, Human Herpes Virus 4 (Epstein Barr virus); identical to SEQ ID NO: 536207

SEQ ID NO: 538667 - RNA, 64 nt, Human Herpes Virus 4 (Epstein Barr virus); identical to SEQ ID NO: 536207

SEQ ID NO: 538668 - RNA, 64 nt, Human Herpes Virus 4 (Epstein Barr virus); identical to SEQ ID NO: 536207

SEQ ID NO: 538669 - RNA, 64 nt, Human Herpes Virus 4 (Epstein Barr virus); identical to SEQ ID NO: 536207

SEQ ID NO: 538670 - RNA, 64 nt, Human Herpes Virus 4 (Epstein Barr virus); identical to SEQ ID NO: 536207

SEQ ID NO: 538671 - RNA, 64 nt, Human Herpes Virus 4 (Epstein Barr virus); identical to SEQ ID NO: 536207

SEQ ID NO: 538672 - RNA, 64 nt, Human Herpes Virus 4 (Epstein Barr virus); identical to SEQ ID NO: 536207

SEQ ID NO: 538673 - RNA, 64 nt, Human Herpes Virus 4 (Epstein Barr virus); identical to SEQ ID NO: 536207

SEQ ID NO: 538674 - RNA, 64 nt, Human Herpes Virus 4 (Epstein Barr virus); identical to SEQ ID NO: 536207

SEQ ID NO: 538675 - RNA, 64 nt, Human Herpes Virus 4 (Epstein Barr virus); identical to SEQ ID NO: 536207

SEQ ID NO: 538676 - RNA, 64 nt, Human Herpes Virus 4 (Epstein Barr virus); identical to SEQ ID NO: 536207

SEQ ID NO: 538677 - RNA, 64 nt, Human Herpes Virus 4 (Epstein Barr virus); identical to SEQ ID NO: 536207

SEQ ID NO: 538678 - RNA, 64 nt, Human Herpes Virus 4 (Epstein Barr virus); identical to SEQ ID NO: 536207

SEQ ID NO: 538679 - RNA, 64 nt, Human Herpes Virus 4 (Epstein Barr virus); identical to SEQ ID NO: 536207

SEQ ID NO: 538680 - RNA, 64 nt, Human Herpes Virus 4 (Epstein Barr virus); identical to SEQ ID NO: 536207

SEQ ID NO: 538681 - RNA, 64 nt, Human Herpes Virus 4 (Epstein Barr virus); identical to SEQ ID NO: 536231

SEQ ID NO: 538682 - RNA, 64 nt, Human Herpes Virus 4 (Epstein Barr virus); identical to SEQ ID NO: 536232

SEQ ID NO: 538683 - RNA, 64 nt, Human Herpes Virus 4 (Epstein Barr virus); identical to SEQ ID NO: 536194

SEQ ID NO: 538684 - RNA, 64 nt, Human Herpes Virus 4 (Epstein Barr virus); identical to SEQ ID NO: 536194

SEQ ID NO: 538685 - RNA, 64 nt, Human Herpes Virus 4 (Epstein Barr virus); identical to SEQ ID NO: 536194

SEQ ID NO: 538686 - RNA, 64 nt, Human Herpes Virus 4 (Epstein Barr virus); identical to SEQ ID NO: 536194

SEQ ID NO: 538687 - RNA, 64 nt, Human Herpes Virus 4 (Epstein Barr virus); identical to SEQ ID NO: 536194

SEQ ID NO: 538688 - RNA, 64 nt, Human Herpes Virus 4 (Epstein Barr virus); identical to SEQ ID NO: 536194

SEQ ID NO: 538689 - RNA, 64 nt, Human Herpes Virus 4 (Epstein Barr virus); identical to SEQ ID NO: 536194

SEQ ID NO: 538690 - RNA, 64 nt, Human Herpes Virus 4 (Epstein Barr virus); identical to SEQ ID NO: 536194

SEQ ID NO: 538691 - RNA, 64 nt, Human Herpes Virus 4 (Epstein Barr virus); identical to SEQ ID NO: 536194

SEQ ID NO: 538692 - RNA, 64 nt, Human Herpes Virus 4 (Epstein Barr virus); identical to SEQ ID NO: 536194

SEQ ID NO: 538693 - RNA, 64 nt, Human Herpes Virus 4 (Epstein Barr virus); identical to SEQ ID NO: 536194

SEQ ID NO: 538694 - RNA, 64 nt, Human Herpes Virus 4 (Epstein Barr virus); identical to SEQ ID NO: 536194

SEQ ID NO: 538695 - RNA, 64 nt, Human Herpes Virus 4 (Epstein Barr virus); identical to SEQ ID NO: 536206

SEQ ID NO: 538696 - RNA, 64 nt, Human Herpes Virus 4 (Epstein Barr virus); identical to SEQ ID NO: 536207

SEQ ID NO: 538697 - RNA, 64 nt, Human Herpes Virus 4 (Epstein Barr virus); identical to SEQ ID NO: 536207

SEQ ID NO: 538698 - RNA, 64 nt, Human Herpes Virus 4 (Epstein Barr virus); identical to SEQ ID NO: 536207

SEQ ID NO: 538699 - RNA, 64 nt, Human Herpes Virus 4 (Epstein Barr virus); identical to SEQ ID NO: 536207

SEQ ID NO: 538700 - RNA, 64 nt, Human Herpes Virus 4 (Epstein Barr virus); identical to SEQ ID NO: 536207

SEQ ID NO: 538701 - RNA, 64 nt, Human Herpes Virus 4 (Epstein Barr virus); identical to SEQ ID NO: 536207

SEQ ID NO: 538702 - RNA, 64 nt, Human Herpes Virus 4 (Epstein Barr virus); identical to SEQ ID NO: 536207

SEQ ID NO: 538703 - RNA, 64 nt, Human Herpes Virus 4 (Epstein Barr virus); identical to SEQ ID NO: 536207

SEQ ID NO: 538704 - RNA, 64 nt, Human Herpes Virus 4 (Epstein Barr virus); identical to SEQ ID NO: 536207

SEQ ID NO: 538705 - RNA, 64 nt, Human Herpes Virus 4 (Epstein Barr virus); identical to SEQ ID NO: 536207

SEQ ID NO: 538706 - RNA, 64 nt, Human Herpes Virus 4 (Epstein Barr virus); identical to SEQ ID NO: 536207

SEQ ID NO: 538707 - RNA, 64 nt, Human Herpes Virus 4 (Epstein Barr virus); identical to SEQ ID NO: 536207

SEQ ID NO: 538708 - RNA, 64 nt, Human Herpes Virus 4 (Epstein Barr virus); identical to SEQ ID NO: 536207

SEQ ID NO: 538709 - RNA, 64 nt, Human Herpes Virus 4 (Epstein Barr virus); identical to SEQ ID NO: 536207

SEQ ID NO: 538710 - RNA, 64 nt, Human Herpes Virus 4 (Epstein Barr virus); identical to SEQ ID NO: 536207

SEQ ID NO: 538711 - RNA, 64 nt, Human Herpes Virus 4 (Epstein Barr virus); identical to SEQ ID NO: 536207

SEQ ID NO: 538712 - RNA, 64 nt, Human Herpes Virus 4 (Epstein Barr virus); identical to SEQ ID NO: 536207

SEQ ID NO: 538713 - RNA, 64 nt, Human Herpes Virus 4 (Epstein Barr virus); identical to SEQ ID NO: 536207

SEQ ID NO: 538714 - RNA, 64 nt, Human Herpes Virus 4 (Epstein Barr virus); identical to SEQ ID NO: 536207

SEQ ID NO: 538715 - RNA, 64 nt, Human Herpes Virus 4 (Epstein Barr virus); identical to SEQ ID NO: 536207

SEQ ID NO: 538716 - RNA, 64 nt, Human Herpes Virus 4 (Epstein Barr virus); identical to SEQ ID NO: 536207

SEQ ID NO: 538717 - RNA, 64 nt, Human Herpes Virus 4 (Epstein Barr virus); identical to SEQ ID NO: 536207

SEQ ID NO: 538718 - RNA, 64 nt, Human Herpes Virus 4 (Epstein Barr virus); identical to SEQ ID NO: 536207

SEQ ID NO: 538719 - RNA, 64 nt, Human Herpes Virus 4 (Epstein Barr virus); identical to SEQ ID NO: 536207

SEQ ID NO: 538720 - RNA, 64 nt, Human Herpes Virus 4 (Epstein Barr virus); identical to SEQ ID NO: 536231

SEQ ID NO: 538721 - RNA, 64 nt, Human Herpes Virus 4 (Epstein Barr virus); identical to SEQ ID NO: 536232

SEQ ID NO: 538722 - RNA, 64 nt, Human Herpes Virus 2; identical to SEQ ID NO: 535993

SEQ ID NO: 538723 - RNA, 64 nt, Human Herpes Virus 2; identical to SEQ ID NO: 535994

SEQ ID NO: 538724 - RNA, 64 nt, Human Herpes Virus 2; identical to SEQ ID NO: 535995

SEQ ID NO: 538725 - RNA, 64 nt, Human Herpes Virus 2; identical to SEQ ID NO: 535993

SEQ ID NO: 538726 - RNA, 64 nt, Human Herpes Virus 4 (Epstein Barr virus)
ggcccucguuggcauucuacuaggaaacggcgagcagggugaacacuugggcacggagagugcc

SEQ ID NO: 538727 - RNA, 64 nt, Human Herpes Virus 4 (Epstein Barr virus)
cccaggagaaggcccaagcacuggaccccggggucagggugauggaggcaggcgcaaaaaagga

SEQ ID NO: 538728 - RNA, 64 nt, Human Herpes Virus 4 (Epstein Barr virus)
uuguuaugacaaagcccgcuccuaccugcaauaucagggugacugugugcagcuuugacgaugg

SEQ ID NO: 538729 - RNA, 64 nt, Human Herpes Virus 4 (Epstein Barr virus)
uggucucggagccagggacccucaugcucuugcgcagggugacgguggccugguuaacgggcac

SEQ ID NO: 538730 - RNA, 64 nt, Human Herpes Virus 4 (Epstein Barr virus)
cuggaccgaggcucacccuccuccaguaggaggucagggugacucgcucacccaagaaagcggu

SEQ ID NO: 538731 - RNA, 64 nt, Human Herpes Virus 1
cggcgacggcccgggccuccccucgggcgcaugugucucccaagaggcgcucuucgacacccgu

SEQ ID NO: 538732 - RNA, 64 nt, Human Herpes Virus 1
gcgcuuccgcguuucguccguuagccggaccggagucucccagggaccuggagguccgcgacgc

SEQ ID NO: 538733 - RNA, 64 nt, Human Herpes Virus 1
cgugggggcggcugacaaguccgcggaugugcucgucucccaggcuauucggagcauggccgag

SEQ ID NO: 538734 - RNA, 64 nt, Human Herpes Virus 1
uaccgcgugaccccagggauccacgacaaccccggucucccagggagccccggucuccccggga

SEQ ID NO: 538735 - RNA, 61 nt, Human Herpes Virus 4 (Epstein Barr virus)
ccaguccuuguaugccugguguccccuuagugggacgcaggccuagguagcaucauuuaca

SEQ ID NO: 538736 - RNA, 61 nt, Human Herpes Virus 4 (Epstein Barr virus)
ccccucaacuuagagggggaaggcaaggccggggacgcaggagccgagggugcagaagacg

SEQ ID NO: 538737 - RNA, 61 nt, Human Herpes Virus 4 (Epstein Barr virus)
uggcugcaucuuaccccuggcuuccacucacgggacgcagaaugugcagggauugggcuug

SEQ ID NO: 538738 - RNA, 64 nt, Human Herpes Virus 4 (Epstein Barr virus)
gccgagccgaccggccccgcgccuggcgccuccucggggccagccgccgggguugguucugccc

SEQ ID NO: 538739 - RNA, 64 nt, Human Herpes Virus 4 (Epstein Barr virus)
uuuuccccuucccucccucgucuugcccugcgcccggggccaccuucaucaccgucgcugacuc

SEQ ID NO: 538740 - RNA, 64 nt, Human Herpes Virus 4 (Epstein Barr virus); identical to SEQ ID NO: 538738

SEQ ID NO: 538741 - RNA, 64 nt, Human Herpes Virus 4 (Epstein Barr virus); identical to SEQ ID NO: 538739

SEQ ID NO: 538742 - RNA, 64 nt, Human Herpes Virus 4 (Epstein Barr virus); identical to SEQ ID NO: 538738

SEQ ID NO: 538743 - RNA, 64 nt, Human Herpes Virus 4 (Epstein Barr virus); identical to SEQ ID NO: 538739

SEQ ID NO: 538744 - RNA, 64 nt, Human Herpes Virus 4 (Epstein Barr virus); identical to SEQ ID NO: 538738

SEQ ID NO: 538745 - RNA, 64 nt, Human Herpes Virus 4 (Epstein Barr virus); identical to SEQ ID NO: 538738

SEQ ID NO: 538746 - RNA, 64 nt, Human Herpes Virus 4 (Epstein Barr virus); identical to SEQ ID NO: 538738

SEQ ID NO: 538747 - RNA, 64 nt, Human Herpes Virus 4 (Epstein Barr virus); identical to SEQ ID NO: 538738

SEQ ID NO: 538748 - RNA, 64 nt, Human Herpes Virus 4 (Epstein Barr virus); identical to SEQ ID NO: 538738

SEQ ID NO: 538749 - RNA, 64 nt, Human Herpes Virus 4 (Epstein Barr virus)
gucaucaacgaccaacaauuacaucaucuacccucggggccaccaugguggccacccaucugcg

SEQ ID NO: 538750 - RNA, 64 nt, Human Herpes Virus 4 (Epstein Barr virus)
ccccaggaccuggcggcggcgcagcggugcccagcggggccaccccccacccggagcggggcag

SEQ ID NO: 538751 - RNA, 64 nt, Human Herpes Virus 4 (Epstein Barr virus); identical to SEQ ID NO: 538750

SEQ ID NO: 538752 - RNA, 64 nt, Human Herpes Virus 4 (Epstein Barr virus); identical to SEQ ID NO: 538750

SEQ ID NO: 538753 - RNA, 64 nt, Human Herpes Virus 4 (Epstein Barr virus); identical to SEQ ID NO: 538750

SEQ ID NO: 538754 - RNA, 64 nt, Human Herpes Virus 4 (Epstein Barr virus); identical to SEQ ID NO: 538750

SEQ ID NO: 538755 - RNA, 64 nt, Human Herpes Virus 4 (Epstein Barr virus); identical to SEQ ID NO: 538750

SEQ ID NO: 538756 - RNA, 64 nt, Human Herpes Virus 4 (Epstein Barr virus); identical to SEQ ID NO: 538750

SEQ ID NO: 538757 - RNA, 64 nt, Human Herpes Virus 4 (Epstein Barr virus); identical to SEQ ID NO: 538750

SEQ ID NO: 538758 - RNA, 64 nt, Human Herpes Virus 4 (Epstein Barr virus); identical to SEQ ID NO: 538750

SEQ ID NO: 538759 - RNA, 64 nt, Human Herpes Virus 4 (Epstein Barr virus); identical to SEQ ID NO: 538750

SEQ ID NO: 538760 - RNA, 64 nt, Human Herpes Virus 4 (Epstein Barr virus); identical to SEQ ID NO: 538750

SEQ ID NO: 538761 - RNA, 64 nt, Human Herpes Virus 4 (Epstein Barr virus); identical to SEQ ID NO: 538750

SEQ ID NO: 538762 - RNA, 64 nt, Human Herpes Virus 4 (Epstein Barr virus)
aggguuucuaugcuuggccggccaggccaccugccggggccaguggaaucccaaggaacaauuc

SEQ ID NO: 538763 - RNA, 64 nt, Human Herpes Virus 4 (Epstein Barr virus)
cggucacuuaugaaguagaucuggugucguccgacggggccaccggccgugguggggacgcccg

SEQ ID NO: 538764 - RNA, 64 nt, Human Herpes Virus 4 (Epstein Barr virus)
caaggcugacucaccuguuugacgccguggcucccggggccacggagcggcucuucugcggcgg

SEQ ID NO: 538765 - RNA, 64 nt, Human Herpes Virus 4 (Epstein Barr virus)
acuuuuccaggcggcgcucggucccuguccccagcggggccagcgcggaggaguacucugaccu

SEQ ID NO: 538766 - RNA, 64 nt, Human Herpes Virus 4 (Epstein Barr virus); identical to SEQ ID NO: 538738

SEQ ID NO: 538767 - RNA, 64 nt, Human Herpes Virus 4 (Epstein Barr virus); identical to SEQ ID NO: 538739

SEQ ID NO: 538768 - RNA, 64 nt, Human Herpes Virus 4 (Epstein Barr virus); identical to SEQ ID NO: 538738

SEQ ID NO: 538769 - RNA, 64 nt, Human Herpes Virus 4 (Epstein Barr virus); identical to SEQ ID NO: 538739

SEQ ID NO: 538770 - RNA, 64 nt, Human Herpes Virus 4 (Epstein Barr virus); identical to SEQ ID NO: 538738

SEQ ID NO: 538771 - RNA, 64 nt, Human Herpes Virus 4 (Epstein Barr virus); identical to SEQ ID NO: 538739

SEQ ID NO: 538772 - RNA, 64 nt, Human Herpes Virus 4 (Epstein Barr virus); identical to SEQ ID NO: 538738

SEQ ID NO: 538773 - RNA, 64 nt, Human Herpes Virus 4 (Epstein Barr virus); identical to SEQ ID NO: 538738

SEQ ID NO: 538774 - RNA, 64 nt, Human Herpes Virus 4 (Epstein Barr virus); identical to SEQ ID NO: 538738

SEQ ID NO: 538775 - RNA, 64 nt, Human Herpes Virus 4 (Epstein Barr virus); identical to SEQ ID NO: 538738

SEQ ID NO: 538776 - RNA, 64 nt, Human Herpes Virus 4 (Epstein Barr virus); identical to SEQ ID NO: 538738

SEQ ID NO: 538777 - RNA, 64 nt, Human Herpes Virus 4 (Epstein Barr virus); identical to SEQ ID NO: 538749

SEQ ID NO: 538778 - RNA, 64 nt, Human Herpes Virus 4 (Epstein Barr virus); identical to SEQ ID NO: 538750

SEQ ID NO: 538779 - RNA, 64 nt, Human Herpes Virus 4 (Epstein Barr virus); identical to SEQ ID NO: 538750

SEQ ID NO: 538780 - RNA, 64 nt, Human Herpes Virus 4 (Epstein Barr virus); identical to SEQ ID NO: 538750

SEQ ID NO: 538781 - RNA, 64 nt, Human Herpes Virus 4 (Epstein Barr virus); identical to SEQ ID NO: 538750

SEQ ID NO: 538782 - RNA, 64 nt, Human Herpes Virus 4 (Epstein Barr virus); identical to SEQ ID NO: 538750

SEQ ID NO: 538783 - RNA, 64 nt, Human Herpes Virus 4 (Epstein Barr virus); identical to SEQ ID NO: 538750

SEQ ID NO: 538784 - RNA, 64 nt, Human Herpes Virus 4 (Epstein Barr virus); identical to SEQ ID NO: 538750

SEQ ID NO: 538785 - RNA, 64 nt, Human Herpes Virus 4 (Epstein Barr virus); identical to SEQ ID NO: 538750

SEQ ID NO: 538786 - RNA, 64 nt, Human Herpes Virus 4 (Epstein Barr virus); identical to SEQ ID NO: 538750

SEQ ID NO: 538787 - RNA, 64 nt, Human Herpes Virus 4 (Epstein Barr virus); identical to SEQ ID NO: 538750

SEQ ID NO: 538788 - RNA, 64 nt, Human Herpes Virus 4 (Epstein Barr virus); identical to SEQ ID NO: 538750

SEQ ID NO: 538789 - RNA, 64 nt, Human Herpes Virus 4 (Epstein Barr virus); identical to SEQ ID NO: 538750

SEQ ID NO: 538790 - RNA, 64 nt, Human Herpes Virus 4 (Epstein Barr virus); identical to SEQ ID NO: 538762

SEQ ID NO: 538791 - RNA, 64 nt, Human Herpes Virus 4 (Epstein Barr virus); identical to SEQ ID NO: 538763

SEQ ID NO: 538792 - RNA, 64 nt, Human Herpes Virus 4 (Epstein Barr virus); identical to SEQ ID NO: 538764

SEQ ID NO: 538793 - RNA, 64 nt, Human Herpes Virus 4 (Epstein Barr virus); identical to SEQ ID NO: 538765

SEQ ID NO: 538794 - RNA, 64 nt, Human Herpes Virus 4 (Epstein Barr virus)
cggcccgcgggagcacccccgccgccguucugaggcgucggaggcgggaugcggggaacgccac

SEQ ID NO: 538795 - RNA, 64 nt, Human Herpes Virus 4 (Epstein Barr virus)
ggaaaggccaauucuaccaccgguggaaagcacaccacaggacauggagcccggacaaguacag

SEQ ID NO: 538796 - RNA, 64 nt, Human Herpes Virus 4 (Epstein Barr virus)
aaccggccccugccugccucuuuggcucccacccccacaggaccuguccaugaaccggucggau

SEQ ID NO: 538797 - RNA, 64 nt, Human Herpes Virus 4 (Epstein Barr virus)
gucccacuccuccaacccggucuucuacgucuacccacaggaguggaagccgggccagacccuc

SEQ ID NO: 538798 - RNA, 64 nt, Human Herpes Virus 4 (Epstein Barr virus)
gccucaggacccugacaacacugaugacaauggcccacaggacccugacaacacugaugacaau

SEQ ID NO: 538799 - RNA, 64 nt, Human Herpes Virus 4 (Epstein Barr virus)
cccacaggacccugacaacacugaugacaauggcccacaggacccugacaacacugaugacaau

SEQ ID NO: 538800 - RNA, 64 nt, Human Herpes Virus 4 (Epstein Barr virus)
ccuaggcgcaccuggaggugguccugacaauggcccacaggacccugacaacacugaugacaau

SEQ ID NO: 538801 - RNA, 64 nt, Human Herpes Virus 4 (Epstein Barr virus); identical to SEQ ID NO: 536176

SEQ ID NO: 538802 - RNA, 64 nt, Human Herpes Virus 4 (Epstein Barr virus); identical to SEQ ID NO: 536177

SEQ ID NO: 538803 - RNA, 64 nt, Human Herpes Virus 4 (Epstein Barr virus); identical to SEQ ID NO: 536178

SEQ ID NO: 538804 - RNA, 64 nt, Human Herpes Virus 4 (Epstein Barr virus); identical to SEQ ID NO: 536178

SEQ ID NO: 538805 - RNA, 64 nt, Human Herpes Virus 4 (Epstein Barr virus); identical to SEQ ID NO: 536178

SEQ ID NO: 538806 - RNA, 64 nt, Human Herpes Virus 4 (Epstein Barr virus); identical to SEQ ID NO: 536181

SEQ ID NO: 538807 - RNA, 64 nt, Human Herpes Virus 4 (Epstein Barr virus); identical to SEQ ID NO: 536182

SEQ ID NO: 538808 - RNA, 64 nt, Human Herpes Virus 4 (Epstein Barr virus); identical to SEQ ID NO: 536183

SEQ ID NO: 538809 - RNA, 64 nt, Human Herpes Virus 4 (Epstein Barr virus); identical to SEQ ID NO: 536184

SEQ ID NO: 538810 - RNA, 64 nt, Human Herpes Virus 4 (Epstein Barr virus); identical to SEQ ID NO: 536185

SEQ ID NO: 538811 - RNA, 64 nt, Human Herpes Virus 4 (Epstein Barr virus); identical to SEQ ID NO: 536186

SEQ ID NO: 538812 - RNA, 64 nt, Human Herpes Virus 2
gccaacggcauacgcccgcgccucgcccccucccuggcgccagagggcgucuacacccacgucg

SEQ ID NO: 538813 - RNA, 64 nt, Human Herpes Virus 2
acgaugacgccgccaugcccgcgggcgucgggcuuggcgccacccccgccgccgacaccaccgc

SEQ ID NO: 538814 - RNA, 64 nt, Human Herpes Virus 2
ucuguucgacggccucugcugcgaccuggagagcuggcgccaguuggcgugucuguuucagccc

SEQ ID NO: 538815 - RNA, 64 nt, Human Herpes Virus 1
ccuggcgauccaauacgaacaggggcuuggccugcuggcgcagcaggcacgcauuggcuugggc

SEQ ID NO: 538816 - RNA, 64 nt, Human Herpes Virus 1
gcugaugggggcggugacgucucugcagcaggaacuggcgcacaugcgggcucggaccagcgcc

SEQ ID NO: 538817 - RNA, 64 nt, Human Herpes Virus 1
gcgagcggacgacgucgccgcgcuacaggacgcccuggcgcacgggaccccgcuacaaccggac

SEQ ID NO: 538818 - RNA, 64 nt, Human Herpes Virus 1
uucugggggccccgacgcacccccccaacgggggcuggcgcaaccacgcccauaucugcuacgc

SEQ ID NO: 538819 - RNA, 64 nt, Human Herpes Virus 1
cuacgccauggcggccggccgcuucggcuggggccuggcgcacgcggcggccgccguggccaug

SEQ ID NO: 538820 - RNA, 64 nt, Human Herpes Virus 1
agccgccaaggugcaguacuccaacuacucguuccuggcgcagucugccacccgggcccucauc

SEQ ID NO: 538821 - RNA, 64 nt, Human Herpes Virus 1
gccguccgccgcgcccucgaagccggcccugcgucuggcgcaucuguucuguauucgcguucuc

SEQ ID NO: 538822 - RNA, 64 nt, Human Herpes Virus 1; identical to SEQ ID NO: 538819

SEQ ID NO: 538823 - RNA, 64 nt, Human Hepatitis C Virus
ccaugcccccccuggagggggagccuggggauccggaucucagcgacgggucauggucgacggu

SEQ ID NO: 538824 - RNA, 64 nt, Human Herpes Virus 4 (Epstein Barr virus)
guggacgggggcucccgggcccacgaagagagcaacgucauagauguggugccuggcaaccugg

SEQ ID NO: 538825 - RNA, 64 nt, Human Herpes Virus 2; identical to SEQ ID NO: 535901

SEQ ID NO: 538826 - RNA, 64 nt, Human Herpes Virus 2; identical to SEQ ID NO: 535902

SEQ ID NO: 538827 - RNA, 64 nt, Human Herpes Virus 2; identical to SEQ ID NO: 535903

SEQ ID NO: 538828 - RNA, 64 nt, Human Herpes Virus 2; identical to SEQ ID NO: 535904

SEQ ID NO: 538829 - RNA, 64 nt, Human Herpes Virus 2; identical to SEQ ID NO: 535905

SEQ ID NO: 538830 - RNA, 64 nt, Human Herpes Virus 2; identical to SEQ ID NO: 535906

SEQ ID NO: 538831 - RNA, 64 nt, Human Herpes Virus 2; identical to SEQ ID NO: 535907

SEQ ID NO: 538832 - RNA, 64 nt, Human Herpes Virus 2; identical to SEQ ID NO: 535908

SEQ ID NO: 538833 - RNA, 64 nt, Human Herpes Virus 2; identical to SEQ ID NO: 535909

SEQ ID NO: 538834 - RNA, 64 nt, Human Herpes Virus 2; identical to SEQ ID NO: 535910

SEQ ID NO: 538835 - RNA, 64 nt, Human Herpes Virus 2; identical to SEQ ID NO: 535911

SEQ ID NO: 538836 - RNA, 64 nt, Human Herpes Virus 2; identical to SEQ ID NO: 535912

SEQ ID NO: 538837 - RNA, 64 nt, Human Herpes Virus 2; identical to SEQ ID NO: 535913

SEQ ID NO: 538838 - RNA, 64 nt, Human Herpes Virus 2; identical to SEQ ID NO: 535914

SEQ ID NO: 538839 - RNA, 64 nt, Human Herpes Virus 2; identical to SEQ ID NO: 535915

SEQ ID NO: 538840 - RNA, 64 nt, Human Herpes Virus 2; identical to SEQ ID NO: 535916

SEQ ID NO: 538841 - RNA, 64 nt, Human Herpes Virus 2; identical to SEQ ID NO: 535917

SEQ ID NO: 538842 - RNA, 64 nt, Human Herpes Virus 2; identical to SEQ ID NO: 535918

SEQ ID NO: 538843 - RNA, 64 nt, Human Herpes Virus 2; identical to SEQ ID NO: 535919

SEQ ID NO: 538844 - RNA, 64 nt, Human Herpes Virus 2; identical to SEQ ID NO: 535920

SEQ ID NO: 538845 - RNA, 64 nt, Human Herpes Virus 2; identical to SEQ ID NO: 535921

SEQ ID NO: 538846 - RNA, 64 nt, Human Herpes Virus 2; identical to SEQ ID NO: 535922

SEQ ID NO: 538847 - RNA, 64 nt, Human Herpes Virus 2; identical to SEQ ID NO: 535923

SEQ ID NO: 538848 - RNA, 64 nt, Human Herpes Virus 2; identical to SEQ ID NO: 535924

SEQ ID NO: 538849 - RNA, 64 nt, Human Herpes Virus 2
gcgggggacagcuggugggggcgcacgacgcgcucggcggcacaggccuccgucagggccgugg

SEQ ID NO: 538850 - RNA, 64 nt, Human Herpes Virus 2
gcugcgugaccgcuggagccuuguggccgagcggcggcggcaggccgggaucgccggacacacg

SEQ ID NO: 538851 - RNA, 64 nt, Human Herpes Virus 2
gcauccguggagucgucgccacuccccgccgcggcggcggcaacgcccggggccgggcacacga

SEQ ID NO: 538852 - RNA, 64 nt, Human Herpes Virus 2
ugcugaugcgccugcgcggggaccugcgcguggccggcggcagcgaggccgccguggccgccgu

SEQ ID NO: 538853 - RNA, 64 nt, Human Herpes Virus 2
cacccggguguucgcguucgcggaggagcugcggcggcggcacgcgacggccggcguggccgag

SEQ ID NO: 538854 - RNA, 64 nt, Human Herpes Virus 2
agcagacggccagcucggugaaguuugcggucugcggcggcaccggggcugcguucugggggcu

SEQ ID NO: 538855 - RNA, 64 nt, Human Herpes Virus 2
gcuaaaacucaacgcgcuccaggugcgcgugcugcggcggcaccugcggccggggcuggaggcu

SEQ ID NO: 538856 - RNA, 64 nt, Human Herpes Virus 2
cggcgggccggacgccgcccgguuuccgccgcagcggcggcaguucgagacgugggccgucggc

SEQ ID NO: 538857 - RNA, 64 nt, Human Herpes Virus 2
cccgcgcccacccacguccagccgccccgggcgccggcggcaggcgaggccccccggggggccu

SEQ ID NO: 538858 - RNA, 64 nt, Human Herpes Virus 2
gccuggcccaccugugggagaccggcaagcgcagcggcggcacguacgggaucguggacgccau

SEQ ID NO: 538859 - RNA, 64 nt, Human Herpes Virus 2; identical to SEQ ID NO: 538852

SEQ ID NO: 538860 - RNA, 64 nt, Human Herpes Virus 4 (Epstein Barr virus)
ggcccgccuccaggcgcccuccuggucuccgcuccccucugagccccguuaaacccaaagaaug

SEQ ID NO: 538861 - RNA, 64 nt, Human Herpes Virus 4 (Epstein Barr virus); identical to SEQ ID NO: 538860

SEQ ID NO: 538862 - RNA, 64 nt, Human Herpes Virus 4 (Epstein Barr virus); identical to SEQ ID NO: 538860

SEQ ID NO: 538863 - RNA, 64 nt, Human Herpes Virus 4 (Epstein Barr virus); identical to SEQ ID NO: 538860

SEQ ID NO: 538864 - RNA, 64 nt, Human Herpes Virus 4 (Epstein Barr virus); identical to SEQ ID NO: 538860

SEQ ID NO: 538865 - RNA, 64 nt, Human Herpes Virus 4 (Epstein Barr virus); identical to SEQ ID NO: 538860

SEQ ID NO: 538866 - RNA, 64 nt, Human Herpes Virus 4 (Epstein Barr virus); identical to SEQ ID NO: 538860

SEQ ID NO: 538867 - RNA, 64 nt, Human Herpes Virus 4 (Epstein Barr virus); identical to SEQ ID NO: 538860

SEQ ID NO: 538868 - RNA, 64 nt, Human Herpes Virus 4 (Epstein Barr virus)
ggacaugugcauggccugggcccgcuuuugcgaccccucugauauuaaggugguuauuuugggc

SEQ ID NO: 538869 - RNA, 64 nt, Human Herpes Virus 4 (Epstein Barr virus)
cccaguaugcagucucaaucucucccacggaccccccucugaugguggccggcagccuggcuca

SEQ ID NO: 538870 - RNA, 64 nt, Human Herpes Virus 4 (Epstein Barr virus)
uucaccuggauccccucaccgucaagagccagcucccucugaagaagcccuugccacucacggu

SEQ ID NO: 538871 - RNA, 64 nt, Human Herpes Virus 4 (Epstein Barr virus)
ugcaaugcucugcuggccacugaggguccggccgcccucugagcugcucucuuuugcuccuggu

SEQ ID NO: 538872 - RNA, 64 nt, Human Herpes Virus 4 (Epstein Barr virus)
aggaccauggaugugaaugcucgaacccaaaaaucccucugaccggcccuccgcauccuaggca

SEQ ID NO: 538873 - RNA, 64 nt, Human Herpes Virus 4 (Epstein Barr virus)
caauucuucagccugccuauuuucaauuugccuaagguggcaauuuaagaugugguuaauuaac

SEQ ID NO: 538874 - RNA, 64 nt, Human Herpes Virus 4 (Epstein Barr virus)
uccagcugcccccucacgaggaguggcguaacagagguggcacagaucgcgggcagaacuccaa

SEQ ID NO: 538875 - RNA, 64 nt, Human Herpes Virus 4 (Epstein Barr virus)
auggaucugcuaaaccauuucgugauccacguggagguggcagagauugccaagaucgcucaca

SEQ ID NO: 538876 - RNA, 64 nt, Human Herpes Virus 1
gcgugacccggcucgucccgcagaaggucuccgguaauaucaccgcagucgugcggaugcucca

SEQ ID NO: 538877 - RNA, 64 nt, Human Herpes Virus 4 (Epstein Barr virus)
accucagcuguucccagucuccgacauaacccagaaucaacagacuaaccaagccgggggagaa

SEQ ID NO: 538878 - RNA, 64 nt, Human Herpes Virus 4 (Epstein Barr virus)
uuguggagagcuccucccuccccaccuuugagagaaucaacaagacauuuaacgggaauaucgu

SEQ ID NO: 538879 - RNA, 59 nt, Human immunodeficiency virus type 1 (HIV1084i)
auggggaaagacuccuaaauuuagacuacccauccaaaaagacacaugggaggcauggu

SEQ ID NO: 538880 - RNA, 59 nt, Human immunodeficiency virus type 1 (HIV1084i); identical to SEQ ID NO: 538879

SEQ ID NO: 538881 - RNA, 63 nt, Human Herpes Virus 4 (Epstein Barr virus)
agauagcugauacccaauguuaucuuuugcggcagaaauugaaagugcuggccauaucuacaa

SEQ ID NO: 538882 - RNA, 64 nt, Human Herpes Virus 4 (Epstein Barr virus)
uccuauaauuguugaggaugacgacgaaagugaggaaauugaagcugaaagcgacgaggaggaa

SEQ ID NO: 538883 - RNA, 64 nt, Human Herpes Virus 4 (Epstein Barr virus)
ccgucccuggccacgaaggacuaaguuaccugcagaaauugaaguaagaugcuggcugaaauuc

SEQ ID NO: 538884 - RNA, 60 nt, Human Herpes Virus 4 (Epstein Barr virus)
augacccggcccccacuuuuaaauucuguugcagcagauagcugauacccaauguuaucu

SEQ ID NO: 538885 - RNA, 58 nt, Human Herpes Virus 4 (Epstein Barr virus)
ugcaucagcaucgcuuaaguaugagugggcagcagagaggcucgguuauuuugguucc

SEQ ID NO: 538886 - RNA, 64 nt, Human Herpes Virus 4 (Epstein Barr virus)
cucacauccccugcaggcgggugcuggacgaugggcagcagauccgcguguucuccugccuccu

SEQ ID NO: 538887 - RNA, 64 nt, Human Herpes Virus 1
ccgccccggagcgaguacccgccggccugagggccgcccccagcgcgaggugaggggccgggcg

SEQ ID NO: 538888 - RNA, 64 nt, Human Herpes Virus 1
cgccgugggacccccugacucauacacagagacacgcccccacaacaaacacacaaggaccggg

SEQ ID NO: 538889 - RNA, 64 nt, Human Herpes Virus 1
gcuccagacccgccagcaccgcaucugcgucagccgcccccauggcgcccccgcugacggccug

SEQ ID NO: 538890 - RNA, 64 nt, Human Herpes Virus 1
uaugccccagcugccugcccgccaggcccgccaccgcccccauguccuuccacccagacgcgcg

SEQ ID NO: 538891 - RNA, 64 nt, Human Herpes Virus 1
agcgcgccggggugcacgacggucaccucaagcgcgcccccaagguguacugcgggggggacga

SEQ ID NO: 538892 - RNA, 64 nt, Human Herpes Virus 1
ugagcguagcaaacgccccgcccacacaacgcuccgcccccaaccccuuccccgcugucacucg

SEQ ID NO: 538893 - RNA, 64 nt, Human Herpes Virus 1
caccaugaucaucgacggagacguggugcgcgggcgcccccaggacccgggggccgcggcaucc

SEQ ID NO: 538894 - RNA, 64 nt, Human Herpes Virus 1
ccgccccacccgggggacuccugguguacgacagcgcccccaaccuaacggacccccacgugcu

SEQ ID NO: 538895 - RNA, 64 nt, Human Herpes Virus 1
gccagucccggggaggacacggcgggcggcacgccgcccccacagaccugcggaauugucaagc

SEQ ID NO: 538896 - RNA, 64 nt, Human Herpes Virus 1
gugcaagaugugcauccaccacaaccugccgcugcgcccccaggaccccauuaucgggacgacc

SEQ ID NO: 538897 - RNA, 64 nt, Human Herpes Virus 1
cccacccacccgcacgucggggccccuccccacgcgcccccaacccacggcgcccugcgguuag

SEQ ID NO: 538898 - RNA, 64 nt, Human Herpes Virus 1
gacaccauuuacaucacugcaaccauuuacgggucgcccccagaggagacgccaggcgcggcac

SEQ ID NO: 538899 - RNA, 64 nt, Human Herpes Virus 1
ccugaccgaggccugcgccgcagaacgcgucgugcgcccccaccagcugucucccgcugggcag

SEQ ID NO: 538900 - RNA, 64 nt, Human Herpes Virus 1
accugcucggccggcccccgaacgcgagccugcccgcccccaccacggucgagccgaccgccca

SEQ ID NO: 538901 - RNA, 64 nt, Human Herpes Virus 1
uuuucucgauccucuacucgguccuccagcaccucgcccccaggcuaccugacggggggcacga

SEQ ID NO: 538902 - RNA, 64 nt, Human Herpes Virus 1
ugacggucgcgcucucggagggggcggcuaucugcgcccccagccuaacggccggccagacggc

SEQ ID NO: 538903 - RNA, 64 nt, Human Herpes Virus 1
uucggggccgcggccgacaccuggaucggccguucgcccccagccaccgagccccuggcgcggc

SEQ ID NO: 538904 - RNA, 64 nt, Human Herpes Virus 1
gucggaccaccgccccccuguuccccacgaugaccgcccccagcugggcccggauggaguugag

SEQ ID NO: 538905 - RNA, 64 nt, Human Herpes Virus 1
aggaggcccuggcggucguuaacgcgcuacuucccgcccccaucacgcucgaugacgcccuggg

SEQ ID NO: 538906 - RNA, 64 nt, Human Herpes Virus 1; identical to SEQ ID NO: 538888

SEQ ID NO: 538907 - RNA, 64 nt, Human Herpes Virus 1; identical to SEQ ID NO: 538887

SEQ ID NO: 538908 - RNA, 64 nt, Human Herpes Virus 1
cccugcugcgcucucccgggcugcugcccgaaaucgcccccaacgcauccuuggguguggcaca

SEQ ID NO: 538909 - RNA, 64 nt, Human Herpes Virus 2
uccuggagcuaaagacaugcaaaucgauuucuuccggggacacggccagcaaacgcgaacagcg

SEQ ID NO: 538910 - RNA, 64 nt, Human Herpes Virus 2
gcgcccccgguccguacuccaugcgcaucaucuacggggacacggacuccauuuucguuuugug

SEQ ID NO: 538911 - RNA, 58 nt, Human Herpes Virus 2
cgucgggccccgggugcgggaugugucgcggggacagccccggggucgcgggcgggag

SEQ ID NO: 538912 - RNA, 64 nt, Human Herpes Virus 2
cggcggugguggcgggccucgggacaaccgccgccggggacagcuuuuccaaggccuguccccg

SEQ ID NO: 538913 - RNA, 64 nt, Human Herpes Virus 2
agguugcuucuucuuuuuguucuuucuggucuuccggggacacgcggcgggucggguguccccg

SEQ ID NO: 538914 - RNA, 64 nt, Human Herpes Virus 2
ccccguccuccccccgagacccgacccccgcccccggggacacagggacgcccgcgcccgcgag

SEQ ID NO: 538915 - RNA, 64 nt, Human Herpes Virus 2
cgcuggucgccuggcuggcgcacgcgggccaacucggggacauccuggcccuggccccggcggu

SEQ ID NO: 538916 - RNA, 64 nt, Human Herpes Virus 2
ggccgacgcaacgcgccgcccccggggccgcccgcggggacaccgaggcauccgacgacgaacc

SEQ ID NO: 538917 - RNA, 64 nt, Human Herpes Virus 2
guuugggugcggacccccgguccugaccacgucccggggacagggugguugguguaauuaauaa

SEQ ID NO: 538918 - RNA, 64 nt, Human Herpes Virus 2
cggagaccacgggauccgggggucggcgaagcgccgccgacacgagguggagcagccggaguac

SEQ ID NO: 538919 - RNA, 64 nt, Human Herpes Virus 2
ccgccccgcaguuucaccgccccagcaccauuaccgccgacaacguccgggcgcucggcaugcg

SEQ ID NO: 538920 - RNA, 64 nt, Human Herpes Virus 2
cgcccagcgaaccggacuccgucguguguuccugcgccgacaagaucgggcugcgcgugugccu

SEQ ID NO: 538921 - RNA, 64 nt, Human Herpes Virus 2
cauggccagccugucgccgcgacccccggcgccccgccgacaccaccaccaccaccaccaccgc

SEQ ID NO: 538922 - RNA, 64 nt, Human Herpes Virus 2
gccgggacgccgccggcgcaucggcaaccagggccgccgacaccagcgaccgcucuccggggga

SEQ ID NO: 538923 - RNA, 64 nt, Human Herpes Virus 2
cgcagccguccguggccgugccccgccugacgcacgccgacacgcgcgggcggccggucgacgg

SEQ ID NO: 538924 - RNA, 64 nt, Human Herpes Virus 2
gguaucgcgucuuuguccugggggccccgacgcccgccgacaacggcucggcgcuggacgcccu

SEQ ID NO: 538925 - RNA, 64 nt, Human Herpes Virus 2
gcgaucgcgcccgccacuccaccauggacgccuucgccgacaaccugaacgcgcuggcgcagcg

SEQ ID NO: 538926 - RNA, 64 nt, Human Herpes Virus 2
cguucgacgaaaaccacgagggcgcggcccuccccgccgacauuacguucacggccuucgaggc

SEQ ID NO: 538927 - RNA, 64 nt, Human Herpes Virus 2
cgccgcgcgcguuacggccaaacagcgggucccucgccgacaccuccucggcgcgcccgucgug

SEQ ID NO: 538928 - RNA, 64 nt, Human Herpes Virus 2
ucccccgaggccacgcgcaugccgccgaaaccuacgccgacauggagggccauggaggcggcca

SEQ ID NO: 538929 - RNA, 64 nt, Human Herpes Virus 2
ugcccgcgggcgucgggcuuggcgccacccccgccgccgacaccaccgccgccgccgccuggcc

SEQ ID NO: 538930 - RNA, 64 nt, Human Herpes Virus 2
ggaacgaggaccuguucucuggguucccgaccaacgccgacauguaccgggagugcaaguuucu

SEQ ID NO: 538931 - RNA, 64 nt, Human Herpes Virus 2; identical to SEQ ID NO: 538921

SEQ ID NO: 538932 - RNA, 64 nt, Human Herpes Virus 4 (Epstein Barr virus)
cgcuuccagucccacaaacgcggcggcggcuucccugacugaagcccaggaccaguucuacucc

SEQ ID NO: 538933 - RNA, 64 nt, Human Herpes Virus 4 (Epstein Barr virus)
cacagacaccauguggggcauggguaggcugguccugacugauuaugggacugcuucccuccac

SEQ ID NO: 538934 - RNA, 64 nt, Human Herpes Virus 4 (Epstein Barr virus)
acgucaguuccccgugacgugggcccuggccagccugacugacuuccugaaaucuuuguaaaug

SEQ ID NO: 538935 - RNA, 64 nt, Human Herpes Virus 4 (Epstein Barr virus)
caucgucuccagcggcuaccugucggcccugcgcuacuaugacaccuaucuguauguggggcgc

SEQ ID NO: 538936 - RNA, 64 nt, Human Herpes Virus 4 (Epstein Barr virus)
ugaugacgacccccacggcccaguucagcuaagcuacuaugacuaaccuuucuuuacuucuagg

SEQ ID NO: 538937 - RNA, 63 nt, Human Herpes Virus 4 (Epstein Barr virus)
ugaugacgacccccacggcccaguucagcuaagcuacuaugacuaaccuuucuuuacuucuag

SEQ ID NO: 538938 - RNA, 62 nt, Human Herpes Virus 1
cccccccgaggucuuggcccagcgcccccgaagucucacaugugcguggggugaccgugcgu

SEQ ID NO: 538939 - RNA, 62 nt, Human Herpes Virus 1
uuuuucgugccgucgggcccggggucgacgcggucucacagcuugacggccgcggcucugca

SEQ ID NO: 538940 - RNA, 64 nt, Human Hepatitis C Virus (HCV-N)
gccacgcgucaggucaccgcauggccugggacaugaugaugaacuggucaccuacaacagcccu

SEQ ID NO: 538941 - RNA, 64 nt, Human Herpes Virus 1
gagccaggaccaggacgcggggcacaugcgcugcgaggugcacagcaaacagcagcuggucgug

SEQ ID NO: 538942 - RNA, 64 nt, Human Herpes Virus 1
gggaggcucggacaagguaaccauaggcggggcggaggugcaccgcauacccguguacccguug

SEQ ID NO: 538943 - RNA, 62 nt, Human Herpes Virus 4 (Epstein Barr virus)
agucccauaauagcccagaggcucccauucucuuccccgaugauugguauccuccaucuaua

SEQ ID NO: 538944 - RNA, 62 nt, Human Herpes Virus 4 (Epstein Barr virus)
cgggggcgggaguggaggcucaccccauccccuuccccgacuggccucgugcaaccaggccc

SEQ ID NO: 538945 - RNA, 62 nt, Human Herpes Virus 4 (Epstein Barr virus)
uaccgagggaaagcuccaagccgggggacuucuuccccgaagggcuagaucccucugccuac

SEQ ID NO: 538946 - RNA, 64 nt, Human Herpes Virus 4 (Epstein Barr virus)
ggccugcaaguuugugcagacacgcugccggcgcgugcucgaccuggugcuggcggaugcccgg

SEQ ID NO: 538947 - RNA, 64 nt, Human Herpes Virus 2
cuggcugcuggugccccaggcggacgacagcgacgacgcggacuacgccggcaacgacgacgca

SEQ ID NO: 538948 - RNA, 64 nt, Human Herpes Virus 2
agacccgccgauuuugguguuuacgaacgaguuugacgcggacgcccccccaagcaagcggggg

SEQ ID NO: 538949 - RNA, 64 nt, Human Herpes Virus 2
uauccguccguccucugguaaggcgucuuccgacgacgcggacgucggcgaugaacugauugcc

SEQ ID NO: 538950 - RNA, 64 nt, Human Herpes Virus 2
guacgcccugaucacgcggcugcuguacacgccggacgcggaggcgaugggguggcuccagaac

SEQ ID NO: 538951 - RNA, 64 nt, Human Herpes Virus 2
cgacggcgacgcgcccccgcuggugcugcgcgacgacgcggacgcgggcccgcccccgcagaua

SEQ ID NO: 538952 - RNA, 64 nt, Human Herpes Virus 2
ggccacgccgccgaggcgcgagcccguggacauggacgcggagcuggaggacgacgacgacgga

SEQ ID NO: 538953 - RNA, 64 nt, Human Herpes Virus 2
gccccaaacggccuuccgcggaggcgcccugcuggacgcggagcaauacuggagacgcgucgug

SEQ ID NO: 538954 - RNA, 64 nt, Human Herpes Virus 2
ccgcuuuguccuggaugccuucgggaggcgucuggacgcggaguacuggagcguucugaccccc

SEQ ID NO: 538955 - RNA, 64 nt, Human Herpes Virus 2
ugcguucugggggcuguucaacguggaccccggggacgcggacgccgcgcacggcgcgauccag

SEQ ID NO: 538956 - RNA, 64 nt, Human Herpes Virus 2
ccaggccgucagcgggggagcccugggcgcgucggacgcggaggcggugcuggcgggccuggag

SEQ ID NO: 538957 - RNA, 64 nt, Human Herpes Virus 2
gcaucugggcgggauggacaagguaaccaucggggacgcggagguucaccgcauccccguguau

SEQ ID NO: 538958 - RNA, 64 nt, Human Herpes Virus 2
ggagcugcugucgcuacugucggcgcgcagcggcgacgcggacgucgccgucgcgccccucauc

SEQ ID NO: 538959 - RNA, 64 nt, Human Herpes Virus 2
gcucguggucagacgcaacgcagagaaaccagcggacgcggaaauuccgaccgugucggccgca

SEQ ID NO: 538960 - RNA, 64 nt, Human Herpes Virus 2
cggacguccucgaaucggcccggcgagcgccgccgacgcggacccugaccgucgugaaccggcu

SEQ ID NO: 538961 - RNA, 64 nt, Human Herpes Virus 2
cggggucuacgacgcggugcggaccugggggccggacgcggaggccgaaccggaccagauggaa

SEQ ID NO: 538962 - RNA, 64 nt, Human Herpes Virus 2
ccccauggaccuguuggucgacgaucuguuugcggacgcggacgggguuucgccaccgcccccc

SEQ ID NO: 538963 - RNA, 64 nt, Human Herpes Virus 2; identical to SEQ ID NO: 538947

SEQ ID NO: 538964 - RNA, 64 nt, Human Herpes Virus 2; identical to SEQ ID NO: 538952

SEQ ID NO: 538965 - RNA, 64 nt, Human Herpes Virus 2; identical to SEQ ID NO: 538951

SEQ ID NO: 538966 - RNA, 64 nt, Human Herpes Virus 2; identical to SEQ ID NO: 538950

SEQ ID NO: 538967 - RNA, 64 nt, Human Herpes Virus 4 (Epstein Barr virus)
agggcacacacucaagcggggucucggagcuccuaggucagaccacgaaaggucagccugcaag

SEQ ID NO: 538968 - RNA, 64 nt, Human Herpes Virus 4 (Epstein Barr virus)
gcguggacaguuugauacucaccaagauuguuccaggucagaccuacgccauuaagaacaagua

SEQ ID NO: 538969 - RNA, 63 nt, Human Herpes Virus 1
gcgggggcaucgggcaccgggauggccgccgcgacggccgacgaugaggggucggccgccacc

SEQ ID NO: 538970 - RNA, 62 nt, Human Herpes Virus 1
cgggggcaucgggcaccgggauggccgccgcgacggccgacgaugaggggucggccgccacc

SEQ ID NO: 538971 - RNA, 63 nt, Human Herpes Virus 1
gccacggcgagcucuuaugccggggugaacuccacggccgaggugcgcggggguguagccgug

SEQ ID NO: 538972 - RNA, 63 nt, Human Herpes Virus 1
acaaacgccuugcuguugggcgucuuccugugcacggccgacgccgcgguaucccugaauacc

SEQ ID NO: 538973 - RNA, 63 nt, Human Herpes Virus 1
cgucgcucggcggggacgucuaccgguacccagacggccgacguccccaccgaggcccuuggg

SEQ ID NO: 538974 - RNA, 63 nt, Human Herpes Virus 1
gcgccuccacccccgacaaccgccugccccgggacggccgaguuucuccagcccaccgcggac

SEQ ID NO: 538975 - RNA, 63 nt, Human Herpes Virus 1
uuuccggguuggcccacguucaccgugccggccacggccgagucggcacgggaccuggugcgc

SEQ ID NO: 538976 - RNA, 63 nt, Human Herpes Virus 1
guccaggccguccucggggcguuugagcgcggcacggccgaccagaugcugcacgugcugcug

SEQ ID NO: 538977 - RNA, 63 nt, Human Herpes Virus 1
uacgaggagcgcuuuuguuuuguauuggucaccacggccgaguuuccgcgggaccccggccag

SEQ ID NO: 538978 - RNA, 63 nt, Human Herpes Virus 1
agccugcggcgggcgcucgugggggaguuugagacggccgagcgccgcuuuaguuccggucaa

SEQ ID NO: 538979 - RNA, 63 nt, Human Herpes Virus 1
agccuagccggccuucgccaaccgccaacccccacggccgagacggcaaacggggcggacgac

SEQ ID NO: 538980 - RNA, 63 nt, Human Herpes Virus 1
ggagaacccgaccagauggaagccacguaucugacggccgacgacgacgacgacgacgcccgc

SEQ ID NO: 538981 - RNA, 62 nt, Human Herpes Virus 1
uucgucggcacccuggggauggucgucggcgggcugacgaucggaggcagcgcgcgcuacug

SEQ ID NO: 538982 - RNA, 64 nt, Human Herpes Virus 4 (Epstein Barr virus)
ucagaggaugaucuguuggagacugacgguuuuacugaacgagccugugaaucuugccaauaaa

SEQ ID NO: 538983 - RNA, 64 nt, Human Herpes Virus 4 (Epstein Barr virus)
uggaaaugauggaggcccuccacaauugacggaagagguugaaaacaaaggaggugaccagggc

SEQ ID NO: 538984 - RNA, 64 nt, Human Herpes Virus 2
ugaacacgaucgccgcccugaacuucaacuuuuccgccccgagcaugcucaucugccugacgac

SEQ ID NO: 538985 - RNA, 64 nt, Human Herpes Virus 2
ggaccgggacuucccguauuacccgggcgaggcccgccccgagccgcgcccggucgacucccgg

SEQ ID NO: 538986 - RNA, 64 nt, Human Herpes Virus 2
cgcuuuugcgucgucuccgcggucgagucucccccgccccgauacgccccggaggacgccgagc

SEQ ID NO: 538987 - RNA, 64 nt, Human Herpes Virus 2
caucugcgcgaccuacgcaaucccccacgacccacgccccgacacccucagugccgcguccuug

SEQ ID NO: 538988 - RNA, 64 nt, Human Herpes Virus 2
caucgacgcggcgauucccaaaggucccccggcccgccccgaggacgccggcacccccgaagcc

SEQ ID NO: 538989 - RNA, 64 nt, Human Herpes Virus 2
agugcgucaaccagcucuuucggauccugcgugccgccccgaacccgcccggcagcgccaaccg

SEQ ID NO: 538990 - RNA, 64 nt, Human Herpes Virus 2
agcaacacggacccgucaccuucccggacgcgagcgccccgacggcccggugcguaacuguggu

SEQ ID NO: 538991 - RNA, 64 nt, Human Herpes Virus 2
ggauuaccgaccccccgggaggaggcggcgccugcgccccgacggcccacaucgauuccgccaa

SEQ ID NO: 538992 - RNA, 64 nt, Human Herpes Virus 2
ggcgggggucccgcuguccgcccucgugcgcggccgccccgacgguggggcggccgcgaacuuc

SEQ ID NO: 538993 - RNA, 64 nt, Human Herpes Virus 2
cgaagcagacaucgcgauccccucggguaucucgcgccccgaugccgcggcgcugcagcggugc

SEQ ID NO: 538994 - RNA, 64 nt, Human Herpes Virus 2
uguacgccgaguuucucggcggccgcgcgcuaaccgccccgaugguccgccgagcgcuguuuua

SEQ ID NO: 538995 - RNA, 64 nt, Human Herpes Virus 2
gggccggcugacgggggucgccgcggcgaccccgcgccccgaccccgaggacggcgcggggucu

SEQ ID NO: 538996 - RNA, 64 nt, Human Herpes Virus 2
gucggucuaccggugcggggagcuugaguugcgccgccccgacugcagccgcccgaccuccgaa

SEQ ID NO: 538997 - RNA, 64 nt, Human Herpes Virus 2
ggucgcagacgcccacgagcgccuggggcccuggcgccccgaggccaugggcgacgcggugagc

SEQ ID NO: 538998 - RNA, 64 nt, Human Herpes Virus 2
ccgucgaggacgugcugcgcgagugucacuggaccgccccgagccgaucccaggcccgccgggc

SEQ ID NO: 538999 - RNA, 64 nt, Human Herpes Virus 2
gcaggaccgccgccccccuguuccccacgaugaccgccccgagcugggcccggauggaacucag

SEQ ID NO: 539000 - RNA, 64 nt, Human Herpes Virus 2
gucccugcucggggugcugugcgguuggggaacgcgccccgaggaacaacaauaugagaugauu

SEQ ID NO: 539001 - RNA, 64 nt, Human Herpes Virus 2; identical to SEQ ID NO: 538984

SEQ ID NO: 539002 - RNA, 64 nt, Human Herpes Virus 2; identical to SEQ ID NO: 538985

SEQ ID NO: 539003 - RNA, 64 nt, Human Herpes Virus 2; identical to SEQ ID NO: 538986

SEQ ID NO: 539004 - RNA, 64 nt, Human Herpes Virus 2; identical to SEQ ID NO: 538987

SEQ ID NO: 539005 - RNA, 64 nt, Human Herpes Virus 2; identical to SEQ ID NO: 538988

SEQ ID NO: 539006 - RNA, 64 nt, Human Herpes Virus 2; identical to SEQ ID NO: 538989

SEQ ID NO: 539007 - RNA, 64 nt, Human Herpes Virus 2; identical to SEQ ID NO: 538990

SEQ ID NO: 539008 - RNA, 64 nt, Human Herpes Virus 2; identical to SEQ ID NO: 538991

SEQ ID NO: 539009 - RNA, 64 nt, Human Herpes Virus 2; identical to SEQ ID NO: 538992

SEQ ID NO: 539010 - RNA, 64 nt, Human Herpes Virus 2; identical to SEQ ID NO: 538993

SEQ ID NO: 539011 - RNA, 64 nt, Human Herpes Virus 2; identical to SEQ ID NO: 538994

SEQ ID NO: 539012 - RNA, 64 nt, Human Herpes Virus 2; identical to SEQ ID NO: 538995

SEQ ID NO: 539013 - RNA, 64 nt, Human Herpes Virus 2; identical to SEQ ID NO: 538996

SEQ ID NO: 539014 - RNA, 64 nt, Human Herpes Virus 2; identical to SEQ ID NO: 538997

SEQ ID NO: 539015 - RNA, 64 nt, Human Herpes Virus 2; identical to SEQ ID NO: 538998

SEQ ID NO: 539016 - RNA, 64 nt, Human Herpes Virus 2; identical to SEQ ID NO: 538999

SEQ ID NO: 539017 - RNA, 64 nt, Human Herpes Virus 2; identical to SEQ ID NO: 539000

SEQ ID NO: 539018 - RNA, 64 nt, Human Hepatitis C Virus (HCV-N)
ccugucaccccgcggcucccggccuaguuggggccccacggacccccggcguaggucgcguaau

SEQ ID NO: 539019 - RNA, 64 nt, Human Hepatitis C Virus (HCV-N)
caucgggggggucggcaauaacaccuugaccugccccacggacugcuuccggaagcaccccgag

SEQ ID NO: 539020 - RNA, 59 nt, Human Herpes Virus 1
uccggacgggcuuuuccacuuuaucgccaccaaccaaaugcugccgcccaccgaucccc

SEQ ID NO: 539021 - RNA, 59 nt, Human Herpes Virus 1
cucuggccaaauuugcccgugccgggccgccaaccaaccaggcggaggaucgccagaug

SEQ ID NO: 539022 - RNA, 59 nt, Human Herpes Virus 1
agacccccgccgcagaggcgcggacgccgccaaccaaggacaugcggguccuggagaug

SEQ ID NO: 539023 - RNA, 59 nt, Human Herpes Virus 1
acgacaggccauucgccgcaccgugagugccaaccaacgagcaccccgaacgacgggcc

SEQ ID NO: 539024 - RNA, 59 nt, Human Herpes Virus 1
gcggcugguccacacccaguggcuccgggccaaccaagagacgucgccccuguggcccu

SEQ ID NO: 539025 - RNA, 58 nt, Human Herpes Virus 4 (Epstein Barr virus)
augucugccgcaguggcuaugccuccaugcccuccaugacggccacgcacaaccucuc

SEQ ID NO: 539026 - RNA, 58 nt, Human Herpes Virus 4 (Epstein Barr virus)
cuuccucaaggaccuaacaggggacgcugcccuccagaucgccaccugcgucguggcc

SEQ ID NO: 539027 - RNA, 58 nt, Human Herpes Virus 4 (Epstein Barr virus)
gcgccuggaaguuguacucccggaagaugcccuccaggucaaagacguuggaggcacg

SEQ ID NO: 539028 - RNA, 58 nt, Human Herpes Virus 4 (Epstein Barr virus)
uggccgggggguuggauucccucuucaugcccuccaggauucuugccauugacaucca

SEQ ID NO: 539029 - RNA, 58 nt, Human Herpes Virus 4 (Epstein Barr virus)
caacuccggcccacgccauaccugcacggcccuccagcguggucauaaccccuaccuc

SEQ ID NO: 539030 - RNA, 58 nt, Human Herpes Virus 4 (Epstein Barr virus)
uauggccuuucugcuugaugugauaucggcccuccaccccggcuacaccauuccuaug

SEQ ID NO: 539031 - RNA, 58 nt, Human Herpes Virus 4 (Epstein Barr virus)
caggguggucuucacgggggagaaugccgcccuccagaacagcuucaucaaguccacu

SEQ ID NO: 539032 - RNA, 58 nt, Human Herpes Virus 4 (Epstein Barr virus)
ccuagcgacucugcuggaaaugauggaggcccuccacaauugacggaagagguugaaa

SEQ ID NO: 539033 - RNA, 64 nt, Human Hepatitis C Virus
gagacaaccacgcucccccaggaugcugucuccaggacucaacgccggggcaggacuggcaggg

SEQ ID NO: 539034 - RNA, 64 nt, Human Herpes Virus 1
cgacgacgaugacgacgacuggccggacagccccccgcccgagccggcgccagaggcccggccc

SEQ ID NO: 539035 - RNA, 64 nt, Human Herpes Virus 1
accguuagacaccgaaagaucuugagccgcucguccgcccgaacgacgcgccacacaaagacgg

SEQ ID NO: 539036 - RNA, 64 nt, Human Herpes Virus 1
cagaccgaaaaggucacacucuggggcgcgcgacccgcccgagucagcggcccgccaguuacca

SEQ ID NO: 539037 - RNA, 64 nt, Human Herpes Virus 1
cuacaacaacuaccucggcgggcacgccaagcccccgcccgaccgcguguacgggcuguuccgc

SEQ ID NO: 539038 - RNA, 64 nt, Human Herpes Virus 1
cgcgaauaaagugggcguggcuucggccguuucuccgcccgaccgaauaaacuguaaccguguc

SEQ ID NO: 539039 - RNA, 64 nt, Human Herpes Virus 1
gcggggagcucgaguugcgccgcccggacugcagccgcccgaccuccgaaggucguuaccguua

SEQ ID NO: 539040 - RNA, 64 nt, Human Herpes Virus 1
cggccccaggucguccuccucggagauacucaccccgcccgagcucguccaggucccgaacgcg

SEQ ID NO: 539041 - RNA, 64 nt, Human Herpes Virus 1
cacacgccgcccccggagguuacgcuggcgccugccgcccgaaacggcgacgcccucccggacc

SEQ ID NO: 539042 - RNA, 64 nt, Human Herpes Virus 1; identical to SEQ ID NO: 539034

SEQ ID NO: 539043 - RNA, 64 nt, Human Herpes Virus 1
uggccgagccgcugauggacuuacccaaacccacccgcccgaucgugcgcacuagguccugucg

SEQ ID NO: 539044 - RNA, 57 nt, Human Herpes Virus 1
gggcccagccuucccguuggcugaggacgucgagaaggacaaacccaaccgucccgu

SEQ ID NO: 539045 - RNA, 57 nt, Human Herpes Virus 1
cgacuccgacuguccgcugguggccaucgucgagagcgcccccgacggcuguaucgg

SEQ ID NO: 539046 - RNA, 57 nt, Human Herpes Virus 1
gccccccaacaccgcgcuguauuacagcgucgagaacguggggcuccugccgcaccu

SEQ ID NO: 539047 - RNA, 57 nt, Human Herpes Virus 1
ccauauggagcuguguuuccugcacgacgucgagaacuuucuaaagcagcuaaacua

SEQ ID NO: 539048 - RNA, 64 nt, Human Herpes Virus 4 (Epstein Barr virus)
acaccggagucggauacugcccccagcagggccccugcuacacccacucggggccuuacggauu

SEQ ID NO: 539049 - RNA, 64 nt, Human Herpes Virus 4 (Epstein Barr virus)
acaauuuuccccaaauguugagggaccuaagagaugccuucagucguguuaaaaccuuuuucca

SEQ ID NO: 539050 - RNA, 64 nt, Human Herpes Virus 4 (Epstein Barr virus)
ggacauuuagugcuacugacgguuggaggaggucugccuucaauuaccguggcucuagccuccc

SEQ ID NO: 539051 - RNA, 64 nt, Human Herpes Virus 4 (Epstein Barr virus)
aggagcuguuucgcacugcgguggagguagagacugccuucaucgaggcucguggagagggggu

SEQ ID NO: 539052 - RNA, 64 nt, Human Herpes Virus 4 (Epstein Barr virus)
cguggagcgcccggacgccccacccaaggacgccugccuucaccuggauccccucaccgucaag

SEQ ID NO: 539053 - RNA, 64 nt, Human Herpes Virus 4 (Epstein Barr virus)
ugccuagaacauugcuaaugugcccuggguuuccugccuucaugcaaauauucuaccucccccg

SEQ ID NO: 539054 - RNA, 64 nt, Human Herpes Virus 4 (Epstein Barr virus)
acccaccggcuucaucuucugauuccaggguuggugccuucacaauacccgagccgcccucugg

SEQ ID NO: 539055 - RNA, 64 nt, Human Herpes Virus 4 (Epstein Barr virus)
cgcugcguccaucggagcucaaaauccaccuggcugccuucagauaugccaccccccagaugga

SEQ ID NO: 539056 - RNA, 64 nt, Human Herpes Virus 4 (Epstein Barr virus)
ucuggcggugcgggcacagcgggccgacacgcagggggaugaacuccugcuggcccucccucga

SEQ ID NO: 539057 - RNA, 64 nt, Human Herpes Virus 4 (Epstein Barr virus)
uucagaccuggaucugucugacagcgaccaugaaggggaugagggugggggggcuguuggaggg

SEQ ID NO: 539058 - RNA, 64 nt, Human Herpes Virus 4 (Epstein Barr virus)
ugccaucuacgaggccaucaaggaccuggaauguggggaugagcugcgccuacagaucaucaac

SEQ ID NO: 539059 - RNA, 64 nt, Human Herpes Virus 4 (Epstein Barr virus)
uucagucccuggccgaggucagcagcccuccuuuggggaugauggcccaguucauccucuacau

SEQ ID NO: 539060 - RNA, 64 nt, Human Herpes Virus 4 (Epstein Barr virus)
cuuuccagcacagguggucugccaaagcugcucgggggaugaugggcgggaccaacaaccccca

SEQ ID NO: 539061 - RNA, 64 nt, Human Herpes Virus 4 (Epstein Barr virus)
ggcccugaugcgccuggccgggucagauguugugggggaugagagcgugggucaguaugucugc

SEQ ID NO: 539062 - RNA, 62 nt, Human Herpes Virus 2
ccauggacgacgacacguacguggccaacaguuuccagcaccaguacauccccgcguacggc

SEQ ID NO: 539063 - RNA, 62 nt, Human Herpes Virus 2
uggcguggcuggccuccaccgucaaucuggaauuccagcacgccuccccccagcacgccggc

SEQ ID NO: 539064 - RNA, 64 nt, Human Herpes Virus 2
caacagcggccugauggcccccgagcuguacguguacguggacccggcguucacggccaacacg

SEQ ID NO: 539065 - RNA, 64 nt, Human Herpes Virus 2
cggccucuucgaacagaaggacauucuucacuacuacguggagcaggaaugcaucgaggucguc

SEQ ID NO: 539066 - RNA, 64 nt, Human Herpes Virus 2
cccccagcacgccggccucuaccugugcgugguguacguggacgaucauauccacgccuggggc

SEQ ID NO: 539067 - RNA, 64 nt, Human Herpes Virus 2
cggggagguguuugagagcgcccccuucagcaccuacguggacaaugucauuuuccggggcugc

SEQ ID NO: 539068 - RNA, 64 nt, Human Herpes Virus 2
cgagcgcgucauggccgagcucgaggcccugcaguacguggaccaggcggugcccacggcccug

SEQ ID NO: 539069 - RNA, 64 nt, Human Herpes Virus 2
acaaacuccaagggguccugauggcuacgccgacuacguggagccuaaaggcguguccggccgu

SEQ ID NO: 539070 - RNA, 64 nt, Human Herpes Virus 2
cagccgcggggggcgggcgcgucgcccgccccacgccaccgaauucucguaggagacgacgacg

SEQ ID NO: 539071 - RNA, 64 nt, Human Herpes Virus 2
ugcgacggccuuaugcgacacgcggcccuggaccgccaccgagacugccggauugacgcggggg

SEQ ID NO: 539072 - RNA, 64 nt, Human Herpes Virus 2
cgaccgccgggcccugaacgccgccuucagccuggccaccgaggccauugcccugcucacgggg

SEQ ID NO: 539073 - RNA, 64 nt, Human Herpes Virus 2
cacccggaccaucaugcaggagacguaccgcgcggccaccgagcgcgucauggccgagcucgag

SEQ ID NO: 539074 - RNA, 64 nt, Human Herpes Virus 2
accucguucgccagcacgaguucuucccccccccgccaccgaucgcguucgaggacgcagcgga

SEQ ID NO: 539075 - RNA, 64 nt, Human Herpes Virus 2
acaaacucggcgcgcugcuguugugggcagcgaggccaccgaggcggcccccgcuuccgacgga

SEQ ID NO: 539076 - RNA, 64 nt, Human Herpes Virus 2
cccccacaaucgccaaagccagcagcgcgcggaggccaccgagcagcgccgccgucgcgacggc

SEQ ID NO: 539077 - RNA, 64 nt, Human Herpes Virus 2; identical to SEQ ID NO: 537050

SEQ ID NO: 539078 - RNA, 64 nt, Human Herpes Virus 2; identical to SEQ ID NO: 538176

SEQ ID NO: 539079 - RNA, 64 nt, Human Herpes Virus 2; identical to SEQ ID NO: 538177

SEQ ID NO: 539080 - RNA, 64 nt, Human Herpes Virus 2; identical to SEQ ID NO: 538178

SEQ ID NO: 539081 - RNA, 64 nt, Human Herpes Virus 2; identical to SEQ ID NO: 538179

SEQ ID NO: 539082 - RNA, 64 nt, Human Herpes Virus 2; identical to SEQ ID NO: 538180

SEQ ID NO: 539083 - RNA, 64 nt, Human Herpes Virus 2; identical to SEQ ID NO: 538181

SEQ ID NO: 539084 - RNA, 64 nt, Human Herpes Virus 2; identical to SEQ ID NO: 538182

SEQ ID NO: 539085 - RNA, 64 nt, Human Herpes Virus 2; identical to SEQ ID NO: 538183

SEQ ID NO: 539086 - RNA, 64 nt, Human Herpes Virus 2; identical to SEQ ID NO: 538184

SEQ ID NO: 539087 - RNA, 64 nt, Human Herpes Virus 2; identical to SEQ ID NO: 536887

SEQ ID NO: 539088 - RNA, 64 nt, Human Herpes Virus 2; identical to SEQ ID NO: 536888

SEQ ID NO: 539089 - RNA, 64 nt, Human Herpes Virus 2; identical to SEQ ID NO: 536889

SEQ ID NO: 539090 - RNA, 64 nt, Human Herpes Virus 2; identical to SEQ ID NO: 536890

SEQ ID NO: 539091 - RNA, 64 nt, Human Herpes Virus 2; identical to SEQ ID NO: 536891

SEQ ID NO: 539092 - RNA, 64 nt, Human Herpes Virus 2; identical to SEQ ID NO: 536892

SEQ ID NO: 539093 - RNA, 64 nt, Human Herpes Virus 2; identical to SEQ ID NO: 536893

SEQ ID NO: 539094 - RNA, 64 nt, Human Herpes Virus 2; identical to SEQ ID NO: 536894

SEQ ID NO: 539095 - RNA, 64 nt, Human Herpes Virus 2; identical to SEQ ID NO: 536895

SEQ ID NO: 539096 - RNA, 64 nt, Human Herpes Virus 2; identical to SEQ ID NO: 536896

SEQ ID NO: 539097 - RNA, 64 nt, Human Herpes Virus 2; identical to SEQ ID NO: 536897

SEQ ID NO: 539098 - RNA, 64 nt, Human Herpes Virus 2; identical to SEQ ID NO: 536898

SEQ ID NO: 539099 - RNA, 64 nt, Human Herpes Virus 2; identical to SEQ ID NO: 536899

SEQ ID NO: 539100 - RNA, 64 nt, Human Herpes Virus 2; identical to SEQ ID NO: 536900

SEQ ID NO: 539101 - RNA, 64 nt, Human Herpes Virus 2; identical to SEQ ID NO: 536901

SEQ ID NO: 539102 - RNA, 64 nt, Human Herpes Virus 2; identical to SEQ ID NO: 536902

SEQ ID NO: 539103 - RNA, 64 nt, Human Herpes Virus 2; identical to SEQ ID NO: 536903

SEQ ID NO: 539104 - RNA, 64 nt, Human Herpes Virus 2; identical to SEQ ID NO: 536904

SEQ ID NO: 539105 - RNA, 64 nt, Human Herpes Virus 2; identical to SEQ ID NO: 536905

SEQ ID NO: 539106 - RNA, 64 nt, Human Herpes Virus 2; identical to SEQ ID NO: 536906

SEQ ID NO: 539107 - RNA, 64 nt, Human Herpes Virus 2; identical to SEQ ID NO: 536907

SEQ ID NO: 539108 - RNA, 64 nt, Human Herpes Virus 2; identical to SEQ ID NO: 536908

SEQ ID NO: 539109 - RNA, 64 nt, Human Herpes Virus 2; identical to SEQ ID NO: 536909

SEQ ID NO: 539110 - RNA, 64 nt, Human Herpes Virus 2; identical to SEQ ID NO: 536910

SEQ ID NO: 539111 - RNA, 64 nt, Human Herpes Virus 2; identical to SEQ ID NO: 536911

SEQ ID NO: 539112 - RNA, 64 nt, Human Herpes Virus 2; identical to SEQ ID NO: 536912

SEQ ID NO: 539113 - RNA, 64 nt, Human Herpes Virus 2; identical to SEQ ID NO: 536913

SEQ ID NO: 539114 - RNA, 64 nt, Human Herpes Virus 2; identical to SEQ ID NO: 536914

SEQ ID NO: 539115 - RNA, 64 nt, Human Herpes Virus 2; identical to SEQ ID NO: 536915

SEQ ID NO: 539116 - RNA, 64 nt, Human Herpes Virus 2; identical to SEQ ID NO: 536916

SEQ ID NO: 539117 - RNA, 64 nt, Human Herpes Virus 2; identical to SEQ ID NO: 536917

SEQ ID NO: 539118 - RNA, 64 nt, Human Herpes Virus 2; identical to SEQ ID NO: 536918

SEQ ID NO: 539119 - RNA, 64 nt, Human Herpes Virus 2; identical to SEQ ID NO: 536919

SEQ ID NO: 539120 - RNA, 64 nt, Human Herpes Virus 2; identical to SEQ ID NO: 536890

SEQ ID NO: 539121 - RNA, 64 nt, Human Herpes Virus 2; identical to SEQ ID NO: 536889

SEQ ID NO: 539122 - RNA, 64 nt, Human Herpes Virus 2; identical to SEQ ID NO: 536888

SEQ ID NO: 539123 - RNA, 64 nt, Human Herpes Virus 2; identical to SEQ ID NO: 536887

SEQ ID NO: 539124 - RNA, 64 nt, Human Herpes Virus 2; identical to SEQ ID NO: 536908

SEQ ID NO: 539125 - RNA, 62 nt, Human Herpes Virus 2
ccgaggcccgagcucgggcccgagcccgagcccgggcccacgaagacggcggacccgcggag

SEQ ID NO: 539126 - RNA, 62 nt, Human Herpes Virus 2
ccuacgaugcgcgcgacgccgccgaggcgguccgggcccacaucacgaccaacuacggcggg

SEQ ID NO: 539127 - RNA, 62 nt, Human Herpes Virus 2
agaggauaagcguggggggcggcugcggugcacgggcccauucagcugcggaaccaucaagg

SEQ ID NO: 539128 - RNA, 62 nt, Human Herpes Virus 2
ccgaaccccaacaaaccaccccccgcgcgccccgggcccauccgccccacgcucccgccagg

SEQ ID NO: 539129 - RNA, 62 nt, Human Herpes Virus 2
ugguguugcuuccggcgcccgcggaacgcacccgggcccacaaacuacugugggccgcggaa

SEQ ID NO: 539130 - RNA, 62 nt, Human Herpes Virus 2
cggccgcgaacuuccgggucgaaacccagacccgggcccacgcgaccggcgacugcaccccg

SEQ ID NO: 539131 - RNA, 62 nt, Human Herpes Virus 2
gccgaccugacggcgaagaugugucggggcugcgggcccagcagcagcgagcgcugggccgc

SEQ ID NO: 539132 - RNA, 62 nt, Human Herpes Virus 2
gcgacggcaagucccgcggcgcgcgcgagcgccgggcccagagcgcauggcgcccuggcgga

SEQ ID NO: 539133 - RNA, 62 nt, Human Herpes Virus 2
acccuccucgaaccggccacccgggccggcgucgggcccacgaugcagauggccgacaacau

SEQ ID NO: 539134 - RNA, 62 nt, Human Herpes Virus 2
acccgcuccuggagcaacugugcgccuugcaccgggcccacgggcuuccggagacggcgcuc

SEQ ID NO: 539135 - RNA, 62 nt, Human Herpes Virus 2
cccgcggagacguuugcgcgccaccuggaccgcgggcccagcggcaccacgggcucgaugca

SEQ ID NO: 539136 - RNA, 62 nt, Human Herpes Virus 2
gacccccgcuugucaauucgcgagagcuguaccgggcccaacgcgcggcccgcugugcgucg

SEQ ID NO: 539137 - RNA, 62 nt, Human Herpes Virus 2; identical to SEQ ID NO: 539125

SEQ ID NO: 539138 - RNA, 64 nt, Human Herpes Virus 2
cggcggucgcggcgccgggucgccgcgaccgccagaccgcaaaggccccccuccccgacacgug

SEQ ID NO: 539139 - RNA, 64 nt, Human Herpes Virus 2
cgagcuguacgugcgggaguacaugcgggagcaggaccgcaagccccggaaugccacgcccgcg

SEQ ID NO: 539140 - RNA, 64 nt, Human Herpes Virus 1
uugacggcauccccgccccacgccagccacuugacgcccacaacccgcgcacggaugugguuau

SEQ ID NO: 539141 - RNA, 64 nt, Human Herpes Virus 1
cggcgugucggugcuguuucagggguuuuuucaucgcccacacaacgcccccgggggcgcgauu

SEQ ID NO: 539142 - RNA, 64 nt, Human Herpes Virus 1
guggcgggcaugcgcgugagcguagcaaacgccccgcccacacaacgcuccgcccccaaccccu

SEQ ID NO: 539143 - RNA, 64 nt, Human Herpes Virus 1
accaacgccgauguauguuuggcgucgugagucccgcccacaagaugguggccccggccaccua

SEQ ID NO: 539144 - RNA, 64 nt, Human Herpes Virus 1
ccgcgagcccgacgacggcgcgcgucggaagccccgcccacaucccaucgccgagcgucccggc

SEQ ID NO: 539145 - RNA, 64 nt, Human Herpes Virus 4 (Epstein Barr virus); identical to SEQ ID NO: 538345

SEQ ID NO: 539146 - RNA, 64 nt, Human Herpes Virus 4 (Epstein Barr virus); identical to SEQ ID NO: 538345

SEQ ID NO: 539147 - RNA, 64 nt, Human Herpes Virus 4 (Epstein Barr virus); identical to SEQ ID NO: 538347

SEQ ID NO: 539148 - RNA, 64 nt, Human Herpes Virus 4 (Epstein Barr virus); identical to SEQ ID NO: 538348

SEQ ID NO: 539149 - RNA, 64 nt, Human Herpes Virus 4 (Epstein Barr virus); identical to SEQ ID NO: 538349

SEQ ID NO: 539150 - RNA, 64 nt, Human Herpes Virus 4 (Epstein Barr virus); identical to SEQ ID NO: 538350

SEQ ID NO: 539151 - RNA, 64 nt, Human Herpes Virus 4 (Epstein Barr virus); identical to SEQ ID NO: 538351

SEQ ID NO: 539152 - RNA, 64 nt, Human Herpes Virus 4 (Epstein Barr virus); identical to SEQ ID NO: 538352

SEQ ID NO: 539153 - RNA, 64 nt, Human Herpes Virus 4 (Epstein Barr virus); identical to SEQ ID NO: 538353

SEQ ID NO: 539154 - RNA, 64 nt, Human Herpes Virus 4 (Epstein Barr virus); identical to SEQ ID NO: 538354

SEQ ID NO: 539155 - RNA, 64 nt, Human Herpes Virus 4 (Epstein Barr virus); identical to SEQ ID NO: 538355

SEQ ID NO: 539156 - RNA, 64 nt, Human Herpes Virus 4 (Epstein Barr virus); identical to SEQ ID NO: 538356

SEQ ID NO: 539157 - RNA, 64 nt, Human Herpes Virus 4 (Epstein Barr virus); identical to SEQ ID NO: 538355

SEQ ID NO: 539158 - RNA, 64 nt, Human Herpes Virus 4 (Epstein Barr virus); identical to SEQ ID NO: 538356

SEQ ID NO: 539159 - RNA, 64 nt, Human Herpes Virus 4 (Epstein Barr virus); identical to SEQ ID NO: 538359

SEQ ID NO: 539160 - RNA, 64 nt, Human Herpes Virus 4 (Epstein Barr virus); identical to SEQ ID NO: 538360

SEQ ID NO: 539161 - RNA, 64 nt, Human Herpes Virus 4 (Epstein Barr virus); identical to SEQ ID NO: 538361

SEQ ID NO: 539162 - RNA, 64 nt, Human Herpes Virus 4 (Epstein Barr virus); identical to SEQ ID NO: 538362

SEQ ID NO: 539163 - RNA, 64 nt, Human Herpes Virus 4 (Epstein Barr virus); identical to SEQ ID NO: 538363

SEQ ID NO: 539164 - RNA, 64 nt, Human Herpes Virus 4 (Epstein Barr virus); identical to SEQ ID NO: 538364

SEQ ID NO: 539165 - RNA, 64 nt, Human Herpes Virus 4 (Epstein Barr virus); identical to SEQ ID NO: 538365

SEQ ID NO: 539166 - RNA, 64 nt, Human Herpes Virus 4 (Epstein Barr virus); identical to SEQ ID NO: 538345

SEQ ID NO: 539167 - RNA, 64 nt, Human Herpes Virus 4 (Epstein Barr virus); identical to SEQ ID NO: 538345

SEQ ID NO: 539168 - RNA, 64 nt, Human Herpes Virus 4 (Epstein Barr virus); identical to SEQ ID NO: 538347

SEQ ID NO: 539169 - RNA, 64 nt, Human Herpes Virus 4 (Epstein Barr virus); identical to SEQ ID NO: 538348

SEQ ID NO: 539170 - RNA, 64 nt, Human Herpes Virus 4 (Epstein Barr virus); identical to SEQ ID NO: 538349

SEQ ID NO: 539171 - RNA, 64 nt, Human Herpes Virus 4 (Epstein Barr virus); identical to SEQ ID NO: 538350

SEQ ID NO: 539172 - RNA, 64 nt, Human Herpes Virus 4 (Epstein Barr virus); identical to SEQ ID NO: 538351

SEQ ID NO: 539173 - RNA, 64 nt, Human Herpes Virus 4 (Epstein Barr virus); identical to SEQ ID NO: 538352

SEQ ID NO: 539174 - RNA, 64 nt, Human Herpes Virus 4 (Epstein Barr virus); identical to SEQ ID NO: 538353

SEQ ID NO: 539175 - RNA, 64 nt, Human Herpes Virus 4 (Epstein Barr virus); identical to SEQ ID NO: 538354

SEQ ID NO: 539176 - RNA, 64 nt, Human Herpes Virus 4 (Epstein Barr virus); identical to SEQ ID NO: 538355

SEQ ID NO: 539177 - RNA, 64 nt, Human Herpes Virus 4 (Epstein Barr virus); identical to SEQ ID NO: 538356

SEQ ID NO: 539178 - RNA, 64 nt, Human Herpes Virus 4 (Epstein Barr virus); identical to SEQ ID NO: 538355

SEQ ID NO: 539179 - RNA, 64 nt, Human Herpes Virus 4 (Epstein Barr virus); identical to SEQ ID NO: 538356

SEQ ID NO: 539180 - RNA, 64 nt, Human Herpes Virus 4 (Epstein Barr virus); identical to SEQ ID NO: 538359

SEQ ID NO: 539181 - RNA, 64 nt, Human Herpes Virus 4 (Epstein Barr virus); identical to SEQ ID NO: 538360

SEQ ID NO: 539182 - RNA, 64 nt, Human Herpes Virus 4 (Epstein Barr virus); identical to SEQ ID NO: 538361

SEQ ID NO: 539183 - RNA, 64 nt, Human Herpes Virus 4 (Epstein Barr virus); identical to SEQ ID NO: 538362

SEQ ID NO: 539184 - RNA, 64 nt, Human Herpes Virus 4 (Epstein Barr virus); identical to SEQ ID NO: 538363

SEQ ID NO: 539185 - RNA, 64 nt, Human Herpes Virus 4 (Epstein Barr virus); identical to SEQ ID NO: 538364

SEQ ID NO: 539186 - RNA, 64 nt, Human Herpes Virus 4 (Epstein Barr virus); identical to SEQ ID NO: 538365

SEQ ID NO: 539187 - RNA, 64 nt, Human Herpes Virus 4 (Epstein Barr virus); identical to SEQ ID NO: 538345

SEQ ID NO: 539188 - RNA, 64 nt, Human Herpes Virus 4 (Epstein Barr virus); identical to SEQ ID NO: 538345

SEQ ID NO: 539189 - RNA, 64 nt, Human Herpes Virus 4 (Epstein Barr virus); identical to SEQ ID NO: 538347

SEQ ID NO: 539190 - RNA, 64 nt, Human Herpes Virus 4 (Epstein Barr virus); identical to SEQ ID NO: 538348

SEQ ID NO: 539191 - RNA, 64 nt, Human Herpes Virus 4 (Epstein Barr virus); identical to SEQ ID NO: 538349

SEQ ID NO: 539192 - RNA, 64 nt, Human Herpes Virus 4 (Epstein Barr virus); identical to SEQ ID NO: 538350

SEQ ID NO: 539193 - RNA, 64 nt, Human Herpes Virus 4 (Epstein Barr virus); identical to SEQ ID NO: 538351

SEQ ID NO: 539194 - RNA, 64 nt, Human Herpes Virus 4 (Epstein Barr virus); identical to SEQ ID NO: 538352

SEQ ID NO: 539195 - RNA, 64 nt, Human Herpes Virus 4 (Epstein Barr virus); identical to SEQ ID NO: 538353

SEQ ID NO: 539196 - RNA, 64 nt, Human Herpes Virus 4 (Epstein Barr virus); identical to SEQ ID NO: 538354

SEQ ID NO: 539197 - RNA, 64 nt, Human Herpes Virus 4 (Epstein Barr virus); identical to SEQ ID NO: 538355

SEQ ID NO: 539198 - RNA, 64 nt, Human Herpes Virus 4 (Epstein Barr virus); identical to SEQ ID NO: 538356

SEQ ID NO: 539199 - RNA, 64 nt, Human Herpes Virus 4 (Epstein Barr virus); identical to SEQ ID NO: 538355

SEQ ID NO: 539200 - RNA, 64 nt, Human Herpes Virus 4 (Epstein Barr virus); identical to SEQ ID NO: 538356

SEQ ID NO: 539201 - RNA, 64 nt, Human Herpes Virus 4 (Epstein Barr virus); identical to SEQ ID NO: 538359

SEQ ID NO: 539202 - RNA, 64 nt, Human Herpes Virus 4 (Epstein Barr virus); identical to SEQ ID NO: 538360

SEQ ID NO: 539203 - RNA, 64 nt, Human Herpes Virus 4 (Epstein Barr virus); identical to SEQ ID NO: 538361

SEQ ID NO: 539204 - RNA, 64 nt, Human Herpes Virus 4 (Epstein Barr virus); identical to SEQ ID NO: 538362

SEQ ID NO: 539205 - RNA, 64 nt, Human Herpes Virus 4 (Epstein Barr virus); identical to SEQ ID NO: 538363

SEQ ID NO: 539206 - RNA, 64 nt, Human Herpes Virus 4 (Epstein Barr virus); identical to SEQ ID NO: 538364

SEQ ID NO: 539207 - RNA, 64 nt, Human Herpes Virus 4 (Epstein Barr virus); identical to SEQ ID NO: 538365

SEQ ID NO: 539208 - RNA, 64 nt, Human Herpes Virus 4 (Epstein Barr virus); identical to SEQ ID NO: 538345

SEQ ID NO: 539209 - RNA, 64 nt, Human Herpes Virus 4 (Epstein Barr virus); identical to SEQ ID NO: 538345

SEQ ID NO: 539210 - RNA, 64 nt, Human Herpes Virus 4 (Epstein Barr virus); identical to SEQ ID NO: 538347

SEQ ID NO: 539211 - RNA, 64 nt, Human Herpes Virus 4 (Epstein Barr virus); identical to SEQ ID NO: 538348

SEQ ID NO: 539212 - RNA, 64 nt, Human Herpes Virus 4 (Epstein Barr virus); identical to SEQ ID NO: 538349

SEQ ID NO: 539213 - RNA, 64 nt, Human Herpes Virus 4 (Epstein Barr virus); identical to SEQ ID NO: 538350

SEQ ID NO: 539214 - RNA, 64 nt, Human Herpes Virus 4 (Epstein Barr virus); identical to SEQ ID NO: 538351

SEQ ID NO: 539215 - RNA, 64 nt, Human Herpes Virus 4 (Epstein Barr virus); identical to SEQ ID NO: 538352

SEQ ID NO: 539216 - RNA, 64 nt, Human Herpes Virus 4 (Epstein Barr virus); identical to SEQ ID NO: 538353

SEQ ID NO: 539217 - RNA, 64 nt, Human Herpes Virus 4 (Epstein Barr virus); identical to SEQ ID NO: 538354

SEQ ID NO: 539218 - RNA, 64 nt, Human Herpes Virus 4 (Epstein Barr virus); identical to SEQ ID NO: 538355

SEQ ID NO: 539219 - RNA, 64 nt, Human Herpes Virus 4 (Epstein Barr virus); identical to SEQ ID NO: 538356

SEQ ID NO: 539220 - RNA, 64 nt, Human Herpes Virus 4 (Epstein Barr virus); identical to SEQ ID NO: 538355

SEQ ID NO: 539221 - RNA, 64 nt, Human Herpes Virus 4 (Epstein Barr virus); identical to SEQ ID NO: 538356

SEQ ID NO: 539222 - RNA, 64 nt, Human Herpes Virus 4 (Epstein Barr virus); identical to SEQ ID NO: 538359

SEQ ID NO: 539223 - RNA, 64 nt, Human Herpes Virus 4 (Epstein Barr virus); identical to SEQ ID NO: 538360

SEQ ID NO: 539224 - RNA, 64 nt, Human Herpes Virus 4 (Epstein Barr virus); identical to SEQ ID NO: 538361

SEQ ID NO: 539225 - RNA, 64 nt, Human Herpes Virus 4 (Epstein Barr virus); identical to SEQ ID NO: 538362

SEQ ID NO: 539226 - RNA, 64 nt, Human Herpes Virus 4 (Epstein Barr virus); identical to SEQ ID NO: 538363

SEQ ID NO: 539227 - RNA, 64 nt, Human Herpes Virus 4 (Epstein Barr virus); identical to SEQ ID NO: 538364

SEQ ID NO: 539228 - RNA, 64 nt, Human Herpes Virus 4 (Epstein Barr virus); identical to SEQ ID NO: 538365

SEQ ID NO: 539229 - RNA, 64 nt, Human Herpes Virus 4 (Epstein Barr virus)
cacugaauuuagccugauauugucccccuagccccgggcccagcccuccucagaaaacucugca

SEQ ID NO: 539230 - RNA, 64 nt, Human Herpes Virus 4 (Epstein Barr virus)
uaaaguccagccucccacgcccguccacggcucccgggcccagccucguccaccccuccccacg

SEQ ID NO: 539231 - RNA, 64 nt, Human Herpes Virus 4 (Epstein Barr virus)
accucucccuagcccuccgcccccuccaaggacucgggcccaguuucuaacuuuuccccuuccc

SEQ ID NO: 539232 - RNA, 64 nt, Human Herpes Virus 4 (Epstein Barr virus); identical to SEQ ID NO: 539230

SEQ ID NO: 539233 - RNA, 64 nt, Human Herpes Virus 4 (Epstein Barr virus); identical to SEQ ID NO: 539231

SEQ ID NO: 539234 - RNA, 64 nt, Human Herpes Virus 4 (Epstein Barr virus); identical to SEQ ID NO: 539230

SEQ ID NO: 539235 - RNA, 64 nt, Human Herpes Virus 4 (Epstein Barr virus); identical to SEQ ID NO: 539231

SEQ ID NO: 539236 - RNA, 64 nt, Human Herpes Virus 4 (Epstein Barr virus); identical to SEQ ID NO: 539230

SEQ ID NO: 539237 - RNA, 64 nt, Human Herpes Virus 4 (Epstein Barr virus); identical to SEQ ID NO: 539230

SEQ ID NO: 539238 - RNA, 64 nt, Human Herpes Virus 4 (Epstein Barr virus); identical to SEQ ID NO: 539230

SEQ ID NO: 539239 - RNA, 64 nt, Human Herpes Virus 4 (Epstein Barr virus); identical to SEQ ID NO: 539230

SEQ ID NO: 539240 - RNA, 64 nt, Human Herpes Virus 4 (Epstein Barr virus); identical to SEQ ID NO: 539230

SEQ ID NO: 539241 - RNA, 64 nt, Human Herpes Virus 4 (Epstein Barr virus)
cgcacaaccucucccaccagcucuugauggcguccgggcccagugaggaaccgugcgccuggcg

SEQ ID NO: 539242 - RNA, 64 nt, Human Herpes Virus 4 (Epstein Barr virus)
caaugccaggggggaccuuaacauccgagaccuccgggcccacgucaaggcccggaugaucucg

SEQ ID NO: 539243 - RNA, 64 nt, Human Herpes Virus 4 (Epstein Barr virus)
ugaccaggcuggggugccggagagagguagaaagcgggcccaugaaggcccgggggcuggcgag

SEQ ID NO: 539244 - RNA, 64 nt, Human Herpes Virus 4 (Epstein Barr virus)
cucugaccuggcccucuuuguggacgggggcucccgggcccacgaagagagcaacgucauagau

SEQ ID NO: 539245 - RNA, 64 nt, Human Herpes Virus 4 (Epstein Barr virus)
ccagcuuuucuccccccagccugaggcccagucuccugugcacugucuguaaaguccagccucc

SEQ ID NO: 539246 - RNA, 64 nt, Human Herpes Virus 4 (Epstein Barr virus); identical to SEQ ID NO: 539245

SEQ ID NO: 539247 - RNA, 64 nt, Human Herpes Virus 4 (Epstein Barr virus); identical to SEQ ID NO: 539245

SEQ ID NO: 539248 - RNA, 64 nt, Human Herpes Virus 4 (Epstein Barr virus); identical to SEQ ID NO: 539245

SEQ ID NO: 539249 - RNA, 64 nt, Human Herpes Virus 4 (Epstein Barr virus); identical to SEQ ID NO: 539245

SEQ ID NO: 539250 - RNA, 64 nt, Human Herpes Virus 4 (Epstein Barr virus); identical to SEQ ID NO: 539245

SEQ ID NO: 539251 - RNA, 64 nt, Human Herpes Virus 4 (Epstein Barr virus); identical to SEQ ID NO: 539245

SEQ ID NO: 539252 - RNA, 64 nt, Human Herpes Virus 4 (Epstein Barr virus); identical to SEQ ID NO: 539245

SEQ ID NO: 539253 - RNA, 64 nt, Human Herpes Virus 4 (Epstein Barr virus)
uuauaggcaccccugggcaccauggucucaagauccugugcaugggcacacccaggguccaugg

SEQ ID NO: 539254 - RNA, 64 nt, Human Herpes Virus 4 (Epstein Barr virus)
uacaggacaagacagucacauugcaucgcucaccccugugcagggacgaggacgagaaggagga

SEQ ID NO: 539255 - RNA, 64 nt, Human Herpes Virus 4 (Epstein Barr virus)
aaaaagaagcacaccuggaauggguguuuccaagccugugcagagcuauauccaugcacuuauu

SEQ ID NO: 539256 - RNA, 64 nt, Human Herpes Virus 4 (Epstein Barr virus)
aggaaaaguuugucaugaacgugccuuuggugucccugugcaucaacaccuacugggaacgguc

SEQ ID NO: 539257 - RNA, 64 nt, Human Herpes Virus 4 (Epstein Barr virus); identical to SEQ ID NO: 539229

SEQ ID NO: 539258 - RNA, 64 nt, Human Herpes Virus 4 (Epstein Barr virus); identical to SEQ ID NO: 539230

SEQ ID NO: 539259 - RNA, 64 nt, Human Herpes Virus 4 (Epstein Barr virus); identical to SEQ ID NO: 539231

SEQ ID NO: 539260 - RNA, 64 nt, Human Herpes Virus 4 (Epstein Barr virus); identical to SEQ ID NO: 539230

SEQ ID NO: 539261 - RNA, 64 nt, Human Herpes Virus 4 (Epstein Barr virus); identical to SEQ ID NO: 539231

SEQ ID NO: 539262 - RNA, 64 nt, Human Herpes Virus 4 (Epstein Barr virus); identical to SEQ ID NO: 539230

SEQ ID NO: 539263 - RNA, 64 nt, Human Herpes Virus 4 (Epstein Barr virus); identical to SEQ ID NO: 539231

SEQ ID NO: 539264 - RNA, 64 nt, Human Herpes Virus 4 (Epstein Barr virus); identical to SEQ ID NO: 539230

SEQ ID NO: 539265 - RNA, 64 nt, Human Herpes Virus 4 (Epstein Barr virus); identical to SEQ ID NO: 539230

SEQ ID NO: 539266 - RNA, 64 nt, Human Herpes Virus 4 (Epstein Barr virus); identical to SEQ ID NO: 539230

SEQ ID NO: 539267 - RNA, 64 nt, Human Herpes Virus 4 (Epstein Barr virus); identical to SEQ ID NO: 539230

SEQ ID NO: 539268 - RNA, 64 nt, Human Herpes Virus 4 (Epstein Barr virus); identical to SEQ ID NO: 539230

SEQ ID NO: 539269 - RNA, 64 nt, Human Herpes Virus 4 (Epstein Barr virus); identical to SEQ ID NO: 539241

SEQ ID NO: 539270 - RNA, 64 nt, Human Herpes Virus 4 (Epstein Barr virus); identical to SEQ ID NO: 539242

SEQ ID NO: 539271 - RNA, 64 nt, Human Herpes Virus 4 (Epstein Barr virus); identical to SEQ ID NO: 539243

SEQ ID NO: 539272 - RNA, 64 nt, Human Herpes Virus 4 (Epstein Barr virus); identical to SEQ ID NO: 539244

SEQ ID NO: 539273 - RNA, 64 nt, Human Herpes Virus 4 (Epstein Barr virus); identical to SEQ ID NO: 539245

SEQ ID NO: 539274 - RNA, 64 nt, Human Herpes Virus 4 (Epstein Barr virus); identical to SEQ ID NO: 539245

SEQ ID NO: 539275 - RNA, 64 nt, Human Herpes Virus 4 (Epstein Barr virus); identical to SEQ ID NO: 539245

SEQ ID NO: 539276 - RNA, 64 nt, Human Herpes Virus 4 (Epstein Barr virus); identical to SEQ ID NO: 539245

SEQ ID NO: 539277 - RNA, 64 nt, Human Herpes Virus 4 (Epstein Barr virus); identical to SEQ ID NO: 539245

SEQ ID NO: 539278 - RNA, 64 nt, Human Herpes Virus 4 (Epstein Barr virus); identical to SEQ ID NO: 539245

SEQ ID NO: 539279 - RNA, 64 nt, Human Herpes Virus 4 (Epstein Barr virus); identical to SEQ ID NO: 539245

SEQ ID NO: 539280 - RNA, 64 nt, Human Herpes Virus 4 (Epstein Barr virus); identical to SEQ ID NO: 539245

SEQ ID NO: 539281 - RNA, 64 nt, Human Herpes Virus 4 (Epstein Barr virus); identical to SEQ ID NO: 539253

SEQ ID NO: 539282 - RNA, 64 nt, Human Herpes Virus 4 (Epstein Barr virus); identical to SEQ ID NO: 539254

SEQ ID NO: 539283 - RNA, 64 nt, Human Herpes Virus 4 (Epstein Barr virus); identical to SEQ ID NO: 539255

SEQ ID NO: 539284 - RNA, 64 nt, Human Herpes Virus 4 (Epstein Barr virus); identical to SEQ ID NO: 539256

SEQ ID NO: 539285 - RNA, 64 nt, Human Herpes Virus 4 (Epstein Barr virus); identical to SEQ ID NO: 539229

SEQ ID NO: 539286 - RNA, 64 nt, Human Herpes Virus 4 (Epstein Barr virus); identical to SEQ ID NO: 539230

SEQ ID NO: 539287 - RNA, 64 nt, Human Herpes Virus 4 (Epstein Barr virus); identical to SEQ ID NO: 539231

SEQ ID NO: 539288 - RNA, 64 nt, Human Herpes Virus 4 (Epstein Barr virus); identical to SEQ ID NO: 539230

SEQ ID NO: 539289 - RNA, 64 nt, Human Herpes Virus 4 (Epstein Barr virus); identical to SEQ ID NO: 539231

SEQ ID NO: 539290 - RNA, 64 nt, Human Herpes Virus 4 (Epstein Barr virus); identical to SEQ ID NO: 539230

SEQ ID NO: 539291 - RNA, 64 nt, Human Herpes Virus 4 (Epstein Barr virus); identical to SEQ ID NO: 539231

SEQ ID NO: 539292 - RNA, 64 nt, Human Herpes Virus 4 (Epstein Barr virus); identical to SEQ ID NO: 539230

SEQ ID NO: 539293 - RNA, 64 nt, Human Herpes Virus 4 (Epstein Barr virus); identical to SEQ ID NO: 539230

SEQ ID NO: 539294 - RNA, 64 nt, Human Herpes Virus 4 (Epstein Barr virus); identical to SEQ ID NO: 539230

SEQ ID NO: 539295 - RNA, 64 nt, Human Herpes Virus 4 (Epstein Barr virus); identical to SEQ ID NO: 539230

SEQ ID NO: 539296 - RNA, 64 nt, Human Herpes Virus 4 (Epstein Barr virus); identical to SEQ ID NO: 539230

SEQ ID NO: 539297 - RNA, 64 nt, Human Herpes Virus 4 (Epstein Barr virus); identical to SEQ ID NO: 539241

SEQ ID NO: 539298 - RNA, 64 nt, Human Herpes Virus 4 (Epstein Barr virus); identical to SEQ ID NO: 539242

SEQ ID NO: 539299 - RNA, 64 nt, Human Herpes Virus 4 (Epstein Barr virus); identical to SEQ ID NO: 539243

SEQ ID NO: 539300 - RNA, 64 nt, Human Herpes Virus 4 (Epstein Barr virus); identical to SEQ ID NO: 539244

SEQ ID NO: 539301 - RNA, 64 nt, Human Herpes Virus 4 (Epstein Barr virus); identical to SEQ ID NO: 539245

SEQ ID NO: 539302 - RNA, 64 nt, Human Herpes Virus 4 (Epstein Barr virus); identical to SEQ ID NO: 539245

SEQ ID NO: 539303 - RNA, 64 nt, Human Herpes Virus 4 (Epstein Barr virus); identical to SEQ ID NO: 539245

SEQ ID NO: 539304 - RNA, 64 nt, Human Herpes Virus 4 (Epstein Barr virus); identical to SEQ ID NO: 539245

SEQ ID NO: 539305 - RNA, 64 nt, Human Herpes Virus 4 (Epstein Barr virus); identical to SEQ ID NO: 539245

SEQ ID NO: 539306 - RNA, 64 nt, Human Herpes Virus 4 (Epstein Barr virus); identical to SEQ ID NO: 539245

SEQ ID NO: 539307 - RNA, 64 nt, Human Herpes Virus 4 (Epstein Barr virus); identical to SEQ ID NO: 539245

SEQ ID NO: 539308 - RNA, 64 nt, Human Herpes Virus 4 (Epstein Barr virus); identical to SEQ ID NO: 539245

SEQ ID NO: 539309 - RNA, 64 nt, Human Herpes Virus 4 (Epstein Barr virus); identical to SEQ ID NO: 539253

SEQ ID NO: 539310 - RNA, 64 nt, Human Herpes Virus 4 (Epstein Barr virus); identical to SEQ ID NO: 539254

SEQ ID NO: 539311 - RNA, 64 nt, Human Herpes Virus 4 (Epstein Barr virus); identical to SEQ ID NO: 539255

SEQ ID NO: 539312 - RNA, 64 nt, Human Herpes Virus 4 (Epstein Barr virus); identical to SEQ ID NO: 539256

SEQ ID NO: 539313 - RNA, 64 nt, Human Herpes Virus 2
caacgacgccccucucgaaccuguuuuuacgggccccggacaucacccacgucgcccccccgua

SEQ ID NO: 539314 - RNA, 64 nt, Human Herpes Virus 2
gugcgacggccggcauccugacggugguguggaccccggacaccaucuacaucaccgcaacgau

SEQ ID NO: 539315 - RNA, 64 nt, Human Herpes Virus 2
acgucauggccgucuccacgugcgugcccgucgccccggacaacgugaucgugcagaacucgau

SEQ ID NO: 539316 - RNA, 64 nt, Human Herpes Virus 2
uagcgcgcuccaucgugacucggcauaucaccgccccggacaucgccgaccgguuucuggcgca

SEQ ID NO: 539317 - RNA, 64 nt, Human Herpes Virus 4 (Epstein Barr virus)
cuaucccccaggcaaccgccgucucaucgccucuaggaaucaccgcgcucuggccuaagaagcc

SEQ ID NO: 539318 - RNA, 64 nt, Human Herpes Virus 4 (Epstein Barr virus)
cacuaagcccccguugcucgccuugccugccucaccaugacacacuaagccccugcuaauccau

SEQ ID NO: 539319 - RNA, 64 nt, Human Herpes Virus 4 (Epstein Barr virus)
uaaugacccaggccaggcuacaaccccauuguggccaugacacucccaggcaaccgccccgccc

SEQ ID NO: 539320 - RNA, 64 nt, Human Herpes Virus 4 (Epstein Barr virus)
cucauagacacaccuaaauuuagcacgucccaaaccaugacaucacagaggaggcuggugccuu

SEQ ID NO: 539321 - RNA, 64 nt, Human Herpes Virus 4 (Epstein Barr virus)
ggccauuuggacgaacugaccacaacacuagaguccaugacagaggauuugaaucuggacuccc

SEQ ID NO: 539322 - RNA, 64 nt, Human Herpes Virus 4 (Epstein Barr virus)
cccaaccugaaggauauguuuucccgagccgucaccaugacagccgccagcuacgcucgcuacg

SEQ ID NO: 539323 - RNA, 64 nt, Human Herpes Virus 4 (Epstein Barr virus); identical to SEQ ID NO: 537373

SEQ ID NO: 539324 - RNA, 64 nt, Human Herpes Virus 4 (Epstein Barr virus); identical to SEQ ID NO: 537374

SEQ ID NO: 539325 - RNA, 64 nt, Human Herpes Virus 4 (Epstein Barr virus); identical to SEQ ID NO: 537375

SEQ ID NO: 539326 - RNA, 64 nt, Human Herpes Virus 2
agagggcgacccccgggucucaggcccccccuuuuccccggaccacccggcugcggguuggggg

SEQ ID NO: 539327 - RNA, 64 nt, Human Herpes Virus 2
agcucgucugccugcugauguaccuggagaacuguccccggagccacgccacgcccucgcuguu

SEQ ID NO: 539328 - RNA, 64 nt, Human Herpes Virus 2
ucuggucuuccggggacacgcggcgggucggguguccccggaccaauuaauccccccaacagcg

SEQ ID NO: 539329 - RNA, 64 nt, Human Herpes Virus 2
gccggccguugucggcaccccagacccccccaucuccccggaggagcagcucacggccccggga

SEQ ID NO: 539330 - RNA, 64 nt, Human Herpes Virus 2; identical to SEQ ID NO: 539326

SEQ ID NO: 539331 - RNA, 64 nt, Human Herpes Virus 2
ccggcucuccuuguuucgccccacggaccuccgggacuucgagcucgucugccugcugauguac

SEQ ID NO: 539332 - RNA, 64 nt, Human Herpes Virus 2
ggagguggauaugacgcccgccgacgcccuggacgacuucgacuuggagaugcugggggacgug

SEQ ID NO: 539333 - RNA, 64 nt, Human Herpes Virus 4 (Epstein Barr virus)
gcuaucaaaccugauacucgauaguggguuagacacacaacacaucuugugcuucgugauggca

SEQ ID NO: 539334 - RNA, 64 nt, Human Herpes Virus 4 (Epstein Barr virus)
cagccggccuuuuuaaaguagaauaccauacaggacacaacaccucacuacacaaacagacgca

SEQ ID NO: 539335 - RNA, 63 nt, Human Herpes Virus 4 (Epstein Barr virus)
guacaugguucgaugcuagaccuucuugaaaaagacgaugaagucauggagcagaggguuaug

SEQ ID NO: 539336 - RNA, 63 nt, Human Herpes Virus 4 (Epstein Barr virus)
agacaggguucggacguggagcuagaguccucggacgaugagcugccauauaucgaucccaau

SEQ ID NO: 539337 - RNA, 63 nt, Human Herpes Virus 4 (Epstein Barr virus)
ucccguaggagaaggggagcguguguuguguacgacgaugaugucauagaggugauugauguu

SEQ ID NO: 539338 - RNA, 63 nt, Human Herpes Virus 4 (Epstein Barr virus)
cucagaggcccugcacacaucgacgaagcccccgacgaugaaccuggagccagcgcgccuagu

SEQ ID NO: 539339 - RNA, 64 nt, Human Herpes Virus 2
cgggaaauucagaucagccccacccuggacgacgcagacccaacccccggaaccugaaaccuuc

SEQ ID NO: 539340 - RNA, 64 nt, Human Herpes Virus 2
ggccgagacgaugaacgucgccaccugcacacaccagacccaccacgccgcccgcgccccgggc

SEQ ID NO: 539341 - RNA, 64 nt, Human Herpes Virus 2
cgagacggcgcucaucuggcucgacguguacggccagacccacugggaccugacccccaccacc

SEQ ID NO: 539342 - RNA, 64 nt, Human Herpes Virus 1
cggcgcacaccggccacccgggccggccccgcucggccgugauccucccggcaugugcguucgu

SEQ ID NO: 539343 - RNA, 64 nt, Human Herpes Virus 1
guuucagccccccgcgccuagccacgcaucuucgggccgugacgacccacgaccccaaccccgc

SEQ ID NO: 539344 - RNA, 64 nt, Human Herpes Virus 1
gccugccccuauccgugcagcgacacguuucuccggccgugaguccggucgccccgacccccuu

SEQ ID NO: 539345 - RNA, 64 nt, Human Herpes Virus 1
guuccgguauggggggggcugccgccagguugggggccgugauuuuguuugucgucauaguggg

SEQ ID NO: 539346 - RNA, 64 nt, Human Herpes Virus 1
gcgcggcuucugcggcuggcgcgcucugcuucccggccgugaccggcgaacgacggguuuaucg

SEQ ID NO: 539347 - RNA, 64 nt, Human Herpes Virus 1
gaaccaucgagcgccugcgcgagaccaacgcgggccuggcgacccaauugcaggagcgcgaccg

SEQ ID NO: 539348 - RNA, 64 nt, Human Herpes Virus 1
ccccugugggggagguuauccacgcccacgacgcccuggcgauccaauacgaacaggggcuugg

SEQ ID NO: 539349 - RNA, 64 nt, Human Herpes Virus 1
ugacggcccuuacggaccagagcgcgacggcggaccuggcgauccagauuccaaagugccccga

SEQ ID NO: 539350 - RNA, 64 nt, Human Herpes Virus 1
ggacccugcgggucgacgugacguuccuggacauccuggcgacccccccggcccucaccgagcc

SEQ ID NO: 539351 - RNA, 64 nt, Human Herpes Virus 1
gccgagcucacggaccacccgcuguuccccguccccuggcgaccggcccucauguuugacccgc

SEQ ID NO: 539352 - RNA, 64 nt, Human Herpes Virus 1
ggcauuuccggaauaacgcccacucagcgcgccgccuggcgauauauucgcgagcugauuaucg

SEQ ID NO: 539353 - RNA, 64 nt, Human Herpes Virus 1
cccgcccagccauggcaacuucgccccccgggguccuggcgagcgucgcggugugcgaagaguc

SEQ ID NO: 539354 - RNA, 64 nt, Human Herpes Virus 1
aaguucaccgcgugcuccgcgccuguccggccguccuggcgaccguguucgcggcucaccauca

SEQ ID NO: 539355 - RNA, 64 nt, Human Herpes Virus 1
ugcugggcgcugcgguguacgcgcugcacacggcccuggcgaccgugaccuuaaaguacgcccg

SEQ ID NO: 539356 - RNA, 64 nt, Human Herpes Virus 1; identical to SEQ ID NO: 539351

SEQ ID NO: 539357 - RNA, 64 nt, Human Herpes Virus 1
ucgcgggucuguauagcccgggcaaguaugccccccuggcgagcccagaccccuucuccccaca

SEQ ID NO: 539358 - RNA, 64 nt, Human Hepatitis C Virus
ccucuguugcugcaacgcugggcuuuggugcuuacauguccaaggcccaugggguugauccuaa

SEQ ID NO: 539359 - RNA, 64 nt, Human Herpes Virus 1
cuccggcgccgccccgcuccccuccgccgccucugucgagcaggaggcggcggugcguccgagg

SEQ ID NO: 539360 - RNA, 64 nt, Human Herpes Virus 1
uagcugggccauuuuuauuaacaacaaacggugcgucgagcacgaguucgguaaccucaugaag

SEQ ID NO: 539361 - RNA, 64 nt, Human Herpes Virus 1
gcuccgggagcuguacgugaucuccaggggugccgucgagcagcugcggccccugguccagcug

SEQ ID NO: 539362 - RNA, 64 nt, Human Herpes Virus 1; identical to SEQ ID NO: 539359

SEQ ID NO: 539363 - RNA, 64 nt, Human Hepatitis C Virus
uucagaaugaagucacccugacgcacccaaucaccaaauacaucaugacaugcaugucggccga

SEQ ID NO: 539364 - RNA, 63 nt, Human Herpes Virus 1
guccgcgagaccagugcgcuggagaaguucauaacccacgaucgcaguugccugcgcgugucc

SEQ ID NO: 539365 - RNA, 63 nt, Human Herpes Virus 1
ccgcgccuagccacgcaucuucgggccgugacgacccacgaccccaaccccgcggccagcacg

SEQ ID NO: 539366 - RNA, 64 nt, Human Herpes Virus 2
gauucugcacuccaccgagacgacgggacugucccucggagaccuggacgacgucaaggggcgc

SEQ ID NO: 539367 - RNA, 64 nt, Human Herpes Virus 2
cgccaccgucggccggcgggugagcgcgcgcaugcucggagacgucauggccgucuccacgugc

SEQ ID NO: 539368 - RNA, 64 nt, Human Herpes Virus 2
ccaugcgacgccugagggcguccgucguccgcuacucggagaacaacaccagccucuucgacug

SEQ ID NO: 539369 - RNA, 64 nt, Human Herpes Virus 2
aggugcggugggcgggcgccaucuguacgcacgccucggagaguccgggggccguggcgccggc

SEQ ID NO: 539370 - RNA, 64 nt, Human Herpes Virus 2
ccggugggccgcgcgacggcgcccggucguccuccucggagauacucaccccgcccgagcucgu

SEQ ID NO: 539371 - RNA, 64 nt, Human Herpes Virus 4 (Epstein Barr virus)
ccuucuuccagcucaucagagaccucagcguggagauugugaccggcuacaacguggccaacuu

SEQ ID NO: 539372 - RNA, 64 nt, Human Herpes Virus 1
acaggcuagcaucccccuggaccgccaggguacacugggccaucuuggcccacagacacggggc

SEQ ID NO: 539373 - RNA, 64 nt, Human Herpes Virus 1
ggagcccguccccuuucgccggcuccacgaggcccugggccacuuuaggcgcggggcucuggcu

SEQ ID NO: 539374 - RNA, 64 nt, Human Herpes Virus 1
gcacgcugcgcgaguacgcccgccucucguauagcugggccauuuuuauuaacaacaaacggug

SEQ ID NO: 539375 - RNA, 64 nt, Human Herpes Virus 1
ccacuacgaccgcuacaugcagcugguguucgaacugggccacuguaacguaaccgacggacuu

SEQ ID NO: 539376 - RNA, 64 nt, Human Herpes Virus 1
cgacguccucguucuggacgagguuaugucgacgcugggccagcucuauucgccaacgaugcag

SEQ ID NO: 539377 - RNA, 64 nt, Human Herpes Virus 1
gcacgacgucggguuagcgguugaccuguacgcccugggccagacgcugcuggaguuggugguu

SEQ ID NO: 539378 - RNA, 64 nt, Human Herpes Virus 1
ccugguggcaccuccccagcggccagaucuacugcugggccauggacagcgaccuggggucgcu

SEQ ID NO: 539379 - RNA, 64 nt, Human Herpes Virus 1
uaccgcgcgcauacaucuggcgugccuccgggcccugggccaggccauccgggccgcgcuucag

SEQ ID NO: 539380 - RNA, 64 nt, Human Herpes Virus 1
gcuguucucggagcgcgcgucggaggcguacuuccugggccagcuccagguggcccggcacgaa

SEQ ID NO: 539381 - RNA, 64 nt, Human Herpes Virus 1
uggccggcaacgaccguguguuucaggccgggaacugggccagccugaugggcggcaaaaacgc

SEQ ID NO: 539382 - RNA, 64 nt, Human Herpes Virus 1
ccuggacuccgccuuccagccccuagaugcggcccugggccagcaaaacgaaacgcucggcccc

SEQ ID NO: 539383 - RNA, 64 nt, Human Herpes Virus 1
ccuaggggccuggggggacuacagccucggcccccugggccagacgaccgcgguuccggacucc

SEQ ID NO: 539384 - RNA, 64 nt, Human Herpes Virus 1
auaucaucaacgcgacccucaccggguacggcgucugggccaccgacagccugaacaacgagua

SEQ ID NO: 539385 - RNA, 64 nt, Human Herpes Virus 1
gugcauggcgcucagggcggcggucagcgacguccugggccaccugacgcgccuagccaaccug

SEQ ID NO: 539386 - RNA, 64 nt, Human Herpes Virus 1
auaccaucgccgcguucaacuuuaauuuuucggccccgggcaugcucaucugccugaccgugcu

SEQ ID NO: 539387 - RNA, 64 nt, Human Herpes Virus 1
ggcacugauuuuuauucgggaucgcuugaggaggcccgggcaacggcccgggcaacgguggggc

SEQ ID NO: 539388 - RNA, 64 nt, Human Herpes Virus 1
uauucgggaucgcuugaggaggcccgggcaacggcccgggcaacgguggggcaacucguagcaa

SEQ ID NO: 539389 - RNA, 64 nt, Human Herpes Virus 1
gauuaaaccccaggcagagguaggcguagcuuuccccgggcagguauugcucgcagacccugcg

SEQ ID NO: 539390 - RNA, 64 nt, Human Herpes Virus 1
uugcgcgauuauucacgcccccgcgcuagccagccccgggcaccacguaauacugggucuuauc

SEQ ID NO: 539391 - RNA, 64 nt, Human Herpes Virus 1
ccgcggccuccuggucguuccuacgcgcuggcuccccgggcacguaugugcguuuguuguuuac

SEQ ID NO: 539392 - RNA, 64 nt, Human Herpes Virus 1
ccgcgaaccacguacggcucgcgggucuguauagcccgggcaaguaugccccccuggcgagccc

SEQ ID NO: 539393 - RNA, 64 nt, Human Hepatitis C Virus (M1LE)
gcuuaguugacuaccccuauaggcucuggcacuaccccugcacugucaacuuuaccgucuucaa

SEQ ID NO: 539394 - RNA, 64 nt, Human Hepatitis C Virus (M1LE)
auggaacauuccccaucaacgcguacaccacgggccccugcacacccuccccggcgccaaacua

SEQ ID NO: 539395 - RNA, 64 nt, Human Hepatitis C Virus (M1LE)
ggaucgcugggccuaaaaccugcagcaacacguggcauggaacauuccccaucaacgcguacac

SEQ ID NO: 539396 - RNA, 64 nt, Human Herpes Virus 4 (Epstein Barr virus)
ggaccuuaaacgaguagggaauaauguugucuuuaaacaccaucaacaggcccuccgugugauu

SEQ ID NO: 539397 - RNA, 64 nt, Human Herpes Virus 4 (Epstein Barr virus)
cugaugagauuccagcuucacaggacaugccgacaaacaccacagacaucacauauguggguga

SEQ ID NO: 539398 - RNA, 64 nt, Human Herpes Virus 4 (Epstein Barr virus)
gcagcggacauucauuguggucaaaaauugccacaaacaccacauuaguacggaaauggaacug

SEQ ID NO: 539399 - RNA, 64 nt, Human Herpes Virus 4 (Epstein Barr virus)
ugacacgcuccugcacccagagcggggacaagcuaaacaccagcgagccccagaucuuccucag

SEQ ID NO: 539400 - RNA, 64 nt, Human Herpes Virus 1
cagcccgggugugcuaauauccgggcugcgcgugcgggcgcaggacagaaucaucgaguuguuu

SEQ ID NO: 539401 - RNA, 64 nt, Human Herpes Virus 1
uuggugcguuccugagcgugcuguacgcuggccgcgggcgcauguccgcagccacgcacaccgc

SEQ ID NO: 539402 - RNA, 64 nt, Human Herpes Virus 1
ggcgacuggccgccgaggccgagcucgcgcuguccgggcgcaccugggcgcccggcguggaggc

SEQ ID NO: 539403 - RNA, 64 nt, Human Herpes Virus 1
ugauggccaccgugcugaaacacggccgggggcgcgggcgcaccggcggagaaugccugcugug

SEQ ID NO: 539404 - RNA, 64 nt, Human Herpes Virus 1
agcgcggccagcggcgacgggcggugagcguccucgggcgcaugcgcgcgccugcaggcgcucu

SEQ ID NO: 539405 - RNA, 64 nt, Human Herpes Virus 1
uggcgaagcugauccuuguguggaugcggccgugcgggcgcaccgacgccuuuuacggggaacu

SEQ ID NO: 539406 - RNA, 62 nt, Human Herpes Virus 1
cggggccaugguacgggggccgcccgagcccccgggcgcagaaccccggggguccgguccau

SEQ ID NO: 539407 - RNA, 64 nt, Human Herpes Virus 1
acugcugaugggagacgagggggccgccgcccugcgggcgcacgugucggggaggcgcgcgacc

SEQ ID NO: 539408 - RNA, 64 nt, Human Herpes Virus 4 (Epstein Barr virus)
cuggguaucauaugcugacuguauaugcaugaggauagcauaugcuacccggauacagauuagg

SEQ ID NO: 539409 - RNA, 64 nt, Human Herpes Virus 4 (Epstein Barr virus)
gaggauagcauaugcuacccggauacagauuaggauagcauauacuacccagauauagauuagg

SEQ ID NO: 539410 - RNA, 64 nt, Human Herpes Virus 4 (Epstein Barr virus)
uaggauagcauauacuacccagauauagauuaggauagcauaugcuacccagauauagauuagg

SEQ ID NO: 539411 - RNA, 64 nt, Human Herpes Virus 4 (Epstein Barr virus)
uaggauagccuaugcuacccagauauaaauuaggauagcauauacuacccagauauagauuagg

SEQ ID NO: 539412 - RNA, 64 nt, Human Herpes Virus 4 (Epstein Barr virus); identical to SEQ ID NO: 539410

SEQ ID NO: 539413 - RNA, 64 nt, Human Herpes Virus 4 (Epstein Barr virus)
uaggauagccuaugcuacccagauauagauuaggauagcauaugcuacccagauauagauuagg

SEQ ID NO: 539414 - RNA, 64 nt, Human Herpes Virus 4 (Epstein Barr virus)
uaggauagcauaugcuacccagauauagauuaggauagcauaugcuauccagauauuuggguag

SEQ ID NO: 539415 - RNA, 64 nt, Human Herpes Virus 4 (Epstein Barr virus)
uuggguaguauaugcuacccagauauaaauuaggauagcauauacuacccuaaucucuauuagg

SEQ ID NO: 539416 - RNA, 64 nt, Human Herpes Virus 4 (Epstein Barr virus)
uaggauagcauauacuacccuaaucucuauuaggauagcauaugcuacccggauacagauuagg

SEQ ID NO: 539417 - RNA, 64 nt, Human Herpes Virus 4 (Epstein Barr virus)
uaggauagcauaugcuacccggauacagauuaggauagcauauacuacccagauauagauuagg

SEQ ID NO: 539418 - RNA, 64 nt, Human Herpes Virus 4 (Epstein Barr virus); identical to SEQ ID NO: 539410

SEQ ID NO: 539419 - RNA, 64 nt, Human Herpes Virus 4 (Epstein Barr virus); identical to SEQ ID NO: 539411

SEQ ID NO: 539420 - RNA, 64 nt, Human Herpes Virus 4 (Epstein Barr virus); identical to SEQ ID NO: 539410

SEQ ID NO: 539421 - RNA, 64 nt, Human Herpes Virus 4 (Epstein Barr virus)
uaggauagccuaugcuacccagauauagauuaggauagcauaugcuauccagauauuuggguag

SEQ ID NO: 539422 - RNA, 64 nt, Human Herpes Virus 1
cccgcccccgcguauugcggggccguggacuccgccaccaaaaugauggggcguuuggcggacg

SEQ ID NO: 539423 - RNA, 64 nt, Human Herpes Virus 1
ggaggaccccguggggacgguggcgccgcaaaucccaccaaacuggcacauaccgucgauccag

SEQ ID NO: 539424 - RNA, 64 nt, Human Herpes Virus 4 (Epstein Barr virus)
gacuacggccacuaucucauaauguuggggccauuccagccauggagcggacugacggccccuc

SEQ ID NO: 539425 - RNA, 64 nt, Human Herpes Virus 4 (Epstein Barr virus)
caaggcccacaaacagccccucaggccagguugguccagccacauguccccccucuacgcccga

SEQ ID NO: 539426 - RNA, 64 nt, Human Herpes Virus 4 (Epstein Barr virus)
ugguacccgccaagcacgcggugagggccgucacuccagccaucaugcugaauauugccagcgc

SEQ ID NO: 539427 - RNA, 64 nt, Human Herpes Virus 4 (Epstein Barr virus)
acccaccacucguccacaccuacgagucccucucuccagccagcaccugccgaguuugugaucu

SEQ ID NO: 539428 - RNA, 64 nt, Human Herpes Virus 4 (Epstein Barr virus)
aggcagucggccuuuugauggcccacuccuaucuuccagccaacgcggaagaaggcauagccua

SEQ ID NO: 539429 - RNA, 64 nt, Human Herpes Virus 4 (Epstein Barr virus)
uaccgguuccgggauuacacauucgcccgccuguuccagccacccgccaucgacgccgagcgug

SEQ ID NO: 539430 - RNA, 64 nt, Human Herpes Virus 4 (Epstein Barr virus)
ggcucugauuaagacacugccccgggccuccuacuccagccacgccggacagaggagcuacgug

SEQ ID NO: 539431 - RNA, 64 nt, Human Herpes Virus 4 (Epstein Barr virus)
gcaaaccagcuuuccuuuccgagucugcgagcucuccagccacggcgaccuguuccgcuucucc

SEQ ID NO: 539432 - RNA, 64 nt, Human Herpes Virus 4 (Epstein Barr virus); identical to SEQ ID NO: 536194

SEQ ID NO: 539433 - RNA, 64 nt, Human Herpes Virus 4 (Epstein Barr virus); identical to SEQ ID NO: 536194

SEQ ID NO: 539434 - RNA, 64 nt, Human Herpes Virus 4 (Epstein Barr virus); identical to SEQ ID NO: 536194

SEQ ID NO: 539435 - RNA, 64 nt, Human Herpes Virus 4 (Epstein Barr virus); identical to SEQ ID NO: 536194

SEQ ID NO: 539436 - RNA, 64 nt, Human Herpes Virus 4 (Epstein Barr virus); identical to SEQ ID NO: 536194

SEQ ID NO: 539437 - RNA, 64 nt, Human Herpes Virus 4 (Epstein Barr virus); identical to SEQ ID NO: 536194

SEQ ID NO: 539438 - RNA, 64 nt, Human Herpes Virus 4 (Epstein Barr virus); identical to SEQ ID NO: 536194

SEQ ID NO: 539439 - RNA, 64 nt, Human Herpes Virus 4 (Epstein Barr virus); identical to SEQ ID NO: 536194

SEQ ID NO: 539440 - RNA, 64 nt, Human Herpes Virus 4 (Epstein Barr virus); identical to SEQ ID NO: 536194

SEQ ID NO: 539441 - RNA, 64 nt, Human Herpes Virus 4 (Epstein Barr virus); identical to SEQ ID NO: 536194

SEQ ID NO: 539442 - RNA, 64 nt, Human Herpes Virus 4 (Epstein Barr virus); identical to SEQ ID NO: 536194

SEQ ID NO: 539443 - RNA, 64 nt, Human Herpes Virus 4 (Epstein Barr virus); identical to SEQ ID NO: 536194

SEQ ID NO: 539444 - RNA, 64 nt, Human Herpes Virus 4 (Epstein Barr virus); identical to SEQ ID NO: 536206

SEQ ID NO: 539445 - RNA, 64 nt, Human Herpes Virus 4 (Epstein Barr virus); identical to SEQ ID NO: 536207

SEQ ID NO: 539446 - RNA, 64 nt, Human Herpes Virus 4 (Epstein Barr virus); identical to SEQ ID NO: 536207

SEQ ID NO: 539447 - RNA, 64 nt, Human Herpes Virus 4 (Epstein Barr virus); identical to SEQ ID NO: 536207

SEQ ID NO: 539448 - RNA, 64 nt, Human Herpes Virus 4 (Epstein Barr virus); identical to SEQ ID NO: 536207

SEQ ID NO: 539449 - RNA, 64 nt, Human Herpes Virus 4 (Epstein Barr virus); identical to SEQ ID NO: 536207

SEQ ID NO: 539450 - RNA, 64 nt, Human Herpes Virus 4 (Epstein Barr virus); identical to SEQ ID NO: 536207

SEQ ID NO: 539451 - RNA, 64 nt, Human Herpes Virus 4 (Epstein Barr virus); identical to SEQ ID NO: 536207

SEQ ID NO: 539452 - RNA, 64 nt, Human Herpes Virus 4 (Epstein Barr virus); identical to SEQ ID NO: 536207

SEQ ID NO: 539453 - RNA, 64 nt, Human Herpes Virus 4 (Epstein Barr virus); identical to SEQ ID NO: 536207

SEQ ID NO: 539454 - RNA, 64 nt, Human Herpes Virus 4 (Epstein Barr virus); identical to SEQ ID NO: 536207

SEQ ID NO: 539455 - RNA, 64 nt, Human Herpes Virus 4 (Epstein Barr virus); identical to SEQ ID NO: 536207

SEQ ID NO: 539456 - RNA, 64 nt, Human Herpes Virus 4 (Epstein Barr virus); identical to SEQ ID NO: 536207

SEQ ID NO: 539457 - RNA, 64 nt, Human Herpes Virus 4 (Epstein Barr virus); identical to SEQ ID NO: 536207

SEQ ID NO: 539458 - RNA, 64 nt, Human Herpes Virus 4 (Epstein Barr virus); identical to SEQ ID NO: 536207

SEQ ID NO: 539459 - RNA, 64 nt, Human Herpes Virus 4 (Epstein Barr virus); identical to SEQ ID NO: 536207

SEQ ID NO: 539460 - RNA, 64 nt, Human Herpes Virus 4 (Epstein Barr virus); identical to SEQ ID NO: 536207

SEQ ID NO: 539461 - RNA, 64 nt, Human Herpes Virus 4 (Epstein Barr virus); identical to SEQ ID NO: 536207

SEQ ID NO: 539462 - RNA, 64 nt, Human Herpes Virus 4 (Epstein Barr virus); identical to SEQ ID NO: 536207

SEQ ID NO: 539463 - RNA, 64 nt, Human Herpes Virus 4 (Epstein Barr virus); identical to SEQ ID NO: 536207

SEQ ID NO: 539464 - RNA, 64 nt, Human Herpes Virus 4 (Epstein Barr virus); identical to SEQ ID NO: 536207

SEQ ID NO: 539465 - RNA, 64 nt, Human Herpes Virus 4 (Epstein Barr virus); identical to SEQ ID NO: 536207

SEQ ID NO: 539466 - RNA, 64 nt, Human Herpes Virus 4 (Epstein Barr virus); identical to SEQ ID NO: 536207

SEQ ID NO: 539467 - RNA, 64 nt, Human Herpes Virus 4 (Epstein Barr virus); identical to SEQ ID NO: 536207

SEQ ID NO: 539468 - RNA, 64 nt, Human Herpes Virus 4 (Epstein Barr virus); identical to SEQ ID NO: 536207

SEQ ID NO: 539469 - RNA, 64 nt, Human Herpes Virus 4 (Epstein Barr virus); identical to SEQ ID NO: 536231

SEQ ID NO: 539470 - RNA, 64 nt, Human Herpes Virus 4 (Epstein Barr virus); identical to SEQ ID NO: 536232

SEQ ID NO: 539471 - RNA, 63 nt, Human Herpes Virus 1
cgcggagcucccgggagcuccgcaccaagccgcucuccggagagacgauggcaggagccgcgc

SEQ ID NO: 539472 - RNA, 63 nt, Human Herpes Virus 1
cccuggucgaccugcuguuuuacgacgauaccgucuccggagcggccgccgcguuagccgagc

SEQ ID NO: 539473 - RNA, 63 nt, Human Herpes Virus 1
cccgggccgccgagcggcccgucuccggacgccucuccggaggcccggggggccacguucuuu

SEQ ID NO: 539474 - RNA, 63 nt, Human Herpes Virus 1
gcccugcgcccgcccgggccgccgagcggcccgucuccggacgccucuccggaggcccggggg

SEQ ID NO: 539475 - RNA, 63 nt, Human Herpes Virus 1
gcgcugauccgcuggcugcgggaagcgauccacucuccggacacgagugugcucgucgucucc

SEQ ID NO: 539476 - RNA, 63 nt, Human Herpes Virus 1
ugacgcuggccgacguggcgcacgaauccuucgucuccggaggcgucagucccgacacguugg

SEQ ID NO: 539477 - RNA, 63 nt, Human Herpes Virus 1
gauuaccgccgcccuggcuggcauccuaaagguucuccggacaagugucccguuuuuuuggag

SEQ ID NO: 539478 - RNA, 63 nt, Human Herpes Virus 1; identical to SEQ ID NO: 539471

SEQ ID NO: 539479 - RNA, 63 nt, Human Herpes Virus 1
guguucacgcaccucgaggacacccgcgcaugaucuccggacccccgcaacggggugauaaug

SEQ ID NO: 539480 - RNA, 64 nt, Human Herpes Virus 1
gagacggacagcggccuguauacccuguccgugggcgacauaaaggacccggcucgccaagugg

SEQ ID NO: 539481 - RNA, 64 nt, Human Herpes Virus 1; identical to SEQ ID NO: 538175

SEQ ID NO: 539482 - RNA, 64 nt, Human Herpes Virus 1
gcgacgggacgccgccacaaaaagcagacgccgacgaccccacucccggcgccucuaacgaugc

SEQ ID NO: 539483 - RNA, 64 nt, Human Herpes Virus 1
ccagauggcgggcccugcuucccgguggacagagcgaccccaggucgcuguccauggcccagca

SEQ ID NO: 539484 - RNA, 64 nt, Human Herpes Virus 1
gugcgauucgucaggcagcggccuugucgaaucucgaccccaccacucgccggacccgccgacg

SEQ ID NO: 539485 - RNA, 64 nt, Human Herpes Virus 1
gggucagccgccagcccggaggucacccccacaucgaccccaaaccccaacaaugucacacaaa

SEQ ID NO: 539486 - RNA, 64 nt, Human Herpes Virus 1
ccuccacgcccaaaagcccccccacguccacccccgaccccaaacccaagaacaacaccacccc

SEQ ID NO: 539487 - RNA, 64 nt, Human Herpes Virus 1
gccuagccacgcaucuucgggccgugacgacccacgaccccaaccccgcggccagcacggagca

SEQ ID NO: 539488 - RNA, 64 nt, Human Herpes Virus 1
agauguacggaaaccaggacuaccccauagaggacgaccccagcgcggaugccgcggacgaugu

SEQ ID NO: 539489 - RNA, 64 nt, Human Herpes Virus 1
aauaugccuugguggaugccucucucaagauggccgaccccaaucgcuuucgcggcaaagaccu

SEQ ID NO: 539490 - RNA, 64 nt, Human Herpes Virus 1
ucggugguccugguggugcaaccggccccaguuccgaccccacccccgaccccagccgauuacg

SEQ ID NO: 539491 - RNA, 64 nt, Human Herpes Virus 1
guggugcaaccggccccaguuccgaccccacccccgaccccagccgauuacgacgaggaugaca

SEQ ID NO: 539492 - RNA, 64 nt, Human Herpes Virus 1
gggccaaguacgcuuucgaccccauggaccccagcgaccccacggccuccgcguacgaggacuu

SEQ ID NO: 539493 - RNA, 64 nt, Human Herpes Virus 1
uuuacgaggucaaaugccgggccaaguacgcuuucgaccccauggaccccagcgaccccacggc

SEQ ID NO: 539494 - RNA, 64 nt, Human Herpes Virus 1
gcgucgccggcacuuucugacgccucagggccuccgaccccagacauuccgcuaucuccugggg

SEQ ID NO: 539495 - RNA, 64 nt, Human Herpes Virus 1
gggccaauaucgcuagagacagccgaucuccacgcgaccccauggccgcucccaaccgcgaccc

SEQ ID NO: 539496 - RNA, 64 nt, Human Herpes Virus 1
ccagggugccgagccccagagcaacgcgggcccacgaccccauaucggggacacguuauuuacc

SEQ ID NO: 539497 - RNA, 64 nt, Human Herpes Virus 1
cuggaaucugggcagacgcucccugggaccccgccgaccccacggucaccccccgcucccccca

SEQ ID NO: 539498 - RNA, 64 nt, Human Herpes Virus 1
gccuggacguccccgaggaccccgugggcgacugcgaccccagccuucacgugcugcugcggcc

SEQ ID NO: 539499 - RNA, 64 nt, Human Herpes Virus 1; identical to SEQ ID NO: 536518

SEQ ID NO: 539500 - RNA, 64 nt, Human Herpes Virus 1; identical to SEQ ID NO: 536519

SEQ ID NO: 539501 - RNA, 64 nt, Human Herpes Virus 1; identical to SEQ ID NO: 536520

SEQ ID NO: 539502 - RNA, 64 nt, Human Herpes Virus 1; identical to SEQ ID NO: 536521

SEQ ID NO: 539503 - RNA, 64 nt, Human Herpes Virus 1; identical to SEQ ID NO: 536522

SEQ ID NO: 539504 - RNA, 64 nt, Human Herpes Virus 1; identical to SEQ ID NO: 536523

SEQ ID NO: 539505 - RNA, 64 nt, Human Herpes Virus 1; identical to SEQ ID NO: 536524

SEQ ID NO: 539506 - RNA, 64 nt, Human Herpes Virus 1; identical to SEQ ID NO: 536525

SEQ ID NO: 539507 - RNA, 64 nt, Human Herpes Virus 1; identical to SEQ ID NO: 536526

SEQ ID NO: 539508 - RNA, 64 nt, Human Herpes Virus 1; identical to SEQ ID NO: 536527

SEQ ID NO: 539509 - RNA, 64 nt, Human Herpes Virus 1; identical to SEQ ID NO: 536528

SEQ ID NO: 539510 - RNA, 64 nt, Human Herpes Virus 1; identical to SEQ ID NO: 536529

SEQ ID NO: 539511 - RNA, 64 nt, Human Herpes Virus 1; identical to SEQ ID NO: 536530

SEQ ID NO: 539512 - RNA, 64 nt, Human Herpes Virus 1; identical to SEQ ID NO: 536531

SEQ ID NO: 539513 - RNA, 64 nt, Human Herpes Virus 1; identical to SEQ ID NO: 536521

SEQ ID NO: 539514 - RNA, 64 nt, Human Herpes Virus 4 (Epstein Barr virus)
gauuuucaaguuuuuggaaacgaagcugccggagaaccacgagaggugcccgggcaucuuuacg

SEQ ID NO: 539515 - RNA, 64 nt, Human Herpes Virus 4 (Epstein Barr virus)
gaggagcugccgguugccauuuuucaagcugcuaaaccacgaguggcagcaggccuaagaagcu

SEQ ID NO: 539516 - RNA, 64 nt, Human Herpes Virus 4 (Epstein Barr virus)
cugaccuagaggagccuuuccugcgacacccgccaaccacgacagcggagagcgacuuagccuc

SEQ ID NO: 539517 - RNA, 60 nt, Human Herpes Virus 4 (Epstein Barr virus)
ggccuugagggcgcugaggacugcaaacuccacguccagacccugaggcgcgcuggcgua

SEQ ID NO: 539518 - RNA, 60 nt, Human Herpes Virus 4 (Epstein Barr virus)
acaugcaccgugaaugcauuuccccauccccacguccaguggcucaugcccgagggcgug

SEQ ID NO: 539519 - RNA, 60 nt, Human Herpes Virus 4 (Epstein Barr virus)
cagccgccccggcuccuucuacauccgguacacguccauugcccccgccaucagccgccc

SEQ ID NO: 539520 - RNA, 60 nt, Human Herpes Virus 4 (Epstein Barr virus)
caggguaugcauacagccugcgucugacaccacguccagugucacgauuucuuggcaaua

SEQ ID NO: 539521 - RNA, 64 nt, Human Herpes Virus 4 (Epstein Barr virus)
cccccaccacccccaccacccccaccacccccaccaccuccaccaccuucaccaccacccccgc

SEQ ID NO: 539522 - RNA, 64 nt, Human Herpes Virus 4 (Epstein Barr virus)
ucacaauugccaccaccagcagcaccagcacagccaccuccaggggucaucaacgaccaacaau

SEQ ID NO: 539523 - RNA, 64 nt, Human Herpes Virus 4 (Epstein Barr virus)
gcaagcccgguggaccuuggagaccagagccaaacaccuccaguccuagcaugccugaacuaag

SEQ ID NO: 539524 - RNA, 64 nt, Human Herpes Virus 4 (Epstein Barr virus)
ccgguggagaugccaauggugauucuccaucaaccaccuccagugcccaaaccgguuccaguca

SEQ ID NO: 539525 - RNA, 64 nt, Human Herpes Virus 4 (Epstein Barr virus)
uagaguuuccagcccugggccaaaagacccuccccaccuccaccaccggccugcuaaaccuccu

SEQ ID NO: 539526 - RNA, 64 nt, Human Herpes Virus 4 (Epstein Barr virus)
gguauuuaaggaucuauaugcccuucucuaccugcaccuccaaaugagagaugacucggcguag

SEQ ID NO: 539527 - RNA, 64 nt, Human Herpes Virus 1
ggcggaggccgaggcggucaucgggccgugccuggggcccgaggcccgugcccgggcccuggcc

SEQ ID NO: 539528 - RNA, 64 nt, Human Herpes Virus 1
gguaucaaacucauuuguggacgccggggccuuggggcccgacggcguaguggaggaagaccug

SEQ ID NO: 539529 - RNA, 64 nt, Human Herpes Virus 1
ccuccccgcgcccgcgccccccuccacgcccccggggcccgagcccgcccccgcccagcccgcg

SEQ ID NO: 539530 - RNA, 64 nt, Human Herpes Virus 1
ccccggggcccuggcccccgucuuugccuuucuggggcccgaguuugagguccgggggggaccc

SEQ ID NO: 539531 - RNA, 64 nt, Human Herpes Virus 1
cccgcccuacacuacacgacccucgagauccccggggcccgaagcuucggggggucugggggau

SEQ ID NO: 539532 - RNA, 64 nt, Human Herpes Virus 1
ggacuccgcggacggauucgcucucggugcgucugggcccgacagaccuccccgcgcaugcucu

SEQ ID NO: 539533 - RNA, 64 nt, Human Herpes Virus 1
ggacgaagaccgucgccgcgggcccggggggcaggggcccgagacguggggggacaucgccacg

SEQ ID NO: 539534 - RNA, 64 nt, Human Herpes Virus 1
cgggggccgguuugugagccugcuucgggccgcggggcccgaggccaucuuuaagcacauguuc

SEQ ID NO: 539535 - RNA, 64 nt, Human Herpes Virus 1
cacaucccaucgccgagcgucccggcagcgccccgggcccgaugcggcccguagccagucggug

SEQ ID NO: 539536 - RNA, 64 nt, Human Herpes Virus 1; identical to SEQ ID NO: 539527

SEQ ID NO: 539537 - RNA, 64 nt, Human Herpes Virus 1; identical to SEQ ID NO: 539529

SEQ ID NO: 539538 - RNA, 64 nt, Human Herpes Virus 1; identical to SEQ ID NO: 539527

SEQ ID NO: 539539 - RNA, 64 nt, Human Herpes Virus 1; identical to SEQ ID NO: 539528

SEQ ID NO: 539540 - RNA, 64 nt, Human Herpes Virus 1; identical to SEQ ID NO: 539529

SEQ ID NO: 539541 - RNA, 64 nt, Human Herpes Virus 1; identical to SEQ ID NO: 539530

SEQ ID NO: 539542 - RNA, 64 nt, Human Herpes Virus 1; identical to SEQ ID NO: 539531

SEQ ID NO: 539543 - RNA, 64 nt, Human Herpes Virus 1; identical to SEQ ID NO: 539532

SEQ ID NO: 539544 - RNA, 64 nt, Human Herpes Virus 1; identical to SEQ ID NO: 539533

SEQ ID NO: 539545 - RNA, 64 nt, Human Herpes Virus 1; identical to SEQ ID NO: 539534

SEQ ID NO: 539546 - RNA, 64 nt, Human Herpes Virus 1; identical to SEQ ID NO: 539535

SEQ ID NO: 539547 - RNA, 64 nt, Human Herpes Virus 1; identical to SEQ ID NO: 539527

SEQ ID NO: 539548 - RNA, 64 nt, Human Herpes Virus 1; identical to SEQ ID NO: 539529

SEQ ID NO: 539549 - RNA, 64 nt, Human Herpes Virus 1
agagucccuucugguuucuuagcaaauucgggccggacgaaaaaagccuggugcucaccacucg

SEQ ID NO: 539550 - RNA, 64 nt, Human Herpes Virus 1
ccgauuacgacgaggaugacaaugacgagggcgaggacgaaagucucgccggcacucccgccag

SEQ ID NO: 539551 - RNA, 64 nt, Human Herpes Virus 1
cgggccagacgcuagaucgggucggggaccccgcggacgaaaaccccccgggggcucuucccgg

SEQ ID NO: 539552 - RNA, 64 nt, Human Herpes Virus 1
cucgaguacccaggggcgcgguccagcacgugcuggacgaaaacgcgcguauacggcgaggugg

SEQ ID NO: 539553 - RNA, 64 nt, Human Herpes Virus 4 (Epstein Barr virus)
agcgacgaggaggaagacaagaguggaauggaaucucuuaaaaauauaccgcaaacacugccgu

SEQ ID NO: 539554 - RNA, 64 nt, Human Herpes Virus 4 (Epstein Barr virus)
uaucccccggacaccagauguuuuacacgaggaucucuuaaauuucuaacucccguuauugaaa

SEQ ID NO: 539555 - RNA, 64 nt, Human Herpes Virus 2; identical to SEQ ID NO: 535987

SEQ ID NO: 539556 - RNA, 64 nt, Human Herpes Virus 2; identical to SEQ ID NO: 535988

SEQ ID NO: 539557 - RNA, 64 nt, Human Herpes Virus 2; identical to SEQ ID NO: 535987

SEQ ID NO: 539558 - RNA, 64 nt, Human Herpes Virus 2; identical to SEQ ID NO: 535988

SEQ ID NO: 539559 - RNA, 64 nt, Human Herpes Virus 2; identical to SEQ ID NO: 535991

SEQ ID NO: 539560 - RNA, 64 nt, Human Herpes Virus 2; identical to SEQ ID NO: 535991

SEQ ID NO: 539561 - RNA, 64 nt, Human Herpes Virus 1
ccuuggagucugaggucgaauccgagacagcaucggauucgaccgagucuggggaccaggauga

SEQ ID NO: 539562 - RNA, 64 nt, Human Herpes Virus 1; identical to SEQ ID NO: 536510

SEQ ID NO: 539563 - RNA, 64 nt, Human Herpes Virus 1; identical to SEQ ID NO: 536511

SEQ ID NO: 539564 - RNA, 64 nt, Human Herpes Virus 1; identical to SEQ ID NO: 536512

SEQ ID NO: 539565 - RNA, 64 nt, Human Herpes Virus 1; identical to SEQ ID NO: 536513

SEQ ID NO: 539566 - RNA, 64 nt, Human Herpes Virus 1; identical to SEQ ID NO: 536514

SEQ ID NO: 539567 - RNA, 64 nt, Human Herpes Virus 1; identical to SEQ ID NO: 536515

SEQ ID NO: 539568 - RNA, 64 nt, Human Herpes Virus 1; identical to SEQ ID NO: 536510

SEQ ID NO: 539569 - RNA, 64 nt, Human Herpes Virus 1; identical to SEQ ID NO: 536513

SEQ ID NO: 539570 - RNA, 64 nt, Human Herpes Virus 2; identical to SEQ ID NO: 535961

SEQ ID NO: 539571 - RNA, 64 nt, Human Herpes Virus 2; identical to SEQ ID NO: 535962

SEQ ID NO: 539572 - RNA, 64 nt, Human Herpes Virus 2; identical to SEQ ID NO: 535963

SEQ ID NO: 539573 - RNA, 64 nt, Human Herpes Virus 2; identical to SEQ ID NO: 535964

SEQ ID NO: 539574 - RNA, 64 nt, Human Herpes Virus 2; identical to SEQ ID NO: 535965

SEQ ID NO: 539575 - RNA, 64 nt, Human Herpes Virus 2; identical to SEQ ID NO: 535966

SEQ ID NO: 539576 - RNA, 64 nt, Human Herpes Virus 2; identical to SEQ ID NO: 535967

SEQ ID NO: 539577 - RNA, 64 nt, Human Herpes Virus 2; identical to SEQ ID NO: 535968

SEQ ID NO: 539578 - RNA, 64 nt, Human Herpes Virus 2; identical to SEQ ID NO: 535969

SEQ ID NO: 539579 - RNA, 64 nt, Human Herpes Virus 2; identical to SEQ ID NO: 535970

SEQ ID NO: 539580 - RNA, 64 nt, Human Herpes Virus 2; identical to SEQ ID NO: 535971

SEQ ID NO: 539581 - RNA, 64 nt, Human Herpes Virus 2; identical to SEQ ID NO: 535972

SEQ ID NO: 539582 - RNA, 64 nt, Human Herpes Virus 2; identical to SEQ ID NO: 535973

SEQ ID NO: 539583 - RNA, 64 nt, Human Herpes Virus 2; identical to SEQ ID NO: 535974

SEQ ID NO: 539584 - RNA, 64 nt, Human Herpes Virus 2; identical to SEQ ID NO: 535975

SEQ ID NO: 539585 - RNA, 64 nt, Human Herpes Virus 2; identical to SEQ ID NO: 535976

SEQ ID NO: 539586 - RNA, 64 nt, Human Herpes Virus 4 (Epstein Barr virus)
cgcaaaaaaggagggugguuuggaaagcaucguggucaaggagguuccaacccgaaauuugaga

SEQ ID NO: 539587 - RNA, 64 nt, Human Herpes Virus 4 (Epstein Barr virus)
ggacgcuggcaguucacgcaugcccaggcuaauggucaaggaugaggcaggcuucgugugcugc

SEQ ID NO: 539588 - RNA, 64 nt, Human Herpes Virus 4 (Epstein Barr virus)
acguguucgaggggcgagaggugugucagccaaagaggaucaggcccuuccauccacccggauc

SEQ ID NO: 539589 - RNA, 64 nt, Human Herpes Virus 4 (Epstein Barr virus)
caagucugaccugccggcuguggccgcaggggucgaggaucagccccgggugccgaucucagcc

SEQ ID NO: 539590 - RNA, 64 nt, Human Herpes Virus 4 (Epstein Barr virus); identical to SEQ ID NO: 536194

SEQ ID NO: 539591 - RNA, 64 nt, Human Herpes Virus 4 (Epstein Barr virus); identical to SEQ ID NO: 536194

SEQ ID NO: 539592 - RNA, 64 nt, Human Herpes Virus 4 (Epstein Barr virus); identical to SEQ ID NO: 536194

SEQ ID NO: 539593 - RNA, 64 nt, Human Herpes Virus 4 (Epstein Barr virus); identical to SEQ ID NO: 536194

SEQ ID NO: 539594 - RNA, 64 nt, Human Herpes Virus 4 (Epstein Barr virus); identical to SEQ ID NO: 536194

SEQ ID NO: 539595 - RNA, 64 nt, Human Herpes Virus 4 (Epstein Barr virus); identical to SEQ ID NO: 536194

SEQ ID NO: 539596 - RNA, 64 nt, Human Herpes Virus 4 (Epstein Barr virus); identical to SEQ ID NO: 536194

SEQ ID NO: 539597 - RNA, 64 nt, Human Herpes Virus 4 (Epstein Barr virus); identical to SEQ ID NO: 536194

SEQ ID NO: 539598 - RNA, 64 nt, Human Herpes Virus 4 (Epstein Barr virus); identical to SEQ ID NO: 536194

SEQ ID NO: 539599 - RNA, 64 nt, Human Herpes Virus 4 (Epstein Barr virus); identical to SEQ ID NO: 536194

SEQ ID NO: 539600 - RNA, 64 nt, Human Herpes Virus 4 (Epstein Barr virus); identical to SEQ ID NO: 536194

SEQ ID NO: 539601 - RNA, 64 nt, Human Herpes Virus 4 (Epstein Barr virus); identical to SEQ ID NO: 536194

SEQ ID NO: 539602 - RNA, 64 nt, Human Herpes Virus 4 (Epstein Barr virus); identical to SEQ ID NO: 536206

SEQ ID NO: 539603 - RNA, 64 nt, Human Herpes Virus 4 (Epstein Barr virus); identical to SEQ ID NO: 536207

SEQ ID NO: 539604 - RNA, 64 nt, Human Herpes Virus 4 (Epstein Barr virus); identical to SEQ ID NO: 536207

SEQ ID NO: 539605 - RNA, 64 nt, Human Herpes Virus 4 (Epstein Barr virus); identical to SEQ ID NO: 536207

SEQ ID NO: 539606 - RNA, 64 nt, Human Herpes Virus 4 (Epstein Barr virus); identical to SEQ ID NO: 536207

SEQ ID NO: 539607 - RNA, 64 nt, Human Herpes Virus 4 (Epstein Barr virus); identical to SEQ ID NO: 536207

SEQ ID NO: 539608 - RNA, 64 nt, Human Herpes Virus 4 (Epstein Barr virus); identical to SEQ ID NO: 536207

SEQ ID NO: 539609 - RNA, 64 nt, Human Herpes Virus 4 (Epstein Barr virus); identical to SEQ ID NO: 536207

SEQ ID NO: 539610 - RNA, 64 nt, Human Herpes Virus 4 (Epstein Barr virus); identical to SEQ ID NO: 536207

SEQ ID NO: 539611 - RNA, 64 nt, Human Herpes Virus 4 (Epstein Barr virus); identical to SEQ ID NO: 536207

SEQ ID NO: 539612 - RNA, 64 nt, Human Herpes Virus 4 (Epstein Barr virus); identical to SEQ ID NO: 536207

SEQ ID NO: 539613 - RNA, 64 nt, Human Herpes Virus 4 (Epstein Barr virus); identical to SEQ ID NO: 536207

SEQ ID NO: 539614 - RNA, 64 nt, Human Herpes Virus 4 (Epstein Barr virus); identical to SEQ ID NO: 536207

SEQ ID NO: 539615 - RNA, 64 nt, Human Herpes Virus 4 (Epstein Barr virus); identical to SEQ ID NO: 536207

SEQ ID NO: 539616 - RNA, 64 nt, Human Herpes Virus 4 (Epstein Barr virus); identical to SEQ ID NO: 536207

SEQ ID NO: 539617 - RNA, 64 nt, Human Herpes Virus 4 (Epstein Barr virus); identical to SEQ ID NO: 536207

SEQ ID NO: 539618 - RNA, 64 nt, Human Herpes Virus 4 (Epstein Barr virus); identical to SEQ ID NO: 536207

SEQ ID NO: 539619 - RNA, 64 nt, Human Herpes Virus 4 (Epstein Barr virus); identical to SEQ ID NO: 536207

SEQ ID NO: 539620 - RNA, 64 nt, Human Herpes Virus 4 (Epstein Barr virus); identical to SEQ ID NO: 536207

SEQ ID NO: 539621 - RNA, 64 nt, Human Herpes Virus 4 (Epstein Barr virus); identical to SEQ ID NO: 536207

SEQ ID NO: 539622 - RNA, 64 nt, Human Herpes Virus 4 (Epstein Barr virus); identical to SEQ ID NO: 536207

SEQ ID NO: 539623 - RNA, 64 nt, Human Herpes Virus 4 (Epstein Barr virus); identical to SEQ ID NO: 536207

SEQ ID NO: 539624 - RNA, 64 nt, Human Herpes Virus 4 (Epstein Barr virus); identical to SEQ ID NO: 536207

SEQ ID NO: 539625 - RNA, 64 nt, Human Herpes Virus 4 (Epstein Barr virus); identical to SEQ ID NO: 536207

SEQ ID NO: 539626 - RNA, 64 nt, Human Herpes Virus 4 (Epstein Barr virus); identical to SEQ ID NO: 536207

SEQ ID NO: 539627 - RNA, 64 nt, Human Herpes Virus 4 (Epstein Barr virus); identical to SEQ ID NO: 536231

SEQ ID NO: 539628 - RNA, 64 nt, Human Herpes Virus 4 (Epstein Barr virus); identical to SEQ ID NO: 536232

SEQ ID NO: 539629 - RNA, 64 nt, Human Herpes Virus 4 (Epstein Barr virus); identical to SEQ ID NO: 536194

SEQ ID NO: 539630 - RNA, 64 nt, Human Herpes Virus 4 (Epstein Barr virus); identical to SEQ ID NO: 536194

SEQ ID NO: 539631 - RNA, 64 nt, Human Herpes Virus 4 (Epstein Barr virus); identical to SEQ ID NO: 536194

SEQ ID NO: 539632 - RNA, 64 nt, Human Herpes Virus 4 (Epstein Barr virus); identical to SEQ ID NO: 536194

SEQ ID NO: 539633 - RNA, 64 nt, Human Herpes Virus 4 (Epstein Barr virus); identical to SEQ ID NO: 536194

SEQ ID NO: 539634 - RNA, 64 nt, Human Herpes Virus 4 (Epstein Barr virus); identical to SEQ ID NO: 536194

SEQ ID NO: 539635 - RNA, 64 nt, Human Herpes Virus 4 (Epstein Barr virus); identical to SEQ ID NO: 536194

SEQ ID NO: 539636 - RNA, 64 nt, Human Herpes Virus 4 (Epstein Barr virus); identical to SEQ ID NO: 536194

SEQ ID NO: 539637 - RNA, 64 nt, Human Herpes Virus 4 (Epstein Barr virus); identical to SEQ ID NO: 536194

SEQ ID NO: 539638 - RNA, 64 nt, Human Herpes Virus 4 (Epstein Barr virus); identical to SEQ ID NO: 536194

SEQ ID NO: 539639 - RNA, 64 nt, Human Herpes Virus 4 (Epstein Barr virus); identical to SEQ ID NO: 536194

SEQ ID NO: 539640 - RNA, 64 nt, Human Herpes Virus 4 (Epstein Barr virus); identical to SEQ ID NO: 536194

SEQ ID NO: 539641 - RNA, 64 nt, Human Herpes Virus 4 (Epstein Barr virus); identical to SEQ ID NO: 536206

SEQ ID NO: 539642 - RNA, 64 nt, Human Herpes Virus 4 (Epstein Barr virus); identical to SEQ ID NO: 536207

SEQ ID NO: 539643 - RNA, 64 nt, Human Herpes Virus 4 (Epstein Barr virus); identical to SEQ ID NO: 536207

SEQ ID NO: 539644 - RNA, 64 nt, Human Herpes Virus 4 (Epstein Barr virus); identical to SEQ ID NO: 536207

SEQ ID NO: 539645 - RNA, 64 nt, Human Herpes Virus 4 (Epstein Barr virus); identical to SEQ ID NO: 536207

SEQ ID NO: 539646 - RNA, 64 nt, Human Herpes Virus 4 (Epstein Barr virus); identical to SEQ ID NO: 536207

SEQ ID NO: 539647 - RNA, 64 nt, Human Herpes Virus 4 (Epstein Barr virus); identical to SEQ ID NO: 536207

SEQ ID NO: 539648 - RNA, 64 nt, Human Herpes Virus 4 (Epstein Barr virus); identical to SEQ ID NO: 536207

SEQ ID NO: 539649 - RNA, 64 nt, Human Herpes Virus 4 (Epstein Barr virus); identical to SEQ ID NO: 536207

SEQ ID NO: 539650 - RNA, 64 nt, Human Herpes Virus 4 (Epstein Barr virus); identical to SEQ ID NO: 536207

SEQ ID NO: 539651 - RNA, 64 nt, Human Herpes Virus 4 (Epstein Barr virus); identical to SEQ ID NO: 536207

SEQ ID NO: 539652 - RNA, 64 nt, Human Herpes Virus 4 (Epstein Barr virus); identical to SEQ ID NO: 536207

SEQ ID NO: 539653 - RNA, 64 nt, Human Herpes Virus 4 (Epstein Barr virus); identical to SEQ ID NO: 536207

SEQ ID NO: 539654 - RNA, 64 nt, Human Herpes Virus 4 (Epstein Barr virus); identical to SEQ ID NO: 536207

SEQ ID NO: 539655 - RNA, 64 nt, Human Herpes Virus 4 (Epstein Barr virus); identical to SEQ ID NO: 536207

SEQ ID NO: 539656 - RNA, 64 nt, Human Herpes Virus 4 (Epstein Barr virus); identical to SEQ ID NO: 536207

SEQ ID NO: 539657 - RNA, 64 nt, Human Herpes Virus 4 (Epstein Barr virus); identical to SEQ ID NO: 536207

SEQ ID NO: 539658 - RNA, 64 nt, Human Herpes Virus 4 (Epstein Barr virus); identical to SEQ ID NO: 536207

SEQ ID NO: 539659 - RNA, 64 nt, Human Herpes Virus 4 (Epstein Barr virus); identical to SEQ ID NO: 536207

SEQ ID NO: 539660 - RNA, 64 nt, Human Herpes Virus 4 (Epstein Barr virus); identical to SEQ ID NO: 536207

SEQ ID NO: 539661 - RNA, 64 nt, Human Herpes Virus 4 (Epstein Barr virus); identical to SEQ ID NO: 536207

SEQ ID NO: 539662 - RNA, 64 nt, Human Herpes Virus 4 (Epstein Barr virus); identical to SEQ ID NO: 536207

SEQ ID NO: 539663 - RNA, 64 nt, Human Herpes Virus 4 (Epstein Barr virus); identical to SEQ ID NO: 536207

SEQ ID NO: 539664 - RNA, 64 nt, Human Herpes Virus 4 (Epstein Barr virus); identical to SEQ ID NO: 536207

SEQ ID NO: 539665 - RNA, 64 nt, Human Herpes Virus 4 (Epstein Barr virus); identical to SEQ ID NO: 536207

SEQ ID NO: 539666 - RNA, 64 nt, Human Herpes Virus 4 (Epstein Barr virus); identical to SEQ ID NO: 536231

SEQ ID NO: 539667 - RNA, 64 nt, Human Herpes Virus 4 (Epstein Barr virus); identical to SEQ ID NO: 536232

SEQ ID NO: 539668 - RNA, 64 nt, Human Herpes Virus 4 (Epstein Barr virus)
ucgguggccugcucaccaugguagccggcgcuguguggcugacggugaugucuaacacgcuuuu

SEQ ID NO: 539669 - RNA, 64 nt, Human Herpes Virus 4 (Epstein Barr virus)
cgacagaguuacaccagcgacugcaccuucguucguggcugaucaugccucggcucuauuggcc

SEQ ID NO: 539670 - RNA, 64 nt, Human Herpes Virus 4 (Epstein Barr virus)
ggcgugggucgcgcccucgccgccggacgacaagguggcugaguccagcuaccucauguucagg

SEQ ID NO: 539671 - RNA, 64 nt, Human Herpes Virus 4 (Epstein Barr virus)
auggcaacgaccagucaugucgagcaugagcuccucuccaaauugauugaugaguuaaagguca

SEQ ID NO: 539672 - RNA, 64 nt, Human Herpes Virus 4 (Epstein Barr virus)
cacccgagucauugcuccgggcuaucgugacgggucuccaaaaauuguggguggauucgugcgg

SEQ ID NO: 539673 - RNA, 64 nt, Human Herpes Virus 4 (Epstein Barr virus)
ugggcacgcuggcgccaccacaugcccuuuccauccucgucaccccccaccaccgucagggagu

SEQ ID NO: 539674 - RNA, 64 nt, Human Herpes Virus 4 (Epstein Barr virus)
cccacgguuguguuggucacgaagcuagaggugcccucgucagucacaaaauguauugacuucc

SEQ ID NO: 539675 - RNA, 64 nt, Human Herpes Virus 4 (Epstein Barr virus)
gaagaacggacugcggagauggaugacaccauggccucgucaggagggcagagaggggcaccaa

SEQ ID NO: 539676 - RNA, 62 nt, Human Herpes Virus 2
agccccgcgaccaccaaggcccggaagcggaaaaccaaaaagccgcccaagcggcccgaggc

SEQ ID NO: 539677 - RNA, 64 nt, Human Herpes Virus 4 (Epstein Barr virus); identical to SEQ ID NO: 538345

SEQ ID NO: 539678 - RNA, 64 nt, Human Herpes Virus 4 (Epstein Barr virus); identical to SEQ ID NO: 538345

SEQ ID NO: 539679 - RNA, 64 nt, Human Herpes Virus 4 (Epstein Barr virus); identical to SEQ ID NO: 538347

SEQ ID NO: 539680 - RNA, 64 nt, Human Herpes Virus 4 (Epstein Barr virus); identical to SEQ ID NO: 538348

SEQ ID NO: 539681 - RNA, 64 nt, Human Herpes Virus 4 (Epstein Barr virus); identical to SEQ ID NO: 538349

SEQ ID NO: 539682 - RNA, 64 nt, Human Herpes Virus 4 (Epstein Barr virus); identical to SEQ ID NO: 538350

SEQ ID NO: 539683 - RNA, 64 nt, Human Herpes Virus 4 (Epstein Barr virus); identical to SEQ ID NO: 538351

SEQ ID NO: 539684 - RNA, 64 nt, Human Herpes Virus 4 (Epstein Barr virus); identical to SEQ ID NO: 538352

SEQ ID NO: 539685 - RNA, 64 nt, Human Herpes Virus 4 (Epstein Barr virus); identical to SEQ ID NO: 538353

SEQ ID NO: 539686 - RNA, 64 nt, Human Herpes Virus 4 (Epstein Barr virus); identical to SEQ ID NO: 538354

SEQ ID NO: 539687 - RNA, 64 nt, Human Herpes Virus 4 (Epstein Barr virus); identical to SEQ ID NO: 538355

SEQ ID NO: 539688 - RNA, 64 nt, Human Herpes Virus 4 (Epstein Barr virus); identical to SEQ ID NO: 538356

SEQ ID NO: 539689 - RNA, 64 nt, Human Herpes Virus 4 (Epstein Barr virus); identical to SEQ ID NO: 538355

SEQ ID NO: 539690 - RNA, 64 nt, Human Herpes Virus 4 (Epstein Barr virus); identical to SEQ ID NO: 538356

SEQ ID NO: 539691 - RNA, 64 nt, Human Herpes Virus 4 (Epstein Barr virus); identical to SEQ ID NO: 538359

SEQ ID NO: 539692 - RNA, 64 nt, Human Herpes Virus 4 (Epstein Barr virus); identical to SEQ ID NO: 538360

SEQ ID NO: 539693 - RNA, 64 nt, Human Herpes Virus 4 (Epstein Barr virus); identical to SEQ ID NO: 538361

SEQ ID NO: 539694 - RNA, 64 nt, Human Herpes Virus 4 (Epstein Barr virus); identical to SEQ ID NO: 538362

SEQ ID NO: 539695 - RNA, 64 nt, Human Herpes Virus 4 (Epstein Barr virus); identical to SEQ ID NO: 538363

SEQ ID NO: 539696 - RNA, 64 nt, Human Herpes Virus 4 (Epstein Barr virus); identical to SEQ ID NO: 538364

SEQ ID NO: 539697 - RNA, 64 nt, Human Herpes Virus 4 (Epstein Barr virus); identical to SEQ ID NO: 538365

SEQ ID NO: 539698 - RNA, 64 nt, Human Herpes Virus 4 (Epstein Barr virus); identical to SEQ ID NO: 538345

SEQ ID NO: 539699 - RNA, 64 nt, Human Herpes Virus 4 (Epstein Barr virus); identical to SEQ ID NO: 538345

SEQ ID NO: 539700 - RNA, 64 nt, Human Herpes Virus 4 (Epstein Barr virus); identical to SEQ ID NO: 538347

SEQ ID NO: 539701 - RNA, 64 nt, Human Herpes Virus 4 (Epstein Barr virus); identical to SEQ ID NO: 538348

SEQ ID NO: 539702 - RNA, 64 nt, Human Herpes Virus 4 (Epstein Barr virus); identical to SEQ ID NO: 538349

SEQ ID NO: 539703 - RNA, 64 nt, Human Herpes Virus 4 (Epstein Barr virus); identical to SEQ ID NO: 538350

SEQ ID NO: 539704 - RNA, 64 nt, Human Herpes Virus 4 (Epstein Barr virus); identical to SEQ ID NO: 538351

SEQ ID NO: 539705 - RNA, 64 nt, Human Herpes Virus 4 (Epstein Barr virus); identical to SEQ ID NO: 538352

SEQ ID NO: 539706 - RNA, 64 nt, Human Herpes Virus 4 (Epstein Barr virus); identical to SEQ ID NO: 538353

SEQ ID NO: 539707 - RNA, 64 nt, Human Herpes Virus 4 (Epstein Barr virus); identical to SEQ ID NO: 538354

SEQ ID NO: 539708 - RNA, 64 nt, Human Herpes Virus 4 (Epstein Barr virus); identical to SEQ ID NO: 538355

SEQ ID NO: 539709 - RNA, 64 nt, Human Herpes Virus 4 (Epstein Barr virus); identical to SEQ ID NO: 538356

SEQ ID NO: 539710 - RNA, 64 nt, Human Herpes Virus 4 (Epstein Barr virus); identical to SEQ ID NO: 538355

SEQ ID NO: 539711 - RNA, 64 nt, Human Herpes Virus 4 (Epstein Barr virus); identical to SEQ ID NO: 538356

SEQ ID NO: 539712 - RNA, 64 nt, Human Herpes Virus 4 (Epstein Barr virus); identical to SEQ ID NO: 538359

SEQ ID NO: 539713 - RNA, 64 nt, Human Herpes Virus 4 (Epstein Barr virus); identical to SEQ ID NO: 538360

SEQ ID NO: 539714 - RNA, 64 nt, Human Herpes Virus 4 (Epstein Barr virus); identical to SEQ ID NO: 538361

SEQ ID NO: 539715 - RNA, 64 nt, Human Herpes Virus 4 (Epstein Barr virus); identical to SEQ ID NO: 538362

SEQ ID NO: 539716 - RNA, 64 nt, Human Herpes Virus 4 (Epstein Barr virus); identical to SEQ ID NO: 538363

SEQ ID NO: 539717 - RNA, 64 nt, Human Herpes Virus 4 (Epstein Barr virus); identical to SEQ ID NO: 538364

SEQ ID NO: 539718 - RNA, 64 nt, Human Herpes Virus 4 (Epstein Barr virus); identical to SEQ ID NO: 538365

SEQ ID NO: 539719 - RNA, 64 nt, Human Herpes Virus 4 (Epstein Barr virus)
uugucaccucugucacaaccgaggcuuaccccuccacaaccacucaugaugccaccaaggccua

SEQ ID NO: 539720 - RNA, 64 nt, Human Herpes Virus 4 (Epstein Barr virus)
ccgccaaguggauccggggcucuugggccugguccacaaccaaauccgaaggagcccuggccuu

SEQ ID NO: 539721 - RNA, 64 nt, Human Herpes Virus 4 (Epstein Barr virus)
ccccuauaaccacaacugcuauucugagcaccaacacaaccacggugacauucacugggacaac

SEQ ID NO: 539722 - RNA, 64 nt, Human Herpes Virus 1
guagugguggcgcaggaccacggagauagaacgacggcuccacagccaguccggccggucgccg

SEQ ID NO: 539723 - RNA, 64 nt, Human Herpes Virus 1
acuacaucuacgacacccagggggcggccaucgccggcuccaaccucugcaccgagaucgucca

SEQ ID NO: 539724 - RNA, 64 nt, Human Herpes Virus 1
cgacaucgcccugaaggagcccguccccuuucgccggcuccacgaggcccugggccacuuuagg

SEQ ID NO: 539725 - RNA, 64 nt, Human Herpes Virus 1
cuuggaucccacggcccgccugcagcuagaggcucggcuccagcaccugguggccgagauucug

SEQ ID NO: 539726 - RNA, 64 nt, Human Herpes Virus 1
cgcgccaucuggaccggggucccagcggcacgaccggcuccaugcagugcauggcgcucagggc

SEQ ID NO: 539727 - RNA, 64 nt, Human Herpes Virus 2
ggccccgggcgacguuccccgagacaccagcacccgcgugaaccccgacgacguggcccaccgc

SEQ ID NO: 539728 - RNA, 64 nt, Human Herpes Virus 2
guagugauggcgcaggaccacggagauggagcgacggcuccacagccagucgggccggucgccg

SEQ ID NO: 539729 - RNA, 64 nt, Human Herpes Virus 2
ggcccccccggcuggcaaagcgccccccgccgggcggcuccaggcccgccagcaccgccuccgc

SEQ ID NO: 539730 - RNA, 64 nt, Human Herpes Virus 2
ccuaccgcauuagcgacagcagcuuuguucaaugcggcuccaacugcaguaugauaaucgacgg

SEQ ID NO: 539731 - RNA, 64 nt, Human Herpes Virus 2
acuacaucuacgacacgcaaggggcggccaucgccggcuccaaccucugcaccgagaucgucca

SEQ ID NO: 539732 - RNA, 64 nt, Human Herpes Virus 2
cgucgacgacugcagcaugcgggcgguccuccggcggcuccaggucggcggggggacccucaag

SEQ ID NO: 539733 - RNA, 64 nt, Human Herpes Virus 2
ggacaucgcccugaaggagcccguccccuuuccccggcuccacgaggcccugggucacuuuagg

SEQ ID NO: 539734 - RNA, 64 nt, Human Herpes Virus 2
cggguuaccgguacgccgcggccauccugcccaccggcuccauccugaguacgaucgagguggc

SEQ ID NO: 539735 - RNA, 64 nt, Human Herpes Virus 2
ccagcgaggacgcgcuggucugaccgucgugaaccggcuccagcguggaccagagccccgugaa

SEQ ID NO: 539736 - RNA, 64 nt, Human Herpes Virus 4 (Epstein Barr virus)
uagaguccucggacgaugagcugccauauaucgaucccaauauggagccgguucagcagaggcc

SEQ ID NO: 539737 - RNA, 64 nt, Human Herpes Virus 4 (Epstein Barr virus)
gcccagcuccacgccgccccccuccaccuucaagucccaauacauacaauaaacacaugaugga

SEQ ID NO: 539738 - RNA, 64 nt, Human Herpes Virus 4 (Epstein Barr virus)
cggggauccggauggguacgauggcggaaacaacucccaauauccaucugcuucuggcucuucu

SEQ ID NO: 539739 - RNA, 64 nt, Human Herpes Virus 4 (Epstein Barr virus)
ccuccccuaccuugaauacaacuggauuugcugaucccaauacaacgacaggucuacccagcuc

SEQ ID NO: 539740 - RNA, 63 nt, Human Herpes Virus 4 (Epstein Barr virus)
aagacaaggguccccauagaccuacgcgaccuguacuuagaggcccagcuccacgccgccccc

SEQ ID NO: 539741 - RNA, 64 nt, Human Herpes Virus 2
gggggugggggccaagagggcggcgccgcgccgggccccggacucggacucgggcgaccgcggc

SEQ ID NO: 539742 - RNA, 64 nt, Human Herpes Virus 2
gugccaccaggcccccggacccagggcacagcacgccccggauucgggggccguguccgugggu

SEQ ID NO: 539743 - RNA, 64 nt, Human Herpes Virus 2
cgucuccgcggucgagucucccccgccccgauacgccccggaggacgccgagcggccaacagac

SEQ ID NO: 539744 - RNA, 64 nt, Human Herpes Virus 2
gacaacgacgccccucucgaaccuguuuuuacgggccccggacaucacccacgucgcccccccg

SEQ ID NO: 539745 - RNA, 64 nt, Human Herpes Virus 2
gggugcggaggaggaagacgaggccgacgaugacgccccggaugacguggccuacccggaggac

SEQ ID NO: 539746 - RNA, 64 nt, Human Herpes Virus 2
gcucgagacggucguggaugcggcgugcaugcgcgccccggaaccgcucgccauagcauacagu

SEQ ID NO: 539747 - RNA, 64 nt, Human Herpes Virus 2
ggacgucuccgggccgcggcggagacgaccggcggccccggaucuccggauccagccgacggac

SEQ ID NO: 539748 - RNA, 64 nt, Human Herpes Virus 2
uucccgcgccgccggcgaaaaaaggcgaugcuccgccccggaucgggcgcugguggaguuaaau

SEQ ID NO: 539749 - RNA, 64 nt, Human Herpes Virus 2
cccaccaguguagcggcccgucgcacaacgcggagccccggauccucgugcccaucacccacaa

SEQ ID NO: 539750 - RNA, 64 nt, Human Herpes Virus 2
agacgucauggccgucuccacgugcgugcccgucgccccggacaacgugaucgugcagaacucg

SEQ ID NO: 539751 - RNA, 64 nt, Human Herpes Virus 2
acgugcgggaguacaugcgggagcaggaccgcaagccccggaaugccacgcccgcgccacugcg

SEQ ID NO: 539752 - RNA, 64 nt, Human Herpes Virus 2
cggacggaacgccgcugcagcggucuugugggaagccccggagcaccgacaaacucggcgcgcu

SEQ ID NO: 539753 - RNA, 64 nt, Human Herpes Virus 2
ccgacuacguggagcuccgcccaccagcuuuuuggccccggacggacgugcaccgggcgcucgg

SEQ ID NO: 539754 - RNA, 64 nt, Human Herpes Virus 2
uuuagcgcgcuccaucgugacucggcauaucaccgccccggacaucgccgaccgguuucuggcg

SEQ ID NO: 539755 - RNA, 64 nt, Human Herpes Virus 2
ugucgccggacgucgccgccacgucauccacgacgccccggaggcccuggacuggcugcccgau

SEQ ID NO: 539756 - RNA, 64 nt, Human Herpes Virus 2
gacucaccaucuggugaagcgccggggccuccgggccccggagggcuacuuuacccccaucgcc

SEQ ID NO: 539757 - RNA, 64 nt, Human Herpes Virus 2
gucugcccucuucuccccucggcgggccacacgcgccccggacccgggacuaagccugucgccc

SEQ ID NO: 539758 - RNA, 64 nt, Human Herpes Virus 2
gcgucuugccggcggggccgcccugccgggagacgccccggacuccccguacaucgaggcggaa

SEQ ID NO: 539759 - RNA, 64 nt, Human Herpes Virus 2
acucagcaucaaguccugguucggggccgcccuggccccggaccugcuucggagcggaaccccg

SEQ ID NO: 539760 - RNA, 64 nt, Human Herpes Virus 2
gaccgaggccccccccgggccuacgagggcacaagccccggagguugcgucggucccagucacc

SEQ ID NO: 539761 - RNA, 64 nt, Human Herpes Virus 2; identical to SEQ ID NO: 539741

SEQ ID NO: 539762 - RNA, 64 nt, Human Herpes Virus 2; identical to SEQ ID NO: 539747

SEQ ID NO: 539763 - RNA, 64 nt, Human Herpes Virus 2
cgacacccaagcacagagucugggccgggcaggcgcgaccgacgcgcgcgggucgggagggccg

SEQ ID NO: 539764 - RNA, 64 nt, Human Herpes Virus 2
gaucaagauaggcuacacggcccacauccgcaaggcgaccgagcccguguuugaugagaucgac

SEQ ID NO: 539765 - RNA, 64 nt, Human Herpes Virus 2
cgcacgagccuuuuggacucgcuccuggucgugggcgaccgaggcauccuuguacauaacgcga

SEQ ID NO: 539766 - RNA, 64 nt, Human Herpes Virus 2
gguugcggcucccguggagguuacggcgcuguaugcgaccgacgggugcguuaucaccuccucg

SEQ ID NO: 539767 - RNA, 64 nt, Human Herpes Virus 2
cgaggggcuuacguucccgcggggagacgacggggcgaccgagaggcacccggacggccgacgc

SEQ ID NO: 539768 - RNA, 64 nt, Human Herpes Virus 2
gcgcaccgcagccauucaggaggugauggcccacgcgaccgaggacgcgccccccagcccggcc

SEQ ID NO: 539769 - RNA, 64 nt, Human Herpes Virus 2
gacgcgcggggcgccuaaggccuccgcgaccccggcgaccgaccccgcccgcggcaggcgaccc

SEQ ID NO: 539770 - RNA, 64 nt, Human Herpes Virus 2
ucuggccggagggacccgcaccgcggggcuuggagcgaccgaggccccccccgggccuacgagg

SEQ ID NO: 539771 - RNA, 64 nt, Human Herpes Virus 2; identical to SEQ ID NO: 539763

SEQ ID NO: 539772 - RNA, 63 nt, Human Herpes Virus 4 (Epstein Barr virus)
cccucccccugccccguugcaccgauagcauggccgccagaguuccaauagaggagcuccgag

SEQ ID NO: 539773 - RNA, 63 nt, Human Herpes Virus 4 (Epstein Barr virus)
uaaauguucgcagggugcuguggcuggggagccccgccagauuccaaagauccagaauuuuac

SEQ ID NO: 539774 - RNA, 63 nt, Human Herpes Virus 4 (Epstein Barr virus)
uuauggacucucucaagaaccaggugacagucaccgccagauacuucagaagggugccuagcc

SEQ ID NO: 539775 - RNA, 63 nt, Human Herpes Virus 4 (Epstein Barr virus)
cguccagauccaauuugccuacgacucccugcgccgccagaucaaccgcaugcugggagaccu

SEQ ID NO: 539776 - RNA, 64 nt, Human Herpes Virus 1
gguauucgaggccacacgcgucaccuuaauaugcgaaguggaccugggaccgcgccgccccgac

SEQ ID NO: 539777 - RNA, 64 nt, Human Herpes Virus 1; identical to SEQ ID NO: 539776

SEQ ID NO: 539778 - RNA, 64 nt, Human Herpes Virus 4 (Epstein Barr virus)
ggggcccgagguuggagccagcgggcacccgaggucccagcacccggucccuccggggggcaga

SEQ ID NO: 539779 - RNA, 64 nt, Human Herpes Virus 4 (Epstein Barr virus); identical to SEQ ID NO: 539778

SEQ ID NO: 539780 - RNA, 64 nt, Human Herpes Virus 4 (Epstein Barr virus); identical to SEQ ID NO: 539778

SEQ ID NO: 539781 - RNA, 64 nt, Human Herpes Virus 4 (Epstein Barr virus)
ucuucugcuccaggcaccaggcccgcgcaaggucucccagcaugcgguugaucuggcggcgcag

SEQ ID NO: 539782 - RNA, 64 nt, Human Herpes Virus 4 (Epstein Barr virus)
caagaccgagauacaaugcgaccaccuaucuaccucccagcacuucuagcaaacugcggccccg

SEQ ID NO: 539783 - RNA, 63 nt, Human Herpes Virus 1
aacucucaguuuaucauggauaacaaccacccgcacccccagggcacccaaggggccgugcgg

SEQ ID NO: 539784 - RNA, 63 nt, Human Herpes Virus 1
agggcgcuuggucgggaggccgcaucgaacgcacacccccauccggugguccguguggagguc

SEQ ID NO: 539785 - RNA, 63 nt, Human Herpes Virus 1
ggggucccccgggucagccgccagcccggaggucacccccacaucgaccccaaaccccaacaa

SEQ ID NO: 539786 - RNA, 63 nt, Human Herpes Virus 1
cccaaaccccaacaaugucacacaaaacaaaaccacccccaccgagccggccagccccccaac

SEQ ID NO: 539787 - RNA, 63 nt, Human Herpes Virus 1
gagggcggggacgaccccgaccacgaccccgaccacccccacgaccucgacgacgcccggcgg

SEQ ID NO: 539788 - RNA, 63 nt, Human Herpes Virus 1
gcgugcggcggcggcgacgacgacgauaacccccacccccacggggccgccgggggccgccuc

SEQ ID NO: 539789 - RNA, 63 nt, Human Herpes Virus 1
ccgccugccgcgcggaggcguuguuauccagcacacccccauugggcuguuggugauuaucga

SEQ ID NO: 539790 - RNA, 63 nt, Human Herpes Virus 1
gaucgacguguauggucagacccacugggacaucacccccaccaccccggccacgccgcuguc

SEQ ID NO: 539791 - RNA, 63 nt, Human Herpes Virus 1
gcgccggggccuuggggccccggccggguacuucacccccauugccguggaccuguggaacgu

SEQ ID NO: 539792 - RNA, 63 nt, Human Herpes Virus 1
gggauuggggugaccgaggcgcccuccuuggggcacccccacacgccgcccccggagguuacg

SEQ ID NO: 539793 - RNA, 63 nt, Human Herpes Virus 1
gaacgaggggccguuugucguuauugaucuggacacccccacggacccaccuccaccguacuc

SEQ ID NO: 539794 - RNA, 63 nt, Human Herpes Virus 1; identical to SEQ ID NO: 539788

SEQ ID NO: 539795 - RNA, 63 nt, Human Herpes Virus 1; identical to SEQ ID NO: 539787

SEQ ID NO: 539796 - RNA, 64 nt, Human Herpes Virus 1
gguucucgaggagaauggggaagcgccuggucaccucccccaaccacgcgcguuggucggggcc

SEQ ID NO: 539797 - RNA, 64 nt, Human Herpes Virus 1
ggccagggugugccggcacgacgggggccagaagcucccccaccgcauccgcgggcacguaggc

SEQ ID NO: 539798 - RNA, 64 nt, Human Herpes Virus 1
ugcucgagcagcuaaauaaccucaccgaaaccgucucccccaacacugacguccguacguauuc

SEQ ID NO: 539799 - RNA, 64 nt, Human Herpes Virus 1
ccgccacacucaaaaagccccaaagcgcauacgccucccccacauccgggaagacgaccagccg

SEQ ID NO: 539800 - RNA, 64 nt, Human Herpes Virus 1
ccggcggugcgacccccacaucggacgggggaagcucccccaacugaagcugaacgcgcuucag

SEQ ID NO: 539801 - RNA, 64 nt, Human Herpes Virus 1
gcggagggcucguuggggccccuggggaaccacacucccccauacaccgacgccacccccggcg

SEQ ID NO: 539802 - RNA, 64 nt, Human Herpes Virus 1
cccgccccggccggggcggcacggccggggaccacucccccagccccccugggccccgaggccg

SEQ ID NO: 539803 - RNA, 64 nt, Human Herpes Virus 1
ccgggagccccggguuccgcgaccaccccgagaaccuagggaacccagaguaccgcgagcuccc

SEQ ID NO: 539804 - RNA, 64 nt, Human Herpes Virus 1
uguuuauuccguggggcggccgugugccucgcagcccggggagauugccaaguuuggucugguc

SEQ ID NO: 539805 - RNA, 64 nt, Human Herpes Virus 1
ccaggacgaaccggacgcggacuacccguacuaccccggggaggcucgaggcgcgccgcgcggg

SEQ ID NO: 539806 - RNA, 64 nt, Human Herpes Virus 1
ggcgcgcuugccgucaagacggugcgagaacaugcccggggaacgccgggcccgggccugccgc

SEQ ID NO: 539807 - RNA, 64 nt, Human Herpes Virus 1
gcuggggcuccggcgucgccugcacaggaaggaccccggggacggggcccgguuggcggcgacg

SEQ ID NO: 539808 - RNA, 64 nt, Human Herpes Virus 1
cccccgcggguggcccgcguuugcgcccgccagucccggggaggacacggcgggcggcacgccg

SEQ ID NO: 539809 - RNA, 64 nt, Human Herpes Virus 1
cuauccggaggaauacgcagaggagcuuuuucugcccggggacgcgaccgguccccuuaucggg

SEQ ID NO: 539810 - RNA, 64 nt, Human Herpes Virus 1
gcguauggagacuccggaagcuauccuguuuucccccggggagacguucagcacgaacgucucc

SEQ ID NO: 539811 - RNA, 64 nt, Human Herpes Virus 1
ggccaugggguggcuccagaacccgcgcgugguccccggggacguggcgcuggaccaggccugc

SEQ ID NO: 539812 - RNA, 64 nt, Human Herpes Virus 1
acaacagcucgacguguuuuacugccacuacacccccggggaaccggagaccaccgccgccguu

SEQ ID NO: 539813 - RNA, 64 nt, Human Herpes Virus 1
cggacagaaacccggcccgccgcaccuucagcaacccggggaccgaccagccguuccagggagg

SEQ ID NO: 539814 - RNA, 64 nt, Human Herpes Virus 1
acgugcccccggauaugcgcgggguuacgcgggccccggggagacagcgccugcguucaucgga

SEQ ID NO: 539815 - RNA, 64 nt, Human Herpes Virus 1
ugggaccccggcggccccuggcgccgccuggucccccggggaccuugccccggccggauucccg

SEQ ID NO: 539816 - RNA, 64 nt, Human Herpes Virus 1
cacagccccacgcagggucugcgagcaauaccugcccggggaaagcuacgccuaccucugccug

SEQ ID NO: 539817 - RNA, 64 nt, Human Herpes Virus 1
accgacgucaacuacuuccgccggcccugcaacccccggggacgcgccgccgggggcguuuacg

SEQ ID NO: 539818 - RNA, 64 nt, Human Herpes Virus 1
cgucgaccagcucgaggcugaccccgagacgcagcccggggacgggggccgguuugugagccug

SEQ ID NO: 539819 - RNA, 64 nt, Human Herpes Virus 1
aaaacccggacccccccggcacgggcauguagcacccggggaguagcgaggccaccgaggagcu

SEQ ID NO: 539820 - RNA, 64 nt, Human Herpes Virus 1
ucagccgcgucagcccgcgcucggccugugcgcccccggggacgcuaauggcgcgcgugcggac

SEQ ID NO: 539821 - RNA, 64 nt, Human Herpes Virus 1; identical to SEQ ID NO: 539811

SEQ ID NO: 539822 - RNA, 64 nt, Human Hepatitis C Virus (HCV-N)
gcuggagcgcggcuugucgugcucgccaccgcuacgccuccaggaucggucaccgugccacacc

SEQ ID NO: 539823 - RNA, 64 nt, Human Hepatitis C Virus (HCV-N)
uugggcaucggcacaguccuggaccaagcggagacggcuggagcgcggcuugucgugcucgcca

SEQ ID NO: 539824 - RNA, 63 nt, Human Herpes Virus 4 (Epstein Barr virus)
uuccccgaugauugguauccuccaucuauagaccccgcagacuuagacgaaaguugggauuac

SEQ ID NO: 539825 - RNA, 52 nt, Human Herpes Virus 4 (Epstein Barr virus)
uugguauccuccaucuauagaccccgcagacuuagacgaaaguugggauuac

SEQ ID NO: 539826 - RNA, 63 nt, Human Herpes Virus 4 (Epstein Barr virus)
ccugacgugcccccgggagcgauagagcagggccccgcagaugacccaggagaaggcccaagc

SEQ ID NO: 539827 - RNA, 63 nt, Human Herpes Virus 4 (Epstein Barr virus)
ccaccaagggcgucgagcgggaccuggaggcggcccgcagacgggaaaaagggauugggcaaa

SEQ ID NO: 539828 - RNA, 63 nt, Human Herpes Virus 4 (Epstein Barr virus)
cggcccgagcccagaagguugagaccuccugcccccgcagacgcaguccgcggacuacccccu

SEQ ID NO: 539829 - RNA, 63 nt, Human Herpes Virus 4 (Epstein Barr virus)
accgggaugugauggguggagaggccaccguggcccgcagacacauucgggugaaggcucgac

SEQ ID NO: 539830 - RNA, 64 nt, Human Herpes Virus 1; identical to SEQ ID NO: 537816

SEQ ID NO: 539831 - RNA, 64 nt, Human Herpes Virus 1; identical to SEQ ID NO: 537817

SEQ ID NO: 539832 - RNA, 64 nt, Human Herpes Virus 1; identical to SEQ ID NO: 537818

SEQ ID NO: 539833 - RNA, 64 nt, Human Herpes Virus 1; identical to SEQ ID NO: 537819

SEQ ID NO: 539834 - RNA, 64 nt, Human Herpes Virus 1; identical to SEQ ID NO: 537820

SEQ ID NO: 539835 - RNA, 64 nt, Human Herpes Virus 1; identical to SEQ ID NO: 537821

SEQ ID NO: 539836 - RNA, 64 nt, Human Herpes Virus 1; identical to SEQ ID NO: 537822

SEQ ID NO: 539837 - RNA, 64 nt, Human Herpes Virus 1; identical to SEQ ID NO: 537823

SEQ ID NO: 539838 - RNA, 64 nt, Human Herpes Virus 1; identical to SEQ ID NO: 537824

SEQ ID NO: 539839 - RNA, 64 nt, Human Herpes Virus 1; identical to SEQ ID NO: 537816

SEQ ID NO: 539840 - RNA, 64 nt, Human Herpes Virus 1; identical to SEQ ID NO: 537822

SEQ ID NO: 539841 - RNA, 64 nt, Human Herpes Virus 1; identical to SEQ ID NO: 537821

SEQ ID NO: 539842 - RNA, 64 nt, Human Herpes Virus 2; identical to SEQ ID NO: 537772

SEQ ID NO: 539843 - RNA, 64 nt, Human Herpes Virus 1; identical to SEQ ID NO: 537828

SEQ ID NO: 539844 - RNA, 64 nt, Human Herpes Virus 1; identical to SEQ ID NO: 537829

SEQ ID NO: 539845 - RNA, 64 nt, Human Herpes Virus 1; identical to SEQ ID NO: 537830

SEQ ID NO: 539846 - RNA, 64 nt, Human Herpes Virus 1; identical to SEQ ID NO: 537831

SEQ ID NO: 539847 - RNA, 64 nt, Human Herpes Virus 1; identical to SEQ ID NO: 537832

SEQ ID NO: 539848 - RNA, 64 nt, Human Herpes Virus 1; identical to SEQ ID NO: 537833

SEQ ID NO: 539849 - RNA, 64 nt, Human Herpes Virus 1; identical to SEQ ID NO: 537834

SEQ ID NO: 539850 - RNA, 64 nt, Human Herpes Virus 1; identical to SEQ ID NO: 537835

SEQ ID NO: 539851 - RNA, 64 nt, Human Herpes Virus 1; identical to SEQ ID NO: 537836

SEQ ID NO: 539852 - RNA, 64 nt, Human Herpes Virus 1; identical to SEQ ID NO: 537837

SEQ ID NO: 539853 - RNA, 64 nt, Human Herpes Virus 1; identical to SEQ ID NO: 537838

SEQ ID NO: 539854 - RNA, 64 nt, Human Herpes Virus 1; identical to SEQ ID NO: 537839

SEQ ID NO: 539855 - RNA, 64 nt, Human Herpes Virus 1; identical to SEQ ID NO: 537831

SEQ ID NO: 539856 - RNA, 64 nt, Human Herpes Virus 1
ccacgugaugccccccgaguacccgacggcccccgcgucggaguggaacagccucuggaugacc

SEQ ID NO: 539857 - RNA, 64 nt, Human Herpes Virus 1
cuauaaccccgccgggaucauggggagcugcugggcgucggaggaggugcgcgcgccucugguc

SEQ ID NO: 539858 - RNA, 64 nt, Human Herpes Virus 1
uggcgguguggcccccgccucccccguggaggacgcgucggacgcgucccucgggcagccggag

SEQ ID NO: 539859 - RNA, 64 nt, Human Herpes Virus 1
cucugggagcgagccaacagacagccaggacuccgcgucggacgcggucagccacggcgauccg

SEQ ID NO: 539860 - RNA, 53 nt, Human Herpes Virus 1
aggaucgccccgcaucggcgauggcgucggagaacaagcagcgccccggcucc

SEQ ID NO: 539861 - RNA, 64 nt, Human Herpes Virus 1
cuuugugacugagaacgugcuguucucggagcgcgcgucggaggcguacuuccugggccagcuc

SEQ ID NO: 539862 - RNA, 64 nt, Human Herpes Virus 1
ucgacgggaaggcccgcgagcccgacgacggcgcgcgucggaagccccgcccacaucccaucgc

SEQ ID NO: 539863 - RNA, 64 nt, Human Herpes Virus 1
gccaauuccgccaaccuccuccggagagggcgaggcgucggagcggggccgcucacgccaagcc

SEQ ID NO: 539864 - RNA, 64 nt, Human Herpes Virus 1; identical to SEQ ID NO: 539856

SEQ ID NO: 539865 - RNA, 53 nt, Human Herpes Virus 1; identical to SEQ ID NO: 539860

SEQ ID NO: 539866 - RNA, 64 nt, Human immunodeficiency virus type 1 (BLAI)
uaacagaagaagcagagcuagaacuggcagaaaacagagagauucuaaaagaaccaguacaugg

SEQ ID NO: 539867 - RNA, 64 nt, Human immunodeficiency virus type 1 (BLAI)
aguagcacccaccaaggcaaagagaagaguggugcagagagaaaaaagagcagugggaauagga

SEQ ID NO: 539868 - RNA, 64 nt, Human Herpes Virus 2
uggucaccuauauaugcgacgaccacaugccgcggguggugacgcacaccaacgccacggccug

SEQ ID NO: 539869 - RNA, 64 nt, Human Herpes Virus 2
uccagcugcgccucacgaagccccagcucacgaagguggugaacgccgucggggacgagaccgc

SEQ ID NO: 539870 - RNA, 64 nt, Human Herpes Virus 2
uuccgccccacacccagccggucuuuuccaagcggguggugauguuugcuuggucguuccuggu

SEQ ID NO: 539871 - RNA, 64 nt, Human Herpes Virus 2
cagccgggacgacgaccaugggccccggucuguggguggugauggggguccuggugggcguugc

SEQ ID NO: 539872 - RNA, 64 nt, Human Herpes Virus 2
agacgauuaucggcaaccgcgaggcccugcacacgguggugaacaacaucaagcagcuggugga

SEQ ID NO: 539873 - RNA, 64 nt, Human Herpes Virus 4 (Epstein Barr virus)
gccuggcucaaacgcugcuugguaaucuguacgggaacaucaaccaguggguaccguccuucgg

SEQ ID NO: 539874 - RNA, 64 nt, Human Herpes Virus 4 (Epstein Barr virus)
ccaccaucaaugucaccacuaagguuacugcacagaacaucacugccaccgaggccggaacagg

SEQ ID NO: 539875 - RNA, 64 nt, Human Herpes Virus 4 (Epstein Barr virus)
gccggacccaagccgcgaccacauaugagauugagaacaucagggcuggccuggaggccauuau

SEQ ID NO: 539876 - RNA, 64 nt, Human Herpes Virus 4 (Epstein Barr virus)
ugcgcauguccaaggugcugaugcugugccccaggaacaucaagaucaagaacaggguggucuu

SEQ ID NO: 539877 - RNA, 64 nt, Human Herpes Virus 1
gcccccgccuucuuguucgcugcugcugcgccaguggcuccacguucccgaguccgcguccgac

SEQ ID NO: 539878 - RNA, 64 nt, Human Herpes Virus 1
gcugcuguacaccccggacgcggaggccaugggguggcuccagaacccgcgcgugguccccggg

SEQ ID NO: 539879 - RNA, 64 nt, Human Herpes Virus 1; identical to SEQ ID NO: 539877

SEQ ID NO: 539880 - RNA, 64 nt, Human Herpes Virus 1; identical to SEQ ID NO: 539878

SEQ ID NO: 539881 - RNA, 64 nt, Human Herpes Virus 1; identical to SEQ ID NO: 539877

SEQ ID NO: 539882 - RNA, 64 nt, Human Herpes Virus 1; identical to SEQ ID NO: 539878

SEQ ID NO: 539883 - RNA, 64 nt, Human Herpes Virus 1; identical to SEQ ID NO: 539877

SEQ ID NO: 539884 - RNA, 64 nt, Human Herpes Virus 1; identical to SEQ ID NO: 539878

SEQ ID NO: 539885 - RNA, 64 nt, Human Herpes Virus 2
ucccgacagccccgauggcgugggccgagagugccguggaaaccaccaccagcccgcgcgagcu

SEQ ID NO: 539886 - RNA, 64 nt, Human Herpes Virus 2
ucacggccaaacaucgcugccuggagcgucucaucguggaaacgggaucggcgguauccacggc

SEQ ID NO: 539887 - RNA, 64 nt, Human Herpes Virus 4 (Epstein Barr virus)
ucagggccaagacauagagaugguguccggagaccccaaaaacguccaaguugcauuggcugca

SEQ ID NO: 539888 - RNA, 64 nt, Human Herpes Virus 4 (Epstein Barr virus)
ugaggcggccguggcggcggauuggcaccgcgcccccaaaaaacucuuugucuccucucaauau

SEQ ID NO: 539889 - RNA, 64 nt, Human Herpes Virus 4 (Epstein Barr virus)
cgcggaaucaggaccauggagcagcucccucgaacccaaaaaucuggaggcucggcccuccgca

SEQ ID NO: 539890 - RNA, 62 nt, Human Herpes Virus 4 (Epstein Barr virus)
gggcugggggaggcggcgcaagggcuggauaccccugugaauggacagguacuaacacgcaa

SEQ ID NO: 539891 - RNA, 62 nt, Human Herpes Virus 4 (Epstein Barr virus)
ggggaauccacagacauccgcuacuuuggcuccccugugauuauuccuccuaauuucaucac

SEQ ID NO: 539892 - RNA, 64 nt, Human Herpes Virus 1
gcugcgggaccgcuggagccugguggccgagcggcggcggcaggccgggaucgccggacacacc

SEQ ID NO: 539893 - RNA, 64 nt, Human Herpes Virus 1
ccauggacagggaggcggcucgagccaucagccgcggcggcaagccccccucgaccauggccaa

SEQ ID NO: 539894 - RNA, 64 nt, Human Herpes Virus 1
ugcucaugcgccugcgcggggaccugcgcguggccggcggcagcgaggccgccguggccgccgu

SEQ ID NO: 539895 - RNA, 64 nt, Human Herpes Virus 1
gcccgccgagggccccgacccccugggcggcuggcggcggcagcccccggggcccagccacacg

SEQ ID NO: 539896 - RNA, 64 nt, Human Herpes Virus 1
uguaccccgacgcgccgccgcugcgccugugccgcggcggcaacgugcgcuaccgcgugcgcac

SEQ ID NO: 539897 - RNA, 64 nt, Human Herpes Virus 1
gggggauuuccucuccgcgggcccgcguacaccacggcggcaggggucguacgcgacacgcugc

SEQ ID NO: 539898 - RNA, 64 nt, Human Herpes Virus 1
guccuccccccgcgagccuggcccggcguggccucggcggcagccggaugccuccugcccgcgg

SEQ ID NO: 539899 - RNA, 64 nt, Human Herpes Virus 1
cggguuagcgcggggggccacgaccccguguacgcggcggcauguaacguggcgaccgcggacu

SEQ ID NO: 539900 - RNA, 64 nt, Human Herpes Virus 1
ugauacaccgcccccccgaccgccgguuggggcccggcggcacccgacgacggagcuggacauc

SEQ ID NO: 539901 - RNA, 64 nt, Human Herpes Virus 1
gccaggguaagaccccgcggggcgggcgcgacggcggcggcaagggcgcggcgggcggguucga

SEQ ID NO: 539902 - RNA, 64 nt, Human Herpes Virus 1
ccacggaaaccaggcccccucugccgccggccgccggcggcaccgagacgcgcgucucguggac

SEQ ID NO: 539903 - RNA, 64 nt, Human Herpes Virus 1
ggcugagucccuccaaucgccgguuccucccgcucggcggcagcccggaggcgcccgcggaaac

SEQ ID NO: 539904 - RNA, 64 nt, Human Herpes Virus 1
cgucgcucccguccauucccaucgcgaggggguccggcggcaccuaccccggccuccauccgcg

SEQ ID NO: 539905 - RNA, 64 nt, Human Herpes Virus 1; identical to SEQ ID NO: 539896

SEQ ID NO: 539906 - RNA, 64 nt, Human Herpes Virus 1; identical to SEQ ID NO: 539895

SEQ ID NO: 539907 - RNA, 64 nt, Human Herpes Virus 1; identical to SEQ ID NO: 539894

SEQ ID NO: 539908 - RNA, 64 nt, Human Herpes Virus 1; identical to SEQ ID NO: 539892

SEQ ID NO: 539909 - RNA, 64 nt, Human Herpes Virus 1; identical to SEQ ID NO: 539893

SEQ ID NO: 539910 - RNA, 64 nt, Human Herpes Virus 1; identical to SEQ ID NO: 539894

SEQ ID NO: 539911 - RNA, 64 nt, Human Herpes Virus 1; identical to SEQ ID NO: 539895

SEQ ID NO: 539912 - RNA, 64 nt, Human Herpes Virus 1; identical to SEQ ID NO: 539896

SEQ ID NO: 539913 - RNA, 64 nt, Human Herpes Virus 1; identical to SEQ ID NO: 539897

SEQ ID NO: 539914 - RNA, 64 nt, Human Herpes Virus 1; identical to SEQ ID NO: 539898

SEQ ID NO: 539915 - RNA, 64 nt, Human Herpes Virus 1; identical to SEQ ID NO: 539899

SEQ ID NO: 539916 - RNA, 64 nt, Human Herpes Virus 1; identical to SEQ ID NO: 539900

SEQ ID NO: 539917 - RNA, 64 nt, Human Herpes Virus 1; identical to SEQ ID NO: 539901

SEQ ID NO: 539918 - RNA, 64 nt, Human Herpes Virus 1; identical to SEQ ID NO: 539902

SEQ ID NO: 539919 - RNA, 64 nt, Human Herpes Virus 1; identical to SEQ ID NO: 539903

SEQ ID NO: 539920 - RNA, 64 nt, Human Herpes Virus 1; identical to SEQ ID NO: 539904

SEQ ID NO: 539921 - RNA, 64 nt, Human Herpes Virus 1; identical to SEQ ID NO: 539896

SEQ ID NO: 539922 - RNA, 64 nt, Human Herpes Virus 1; identical to SEQ ID NO: 539895

SEQ ID NO: 539923 - RNA, 64 nt, Human Herpes Virus 1; identical to SEQ ID NO: 539894

SEQ ID NO: 539924 - RNA, 64 nt, Human Herpes Virus 2
cgccgaggggugcgccggaccagggcuggggcgucgaacgcagggauggccgaccccacgcccg

SEQ ID NO: 539925 - RNA, 64 nt, Human Herpes Virus 2
ccgucgguaggcccgcucgcacgagcagccugaccgaacgcaggcgcgugcuguuggccggcgu

SEQ ID NO: 539926 - RNA, 64 nt, Human Herpes Virus 2
ccccuacaacaagucguugggggucugccccauccgaacgcagccccgcuggagcuacuaugac

SEQ ID NO: 539927 - RNA, 64 nt, Human Herpes Virus 2
gacgacuacgacgaagaagacgacgcgggcgugacgaacgcacgccggucagcguucccccccc

SEQ ID NO: 539928 - RNA, 64 nt, Human Herpes Virus 2
uccaccccgaagcccccaugcugaugcaggacggcgaacgcaggcugccgcuuuacgaggcgcu

SEQ ID NO: 539929 - RNA, 64 nt, Human Herpes Virus 2
aaguccgcgcccaagaagaaacccaggggcucaucgaacgcaagcgccuccuccccgacgccca

SEQ ID NO: 539930 - RNA, 64 nt, Human Herpes Virus 2
gcgggaugauguuccuuuguuggaucgcgagcugguagacgaggccgcguguggcggggaggac

SEQ ID NO: 539931 - RNA, 62 nt, Human Herpes Virus 1
gccgacagacgcgcaugaugcgcgugcugucggccgcguagcgcguguugggggggacgagc

SEQ ID NO: 539932 - RNA, 62 nt, Human Herpes Virus 1
cgcuauacguccaccacgaggugcgcgugcuugccgcguaccgcagggcguauuauggaagc

SEQ ID NO: 539933 - RNA, 62 nt, Human Herpes Virus 1
uguaucuauuuuugacccgcgagauccuaugggccgcguacgccgagcagaugaugcggccc

SEQ ID NO: 539934 - RNA, 64 nt, Human Herpes Virus 1
cgcaacuaaaggggcgugauuucgggggcgaccacacggccaagcuggaauuccuggcccccga

SEQ ID NO: 539935 - RNA, 64 nt, Human Herpes Virus 1
cccccgauuuguacguguacguggaucccgcguucacggccaacacccgagccuccgggaccgg

SEQ ID NO: 539936 - RNA, 64 nt, Human Herpes Virus 1
cgcgcgacgccgccgaugcgguacgggcccacgucacggccaacuaccgcgggacgcggguggg

SEQ ID NO: 539937 - RNA, 64 nt, Human Herpes Virus 1
cacccagggggaggccgccggggccccucucgcccacggccaccacguguacugccagcgaguc

SEQ ID NO: 539938 - RNA, 64 nt, Human Herpes Virus 1
auguggggcgugacggaaccaccccgcgugccaucacggccaaggcgcgggaugcuccgcaacg

SEQ ID NO: 539939 - RNA, 64 nt, Human Herpes Virus 1
aaacuuccuguugaucgauacggggguguacgcccacggccacagccugcgcuugccguauuuu

SEQ ID NO: 539940 - RNA, 64 nt, Human Herpes Virus 1
acccaccccaacgccuccccuguugguauagguccacggccacuggccgggagcaccacauaac

SEQ ID NO: 539941 - RNA, 64 nt, Human Herpes Virus 1
cacaccagcccggccugacgauugaaaaguggcucacggccaacgccagccgcaucaccaacua

SEQ ID NO: 539942 - RNA, 64 nt, Human Herpes Virus 1
agcgccugaucguggagacggguucggcgguguccacggccaccgccgccagcgacguacaguu

SEQ ID NO: 539943 - RNA, 64 nt, Human Herpes Virus 1
acggccagagcgacccgucccgggccuucgcggccacggccaacccgugggcgucgcagcgauu

SEQ ID NO: 539944 - RNA, 64 nt, Human Herpes Virus 1
caaggagggggaugucaccgcccucauguacgaccacggccagagcgacccgucccgggccuuc

SEQ ID NO: 539945 - RNA, 64 nt, Human Herpes Virus 1
gugcgcccaggugccgcggcgcgcagggauggaccacggccaggacgccgugugugaguuuauc

SEQ ID NO: 539946 - RNA, 64 nt, Human Herpes Virus 1
gggaggccgucgaggccuggcucguggaccucaccacggccacgcagcccuccguggccgugcc

SEQ ID NO: 539947 - RNA, 64 nt, Human Herpes Virus 1
ucgacaagaucaacgccaagggggucugucgguccacggccaaguacgugcgcaacaaccugga

SEQ ID NO: 539948 - RNA, 64 nt, Human Herpes Virus 1
ucgagacccugcaguacguggaccaggcgguccccacggccauggggcggcuggagaccaucau

SEQ ID NO: 539949 - RNA, 64 nt, Human Herpes Virus 1
uuggggggcgugccggcccuucggccucgaccgucacggccaugaaagggcuacgccgaguacg

SEQ ID NO: 539950 - RNA, 64 nt, Human Herpes Virus 1
guggcccugaaggguaccccaucgcgaccagccccacggccauccccacccuccgccgacccac

SEQ ID NO: 539951 - RNA, 64 nt, Human Herpes Virus 1
cggcaaacggggcggacgacccggcguuucuggccacggccaagcugcgcgccgccauggcggc

SEQ ID NO: 539952 - RNA, 64 nt, Human Herpes Virus 1
uguuguuggccguggccguguaugccguggucggcgccgugaccucccgcuacgaccgcgcccu

SEQ ID NO: 539953 - RNA, 64 nt, Human Herpes Virus 1
ccggcggcagcgaggccgccguggccgccgugcgcgccgugagccuggucgccggggcccuggg

SEQ ID NO: 539954 - RNA, 64 nt, Human Herpes Virus 1
ccaagaugcuguuuuaccuggagcgcugcgacggcgccgugaucgucgggcgccaggagaugga

SEQ ID NO: 539955 - RNA, 64 nt, Human Herpes Virus 1; identical to SEQ ID NO: 539953

SEQ ID NO: 539956 - RNA, 64 nt, Human Herpes Virus 2
caacaguuuccagcaccaguacauccccgcguacggccaggaccucgagcgccugucgcgccuc

SEQ ID NO: 539957 - RNA, 64 nt, Human Herpes Virus 2
cugcuucaagauucugcgccaccgcaacaagcagggccaggaaacgucgaucucguacucuagc

SEQ ID NO: 539958 - RNA, 64 nt, Human Herpes Virus 2
cgcuguguguuucgucuguccccagggaauccggggccaggacuuuaaccugcuuuucgucgac

SEQ ID NO: 539959 - RNA, 64 nt, Human Herpes Virus 2
caacccgcccucgagaugugccuuccaguuccacggccaggauggguccgacgaggccuucccg

SEQ ID NO: 539960 - RNA, 64 nt, Human Herpes Virus 2
gccccccgacaucaccacguggccccugcuugagggccaggaaacgcccgcggcccgcgccggc

SEQ ID NO: 539961 - RNA, 64 nt, Human Herpes Virus 2
gccgggcguccuuuccgcgccccagguccguuacggccaggagccaguccguucgcggacgccg

SEQ ID NO: 539962 - RNA, 64 nt, Human Herpes Virus 2; identical to SEQ ID NO: 536872

SEQ ID NO: 539963 - RNA, 64 nt, Human Herpes Virus 2; identical to SEQ ID NO: 536873

SEQ ID NO: 539964 - RNA, 64 nt, Human Herpes Virus 2; identical to SEQ ID NO: 536874

SEQ ID NO: 539965 - RNA, 64 nt, Human Herpes Virus 2; identical to SEQ ID NO: 536875

SEQ ID NO: 539966 - RNA, 64 nt, Human Herpes Virus 2; identical to SEQ ID NO: 536876

SEQ ID NO: 539967 - RNA, 64 nt, Human Herpes Virus 2; identical to SEQ ID NO: 536877

SEQ ID NO: 539968 - RNA, 64 nt, Human Herpes Virus 2; identical to SEQ ID NO: 536878

SEQ ID NO: 539969 - RNA, 64 nt, Human Herpes Virus 2; identical to SEQ ID NO: 536879

SEQ ID NO: 539970 - RNA, 64 nt, Human Herpes Virus 2; identical to SEQ ID NO: 536880

SEQ ID NO: 539971 - RNA, 64 nt, Human Herpes Virus 2; identical to SEQ ID NO: 536881

SEQ ID NO: 539972 - RNA, 64 nt, Human Herpes Virus 2; identical to SEQ ID NO: 536882

SEQ ID NO: 539973 - RNA, 64 nt, Human Herpes Virus 2; identical to SEQ ID NO: 536883

SEQ ID NO: 539974 - RNA, 64 nt, Human Herpes Virus 2; identical to SEQ ID NO: 536884

SEQ ID NO: 539975 - RNA, 64 nt, Human Herpes Virus 2; identical to SEQ ID NO: 536885

SEQ ID NO: 539976 - RNA, 64 nt, Human Herpes Virus 2; identical to SEQ ID NO: 536877

SEQ ID NO: 539977 - RNA, 64 nt, Human Herpes Virus 2
acgucacccccagggggcgguugcgguucguucuggacgggaguuccgacgacgcguacguggc

SEQ ID NO: 539978 - RNA, 57 nt, Human Herpes Virus 2
gcuccggaggcccccuggcgauggcuaggacgggacgccgcgcggccgucgguaggc

SEQ ID NO: 539979 - RNA, 64 nt, Human Herpes Virus 2
cggccgugccucggggggaaggggagcggccgggggacgggaacggggacgaggauaaggacga

SEQ ID NO: 539980 - RNA, 64 nt, Human Herpes Virus 2
gccaauccaugacucuguaugucacagagaaggcggacgggacgcuccccgccuccacccuggu

SEQ ID NO: 539981 - RNA, 64 nt, Human Herpes Virus 2
ccgaggccauugcccugcucacgggggaggcccuggacgggacgggcauuagccugcaucgcca

SEQ ID NO: 539982 - RNA, 59 nt, Human Herpes Virus 4 (Epstein Barr virus)
accaugccucuguaaauguccucaugccaggaagcgacuacacagccgugucgcugcag

SEQ ID NO: 539983 - RNA, 64 nt, Human Herpes Virus 2
gaagcgcugcuuggucccguagugauggcgcaggaccacggagauggagcgacggcuccacagc

SEQ ID NO: 539984 - RNA, 64 nt, Human Herpes Virus 2
caugacccccgccgaacuagagguuauauucccgaccacggacgccaagcugaacuaccucucg

SEQ ID NO: 539985 - RNA, 64 nt, Human Herpes Virus 2
cgauacgccccggaggacgccgagcggccaacagaccacggaccccuguuaccgucgacgcacc

SEQ ID NO: 539986 - RNA, 64 nt, Human Herpes Virus 2
ccucuaucauaccaacacggucgcguacgugcauaccacggauaccgaucuccugcugaugggc

SEQ ID NO: 539987 - RNA, 64 nt, Human Herpes Virus 4 (Epstein Barr virus)
cagauuuauaacacacaccgaacauguggaucuggauuuuaacucaguauuuuuagagauauuu

SEQ ID NO: 539988 - RNA, 64 nt, Human Herpes Virus 4 (Epstein Barr virus)
accucaaggccaagucacccggcggaaauuuuaugauuuuaacaagcggaaacaaggaagcgcg

SEQ ID NO: 539989 - RNA, 64 nt, Human Herpes Virus 4 (Epstein Barr virus)
gggauaguguuucagguaaagcucauggaggaaagauuuuaauggucgggcauuuccucuguua

SEQ ID NO: 539990 - RNA, 64 nt, Human Herpes Virus 4 (Epstein Barr virus)
ucgauguaaguuugugccuaauaaaugacauagagauuuuaaugaagagaaucaauagcguguu

SEQ ID NO: 539991 - RNA, 64 nt, Human Herpes Virus 4 (Epstein Barr virus)
ugguugaucuccuuuggcuccuccuguuucuggcgauuuuaaucuggauguauuaccauggaca

SEQ ID NO: 539992 - RNA, 64 nt, Human Herpes Virus 1
ggagggcucguuggggcccguggggaaccacacucccccauaacccgacgccacccccggcgag

SEQ ID NO: 539993 - RNA, 64 nt, Human Herpes Virus 1
cucgggaacggacgggguucccgcugcccacuuccccccauaagguccguccgguccucuaacg

SEQ ID NO: 539994 - RNA, 64 nt, Human Herpes Virus 1
ggagggcggccagcacgcugugguugcuuggccuggacggcacagacgcgcccccuggggcgcu

SEQ ID NO: 539995 - RNA, 64 nt, Human Herpes Virus 1
cccgccuccucagcgccccgggcccccguguccgggacggcagaccccgccuuucuucucaagg

SEQ ID NO: 539996 - RNA, 63 nt, Human Herpes Virus 2
acgccagggccggcggccagcggaacuggaacugugccugacggcccgcgccccugcucguug

SEQ ID NO: 539997 - RNA, 63 nt, Human Herpes Virus 2
ggcgcgcggcgcgagcucccugcggcuggcgcggugccugacgccggccaaccucauccgcgg

SEQ ID NO: 539998 - RNA, 64 nt, Human Herpes Virus 2
agcauuuccucgccgcgaaucgcuaccucgaaacccgggacauuaugccgaucgacuggucggu

SEQ ID NO: 539999 - RNA, 64 nt, Human Herpes Virus 2
gcgucguggggcuccuggugcuggccucuguguuccgggacagguuucccugccuuuacgcccc

SEQ ID NO: 540000 - RNA, 64 nt, Human Herpes Virus 2
acggcgagaaaaacgucaccuggucccuguucgaccgggacaccagcaugucgcucgccgacuu

SEQ ID NO: 540001 - RNA, 64 nt, Human Herpes Virus 2
ucaucacccccguccgcgucgagccggggaucuaccgggacauccggcgaaacagccgccuggc

SEQ ID NO: 540002 - RNA, 64 nt, Human Herpes Virus 2
ucagcgacgcccaggccgcccgggggagcuguucccgggacaccgugcgccaucgccaggcgac

SEQ ID NO: 540003 - RNA, 64 nt, Human Herpes Virus 2
caccggggggccgcggcgcggucggcgggagcugccgggacaagauacaacggacccggcgcga

SEQ ID NO: 540004 - RNA, 64 nt, Human Herpes Virus 2
ccguuacggccaggagccaguccguucgcggacgccgggacagcgccaucacgcgggccccgcg

SEQ ID NO: 540005 - RNA, 64 nt, Human Herpes Virus 2
auucgagaugcugcuggccuucaugaccuucgucaagcaguacggccccgaguucgugaccggg

SEQ ID NO: 540006 - RNA, 64 nt, Human Herpes Virus 4 (Epstein Barr virus)
gguccaggagucugcugcggcuaugcagcccauaccuauagauccugggccccccggaggggcg

SEQ ID NO: 540007 - RNA, 64 nt, Human Herpes Virus 1
guugucucggaggugcuucuguuuggcgcccccgaccucggacgccacaccaucucccccgugu

SEQ ID NO: 540008 - RNA, 64 nt, Human Herpes Virus 1
cacgcacuugcggcaagacccgggcgaugagccaaccucggaugacucagggcucuacccucug

SEQ ID NO: 540009 - RNA, 64 nt, Human Herpes Virus 2
ccgcgccgaccaucgcgacgagcugcagcuucacaaggccaaguuggccugcggcaacgaguuc

SEQ ID NO: 540010 - RNA, 64 nt, Human Herpes Virus 2
gacgcgccacgcggagggcggccccgagcccggggcccgcgacccggcgcccggccucacgcgc

SEQ ID NO: 540011 - RNA, 64 nt, Human Herpes Virus 2
cgacuccuucaugcaggagaucaucggggggcaggcccgcgagaccggcgacgaccggcccguc

SEQ ID NO: 540012 - RNA, 64 nt, Human Herpes Virus 2
ugacggcauucccgccccgcgccagccccuggacgcccgcgaccggcgcacggaugucgugauc

SEQ ID NO: 540013 - RNA, 64 nt, Human Herpes Virus 2
gcccgcgcucaugcuggaguacuucugucggugcgcccgcgaggagagcaagcgcgugccccca

SEQ ID NO: 540014 - RNA, 64 nt, Human Herpes Virus 2
cguguuuaacgcgcgcaccugcgucaccuuugccgcccgcgaggagggcgcgucguccagcacc

SEQ ID NO: 540015 - RNA, 64 nt, Human Herpes Virus 2
ccguuacgccggaggaaacggcagucgccuccccgcccgcgacugcauccguggagucgucgcc

SEQ ID NO: 540016 - RNA, 64 nt, Human Herpes Virus 2
cgacccccgcccccggggacacagggacgcccgcgcccgcgagcggcgagauagccccgcccaa

SEQ ID NO: 540017 - RNA, 64 nt, Human Herpes Virus 2
ggacccucggcgcggacgacgaggaggcgggggugcccgcgagggccccgggggcggcgccccg

SEQ ID NO: 540018 - RNA, 64 nt, Human Herpes Virus 2
cgcaacacccggcgccaagcgccccgcggaccccgcccgcgaccccgauagucccccgaagcgg

SEQ ID NO: 540019 - RNA, 64 nt, Human Herpes Virus 2
gcugcgguuuccggucccgcucccaacgccccuggcccgcgagauagucgcgcggcuggucgcc

SEQ ID NO: 540020 - RNA, 64 nt, Human Herpes Virus 2
caccugcgccagcgaccccgcccugcuacgcagcgcccgcgauggggaggcccacgcgcgagag

SEQ ID NO: 540021 - RNA, 64 nt, Human Herpes Virus 2
cuucuccuccauccgccagcccguggugcagcacgcccgcgagagcgcggcgggggagaacgcg

SEQ ID NO: 540022 - RNA, 64 nt, Human Herpes Virus 2
gcgugugcaguucgagguccaccagccccucaucgcccgcgacggcccgcaccccgucgagcag

SEQ ID NO: 540023 - RNA, 62 nt, Human Herpes Virus 2
cgaaucccccaaggaacccaauggccgcuccugcccgcgaccccccggguuaccgguacgcc

SEQ ID NO: 540024 - RNA, 64 nt, Human Herpes Virus 2
caucgccgagauacgcgaccuggcgcgcacguuugcccgcgagguggggggaguuuaguucaaa

SEQ ID NO: 540025 - RNA, 64 nt, Human Herpes Virus 2
gcgcgucgaccugggcgacugcaucggccgggaugcccgcgaggccaucgaccgcauguuugcg

SEQ ID NO: 540026 - RNA, 64 nt, Human Herpes Virus 2
agaugcugcgggucagcguccacggcgaggugcugcccgcgaccuucgccgcggucgccaacgg

SEQ ID NO: 540027 - RNA, 64 nt, Human Herpes Virus 2
cggaggagggggggcggaggcguggcgcggggacgcccgcgagcgaggacggggagcgcggccc

SEQ ID NO: 540028 - RNA, 64 nt, Human Herpes Virus 2
agcuccuggcggccugucacgugguaggcgugccgcccgcgagcgcgcucgacgaggacgugga

SEQ ID NO: 540029 - RNA, 64 nt, Human Herpes Virus 2
cguggggcgccucgauggaccugccccgaccgccgcccgcgacccucgucgccaccacccucac

SEQ ID NO: 540030 - RNA, 64 nt, Human Herpes Virus 2
aagagaugcgggucgaggcgcccugggcgcggccgcccgcgaccuuagacgcccucgcccgcgg

SEQ ID NO: 540031 - RNA, 64 nt, Human Herpes Virus 2
ccaucacccacccccugcgggggucgaggcggaggcccgcgagacucuuugucggugugguccc

SEQ ID NO: 540032 - RNA, 64 nt, Human Herpes Virus 2
ggccccgcgacgugcuguccgcgaugccgcccuggcccgcgaggguggaggggggcgaguggac

SEQ ID NO: 540033 - RNA, 64 nt, Human Herpes Virus 2
gcgcuaccucaccccacgauggcggcgacgacgggcccgcgagccguggucaccgguguucgga

SEQ ID NO: 540034 - RNA, 64 nt, Human Herpes Virus 2; identical to SEQ ID NO: 540010

SEQ ID NO: 540035 - RNA, 64 nt, Human Herpes Virus 2; identical to SEQ ID NO: 540017

SEQ ID NO: 540036 - RNA, 60 nt, Human Herpes Virus 2
cagaccgaguacaucugccggcuggcgggauacccggacggaauuccgguccuagagcac

SEQ ID NO: 540037 - RNA, 60 nt, Human Herpes Virus 2
gccgacgaugacgccccggaugacguggccuacccggaggacuacgcggaggggcguuuu

SEQ ID NO: 540038 - RNA, 60 nt, Human Herpes Virus 2
ccggagacgacguccgcgguccgcggggcguacccggaccccauggccagccugucgccg

SEQ ID NO: 540039 - RNA, 60 nt, Human Herpes Virus 2
gggggggcgugcgacccccgguuucuuuuuuacccggaccccacguacgggggccacaug

SEQ ID NO: 540040 - RNA, 60 nt, Human Herpes Virus 2; identical to SEQ ID NO: 540038

SEQ ID NO: 540041 - RNA, 64 nt, Human Herpes Virus 4 (Epstein Barr virus)
cuccgagggccuguuugauuucuccaagagaagcaucgcccacuccaaaaaccgacacgagugc

SEQ ID NO: 540042 - RNA, 64 nt, Human Herpes Virus 4 (Epstein Barr virus)
ugaccacaagagcgccgccuucgugcugggggcaaucgcccacuaccuggcccucuaucgcaga

SEQ ID NO: 540043 - RNA, 64 nt, Human Herpes Virus 4 (Epstein Barr virus); identical to SEQ ID NO: 540041

SEQ ID NO: 540044 - RNA, 64 nt, Human Herpes Virus 4 (Epstein Barr virus); identical to SEQ ID NO: 540042

SEQ ID NO: 540045 - RNA, 64 nt, Human Herpes Virus 1
aggacgcccuggcgcacgggaccccgcuacaaccggaccacaucgccgccacccuggacgcgga

SEQ ID NO: 540046 - RNA, 64 nt, Human Herpes Virus 1
ucuccgaugccaccgaucuggaggccgccgguucggaccacacgcucgcgucccaguccgacac

SEQ ID NO: 540047 - RNA, 64 nt, Human Herpes Virus 1
ccgagguggacgacgccggcccggcggacccaaaggaccacagcaaacccuccuuuuaccgcuu

SEQ ID NO: 540048 - RNA, 62 nt, Human Herpes Virus 4 (Epstein Barr virus)
uuccucuucugaaacaucgaacgaugagugauuucgcccauguaacaagaacugggaugaac

SEQ ID NO: 540049 - RNA, 64 nt, Human Herpes Virus 4 (Epstein Barr virus)
ccucaacccccgaguagccggacgccuagccuccucccucuacguguacguugauccggccuau

SEQ ID NO: 540050 - RNA, 64 nt, Human Herpes Virus 4 (Epstein Barr virus)
caugaucgccauuugcugucggccuccgugguuuucccucuaaugcugcuccggagccagcuuc

SEQ ID NO: 540051 - RNA, 64 nt, Human Herpes Virus 4 (Epstein Barr virus)
gugccgggcgcugcgcgaggccguccuaaccgugucccucuacaacaagaccugggggcggucc

SEQ ID NO: 540052 - RNA, 64 nt, Human Herpes Virus 2
ccuggaccuucccccggucccccccaacgcauacacgcccuaucaucugagggaguaugcgacg

SEQ ID NO: 540053 - RNA, 64 nt, Human Herpes Virus 2
aaugcgcuuuugcccgcccccaucacgcucgacgacgcccuagagucgcuggacgacacccggc

SEQ ID NO: 540054 - RNA, 64 nt, Human Herpes Virus 2
ccgccgucgaccacacccucccuggguucggcaagggcggcaccggccgcgggucgcgccccca

SEQ ID NO: 540055 - RNA, 64 nt, Human Herpes Virus 2
guguucaacaucccccgggagacggcggcggagcgggcggcagugcugcaggcccagcgcaccg

SEQ ID NO: 540056 - RNA, 64 nt, Human Herpes Virus 2
cguucgcaccaacaacccccggggacgacgcggggggcggcacugccgccccccagaccugcgg

SEQ ID NO: 540057 - RNA, 64 nt, Human Herpes Virus 2
ggacgaucccgggcccuuggguuccgcggacgccgggcggcaagaccugccccggcgcgucguc

SEQ ID NO: 540058 - RNA, 64 nt, Human Herpes Virus 2
caacauuaucgucaucgacgaggccgggcuccuggggcggcaccuacucacgaccgugguguau

SEQ ID NO: 540059 - RNA, 64 nt, Human Herpes Virus 2
gcguguuucaggccgggaacugggccagccugcugggcggcaaaaacgcgugcccgcugcugau

SEQ ID NO: 540060 - RNA, 64 nt, Human Herpes Virus 2
ugacgcggcuccgucaggcccgguccugccgcuguggccccagguguuugucgggggccacgcg

SEQ ID NO: 540061 - RNA, 64 nt, Human Herpes Virus 2
ucagcuacgacgcguaccgguccgaugcgcccaauggccccacgggcgcgcccaccgaacagga

SEQ ID NO: 540062 - RNA, 64 nt, Human Herpes Virus 2
ccgccccacgucaccgggggccccggguucccauuggccccagagccccccacgugggcaaccc

SEQ ID NO: 540063 - RNA, 64 nt, Human Herpes Virus 2
ccacaccgaucucaacccgacagccccccgccuuuggccccaggagcucccgcgccugucggcg

SEQ ID NO: 540064 - RNA, 64 nt, Human Herpes Virus 1
gagcucacaugccccgcccccggcccucacccucaucuucgaccgccaucccaucgccgcccuc

SEQ ID NO: 540065 - RNA, 64 nt, Human Herpes Virus 2
ggcgccuccggauaaccaacacgauucacggggccgaggacaugacgcccccucccccgaaccg

SEQ ID NO: 540066 - RNA, 64 nt, Human Herpes Virus 2
agcgcaaccagcuccccgcccggcucuugucgcgcgaggacauagagaccaucgcguucauuaa

SEQ ID NO: 540067 - RNA, 59 nt, Human Herpes Virus 2
uuggauuuugccaccgcgacgcccaagcgccaccagaccguggucccgggcgucgggac

SEQ ID NO: 540068 - RNA, 64 nt, Human Herpes Virus 1
ggcgccuccggaucaccaacacgauucacggcaccgaggacaugacgcccccggccccaaaccg

SEQ ID NO: 540069 - RNA, 64 nt, Human Herpes Virus 1
aacgcaaccagcuucccgcccggcuccugucgcgcgaggacaucgagaccaucgcguucauuaa

SEQ ID NO: 540070 - RNA, 62 nt, Human Herpes Virus 4 (Epstein Barr virus)
gcugucguggggugguggaggcccagguggccaagcuugaggccgugcgcucagucaucugg

SEQ ID NO: 540071 - RNA, 64 nt, Human Herpes Virus 1
uagccagcagacgcugcuccgccuggccugcgaggugcgccaggucggcgaccgccagccgcgg

SEQ ID NO: 540072 - RNA, 64 nt, Human Herpes Virus 1
acaccaccugcgggaucagccaccuggauaucaagugcgccaacauccucgucaugcugcgguc

SEQ ID NO: 540073 - RNA, 64 nt, Human Herpes Virus 4 (Epstein Barr virus)
agaggaauaagcccccagacaggggagugggcuuguuugugacuucaccaaaggucagggccca

SEQ ID NO: 540074 - RNA, 64 nt, Human Herpes Virus 4 (Epstein Barr virus); identical to SEQ ID NO: 540073

SEQ ID NO: 540075 - RNA, 64 nt, Human Herpes Virus 4 (Epstein Barr virus)
agcugaagaacugcaacuaccccuccucgcccguguuugugauauccaacaacggccuggccac

SEQ ID NO: 540076 - RNA, 64 nt, Human Herpes Virus 4 (Epstein Barr virus)
cccugagcgcagcuaugcgcuacaagcuuaagaaguuugugaacggaccccugguccaucuccg

SEQ ID NO: 540077 - RNA, 64 nt, Human Herpes Virus 4 (Epstein Barr virus)
cagccaucuaccugauguacgucugcuuuaacaaguuugugaacacgcugcugacggauuagau

SEQ ID NO: 540078 - RNA, 64 nt, Human Herpes Virus 4 (Epstein Barr virus)
ccaauauggagccgguucagcagaggcccgucauguuugugagccgugugccugcaaagaaacc

SEQ ID NO: 540079 - RNA, 64 nt, Human Herpes Virus 4 (Epstein Barr virus)
cuacgagucccucucuccagccagcaccugccgaguuugugaucugcucgacacccuggucaau

SEQ ID NO: 540080 - RNA, 64 nt, Human Herpes Virus 4 (Epstein Barr virus)
ccuccagcguggucauaaccccuaccucggcaucguuugugauucccagaaagaagugggaccu

SEQ ID NO: 540081 - RNA, 64 nt, Human Herpes Virus 4 (Epstein Barr virus)
agaccaugaggccagccaagucuacagauucuguguuugugaggaccccggucgaggcgugggu

SEQ ID NO: 540082 - RNA, 59 nt, Human Herpes Virus 2
acccggaaggcacggcgggucauccggccccaccagagagcgacccccccuccccaggg

SEQ ID NO: 540083 - RNA, 59 nt, Human Herpes Virus 2
uucaaguucuuuuuccaccgccucuacgaccaccagaucgugccguccacccccgccau

SEQ ID NO: 540084 - RNA, 59 nt, Human Herpes Virus 2
uuccagcgccugcgcuacgacuuuggcccccaccagagcgaguggcuaggggaggugac

SEQ ID NO: 540085 - RNA, 59 nt, Human Herpes Virus 2
gaucuccgggccgcgcuagccaggaccgaccaccagaaaaaccucuucuggcucccgga

SEQ ID NO: 540086 - RNA, 56 nt, Human Herpes Virus 2
gugucgaucgagccccuuccauuacgggaucgcaggcaccaucgauacaaacgccc

SEQ ID NO: 540087 - RNA, 64 nt, Human Herpes Virus 4 (Epstein Barr virus)
ccucgagaucaaggcccucugcagcuggauaauaucccaggauggcaugcgccucuuucaacac

SEQ ID NO: 540088 - RNA, 64 nt, Human Herpes Virus 4 (Epstein Barr virus)
gugccauggggacccccugccagucggcgcggggucccaggaccacgccccucccucacugccc

SEQ ID NO: 540089 - RNA, 64 nt, Human Herpes Virus 4 (Epstein Barr virus)
ucuuacccucccuggacccagaaccugcaaagauucccaggaugucccaggggacgucggcagg

SEQ ID NO: 540090 - RNA, 64 nt, Human Herpes Virus 4 (Epstein Barr virus)
aaaggaaggccuggaaacuacaaccuacaucaccucccaggaaguccaaaacuccaucuugagc

SEQ ID NO: 540091 - RNA, 60 nt, Human Herpes Virus 4 (Epstein Barr virus)
guugcaugugcacgcagagguguucuuuggacucucuagauaccugccccucuuucucug

SEQ ID NO: 540092 - RNA, 60 nt, Human Herpes Virus 4 (Epstein Barr virus)
gcaacgugcucaucgccaaccgcucccacaacucucuaaggcuggugcccaauccggacu

SEQ ID NO: 540093 - RNA, 60 nt, Human Herpes Virus 4 (Epstein Barr virus)
augugcagggauugggcuugggucagguguacucucuagagacggucccggacuacgugu

SEQ ID NO: 540094 - RNA, 64 nt, Human Herpes Virus 4 (Epstein Barr virus)
cgccagccuagauuuguggaugugaacccaacgcaggcuccagugauccaacuaguccacgcug

SEQ ID NO: 540095 - RNA, 64 nt, Human Herpes Virus 4 (Epstein Barr virus)
uuacauccagacguugcugcucaaccagcuccccaggcuccauaccagggauaccaggagccgc

SEQ ID NO: 540096 - RNA, 64 nt, Human Herpes Virus 4 (Epstein Barr virus)
ccauaccagggauaccaggagccgccggccccccaggcuccauaccagggauaccaggagccgc

SEQ ID NO: 540097 - RNA, 64 nt, Human Herpes Virus 4 (Epstein Barr virus)
ccauaccagggauaccaggagccgccgcccccccaggcuccauaccagggauaccaggagccgc

SEQ ID NO: 540098 - RNA, 64 nt, Human Herpes Virus 4 (Epstein Barr virus)
uuccgaacuuaacauccaaagacgaucacaggucaggcuccagaacaagggaagagcgggagag

SEQ ID NO: 540099 - RNA, 64 nt, Human Herpes Virus 2
aguccgacagcagcggggaguguuccucgucggacgaggacauggaagaccccugcggagacgg

SEQ ID NO: 540100 - RNA, 64 nt, Human Herpes Virus 2
ccccccgaaccgggcggcgccucauggccuugaccgaggacacguccuccgauucgccuacguc

SEQ ID NO: 540101 - RNA, 64 nt, Human Herpes Virus 2
cgcgagacggcgcgggggacgcggccgucugguucgaggacaugacccccgccgaacuagaggu

SEQ ID NO: 540102 - RNA, 64 nt, Human Herpes Virus 2
accccgaggacggcgcggggucucugccccgcaucgaggacacgcuguuugcccuguuccgcgu

SEQ ID NO: 540103 - RNA, 64 nt, Human Herpes Virus 1
cacgaccgucgacauuuggagcgccggucuggugaucuucgagacugccguccacaacgcgucc

SEQ ID NO: 540104 - RNA, 64 nt, Human Herpes Virus 4 (Epstein Barr virus); identical to SEQ ID NO: 537399

SEQ ID NO: 540105 - RNA, 64 nt, Human Herpes Virus 4 (Epstein Barr virus); identical to SEQ ID NO: 537400

SEQ ID NO: 540106 - RNA, 64 nt, Human Herpes Virus 4 (Epstein Barr virus); identical to SEQ ID NO: 537401

SEQ ID NO: 540107 - RNA, 64 nt, Human Herpes Virus 4 (Epstein Barr virus); identical to SEQ ID NO: 537402

SEQ ID NO: 540108 - RNA, 64 nt, Human Herpes Virus 4 (Epstein Barr virus); identical to SEQ ID NO: 537403

SEQ ID NO: 540109 - RNA, 64 nt, Human Herpes Virus 1
gggagacagcuggugggggcgcacgacgcguucugcggcgcaggccucggucagggccguggcc

SEQ ID NO: 540110 - RNA, 64 nt, Human Herpes Virus 1
ccccggccgccugguugcggcccgcguuuggccugcggcgcaccuauucaccguuugucguucg

SEQ ID NO: 540111 - RNA, 64 nt, Human Herpes Virus 1
gagcgucaccgccgugugcgccgggccccaggaggcggcgcacaccggccacccgggccggccc

SEQ ID NO: 540112 - RNA, 64 nt, Human Herpes Virus 1
caugcccgcccucaagguccuugacucgcugguggcggcgcacaacaaagagagcgcgcguccg

SEQ ID NO: 540113 - RNA, 64 nt, Human Herpes Virus 1
caacgccagcccccgcaccggacgcgacgccgccgcggcgcaguaugaucagggcgcgucccua

SEQ ID NO: 540114 - RNA, 64 nt, Human Herpes Virus 1
ucgccuggccgaagcggucguguccgccgaagcggcggcgcaccccgaccacggcgcgcugggc

SEQ ID NO: 540115 - RNA, 64 nt, Human Herpes Virus 1
uauucacgccuggggccacauuaccaucagcaccgcggcgcaguaccggaacgcggugguggaa

SEQ ID NO: 540116 - RNA, 64 nt, Human Herpes Virus 1
cgcccccgcccagcccgcggcgccccgggccgccgcggcgcaggcccgcccgcgccccguggcc

SEQ ID NO: 540117 - RNA, 64 nt, Human Herpes Virus 1
accugauccgcggcgacaacgcgggcguucccgagcggcgcaucuucggcgggugucugcuccc

SEQ ID NO: 540118 - RNA, 62 nt, Human Herpes Virus 1
cguggcuuuggggcgcauccauggcuucggaggcggcgcaacccgacgcggguuuauggagc

SEQ ID NO: 540119 - RNA, 64 nt, Human Herpes Virus 1; identical to SEQ ID NO: 540116

SEQ ID NO: 540120 - RNA, 64 nt, Human Herpes Virus 4 (Epstein Barr virus)
ccggcugcccaagcccacccuccaggggaggcuggaggcggauuuuccagacaguccccugcuu

SEQ ID NO: 540121 - RNA, 64 nt, Human Herpes Virus 4 (Epstein Barr virus)
cauggacgaggacggggaagaggacgaggacgaggaggcggaagaccaggagccccgggcggcu

SEQ ID NO: 540122 - RNA, 64 nt, Human Herpes Virus 4 (Epstein Barr virus)
gcgggcaagcggcggcggcggcccagacagaggagaggcggaggcacacacguaccccccuuau

SEQ ID NO: 540123 - RNA, 64 nt, Human Herpes Virus 4 (Epstein Barr virus)
uaccggcaccuucggggacuuuauggacacgcucgaggcggacagcuucguggaggcccacggg

SEQ ID NO: 540124 - RNA, 64 nt, Human Herpes Virus 1
gcuuuguggccccagcgccccacgggcccgggggcgaggacauccugaacgacguucuaacccu

SEQ ID NO: 540125 - RNA, 64 nt, Human Herpes Virus 1
aaucggacagcagcggggaguguuccucgucggacgaggacauggaagacccccacggagagga

SEQ ID NO: 540126 - RNA, 64 nt, Human Herpes Virus 1
acauuaagaccgaaaauauuuuuauuaacacccccgaggacauuugccugggggacuuuggcgc

SEQ ID NO: 540127 - RNA, 64 nt, Human Herpes Virus 1
gacgcaccgugacuaagcgucccugggcccuggccgaggacaccccucguggccccgacagccc

SEQ ID NO: 540128 - RNA, 64 nt, Human Herpes Virus 1
gggugugcgacgagcuggcggcccaggugucgcacgaggacaacgugcuggccgugguccggcg

SEQ ID NO: 540129 - RNA, 64 nt, Human Herpes Virus 1
cgccggcaugcaccccagagguguucacgcaccucgaggacacccgcgcaugaucuccggaccc

SEQ ID NO: 540130 - RNA, 64 nt, Human Herpes Virus 1
cggcgcaggccucggucagggccguggccagcgccgaggacagcagcggagggcgggcgcgucg

SEQ ID NO: 540131 - RNA, 64 nt, Human Herpes Virus 2
cggugguuacuacgugguggagcagcaguggccgggggcccagacgggaguccgcgucgcccug

SEQ ID NO: 540132 - RNA, 61 nt, Human Herpes Virus 2
guuuccccgucaucgcggcgaugagucagugggggcccagggcgauccuuguccagacgga

SEQ ID NO: 540133 - RNA, 64 nt, Human Herpes Virus 2
ggaccugcguguuuucggggagcuucauuuugugggggcccaggucccccauacaaacuacuac

SEQ ID NO: 540134 - RNA, 64 nt, Human Herpes Virus 2
ccgacccgcagggcggcuggcgccgccagccgccggggcccagccacacgccggcgcccucggc

SEQ ID NO: 540135 - RNA, 64 nt, Human Herpes Virus 2
cucggaacgcgagccugcccgagcuccccgaggcggggcccacgucccguccccccgccgaggu

SEQ ID NO: 540136 - RNA, 64 nt, Human Herpes Virus 2
cggguuugugugcgcggcgucgagucucgggggcggggcccacgagcauucgcugugcgagcag

SEQ ID NO: 540137 - RNA, 64 nt, Human Herpes Virus 2
cggccugcugcagcuaggggagccgcccuccgccggggcccagcaacggcuccucgcgcugcug

SEQ ID NO: 540138 - RNA, 64 nt, Human Herpes Virus 2
ggagaccccccuguuucuaccggaaacuaugauuggggcccacccuggcgugggaggcgaccuc

SEQ ID NO: 540139 - RNA, 64 nt, Human Herpes Virus 2; identical to SEQ ID NO: 540134

SEQ ID NO: 540140 - RNA, 62 nt, Human Herpes Virus 1; identical to SEQ ID NO: 537566

SEQ ID NO: 540141 - RNA, 64 nt, Human Herpes Virus 1; identical to SEQ ID NO: 537567

SEQ ID NO: 540142 - RNA, 64 nt, Human Herpes Virus 1; identical to SEQ ID NO: 537568

SEQ ID NO: 540143 - RNA, 64 nt, Human Herpes Virus 1; identical to SEQ ID NO: 537569

SEQ ID NO: 540144 - RNA, 64 nt, Human Herpes Virus 1; identical to SEQ ID NO: 537570

SEQ ID NO: 540145 - RNA, 64 nt, Human Herpes Virus 1; identical to SEQ ID NO: 537571

SEQ ID NO: 540146 - RNA, 64 nt, Human Herpes Virus 1; identical to SEQ ID NO: 537572

SEQ ID NO: 540147 - RNA, 64 nt, Human Herpes Virus 1; identical to SEQ ID NO: 537573

SEQ ID NO: 540148 - RNA, 64 nt, Human Herpes Virus 1; identical to SEQ ID NO: 537574

SEQ ID NO: 540149 - RNA, 64 nt, Human Herpes Virus 1; identical to SEQ ID NO: 537575

SEQ ID NO: 540150 - RNA, 64 nt, Human Herpes Virus 1; identical to SEQ ID NO: 537576

SEQ ID NO: 540151 - RNA, 64 nt, Human Herpes Virus 1; identical to SEQ ID NO: 537577

SEQ ID NO: 540152 - RNA, 64 nt, Human Herpes Virus 1; identical to SEQ ID NO: 537578

SEQ ID NO: 540153 - RNA, 64 nt, Human Herpes Virus 1; identical to SEQ ID NO: 537579

SEQ ID NO: 540154 - RNA, 64 nt, Human Herpes Virus 1; identical to SEQ ID NO: 537580

SEQ ID NO: 540155 - RNA, 64 nt, Human Herpes Virus 1; identical to SEQ ID NO: 537581

SEQ ID NO: 540156 - RNA, 64 nt, Human Herpes Virus 1; identical to SEQ ID NO: 537582

SEQ ID NO: 540157 - RNA, 64 nt, Human Herpes Virus 1; identical to SEQ ID NO: 537583

SEQ ID NO: 540158 - RNA, 64 nt, Human Herpes Virus 1; identical to SEQ ID NO: 537584

SEQ ID NO: 540159 - RNA, 64 nt, Human Herpes Virus 1; identical to SEQ ID NO: 537585

SEQ ID NO: 540160 - RNA, 64 nt, Human Herpes Virus 1; identical to SEQ ID NO: 537586

SEQ ID NO: 540161 - RNA, 64 nt, Human Herpes Virus 1; identical to SEQ ID NO: 537587

SEQ ID NO: 540162 - RNA, 64 nt, Human Herpes Virus 1; identical to SEQ ID NO: 537588

SEQ ID NO: 540163 - RNA, 64 nt, Human Herpes Virus 1; identical to SEQ ID NO: 537589

SEQ ID NO: 540164 - RNA, 62 nt, Human Herpes Virus 1; identical to SEQ ID NO: 537566

SEQ ID NO: 540165 - RNA, 62 nt, Human Herpes Virus 1
cggucucggcacccgugguccggggagcagggggcgucgacccgggacgagggaaaacaaua

SEQ ID NO: 540166 - RNA, 62 nt, Human Herpes Virus 1
cguacgcaugggccgccaacagucgguauuaaggcgucgacgcagacgcacccgcugcgucg

SEQ ID NO: 540167 - RNA, 62 nt, Human Herpes Virus 1
cucugccccgggggaucggcuacaagcucaccggcgucgacguccgacgcccacuguuccua

SEQ ID NO: 540168 - RNA, 62 nt, Human Herpes Virus 1
uuucuguccgucguguccggcauucacgcccgggcgucgaagcugcugucgggagaccaggu

SEQ ID NO: 540169 - RNA, 62 nt, Human Herpes Virus 1; identical to SEQ ID NO: 540165

SEQ ID NO: 540170 - RNA, 64 nt, Human Herpes Virus 2
uuuccuccgggggggaggcagcuuccagguggccgaaggcuagggugcacagcagcgggguccg

SEQ ID NO: 540171 - RNA, 64 nt, Human Herpes Virus 1
ugccgacccagcggcugauuaucggcgaggugacgcccgcgacccagggaauguauuacuuggc

SEQ ID NO: 540172 - RNA, 64 nt, Human Herpes Virus 1
gcgcguacaguucgagguccaccagccgcugauugcccgcgacggcccgcaccccaucgagcaa

SEQ ID NO: 540173 - RNA, 64 nt, Human Herpes Virus 1
cgacgcccgccgcaaagccacccacgccgccucggcccgcgaacggcacgcccccuacgaggac

SEQ ID NO: 540174 - RNA, 64 nt, Human Herpes Virus 1
gcagggcacauaugaucgcggcuccgccgcccuggcccgcgagggaacgcgggggggaucgcga

SEQ ID NO: 540175 - RNA, 64 nt, Human Herpes Virus 1
cucggccgcccgccuggcgcgccgcggcucgugggcccgcgagcgggccgaccgggcucgguuc

SEQ ID NO: 540176 - RNA, 64 nt, Human Herpes Virus 1
acccgcgcucaugcuggaguacuuuugccggugcgcccgcgaggaaaccaagcguguccccccc

SEQ ID NO: 540177 - RNA, 64 nt, Human Herpes Virus 1
agucccggcccggcccggccgcccggaggcggcggcccgcgacccccgaagacgaagaagagcg

SEQ ID NO: 540178 - RNA, 64 nt, Human Herpes Virus 1
cccagacauuccgcuaucuccugggggcacccacgcccgcgacccggacgccgaucccgacucc

SEQ ID NO: 540179 - RNA, 64 nt, Human Herpes Virus 1
gcgcguggaccugggggacugcaucggcaaggacgcccgcgacgccauggaccgcaucuucgcc

SEQ ID NO: 540180 - RNA, 64 nt, Human Herpes Virus 1
agaugcugcgggucagcguccacggcgaggugcugcccgcgacguucgccgcggucgccaacgg

SEQ ID NO: 540181 - RNA, 64 nt, Human Herpes Virus 1
aggcgcugaagacucgccgcagcgggcgaagguggcccgcgacgcucgcccagcuguucgaggc

SEQ ID NO: 540182 - RNA, 64 nt, Human Herpes Virus 4 (Epstein Barr virus); identical to SEQ ID NO: 536064

SEQ ID NO: 540183 - RNA, 64 nt, Human Herpes Virus 4 (Epstein Barr virus); identical to SEQ ID NO: 536065

SEQ ID NO: 540184 - RNA, 64 nt, Human Herpes Virus 4 (Epstein Barr virus); identical to SEQ ID NO: 536064

SEQ ID NO: 540185 - RNA, 64 nt, Human Herpes Virus 1
cguguucaccacgaguaccugcgucaccuuugcugcccgcgaggagggcgugucguccagcacc

SEQ ID NO: 540186 - RNA, 64 nt, Human Herpes Virus 1
ggcgacgagccgcccgugcgccgucgacgggaaggcccgcgagcccgacgacggcgcgcgucgg

SEQ ID NO: 540187 - RNA, 64 nt, Human Herpes Virus 1; identical to SEQ ID NO: 540175

SEQ ID NO: 540188 - RNA, 64 nt, Human Herpes Virus 4 (Epstein Barr virus); identical to SEQ ID NO: 536065

SEQ ID NO: 540189 - RNA, 64 nt, Human Herpes Virus 4 (Epstein Barr virus); identical to SEQ ID NO: 536064

SEQ ID NO: 540190 - RNA, 64 nt, Human Herpes Virus 4 (Epstein Barr virus); identical to SEQ ID NO: 536065

SEQ ID NO: 540191 - RNA, 64 nt, Human Herpes Virus 4 (Epstein Barr virus); identical to SEQ ID NO: 536064

SEQ ID NO: 540192 - RNA, 64 nt, Human Herpes Virus 4 (Epstein Barr virus); identical to SEQ ID NO: 536065

SEQ ID NO: 540193 - RNA, 64 nt, Human Herpes Virus 4 (Epstein Barr virus); identical to SEQ ID NO: 536064

SEQ ID NO: 540194 - RNA, 64 nt, Human Herpes Virus 4 (Epstein Barr virus); identical to SEQ ID NO: 536065

SEQ ID NO: 540195 - RNA, 64 nt, Human Herpes Virus 4 (Epstein Barr virus); identical to SEQ ID NO: 536064

SEQ ID NO: 540196 - RNA, 64 nt, Human Herpes Virus 4 (Epstein Barr virus); identical to SEQ ID NO: 536065

SEQ ID NO: 540197 - RNA, 64 nt, Human Herpes Virus 4 (Epstein Barr virus); identical to SEQ ID NO: 536064

SEQ ID NO: 540198 - RNA, 64 nt, Human Herpes Virus 4 (Epstein Barr virus); identical to SEQ ID NO: 536065

SEQ ID NO: 540199 - RNA, 64 nt, Human Herpes Virus 4 (Epstein Barr virus); identical to SEQ ID NO: 536064

SEQ ID NO: 540200 - RNA, 64 nt, Human Herpes Virus 4 (Epstein Barr virus); identical to SEQ ID NO: 536065

SEQ ID NO: 540201 - RNA, 64 nt, Human Herpes Virus 4 (Epstein Barr virus); identical to SEQ ID NO: 536080

SEQ ID NO: 540202 - RNA, 64 nt, Human Herpes Virus 4 (Epstein Barr virus); identical to SEQ ID NO: 536081

SEQ ID NO: 540203 - RNA, 64 nt, Human Herpes Virus 4 (Epstein Barr virus); identical to SEQ ID NO: 536082

SEQ ID NO: 540204 - RNA, 64 nt, Human Herpes Virus 1; identical to SEQ ID NO: 540177

SEQ ID NO: 540205 - RNA, 64 nt, Human Herpes Virus 1
cugggccaggccauccgggccgcgcuucagggcggcccgcgaaucucacagcgccugcgcuaug

SEQ ID NO: 540206 - RNA, 64 nt, Human Herpes Virus 1
ccccgcgcgggugcgcuucucgccccacguccgggugcgccaccugguggucugggccucggcc

SEQ ID NO: 540207 - RNA, 64 nt, Human Herpes Virus 1
cguguuugagaucccccuguuuagcgacgcggccgugcgccacuuccgccagcgcgccaccgug

SEQ ID NO: 540208 - RNA, 64 nt, Human Herpes Virus 1
cucuccccgauucgggcccggucgcucgcuaccggugcgccaccaccagaggccauauccgaca

SEQ ID NO: 540209 - RNA, 64 nt, Human Herpes Virus 1
gcccgacccacccggaggccagcggacacggggcgugcgccaagcaccccccccgcuaaugacg

SEQ ID NO: 540210 - RNA, 64 nt, Human Herpes Virus 1; identical to SEQ ID NO: 540206

SEQ ID NO: 540211 - RNA, 64 nt, Human Herpes Virus 1
aggccaucuuuaagcacauguucugugaccccaugugcgccauuacggagauggagguugaccc

SEQ ID NO: 540212 - RNA, 64 nt, Human Herpes Virus 1
uccgggccgacgcgcggcgcucuucggacgcuuugugcgccacccuggccgccgccgcggagga

SEQ ID NO: 540213 - RNA, 64 nt, Human Herpes Virus 4 (Epstein Barr virus)
cuuuagccuggccuccuuaaauucaccuaagaaugggagcaaccagcuggucaucagccgcugc

SEQ ID NO: 540214 - RNA, 64 nt, Human Herpes Virus 4 (Epstein Barr virus)
ugguugaguccguaaaacgaguccgggucgaugagggagcaaacacccggcgcaccauccggga

SEQ ID NO: 540215 - RNA, 64 nt, Human Herpes Virus 4 (Epstein Barr virus)
cgguguuacuccaagcugcucucucuuaagagcugggagcaacuggccucuuuuuugucucugc

SEQ ID NO: 540216 - RNA, 64 nt, Human Herpes Virus 4 (Epstein Barr virus)
augaaaguuauggcaagcgccgacaccugcccccgggagcaagagcgcccagagccccaagggc

SEQ ID NO: 540217 - RNA, 64 nt, Human Herpes Virus 1
ggccccaagcccaaaugcaaugcuacggcgcucggugcgccaggcccagaggcggagcagcgca

SEQ ID NO: 540218 - RNA, 64 nt, Human Herpes Virus 1
aagggcccucccgcccguggcaccaggcccugcggggucuuaagcaccuacggauuggcccccc

SEQ ID NO: 540219 - RNA, 64 nt, Human Herpes Virus 1
ccgcgcuagccagccccgggcaccacguaauacugggucuuaucgacucgggguaccgcggaac

SEQ ID NO: 540220 - RNA, 64 nt, Human Herpes Virus 4 (Epstein Barr virus)
gugaugcuacuagugaaacgagcagugaugaggacaccgguagacaggguucggacguggagcu

SEQ ID NO: 540221 - RNA, 64 nt, Human Herpes Virus 1
cccaugggcgguggaggagucgaaaacgcgugucuggcggcacaaacgccgcaugggcuuauau

SEQ ID NO: 540222 - RNA, 64 nt, Human Herpes Virus 1
cgagcgccuucccgccaagucauggaccuggugcuggcggcagugcgccgagcgggccggggcc

SEQ ID NO: 540223 - RNA, 64 nt, Human Herpes Virus 1
cccacgccagacgccgguccgcugugccaucgcgcccccucaucccaccccccaucuugucccc

SEQ ID NO: 540224 - RNA, 61 nt, Human Herpes Virus 1
cgcauccccccuuuugcacuaugacagcgaccccccucaccaaccuguucuuacgggcccc

SEQ ID NO: 540225 - RNA, 64 nt, Human Herpes Virus 1
agaaauuuaccuacccgcuuccguuuuuuaaccgcccccucaaccgccuccuguucgaggcggu

SEQ ID NO: 540226 - RNA, 64 nt, Human Herpes Virus 1
cucgacgaggacgucgccgccgacguggucaccgcccccucaagggcccgcgggggggcgggcg

SEQ ID NO: 540227 - RNA, 64 nt, Human Herpes Virus 4 (Epstein Barr virus)
accauggaugugaaugccccaacccaaaaaucccucugaccaccccuccgcauccuaggcacgg

SEQ ID NO: 540228 - RNA, 64 nt, Human Herpes Virus 4 (Epstein Barr virus)
agauuagggguaacccuguagucaccugcacagaucugaccacggcccacgucuuuaccaccuc

SEQ ID NO: 540229 - RNA, 64 nt, Human Herpes Virus 4 (Epstein Barr virus)
cgagguauuccucaagcccuucuucguuaugcacucugaccaggacaucgugcuaagcguccug

SEQ ID NO: 540230 - RNA, 58 nt, Human Herpes Virus 1
uugguugcugcagaucaccguccuguugcuggcccaucgcaucagccagcuggcccac

SEQ ID NO: 540231 - RNA, 58 nt, Human Herpes Virus 1
ccuguugcuggcccaucgcaucagccagcuggcccaccugguuuacguccugcacuuu

SEQ ID NO: 540232 - RNA, 58 nt, Human Herpes Virus 1
ggccgcccugaagcgcggcccggauggccuggcccagggcccggaggcacgccagaug

SEQ ID NO: 540233 - RNA, 58 nt, Human Herpes Virus 1
guauaccccguccccauacguguucgcccuggcccaggcgcaccucccccggcucccg

SEQ ID NO: 540234 - RNA, 58 nt, Human Herpes Virus 1
acacccgcgcgcguacaccaacaagcgccuggcccaccugacgguguauuacaagcuc

SEQ ID NO: 540235 - RNA, 58 nt, Human Herpes Virus 1
ucaggcggcggcgcugacggaccuuggucuggcccacgcaaacaacacguuuaccccg

SEQ ID NO: 540236 - RNA, 58 nt, Human Herpes Virus 1
gcugcggcaccccgccgaccugccucaccuggcccaccagcgcgccccgccaggccgg

SEQ ID NO: 540237 - RNA, 58 nt, Human Herpes Virus 1
ucgcgagcacgaagcccagcuggugauccuggcccaggcucuggaccauuacgacugu

SEQ ID NO: 540238 - RNA, 58 nt, Human Herpes Virus 1
cgaccgugaauucauuacguacaucuaccuggcccauuuugaguguuucagccccccg

SEQ ID NO: 540239 - RNA, 58 nt, Human Herpes Virus 1
ccccgcauaucccacccuggagcucaaucuggcccaacagccgcuuuugcggguccag

SEQ ID NO: 540240 - RNA, 58 nt, Human Herpes Virus 1
cggcgcugucggagcuccccaccgaggccuggcccaugaugcagggggcggugaacuu

SEQ ID NO: 540241 - RNA, 58 nt, Human Herpes Virus 1
cgggcccgccaugcucacgcugcaggugcuggcccacaacauggccgaacgcacaacg

SEQ ID NO: 540242 - RNA, 58 nt, Human Herpes Virus 1
ccgggaccugguggcgcacgucgaggcccuggcccagcugguugaugacuuuacccug

SEQ ID NO: 540243 - RNA, 58 nt, Human Herpes Virus 1
gcuguuuuugaacgccugggggcagcgccuggcccacgggcggguccgaugggucgcg

SEQ ID NO: 540244 - RNA, 58 nt, Human Herpes Virus 1
cacccgauccgagaccccggucgaaguccuggcccagcagacccacggccucgccucg

SEQ ID NO: 540245 - RNA, 58 nt, Human Herpes Virus 1
ccuacagccuccccaaccgcaccucgcccuggcccaucucgagcagcuccguguguuu

SEQ ID NO: 540246 - RNA, 64 nt, Human Herpes Virus 1
ccaucaacgggcuguuucgcgacgcgcuggcggccggaaccacagccgagcagcuccucauguu

SEQ ID NO: 540247 - RNA, 64 nt, Human Herpes Virus 1
ccgguggcgcacuaucgcccucaggugggggagccggaaccaacaacgacccacccggcccuuu

SEQ ID NO: 540248 - RNA, 63 nt, Human Herpes Virus 1
ccuguccuuauaaaagccguauguggggcgugacggaaccaccccgcgugccaucacggccaa

SEQ ID NO: 540249 - RNA, 64 nt, Human Herpes Virus 1
guucccgaucaagccccuuccccuacggaaucgccggaaccaucgacaccaacgcccccgaggu

SEQ ID NO: 540250 - RNA, 64 nt, Human Herpes Virus 1
gucguucuaucuccgugguccugcgccaccacuacggaaccaagcagcgcuucgucgucgucuc

SEQ ID NO: 540251 - RNA, 58 nt, Human Herpes Virus 2
ggauccugugggggugggcccgugggugaggaggaagcggaagcgggaggggggggcg

SEQ ID NO: 540252 - RNA, 58 nt, Human Herpes Virus 2
uaccccaucguggacgccgcgggugcggaggaggaagacgaggccgacgaugacgccc

SEQ ID NO: 540253 - RNA, 58 nt, Human Herpes Virus 2
gagaacguggggcuccugccgcaccucaaggaggaacucgcccgcuucaucaugggcg

SEQ ID NO: 540254 - RNA, 58 nt, Human Herpes Virus 2
ggggccggcggcgcgaccgggggggccgaggaggaagagccccgggccgccgcggagg

SEQ ID NO: 540255 - RNA, 58 nt, Human Herpes Virus 2; identical to SEQ ID NO: 540251

SEQ ID NO: 540256 - RNA, 64 nt, Human Herpes Virus 1
uccccgccccacgccagccacuugacgcccacaacccgcgcacggaugugguuaucacgggccg

SEQ ID NO: 540257 - RNA, 64 nt, Human Herpes Virus 1
cuaucgcgacauccccgccuacuacgccgccgggcccgcgcaacgcggggugaucggcgaguac

SEQ ID NO: 540258 - RNA, 64 nt, Human Herpes Virus 1
guuaccugaugggauacugccgagcccgucuggccccgcgcacguggugccguuugcugcaggu

SEQ ID NO: 540259 - RNA, 64 nt, Human Herpes Virus 1
ccuuaaucacguggucaguuccugcggccaguggcccgcgcaguucucccaggucacaaaccug

SEQ ID NO: 540260 - RNA, 64 nt, Human Herpes Virus 1
uucgcucucggugcgucugggcccgacagaccuccccgcgcaugcucuggggucccugucgccu

SEQ ID NO: 540261 - RNA, 64 nt, Human Herpes Virus 1
cggcgaggagugccccagcgaccccgugacggaccccgcgcacccccugcacccggccaaucug

SEQ ID NO: 540262 - RNA, 64 nt, Human Herpes Virus 1
ccccgcgucgacggcgccaacccgauccaagacacccgcgcaggggcuggccagaaagcugcac

SEQ ID NO: 540263 - RNA, 64 nt, Human Herpes Virus 1
ugcaccccagagguguucacgcaccucgaggacacccgcgcaugaucuccggacccccgcaacg

SEQ ID NO: 540264 - RNA, 64 nt, Human Herpes Virus 1; identical to SEQ ID NO: 539992

SEQ ID NO: 540265 - RNA, 64 nt, Human Herpes Virus 1; identical to SEQ ID NO: 539993

SEQ ID NO: 540266 - RNA, 64 nt, Human Herpes Virus 1; identical to SEQ ID NO: 539994

SEQ ID NO: 540267 - RNA, 64 nt, Human Herpes Virus 1; identical to SEQ ID NO: 539995

SEQ ID NO: 540268 - RNA, 64 nt, Human Herpes Virus 1
ggggggacgagcucgucguaacuaaacagaaucacgcgggcacagcucgcccccgagccccacg

SEQ ID NO: 540269 - RNA, 64 nt, Human Herpes Virus 1
gcacgacgggggccagaagcucccccaccgcauccgcgggcacguaggcggcaaacgccgugca

SEQ ID NO: 540270 - RNA, 64 nt, Human Herpes Virus 1
ccuggucgaggugugcgaggugggccugcggccacgcgggcacccgcaacgagucacggcacgg

SEQ ID NO: 540271 - RNA, 64 nt, Human Herpes Virus 1
ccggaggagggcacgaacuacgcccaguuccugucgcgggcauacgcggaguuuuucucggggg

SEQ ID NO: 540272 - RNA, 64 nt, Human Herpes Virus 1
cggcgcgcgcgcgcuucugcgcccugacggcgggcgcgggcacggucaucgacaaccgcucggc

SEQ ID NO: 540273 - RNA, 64 nt, Human Herpes Virus 2
ccgccgccgggaaccccggcguggagcgccgggccucccgcaagagccugccgucgcacgcgcg

SEQ ID NO: 540274 - RNA, 64 nt, Human Herpes Virus 4 (Epstein Barr virus)
cgaggcuuuugcccacuuugcacacgagaaacugcggcgggacucgcgagagauccgcgcugug

SEQ ID NO: 540275 - RNA, 64 nt, Human Herpes Virus 4 (Epstein Barr virus)
ucgcucuacggacgccgcccuagaggaacuccagcggcgggaccuggccaaauacuggccggua

SEQ ID NO: 540276 - RNA, 64 nt, Human Herpes Virus 2
cggacacggagauguucgaggcgggccugauggacgcggccacgcccccggcccggcccccggc

SEQ ID NO: 540277 - RNA, 64 nt, Human Herpes Virus 2
gccgcgccgggccccggacucggacucgggcgaccgcggccacgggccgcucgccccggcgucc

SEQ ID NO: 540278 - RNA, 64 nt, Human Herpes Virus 2
ugggcguguuguacgccggccacggacgccuggccgcggccacgcauaccgcgcgccugacggg

SEQ ID NO: 540279 - RNA, 64 nt, Human Herpes Virus 2
cgacgucaaccgcgccgccgccgcguuuuuggcacgcggccacaaccucuuccugugggaggac

SEQ ID NO: 540280 - RNA, 64 nt, Human Herpes Virus 2
uuggaaccaucgucaccuacgacaccagccuagacgcggccaucgcuccguuucgccaccugga

SEQ ID NO: 540281 - RNA, 64 nt, Human Herpes Virus 2
ccauccaggaccuggcguacgccaucgugcgcagcgcggccaccaccggaagccccuucaucau

SEQ ID NO: 540282 - RNA, 64 nt, Human Herpes Virus 2
accugaacacacacaucgccgaggugaugcugcucgcggccaugaagaccaguaacgcgcugug

SEQ ID NO: 540283 - RNA, 64 nt, Human Herpes Virus 2
cggcgcaacgccagcggcacggcaucggugcugccgcggccaaccaucaccauggaguuuacgg

SEQ ID NO: 540284 - RNA, 64 nt, Human Herpes Virus 2
aucuccgggccgugaccacccacgaccccagccccgcggccagcacggagcagcccucgccccu

SEQ ID NO: 540285 - RNA, 64 nt, Human Herpes Virus 2
cgcggaggggagcagcucgacgucuccgggggcccgcggccacgaggcacgcgccaggcccccc

SEQ ID NO: 540286 - RNA, 64 nt, Human Herpes Virus 2
cauccauagaugccagcgccgauacaggcgcccccgcggccagauuuacaaccccgggggcguu

SEQ ID NO: 540287 - RNA, 64 nt, Human Herpes Virus 2
ccgccgagucggcgcgugaccuggugcggggcgccgcggccacccaugccgcgugccugggggc

SEQ ID NO: 540288 - RNA, 64 nt, Human Herpes Virus 2
acgaccacggccagagcgacccggcgcggcccuucgcggccacggccaacccgugggcgucgca

SEQ ID NO: 540289 - RNA, 64 nt, Human Herpes Virus 2
gaaacguggaccugggugugggcuacaccgccgucgcggccacgggcaccguccgcaaccccgu

SEQ ID NO: 540290 - RNA, 64 nt, Human Herpes Virus 2
cuccugcccgcgaccccccggguuaccgguacgccgcggccauccugcccaccggcuccauccu

SEQ ID NO: 540291 - RNA, 64 nt, Human Herpes Virus 2
agaacacccggaccaucaugcaggagacguaccgcgcggccaccgagcgcgucauggccgagcu

SEQ ID NO: 540292 - RNA, 64 nt, Human Herpes Virus 2
cacggcaucaacgaccagcagccgagcaggcgcucgcggccaaccgaacugcagcgcuucgacg

SEQ ID NO: 540293 - RNA, 64 nt, Human Herpes Virus 2
ggcggcgccucucggccggcuaucaggccgcacgcgcggccacgggccccgagcggguggccga

SEQ ID NO: 540294 - RNA, 64 nt, Human Herpes Virus 2
ggccgccuagccacgcccccucgguucaccuggccgcggccaccaagauccgcuucccggcccu

SEQ ID NO: 540295 - RNA, 64 nt, Human Herpes Virus 2
cggcgggcagcgcggacgagccggcguuucuguccgcggccaaacugcacgccgccacggcggc

SEQ ID NO: 540296 - RNA, 64 nt, Human Herpes Virus 2
ugcuggugcgcgccccguucaagagcggggccgccgcggccaaguacgccgccgcgguggcggg

SEQ ID NO: 540297 - RNA, 64 nt, Human Herpes Virus 2; identical to SEQ ID NO: 540277

SEQ ID NO: 540298 - RNA, 64 nt, Human Herpes Virus 2; identical to SEQ ID NO: 540276

SEQ ID NO: 540299 - RNA, 63 nt, Human Herpes Virus 2
cgagugugauguuggcaaucucgagaccaacggcggcucgacgagcgaugaugagauaucgga

SEQ ID NO: 540300 - RNA, 62 nt, Human Herpes Virus 2
ugcguuaacuauguacuuccgcuguaucaggcagaccccacggucgagcugacccaguuguu

SEQ ID NO: 540301 - RNA, 62 nt, Human Herpes Virus 2
cgggggccgggguccgcccgcggcccgcccgcagaccccacggcagagggacucuuggacac

SEQ ID NO: 540302 - RNA, 64 nt, Human Herpes Virus 4 (Epstein Barr virus)
acggccaucgugagcgaguacgggaauacgucucugcgcccaaacacuaaugacccaggccagg

SEQ ID NO: 540303 - RNA, 64 nt, Human Herpes Virus 4 (Epstein Barr virus)
aacaaggagugaagguguggggaucggcaaagauugcgcccaggaucacgccugccccguccca

SEQ ID NO: 540304 - RNA, 64 nt, Human Herpes Virus 4 (Epstein Barr virus)
aaaggccacucuauaaagaugacaucguggugcaugcgcccaauaagcaccugcuccucuccug

SEQ ID NO: 540305 - RNA, 64 nt, Human Herpes Virus 4 (Epstein Barr virus)
aggaugcgauuaaggaccuuguuaugacaaagcccgcuccuaccugcaauaucagggugacugu

SEQ ID NO: 540306 - RNA, 64 nt, Human Herpes Virus 4 (Epstein Barr virus)
uaaagacaacauuauucccuacucguuuaagguccgcuccuacaccaagauagugaccaacauu

SEQ ID NO: 540307 - RNA, 64 nt, Human Herpes Virus 4 (Epstein Barr virus); identical to SEQ ID NO: 540305

SEQ ID NO: 540308 - RNA, 64 nt, Human Herpes Virus 4 (Epstein Barr virus); identical to SEQ ID NO: 540306

SEQ ID NO: 540309 - RNA, 63 nt, Human Herpes Virus 4 (Epstein Barr virus)
caacgagagcaauacacaauuaggcuaaaagcagccaccuaucaauaaacuguuuaaacuaac

SEQ ID NO: 540310 - RNA, 63 nt, Human Herpes Virus 4 (Epstein Barr virus)
gguccgugcggcuacaucuacuuuuacccccuggccaccuacccucuuagggagguggccaca

SEQ ID NO: 540311 - RNA, 61 nt, Human Herpes Virus 2
uggcuggcgcugcuggaggacgaguaccugagcgaggaaaugauggaguuuaccacccgcg

SEQ ID NO: 540312 - RNA, 64 nt, Human Herpes Virus 2
gcgcgaucacggcggagcagaccaacgugauucugcacuccaccgagacgacgggacugucccu

SEQ ID NO: 540313 - RNA, 62 nt, Human Herpes Virus 1
aauauauuucuuccggggacaccgccagcaaacgcgagcaacgggccacggggaugaagcag

SEQ ID NO: 540314 - RNA, 62 nt, Human Herpes Virus 1
uggcccuggauuuuggccugacggaaaggcuucgcgagcacgaagcccagcuggugauccug

SEQ ID NO: 540315 - RNA, 62 nt, Human Herpes Virus 1
ucgccguggcgauggauggugacgucaguaaacgcgagcagaguaaaugucgcuucauggag

SEQ ID NO: 540316 - RNA, 62 nt, Human Herpes Virus 1
cgcucgcggagcuguacgugcgggaacaccuccgcgagcagagccgcaagcccccaaacccc

SEQ ID NO: 540317 - RNA, 62 nt, Human Herpes Virus 1
acgcgaccgucgccgcgggccacgccacccugcgcgagcaccugcgggacaucaaggcggag

SEQ ID NO: 540318 - RNA, 62 nt, Human Herpes Virus 1
agcggucguuggccagccuggggcgcugcguccgcgagcagcgcggggagcucgagaagaug

SEQ ID NO: 540319 - RNA, 62 nt, Human Herpes Virus 1
aggcccgccggcugcgggagcuaaaccacauucgcgagcaccuuaaccucccgcuggugcgc

SEQ ID NO: 540320 - RNA, 62 nt, Human Herpes Virus 4 (Epstein Barr virus)
ggcgcuuugcuaugaauuauccaagaaaccccacggagcagggcaacauugcagggcucugu

SEQ ID NO: 540321 - RNA, 62 nt, Human Herpes Virus 1; identical to SEQ ID NO: 537566

SEQ ID NO: 540322 - RNA, 64 nt, Human Herpes Virus 1; identical to SEQ ID NO: 537567

SEQ ID NO: 540323 - RNA, 64 nt, Human Herpes Virus 1; identical to SEQ ID NO: 537568

SEQ ID NO: 540324 - RNA, 64 nt, Human Herpes Virus 1; identical to SEQ ID NO: 537569

SEQ ID NO: 540325 - RNA, 64 nt, Human Herpes Virus 1; identical to SEQ ID NO: 537570

SEQ ID NO: 540326 - RNA, 64 nt, Human Herpes Virus 1; identical to SEQ ID NO: 537571

SEQ ID NO: 540327 - RNA, 64 nt, Human Herpes Virus 1; identical to SEQ ID NO: 537572

SEQ ID NO: 540328 - RNA, 64 nt, Human Herpes Virus 1; identical to SEQ ID NO: 537573

SEQ ID NO: 540329 - RNA, 64 nt, Human Herpes Virus 1; identical to SEQ ID NO: 537574

SEQ ID NO: 540330 - RNA, 64 nt, Human Herpes Virus 1; identical to SEQ ID NO: 537575

SEQ ID NO: 540331 - RNA, 64 nt, Human Herpes Virus 1; identical to SEQ ID NO: 537576

SEQ ID NO: 540332 - RNA, 64 nt, Human Herpes Virus 1; identical to SEQ ID NO: 537577

SEQ ID NO: 540333 - RNA, 64 nt, Human Herpes Virus 1; identical to SEQ ID NO: 537578

SEQ ID NO: 540334 - RNA, 64 nt, Human Herpes Virus 1; identical to SEQ ID NO: 537579

SEQ ID NO: 540335 - RNA, 64 nt, Human Herpes Virus 1; identical to SEQ ID NO: 537580

SEQ ID NO: 540336 - RNA, 64 nt, Human Herpes Virus 1; identical to SEQ ID NO: 537581

SEQ ID NO: 540337 - RNA, 64 nt, Human Herpes Virus 1; identical to SEQ ID NO: 537582

SEQ ID NO: 540338 - RNA, 64 nt, Human Herpes Virus 1; identical to SEQ ID NO: 537583

SEQ ID NO: 540339 - RNA, 64 nt, Human Herpes Virus 1; identical to SEQ ID NO: 537584

SEQ ID NO: 540340 - RNA, 64 nt, Human Herpes Virus 1; identical to SEQ ID NO: 537585

SEQ ID NO: 540341 - RNA, 64 nt, Human Herpes Virus 1; identical to SEQ ID NO: 537586

SEQ ID NO: 540342 - RNA, 64 nt, Human Herpes Virus 1; identical to SEQ ID NO: 537587

SEQ ID NO: 540343 - RNA, 64 nt, Human Herpes Virus 1; identical to SEQ ID NO: 537588

SEQ ID NO: 540344 - RNA, 64 nt, Human Herpes Virus 1; identical to SEQ ID NO: 537589

SEQ ID NO: 540345 - RNA, 62 nt, Human Herpes Virus 1; identical to SEQ ID NO: 537566

SEQ ID NO: 540346 - RNA, 64 nt, Human Herpes Virus 2
gucugcgcaacaccgcguccgucaaggugcuguuggggcgcaagagcgacagcgagcgcggggu

SEQ ID NO: 540347 - RNA, 64 nt, Human Herpes Virus 2
ccacagcgcguuggcggaaucgaugugggccgucggggcgcaggcgccgccuccucccgggggg

SEQ ID NO: 540348 - RNA, 64 nt, Human Herpes Virus 2
gcagcgccgucugggccgcgggggacagcuggugggggcgcacgacgcgcucggcggcacaggc

SEQ ID NO: 540349 - RNA, 64 nt, Human Herpes Virus 2
cccccggggcggacgucgccauggccggucgagcggggcgcacgcguccgcgaacguuacggga

SEQ ID NO: 540350 - RNA, 64 nt, Human Herpes Virus 2
gcuccaccgauguauuuacgcggugcgccccgccggggcgcacaacgauaccgcccucgugugg

SEQ ID NO: 540351 - RNA, 64 nt, Human Herpes Virus 2
ucgccuuggcagcacaacuuuggcgcggccgggcggggcgcaggcgauacgcgcacccgagcgu

SEQ ID NO: 540352 - RNA, 64 nt, Human Herpes Virus 2
ggcccgccaacccccgacauuccccucucgccggggggcgcacacgccaucgacccggacugca

SEQ ID NO: 540353 - RNA, 64 nt, Human Herpes Virus 2
auaaccacauacagcgccacgugaaugacaugcuggggcgcaucgccgucgcguggugcgagcu

SEQ ID NO: 540354 - RNA, 64 nt, Human Herpes Virus 2
cgcgagcgaggacggggagcgcggccccgagccaggggcgcaggggccggagagcuggggcgac

SEQ ID NO: 540355 - RNA, 64 nt, Human Herpes Virus 2
agugccacgggguguucgccgggcagucggucgaggggcgcaacuuucgcaaucaauuccaacc

SEQ ID NO: 540356 - RNA, 64 nt, Human Herpes Virus 2
gcgagguggaacagcugaugcgcaaccugaucgaggggcgcaacuuuaaguuccgcgacggucu

SEQ ID NO: 540357 - RNA, 64 nt, Human Herpes Virus 2
uggggcgcgacugucgcguggccgcccgcuacgcggggcgcaugacguacaucgccaccggggc

SEQ ID NO: 540358 - RNA, 63 nt, Human Herpes Virus 2
caggagaucaucggggggcaggcccgcgagaccggcgacgaccggcccguccuaacaaagucg

SEQ ID NO: 540359 - RNA, 63 nt, Human Herpes Virus 2
ccgcgcuaccuggcgcgucuggccgcgguaaucggcgacgagagcggacgcccgcaguaccgc

SEQ ID NO: 540360 - RNA, 63 nt, Human Herpes Virus 2
guucgcaaggcgaccaacagcgggguguucgccggcgacgacaacaucgucugcacaagcugc

SEQ ID NO: 540361 - RNA, 63 nt, Human Herpes Virus 2
ccgaaccacacccacgcccccccaaccccgcaaggcgacgaaaaguaaggccuccaccgccaa

SEQ ID NO: 540362 - RNA, 63 nt, Human Herpes Virus 2
cccgucugugcgggcgacgggcccucggccgguggcgacgacggcgacggggacugguucccc

SEQ ID NO: 540363 - RNA, 63 nt, Human Herpes Virus 2
gacggggacugguuccccgacgccgguggucccggcgacgaggagugggaggaggacacggac

SEQ ID NO: 540364 - RNA, 63 nt, Human Herpes Virus 2
cucgccauagcauacagucccccguuccccgcgggcgacgagggacuguauucggaguuggcg

SEQ ID NO: 540365 - RNA, 63 nt, Human Herpes Virus 2
cccgacgacggcggcgacgccaaccgccacgacggcgacgacgcccgcgggaagcccgccgcc

SEQ ID NO: 540366 - RNA, 63 nt, Human Herpes Virus 2
gcggccggcgucgcccgaaagcgggcguuucacggcgacgauccguuuggggagggaccaccg

SEQ ID NO: 540367 - RNA, 63 nt, Human Herpes Virus 2
gccgccggggagguguuuaacuuuggggauuucggcgacgaggaugaccacgcggcgucguuc

SEQ ID NO: 540368 - RNA, 63 nt, Human Herpes Virus 2
gauuccggccgcgcuaccuccgggcagggcggcggcgacgacggaucgcgauaucguggucac

SEQ ID NO: 540369 - RNA, 63 nt, Human Herpes Virus 2
gacaucauggcgcaguuucggaaacugcucaugggcgacgaggagaccgccgcccuccgggcg

SEQ ID NO: 540370 - RNA, 63 nt, Human Herpes Virus 2; identical to SEQ ID NO: 540365

SEQ ID NO: 540371 - RNA, 63 nt, Human Herpes Virus 2
gacccccagaaccccgggcccccgcuggccguuggcgacgaguggccuccgucaucccacguu

SEQ ID NO: 540372 - RNA, 64 nt, Human Herpes Virus 4 (Epstein Barr virus)
gaaucuaugauuugauagaacuguguggcucucugcaccacaucuggcaaaacuugcuccagac

SEQ ID NO: 540373 - RNA, 64 nt, Human Herpes Virus 4 (Epstein Barr virus)
gcaugggcacacccaggguccaugggaucccagggcaccacaucucccaccucagugggaugga

SEQ ID NO: 540374 - RNA, 64 nt, Human Herpes Virus 4 (Epstein Barr virus)
cgccggcccaguagcuugaugacgaugccacauggcaccacauaccccuguuuauccgauggaa

SEQ ID NO: 540375 - RNA, 64 nt, Human Herpes Virus 4 (Epstein Barr virus)
cggcagaucccgcauugcgccgccuaaugcauccgcaccacagaaacuacacggccucaaaggc

SEQ ID NO: 540376 - RNA, 64 nt, Human Herpes Virus 4 (Epstein Barr virus)
ugucggacucgguccucaccuccuuccccaaccagcaccacaacuccgggagggggggcaugcc

SEQ ID NO: 540377 - RNA, 64 nt, Human Herpes Virus 4 (Epstein Barr virus)
aggucgcagucgaccccgaugguguucaguagaugcaccacaucccccacuucgggauaguguu

SEQ ID NO: 540378 - RNA, 64 nt, Human Herpes Virus 1
ccgccucgcgccucgugcggcuuaucaucaacaugaagggcaugcgccacguaggcgacauuaa

SEQ ID NO: 540379 - RNA, 64 nt, Human Herpes Virus 1
cugccauggagcgcacggaacacaaggccaagaagaagggcacgagcgcgcugcucagcgccaa

SEQ ID NO: 540380 - RNA, 64 nt, Human Herpes Virus 1
ugguuccccagggaacccccgacguucaguugcgccugacgaggccgcagcucaccaagguccu

SEQ ID NO: 540381 - RNA, 64 nt, Human Herpes Virus 1
ccccaaucgcuccggcucccgaccuagaggagguccugacgaacaucaccgccccacccggggg

SEQ ID NO: 540382 - RNA, 64 nt, Human Herpes Virus 1
uugacgaauaccgacggcugacacaccagcccggccugacgauugaaaaguggcucacggccaa

SEQ ID NO: 540383 - RNA, 64 nt, Human Herpes Virus 1
acgugcgggagcgacggcggcuguacgcggaccgccugacgaagcggucguuggccagccuggg

SEQ ID NO: 540384 - RNA, 64 nt, Human Herpes Virus 1
ucgaggcgcucauccgcgcgugcuacgaccaccaccugacgacgccgcucuugcggcgccucgu

SEQ ID NO: 540385 - RNA, 64 nt, Human Herpes Virus 1
gggcccucuuuacguuggcccugguggacgaguaccugacgacccccgagcggggggcuguggu

SEQ ID NO: 540386 - RNA, 63 nt, Human Herpes Virus 1
uuugacuauucgcgcacccgccgcuguguagggcgacaggauuugggaccuaccaacggaacg

SEQ ID NO: 540387 - RNA, 63 nt, Human Herpes Virus 1
ggccuccaucccggguuuggguucaccgucguccgacaggaccgcuuugugacugagaacgug

SEQ ID NO: 540388 - RNA, 63 nt, Human Herpes Virus 1
gcgggccucccugccggcggcgcauucgugacccgacaggaccguucggggggcgcccccuga

SEQ ID NO: 540389 - RNA, 64 nt, Human Herpes Virus 2
acgcgaucuggaugcgcgcgacgaaggccaccucggccgcgaugucaaagggcugcagcacggg

SEQ ID NO: 540390 - RNA, 64 nt, Human Herpes Virus 2
cugccugcacguggccgccaccgugacgaccaucggccgcgagaugcuccucgcgacgcgcgcg

SEQ ID NO: 540391 - RNA, 64 nt, Human Herpes Virus 2
cgaaccgaaacguugacuuuccgcucgccgucccggccgcgagcucgcaauccccgcggugcuc

SEQ ID NO: 540392 - RNA, 64 nt, Human Herpes Virus 2
gccuucacaaggacccagacgccgggcccugggcggccgcgacccugcggggccucuuuuucuc

SEQ ID NO: 540393 - RNA, 64 nt, Human Herpes Virus 2
ccuggagcgccgccgggcccgcgcggcgguggccggccgcgacgccacgggccgcuucacggcc

SEQ ID NO: 540394 - RNA, 64 nt, Human Herpes Virus 2
ccgcccucgugcgcggccgccccgacgguggggcggccgcgaacuuccgggucgaaacccagac

SEQ ID NO: 540395 - RNA, 64 nt, Human Herpes Virus 2
cggccgucgggggcgugaaccacgaccccgucgaggccgcgaauccguacggggcguacgucgc

SEQ ID NO: 540396 - RNA, 64 nt, Human Herpes Virus 2
gccugcggcuggaggcgcgccucgggcaucugguggccgcgauccucgagcgagagcagagccu

SEQ ID NO: 540397 - RNA, 64 nt, Human Herpes Virus 2
cggccccggcggccccccgcgccucgggcggcguggccgcgaccgucgcggcgaacgggggucc

SEQ ID NO: 540398 - RNA, 64 nt, Human Herpes Virus 2
cgccccccgucgcuccggcucccggcccgggcccggccgcgacaagacccggcggcggucgcgc

SEQ ID NO: 540399 - RNA, 64 nt, Human Herpes Virus 2
cacgcaggcccgcgcgccgucgacgcgcccggcgggccgcgagacggucccuuggcccaacacc

SEQ ID NO: 540400 - RNA, 64 nt, Human Herpes Virus 2; identical to SEQ ID NO: 540393

SEQ ID NO: 540401 - RNA, 64 nt, Human Herpes Virus 2
ugugaaagaacgcgucgggggcgguccccucgagggcgcgcaucagguucuccaggagcacggg

SEQ ID NO: 540402 - RNA, 64 nt, Human Herpes Virus 2
ucgcacgaucccgucgccccccccggagcgcgacggcgcgcaagaagaagcggcccgcucgccu

SEQ ID NO: 540403 - RNA, 64 nt, Human Herpes Virus 2
cgcuggaccaggccugcuuccggaucucgggcgcggcgcgcaacagcagcuccuucaucuccgg

SEQ ID NO: 540404 - RNA, 64 nt, Human Herpes Virus 2
acucgcucgccgcgcccgccuccgcgccgcgggaggcgcgcaagcgcaagagccccgccccggc

SEQ ID NO: 540405 - RNA, 64 nt, Human Herpes Virus 2
caacuggaccggcgcccccgacgucucggcgcugggcgcgcagggcgugcugcugcuguccacg

SEQ ID NO: 540406 - RNA, 64 nt, Human Herpes Virus 2
cgcguggucacccgggcgccggggccccaguaccggcgcgcaucggaccccccaucgcgucaca

SEQ ID NO: 540407 - RNA, 64 nt, Human Herpes Virus 2
gcggggccugacgaccgccuccacgcugcgguggggcgcgcaggguccgugcuucucgucccag

SEQ ID NO: 540408 - RNA, 64 nt, Human Herpes Virus 2
caaccgccggguccaucgccgagauacgcgaccuggcgcgcacguuugcccgcgaggugggggg

SEQ ID NO: 540409 - RNA, 64 nt, Human Herpes Virus 2
cggccgaaggccuggagcugcugucgcuacugucggcgcgcagcggcgacgcggacgucgccgu

SEQ ID NO: 540410 - RNA, 64 nt, Human Herpes Virus 2
ccgcggucagcgaguccugggaagcgcaccgcggggcgcgcaugcgcgacgcggccccgcguuu

SEQ ID NO: 540411 - RNA, 64 nt, Human Herpes Virus 2
cccgucgccgccgaggucccccccuggaagagcuggcgcgcagccgccacggucccucccgcac

SEQ ID NO: 540412 - RNA, 64 nt, Human Herpes Virus 2
ucggccugucgggcggcguccucagccagacgcuggcgcgcaucaugggcccggccgugccgac

SEQ ID NO: 540413 - RNA, 64 nt, Human Herpes Virus 2; identical to SEQ ID NO: 540405

SEQ ID NO: 540414 - RNA, 64 nt, Human Herpes Virus 2; identical to SEQ ID NO: 540404

SEQ ID NO: 540415 - RNA, 64 nt, Human Herpes Virus 2; identical to SEQ ID NO: 540403

SEQ ID NO: 540416 - RNA, 64 nt, Human Herpes Virus 2; identical to SEQ ID NO: 540402

SEQ ID NO: 540417 - RNA, 64 nt, Human Herpes Virus 1
ugcgacccccagggacccuccguccgcgacccuccagccgcauacgacccccauggagccccgc

SEQ ID NO: 540418 - RNA, 64 nt, Human Herpes Virus 1
uuuccgcguuugaccgcggagcggcgggcgcggccagccgcacgcgggccgccggguaccugga

SEQ ID NO: 540419 - RNA, 64 nt, Human Herpes Virus 1
ccagcucgucgccggccaugccgcgccccaaccccagccgcauuccgcguuugguuucccggcu

SEQ ID NO: 540420 - RNA, 64 nt, Human Herpes Virus 1
aaacccgccgcgucuguugaaauggccagccgcccagccgcauccucucccgucgaagcgcggg

SEQ ID NO: 540421 - RNA, 64 nt, Human Herpes Virus 1
gccugacgauugaaaaguggcucacggccaacgccagccgcaucaccaacuacucgcagagcca

SEQ ID NO: 540422 - RNA, 64 nt, Human Herpes Virus 1
ccgcagguacaacgcgacgcacaucaaggugggccagccgcaguacuaccuggccaaugggggc

SEQ ID NO: 540423 - RNA, 64 nt, Human Herpes Virus 4 (Epstein Barr virus); identical to SEQ ID NO: 540041

SEQ ID NO: 540424 - RNA, 64 nt, Human Herpes Virus 4 (Epstein Barr virus); identical to SEQ ID NO: 540042

SEQ ID NO: 540425 - RNA, 64 nt, Human Herpes Virus 4 (Epstein Barr virus); identical to SEQ ID NO: 540041

SEQ ID NO: 540426 - RNA, 64 nt, Human Herpes Virus 4 (Epstein Barr virus); identical to SEQ ID NO: 540042

SEQ ID NO: 540427 - RNA, 64 nt, Human Herpes Virus 2
ugcaggcguucggggccguccucguagacgcccaucggcgcaucaccgacccggagagggacau

SEQ ID NO: 540428 - RNA, 64 nt, Human Herpes Virus 2
agcugacguggcaccgcgacuccgugucguucucucggcgcaacgccagcggcacggcaucggu

SEQ ID NO: 540429 - RNA, 64 nt, Human Herpes Virus 2
cuuggcccuggucagcaauugggugacgcuguucucggcgcaccuacagcgcaucgacgacgcc

SEQ ID NO: 540430 - RNA, 62 nt, Human Herpes Virus 2
gguucggcaagggcggcaccggccgcgggucgcgcccccaggacccgggggcgcgaccgcag

SEQ ID NO: 540431 - RNA, 62 nt, Human Herpes Virus 2
uccgggugcgccgggaugacgggggcuaggaucgcccccaccgcauccgccggcacguaggc

SEQ ID NO: 540432 - RNA, 62 nt, Human Herpes Virus 2
cggcgcacggaugucgugaucacgggcacccgcgcccccagaccgauggccgggaccggggc

SEQ ID NO: 540433 - RNA, 62 nt, Human Herpes Virus 2
gccaccaagcgcccgaagacgggcgugcccgccgcccccacgcgagccgagucgcccccccu

SEQ ID NO: 540434 - RNA, 62 nt, Human Herpes Virus 2
gccccgcccgggggccaacugguguaugacagcgcccccaaccgaacggacccgcacgugau

SEQ ID NO: 540435 - RNA, 62 nt, Human Herpes Virus 2
gcaagaugugcauucaccacaaucugccgcuccgcccccaggacccuaucaucggaacggcg

SEQ ID NO: 540436 - RNA, 62 nt, Human Herpes Virus 2
ccguggcgcucggugcccccgguaugguauuccgcccccaaccccggguuucguggccugcg

SEQ ID NO: 540437 - RNA, 62 nt, Human Herpes Virus 2
cgggagcgcugucugcccccacagacgcccgccgcccccagcgaccuaccacgcgucgcuuu

SEQ ID NO: 540438 - RNA, 62 nt, Human Herpes Virus 2
cccacgcucccgccaggaauucuugggccgcucgcccccaacacgccucgcccccccgccca

SEQ ID NO: 540439 - RNA, 62 nt, Human Herpes Virus 2
auccaggacgucgcgccgcaccacgcccccgccgcccccagcaacccgggccugaucaucgg

SEQ ID NO: 540440 - RNA, 62 nt, Human Herpes Virus 2
ggagggcucgcgggacguccgggcaccagguccgcccccacagcagcccggggccagacccg

SEQ ID NO: 540441 - RNA, 62 nt, Human Herpes Virus 2
ccccgacguggcccgcccuccugccacgcucacgcccccacucucugauagcgaauaaagac

SEQ ID NO: 540442 - RNA, 62 nt, Human Herpes Virus 2
ugacggaggccugugccgccgagcgcgucgugcgcccccaccagcugucccccgcggcccag

SEQ ID NO: 540443 - RNA, 62 nt, Human Herpes Virus 2
uuuuccauccucuacucgguccugcagcaccucgcccccagacuagcgggcggcgggagcga

SEQ ID NO: 540444 - RNA, 62 nt, Human Herpes Virus 2
acggucgcgcucucggagggggcggcuaucugcgcccccagccuaacggccggccagacggc

SEQ ID NO: 540445 - RNA, 62 nt, Human Herpes Virus 2
ccgaggaccccgcugcccccacgucgacuccgcgcccccaccggguccucgcccccacucuc

SEQ ID NO: 540446 - RNA, 62 nt, Human Herpes Virus 2
gggggggcgcgaggcguccccggggccuuucccgcccccacgcuaccgacccacgggccagc

SEQ ID NO: 540447 - RNA, 62 nt, Human Herpes Virus 2
cugggcguccggagcggcggcccggggguccucgcccccacuccgggggucccagcgccacu

SEQ ID NO: 540448 - RNA, 62 nt, Human Herpes Virus 2
ggccaaucuguacgcacgcccuuuuccgaucacgcccccacacucgcgcgcccacccgaaca

SEQ ID NO: 540449 - RNA, 62 nt, Human Herpes Virus 2
gcgacaacgcacccccgccgcucccccgggcucgcccccacucgacccccgcggccccucgg

SEQ ID NO: 540450 - RNA, 62 nt, Human Herpes Virus 2
gcgggacaacgcccccgcagacuguccaccaccgcccccauuaccgacgucagccugggaga

SEQ ID NO: 540451 - RNA, 62 nt, Human Herpes Virus 2
gacccuacaccggacccacgucaucgcacguccgcccccaaacgccaggccucgucgaccga

SEQ ID NO: 540452 - RNA, 62 nt, Human Herpes Virus 2
gaggcccuggcgguggucaaugcgcuuuugcccgcccccaucacgcucgacgacgcccuaga

SEQ ID NO: 540453 - RNA, 62 nt, Human Herpes Virus 2
ggaugacggagaugauagcgugauugacgccccgcccccauacgagaguguggccggcgcga

SEQ ID NO: 540454 - RNA, 59 nt, Human Herpes Virus 1
gcaaggcgcagcgccgccacggcguacgggucauagacgcccugcgcgucacacaccac

SEQ ID NO: 540455 - RNA, 64 nt, Human Herpes Virus 2
gguggggggugcgugugcgcguccucggggcccgcgggcgcacgugcgcuuauacgcugugugu

SEQ ID NO: 540456 - RNA, 64 nt, Human Herpes Virus 2
ucccccugaccacccgcagcgccgacuuucgagacgggcgcauguccaagaccuucaugaccgc

SEQ ID NO: 540457 - RNA, 64 nt, Human Herpes Virus 2
gacgcgaggccgccgaggccgagcucgcgcuggccgggcgcaccugggcccccggcguggaggc

SEQ ID NO: 540458 - RNA, 64 nt, Human Herpes Virus 2
ugacggagaucuacaaggucccgcucgacggguacgggcgcaugaacggccgggguguguuccg

SEQ ID NO: 540459 - RNA, 64 nt, Human Herpes Virus 2
uguaugagcccggcgaaucgaugcgcucggucgucgggcgcaugucccuggggcagcgcggccu

SEQ ID NO: 540460 - RNA, 64 nt, Human Herpes Virus 2
ugauggccaccgugcugaagcacggccgggggcgcgggcgcaccggcggggaaugccugcugug

SEQ ID NO: 540461 - RNA, 64 nt, Human Herpes Virus 2
gagcagcugcgcgcccugcagcggugagcguccucgggcgcauggcugcgggcccagccggccu

SEQ ID NO: 540462 - RNA, 64 nt, Human Herpes Virus 2
agccgcuucuccaucggaucuggacgcggccgugcgggcgcaugggcgaagagaugcgggucga

SEQ ID NO: 540463 - RNA, 64 nt, Human Herpes Virus 2
acugcucaugggcgacgaggagaccgccgcccuccgggcgcacguguccgggaggcgcgcgacc

SEQ ID NO: 540464 - RNA, 63 nt, Human Herpes Virus 2
ggccaucgcucggggggcguccggauuggacucgggcgccauaaaaagcggcgacaacaaccu

SEQ ID NO: 540465 - RNA, 63 nt, Human Herpes Virus 2
cccgcacgugaucugggcggagggcgccggcccgggcgccagcccgcggcuguacucggucgu

SEQ ID NO: 540466 - RNA, 63 nt, Human Herpes Virus 2
gacccucaacgagguccuggacugcguggucacgggcgccacgcgaaucgcggcgcagaacau

SEQ ID NO: 540467 - RNA, 63 nt, Human Herpes Virus 2
ccaugccgcgugccugggggccuggcccgcggugggcgccagggucguccugcccccgcgggc

SEQ ID NO: 540468 - RNA, 63 nt, Human Herpes Virus 2
gacggcgcugcugugcuccgcggcgcccgacgcgggcgccaacaccgcgucgacggccaacau

SEQ ID NO: 540469 - RNA, 63 nt, Human Herpes Virus 2
cuacgccgccaccaacgugcccuacccccuggugggcgccauggaccugacguucguccugcc

SEQ ID NO: 540470 - RNA, 63 nt, Human Herpes Virus 2
cgaugcccaguuuuacgugugcccgcccccgacgggcgccacgguggugcaguuugagcagcc

SEQ ID NO: 540471 - RNA, 63 nt, Human Herpes Virus 2
uaccuggagcgcugcgacggcggagucaucgucgggcgccaggagauggacguguuucgcuac

SEQ ID NO: 540472 - RNA, 63 nt, Human Herpes Virus 2
cggggcguaccuggcgcgcgccgcgggccucgugggcgccaugguguucagcaccaauucggc

SEQ ID NO: 540473 - RNA, 63 nt, Human Herpes Virus 2
cacugcugcuuccggaccgacggcggggugcccgggcgccacgcccagaagcaacccaggccg

SEQ ID NO: 540474 - RNA, 63 nt, Human Herpes Virus 2
agcgcugggccgccggcgucaccagggcguccugggcgccaaggaaccgcgccgaguucgacg

SEQ ID NO: 540475 - RNA, 63 nt, Human Herpes Virus 2
cgccggcuacgugaaaacguuccggcggauccagggcgccagcgagcacacgcacgggcggcu

SEQ ID NO: 540476 - RNA, 64 nt, Human Herpes Virus 2
accgcgacuccgugucguucucucggcgcaacgccagcggcacggcaucggugcugccgcggcc

SEQ ID NO: 540477 - RNA, 64 nt, Human Herpes Virus 2
uggccaucguccacaacgcccccgcccgcaucggcagcggcagcaccgccccccuguaugagcc

SEQ ID NO: 540478 - RNA, 64 nt, Human Herpes Virus 2
cggagacguuugcgcgccaccuggaccgcgggcccagcggcaccacgggcucgaugcagugcau

SEQ ID NO: 540479 - RNA, 64 nt, Human Herpes Virus 1; identical to SEQ ID NO: 540256

SEQ ID NO: 540480 - RNA, 64 nt, Human Herpes Virus 1; identical to SEQ ID NO: 540257

SEQ ID NO: 540481 - RNA, 64 nt, Human Herpes Virus 1; identical to SEQ ID NO: 540258

SEQ ID NO: 540482 - RNA, 64 nt, Human Herpes Virus 1; identical to SEQ ID NO: 540259

SEQ ID NO: 540483 - RNA, 64 nt, Human Herpes Virus 1; identical to SEQ ID NO: 540260

SEQ ID NO: 540484 - RNA, 64 nt, Human Herpes Virus 1; identical to SEQ ID NO: 540261

SEQ ID NO: 540485 - RNA, 64 nt, Human Herpes Virus 1; identical to SEQ ID NO: 540262

SEQ ID NO: 540486 - RNA, 64 nt, Human Herpes Virus 1; identical to SEQ ID NO: 540263

SEQ ID NO: 540487 - RNA, 64 nt, Human Herpes Virus 4 (Epstein Barr virus)
cagaggacauugggcaggugugggccacggggcagcuggccauaucccccgcacuacagaagug

SEQ ID NO: 540488 - RNA, 64 nt, Human Herpes Virus 4 (Epstein Barr virus)
ucagcgagccgggguggguguaggggugacgggggcuggccaggaugggaaacacaucagccuc

SEQ ID NO: 540489 - RNA, 64 nt, Human Herpes Virus 4 (Epstein Barr virus)
uggccaaccugccucucuuaugccuguggccccggcuggccaucgagauuguuuacaucugccc

SEQ ID NO: 540490 - RNA, 64 nt, Human Herpes Virus 4 (Epstein Barr virus)
ugaaggagacccuccauaaaugcccgugggaucugcuggccaucucugccuugaccguucuugu

SEQ ID NO: 540491 - RNA, 64 nt, Human Herpes Virus 4 (Epstein Barr virus)
cuggaaaacggucccuggcugccugcaaugcucugcuggccacugaggguccggccgcccucug

SEQ ID NO: 540492 - RNA, 64 nt, Human Herpes Virus 4 (Epstein Barr virus)
ucugcagcauccgugacuauggcauuagcucaaagcuggccaugaccauagccaaggcccaggg

SEQ ID NO: 540493 - RNA, 64 nt, Human Herpes Virus 4 (Epstein Barr virus)
auccgcgccaaaggaccauccucgacaagcagcagcuggccaucaagugcacgugcaacgccgu

SEQ ID NO: 540494 - RNA, 64 nt, Human Herpes Virus 4 (Epstein Barr virus)
acgaguccuucuuggcuagucuguugaccuccuggcuggccaagcgcaaggccaucaagaagcu

SEQ ID NO: 540495 - RNA, 61 nt, Human Herpes Virus 1
ugacuauucgcgcacccgccgcuguguagggcgacaggauuugggaccuaccaacggaacg

SEQ ID NO: 540496 - RNA, 61 nt, Human Herpes Virus 1
ccuccaucccggguuuggguucaccgucguccgacaggaccgcuuugugacugagaacgug

SEQ ID NO: 540497 - RNA, 61 nt, Human Herpes Virus 1
gggccucccugccggcgggccauucgugacccgacaggaccguucggggggcgcccccuga

SEQ ID NO: 540498 - RNA, 64 nt, Human Herpes Virus 1
ggccuucgacuccacgcgcguggcggacuacgaccgcguguauaucuacuacaaccaccgccgg

SEQ ID NO: 540499 - RNA, 64 nt, Human Herpes Virus 1
cguggagcaggaaugcaucgaagucguacacucgcgcguguacaacaucauccagcuggugcuu

SEQ ID NO: 540500 - RNA, 64 nt, Human Herpes Virus 1
cuaccucggcgggcacgccaagcccccgcccgaccgcguguacgggcuguuccgccaggcgguc

SEQ ID NO: 540501 - RNA, 64 nt, Human Herpes Virus 1
cuucgacccgcaacgcgcuggggcugccgugaggcgcguguacugcggucugucucgucuccuc

SEQ ID NO: 540502 - RNA, 64 nt, Human Herpes Virus 1
ccuggaccagcugaccgacccuccggggguccggcgcguguaccacauccaggcgggccuaccg

SEQ ID NO: 540503 - RNA, 64 nt, Human Herpes Virus 2
gggcccgccgaccgccccccccggcggggcauggaccccccacgcccgcgucugcuacgccaau

SEQ ID NO: 540504 - RNA, 64 nt, Human Herpes Virus 2
gauacaacaaacgcgaccgcacgccuccccacgcaccccccacucauccguuccgggggcuuug

SEQ ID NO: 540505 - RNA, 64 nt, Human Herpes Virus 2
guauugcugguggaugauuaacgcccuguaccacaccccccaguacgcgggccgccugcggccg

SEQ ID NO: 540506 - RNA, 64 nt, Human Herpes Virus 2
cgggcgccggggccccaguaccggcgcgcaucggaccccccaucgcgucacaccagacggcggg

SEQ ID NO: 540507 - RNA, 64 nt, Human Herpes Virus 2
cuacccggccgcgcgguaccucaugggaagcaugaccccccaggccguguuggcguucguggcc

SEQ ID NO: 540508 - RNA, 64 nt, Human Herpes Virus 2; identical to SEQ ID NO: 539741

SEQ ID NO: 540509 - RNA, 64 nt, Human Herpes Virus 2; identical to SEQ ID NO: 539742

SEQ ID NO: 540510 - RNA, 64 nt, Human Herpes Virus 2; identical to SEQ ID NO: 539743

SEQ ID NO: 540511 - RNA, 64 nt, Human Herpes Virus 2; identical to SEQ ID NO: 539744

SEQ ID NO: 540512 - RNA, 64 nt, Human Herpes Virus 2; identical to SEQ ID NO: 539745

SEQ ID NO: 540513 - RNA, 64 nt, Human Herpes Virus 2; identical to SEQ ID NO: 539746

SEQ ID NO: 540514 - RNA, 64 nt, Human Herpes Virus 2; identical to SEQ ID NO: 539747

SEQ ID NO: 540515 - RNA, 64 nt, Human Herpes Virus 2; identical to SEQ ID NO: 539748

SEQ ID NO: 540516 - RNA, 64 nt, Human Herpes Virus 2; identical to SEQ ID NO: 539749

SEQ ID NO: 540517 - RNA, 64 nt, Human Herpes Virus 2; identical to SEQ ID NO: 539750

SEQ ID NO: 540518 - RNA, 64 nt, Human Herpes Virus 2; identical to SEQ ID NO: 539751

SEQ ID NO: 540519 - RNA, 64 nt, Human Herpes Virus 2; identical to SEQ ID NO: 539752

SEQ ID NO: 540520 - RNA, 64 nt, Human Herpes Virus 2; identical to SEQ ID NO: 539753

SEQ ID NO: 540521 - RNA, 64 nt, Human Herpes Virus 2; identical to SEQ ID NO: 539754

SEQ ID NO: 540522 - RNA, 64 nt, Human Herpes Virus 2; identical to SEQ ID NO: 539755

SEQ ID NO: 540523 - RNA, 64 nt, Human Herpes Virus 2; identical to SEQ ID NO: 539756

SEQ ID NO: 540524 - RNA, 64 nt, Human Herpes Virus 2; identical to SEQ ID NO: 539757

SEQ ID NO: 540525 - RNA, 64 nt, Human Herpes Virus 2; identical to SEQ ID NO: 539758

SEQ ID NO: 540526 - RNA, 64 nt, Human Herpes Virus 2; identical to SEQ ID NO: 539759

SEQ ID NO: 540527 - RNA, 64 nt, Human Herpes Virus 2; identical to SEQ ID NO: 539760

SEQ ID NO: 540528 - RNA, 64 nt, Human Herpes Virus 2; identical to SEQ ID NO: 539741

SEQ ID NO: 540529 - RNA, 64 nt, Human Herpes Virus 2; identical to SEQ ID NO: 539747

SEQ ID NO: 540530 - RNA, 64 nt, Human Herpes Virus 4 (Epstein Barr virus)
ggccugacgcggauggccaaccugcuguacgacagccccgcaacccuggcugaccuggucccgg

SEQ ID NO: 540531 - RNA, 64 nt, Human Herpes Virus 4 (Epstein Barr virus)
gagccugacgugcccccgggagcgauagagcagggccccgcagaugacccaggagaaggcccaa

SEQ ID NO: 540532 - RNA, 63 nt, Human Herpes Virus 4 (Epstein Barr virus)
cugcacaaggagcugaagcgcgccccauccgaagcccgggaccucaugcagagccucuuucug

SEQ ID NO: 540533 - RNA, 63 nt, Human Herpes Virus 4 (Epstein Barr virus)
ucuggucgcccccucugccuccggccgccccgggcccgggaccgcgcccuccucugggccgcc

SEQ ID NO: 540534 - RNA, 63 nt, Human Herpes Virus 4 (Epstein Barr virus)
augcgggccugggccgggcucaguguggacguggcccgggagcugguggagcucgcgcgcugg

SEQ ID NO: 540535 - RNA, 63 nt, Human Herpes Virus 4 (Epstein Barr virus)
ugcgacguucugcuggagcccgggccgcccaccgcccgggagggcuguucucugagcauggac

SEQ ID NO: 540536 - RNA, 63 nt, Human Herpes Virus 4 (Epstein Barr virus)
cgccgggagaagagcacaggcuagccggccugcgcccgggagaagacuaugaguccuucaggc

SEQ ID NO: 540537 - RNA, 63 nt, Human Herpes Virus 4 (Epstein Barr virus)
gguggcggccauucccgccucucugcccuguuugcccgggagcgucgccuggcccuggugcgg

SEQ ID NO: 540538 - RNA, 64 nt, Human Herpes Virus 1
cccggucgaguaucugcucgagcagcuaaauaaccucaccgaaaccgucucccccaacacugac

SEQ ID NO: 540539 - RNA, 64 nt, Human Herpes Virus 1
gacguuccuggacauccuggcgacccccccggcccucaccgagccgauuucccugcggcaguuc

SEQ ID NO: 540540 - RNA, 64 nt, Human Herpes Virus 1
cgagcggcucaagaucuuucggugucuaacgguccucaccgagccucugugucagguggcccuu

SEQ ID NO: 540541 - RNA, 64 nt, Human Herpes Virus 1
ggccaugguauuuagcaccaacucggcccuccaucucaccgagguggacgacgccggcccggcg

SEQ ID NO: 540542 - RNA, 64 nt, Human Herpes Virus 2
cgggggcgguccccucgagggcgcgcaucagguucuccaggagcacggggaagcgccgcgucac

SEQ ID NO: 540543 - RNA, 64 nt, Human Herpes Virus 2
gagcgcccccgacgcgagucugccgcccccggggcuccaggaggccgccccgccgggccccccg

SEQ ID NO: 540544 - RNA, 64 nt, Human Herpes Virus 2
acguuugggaacacaggcgcuucaucgucgccgacuccaggagcuucaucacccccgaguuccc

SEQ ID NO: 540545 - RNA, 64 nt, Human Herpes Virus 2
cuccaacuccacgauaucccggggccaguuuugccuccaggagccggaccucgaguccccccgg

SEQ ID NO: 540546 - RNA, 64 nt, Human Herpes Virus 2
ccuggucgugcuggccgaccgccacagcaccccccuccaggaccuccuggccgauacgcucggc

SEQ ID NO: 540547 - RNA, 64 nt, Human Herpes Virus 2
cuacaucuacaacaacuaccucgggggccacgccaagcccgaggcggcgcgcguguaccggcug

SEQ ID NO: 540548 - RNA, 64 nt, Human Herpes Virus 2
ccccguccuccccagcucgucggaaucugaggguaagcccgacacagaaucggaauccuccucg

SEQ ID NO: 540549 - RNA, 64 nt, Human Herpes Virus 2
ggcgcgggucgccagccuccagagcgccuaccagaagcccgacaagcgcguggacauccuccuc

SEQ ID NO: 540550 - RNA, 64 nt, Human Herpes Virus 4 (Epstein Barr virus)
cuugguuuguuuguguuccuguuugcuggcaacuuacuggcagccgagcagauucuaaugggcg

SEQ ID NO: 540551 - RNA, 64 nt, Human Herpes Virus 4 (Epstein Barr virus)
cgggcagcggccggacgacgagccccgcuacaccuacuggcagcugaaccagaaccugcuggag

SEQ ID NO: 540552 - RNA, 63 nt, Human Herpes Virus 4 (Epstein Barr virus)
ugggcggagcagaccgaggcuuuugcccacuuugcacacgagaaacugcggcgggacucgcga

SEQ ID NO: 540553 - RNA, 61 nt, Human Herpes Virus 2
gggacagagcgaccccaggucaucauccauggcccagcaguauaugcggccgccggggagg

SEQ ID NO: 540554 - RNA, 61 nt, Human Herpes Virus 2
ggacgcgcugcuuaccguuugccuggcucgcgcccagcacggccagucugugugagauauc

SEQ ID NO: 540555 - RNA, 61 nt, Human Herpes Virus 2
gauacaauacgaacaggggccugggcugcucgcccagcaggcacgcaucggcuuggcguca

SEQ ID NO: 540556 - RNA, 61 nt, Human Herpes Virus 2
gcugcagcuaggggagccgcccuccgccggggcccagcaacggcuccucgcgcugcugcag

SEQ ID NO: 540557 - RNA, 64 nt, Human Herpes Virus 1
uaacccgggccagaucgacacgcagacgcacgagcaccccgacggguucaccacagucucuacc

SEQ ID NO: 540558 - RNA, 64 nt, Human Herpes Virus 1
accgcauaccuuuuugaccccuuuuugcccccgccaccccgacgcgcguucaucgccaaagugc

SEQ ID NO: 540559 - RNA, 62 nt, Human Herpes Virus 2
gcccccgccccccagaccccccuggccuucuacgagguuaagugccgagccaaguacgcguu

SEQ ID NO: 540560 - RNA, 64 nt, Human Herpes Virus 2
gcccgcaccccgucgagcagcccgugcauaauuacaugacgaaggucaucgaccgccgggcccu

SEQ ID NO: 540561 - RNA, 62 nt, Human Herpes Virus 4 (Epstein Barr virus)
ccgccccuguccacugccccgguccccccagaagcccccaaaaguagaggcucaggccaugc

SEQ ID NO: 540562 - RNA, 62 nt, Human Herpes Virus 4 (Epstein Barr virus)
ugcugcuaucuuuagaggggaaaagaggaauaagcccccagacaggggagugggcuuguuug

SEQ ID NO: 540563 - RNA, 62 nt, Human Herpes Virus 4 (Epstein Barr virus); identical to SEQ ID NO: 540561

SEQ ID NO: 540564 - RNA, 62 nt, Human Herpes Virus 4 (Epstein Barr virus); identical to SEQ ID NO: 540562

SEQ ID NO: 540565 - RNA, 62 nt, Human Herpes Virus 4 (Epstein Barr virus)
ucugcaccaucauggucaucuccccagccccgagcccccauacgccccauuccaacaagauu

SEQ ID NO: 540566 - RNA, 62 nt, Human Herpes Virus 4 (Epstein Barr virus)
acccuucuccuggcccaccugcgcaaaaagacagcccccauccacugccgugaugcucaagu

SEQ ID NO: 540567 - RNA, 62 nt, Human Herpes Virus 4 (Epstein Barr virus)
ucccaccaaguccauccugaaaaaggcaccggagcccccaccuccggagccccaagccaccu

SEQ ID NO: 540568 - RNA, 62 nt, Human Herpes Virus 4 (Epstein Barr virus)
accgaacgaugaggaacgugaaucuaaugaagagcccccaccgccuuaugaggacccauauu

SEQ ID NO: 540569 - RNA, 62 nt, Human Herpes Virus 4 (Epstein Barr virus)
gugggagcagggagggggcgucccgggaccccagcccccagccggcaauccaggcguaccgg

SEQ ID NO: 540570 - RNA, 62 nt, Human Herpes Virus 4 (Epstein Barr virus)
cucggcccuccgcauccuaggacugcagcagcagcccccaccccacugcaaguuuggccgcu

SEQ ID NO: 540571 - RNA, 62 nt, Human Herpes Virus 4 (Epstein Barr virus)
accuucacaagcaccaccucaccuccuucuacagcccccacagugacgcggggguccuuggc

SEQ ID NO: 540572 - RNA, 62 nt, Human Herpes Virus 4 (Epstein Barr virus)
gggcccuggucaggggaauugcucauauuuuuagcccccacgcucucuauguugucacauau

SEQ ID NO: 540573 - RNA, 62 nt, Human Herpes Virus 4 (Epstein Barr virus)
augcaucuuacuguuaucccagccacuaccauagcccccaccacauuagucucccacaccac

SEQ ID NO: 540574 - RNA, 64 nt, Human Herpes Virus 4 (Epstein Barr virus)
ccguauaaccucaggccacuagggaccgaucgucugugcuaaaucucauucccugccgccaggu

SEQ ID NO: 540575 - RNA, 64 nt, Human Herpes Virus 4 (Epstein Barr virus)
cccuccagaucgccaccugcgucguggcccucgucuccucgaucgucacccugcacccccacuu

SEQ ID NO: 540576 - RNA, 64 nt, Human Herpes Virus 1
cucccuggccacaaaacgccuggggggcgaggcgcaccccgaucgcacgcuguucgcgcacguc

SEQ ID NO: 540577 - RNA, 64 nt, Human Herpes Virus 1
acccgccccccguucucucggcccuguucugugccaccccgacgagcuccucauuccggcugcc

SEQ ID NO: 540578 - RNA, 64 nt, Human Herpes Virus 1
ggccgaagcggucguguccgccgaagcggcggcgcaccccgaccacggcgcgcugggcaggcgg

SEQ ID NO: 540579 - RNA, 64 nt, Human Herpes Virus 1
uccaggacgccgcgacgccuuaccaucccccggccaccccgaacaacaugggccugaucgccgg

SEQ ID NO: 540580 - RNA, 64 nt, Human Herpes Virus 1
ccggcuccccgggccccaccgacgggccgccgcccaccccgagcccagaccgcgacgagcgggg

SEQ ID NO: 540581 - RNA, 64 nt, Human Herpes Virus 1; identical to SEQ ID NO: 540580

SEQ ID NO: 540582 - RNA, 64 nt, Human Herpes Virus 1
gccauucgccgcaccgugagugccaaccaacgagcaccccgaacgacgggccccgggguuuuaa

SEQ ID NO: 540583 - RNA, 64 nt, Human Herpes Virus 1
gcagagugucacgcgggaggccgcccagcucauucaccccgaagccccggcccugaugcaggau

SEQ ID NO: 540584 - RNA, 64 nt, Human Herpes Virus 1
ccgcguguuccccgggagccccggguuccgcgaccaccccgagaaccuagggaacccagaguac

SEQ ID NO: 540585 - RNA, 64 nt, Human Herpes Virus 4 (Epstein Barr virus)
acccagccaccaugcuaucagguaacgcaggagaaggagcaacagccugcggagguucggccgc

SEQ ID NO: 540586 - RNA, 64 nt, Human Herpes Virus 4 (Epstein Barr virus)
ucuaagaagcuuccaauuaacgucaccaccggagaggagcaacaaguaagccuggaaucuguag

SEQ ID NO: 540587 - RNA, 64 nt, Human Herpes Virus 4 (Epstein Barr virus)
caagccaucauguuagcgcugcaugagcaaaaccaggagcaaaagagagcagcucagagggcgg

SEQ ID NO: 540588 - RNA, 64 nt, Human Herpes Virus 1
ccuugaccgucgccgcccccccccggauuuugacgcucgggagacauaccuugucgggcguccg

SEQ ID NO: 540589 - RNA, 64 nt, Human Herpes Virus 4 (Epstein Barr virus)
uggauggcaaggccuuccacaugguccgcggaaauccagcaauuccugcgacuccugggcgcca

SEQ ID NO: 540590 - RNA, 64 nt, Human Herpes Virus 4 (Epstein Barr virus)
caagaacccagacgaguccguagaaggguccucguccagcaagaagaggaggugguaagcgguu

SEQ ID NO: 540591 - RNA, 64 nt, Human Herpes Virus 4 (Epstein Barr virus); identical to SEQ ID NO: 540590

SEQ ID NO: 540592 - RNA, 64 nt, Human Herpes Virus 4 (Epstein Barr virus); identical to SEQ ID NO: 540590

SEQ ID NO: 540593 - RNA, 64 nt, Human Herpes Virus 4 (Epstein Barr virus)
cucgccccuccauccaguaaaaacccuugcccucuccagcaaccaauguaucccaaauaaaugu

SEQ ID NO: 540594 - RNA, 64 nt, Human Herpes Virus 4 (Epstein Barr virus)
gccagagacacccucgccugccauucccagccacuccagcaacaccgcacuggagaggccucug

SEQ ID NO: 540595 - RNA, 64 nt, Human Herpes Virus 4 (Epstein Barr virus)
agaggaggggucccgagaauccccaucccuaccguccagcaaaaagggggacgaggaauuugag

SEQ ID NO: 540596 - RNA, 63 nt, Human Herpes Virus 2
ggcgcacggaugucgugaucacgggcacccgcgcccccagaccgauggccgggaccggggccg

SEQ ID NO: 540597 - RNA, 63 nt, Human Herpes Virus 2
gcuggccaugcgaaagcagauccgcucgcggaucccccagagcacccccgaggaggccguccu

SEQ ID NO: 540598 - RNA, 63 nt, Human Herpes Virus 2
ccccggggacgacgcggggggcggcacugccgccccccagaccugcggaaucgucaagcgccu

SEQ ID NO: 540599 - RNA, 63 nt, Human Herpes Virus 2
ccgcagcgugcuccuacaugccccaucggaggccccccagaucgugcgcggggcuucggacga

SEQ ID NO: 540600 - RNA, 58 nt, Human Herpes Virus 2; identical to SEQ ID NO: 537367

SEQ ID NO: 540601 - RNA, 63 nt, Human Herpes Virus 2
ccccagggacccucacggcuaccuggcccccgccccccagaccccccuggccuucuacgaggu

SEQ ID NO: 540602 - RNA, 63 nt, Human Herpes Virus 2
gaaccgggagacgcuggaugaacucgaaagcgccccccagacaacgcgcgugcgcgcggaucu

SEQ ID NO: 540603 - RNA, 63 nt, Human Herpes Virus 2
uuuccauccucuacucgguccugcagcaccucgcccccagacuagcgggcggcgggagcgacg

SEQ ID NO: 540604 - RNA, 63 nt, Human Herpes Virus 2
cguuuuucagcuagagcugcuucgacgaugcgacccccagaucggccuggggaagcucgccca

SEQ ID NO: 540605 - RNA, 63 nt, Human Herpes Virus 2
cgaugagcccuccuggcagacgggggacgaugacccccagaaccccgggcccccgcuggccgu

SEQ ID NO: 540606 - RNA, 64 nt, Human Herpes Virus 2
ccgggcgcaccugggcccccggcguggaggcgcucacacacacgcugcucuccaccgccgucaa

SEQ ID NO: 540607 - RNA, 64 nt, Human Herpes Virus 2
gcgucaccgccgucugcagcggaccccaggaggccacacacaccggccacccgggcaggccccg

SEQ ID NO: 540608 - RNA, 64 nt, Human Herpes Virus 2
uggaucuggagucggccgaguuccgggaccugaacacacacaucgccgaggugaugcugcucgc

SEQ ID NO: 540609 - RNA, 61 nt, Human Herpes Virus 1
uauaucgacuggcugacgugccuggggcugguccccauauuacgcaagcgacaagaagggg

SEQ ID NO: 540610 - RNA, 61 nt, Human Herpes Virus 1
caacguuuccucgcacuuuguguauaccccguccccauacguguucgcccuggcccaggcg

SEQ ID NO: 540611 - RNA, 62 nt, Human Herpes Virus 1
cgccugccgaccccccgggaggcgcguccaagccccgcaagcugcugguguccgagcuggcc

SEQ ID NO: 540612 - RNA, 62 nt, Human Herpes Virus 1
guccuucuugucgucucucuucccccccaucaccccgcaauuugcacccagccuuuaacuac

SEQ ID NO: 540613 - RNA, 62 nt, Human Herpes Virus 1
gcgacggaggggguucgggcgggcgcggaggaccccgcaacccgcccccggaucccuguggg

SEQ ID NO: 540614 - RNA, 62 nt, Human Herpes Virus 1
agagguaauggcgcaugcgcccgaggacgcccccccgcaaagccccgcggccgaccgcgucg

SEQ ID NO: 540615 - RNA, 62 nt, Human Herpes Virus 1
accucgaggacacccgcgcaugaucuccggacccccgcaacggggugauaaugaucaagcgg

SEQ ID NO: 540616 - RNA, 59 nt, Human Herpes Virus 2
gccgcgagaugcuccucgcgacgcgcgcguacgugcacgcgcgcugggcggaguucgau

SEQ ID NO: 540617 - RNA, 59 nt, Human Herpes Virus 2
cgaaccucuaucauaccaacacggucgcguacgugcauaccacggauaccgaucuccug

SEQ ID NO: 540618 - RNA, 59 nt, Human Herpes Virus 2
gcgacccaccccacgcagcgcccguguuuuacgugcauggggcgacccgagauucccga

SEQ ID NO: 540619 - RNA, 64 nt, Human Herpes Virus 2
aagcgacauuuacucugcucgcguccauugacgucaccgucaaucaccacugcgauuggacggu

SEQ ID NO: 540620 - RNA, 64 nt, Human Herpes Virus 2
ggaccggggccgggggcgcgggggccaagcgggccaccgucagcgaguucgugcaagugaagca

SEQ ID NO: 540621 - RNA, 64 nt, Human Herpes Virus 2
gcggugcggaccaugcccccgagggguucgaccccaccgucaccgucuuccacguguacgacau

SEQ ID NO: 540622 - RNA, 64 nt, Human Herpes Virus 2
uggaaccggucccgggguuggcguggcuggccuccaccgucaaucuggaauuccagcacgccuc

SEQ ID NO: 540623 - RNA, 64 nt, Human Herpes Virus 2
ccugccccguggaccuggggcucacgcacgccggcaccgucaaucuccgcaacaccucccccgu

SEQ ID NO: 540624 - RNA, 64 nt, Human Herpes Virus 2
cguacucucaccagcugagucgcgccgacgucaccaccgucagcaccuucaucgaccugaacau

SEQ ID NO: 540625 - RNA, 64 nt, Human Herpes Virus 2
cgaaagccauggacaccaagcccaaaacgacgaccaccgucaagguuccuccggggccgauggg

SEQ ID NO: 540626 - RNA, 64 nt, Human Herpes Virus 2
gccccgcgugcagcgcgggcgacgggcggcuggccaccgucagccgcgaggcccucauccuggc

SEQ ID NO: 540627 - RNA, 64 nt, Human Herpes Virus 2
ugaagcccuucgacgacgagcuaguccugccccacugguacauggcccacuaccugcuggccaa

SEQ ID NO: 540628 - RNA, 64 nt, Human Herpes Virus 2
ccguggugguguuugacuuugccagccuguaccccagcaucauccaggcccacaaccugugcuu

SEQ ID NO: 540629 - RNA, 64 nt, Human Herpes Virus 2
ugcaggcguucaacgacgccagccccggcaccgccagcaucaugccggcccugaagguccucga

SEQ ID NO: 540630 - RNA, 64 nt, Human Herpes Virus 2
ugcugcgccaccagguggacccggcccugcuccccagcaucacccaucgcuucuucgagcucgu

SEQ ID NO: 540631 - RNA, 64 nt, Human Herpes Virus 2
ugauggccgcgcgcccgauggucgugcugggccucagcaucagcaaauacuacggcauggccgg

SEQ ID NO: 540632 - RNA, 64 nt, Human Herpes Virus 2
cgaugaccgccccgagcugggcccggauggaacucagcaucaaguccugguucggggccgcccu

SEQ ID NO: 540633 - RNA, 64 nt, Human Herpes Virus 4 (Epstein Barr virus)
aagguccagaucaaauguuugaggugcagcacggcccagagacgguguugcgccagucgcugcg

SEQ ID NO: 540634 - RNA, 64 nt, Human Herpes Virus 4 (Epstein Barr virus)
aagcguccccgcagcggggcucccaacacggguucccagagaggguaaaagagggggccauaaa

SEQ ID NO: 540635 - RNA, 64 nt, Human Herpes Virus 4 (Epstein Barr virus)
cugggaugagcguuugggagagcugauucugcagcccagagaguagucucagggcauccucugg

SEQ ID NO: 540636 - RNA, 64 nt, Human Herpes Virus 4 (Epstein Barr virus)
ccuaguaggggacgccuucuguauaaaggucagccccagagacacgguauaugagaaggcuguc

SEQ ID NO: 540637 - RNA, 64 nt, Human Herpes Virus 4 (Epstein Barr virus)
ugcaucuccugcuccagggcaccucccuucacaucccagagaccugcuugaaacuguuauguga

SEQ ID NO: 540638 - RNA, 64 nt, Human Herpes Virus 4 (Epstein Barr virus)
caaccucuuccaugucacugagacccaguucaaacccagagacacucagccccuccaccaguga

SEQ ID NO: 540639 - RNA, 64 nt, Human Herpes Virus 4 (Epstein Barr virus)
ggagcacggauucauucaugccgcggggaccauccaggccaacugcccacagcuguuuaugaga

SEQ ID NO: 540640 - RNA, 64 nt, Human Herpes Virus 4 (Epstein Barr virus)
agggccaaaaauacaccagcuauaaggaauugcucaggccaaaguuguuccucagguggcuuua

SEQ ID NO: 540641 - RNA, 64 nt, Human Herpes Virus 4 (Epstein Barr virus)
agccaaccaaaaaaugcaaccagugcuguuaccacaggccaacauaacauaacuucaaguucaa

SEQ ID NO: 540642 - RNA, 64 nt, Human Herpes Virus 4 (Epstein Barr virus)
gcacaucaagaugucccccauggccuauauugcccaggccaagcucaagauccacccaggggug

SEQ ID NO: 540643 - RNA, 64 nt, Human Herpes Virus 4 (Epstein Barr virus)
uguucugaaucuggaugaugcccaagacacccgccaggccaaggcucagaggaaggagagcaug

SEQ ID NO: 540644 - RNA, 64 nt, Human Herpes Virus 4 (Epstein Barr virus)
gguggagcugcuggagaagcagagccugcaggaccaggccaagguggccaagguggccccccuc

SEQ ID NO: 540645 - RNA, 64 nt, Human Herpes Virus 4 (Epstein Barr virus); identical to SEQ ID NO: 540633

SEQ ID NO: 540646 - RNA, 64 nt, Human Herpes Virus 4 (Epstein Barr virus); identical to SEQ ID NO: 540634

SEQ ID NO: 540647 - RNA, 64 nt, Human Herpes Virus 4 (Epstein Barr virus); identical to SEQ ID NO: 540635

SEQ ID NO: 540648 - RNA, 64 nt, Human Herpes Virus 4 (Epstein Barr virus); identical to SEQ ID NO: 540636

SEQ ID NO: 540649 - RNA, 64 nt, Human Herpes Virus 4 (Epstein Barr virus); identical to SEQ ID NO: 540637

SEQ ID NO: 540650 - RNA, 64 nt, Human Herpes Virus 4 (Epstein Barr virus); identical to SEQ ID NO: 540638

SEQ ID NO: 540651 - RNA, 64 nt, Human Herpes Virus 4 (Epstein Barr virus); identical to SEQ ID NO: 540639

SEQ ID NO: 540652 - RNA, 64 nt, Human Herpes Virus 4 (Epstein Barr virus); identical to SEQ ID NO: 540640

SEQ ID NO: 540653 - RNA, 64 nt, Human Herpes Virus 4 (Epstein Barr virus); identical to SEQ ID NO: 540641

SEQ ID NO: 540654 - RNA, 64 nt, Human Herpes Virus 4 (Epstein Barr virus); identical to SEQ ID NO: 540642

SEQ ID NO: 540655 - RNA, 64 nt, Human Herpes Virus 4 (Epstein Barr virus); identical to SEQ ID NO: 540643

SEQ ID NO: 540656 - RNA, 64 nt, Human Herpes Virus 4 (Epstein Barr virus); identical to SEQ ID NO: 540644

SEQ ID NO: 540657 - RNA, 64 nt, Human Herpes Virus 4 (Epstein Barr virus); identical to SEQ ID NO: 540633

SEQ ID NO: 540658 - RNA, 64 nt, Human Herpes Virus 4 (Epstein Barr virus); identical to SEQ ID NO: 540634

SEQ ID NO: 540659 - RNA, 64 nt, Human Herpes Virus 4 (Epstein Barr virus); identical to SEQ ID NO: 540635

SEQ ID NO: 540660 - RNA, 64 nt, Human Herpes Virus 4 (Epstein Barr virus); identical to SEQ ID NO: 540636

SEQ ID NO: 540661 - RNA, 64 nt, Human Herpes Virus 4 (Epstein Barr virus); identical to SEQ ID NO: 540637

SEQ ID NO: 540662 - RNA, 64 nt, Human Herpes Virus 4 (Epstein Barr virus); identical to SEQ ID NO: 540638

SEQ ID NO: 540663 - RNA, 64 nt, Human Herpes Virus 4 (Epstein Barr virus); identical to SEQ ID NO: 540639

SEQ ID NO: 540664 - RNA, 64 nt, Human Herpes Virus 4 (Epstein Barr virus); identical to SEQ ID NO: 540640

SEQ ID NO: 540665 - RNA, 64 nt, Human Herpes Virus 4 (Epstein Barr virus); identical to SEQ ID NO: 540641

SEQ ID NO: 540666 - RNA, 64 nt, Human Herpes Virus 4 (Epstein Barr virus); identical to SEQ ID NO: 540642

SEQ ID NO: 540667 - RNA, 64 nt, Human Herpes Virus 4 (Epstein Barr virus); identical to SEQ ID NO: 540643

SEQ ID NO: 540668 - RNA, 64 nt, Human Herpes Virus 4 (Epstein Barr virus); identical to SEQ ID NO: 540644

SEQ ID NO: 540669 - RNA, 64 nt, Human Herpes Virus 4 (Epstein Barr virus); identical to SEQ ID NO: 540633

SEQ ID NO: 540670 - RNA, 64 nt, Human Herpes Virus 4 (Epstein Barr virus); identical to SEQ ID NO: 540634

SEQ ID NO: 540671 - RNA, 64 nt, Human Herpes Virus 4 (Epstein Barr virus); identical to SEQ ID NO: 540635

SEQ ID NO: 540672 - RNA, 64 nt, Human Herpes Virus 4 (Epstein Barr virus); identical to SEQ ID NO: 540636

SEQ ID NO: 540673 - RNA, 64 nt, Human Herpes Virus 4 (Epstein Barr virus); identical to SEQ ID NO: 540637

SEQ ID NO: 540674 - RNA, 64 nt, Human Herpes Virus 4 (Epstein Barr virus); identical to SEQ ID NO: 540638

SEQ ID NO: 540675 - RNA, 64 nt, Human Herpes Virus 4 (Epstein Barr virus); identical to SEQ ID NO: 540639

SEQ ID NO: 540676 - RNA, 64 nt, Human Herpes Virus 4 (Epstein Barr virus); identical to SEQ ID NO: 540640

SEQ ID NO: 540677 - RNA, 64 nt, Human Herpes Virus 4 (Epstein Barr virus); identical to SEQ ID NO: 540641

SEQ ID NO: 540678 - RNA, 64 nt, Human Herpes Virus 4 (Epstein Barr virus); identical to SEQ ID NO: 540642

SEQ ID NO: 540679 - RNA, 64 nt, Human Herpes Virus 4 (Epstein Barr virus); identical to SEQ ID NO: 540643

SEQ ID NO: 540680 - RNA, 64 nt, Human Herpes Virus 4 (Epstein Barr virus); identical to SEQ ID NO: 540644

SEQ ID NO: 540681 - RNA, 64 nt, Human Herpes Virus 2
guaaccugaccggagucccggugacccuacaagccggguccaaggucgcccagcugcucgucgc

SEQ ID NO: 540682 - RNA, 64 nt, Human Herpes Virus 2
gcuuuacgggggggauuuggccgaguggguuccccggguccacccgaaaacaacgaucgagcgg

SEQ ID NO: 540683 - RNA, 64 nt, Human Herpes Virus 2
ccgccgggaugaucccaacccgcgucacaaccgccggguccaucgccgagauacgcgaccuggc

SEQ ID NO: 540684 - RNA, 57 nt, Human Herpes Virus 2
guuuguuugugcgggugcccauggcgucggcggaaaugcgcgagcgguuggaggcgc

SEQ ID NO: 540685 - RNA, 64 nt, Human Herpes Virus 2
ccggcggggauggccgaaccgccgucguggcgcucggcggaaccucgggcccguccgcgacuac

SEQ ID NO: 540686 - RNA, 64 nt, Human Herpes Virus 2
ccggguacgaggggcgccccacggcgccccucgucggcggaacccaggaguucgccggcgagca

SEQ ID NO: 540687 - RNA, 64 nt, Human Herpes Virus 1
uacauggcaaaccagauucugcgguacugcgaucacucgacauacuucaucaacacccuuacgg

SEQ ID NO: 540688 - RNA, 64 nt, Human Herpes Virus 1; identical to SEQ ID NO: 535681

SEQ ID NO: 540689 - RNA, 64 nt, Human Herpes Virus 1; identical to SEQ ID NO: 535682

SEQ ID NO: 540690 - RNA, 64 nt, Human Herpes Virus 1; identical to SEQ ID NO: 535683

SEQ ID NO: 540691 - RNA, 64 nt, Human Herpes Virus 1; identical to SEQ ID NO: 535684

SEQ ID NO: 540692 - RNA, 64 nt, Human Herpes Virus 1; identical to SEQ ID NO: 535685

SEQ ID NO: 540693 - RNA, 64 nt, Human Herpes Virus 1; identical to SEQ ID NO: 535686

SEQ ID NO: 540694 - RNA, 64 nt, Human Herpes Virus 1; identical to SEQ ID NO: 535687

SEQ ID NO: 540695 - RNA, 64 nt, Human Herpes Virus 1; identical to SEQ ID NO: 535681

SEQ ID NO: 540696 - RNA, 64 nt, Human Herpes Virus 4 (Epstein Barr virus)
acgcgcgcauaauggcggaccuaggccuaaaacccccaggaagcgggucuaugguuggcugcgc

SEQ ID NO: 540697 - RNA, 64 nt, Human Herpes Virus 4 (Epstein Barr virus); identical to SEQ ID NO: 540696

SEQ ID NO: 540698 - RNA, 64 nt, Human Herpes Virus 4 (Epstein Barr virus)
cuggucgugcugcgggcucuggcucuuuggccggcccaggaauagauacagccagcucccugag

SEQ ID NO: 540699 - RNA, 64 nt, Human Herpes Virus 4 (Epstein Barr virus)
ugagaagaagcugcggcagccaucauccaggaggcccaggaagaaggagaagcuccgagaacag

SEQ ID NO: 540700 - RNA, 64 nt, Human Herpes Virus 4 (Epstein Barr virus)
aaggaaggccuggaaacuacaaccuacaucaccucccaggaaguccaaaacuccaucuugagcu

SEQ ID NO: 540701 - RNA, 64 nt, Human Herpes Virus 4 (Epstein Barr virus)
gccugugcgcauguccaaggugcugaugcugugccccaggaacaucaagaucaagaacagggug

SEQ ID NO: 540702 - RNA, 64 nt, Human Herpes Virus 2
augcucaacgacgcgcgggacgccuggcggacgacaugacgagcccgggagaaguuccugcaca

SEQ ID NO: 540703 - RNA, 64 nt, Human Herpes Virus 2
acgugcaccgggcgcucggcuaugcuucccggccgucaccgacagccgcggagcagauauccgc

SEQ ID NO: 540704 - RNA, 64 nt, Human Herpes Virus 2
cauggacuggcuauuaauaaacgagcuccugcaggucaccgacggcguguuucgcgccucggcg

SEQ ID NO: 540705 - RNA, 64 nt, Human Herpes Virus 2
gcuggucgcgucccucgcggggcugcgguccgucgucaccgagacgacggcgcaccucggggua

SEQ ID NO: 540706 - RNA, 64 nt, Human Herpes Virus 2
cgggcggcgucuggguuuuuugccccccacaacccccggggagccacccagacggcaccgccgc

SEQ ID NO: 540707 - RNA, 64 nt, Human Herpes Virus 2
cccccacggcuggcccgcguucgcaccaacaacccccggggacgacgcggggggcggcacugcc

SEQ ID NO: 540708 - RNA, 64 nt, Human Herpes Virus 2
acccccguccuccccccgagacccgacccccgcccccggggacacagggacgcccgcgcccgcg

SEQ ID NO: 540709 - RNA, 64 nt, Human Herpes Virus 2
ccauauggagacccuggaggccauucuguuugcccccggggagacguuugggacgaacgucucc

SEQ ID NO: 540710 - RNA, 64 nt, Human Herpes Virus 2
ggcgaugggguggcuccagaacccgcgcguggcgcccggggacguggcgcuggaccaggccugc

SEQ ID NO: 540711 - RNA, 64 nt, Human Herpes Virus 2
cggggcugcguucugggggcuguucaacguggaccccggggacgcggacgccgcgcacggcgcg

SEQ ID NO: 540712 - RNA, 64 nt, Human Herpes Virus 2
cgacgccgacgccgggcgcuucgucuuucaccaacccggggaccucgccgaggagaacgugcac

SEQ ID NO: 540713 - RNA, 64 nt, Human Herpes Virus 2
gggcauccgggaccucaaccccgacccccggacgcccggggagcuccccgaccucaacgugcug

SEQ ID NO: 540714 - RNA, 64 nt, Human Herpes Virus 2
uuggcccacucgcgcgugcuggccggccuggccgcccggggagcagcgggcugcgcggccgacu

SEQ ID NO: 540715 - RNA, 64 nt, Human Herpes Virus 2
cguggaccagcucgaggcggaccccgaggcgcagcccggggacgggggccgguucgugagccug

SEQ ID NO: 540716 - RNA, 64 nt, Human Herpes Virus 2
cucggcguuucggccuuccgccggcccgggggcccccggggaccuggaggcccaagaugccggc

SEQ ID NO: 540717 - RNA, 64 nt, Human Herpes Virus 2
uaagccgcgucagcccgcggucggcgugcgcgcccccggggacgcugauggcgcgcgugcggac

SEQ ID NO: 540718 - RNA, 64 nt, Human Herpes Virus 2
ggugcuguuguucgucgcgcucgucgcgggcgugcccggggagccgccgaacgcggcaggcgca

SEQ ID NO: 540719 - RNA, 64 nt, Human Herpes Virus 2; identical to SEQ ID NO: 540710

SEQ ID NO: 540720 - RNA, 64 nt, Human Herpes Virus 2
gcguuugggugcggacccccgguccugaccacgucccggggacagggugguugguguaauuaau

SEQ ID NO: 540721 - RNA, 62 nt, Human Herpes Virus 2
ccucuccgcggggccgcguacgccgcggcggccgagguuaugcgcgacgcgcugagacgaau

SEQ ID NO: 540722 - RNA, 64 nt, Human Herpes Virus 1
gagauugccaaguuuggucuggucguucgagggacaggcccagacgaccgcguggucgccaacu

SEQ ID NO: 540723 - RNA, 64 nt, Human Herpes Virus 1
ccgggagacggcggcggagcagguggucguccuacaggcccagcgcacagcggcugccgcugcc

SEQ ID NO: 540724 - RNA, 64 nt, Human Herpes Virus 1
guucgacuuugccagccuguaccccagcaucauccaggcccacaaccugugcuucagcacgcuc

SEQ ID NO: 540725 - RNA, 64 nt, Human Herpes Virus 1
aagccuggugcucaccacucgguacuaccugcuucaggcccagcgucuggggggcgcgggggcc

SEQ ID NO: 540726 - RNA, 64 nt, Human Herpes Virus 1
aagcccaaaugcaaugcuacggcgcucggugcgccaggcccagaggcggagcagcgcacgaugg

SEQ ID NO: 540727 - RNA, 64 nt, Human Herpes Virus 1
cccgugcgacagucagaucacccgcaucauccgacaggcccagguccacguugacgaguuuucc

SEQ ID NO: 540728 - RNA, 64 nt, Human Herpes Virus 1
cuuucaugaauuuggguuucgcgggaaucacguccaggcccaacugggacaguacccguacacc

SEQ ID NO: 540729 - RNA, 64 nt, Human Herpes Virus 1
cccuagggauggggcuguucuucuggagcgcucgcaggcccaccuuugacccgcacggccuucc

SEQ ID NO: 540730 - RNA, 64 nt, Human Herpes Virus 1
ggcccccccgcuguacgcaacggggcgccugagccaggcccagcucaugcccuccccacccaug

SEQ ID NO: 540731 - RNA, 64 nt, Human Herpes Virus 2
ggugggccgugaugcgcgggcggcgggucgccugccgcaggauaaccgcguccacggggugccc

SEQ ID NO: 540732 - RNA, 64 nt, Human Herpes Virus 2
gcccaacacccccguggaggacgacgagaugacgccgcaggagacaccaccgguacacccguag

SEQ ID NO: 540733 - RNA, 64 nt, Human Herpes Virus 2
cacgcgccccaccggggcgugcguguaccuggaacccuggcacagcgacguucgggccgugcuc

SEQ ID NO: 540734 - RNA, 64 nt, Human Herpes Virus 2
cgggccaucagccgcgggugcaagcccccuucgacccuggcaaaacuggugaccgggcugggau

SEQ ID NO: 540735 - RNA, 64 nt, Human Herpes Virus 2; identical to SEQ ID NO: 540733

SEQ ID NO: 540736 - RNA, 64 nt, Human Herpes Virus 2; identical to SEQ ID NO: 540734

SEQ ID NO: 540737 - RNA, 64 nt, Human Herpes Virus 2
cugggagcacgagcuggugcgcugcuucaagauucugcgccaccgcaacaagcagggccaggaa

SEQ ID NO: 540738 - RNA, 64 nt, Human Herpes Virus 2
caaacgcgaacagcggaccacgggcaugaagcagcugcgccacucccugaagcugcugcagucg

SEQ ID NO: 540739 - RNA, 64 nt, Human Herpes Virus 2
cgcgucgacagccaaggccaugcgcgacugcgugcugcgccaggaaaaucucaucgaggcccug

SEQ ID NO: 540740 - RNA, 64 nt, Human Herpes Virus 2
ugccgccccgaacccgcccggcagcgccaaccgccugcgccaccuggugcgagacugcuaccuc

SEQ ID NO: 540741 - RNA, 64 nt, Human Herpes Virus 2
cccugcuaguugucgcggugggacuccgcgucgucugcgccaaauacgccuuagcagaccccuc

SEQ ID NO: 540742 - RNA, 64 nt, Human Herpes Virus 2
cgcugcagggccuggcgauccugggccugugggucugcgccaccggccuggucguccgcggccc

SEQ ID NO: 540743 - RNA, 64 nt, Human Herpes Virus 2
uugccauuuucuucuuuaaccgcgagcgccgcuacugcgccaccguccaccuccgcagcguaac

SEQ ID NO: 540744 - RNA, 64 nt, Human Herpes Virus 2
gcugcugcgucgcuuucccgcgcucgagggaccccugcgccacccgcgccccgugcugcagccc

SEQ ID NO: 540745 - RNA, 64 nt, Human Herpes Virus 2
cuggcuguggagccgucgcuccaucuccgugguccugcgccaucacuacgggaccaagcagcgc

SEQ ID NO: 540746 - RNA, 64 nt, Human Herpes Virus 2
cgugcggccuguuucaggaagccuacccgaucaccugcgccagcgaccccgcccugcuacgcag

SEQ ID NO: 540747 - RNA, 64 nt, Human Herpes Virus 2
guuugacgcgcaccgguucaugcgagcgucgcugcugcgccaccagguggacccggcccugcuc

SEQ ID NO: 540748 - RNA, 64 nt, Human Herpes Virus 2
ucucgccccaguggguggccgauuacgcguuccucugcgccaagugccugggcgcgccccacug

SEQ ID NO: 540749 - RNA, 64 nt, Human Herpes Virus 2
uccgcugguuaccgagcuccgcaacuucgcggaccuggucaaccacccgcccgucuugcgcgaa

SEQ ID NO: 540750 - RNA, 60 nt, Human Herpes Virus 1
ggcaucuggacgacgggggagcuggugcucgggugcgaugccgcgcuggugcgcgcgcgc

SEQ ID NO: 540751 - RNA, 64 nt, Human Herpes Virus 2; identical to SEQ ID NO: 536841

SEQ ID NO: 540752 - RNA, 64 nt, Human Herpes Virus 2; identical to SEQ ID NO: 536842

SEQ ID NO: 540753 - RNA, 64 nt, Human Herpes Virus 2; identical to SEQ ID NO: 536843

SEQ ID NO: 540754 - RNA, 64 nt, Human Herpes Virus 2; identical to SEQ ID NO: 536844

SEQ ID NO: 540755 - RNA, 64 nt, Human Herpes Virus 2; identical to SEQ ID NO: 536845

SEQ ID NO: 540756 - RNA, 64 nt, Human Herpes Virus 2; identical to SEQ ID NO: 536846

SEQ ID NO: 540757 - RNA, 64 nt, Human Herpes Virus 2; identical to SEQ ID NO: 536847

SEQ ID NO: 540758 - RNA, 64 nt, Human Herpes Virus 2; identical to SEQ ID NO: 536848

SEQ ID NO: 540759 - RNA, 64 nt, Human Herpes Virus 2; identical to SEQ ID NO: 536849

SEQ ID NO: 540760 - RNA, 64 nt, Human Herpes Virus 2; identical to SEQ ID NO: 536850

SEQ ID NO: 540761 - RNA, 64 nt, Human Herpes Virus 2; identical to SEQ ID NO: 536851

SEQ ID NO: 540762 - RNA, 64 nt, Human Herpes Virus 2; identical to SEQ ID NO: 536852

SEQ ID NO: 540763 - RNA, 64 nt, Human Herpes Virus 2; identical to SEQ ID NO: 536853

SEQ ID NO: 540764 - RNA, 64 nt, Human Herpes Virus 2; identical to SEQ ID NO: 536854

SEQ ID NO: 540765 - RNA, 64 nt, Human Herpes Virus 2; identical to SEQ ID NO: 537989

SEQ ID NO: 540766 - RNA, 64 nt, Human Herpes Virus 2; identical to SEQ ID NO: 537990

SEQ ID NO: 540767 - RNA, 64 nt, Human Herpes Virus 2; identical to SEQ ID NO: 537991

SEQ ID NO: 540768 - RNA, 64 nt, Human Herpes Virus 2; identical to SEQ ID NO: 537992

SEQ ID NO: 540769 - RNA, 64 nt, Human Herpes Virus 2; identical to SEQ ID NO: 537993

SEQ ID NO: 540770 - RNA, 64 nt, Human Herpes Virus 1
ucgacgacgcguggcggccccugauggagccugagcuggcgaaccccuuaaccgcccaccuccu

SEQ ID NO: 540771 - RNA, 64 nt, Human Herpes Virus 1
ggggcgugcgccaagcaccccccccgcuaaugacgcuggcgauugcccccccgcccgcggaccc

SEQ ID NO: 540772 - RNA, 64 nt, Human Herpes Virus 1
ucguggaugcggcgugcaugcgcgcuccggucccgcuggcgauggcguacgcccccccggcccc

SEQ ID NO: 540773 - RNA, 64 nt, Human Herpes Virus 1
acuuuauuaaccuggcccccaacaacgugagcgagcuggcgauguacuacauggcaaaccagau

SEQ ID NO: 540774 - RNA, 64 nt, Human Herpes Virus 1
cgcugugucuucucgcgcguaucggucgccuggcgcuggcgaagggagcccgcggcgggccugc

SEQ ID NO: 540775 - RNA, 64 nt, Human Herpes Virus 1
cagcaccaucccgaucgugaacgacccccagacccgcauggaggccgaggaggccgucagggcg

SEQ ID NO: 540776 - RNA, 64 nt, Human Herpes Virus 1
ggugcagauccgaugccgguuucggaauuccacccgcauggaguuccgccuccagauauggcgu

SEQ ID NO: 540777 - RNA, 64 nt, Human Herpes Virus 1; identical to SEQ ID NO: 540775

SEQ ID NO: 540778 - RNA, 63 nt, Human Herpes Virus 1
uacuucaccuucggugggggcuacguguacuucgaggaguacgcguacucccaccagcugagc

SEQ ID NO: 540779 - RNA, 64 nt, Human Herpes Virus 1
cguggccgccacgggcaucgucggccuggccugcgagcacuauuacaccaacggcuacuacguu

SEQ ID NO: 540780 - RNA, 64 nt, Human Herpes Virus 1
cacugccuuccgcggcggcgccuugcuggacgcagagcacuacuggcggcgcgucgugcguguc

SEQ ID NO: 540781 - RNA, 59 nt, Human Herpes Virus 2
ccagccgcccguccucgcccuuucgaacgcccccccacggcgggucuccccgacgcgag

SEQ ID NO: 540782 - RNA, 59 nt, Human Herpes Virus 2
agacgccgccgccccaggggacgagcccgcccccccagcggcccugcccuccccggcca

SEQ ID NO: 540783 - RNA, 59 nt, Human Herpes Virus 2
cgacgccugugccuggaccuucccccggucccccccaacgcauacacgcccuaucaucu

SEQ ID NO: 540784 - RNA, 59 nt, Human Herpes Virus 2
acgcauccgccccccgaaccacacccacgcccccccaaccccgcaaggcgacgaaaagu

SEQ ID NO: 540785 - RNA, 59 nt, Human Herpes Virus 2
gguguuuacgaacgaguuugacgcggacgcccccccaagcaagcggggggccggggggu

SEQ ID NO: 540786 - RNA, 59 nt, Human Herpes Virus 2
ggugggcggggagggccccggccccaccgcccccccacaggcggcgcgugcggagggcg

SEQ ID NO: 540787 - RNA, 59 nt, Human Herpes Virus 2
cacgcccggaacccggggcaccgcccguacccccccaacggacccaaagacgcacccac

SEQ ID NO: 540788 - RNA, 59 nt, Human Herpes Virus 2
acccgcggacgcuccccccggcucgccagcccccccaccccccgaacaucgcggcggac

SEQ ID NO: 540789 - RNA, 59 nt, Human Herpes Virus 2
ggagccgagcugcgaucccacccaaacaccccccccaaaccccgacgccguucgucguc

SEQ ID NO: 540790 - RNA, 59 nt, Human Herpes Virus 2
gcgugacgaacgcacgccggucagcguuccccccccaaccccccccccgucgucccccc

SEQ ID NO: 540791 - RNA, 59 nt, Human Herpes Virus 2
ucuggacgcggaguacuggagcguucugacccccccaggcgaggccgacgacccccugc

SEQ ID NO: 540792 - RNA, 59 nt, Human Herpes Virus 2
ggucggcgucggcgauccccaacgcacugcccccccauaucuuggcggaaacguucgag

SEQ ID NO: 540793 - RNA, 59 nt, Human Herpes Virus 2
gccgggccggccguugucggcaccccagacccccccaucuccccggaggagcagcucac

SEQ ID NO: 540794 - RNA, 59 nt, Human Herpes Virus 2
agcagcugcggcccgcgguccagcugccucccccccagccucccgaggugggcagcagc

SEQ ID NO: 540795 - RNA, 59 nt, Human Herpes Virus 2
ugccgcugcucagcgcgggaggggccgcgcccccccaccccggccccgacgccgcgguc

SEQ ID NO: 540796 - RNA, 59 nt, Human Herpes Virus 2
ccuacuuacgcagaggcgaccucggaucgcccccccaccuacgccauggucauggccgc

SEQ ID NO: 540797 - RNA, 60 nt, Human Herpes Virus 2
gggggagugcgcucuucgcggcggccgcacccacgacauccgcggcuuuaucaccccgcu

SEQ ID NO: 540798 - RNA, 60 nt, Human Herpes Virus 2
cccaagaugccggcgguagcacccccgaacccacgacacccggcccacaggacacgcagg

SEQ ID NO: 540799 - RNA, 60 nt, Human Herpes Virus 2
cgagcggguggccgaguucguucaggaacuccacgacacguggaagggccugcagacgga

SEQ ID NO: 540800 - RNA, 60 nt, Human Herpes Virus 2; identical to SEQ ID NO: 540797

SEQ ID NO: 540801 - RNA, 60 nt, Human Herpes Virus 2; identical to SEQ ID NO: 540798

SEQ ID NO: 540802 - RNA, 60 nt, Human Herpes Virus 2; identical to SEQ ID NO: 540799

SEQ ID NO: 540803 - RNA, 64 nt, Human Herpes Virus 1
guccccagucugugcgucaccgccaccggucccaacgcgguaucggcgguauuucuccugaaac

SEQ ID NO: 540804 - RNA, 64 nt, Human Herpes Virus 1
gucuucggugccaguccgcugcaccgauguauuuacgcgguacgccccaccggcaccaacaacg

SEQ ID NO: 540805 - RNA, 64 nt, Human Herpes Virus 1
uggguggaggagagcgucagcgccauuacccuuuacgcgguauggcugcccccccgcgcucgcg

SEQ ID NO: 540806 - RNA, 62 nt, Human Herpes Virus 2
gaugcgguccagacgauuaugggcuuucucaaucaggccaacugcaagaucaucuucgucuc

SEQ ID NO: 540807 - RNA, 62 nt, Human Herpes Virus 2
gccgacgcccugcuggaggcgcaugacguguuucaggccacuacgcccggccuguacgccau

SEQ ID NO: 540808 - RNA, 64 nt, Human Herpes Virus 1
ccaccaccagaggccauauccgacaccccagccccgacggcagccgacagcccggucauggcga

SEQ ID NO: 540809 - RNA, 64 nt, Human Herpes Virus 1
cuucguccucgucguccgacgaggacgaggacgacgacggcaacgacgcggccgaccacgcacg

SEQ ID NO: 540810 - RNA, 64 nt, Human Herpes Virus 1; identical to SEQ ID NO: 540809

SEQ ID NO: 540811 - RNA, 64 nt, Human Herpes Virus 2
aucggaccgugccuggagcccgaggcccgagcucgggcccgagcccgagcccgggcccacgaag

SEQ ID NO: 540812 - RNA, 64 nt, Human Herpes Virus 2
ccgcauccuggccucggcgggggccaacggcccggggcccgagcuccucuucuaucacugcgag

SEQ ID NO: 540813 - RNA, 64 nt, Human Herpes Virus 2
uucggcgcgccguugucuguuucucccgcgccuggggcccgagguccugcaggcggcccugcgc

SEQ ID NO: 540814 - RNA, 64 nt, Human Herpes Virus 2
gucucaucgugcagguggaaagucuucaucgcgugggcccgaaccuguugaacaacuacgacgu

SEQ ID NO: 540815 - RNA, 64 nt, Human Herpes Virus 2
gggcgccccccccgacgcgcgcgcccccgacccggggcccgaagccgaccucgucgcgcgcauc

SEQ ID NO: 540816 - RNA, 64 nt, Human Herpes Virus 2
gcgccaucacgcgggccccgcggggaggcuaccugggcccgauggacccacgcgacguuuuggg

SEQ ID NO: 540817 - RNA, 64 nt, Human Herpes Virus 2; identical to SEQ ID NO: 540811

SEQ ID NO: 540818 - RNA, 64 nt, Human Herpes Virus 2
gcgcagggauccugugggggugggcccgugggugaggaggaagcggaagcgggaggggggggcg

SEQ ID NO: 540819 - RNA, 64 nt, Human Herpes Virus 2
gaggacuaccccaucguggacgccgcgggugcggaggaggaagacgaggccgacgaugacgccc

SEQ ID NO: 540820 - RNA, 64 nt, Human Herpes Virus 2
agcgucgagaacguggggcuccugccgcaccucaaggaggaacucgcccgcuucaucaugggcg

SEQ ID NO: 540821 - RNA, 64 nt, Human Herpes Virus 2
cggcugggggccggcggcgcgaccgggggggccgaggaggaagagccccgggccgccgcggagg

SEQ ID NO: 540822 - RNA, 64 nt, Human Herpes Virus 2; identical to SEQ ID NO: 540818

SEQ ID NO: 540823 - RNA, 64 nt, Human Herpes Virus 1; identical to SEQ ID NO: 540256

SEQ ID NO: 540824 - RNA, 64 nt, Human Herpes Virus 1; identical to SEQ ID NO: 540257

SEQ ID NO: 540825 - RNA, 64 nt, Human Herpes Virus 1; identical to SEQ ID NO: 540258

SEQ ID NO: 540826 - RNA, 64 nt, Human Herpes Virus 1; identical to SEQ ID NO: 540259

SEQ ID NO: 540827 - RNA, 64 nt, Human Herpes Virus 1; identical to SEQ ID NO: 540260

SEQ ID NO: 540828 - RNA, 64 nt, Human Herpes Virus 1; identical to SEQ ID NO: 540261

SEQ ID NO: 540829 - RNA, 64 nt, Human Herpes Virus 1; identical to SEQ ID NO: 540262

SEQ ID NO: 540830 - RNA, 64 nt, Human Herpes Virus 1; identical to SEQ ID NO: 540263

SEQ ID NO: 540831 - RNA, 64 nt, Human Herpes Virus 2
ccgucccggccgcgagcucgcaauccccgcggugcucggcgagccaagucacgaacccccaguu

SEQ ID NO: 540832 - RNA, 64 nt, Human Herpes Virus 2
gcaggcgcuccuggcgggcgguuaaaagccgggccucggcgacgggccccacuuacauucgcgu

SEQ ID NO: 540833 - RNA, 64 nt, Human Herpes Virus 2
cauccggcacuacgcgucggccgccaagcaggcgcucggcgagguggagcugucgggcggccag

SEQ ID NO: 540834 - RNA, 64 nt, Human Herpes Virus 4 (Epstein Barr virus)
agcuucucaccgaggccaggcggagccuggcgcgcggcccgaggccccccaccguggccauccu

SEQ ID NO: 540835 - RNA, 64 nt, Human Herpes Virus 4 (Epstein Barr virus)
gaagacagggaaaggccaucggauaucgacaccgcggcccgagcccagaagguugagaccuccu

SEQ ID NO: 540836 - RNA, 64 nt, Human Herpes Virus 2
cgacgcagggacaggccuccgccacggcgggggcgcgccacagcgcguuggcggaaucgaugug

SEQ ID NO: 540837 - RNA, 64 nt, Human Herpes Virus 2
gaaaaaucuuaagccgcucguccccccgaacgacgcgccacacgaagacagaguuggcgaugcg

SEQ ID NO: 540838 - RNA, 64 nt, Human Herpes Virus 2
ccggguuucuggcgugccgggcgacccgcggcaugcgccacaucgcccuggggcgacagggguc

SEQ ID NO: 540839 - RNA, 64 nt, Human Herpes Virus 2; identical to SEQ ID NO: 540836

SEQ ID NO: 540840 - RNA, 64 nt, Human Herpes Virus 2; identical to SEQ ID NO: 540837

SEQ ID NO: 540841 - RNA, 64 nt, Human Herpes Virus 2; identical to SEQ ID NO: 540838

SEQ ID NO: 540842 - RNA, 58 nt, Human Herpes Virus 1
cuacggaaccaagcagcgcuucgucgucgucuccuacgagaacuccguggcguggggc

SEQ ID NO: 540843 - RNA, 64 nt, Human Herpes Virus 1
uggucgccgccuuugcccucggcauggccgugcuccgcugcacccgcgccuaucuguaucacag

SEQ ID NO: 540844 - RNA, 64 nt, Human Herpes Virus 1
cgugcucgugugguacaccgucuucggugccaguccgcugcaccgauguauuuacgcgguacgc

SEQ ID NO: 540845 - RNA, 61 nt, Human Herpes Virus 4 (Epstein Barr virus)
gggcuucagagcccaggaugucccccagaagggacccuaggcguccccucuccuccccucc

SEQ ID NO: 540846 - RNA, 61 nt, Human Herpes Virus 4 (Epstein Barr virus); identical to SEQ ID NO: 540845

SEQ ID NO: 540847 - RNA, 61 nt, Human Herpes Virus 4 (Epstein Barr virus); identical to SEQ ID NO: 540845

SEQ ID NO: 540848 - RNA, 61 nt, Human Herpes Virus 4 (Epstein Barr virus); identical to SEQ ID NO: 540845

SEQ ID NO: 540849 - RNA, 61 nt, Human Herpes Virus 4 (Epstein Barr virus); identical to SEQ ID NO: 540845

SEQ ID NO: 540850 - RNA, 61 nt, Human Herpes Virus 4 (Epstein Barr virus); identical to SEQ ID NO: 540845

SEQ ID NO: 540851 - RNA, 61 nt, Human Herpes Virus 4 (Epstein Barr virus); identical to SEQ ID NO: 540845

SEQ ID NO: 540852 - RNA, 61 nt, Human Herpes Virus 4 (Epstein Barr virus); identical to SEQ ID NO: 540845

SEQ ID NO: 540853 - RNA, 61 nt, Human Herpes Virus 4 (Epstein Barr virus)
ccggaaucgccgccgugacucacgacagggcggacccuaacagggucaucguccugggccu

SEQ ID NO: 540854 - RNA, 61 nt, Human Herpes Virus 4 (Epstein Barr virus)
cggucucagacaccaacacagacugcgaucuggacccuauggagggcagcgaagaacacuc

SEQ ID NO: 540855 - RNA, 61 nt, Human Herpes Virus 4 (Epstein Barr virus)
agagcgugggucaguaugucugcgcucuccuggacccuaaccugcuccccccgguggccua

SEQ ID NO: 540856 - RNA, 64 nt, Human Herpes Virus 1
caucuaugacaccguugggggguacgaccccgagcccgccgaggaccccguguacagcaccguc

SEQ ID NO: 540857 - RNA, 64 nt, Human Herpes Virus 1
gcacuuuuuucuccgcgcgcucacgggcucggcccccgccgacaucgcccgcugcgucguccac

SEQ ID NO: 540858 - RNA, 64 nt, Human Herpes Virus 1
cgacccgcccgagucagcggcccgccaguuaccacccgccgaccaaacccccaccuccacggag

SEQ ID NO: 540859 - RNA, 64 nt, Human Herpes Virus 1
gcaugacgcggccgucugguucgaggauaugacccccgccgagcuggagguugucuucccgacu

SEQ ID NO: 540860 - RNA, 64 nt, Human Herpes Virus 1
ucgugcugggacgcugcuucuggcgcugcggcaccccgccgaccugccucaccuggcccaccag

SEQ ID NO: 540861 - RNA, 64 nt, Human Herpes Virus 1
gccuugucgaaucucgaccccaccacucgccggacccgccgacguccccucucgagcccgccga

SEQ ID NO: 540862 - RNA, 64 nt, Human Herpes Virus 1
ccacucgccggacccgccgacguccccucucgagcccgccgaaacccgccgcgucuguugaaau

SEQ ID NO: 540863 - RNA, 64 nt, Human Herpes Virus 1
agaugcagcgccugugucuggacguuccuccggucccgccgaacgcauacaugcccuauuaucu

SEQ ID NO: 540864 - RNA, 64 nt, Human Herpes Virus 1
ggcccgcccgcgccccguggccgugucgcgccggcccgccgagggccccgacccccugggcggc

SEQ ID NO: 540865 - RNA, 64 nt, Human Herpes Virus 1
caucguggucaacaccgugcgcgccugcgacuggcccgccgacgggcccgcggugucgcggcag

SEQ ID NO: 540866 - RNA, 64 nt, Human Herpes Virus 1
guuuccgcaagccccuagccccgcccccuuuguccccgccgacaagccgcgauuccgagggccg

SEQ ID NO: 540867 - RNA, 64 nt, Human Herpes Virus 1
ccccccaggccgugcuggcguucguggcccucaucccgccgaccuugcccggcacaaacaucgu

SEQ ID NO: 540868 - RNA, 64 nt, Human Herpes Virus 1
cugcgcccccagccuaacggccggccagacggcccccgccgagagcagcuucgagggcgacguu

SEQ ID NO: 540869 - RNA, 64 nt, Human Herpes Virus 1
ggcguuugacgaaaaccacgagggcgccgcccuccccgccgacauuacguucacggccuucgaa

SEQ ID NO: 540870 - RNA, 64 nt, Human Herpes Virus 1
cgcgucuggaaucugggcagcuucacccugggaccccgccgaccgaggcgucaccccccgcucc

SEQ ID NO: 540871 - RNA, 64 nt, Human Herpes Virus 1; identical to SEQ ID NO: 540865

SEQ ID NO: 540872 - RNA, 64 nt, Human Herpes Virus 1; identical to SEQ ID NO: 540864

SEQ ID NO: 540873 - RNA, 64 nt, Human Herpes Virus 1
ggcccgugcccgggcccuggcccgcggagccggcccggcgaacucggucuaacguuacacccga

SEQ ID NO: 540874 - RNA, 64 nt, Human Herpes Virus 1
gugcgggccgugcuccggaugaaggggguccucgccggcgaagaggcccagcgcugcgacaaua

SEQ ID NO: 540875 - RNA, 64 nt, Human Herpes Virus 1
gucgcgugcaucgaaacccacuuucccgaacacgccggcgaauaucaggccguauccguccggc

SEQ ID NO: 540876 - RNA, 64 nt, Human Herpes Virus 1; identical to SEQ ID NO: 540873

SEQ ID NO: 540877 - RNA, 64 nt, Human Herpes Virus 2
cagcacgagcuuuuuguacaaccuccgcggggccgccgacgagcugcucaacguggucaccuau

SEQ ID NO: 540878 - RNA, 64 nt, Human Herpes Virus 2
gcucggggccgccuacgcggcgcugcuggugcuggccgacgacguccauccccuuuuccuccuc

SEQ ID NO: 540879 - RNA, 64 nt, Human Herpes Virus 2
agccucgacgccucgcccggcagcgcggcggggagccgacgauccgccacccgcgaccaccggc

SEQ ID NO: 540880 - RNA, 64 nt, Human Herpes Virus 2
cguggacgccgcgggugcggaggaggaagacgaggccgacgaugacgccccggaugacguggcc

SEQ ID NO: 540881 - RNA, 64 nt, Human Herpes Virus 2
guggcacggugggccggaggagaacgaagacgaggccgacgacgccgccgccgaugccgaugcc

SEQ ID NO: 540882 - RNA, 64 nt, Human Herpes Virus 2
agacgaggccgacgacgccgccgccgaugccgaugccgacgaggcggccccggcguccggggag

SEQ ID NO: 540883 - RNA, 64 nt, Human Herpes Virus 2
cgccgccccguugccgucggcggcggcgucgccggccgacgagcgcgcggugcccgccggcuac

SEQ ID NO: 540884 - RNA, 64 nt, Human Herpes Virus 2
ccugagcgccgcgcccgccuccgcgccggccggggccgacgacgacgacgacgacgacggcgcc

SEQ ID NO: 540885 - RNA, 64 nt, Human Herpes Virus 2
ggaguacuggagcguucugacccccccaggcgaggccgacgacccccugccccaaacggccuuc

SEQ ID NO: 540886 - RNA, 64 nt, Human Herpes Virus 2
acgaagucaugucgacguugggccaacuguacucgccgacgaugcagcagcugggccgcgucga

SEQ ID NO: 540887 - RNA, 64 nt, Human Herpes Virus 2
gcugcacaacacccaggcccgcgcggccgacgccgccgacgaccggccgcaccggccggccgac

SEQ ID NO: 540888 - RNA, 64 nt, Human Herpes Virus 2
cgcgcgaccucaccacgaaggcccgggccacgucgccgacgacccgcaacuugcugacgacccc

SEQ ID NO: 540889 - RNA, 64 nt, Human Herpes Virus 2
ccgacgacgccggcggcccccgcacuugccccccgccgacgaaccuucccccccccgccaccga

SEQ ID NO: 540890 - RNA, 64 nt, Human Herpes Virus 2
uguucggucgcuucgugcgcaccagcgcccccucgccgacgaggucgauggacgcggcggccga

SEQ ID NO: 540891 - RNA, 64 nt, Human Herpes Virus 2
ccuuugaccaacacacgcggccacgcgacgccgcgccgacgaacccccccccgcccccccucgc

SEQ ID NO: 540892 - RNA, 64 nt, Human Herpes Virus 2
gggguacgccuacaucaacucgggucagcuggaggccgacgacgccugcgcgaaccucuaucau

SEQ ID NO: 540893 - RNA, 64 nt, Human Herpes Virus 2
ccucagcgcggccgugggcguccugcggcagcgcgccgacgaccugcagccggcguuucugacc

SEQ ID NO: 540894 - RNA, 64 nt, Human Herpes Virus 2; identical to SEQ ID NO: 540884

SEQ ID NO: 540895 - RNA, 64 nt, Human Herpes Virus 2; identical to SEQ ID NO: 540883

SEQ ID NO: 540896 - RNA, 64 nt, Human Herpes Virus 2; identical to SEQ ID NO: 540882

SEQ ID NO: 540897 - RNA, 64 nt, Human Herpes Virus 2; identical to SEQ ID NO: 540881

SEQ ID NO: 540898 - RNA, 59 nt, Human Herpes Virus 2
ggccgcggcucccggggggccuggcgucgccuggggacgccagagugcccgcugugcca

SEQ ID NO: 540899 - RNA, 59 nt, Human Herpes Virus 2
cggcccggccccgcccgagaccgaggacgccuggggagugggggugccgcuuuccccca

SEQ ID NO: 540900 - RNA, 59 nt, Human Herpes Virus 2
gacggcaucaucgagcuguuucacuacccccuggggaaccacugcccccgcguuguaca

SEQ ID NO: 540901 - RNA, 59 nt, Human Herpes Virus 2
gccgcgacggaggcggcggcccaccugucccuggggaugggggaaagcggcacccccac

SEQ ID NO: 540902 - RNA, 59 nt, Human Herpes Virus 2
cugcuucgacgaugcgacccccagaucggccuggggaagcucgcccagcuaaaacucaa

SEQ ID NO: 540903 - RNA, 59 nt, Human Herpes Virus 2
caguacguggaccaggcggugcccacggcccuggggaggcuggagacgauuaucggcaa

SEQ ID NO: 540904 - RNA, 59 nt, Human Herpes Virus 2
ugccugacccucucgggcaugggcuacuaccuggggaucgggggcugcugccccgcgug

SEQ ID NO: 540905 - RNA, 64 nt, Human Herpes Virus 2
caacagcgauguuguuuucccgggagguucccccguggcucaauauuguuaugccuauccccgg

SEQ ID NO: 540906 - RNA, 64 nt, Human Herpes Virus 2
gguggggcgcgcaggguccgugcuucucgucccaguggcucacccacaacgccagccugcggcu

SEQ ID NO: 540907 - RNA, 64 nt, Human Herpes Virus 2
cgcgugugcgagcugacggccagucacacuaucgcccccuuauaugugcacggcaaauacuucu

SEQ ID NO: 540908 - RNA, 64 nt, Human Herpes Virus 1
ggaugggggggcggucucgggggggagccccccccgcgaggaagaccccggcaguugcgggggc

SEQ ID NO: 540909 - RNA, 64 nt, Human Herpes Virus 1
ggcgggugacguccugcacugcccgcugaaccaacgcgaggaucuccucguucuccugugcgau

SEQ ID NO: 540910 - RNA, 64 nt, Human Herpes Virus 1
gcuggaggagccccgcgccgacucuggccucacccgcgaggagguacgugccguacguggguuc

SEQ ID NO: 540911 - RNA, 64 nt, Human Herpes Virus 1
gcggccagaggaggagggggaggacgaggacgaacgcgaggagggcgggggcgagcgggagccg

SEQ ID NO: 540912 - RNA, 64 nt, Human Herpes Virus 1
cgcgcucaugcuggaguacuuuugccggugcgcccgcgaggaaaccaagcgugucccccccagg

SEQ ID NO: 540913 - RNA, 64 nt, Human Herpes Virus 1
guucaccacgaguaccugcgucaccuuugcugcccgcgaggagggcgugucguccagcaccagc

SEQ ID NO: 540914 - RNA, 64 nt, Human Herpes Virus 1
cggcguacgagaagccaucgccuuccuuccaaaacgcgaggaggaugccgguuucgacauuguc

SEQ ID NO: 540915 - RNA, 64 nt, Human Herpes Virus 1
ccaacgcaaccagcuucccgcccggcuccugucgcgcgaggacaucgagaccaucgcguucauu

SEQ ID NO: 540916 - RNA, 64 nt, Human Herpes Virus 1
uccgccgcucgaggccaacaagaugguucgcagccgcgaggaggugcgcgugucgacggcccuc

SEQ ID NO: 540917 - RNA, 64 nt, Human Herpes Virus 1; identical to SEQ ID NO: 540908

SEQ ID NO: 540918 - RNA, 64 nt, Human Herpes Virus 4 (Epstein Barr virus)
cguuggaaaacauuagcgacauuuaccuggugagcaaucagacaugcgacggcuuuagccuggc

SEQ ID NO: 540919 - RNA, 64 nt, Human Herpes Virus 4 (Epstein Barr virus)
gccaagugcaacaggaaauggaaaggcagugcggcaaucagaagggggagugcguaguguugug

SEQ ID NO: 540920 - RNA, 64 nt, Human Herpes Virus 2
gguuuaccgcgaccagcguccugcgcguugacgucacccccagggggcgguugcgguucguucu

SEQ ID NO: 540921 - RNA, 64 nt, Human Herpes Virus 2
cuacgggccguauccgccgguggggcccuaccaccacccccacgcagacacggagacccccgcc

SEQ ID NO: 540922 - RNA, 64 nt, Human Herpes Virus 2
cguucgcguguuccgcccuccgucgcugaccauccacccccacgcggugcuggagggccagccg

SEQ ID NO: 540923 - RNA, 64 nt, Human Herpes Virus 2
agcugaacauccgcgaguacguaaagcaaaacgucacccccagggaaaccgcccuggcgggaga

SEQ ID NO: 540924 - RNA, 64 nt, Human Herpes Virus 2
accgccugccccgcggaggcguggugauacaacacacccccaucgggcugcuggugauuaucga

SEQ ID NO: 540925 - RNA, 64 nt, Human Herpes Virus 2
cggcccaccugucccuggggaugggggaaagcggcacccccacuccccaggcguccucggucuc

SEQ ID NO: 540926 - RNA, 64 nt, Human Herpes Virus 2
ccggcgcccgccggcaugacccccccguccgcuccacccccaaacggaccguugcagguccugu

SEQ ID NO: 540927 - RNA, 64 nt, Human Herpes Virus 2
cgagcgcgggccaguuugucguuauugauaucgacacccccacggacucgccuccaccguacuc

SEQ ID NO: 540928 - RNA, 64 nt, Human Herpes Virus 2
ugacccccccauggcauccgggguuuccccggcccacccccaaaccccgguuggggcgggcagc

SEQ ID NO: 540929 - RNA, 63 nt, Human Herpes Virus 2
guuguugaaaaccucguuccgggccucuagucucgcggagacuacgggccccccgaagaaacg

SEQ ID NO: 540930 - RNA, 63 nt, Human Herpes Virus 2
ggcagcgccgucgcccaccgcgggccccgccgccgcggagauggagguucagaucguacgcaa

SEQ ID NO: 540931 - RNA, 63 nt, Human Herpes Virus 2
ugcuucccugcuggugccgaucugggaccgcgccgcggagacauucgaguaccagaucgaacu

SEQ ID NO: 540932 - RNA, 63 nt, Human Herpes Virus 2
guucguggcgcucagcgggagucuggaggcgcccgcggagacguuugcgcgccaccuggaccg

SEQ ID NO: 540933 - RNA, 63 nt, Human Herpes Virus 2
gcggugcacacaccggacguauggcgaugucugcgcggagauccauaaaagggaacgggagga

SEQ ID NO: 540934 - RNA, 64 nt, Human Herpes Virus 4 (Epstein Barr virus)
aaggacgggcucggagaaauggggccggccagggccacgggaccuggaaugcagcaguuuguca

SEQ ID NO: 540935 - RNA, 64 nt, Human Herpes Virus 4 (Epstein Barr virus)
gauggccuggagagcaugcaggucaggucccccuccacgggagggcgcucugcgccagccccgc

SEQ ID NO: 540936 - RNA, 64 nt, Human Herpes Virus 4 (Epstein Barr virus)
cgggaaugacgggcucccucccccucccuacucuccacgggaugacucaucucaacacauauac

SEQ ID NO: 540937 - RNA, 64 nt, Human Herpes Virus 4 (Epstein Barr virus)
ggacggggaagaggacgaggacgaggaggcggaagaccaggagccccgggcggcucaggaucag

SEQ ID NO: 540938 - RNA, 64 nt, Human Herpes Virus 4 (Epstein Barr virus)
cuccccauucuccuucuccuccucagacuuuuccgaccaggacgagggagagggaggggaggca

SEQ ID NO: 540939 - RNA, 64 nt, Human Herpes Virus 4 (Epstein Barr virus)
gguauuccucaagcccuucuucguuaugcacucugaccaggacaucgugcuaagcguccugaau

SEQ ID NO: 540940 - RNA, 64 nt, Human Herpes Virus 4 (Epstein Barr virus)
gaggacuuuaagggcuaccuuggaugccaggcccugucagaaaugauccaauucuaccuggagg

SEQ ID NO: 540941 - RNA, 64 nt, Human Herpes Virus 4 (Epstein Barr virus)
aagggcuggauaccccugugaauggacagguacuaacacgcaauaaaguuuacuuucaagccac

SEQ ID NO: 540942 - RNA, 64 nt, Human Herpes Virus 1
cgccgauucccgaaacuucaucacccccgaguucccccgggacuuuuggaugucgcccgucuuu

SEQ ID NO: 540943 - RNA, 64 nt, Human Herpes Virus 1
ccgggacuuuuggaugucgcccgucuuuaaccucccccgggagacggcggcggagcaggugguc

SEQ ID NO: 540944 - RNA, 64 nt, Human Herpes Virus 1
ccacggggugcucccggcggccccgggggacgucccccgggacgcgaguacccacguuaacccc

SEQ ID NO: 540945 - RNA, 63 nt, Human Herpes Virus 1
aagucucugugggugcgcgcauggcagccgaugccccgggagaccggauggaggagccccugc

SEQ ID NO: 540946 - RNA, 64 nt, Human Herpes Virus 1
cccccccgcggcccugcccuccccggccaagcgcccccgggagacgccgucgccugccgacccc

SEQ ID NO: 540947 - RNA, 64 nt, Human Herpes Virus 1
aagcgcccccgggagacgccgucgccugccgaccccccgggaggcgcguccaagccccgcaagc

SEQ ID NO: 540948 - RNA, 64 nt, Human Herpes Virus 1
cguggagcaaugacaccgcgccccuggauguuugccccgggacccccggcccgggcgccgacgc

SEQ ID NO: 540949 - RNA, 64 nt, Human Herpes Virus 1
ucgggcuaugcgugcaggcguuuaacgacuccggccccgggaccgccagcgucaugcccgcccu

SEQ ID NO: 540950 - RNA, 64 nt, Human Herpes Virus 1
ugcgggcaucggaacacgccuaccggccccugggccccgggacaccccccaugcgggcucggcu

SEQ ID NO: 540951 - RNA, 64 nt, Human Herpes Virus 1
uggucguagcgccuaaaaggacgcgggaauuugcccccgggacccugcgggucgacgugacguu

SEQ ID NO: 540952 - RNA, 64 nt, Human Herpes Virus 1
gaauaucggggaguacgucaaacacaacgugaccccccgggagaccguccuggauggcgauacg

SEQ ID NO: 540953 - RNA, 64 nt, Human Herpes Virus 1
ccauuuucacgccccgcccaccuaucucgcuuccccccgggagauccguguccugcacagccug

SEQ ID NO: 540954 - RNA, 64 nt, Human Herpes Virus 1
ugggcucccauuuuacccgaagaucggcugcuauccccgggacauggaucgcggggcgguggug

SEQ ID NO: 540955 - RNA, 64 nt, Human Herpes Virus 1
ugggcgccgcgccuccacccccgacaaccgccugccccgggacggccgaguuucuccagcccac

SEQ ID NO: 540956 - RNA, 64 nt, Human Herpes Virus 1
gacgacaacgcgacgccguucggcggcccgggggccccgggaccggcauuugccggccgcaaac

SEQ ID NO: 540957 - RNA, 64 nt, Human Herpes Virus 1
cggcaugcccagaagcaacccaagcccucgcccuccccgggagccgccaaggugcaguacucca

SEQ ID NO: 540958 - RNA, 64 nt, Human Herpes Virus 1
ugccugucuucgaccagcaccgcacggcuacaacccccgggacugccauucccgccccgccccc

SEQ ID NO: 540959 - RNA, 64 nt, Human Herpes Virus 1
cggauacgaagacgacgaggaccucccccuggauccccgggacguuaccgggggccaccccggc

SEQ ID NO: 540960 - RNA, 64 nt, Human Herpes Virus 1
cggacgccuccgcugccggucgcuccaagggcccccccgggaaggcgggucuguggaccguagg

SEQ ID NO: 540961 - RNA, 64 nt, Human Herpes Virus 1
cagggagccccggucuccccgggagccccggucuccccgggagccccggaccccacgcaccccc

SEQ ID NO: 540962 - RNA, 64 nt, Human Herpes Virus 1
acgacaaccccggucucccagggagccccggucuccccgggagccccggucuccccgggagccc

SEQ ID NO: 540963 - RNA, 64 nt, Human Herpes Virus 1
ccgaccgccaacaauccccaggacaccgcguguuccccgggagccccggguuccgcgaccaccc

SEQ ID NO: 540964 - RNA, 64 nt, Human Herpes Virus 2
ccgcgcuggggacgcgcggcaggagguccgggugcgccgggaugacgggggcuaggaucgcccc

SEQ ID NO: 540965 - RNA, 64 nt, Human Herpes Virus 2
cccucccccgcacacgcccaccccccuccgccgccgccgggacccacgccuccccccgccgcga

SEQ ID NO: 540966 - RNA, 64 nt, Human Herpes Virus 2
agcuccacgagcgauuuauggacgccaucacgcccgccgggaccgucaucacgcuucugggucu

SEQ ID NO: 540967 - RNA, 64 nt, Human Herpes Virus 2
ggccaggcccggguaccgcccgcguucccggaaccgccgggaaccaagcggaggcaccccgggg

SEQ ID NO: 540968 - RNA, 64 nt, Human Herpes Virus 2
aagaccccgaggacucggcccucuuagaggaucccgccgggacggugucuucgcagaucccccc

SEQ ID NO: 540969 - RNA, 64 nt, Human Herpes Virus 2
ccuaggggagcugacggcagaacuccugucgcuacgccgggacgccgccggcgcaucggcaacc

SEQ ID NO: 540970 - RNA, 64 nt, Human Herpes Virus 2
ccgucgggugucgagacgcccuguugcgccucaccgccgggaugaucccaacccgcgucacaac

SEQ ID NO: 540971 - RNA, 64 nt, Human Herpes Virus 2
ccagccaggguaagccccagcggggcgcgcgcgacgccgggaacaagggcccggcgggcggguu

SEQ ID NO: 540972 - RNA, 64 nt, Human Herpes Virus 2
gcgacaagacccggcggcggucgcgcuuuuccgccgccgggaaccccggcguggagcgccgggc

SEQ ID NO: 540973 - RNA, 64 nt, Human Herpes Virus 2
ggggucgcuuuggccgcgucagcucgggacccagcgccgggacggagggguuccgcgccaugca

SEQ ID NO: 540974 - RNA, 64 nt, Human Herpes Virus 2
gagcgcucgcgcgcccacccucaaacgccaucaacgccgggagccccgacgcacccggagccgc

SEQ ID NO: 540975 - RNA, 64 nt, Human Herpes Virus 2
guccguuacggccaggagccaguccguucgcggacgccgggacagcgccaucacgcgggccccg

SEQ ID NO: 540976 - RNA, 64 nt, Human Herpes Virus 2
ggagauggcgagcgaagagccgcccccgcgccgucgccgggaggcccgcggucaccccgggucc

SEQ ID NO: 540977 - RNA, 64 nt, Human Herpes Virus 4 (Epstein Barr virus)
ugcuccacacccgcgcugccucccuguuauacaauagcaugacagccaaggcugaccgaccaag

SEQ ID NO: 540978 - RNA, 64 nt, Human Herpes Virus 4 (Epstein Barr virus)
cgccugccuucccccgcuuccccuuguuaacuuauagcaugauagguaggucaccuaacgugga

SEQ ID NO: 540979 - RNA, 64 nt, Human Herpes Virus 1
acgccaugaaucgucggaucaugaacguccacgaggcaguuaacugucuggagacccuauggua

SEQ ID NO: 540980 - RNA, 63 nt, Human Herpes Virus 1
cagcuggcguccgacguccagcaguaccuggagcgccucgagaaacagaggcaacuuaaggug

SEQ ID NO: 540981 - RNA, 64 nt, Human Herpes Virus 4 (Epstein Barr virus)
ugugacauugcuugccuuuuugccacauguuuucuggacacaggacuaaccaugccaucucuga

SEQ ID NO: 540982 - RNA, 64 nt, Human Herpes Virus 4 (Epstein Barr virus)
cugccucuccuguuacccuuuuagaaccacagccuggacacaugugccagacgccuuggccucu

SEQ ID NO: 540983 - RNA, 64 nt, Human Herpes Virus 4 (Epstein Barr virus); identical to SEQ ID NO: 540982

SEQ ID NO: 540984 - RNA, 64 nt, Human Herpes Virus 4 (Epstein Barr virus); identical to SEQ ID NO: 540982

SEQ ID NO: 540985 - RNA, 64 nt, Human Herpes Virus 4 (Epstein Barr virus)
cccaccacccccaccaccucagcgcagggaugccuggacacaagagccaucaccucuugauagg

SEQ ID NO: 540986 - RNA, 64 nt, Human Herpes Virus 4 (Epstein Barr virus)
ugccgggacaagcucagccucucagacuacaagcuggacacaguagccaggcaccuacuggggg

SEQ ID NO: 540987 - RNA, 64 nt, Human Herpes Virus 4 (Epstein Barr virus)
aggaugggagccucucuguugcuguugaccugucacuucccaagcccuggcaccugccagugac

SEQ ID NO: 540988 - RNA, 64 nt, Human Herpes Virus 4 (Epstein Barr virus)
cauccacggccuugaccugguacaguccuaucaaacuucccaggucuacgugugaaaaguaaac

SEQ ID NO: 540989 - RNA, 64 nt, Human Herpes Virus 1
cguugggggguacgaccccgagcccgccgaggaccccguguacagcaccguccgccguugguag

SEQ ID NO: 540990 - RNA, 64 nt, Human Herpes Virus 1
cugcgcgcgcuggggccugggcgcgccgcugcggcccguguacguggcgcuggggcgcgaggcg

SEQ ID NO: 540991 - RNA, 64 nt, Human Herpes Virus 1
ucgcgacugccggguuagcgcggggggccacgaccccguguacgcggcggcauguaacguggcg

SEQ ID NO: 540992 - RNA, 64 nt, Human Herpes Virus 1
gguaaccauaggcggggcggaggugcaccgcauacccguguacccguugcagcuguucaugccg

SEQ ID NO: 540993 - RNA, 64 nt, Human Herpes Virus 1; identical to SEQ ID NO: 540990

SEQ ID NO: 540994 - RNA, 64 nt, Human Herpes Virus 2
cgcucaugcuggaguacuucugucggugcgcccgcgaggagagcaagcgcgugcccccacgaac

SEQ ID NO: 540995 - RNA, 64 nt, Human Herpes Virus 2
cgccgcggacccccuccaugcgcgccgauuauggcgaggagaacgacgacgacgacgacgacga

SEQ ID NO: 540996 - RNA, 64 nt, Human Herpes Virus 2
ggcgcuucgucuuucaccaacccggggaccucgccgaggagaacgugcacgcgugcgggguccu

SEQ ID NO: 540997 - RNA, 64 nt, Human Herpes Virus 2
ccaccgcggaggacguguccaucacgcaagagaacgaggagauccucgcgcugguccagcgggc

SEQ ID NO: 540998 - RNA, 64 nt, Human Herpes Virus 2
cgcuggacgcccuccggcggguggccggcuaccccgaggagagcacgaacuacgcccaguauau

SEQ ID NO: 540999 - RNA, 64 nt, Human Herpes Virus 2
gcggcuucuucgccgcccucgcccagacgcccuccgaggagaucgccaucgugcgcucgcucuc

SEQ ID NO: 541000 - RNA, 64 nt, Human Herpes Virus 2
acgagucggugggcgaggauggggggcgcgucuacgaggagauccccuggguucggguauacga

SEQ ID NO: 541001 - RNA, 64 nt, Human Herpes Virus 2
ucauggcgcaguuucggaaacugcucaugggcgacgaggagaccgccgcccuccgggcgcacgu

SEQ ID NO: 541002 - RNA, 64 nt, Human Herpes Virus 2; identical to SEQ ID NO: 540995

SEQ ID NO: 541003 - RNA, 64 nt, Human Herpes Virus 4 (Epstein Barr virus)
aaguugcagcuuuagauggcaaggaaacuuggguuucaggcauagaaagccuggcucacuauag

SEQ ID NO: 541004 - RNA, 64 nt, Human Herpes Virus 4 (Epstein Barr virus)
ccuguuaaacauauauaaugaccucagggccuauuucaggcaaugccuggauguggccguccgc

SEQ ID NO: 541005 - RNA, 64 nt, Human Herpes Virus 4 (Epstein Barr virus)
cccgggcuucagagcccaggaugucccccagaagggacccuaggcguccccucuccuccccucc

SEQ ID NO: 541006 - RNA, 64 nt, Human Herpes Virus 4 (Epstein Barr virus); identical to SEQ ID NO: 541005

SEQ ID NO: 541007 - RNA, 64 nt, Human Herpes Virus 4 (Epstein Barr virus); identical to SEQ ID NO: 541005

SEQ ID NO: 541008 - RNA, 64 nt, Human Herpes Virus 4 (Epstein Barr virus); identical to SEQ ID NO: 541005

SEQ ID NO: 541009 - RNA, 64 nt, Human Herpes Virus 4 (Epstein Barr virus); identical to SEQ ID NO: 541005

SEQ ID NO: 541010 - RNA, 64 nt, Human Herpes Virus 4 (Epstein Barr virus); identical to SEQ ID NO: 541005

SEQ ID NO: 541011 - RNA, 64 nt, Human Herpes Virus 4 (Epstein Barr virus); identical to SEQ ID NO: 541005

SEQ ID NO: 541012 - RNA, 64 nt, Human Herpes Virus 4 (Epstein Barr virus); identical to SEQ ID NO: 541005

SEQ ID NO: 541013 - RNA, 64 nt, Human Herpes Virus 4 (Epstein Barr virus)
gcaccggaaucgccgccgugacucacgacagggcggacccuaacagggucaucguccugggccu

SEQ ID NO: 541014 - RNA, 64 nt, Human Herpes Virus 4 (Epstein Barr virus)
aagcggucucagacaccaacacagacugcgaucuggacccuauggagggcagcgaagaacacuc

SEQ ID NO: 541015 - RNA, 64 nt, Human Herpes Virus 4 (Epstein Barr virus)
augagagcgugggucaguaugucugcgcucuccuggacccuaaccugcuccccccgguggccua

SEQ ID NO: 541016 - RNA, 64 nt, Human Herpes Virus 1
aggcggcgcugucggagcuccccaccgaggccuggcccaugaugcagggggcggugaacuuuag

SEQ ID NO: 541017 - RNA, 64 nt, Human Herpes Virus 1
ccugccucaccuggcccaccagcgcgccccgccaggccggcagaccgagcggcugggcgaggcc

SEQ ID NO: 541018 - RNA, 64 nt, Human Herpes Virus 1
gcuccucgcgcggcgaaagcgcccggagcgccacggccggcauuuugaccguggucuggaccgc

SEQ ID NO: 541019 - RNA, 64 nt, Human Herpes Virus 1
uguugggguugagcaucagcaaguacuacggcauggccggcaacgaccguguguuucaggccgg

SEQ ID NO: 541020 - RNA, 64 nt, Human Herpes Virus 1
gcacuacagcucguccguguacgucuuucacggcggccggcaccuggaccccagcacccaggcc

SEQ ID NO: 541021 - RNA, 64 nt, Human Herpes Virus 1
cgucgcgaccacucucacgcaccgcggcccccugggccggcaguagcuggaaugggggggugac

SEQ ID NO: 541022 - RNA, 64 nt, Human Herpes Virus 2
gccuggucuucgauucgcccguucagcggcugugccccgagaucgucgcgugccacgcccuccg

SEQ ID NO: 541023 - RNA, 64 nt, Human Herpes Virus 2
ccucccgcggugccuguuuccccggugccgcccuccccgagaucgaccgacagacaaacacagc

SEQ ID NO: 541024 - RNA, 64 nt, Human Herpes Virus 2
ccacggggugcuaccggcggccccgggcgacguuccccgagacaccagcacccgcgugaacccc

SEQ ID NO: 541025 - RNA, 64 nt, Human Herpes Virus 2
cuaccccagagggguuccggacgcgaccgccaccccccgagacccgccgauuuugguguuuacg

SEQ ID NO: 541026 - RNA, 64 nt, Human Herpes Virus 2
gcgauauuaagaccgagaacaucuucaucaacacccccgagaacaucugucugggggacuuugg

SEQ ID NO: 541027 - RNA, 64 nt, Human Herpes Virus 2
caccccuccacggacaacgacacccccguccuccccccgagacccgacccccgcccccggggac

SEQ ID NO: 541028 - RNA, 64 nt, Human Herpes Virus 2
ccgccgggcguccggacgcccaagcggccccuccccccgagacggcgccgucuccggagcccgc

SEQ ID NO: 541029 - RNA, 64 nt, Human Herpes Virus 2
gcccucgacgcggcgcucgcuuuaaccccuacacccccgagaaccuucgucccggcgaccggcc

SEQ ID NO: 541030 - RNA, 64 nt, Human Herpes Virus 2
gaccucgcggaccuggaucucuguucgccgacgcccccgagacgcaaucuguacgcacgccucg

SEQ ID NO: 541031 - RNA, 64 nt, Human Herpes Virus 2
ccgggcugcuggugcaccgcauggcgguggcgcuccccgagacccccgaggcggccuuccggga

SEQ ID NO: 541032 - RNA, 64 nt, Human Herpes Virus 2
gcguccggcuggcggcgcggcaccauaacaccguccccgagagccugaucguagacgggcucgc

SEQ ID NO: 541033 - RNA, 64 nt, Human Herpes Virus 2
cagggcaccacguguccccagggagccccggguuccccgagagcccagggaaccgcgaguucca

SEQ ID NO: 541034 - RNA, 64 nt, Human Herpes Virus 2
gcggacgcggggcggcgacgcggcgcuaugcgcccccgaggacggcugggugaagguucacccc

SEQ ID NO: 541035 - RNA, 64 nt, Human Herpes Virus 2
aaagcagauccgcucgcggaucccccagagcacccccgaggaggccguccuccucgacaagcaa

SEQ ID NO: 541036 - RNA, 64 nt, Human Herpes Virus 2
gccccgggugcagcucgcguuucgguucaugggccccgaggacgccguucgcacgcggcggauc

SEQ ID NO: 541037 - RNA, 64 nt, Human Herpes Virus 2
cgacgcggcgauucccaaaggucccccggcccgccccgaggacgccggcacccccgaagccucg

SEQ ID NO: 541038 - RNA, 64 nt, Human Herpes Virus 2
gccagcccccccaccccccgaacaucgcggcggacccgaggaguuugagggcgccggggacggc

SEQ ID NO: 541039 - RNA, 64 nt, Human Herpes Virus 2
cgaggaguuugagggcgccggggacggcgaaccccccgaggacgacgacagcgccaccggccuc

SEQ ID NO: 541040 - RNA, 64 nt, Human Herpes Virus 2
caacgccacgcaacccgaacucguuccggaagaccccgaggacucggcccucuuagaggauccc

SEQ ID NO: 541041 - RNA, 64 nt, Human Herpes Virus 2
cucgauggccggggggucggggcgaaccuuuagccccgaggacgugcuggagcugcugaacccc

SEQ ID NO: 541042 - RNA, 64 nt, Human Herpes Virus 2
acgugcgguucuggggccacgacgccgcgcugaccccgaggaacuuuugucuguuuuugcgggg

SEQ ID NO: 541043 - RNA, 64 nt, Human Herpes Virus 2
cucguacaucgugaccuaccucgggggcgaccuccccgaggagugcauggccguguaucgggac

SEQ ID NO: 541044 - RNA, 64 nt, Human Herpes Virus 2
ggcgcuggacgcccuccggcggguggccggcuaccccgaggagagcacgaacuacgcccaguau

SEQ ID NO: 541045 - RNA, 64 nt, Human Herpes Virus 2
gacgggggucgccgcggcgaccccgcgccccgaccccgaggacggcgcggggucucugccccgc

SEQ ID NO: 541046 - RNA, 64 nt, Human Herpes Virus 2
ucgucgccaccacccucacgauggcggaucgggucccgaggacccagcugggcugggcguccgg

SEQ ID NO: 541047 - RNA, 64 nt, Human Herpes Virus 2
aggaucugaccucgggcgagagccccuagaugcccccgaggaccgccaaggccaagaagaaguc

SEQ ID NO: 541048 - RNA, 64 nt, Human Herpes Virus 2
ccugcucggggugcugugcgguuggggaacgcgccccgaggaacaacaauaugagaugauucgg

SEQ ID NO: 541049 - RNA, 64 nt, Human Herpes Virus 4 (Epstein Barr virus)
ucuggaggccguccucuccacgggagggggggcaugcccucaacaugaacuccggagccugcuu

SEQ ID NO: 541050 - RNA, 64 nt, Human Herpes Virus 4 (Epstein Barr virus)
cggaagaggaagacaagcacagcuauguuaagaaugcccucaacauucaaaaccucuuacauca

SEQ ID NO: 541051 - RNA, 64 nt, Human Herpes Virus 4 (Epstein Barr virus)
uccuuuaacucauuacuuguucuuuuguaaucgcagcucuaacuuggcaucucuuuuacagugg

SEQ ID NO: 541052 - RNA, 64 nt, Human Herpes Virus 4 (Epstein Barr virus)
acgcuguucauccuugggggaguaguagcuuagcagcucuaagaaauaagccagcuucuuuaag

SEQ ID NO: 541053 - RNA, 63 nt, Human Herpes Virus 1
ggucgaaguccuggcccagcagacccacggccucgccucgacccugacgcguugggcacacua

SEQ ID NO: 541054 - RNA, 63 nt, Human Herpes Virus 1
gagacaaucgcgaacaucuacaccacacaacaccgccucgaccagggugagauaucggccggg

SEQ ID NO: 541055 - RNA, 64 nt, Human Herpes Virus 2
gcagcuggcguccgacgugcagcaguaccuggagcgccuggagaaacagaggcaacagaaggug

SEQ ID NO: 541056 - RNA, 64 nt, Human Herpes Virus 2
gcucugcucgccaggcccagaugcggagcggagccgccuggacgcuugaucugcauuacauacg

SEQ ID NO: 541057 - RNA, 64 nt, Human Herpes Virus 2
cgccccggcccggacccccgcggcgaccgcgggccgccuggagcgccgccgggcccgcgcggcg

SEQ ID NO: 541058 - RNA, 64 nt, Human Herpes Virus 2
gcaccgcgcgggcgcggaggagggcgugacguuccgccuggaggacggccgcggagcgcccgcc

SEQ ID NO: 541059 - RNA, 64 nt, Human Herpes Virus 2
ccgcuccccucuggccaucgggccccugugggcucgccuggacuaucugugcucccucgucgug

SEQ ID NO: 541060 - RNA, 64 nt, Human Herpes Virus 2
acaccgacgguaccucgaucccgcgcuuagcgagcgccuggacgcggcggacgaucgucuugcg

SEQ ID NO: 541061 - RNA, 64 nt, Human Herpes Virus 2
cccgcccgucuucgagggccaggcgacggacgugcgccuggagucgcuggaccucacgcugcgg

SEQ ID NO: 541062 - RNA, 64 nt, Human Herpes Virus 2
gcgcgcugauggacucccucgacgcgcaccccggcgccuggacguccauguucgcgagcugcaa

SEQ ID NO: 541063 - RNA, 64 nt, Human Herpes Virus 2
ccaagggcgccgagcgcgcgcccuccuggccgcacgccuggagucgcgucaccaagcacaccgc

SEQ ID NO: 541064 - RNA, 64 nt, Human Herpes Virus 2
gcucgguggcggagaucgccucuacaacuucuggcgccuggacccagaccgagaaaacgcgcga

SEQ ID NO: 541065 - RNA, 64 nt, Human Herpes Virus 2
cauucccccagcgggcgcgccgcguccgggggggcgccuggaagcggcgccacgcgacgccgcg

SEQ ID NO: 541066 - RNA, 64 nt, Human Herpes Virus 2
ugcggccccucccggacuuuuggagcuccgcgaucgccuggacggugcuggcgacccugcgggc

SEQ ID NO: 541067 - RNA, 64 nt, Human Herpes Virus 2
ccccauuaccgacgucagccugggagacgaacuccgccuggacggcgaggagguggauaugacg

SEQ ID NO: 541068 - RNA, 64 nt, Human Herpes Virus 2; identical to SEQ ID NO: 541057

SEQ ID NO: 541069 - RNA, 64 nt, Human Herpes Virus 1
gcaggcgugccuggcgggcgguuaaaagcagggccucggguaaggggcccacguacauucgcgu

SEQ ID NO: 541070 - RNA, 64 nt, Human Herpes Virus 4 (Epstein Barr virus)
accaacaacgaucccaggccucagcgucaggagagggccagagaacuggcccucguuggcauuc

SEQ ID NO: 541071 - RNA, 64 nt, Human Herpes Virus 4 (Epstein Barr virus)
ggcggcgggcuuccagagggcccuucugguggccgggccagagaccgcugacacgaggccggac

SEQ ID NO: 541072 - RNA, 64 nt, Human Herpes Virus 4 (Epstein Barr virus)
cccuggaccaacccggcccgggccccccgguaucgggccagagguaaguggacuuuaauuuuuu

SEQ ID NO: 541073 - RNA, 64 nt, Human Herpes Virus 4 (Epstein Barr virus); identical to SEQ ID NO: 541072

SEQ ID NO: 541074 - RNA, 64 nt, Human Herpes Virus 4 (Epstein Barr virus); identical to SEQ ID NO: 541072

SEQ ID NO: 541075 - RNA, 64 nt, Human Herpes Virus 4 (Epstein Barr virus)
ggugcuuuuugcacgagccgucgggucucagaucgggccagagcggcccuugccugggucucuc

SEQ ID NO: 541076 - RNA, 64 nt, Human Herpes Virus 4 (Epstein Barr virus)
ggcggaggccgcccgaacggggcgaaugaggccugggccagaauuagaugaggaggacguccgc

SEQ ID NO: 541077 - RNA, 64 nt, Human Herpes Virus 4 (Epstein Barr virus)
cggucuucuacgucuacccacaggaguggaagccgggccagacccucaagcugacgguccggaa

SEQ ID NO: 541078 - RNA, 64 nt, Human Herpes Virus 4 (Epstein Barr virus)
cgcagugccaagagcugccucccugccccucggugggccagauacucagcuucaaguuaccuuc

SEQ ID NO: 541079 - RNA, 64 nt, Human Herpes Virus 4 (Epstein Barr virus)
ccccugccgccgacccugcuucucgggcuggggugggccagacgugaccggaaccaacgguccg

SEQ ID NO: 541080 - RNA, 64 nt, Human Herpes Virus 2
gcccgggguuggacacguuuuugugggauaggcacgcccagagggcguaucugguuaaccccuu

SEQ ID NO: 541081 - RNA, 64 nt, Human Herpes Virus 2
acgagccgccgccgccgcccccgaccgcccuggccgcccagaugcgccagcacggccagggcgu

SEQ ID NO: 541082 - RNA, 64 nt, Human Herpes Virus 2
caccuuaauaugcgaaguggaccucgggccgcgccgcccagacugcaucugcguguucgaauuc

SEQ ID NO: 541083 - RNA, 64 nt, Human Herpes Virus 2
uaucggccggggaggcggcggugguaaugaccagcgcccagauaacaaugagcacgccuuaugc

SEQ ID NO: 541084 - RNA, 64 nt, Human Herpes Virus 2
agcgccgucgcuaccgcggcuucuucgccgcccucgcccagacgcccuccgaggagaucgccau

SEQ ID NO: 541085 - RNA, 64 nt, Human Herpes Virus 2
gcuuccggaccgacggcggggugcccgggcgccacgcccagaagcaacccaggccgacgcccuc

SEQ ID NO: 541086 - RNA, 64 nt, Human Herpes Virus 4 (Epstein Barr virus)
ccggacccggaccaaugccaaagcugaagaacggacugcggagauggaugacaccauggccucg

SEQ ID NO: 541087 - RNA, 64 nt, Human Herpes Virus 4 (Epstein Barr virus)
gcggcaagcacucggcggggcucaccuacaggcuggucaggaguccucuccaggucacgcgacg

SEQ ID NO: 541088 - RNA, 64 nt, Human Herpes Virus 4 (Epstein Barr virus)
agcucaagauccacccagggguggccaugaccguggucaggaccgaugagauccucucugaaaa

SEQ ID NO: 541089 - RNA, 64 nt, Human Hepatitis C Virus
aucucucaaggcaacuugcaccgccaaccaugacuccccugacgccgagcucauagaggcuaac

SEQ ID NO: 541090 - RNA, 64 nt, Human Hepatitis C Virus (HCV-N)
uaaaaucgcucacagagcggcuuuauaucggggguccccugacuaauucaaaagggcagagcug

SEQ ID NO: 541091 - RNA, 64 nt, Human Hepatitis C Virus (M1LE)
uaaagucgcucacagagcggcucuauguuggggguccccugacuaauucaaaagggcagaacug

SEQ ID NO: 541092 - RNA, 64 nt, Human Herpes Virus 2; identical to SEQ ID NO: 538134

SEQ ID NO: 541093 - RNA, 64 nt, Human Herpes Virus 2; identical to SEQ ID NO: 538135

SEQ ID NO: 541094 - RNA, 64 nt, Human Herpes Virus 2; identical to SEQ ID NO: 538136

SEQ ID NO: 541095 - RNA, 64 nt, Human Herpes Virus 2; identical to SEQ ID NO: 538137

SEQ ID NO: 541096 - RNA, 64 nt, Human Herpes Virus 2; identical to SEQ ID NO: 538138

SEQ ID NO: 541097 - RNA, 64 nt, Human Herpes Virus 2; identical to SEQ ID NO: 538139

SEQ ID NO: 541098 - RNA, 64 nt, Human Herpes Virus 2; identical to SEQ ID NO: 538140

SEQ ID NO: 541099 - RNA, 64 nt, Human Herpes Virus 2; identical to SEQ ID NO: 538141

SEQ ID NO: 541100 - RNA, 64 nt, Human Herpes Virus 2; identical to SEQ ID NO: 538142

SEQ ID NO: 541101 - RNA, 64 nt, Human Herpes Virus 2; identical to SEQ ID NO: 538143

SEQ ID NO: 541102 - RNA, 64 nt, Human Herpes Virus 2; identical to SEQ ID NO: 538144

SEQ ID NO: 541103 - RNA, 64 nt, Human Herpes Virus 2; identical to SEQ ID NO: 538145

SEQ ID NO: 541104 - RNA, 64 nt, Human Herpes Virus 2; identical to SEQ ID NO: 538141

SEQ ID NO: 541105 - RNA, 64 nt, Human Herpes Virus 2; identical to SEQ ID NO: 538147

SEQ ID NO: 541106 - RNA, 64 nt, Human Herpes Virus 1
gagagagccuccucagcauccuccugcgggacuggcucgccaugcgaaagcagauccgcucgcg

SEQ ID NO: 541107 - RNA, 64 nt, Human Herpes Virus 1
acauugcauccuucguguuugucauucuggccaggcucgccaaccgcgucgagcguggcgucgc

SEQ ID NO: 541108 - RNA, 64 nt, Human Herpes Virus 1
guauacccuguccgugggcgacauaaaggacccggcucgccaaguggccucggugguccuggug

SEQ ID NO: 541109 - RNA, 64 nt, Human Herpes Virus 1
uggccuucgccggggccguggaguuucuggggcugcucgccagcgccggcgaccggcggcucau

SEQ ID NO: 541110 - RNA, 64 nt, Human Herpes Virus 1
agacguaucagguauuuguaccaaagcccaccgcgcucgccacauuuguccgugaggcgggcgc

SEQ ID NO: 541111 - RNA, 64 nt, Human Herpes Virus 1
acaacacgguucccgagaguuugaucguggacgggcucgccagcgacccgcacuacgaguacau

SEQ ID NO: 541112 - RNA, 64 nt, Human Herpes Virus 1
acgaggcgcugggcgacaccgcagcgcgccggcugcucgccaacagcgggcucaacgccgugcu

SEQ ID NO: 541113 - RNA, 64 nt, Human Herpes Virus 1; identical to SEQ ID NO: 541109

SEQ ID NO: 541114 - RNA, 64 nt, Human Herpes Virus 1
aaagacaugcaaauauauuucuuccggggacaccgccagcaaacgcgagcaacgggccacgggg

SEQ ID NO: 541115 - RNA, 64 nt, Human Herpes Virus 1
cgaccgcgccggccagaccaccauggacgcguuugccagcaaccugaccgcgcuggcgcggcgc

SEQ ID NO: 541116 - RNA, 60 nt, Human Herpes Virus 4 (Epstein Barr virus)
cgcccucucggugauggaugcugguaaggcccagcccauagaaaguucacacuugaguuc

SEQ ID NO: 541117 - RNA, 60 nt, Human Herpes Virus 4 (Epstein Barr virus)
cgcucugcgccagccccgcccuccccauccccagcccagccguucacucggcucaccggg

SEQ ID NO: 541118 - RNA, 60 nt, Human Herpes Virus 4 (Epstein Barr virus)
gcagacaaccccauuguggcucuggcccucccagcccacaccagucucaucgccucuagg

SEQ ID NO: 541119 - RNA, 60 nt, Human Herpes Virus 4 (Epstein Barr virus)
ccaagccaccgugccagucccgccaacgucccagcccagauucucaaaccucuccaugcu

SEQ ID NO: 541120 - RNA, 60 nt, Human Herpes Virus 4 (Epstein Barr virus)
caggccccacuguauccaccgcggaugucaccagcccaacaccagccggcacaacgucag

SEQ ID NO: 541121 - RNA, 63 nt, Human Herpes Virus 1
cacaaacguaaguccucuuuucuuucgcauggcucucccaaggggccccgggucgacccgacc

SEQ ID NO: 541122 - RNA, 63 nt, Human Herpes Virus 1
gcgacggcccgggccuccugucgggcgcaugugucucccaagcggcgcucuucgacacccguc

SEQ ID NO: 541123 - RNA, 63 nt, Human Herpes Virus 1
gccccuuugacucagacgcagggcccggggucgccgugggacccccugacucauacacagaga

SEQ ID NO: 541124 - RNA, 63 nt, Human Herpes Virus 1
uggggaggagccgcccgccauauuugggggacgccgugggacccccgacuccggugcgucugg

SEQ ID NO: 541125 - RNA, 64 nt, Human Herpes Virus 1
accaugacgacgacuccgccuccgaggcggacagcacggacacggaacuguucgagacggggcu

SEQ ID NO: 541126 - RNA, 64 nt, Human Herpes Virus 1
cggcgcgcggguauaagaacggggccccggaguccacggacauaccgcccggcucgaucgcugc

SEQ ID NO: 541127 - RNA, 64 nt, Human Herpes Virus 2
gcccgccuuucugccaaagcgcgaggaggacgcaggcuuugacauucucauccaccgagccgug

SEQ ID NO: 541128 - RNA, 64 nt, Human Herpes Virus 2
ggagagacccgacucucccuccacaaauggauccggcuuugagaucuuaucaccaacggcuccg

SEQ ID NO: 541129 - RNA, 58 nt, Human Herpes Virus 2
acccgacucucccuccacaaauggauccggcuuugagaucuuaucaccaacggcuccg

SEQ ID NO: 541130 - RNA, 62 nt, Human Herpes Virus 1
cgguuuguuggcagcgaggcguucgguuccgggcaccgcaaagcgggcggcgaggacguccu

SEQ ID NO: 541131 - RNA, 64 nt, Human Herpes Virus 1
ugugcuucuuaccguucgucucgcucgcucccaacacggacagucuguguaaaagaccccaaua

SEQ ID NO: 541132 - RNA, 64 nt, Human Herpes Virus 1
ugucgucgaucgacgaauuagggcgucgccagcucacggacaccauccgcaaggaccugcgguu

SEQ ID NO: 541133 - RNA, 64 nt, Human Herpes Virus 1
ucuaucacaccaacacggucgcguacguguacaccacggacacugaccuccuguugaugggcug

SEQ ID NO: 541134 - RNA, 64 nt, Human Herpes Virus 1; identical to SEQ ID NO: 541125

SEQ ID NO: 541135 - RNA, 63 nt, Human Herpes Virus 1
ugcggcugacgcgcgaugcgaucgagccgugcaccgugggacaccggcgcuacuucaccuucg

SEQ ID NO: 541136 - RNA, 63 nt, Human Herpes Virus 1; identical to SEQ ID NO: 541124

SEQ ID NO: 541137 - RNA, 63 nt, Human Herpes Virus 1
ugaucgaggacgcccggcgggccaucgagacggccgugggagccgugcuuagggccaacgccg

SEQ ID NO: 541138 - RNA, 63 nt, Human Herpes Virus 1; identical to SEQ ID NO: 541123

SEQ ID NO: 541139 - RNA, 64 nt, Human Herpes Virus 2
gcggacguacagcacgcggcucugccccggccccccuccccaacccccgccgauuuccgggcga

SEQ ID NO: 541140 - RNA, 64 nt, Human Herpes Virus 2
gcgggucauccggccccaccagagagcgacccccccuccccaggggucguaggcgucgcugcgg

SEQ ID NO: 541141 - RNA, 64 nt, Human Herpes Virus 2
cacccccggguucacggaagcgcagacgccccguccuccccagcucgucggaaucugaggguaa

SEQ ID NO: 541142 - RNA, 64 nt, Human Herpes Virus 2
accugcacgucguuucuggggucacgugucugguccuccccaaguaucacugcgaccuguauac

SEQ ID NO: 541143 - RNA, 64 nt, Human Herpes Virus 2
gccccgcguccgauacaacaaacgcgaccgcacgccuccccacgcaccccccacucauccguuc

SEQ ID NO: 541144 - RNA, 60 nt, Human Herpes Virus 4 (Epstein Barr virus)
cuacugccuuacacuggaaagugaggagcgcccaccgaccccauaucgcaacacuguaua

SEQ ID NO: 541145 - RNA, 60 nt, Human Herpes Virus 4 (Epstein Barr virus)
gaggggccucuuugggcccucaaguccagccccaccgagacccgaguggcccggaucccc

SEQ ID NO: 541146 - RNA, 60 nt, Human Herpes Virus 4 (Epstein Barr virus); identical to SEQ ID NO: 541145

SEQ ID NO: 541147 - RNA, 60 nt, Human Herpes Virus 4 (Epstein Barr virus); identical to SEQ ID NO: 541145

SEQ ID NO: 541148 - RNA, 60 nt, Human Herpes Virus 4 (Epstein Barr virus); identical to SEQ ID NO: 541145

SEQ ID NO: 541149 - RNA, 60 nt, Human Herpes Virus 4 (Epstein Barr virus); identical to SEQ ID NO: 541145

SEQ ID NO: 541150 - RNA, 60 nt, Human Herpes Virus 4 (Epstein Barr virus); identical to SEQ ID NO: 541145

SEQ ID NO: 541151 - RNA, 60 nt, Human Herpes Virus 4 (Epstein Barr virus); identical to SEQ ID NO: 541145

SEQ ID NO: 541152 - RNA, 60 nt, Human Herpes Virus 4 (Epstein Barr virus); identical to SEQ ID NO: 541145

SEQ ID NO: 541153 - RNA, 60 nt, Human Herpes Virus 4 (Epstein Barr virus)
agggaaaggaggggaguggggccuaugccucccaccgauauuccgccgucuaaacgagcg

SEQ ID NO: 541154 - RNA, 60 nt, Human Herpes Virus 4 (Epstein Barr virus)
gucgccuuaccuccccuauauagucacgaccccaccgaaccaggcaugauguagaauaaa

SEQ ID NO: 541155 - RNA, 60 nt, Human Herpes Virus 4 (Epstein Barr virus)
ugcuucuggcucuucugggaacacccccaccccaccgaacgaugaggaacgugaaucuaa

SEQ ID NO: 541156 - RNA, 60 nt, Human Herpes Virus 4 (Epstein Barr virus)
gugacagauauagcucucaagugcgggcugcccaccgaagacuuccuccacccguccaau

SEQ ID NO: 541157 - RNA, 60 nt, Human Herpes Virus 4 (Epstein Barr virus)
caagaaggagcguguccccguggaggaccgcccaccgacuccgaugcccaccagccagcg

SEQ ID NO: 541158 - RNA, 64 nt, Human Hepatitis C Virus
cuggacgacgcaagacugcaauuguucuaucuaucccggccauauaacgggucaucgcauggca

SEQ ID NO: 541159 - RNA, 64 nt, Human Herpes Virus 1
ucccgagaucgucgcgugucacucccuccgggaacacgcgcacgucugccggcugcgcaauacc

SEQ ID NO: 541160 - RNA, 64 nt, Human Herpes Virus 1
cgcggcgucccgcucuccgauccccgccccugggcacgcgcaagcgcaagcgcccuucccgccc

SEQ ID NO: 541161 - RNA, 64 nt, Human Herpes Virus 1
ucaacgaggucuuggacuguguggugacgggcgccacgcgcauugcggcccaaaacauguacgc

SEQ ID NO: 541162 - RNA, 64 nt, Human Herpes Virus 1
caccccccucgucccccucgcacauccucacccucacgcgcauccgcaagcuaugcagccccgu

SEQ ID NO: 541163 - RNA, 64 nt, Human Herpes Virus 1
ucgucccccccaacacgcgcuacgcggccgacagcacgcgcaucaugcgcgucugucggcauuu

SEQ ID NO: 541164 - RNA, 64 nt, Human Herpes Virus 1
acccccaaaggcaaaacccccugucgccagaggccacgcgcaugcguuccggagccuguccucg

SEQ ID NO: 541165 - RNA, 64 nt, Human Herpes Virus 1
cggcuccgcgccuguccuuucuccccgcgggacacacgcgcagacugucgacggcccccccgac

SEQ ID NO: 541166 - RNA, 64 nt, Human Herpes Virus 1; identical to SEQ ID NO: 541159

SEQ ID NO: 541167 - RNA, 64 nt, Human Herpes Virus 1; identical to SEQ ID NO: 541160

SEQ ID NO: 541168 - RNA, 64 nt, Human Herpes Virus 1; identical to SEQ ID NO: 541161

SEQ ID NO: 541169 - RNA, 64 nt, Human Herpes Virus 1; identical to SEQ ID NO: 541162

SEQ ID NO: 541170 - RNA, 64 nt, Human Herpes Virus 1; identical to SEQ ID NO: 541163

SEQ ID NO: 541171 - RNA, 64 nt, Human Herpes Virus 1; identical to SEQ ID NO: 541164

SEQ ID NO: 541172 - RNA, 64 nt, Human Herpes Virus 1; identical to SEQ ID NO: 541165

SEQ ID NO: 541173 - RNA, 64 nt, Human Herpes Virus 4 (Epstein Barr virus)
uacgaugcauccacugaaagugagcuagauuaaggggauccaaggugaccccuguuagcuauuu

SEQ ID NO: 541174 - RNA, 64 nt, Human Herpes Virus 4 (Epstein Barr virus)
gucagcaccuaugcgcacgaaacagccuggaaucgggauccaguaggggcccaguacacuugcg

SEQ ID NO: 541175 - RNA, 64 nt, Human Herpes Virus 2
acgcgagugugggacgacacgcccgcagccccccccccgccauggcgggggggaagccuuacug

SEQ ID NO: 541176 - RNA, 64 nt, Human Herpes Virus 2
ucauuacaaucagcucgucaccgggcaauccgcgccccgccacccgccgcugaccgcgugcggc

SEQ ID NO: 541177 - RNA, 64 nt, Human Herpes Virus 2
cagacacggagacccccgcccaaccaccccgcuaccccgccaaggccgucuaucugccgccgcc

SEQ ID NO: 541178 - RNA, 64 nt, Human Herpes Virus 2
accgccucuacgaccaccagaucgugccguccacccccgccaugcugaaccucggaacccgcaa

SEQ ID NO: 541179 - RNA, 64 nt, Human Herpes Virus 2
aaccgccgccggggacagcuuuuccaaggccuguccccgccaccgccgcuuuugcgucgucucc

SEQ ID NO: 541180 - RNA, 64 nt, Human Herpes Virus 2
cugacgacgacgacgacgacgacgccgcccgcgcccccgccagcgccgcagaccacgccgcggg

SEQ ID NO: 541181 - RNA, 64 nt, Human Herpes Virus 2
ggagcugguucgccgcgagcccaucuucgccaacccccgccacccgaacuucaaacagaucuug

SEQ ID NO: 541182 - RNA, 64 nt, Human Herpes Virus 2
cuggaccucguucgccagcagcccuucuucccccccccgccaccacgcgcguucgaggacgcag

SEQ ID NO: 541183 - RNA, 64 nt, Human Herpes Virus 2
guggcgccggcggaccugacaacacccuguucgcccccgccaccggccagcgagacuuaccugc

SEQ ID NO: 541184 - RNA, 64 nt, Human Herpes Virus 2
uccgcgcgacccagccccuguacgcgcggaccacccccgccaaauuuugggcggacgugcgcgc

SEQ ID NO: 541185 - RNA, 64 nt, Human Herpes Virus 2; identical to SEQ ID NO: 541180

SEQ ID NO: 541186 - RNA, 64 nt, Human Herpes Virus 1
aggcgcagcacgcgcccggcuccgggggggucuucgcggggaccagauacgcgccauccagcuc

SEQ ID NO: 541187 - RNA, 64 nt, Human Herpes Virus 1
ggggagggcaaaccccagaggcgggggccaacggcgcggggaggagugggugggcgagguggcc

SEQ ID NO: 541188 - RNA, 64 nt, Human Herpes Virus 1
cgcccccgcguggggccgggccaagggcugcggacgcggggacgcgcuuucccccagacccaug

SEQ ID NO: 541189 - RNA, 64 nt, Human Herpes Virus 1
ggcggcggccgccgccgaagaggcggaugccgcgcgcggggaugagccggcgggugggggcgac

SEQ ID NO: 541190 - RNA, 64 nt, Human Herpes Virus 1
gcgcgcggacgcaauggggcaggaagacgggaaccgcggggagaggcgggcggccgggacuccc

SEQ ID NO: 541191 - RNA, 64 nt, Human Herpes Virus 1
uguuggcgcgcgagaacgcggcgcugacgggggccgcggggagccccggcgccggcgcagauga

SEQ ID NO: 541192 - RNA, 64 nt, Human Herpes Virus 1
cgggcgagcgcgcggugcccgccggguacggcgccgcggggauccucgccgcccuggggcggcu

SEQ ID NO: 541193 - RNA, 64 nt, Human Herpes Virus 1
guucgugcgcgacgcgcuggugcucaugcgccugcgcggggaccugcgcguggccggcggcagc

SEQ ID NO: 541194 - RNA, 64 nt, Human Herpes Virus 1
ucggccgucccugaccccgaggcccugacguucccgcggggagacaacguggcgacggcgagcc

SEQ ID NO: 541195 - RNA, 64 nt, Human Herpes Virus 1
guuggccagccuggggcgcugcguccgcgagcagcgcggggagcucgagaagaugcugcggguc

SEQ ID NO: 541196 - RNA, 64 nt, Human Herpes Virus 1
ggugggguucaugggguaccugcgugcgguguuccgcggggaugacgacagcgagcuagaggcu

SEQ ID NO: 541197 - RNA, 64 nt, Human Herpes Virus 1
gcucgucgccuuagcggcgggagacgcgggcccgcgcggggagccgcccggcgaggagggcggg

SEQ ID NO: 541198 - RNA, 64 nt, Human Herpes Virus 1
cggaggcggcgcaacccgacgcggguuuauggagcgcggggaacgcguuugcugaucccccgcc

SEQ ID NO: 541199 - RNA, 64 nt, Human Herpes Virus 1; identical to SEQ ID NO: 541193

SEQ ID NO: 541200 - RNA, 64 nt, Human Herpes Virus 1; identical to SEQ ID NO: 541192

SEQ ID NO: 541201 - RNA, 64 nt, Human Herpes Virus 1; identical to SEQ ID NO: 541191

SEQ ID NO: 541202 - RNA, 61 nt, Human Herpes Virus 1
cacgaguucgucucguccgagccaaugcgccuccaccgagauaacgucaugcuggccucgg

SEQ ID NO: 541203 - RNA, 61 nt, Human Herpes Virus 1
cuccaaaagcuagccguuuacuacuauaucauccaccgagagaggcgccugucccccuucc

SEQ ID NO: 541204 - RNA, 61 nt, Human Herpes Virus 1
uacgccagagcggaccaaugugauccugggcuccaccgagacgacggggcugucccucggc

SEQ ID NO: 541205 - RNA, 61 nt, Human Herpes Virus 1
ccccgacgccagcuuuccgcugagccucauguccaccgacaaacacaccaauuuuuucgag

SEQ ID NO: 541206 - RNA, 61 nt, Human Herpes Virus 1
uccaccaauuacauuaugaacgaccgccccuuccaccgacuuaucguccagguggaaagcc

SEQ ID NO: 541207 - RNA, 64 nt, Human Hepatitis C Virus (M1LE)
acuguuuuccacggugccggcucaaagacccuagccggcccaaaagguccaaucacccaaaugu

SEQ ID NO: 541208 - RNA, 64 nt, Human Herpes Virus 4 (Epstein Barr virus)
ccugggcgccacguacgugcuucgcguggagaugggcaggcaguuuggcuucgaggugcauaga

SEQ ID NO: 541209 - RNA, 64 nt, Human Herpes Virus 4 (Epstein Barr virus)
gggcacugcguccaccuggccaccacaucggacgggcaggcauuuuuggugcugccugggggcu

SEQ ID NO: 541210 - RNA, 62 nt, Human Herpes Virus 1
gcggcccccgccggggggcuccagacccgccagcaccgcaucugcgucagccgcccccaugg

SEQ ID NO: 541211 - RNA, 62 nt, Human Herpes Virus 1
ggcaugaugcccgaggauaguccccgcugccugcaccgcaccgagcgcuuuggggcggucag

SEQ ID NO: 541212 - RNA, 62 nt, Human Herpes Virus 1
ccccacccgcaucuggugacguuuaucggcaggcaccgcaccagcgcggaggagggcguaac

SEQ ID NO: 541213 - RNA, 62 nt, Human Herpes Virus 1
ucggacaagguaaccauaggcggggcggaggugcaccgcauacccguguacccguugcagcu

SEQ ID NO: 541214 - RNA, 62 nt, Human Herpes Virus 1
guccaggucccgaacgcgcagcugcuggaagagcaccgcaguuauguggccaacccgcgacg

SEQ ID NO: 541215 - RNA, 64 nt, Human Herpes Virus 4 (Epstein Barr virus)
caagacagacaccaugccucuguaaauguccucaugccaggaagcgacuacacagccgugucgc

SEQ ID NO: 541216 - RNA, 64 nt, Human Herpes Virus 4 (Epstein Barr virus)
ucggcuucuacucggcguuauccgaaugaaugacugccaggagcugccacccgguuuaauaauu

SEQ ID NO: 541217 - RNA, 64 nt, Human Herpes Virus 4 (Epstein Barr virus)
gcagcuugugcugcuguacagccugcaagacucuugccaggaacagcccccucugggcugucag

SEQ ID NO: 541218 - RNA, 64 nt, Human Herpes Virus 4 (Epstein Barr virus)
guaugggcagugucuggaacuggcacuggaggccugccaggacacgcccgagcaauuuaagcug

SEQ ID NO: 541219 - RNA, 64 nt, Human Herpes Virus 2
ccgccauggccgcacagcgcgcgcgggcgccggcgaugcggacgcggggcggcgacgcggcgcu

SEQ ID NO: 541220 - RNA, 64 nt, Human Herpes Virus 2
cgcacgcgcaccggcgcucugcucgccaggcccagaugcggagcggagccgccuggacgcuuga

SEQ ID NO: 541221 - RNA, 64 nt, Human Herpes Virus 2
gccacccgccgcugaccgcgugcggccugccggccgcggggacgguggccuacggacaccccgg

SEQ ID NO: 541222 - RNA, 56 nt, Human Herpes Virus 2
cgucgggccccgggugcgggaugugucgcggggacagccccggggucgcgggcggg

SEQ ID NO: 541223 - RNA, 64 nt, Human Herpes Virus 2
uacaagccggguccaaggucgcccagcugcucgucgcggggacccacgcccuccccuggauccc

SEQ ID NO: 541224 - RNA, 64 nt, Human Herpes Virus 2
cgucggcgaugaacugauugccaucgcggacgcacgcggggacccgccagagacccugcccccc

SEQ ID NO: 541225 - RNA, 64 nt, Human Herpes Virus 2
guucgugcgcgacgcgcuggugcugaugcgccugcgcggggaccugcgcguggccggcggcagc

SEQ ID NO: 541226 - RNA, 64 nt, Human Herpes Virus 2
ccccgcagauacgcugggcgucggccgcgggccgcgcggggacggugcuggccgcggcgggcgg

SEQ ID NO: 541227 - RNA, 64 nt, Human Herpes Virus 2
acggacaucaacuacuuucgccggcccugcaacccgcggggacgcgcggccggcggcguguacg

SEQ ID NO: 541228 - RNA, 64 nt, Human Herpes Virus 2
acggccgacgcaacgcgccgcccccggggccgcccgcggggacaccgaggcauccgacgacgaa

SEQ ID NO: 541229 - RNA, 64 nt, Human Herpes Virus 2
gcggccgcgccggaccgcgaggggcuuacguucccgcggggagacgacggggcgaccgagaggc

SEQ ID NO: 541230 - RNA, 64 nt, Human Herpes Virus 2
ccguccuagccaucgccagggggccuccggagcccgcggggauccggagcugcccacgcugcug

SEQ ID NO: 541231 - RNA, 64 nt, Human Herpes Virus 2
gcuggccagccucgggcgcugcgugcgcgagcagcgcggggagcucgagaagaugcugcggguc

SEQ ID NO: 541232 - RNA, 64 nt, Human Herpes Virus 2
gggccgccgcggaggagggggggcggaggcguggcgcggggacgcccgcgagcgaggacgggga

SEQ ID NO: 541233 - RNA, 64 nt, Human Herpes Virus 2
cgcggacgccgggacagcgccaucacgcgggccccgcggggaggcuaccugggcccgauggacc

SEQ ID NO: 541234 - RNA, 64 nt, Human Herpes Virus 2; identical to SEQ ID NO: 541226

SEQ ID NO: 541235 - RNA, 64 nt, Human Herpes Virus 2; identical to SEQ ID NO: 541225

SEQ ID NO: 541236 - RNA, 64 nt, Human Herpes Virus 2
cuucucgccgcgcgugcaggugcgccaucugguggccugggagacggccgcgcgccuggcccga

SEQ ID NO: 541237 - RNA, 64 nt, Human Herpes Virus 2
ugcgauccggcgcagcuucccuuuucggccccgcgccugggacccucgagcguauacacccccg

SEQ ID NO: 541238 - RNA, 64 nt, Human Herpes Virus 2
ccgcaacuugcugacgacccccaaguuuaccguggccugggacugggugccgaagcgaccggcg

SEQ ID NO: 541239 - RNA, 64 nt, Human Herpes Virus 2
agacuguccaccaccgcccccauuaccgacgucagccugggagacgaacuccgccuggacggcg

SEQ ID NO: 541240 - RNA, 64 nt, Human Herpes Virus 2; identical to SEQ ID NO: 541236

SEQ ID NO: 541241 - RNA, 64 nt, Human Herpes Virus 2
aggcgcgaccgacgcgcgcgggucgggagggccgggcgcggagggaggacccggggucccccgc

SEQ ID NO: 541242 - RNA, 64 nt, Human Herpes Virus 2
ccccgccgcgagcuuaccccaacccgaggcgcccggcgcggaggccggcgccuuaguuaacgcc

SEQ ID NO: 541243 - RNA, 64 nt, Human Herpes Virus 2
acgcccacaaccaagggggucgccaccccgcgucggcgcggacggacggccccggcgccaccca

SEQ ID NO: 541244 - RNA, 64 nt, Human Herpes Virus 2
acggacggccccggcgccacccacggcgaggcgcggcgcggaggggagcagcucgacgucuccg

SEQ ID NO: 541245 - RNA, 64 nt, Human Herpes Virus 2
cagcgccgcagaccacgccgcgggcgggacccucggcgcggacgacgaggaggcgggggugccc

SEQ ID NO: 541246 - RNA, 64 nt, Human Herpes Virus 2
acgagugcgagcaguacacgucgaguguaucgcuggcgcggaugcuuuacgggggggauuuggc

SEQ ID NO: 541247 - RNA, 64 nt, Human Herpes Virus 2
gcaccuggugacguuccucggcaggcaccgcgcgggcgcggaggagggcgugacguuccgccug

SEQ ID NO: 541248 - RNA, 64 nt, Human Herpes Virus 2
ggcccaccugcacgaggucgucgugggccgggacggcgcggaaagcgucauccgcccgaccagc

SEQ ID NO: 541249 - RNA, 64 nt, Human Herpes Virus 2
guacggggcguacgucgcggccccggccggccccggcgcggacaugcagcagcguuuucugaac

SEQ ID NO: 541250 - RNA, 64 nt, Human Herpes Virus 2
cgaccccgggggcgugggcggggagggggaggaaggcgcggaggggggcggguuugacgaggcc

SEQ ID NO: 541251 - RNA, 64 nt, Human Herpes Virus 2
gcgcgcgagcgcucugugugcuggaccaggcgcuggcgcggaccgcggcgggcggcggggccag

SEQ ID NO: 541252 - RNA, 64 nt, Human Herpes Virus 2
cguuccacgccgccgccgaagccagacgggcgcgggcgcggagugacgccgagccccuggcgcg

SEQ ID NO: 541253 - RNA, 64 nt, Human Herpes Virus 2; identical to SEQ ID NO: 541241

SEQ ID NO: 541254 - RNA, 64 nt, Human Herpes Virus 2; identical to SEQ ID NO: 541245

SEQ ID NO: 541255 - RNA, 64 nt, Human Herpes Virus 2
cugguggggauuacgggccgcacguuuauucggauggcacgacccacggaagacgucggggucc

SEQ ID NO: 541256 - RNA, 64 nt, Human Herpes Virus 2; identical to SEQ ID NO: 540131

SEQ ID NO: 541257 - RNA, 61 nt, Human Herpes Virus 2; identical to SEQ ID NO: 540132

SEQ ID NO: 541258 - RNA, 64 nt, Human Herpes Virus 2; identical to SEQ ID NO: 540133

SEQ ID NO: 541259 - RNA, 64 nt, Human Herpes Virus 2; identical to SEQ ID NO: 540134

SEQ ID NO: 541260 - RNA, 64 nt, Human Herpes Virus 2; identical to SEQ ID NO: 540135

SEQ ID NO: 541261 - RNA, 64 nt, Human Herpes Virus 2; identical to SEQ ID NO: 540136

SEQ ID NO: 541262 - RNA, 64 nt, Human Herpes Virus 2; identical to SEQ ID NO: 540137

SEQ ID NO: 541263 - RNA, 64 nt, Human Herpes Virus 2; identical to SEQ ID NO: 540138

SEQ ID NO: 541264 - RNA, 64 nt, Human Herpes Virus 2; identical to SEQ ID NO: 540134

SEQ ID NO: 541265 - RNA, 64 nt, Human Herpes Virus 2
ggacgcgcacguggggccucucgacggagagccggaccgggaugcgaucuccccgcuuacgucg

SEQ ID NO: 541266 - RNA, 64 nt, Human Herpes Virus 2
ucgcggucaucauggccauuuaccuggcggccccgaccgggauccccccggccuuuuuuccgau

SEQ ID NO: 541267 - RNA, 64 nt, Human Herpes Virus 2
gcagccggaguacgacugcggccgugacgagccggaccgggacuucccguauuacccgggcgag

SEQ ID NO: 541268 - RNA, 64 nt, Human Herpes Virus 2
ccugcggcccgaggccgucgcgcaccuggaggcggaccgggacuaccuggagaucgaggugggg

SEQ ID NO: 541269 - RNA, 64 nt, Human Herpes Virus 2
cgacggcgagaaaaacgucaccuggucccuguucgaccgggacaccagcaugucgcucgccgac

SEQ ID NO: 541270 - RNA, 64 nt, Human Herpes Virus 2
gccugaacuggcucggccggagcccggguuccucgaccgggagcuuggcgucccaggacucucg

SEQ ID NO: 541271 - RNA, 64 nt, Human Herpes Virus 2
caucgcccacgaucgcagcugccugcgcguguccgaccgggaauucauuacguacaucuaccug

SEQ ID NO: 541272 - RNA, 64 nt, Human Herpes Virus 2
cacgggguucaccccggaagagcucgacaccauggaccgggaggcacuucgggccaucagccgc

SEQ ID NO: 541273 - RNA, 64 nt, Human Herpes Virus 2
cguuccgggcccggaggaggcgcucgucacccaagaccgggacuggcucgauucccgcgccgcc

SEQ ID NO: 541274 - RNA, 64 nt, Human Herpes Virus 2
auacgaauaccaauacggcgugguggugcccggcgaccgggaacgcagcugucuucgcuggcua

SEQ ID NO: 541275 - RNA, 64 nt, Human Herpes Virus 4 (Epstein Barr virus)
auacauacaauaaacacaugauggaaaccaccccccccauuaagggcaauaacaacuacaauug

SEQ ID NO: 541276 - RNA, 64 nt, Human Herpes Virus 4 (Epstein Barr virus)
agcugccggagaacaugacgcgcugugaucaccuccccauuaccugcgaguaucugcuggggcg

SEQ ID NO: 541277 - RNA, 62 nt, Human Herpes Virus 2
cgcgccacgcggagggcggccccgagcccggggcccgcgacccggcgcccggccucacgcgc

SEQ ID NO: 541278 - RNA, 62 nt, Human Herpes Virus 2
acuccuucaugcaggagaucaucggggggcaggcccgcgagaccggcgacgaccggcccguc

SEQ ID NO: 541279 - RNA, 62 nt, Human Herpes Virus 2
acggcauucccgccccgcgccagccccuggacgcccgcgaccggcgcacggaugucgugauc

SEQ ID NO: 541280 - RNA, 62 nt, Human Herpes Virus 2
ccgcgcucaugcuggaguacuucugucggugcgcccgcgaggagagcaagcgcgugccccca

SEQ ID NO: 541281 - RNA, 62 nt, Human Herpes Virus 2
uguuuaacgcgcgcaccugcgucaccuuugccgcccgcgaggagggcgcgucguccagcacc

SEQ ID NO: 541282 - RNA, 62 nt, Human Herpes Virus 2
guuacgccggaggaaacggcagucgccuccccgcccgcgacugcauccguggagucgucgcc

SEQ ID NO: 541283 - RNA, 62 nt, Human Herpes Virus 2
acccccgcccccggggacacagggacgcccgcgcccgcgagcggcgagauagccccgcccaa

SEQ ID NO: 541284 - RNA, 62 nt, Human Herpes Virus 2
acccucggcgcggacgacgaggaggcgggggugcccgcgagggccccgggggcggcgccccg

SEQ ID NO: 541285 - RNA, 62 nt, Human Herpes Virus 2
caacacccggcgccaagcgccccgcggaccccgcccgcgaccccgauagucccccgaagcgg

SEQ ID NO: 541286 - RNA, 62 nt, Human Herpes Virus 2
ugcgguuuccggucccgcucccaacgccccuggcccgcgagauagucgcgcggcuggucgcc

SEQ ID NO: 541287 - RNA, 62 nt, Human Herpes Virus 2
ccugcgccagcgaccccgcccugcuacgcagcgcccgcgauggggaggcccacgcgcgagag

SEQ ID NO: 541288 - RNA, 62 nt, Human Herpes Virus 2
ucuccuccauccgccagcccguggugcagcacgcccgcgagagcgcggcgggggagaacgcg

SEQ ID NO: 541289 - RNA, 62 nt, Human Herpes Virus 2
gugugcaguucgagguccaccagccccucaucgcccgcgacggcccgcaccccgucgagcag

SEQ ID NO: 541290 - RNA, 62 nt, Human Herpes Virus 2; identical to SEQ ID NO: 540023

SEQ ID NO: 541291 - RNA, 62 nt, Human Herpes Virus 2
ucgccgagauacgcgaccuggcgcgcacguuugcccgcgagguggggggaguuuaguucaaa

SEQ ID NO: 541292 - RNA, 62 nt, Human Herpes Virus 2
gcgucgaccugggcgacugcaucggccgggaugcccgcgaggccaucgaccgcauguuugcg

SEQ ID NO: 541293 - RNA, 62 nt, Human Herpes Virus 2
augcugcgggucagcguccacggcgaggugcugcccgcgaccuucgccgcggucgccaacgg

SEQ ID NO: 541294 - RNA, 62 nt, Human Herpes Virus 2
gaggagggggggcggaggcguggcgcggggacgcccgcgagcgaggacggggagcgcggccc

SEQ ID NO: 541295 - RNA, 62 nt, Human Herpes Virus 2
cuccuggcggccugucacgugguaggcgugccgcccgcgagcgcgcucgacgaggacgugga

SEQ ID NO: 541296 - RNA, 62 nt, Human Herpes Virus 2
uggggcgccucgauggacgcgccccgaccgccgcccgcgacccucgucgccaccacccucac

SEQ ID NO: 541297 - RNA, 62 nt, Human Herpes Virus 2
gagaugcgggucgaggcggacugggcgcggccgcccgcgaccuuagacgcccucgcccgcgg

SEQ ID NO: 541298 - RNA, 62 nt, Human Herpes Virus 2
aucacccacccccugcgggggucgaggcggaggcccgcgagacucuuugucggugugguccc

SEQ ID NO: 541299 - RNA, 62 nt, Human Herpes Virus 2
ccccgcgacgugcuguccgcgaugccgcccuggcccgcgaggguggaggggggcgaguggac

SEQ ID NO: 541300 - RNA, 62 nt, Human Herpes Virus 2
gcuaccucaccccacgaugacggcgacgacgggcccgcgagccguggucaccgguguucgga

SEQ ID NO: 541301 - RNA, 62 nt, Human Herpes Virus 2; identical to SEQ ID NO: 541277

SEQ ID NO: 541302 - RNA, 62 nt, Human Herpes Virus 2; identical to SEQ ID NO: 541284

SEQ ID NO: 541303 - RNA, 64 nt, Human Herpes Virus 1
cgcaugggccgccaacagucgguauuaaggcgucgacgcagacgcacccgcugcgucggcaugg

SEQ ID NO: 541304 - RNA, 64 nt, Human Herpes Virus 1
gccugcggcccguguuggugugugugggcucgccgacgcagacggcgucccuggagucgaccuu

SEQ ID NO: 541305 - RNA, 64 nt, Human Herpes Virus 1
gccccccacugccuuccgcggcggcgccuugcuggacgcagagcacuacuggcggcgcgucgug

SEQ ID NO: 541306 - RNA, 64 nt, Human Herpes Virus 1
ccaggccgucagcgggggcgccaugggggcggcugacgcagaugcggugcuggcgggucuggag

SEQ ID NO: 541307 - RNA, 64 nt, Human Herpes Virus 1; identical to SEQ ID NO: 537397

SEQ ID NO: 541308 - RNA, 64 nt, Human Herpes Virus 1; identical to SEQ ID NO: 537398

SEQ ID NO: 541309 - RNA, 64 nt, Human Herpes Virus 2
ucccgggggcggggagucggucggcguccccguggaucuguacccgcggcccuuggugcucccc

SEQ ID NO: 541310 - RNA, 64 nt, Human Herpes Virus 1
caugguccccacgggacaggcauuugccgcgcuggccugggacgacugggcccgcauaacgcgg

SEQ ID NO: 541311 - RNA, 64 nt, Human Herpes Virus 1
gcccccgcggcgggaaguuguggacugggaaggcgccugggacgaagacgacggcggcgcguuc

SEQ ID NO: 541312 - RNA, 64 nt, Human Herpes Virus 1
ccggaaccugcucacgacccccaaguucaccguggccugggacugggugccaaagcgcccgucg

SEQ ID NO: 541313 - RNA, 64 nt, Human Herpes Virus 1
cgcgacgccgcgccgacgaauggugccaaggguggccugggagaagagagaagauggcggccca

SEQ ID NO: 541314 - RNA, 64 nt, Human Herpes Virus 1; identical to SEQ ID NO: 541311

SEQ ID NO: 541315 - RNA, 64 nt, Human Herpes Virus 2
cggggccggggucgauacggccccggcggcgccgacuccacaccaaaaccccgccggcgcgucu

SEQ ID NO: 541316 - RNA, 64 nt, Human Herpes Virus 2; identical to SEQ ID NO: 541315

SEQ ID NO: 541317 - RNA, 64 nt, Human Herpes Virus 1
caucgagcgccugcgcgagaccaacgcgggccuggcgacccaauugcaggagcgcgaccgcgag

SEQ ID NO: 541318 - RNA, 64 nt, Human Herpes Virus 1
acuaaaccccccgggcccguguggugcgaccgccgcgacccauuggcccgguacggcucgcggg

SEQ ID NO: 541319 - RNA, 64 nt, Human Herpes Virus 1
gacccagcggcugauuaucggcgaggugacgcccgcgacccagggaauguauuacuuggccugg

SEQ ID NO: 541320 - RNA, 64 nt, Human Herpes Virus 1
cuuuuacaacuuucugcagcgcccgggccuggaugcgacccagaggacccucgccuacgcccgc

SEQ ID NO: 541321 - RNA, 64 nt, Human Herpes Virus 1
uccgaguucccccggcacgccuggggucgcggccgcgacccaggcggcgaacgggggcccugcc

SEQ ID NO: 541322 - RNA, 64 nt, Human Herpes Virus 1
gcccagccacgcccccucuguccaccuggccgcggcgacccagauccgcuuccccgcccucgag

SEQ ID NO: 541323 - RNA, 64 nt, Human Herpes Virus 1
guacaccccccugcgcuacgcgugcguccuccgagcgacccagccccuguacgcgcgcaccacc

SEQ ID NO: 541324 - RNA, 64 nt, Human Herpes Virus 1
agccagacccaacccccggccccaguugggccgggcgacccagauguuuacuuaaaaggcgugc

SEQ ID NO: 541325 - RNA, 62 nt, Human Herpes Virus 2
gaccgguuccggcgccgcguggcggcggccgaggcggucaucggaccgugccuggagcccga

SEQ ID NO: 541326 - RNA, 62 nt, Human Herpes Virus 2
gagcugcucgcccgaaagcgcgaacgguucgcggcggucauuaaccgguuccuggaccugca

SEQ ID NO: 541327 - RNA, 62 nt, Human Herpes Virus 2
gcaggcgcggcgcagcucggggccaacgccgaggcggucacccgacgcccucgacgcggcgc

SEQ ID NO: 541328 - RNA, 62 nt, Human Herpes Virus 2
acgggcucgaugcagugcauggcccugcgggcggcggucagcgacguccugggccaccugac

SEQ ID NO: 541329 - RNA, 62 nt, Human Herpes Virus 2; identical to SEQ ID NO: 541325

SEQ ID NO: 541330 - RNA, 63 nt, Human Herpes Virus 2
gcgcuguggcccccccgacgggugcucgagacggucguggaugcggcgugcaugcgcgccccg

SEQ ID NO: 541331 - RNA, 63 nt, Human Herpes Virus 2
gacgaggcgcgccaaguggcgucggugguucuggucguggagcccgccccugugccgaccccg

SEQ ID NO: 541332 - RNA, 63 nt, Human Herpes Virus 2
gaggucgucucgcugaccgcccacgaauuugacgucguggacaucgaguccgaagaagagggu

SEQ ID NO: 541333 - RNA, 63 nt, Human Herpes Virus 2
aacaacaccagccucuucgacugcauagugccggucguggaccagcucgaggcggaccccgag

SEQ ID NO: 541334 - RNA, 63 nt, Human Herpes Virus 2
aauagcgaguccgugcuggggccgcggguccgcgucguggacaucauggcgcaguuucggaaa

SEQ ID NO: 541335 - RNA, 63 nt, Human Herpes Virus 2
ccugcccgaucgguuuuugcccgagcggaccgugucguggaccccguuccccgcagcgccuaa

SEQ ID NO: 541336 - RNA, 61 nt, Human Herpes Virus 4 (Epstein Barr virus)
ggaggccuucugcguccagacgcgauggcacacgccagagacaaggcaggcgcuguuaugg

SEQ ID NO: 541337 - RNA, 61 nt, Human Herpes Virus 4 (Epstein Barr virus)
gccccguagccgggaguguggccccagcaagacgccagaccccuucuccugguuccgcaaa

SEQ ID NO: 541338 - RNA, 64 nt, Human Herpes Virus 2
agccccccacgugggcaacccgacggcggggccccgggcgaaaaggcccggcccgcguccccgg

SEQ ID NO: 541339 - RNA, 64 nt, Human Herpes Virus 2
gccagcgacccccagcgcggacgcuuggcgcccccgggcgaacucaaccugacuacggcauccg

SEQ ID NO: 541340 - RNA, 64 nt, Human Herpes Virus 2
aaaccaagccacucccgacagccccgauggcgugggccgagagugccguggaaaccaccaccag

SEQ ID NO: 541341 - RNA, 64 nt, Human Herpes Virus 2
agcuccuggaggccuccgcccugggguccgggcgggccgagagcggcugcgcgcgcgcgggccu

SEQ ID NO: 541342 - RNA, 64 nt, Human Herpes Virus 2
gcugcguucugcaccccgcccucuuugucaacucggccgagaccaacacccacggccuggcgua

SEQ ID NO: 541343 - RNA, 64 nt, Human Herpes Virus 2
gagacgccagccacgcggcccugcgccgacguuuggccgagacgcaccuccgggccgaggugua

SEQ ID NO: 541344 - RNA, 64 nt, Human Herpes Virus 2
uggggcucgugauaucgaugcgggacagcccuccggccgagaucauaguggugccugcggacaa

SEQ ID NO: 541345 - RNA, 64 nt, Human Herpes Virus 2
gccgacgcccccgagacgccacccggcaggacacggccgagaccucacgcccccacaaucgcca

SEQ ID NO: 541346 - RNA, 64 nt, Human Herpes Virus 2
accgggcccacgggcuuccggagacggcgcucuuggccgagaaccuccccgggcugcuggugca

SEQ ID NO: 541347 - RNA, 64 nt, Human Herpes Virus 2
cggacgugcucgucucccaggccauucggagcauggccgagagcgacguggucauggaggacgu

SEQ ID NO: 541348 - RNA, 64 nt, Human Herpes Virus 2
cgcguacguggcgucggaggauuacuuuaagcgcugcggggaccagccgacguaucgcgguuuu

SEQ ID NO: 541349 - RNA, 64 nt, Human Herpes Virus 1
agagccacuuccagaagcgcagcaagauaaaggugaacggcauggugaacaucgacauguacgg

SEQ ID NO: 541350 - RNA, 64 nt, Human Herpes Virus 1
cccccuacgguccuccccaggguccggcgucccaugcccccacucccccguaugccccagcugc

SEQ ID NO: 541351 - RNA, 64 nt, Human Herpes Virus 1
gggcugccgaugguuugucggacccccgccggcgugcccccagaaccaaucgcaacccuggggg

SEQ ID NO: 541352 - RNA, 64 nt, Human Herpes Virus 4 (Epstein Barr virus)
uucaauuuuggggagugguuuugugugagccggaaguuggcaauggggugaggguggcgcuggu

SEQ ID NO: 541353 - RNA, 64 nt, Human Herpes Virus 2
ccugcggcgcuggcugcuggugccccaggcggacgacagcgacgacgcggacuacgccggcaac

SEQ ID NO: 541354 - RNA, 64 nt, Human Herpes Virus 2
cgcguccgucaaggugcuguuggggcgcaagagcgacagcgagcgcgggguggcuggcgccgcg

SEQ ID NO: 541355 - RNA, 64 nt, Human Herpes Virus 2
caggggccugccggcccccgucguccuggaguuugacagcgaauucgagaugcugcuggccuuc

SEQ ID NO: 541356 - RNA, 64 nt, Human Herpes Virus 2
uucgaucugggccgcaggggcgacugacgacgaugacagcgacuccgacucgcggucggacgac

SEQ ID NO: 541357 - RNA, 64 nt, Human Herpes Virus 2
ugauaugcuaaucgaccuaggauuggaccuguccgacagcgagcucgaggaggacgcucuggag

SEQ ID NO: 541358 - RNA, 64 nt, Human Herpes Virus 2
cucggcgacgggccccacuuacauucgcguggcggacagcgagcuguacgcggacuggaguucg

SEQ ID NO: 541359 - RNA, 64 nt, Human Herpes Virus 2
ggcggacagcgagcuguacgcggacuggaguucggacagcgagggggagcgcgacgggucccug

SEQ ID NO: 541360 - RNA, 64 nt, Human Herpes Virus 2
cggcgaccuggcggacggauggaugaguccgggcgacagcgaccugcuagucauguggcagcug

SEQ ID NO: 541361 - RNA, 64 nt, Human Herpes Virus 2
cggcuaaagucccgcgcgcgcuuagagaugaugcgacagcgagcgaccuguguuaaaauucgcg

SEQ ID NO: 541362 - RNA, 64 nt, Human Herpes Virus 2
ggcccgcgagcccgucgucgucgcgcagcagcuggacagcgacggcccgccgccccccggagcc

SEQ ID NO: 541363 - RNA, 64 nt, Human Herpes Virus 2
gggguaccugcgggcgguguuuaacguggacgacgacagcgaggucgaggccgcgggggagaug

SEQ ID NO: 541364 - RNA, 64 nt, Human Herpes Virus 2; identical to SEQ ID NO: 541353

SEQ ID NO: 541365 - RNA, 64 nt, Human Herpes Virus 2; identical to SEQ ID NO: 535849

SEQ ID NO: 541366 - RNA, 64 nt, Human Herpes Virus 2; identical to SEQ ID NO: 535850

SEQ ID NO: 541367 - RNA, 64 nt, Human Herpes Virus 2; identical to SEQ ID NO: 535851

SEQ ID NO: 541368 - RNA, 63 nt, Human Herpes Virus 2
ccgcagcgggucacggcgcgggugcugcugccgcgcggcuacgacuacuucgugagcgccggc

SEQ ID NO: 541369 - RNA, 63 nt, Human Herpes Virus 2
uggccgccaaggcggcccacuuggaauuggaggcgcggcuaaagucccgcgcgcgcuuagaga

SEQ ID NO: 541370 - RNA, 63 nt, Human Herpes Virus 2
cagguccccaacgcgcagcgggucgcggaacaccgcggcuaugucgccggacgucgccgccac

SEQ ID NO: 541371 - RNA, 64 nt, Human Herpes Virus 2
caacaaacgcgccguggauuuuaccccggcagaaugcggggacuccgaaugggccgugggccgc

SEQ ID NO: 541372 - RNA, 64 nt, Human Herpes Virus 2
uaucgccaccacacucuuugcgucggucuaccggugcggggagcuugaguugcgccgccccgac

SEQ ID NO: 541373 - RNA, 64 nt, Human Herpes Virus 2
ccuggcgaccguuacccugaaauacgcccuggccugcggggacgcgcgccggcgcagggacgac

SEQ ID NO: 541374 - RNA, 64 nt, Human Herpes Virus 2
gcgcgucgccgaauacgacgcccauagagucgauugcggggaccgcaccggacgcgcacguggg

SEQ ID NO: 541375 - RNA, 64 nt, Human Herpes Virus 2
cagccccugauguuuaucaacggaucgcucaccgugcggggaguucccguggaggcccggcgac

SEQ ID NO: 541376 - RNA, 64 nt, Human Herpes Virus 4 (Epstein Barr virus); identical to SEQ ID NO: 540041

SEQ ID NO: 541377 - RNA, 64 nt, Human Herpes Virus 4 (Epstein Barr virus); identical to SEQ ID NO: 540042

SEQ ID NO: 541378 - RNA, 64 nt, Human Herpes Virus 1
ggcugcgcaauaccgcguccgucaaggugcugcuggggcgcaagagcgacagcgagcgcggggu

SEQ ID NO: 541379 - RNA, 64 nt, Human Herpes Virus 1
ccacagugcguuggcggaaucgauguggggcggcggggcgcaggacucgcagccccccgggugg

SEQ ID NO: 541380 - RNA, 64 nt, Human Herpes Virus 1
gcagcuccgccugcccagcgggagacagcuggugggggcgcacgacgcguucugcggcgcaggc

SEQ ID NO: 541381 - RNA, 64 nt, Human Herpes Virus 1
ccccggggggcgaaguugccauggcugggcgggaggggcgcacgcgccagcgaacuuuacggga

SEQ ID NO: 541382 - RNA, 64 nt, Human Herpes Virus 1
aguaugaucagggcgcgucccuacgcucgcucguggggcgcacgucccugggacaacgcggccu

SEQ ID NO: 541383 - RNA, 64 nt, Human Herpes Virus 1
uggcggccgccgccgccuccgccgcgccgcgggaggggcgcaagcgcaagagucccggcccggc

SEQ ID NO: 541384 - RNA, 64 nt, Human Herpes Virus 1; identical to SEQ ID NO: 540355

SEQ ID NO: 541385 - RNA, 64 nt, Human Herpes Virus 1
cgucuaucgccaccaugucggcucgcgaacccgcggggcgcaggaggcgcgcauccacccgccc

SEQ ID NO: 541386 - RNA, 64 nt, Human Herpes Virus 1; identical to SEQ ID NO: 541383

SEQ ID NO: 541387 - RNA, 64 nt, Human Herpes Virus 4 (Epstein Barr virus)
ccacguauacuucuggggaggccugccucacccuagacuacaagccucugaguguggggccaua

SEQ ID NO: 541388 - RNA, 64 nt, Human Herpes Virus 4 (Epstein Barr virus)
aagagcuggcacccugcuuccuuccuaacacgcgagacuacaacuuugugaagcaacucuucua

SEQ ID NO: 541389 - RNA, 64 nt, Human Herpes Virus 4 (Epstein Barr virus)
uguacgccgugugccgggacaagcucagccucucagacuacaagcuggacacaguagccaggca

SEQ ID NO: 541390 - RNA, 64 nt, Human Herpes Virus 2
aguacggcggcuccuuccgcuucuccuccgacgccaucucgaccaccuucaccaccaaccugac

SEQ ID NO: 541391 - RNA, 64 nt, Human Herpes Virus 1
ggugaaauaccuuaacaacgaacgggccgaauuuaccaaccaccgccugaagcacgacgucggg

SEQ ID NO: 541392 - RNA, 64 nt, Human Herpes Virus 1
ggcccgccaucugggauggcuccuggccaggaucaccaaccacccggggggcugcgaguccugc

SEQ ID NO: 541393 - RNA, 64 nt, Human Herpes Virus 1
cuucaguccggacgggcuuuuccacuuuaucgccaccaaccaaaugcugccgcccaccgauccc

SEQ ID NO: 541394 - RNA, 64 nt, Human Herpes Virus 1
cagagagacaggcucgggugucccggaccgucgcaccaaccacgccuuaguuaggccgauccgc

SEQ ID NO: 541395 - RNA, 63 nt, Human Herpes Virus 1
gcccugccccugggaagccccgcggucgugggggccgagcacgaggcgcugggcgacaccgca

SEQ ID NO: 541396 - RNA, 62 nt, Human Herpes Virus 4 (Epstein Barr virus)
uuuaccugaaacacuaucccgaagugggggauguggugcaucuacugaacaccaucgggguc

SEQ ID NO: 541397 - RNA, 62 nt, Human Herpes Virus 4 (Epstein Barr virus)
ccaucaaaagggaggacguugagacucugaucguggugcaggccugccagccgccgcuugga

SEQ ID NO: 541398 - RNA, 62 nt, Human Herpes Virus 4 (Epstein Barr virus)
acaaggggguccucacggccaaggaggccaagguggugcauggggagcccaccugcgaccug

SEQ ID NO: 541399 - RNA, 62 nt, Human Herpes Virus 4 (Epstein Barr virus)
ccccugaaaggccacucuauaaagaugacaucguggugcaugcgcccaauaagcaccugcuc

SEQ ID NO: 541400 - RNA, 64 nt, Human Herpes Virus 4 (Epstein Barr virus)
gcuuuaccugaaacacuaucccgaagugggggauguggugcaucuacugaacaccaucgggguc

SEQ ID NO: 541401 - RNA, 64 nt, Human Herpes Virus 4 (Epstein Barr virus)
gcccaucaaaagggaggacguugagacucugaucguggugcaggccugccagccgccgcuugga

SEQ ID NO: 541402 - RNA, 64 nt, Human Herpes Virus 4 (Epstein Barr virus)
cgacaaggggguccucacggccaaggaggccaagguggugcauggggagcccaccugcgaccug

SEQ ID NO: 541403 - RNA, 64 nt, Human Herpes Virus 4 (Epstein Barr virus)
agccccugaaaggccacucuauaaagaugacaucguggugcaugcgcccaauaagcaccugcuc

SEQ ID NO: 541404 - RNA, 62 nt, Human Herpes Virus 4 (Epstein Barr virus); identical to SEQ ID NO: 541396

SEQ ID NO: 541405 - RNA, 62 nt, Human Herpes Virus 4 (Epstein Barr virus); identical to SEQ ID NO: 541397

SEQ ID NO: 541406 - RNA, 62 nt, Human Herpes Virus 4 (Epstein Barr virus); identical to SEQ ID NO: 541398

SEQ ID NO: 541407 - RNA, 62 nt, Human Herpes Virus 4 (Epstein Barr virus); identical to SEQ ID NO: 541399

SEQ ID NO: 541408 - RNA, 64 nt, Human Herpes Virus 4 (Epstein Barr virus); identical to SEQ ID NO: 541400

SEQ ID NO: 541409 - RNA, 64 nt, Human Herpes Virus 4 (Epstein Barr virus); identical to SEQ ID NO: 541401

SEQ ID NO: 541410 - RNA, 64 nt, Human Herpes Virus 4 (Epstein Barr virus); identical to SEQ ID NO: 541402

SEQ ID NO: 541411 - RNA, 64 nt, Human Herpes Virus 4 (Epstein Barr virus); identical to SEQ ID NO: 541403

SEQ ID NO: 541412 - RNA, 62 nt, Human Herpes Virus 4 (Epstein Barr virus); identical to SEQ ID NO: 541396

SEQ ID NO: 541413 - RNA, 62 nt, Human Herpes Virus 4 (Epstein Barr virus); identical to SEQ ID NO: 541397

SEQ ID NO: 541414 - RNA, 62 nt, Human Herpes Virus 4 (Epstein Barr virus); identical to SEQ ID NO: 541398

SEQ ID NO: 541415 - RNA, 62 nt, Human Herpes Virus 4 (Epstein Barr virus); identical to SEQ ID NO: 541399

SEQ ID NO: 541416 - RNA, 64 nt, Human Herpes Virus 1
uaacggcccugggcguuauccagcggcuccucgcgaacggcaacguguacgcggaccgccucaa

SEQ ID NO: 541417 - RNA, 64 nt, Human Herpes Virus 1
gcccgggggagauccaggccaccuggcgcguggugaacggcaacuugccccuggcgcuaugucc

SEQ ID NO: 541418 - RNA, 64 nt, Human Herpes Virus 1
ccgccgcaaagccacccacgccgccucggcccgcgaacggcacgcccccuacgaggacgacgag

SEQ ID NO: 541419 - RNA, 64 nt, Human Herpes Virus 4 (Epstein Barr virus); identical to SEQ ID NO: 541400

SEQ ID NO: 541420 - RNA, 64 nt, Human Herpes Virus 4 (Epstein Barr virus); identical to SEQ ID NO: 541401

SEQ ID NO: 541421 - RNA, 64 nt, Human Herpes Virus 4 (Epstein Barr virus); identical to SEQ ID NO: 541402

SEQ ID NO: 541422 - RNA, 64 nt, Human Herpes Virus 4 (Epstein Barr virus); identical to SEQ ID NO: 541403

SEQ ID NO: 541423 - RNA, 64 nt, Human Herpes Virus 4 (Epstein Barr virus)
cuggcccaccucccucuuuucacuccucuucacccugagauacagcacgacggcggagucguug

SEQ ID NO: 541424 - RNA, 63 nt, Human Herpes Virus 1
gcauacgcggaguuuuucucgggggacgcgggcgccgagcagggcccgcgccccccucucuuc

SEQ ID NO: 541425 - RNA, 63 nt, Human Herpes Virus 1
cuguuucgcgacgcgcuggcggccggaaccacagccgagcagcuccucauguucgaccuucuc

SEQ ID NO: 541426 - RNA, 63 nt, Human Herpes Virus 1
gccggacggacgagacggauccugugccgcgccgccgagcaggcuauuacccgucgccgccga

SEQ ID NO: 541427 - RNA, 63 nt, Human Herpes Virus 1
gacaucgacccuauggcccuggcggcgcgcguugccgagcaucccgacgcgcggcuggcgugg

SEQ ID NO: 541428 - RNA, 63 nt, Human Herpes Virus 1
uuuuugacccgcgagauccuaugggccgcguacgccgagcagaugaugcggcccgaccuguuu

SEQ ID NO: 541429 - RNA, 64 nt, Human Herpes Virus 4 (Epstein Barr virus)
ccucccccggccuggugcaaaaugucugccucagaauacuaacagcuaauccaagcuaacauuc

SEQ ID NO: 541430 - RNA, 64 nt, Human Herpes Virus 4 (Epstein Barr virus)
ggaugaggcaggcuucgugugcugccuggaacacaauacuaacaaacuguaugagacgauagag

SEQ ID NO: 541431 - RNA, 64 nt, Human Herpes Virus 4 (Epstein Barr virus)
uaguaugaauccaguaugccugccuguaauuguugcgcccuaccucuuuuggcuggcggcuauu

SEQ ID NO: 541432 - RNA, 64 nt, Human Herpes Virus 4 (Epstein Barr virus)
cagugacccugggcccuuuuccaaucgaucccuggcgcccuaagaccaccugggugcacugggc

SEQ ID NO: 541433 - RNA, 64 nt, Human Herpes Virus 4 (Epstein Barr virus)
gagaccagggagguguuuggguacgacgccuacagcgcccuaccgagggaaagcuccaagccgg

SEQ ID NO: 541434 - RNA, 64 nt, Human Herpes Virus 1
cgucgccugccgaccccccgggaggcgcguccaagccccgcaagcugcugguguccgagcuggc

SEQ ID NO: 541435 - RNA, 64 nt, Human Herpes Virus 1
cgccgggccuauaaaagcgcccgacgacgccgccgccccgcagaccccggacaccgcgugugug

SEQ ID NO: 541436 - RNA, 64 nt, Human Herpes Virus 1
uucgcccugugucgcgcgaccgacagcacucacagccccgcauaucccacccuggagcucaauc

SEQ ID NO: 541437 - RNA, 64 nt, Human Herpes Virus 1
guagcguguucguggcgaccgugaaaagccuggggccccgcacccagcagcugcagaucgagga

SEQ ID NO: 541438 - RNA, 64 nt, Human Herpes Virus 1
ccgcggcucugcaucuuuacccccggccggggcggccccgcagggacgaagcguucagcgaacg

SEQ ID NO: 541439 - RNA, 64 nt, Human Herpes Virus 1
ccggccacccaggugacgccuucgagggucucguucagcgaauucggcuuaucgucccaucuac

SEQ ID NO: 541440 - RNA, 64 nt, Human Herpes Virus 1
augggggcggggggcucgggugcugauugggccgucagcgaauuucagagguuuuacuguuuug

SEQ ID NO: 541441 - RNA, 64 nt, Human Herpes Virus 1
guguuucaggccaccacgcccggccuguacgccaucagcgaauugcgauucuggcucgcguccg

SEQ ID NO: 541442 - RNA, 64 nt, Human Herpes Virus 4 (Epstein Barr virus)
ccucuaagacucaaggccagagccggggacagagcagggggaggggcaggggcaggggcagggg

SEQ ID NO: 541443 - RNA, 64 nt, Human Herpes Virus 4 (Epstein Barr virus)
gccucuggcggugcgggcacagcgggccgacacgcagggggaugaacuccugcuggcccucccu

SEQ ID NO: 541444 - RNA, 64 nt, Human Herpes Virus 4 (Epstein Barr virus)
uauuuucagacccaccauggaaucauuugaaggacagggggacucuagacagucacccgacaau

SEQ ID NO: 541445 - RNA, 64 nt, Human Herpes Virus 4 (Epstein Barr virus)
gugaaagagccagggggggaagucgugaaagagccagggggagaggucguggacguggagaaaa

SEQ ID NO: 541446 - RNA, 64 nt, Human Herpes Virus 4 (Epstein Barr virus)
gggagcugcuucgggaauacgaggggagacggaccagggggaaagaagaccuggcagacaaccc

SEQ ID NO: 541447 - RNA, 64 nt, Human Herpes Virus 4 (Epstein Barr virus)
ggaacugcucacacugagcgcuaagaaacagccacagggggaugccagaggccgcguggcgugg

SEQ ID NO: 541448 - RNA, 64 nt, Human Herpes Virus 4 (Epstein Barr virus)
acgcgggcccgggugccuacugauggccaucuuucagggggaucuuuacguggguggauguagg

SEQ ID NO: 541449 - RNA, 64 nt, Human Herpes Virus 4 (Epstein Barr virus)
gagcuccagggcuggguccugagacccaaagggacagggggagacuuucggggcauugguguaa

SEQ ID NO: 541450 - RNA, 64 nt, Human Herpes Virus 4 (Epstein Barr virus)
gaacucuggcggccaugcuaucggugcaacggggcagggggaggguggcggccauucccgccuc

SEQ ID NO: 541451 - RNA, 64 nt, Human Herpes Virus 4 (Epstein Barr virus)
gccuguggcaggccccggccccggcuccggcccuccccuguaagcccccccuacuccccggcga

SEQ ID NO: 541452 - RNA, 64 nt, Human Herpes Virus 2
ucacacaauuuauccuggagcaccgggcccgcgccuccugcaaguacgcucucccccugcgcau

SEQ ID NO: 541453 - RNA, 64 nt, Human Herpes Virus 2
cgcgcugagcgcccaggacggauacgugaacgcgcuccugcagaugcagagcgucacgcgagaa

SEQ ID NO: 541454 - RNA, 64 nt, Human Herpes Virus 2
ggugcuggucaccaccgccgccaucaaacagcgccuccugcaguccuuccugaagguggaggac

SEQ ID NO: 541455 - RNA, 64 nt, Human Herpes Virus 2
uacgcugagcauggacuggcuauuaauaaacgagcuccugcaggucaccgacggcguguuucgc

SEQ ID NO: 541456 - RNA, 64 nt, Human Herpes Virus 2
caccauucgcgugacggucugcgagggcaagaaccuccugcagcgcgcgaacgaguuggugaau

SEQ ID NO: 541457 - RNA, 64 nt, Human Herpes Virus 2
caucgagauucuggaugccccugcguguuuucggcuccugcaucaagagcgccccggcccccac

SEQ ID NO: 541458 - RNA, 63 nt, Human Herpes Virus 1
ggccgauagugccacgcccaccacguucgagcucgggguuaacggcaaauuuuccguguucac

SEQ ID NO: 541459 - RNA, 63 nt, Human Herpes Virus 1
ggaagguaauuucuacgugcccccggauaugcgcgggguuacgcgggccccggggagacagcg

SEQ ID NO: 541460 - RNA, 64 nt, Human Herpes Virus 2; identical to SEQ ID NO: 539998

SEQ ID NO: 541461 - RNA, 64 nt, Human Herpes Virus 2; identical to SEQ ID NO: 539999

SEQ ID NO: 541462 - RNA, 64 nt, Human Herpes Virus 2; identical to SEQ ID NO: 540000

SEQ ID NO: 541463 - RNA, 64 nt, Human Herpes Virus 2; identical to SEQ ID NO: 540001

SEQ ID NO: 541464 - RNA, 64 nt, Human Herpes Virus 2; identical to SEQ ID NO: 540002

SEQ ID NO: 541465 - RNA, 64 nt, Human Herpes Virus 2; identical to SEQ ID NO: 540003

SEQ ID NO: 541466 - RNA, 64 nt, Human Herpes Virus 2; identical to SEQ ID NO: 540004

SEQ ID NO: 541467 - RNA, 64 nt, Human Herpes Virus 2
ucuggacgcggaguacuggagcguucugacccccccaggcgaggccgacgacccccugccccaa

SEQ ID NO: 541468 - RNA, 64 nt, Human Herpes Virus 2
ccaccaaccuggcacagcgggcacucuggcguccccaggcgacgccaggccccccgggagccgc

SEQ ID NO: 541469 - RNA, 64 nt, Human Herpes Virus 2
aucccgucagccucgucccgcccgucuucgagggccaggcgacggacgugcgccuggagucgcu

SEQ ID NO: 541470 - RNA, 64 nt, Human Herpes Virus 2
cgcuggacaugguggacgcccugaucaucggcggccaggcgacgucgcccgacgaucagaucga

SEQ ID NO: 541471 - RNA, 64 nt, Human Herpes Virus 2
gcguacgccgaguaugucgcuucgugcgccaucgccaggcgacgcgagaccaaggacgcagugg

SEQ ID NO: 541472 - RNA, 62 nt, Human Herpes Virus 4 (Epstein Barr virus)
gcgccuuuggguucaagagccgccacauaaauaugacgcagcgggucagcagucauggucgc

SEQ ID NO: 541473 - RNA, 64 nt, Human Herpes Virus 1
agccagcccgcccucacagggcgggccgccucgggggcgggacuggccaaucggcggccgccag

SEQ ID NO: 541474 - RNA, 64 nt, Human Herpes Virus 1
cagcguccgccgagucuucggggcccggcccauugggcgggaguuaccgcccaaugggccgggc

SEQ ID NO: 541475 - RNA, 64 nt, Human Herpes Virus 1
acgccgugggacccccgacuccggugcgucuggagggcgggagaagagggaagaagaggggucg

SEQ ID NO: 541476 - RNA, 56 nt, Human Herpes Virus 1
ccccggggggcgaaguugccauggcugggcgggaggggcgcacgcgccagcgaacu

SEQ ID NO: 541477 - RNA, 64 nt, Human Herpes Virus 1
agaccaauccgcuacccgcaaccccuuccguguggggcgggaguaccguggaacucccccccac

SEQ ID NO: 541478 - RNA, 64 nt, Human Herpes Virus 1
cacggcgauccggaagaccucgauggcgcugcccgggcgggagaggcgggggccuugcaugccu

SEQ ID NO: 541479 - RNA, 64 nt, Human Herpes Virus 1
cgggugcgaugccgcgcuggugcgcgcgcgcuacgggcgggaauucauggggcucgugauaucc

SEQ ID NO: 541480 - RNA, 64 nt, Human Herpes Virus 1; identical to SEQ ID NO: 541475

SEQ ID NO: 541481 - RNA, 64 nt, Human Herpes Virus 1; identical to SEQ ID NO: 541474

SEQ ID NO: 541482 - RNA, 64 nt, Human Herpes Virus 1; identical to SEQ ID NO: 541473

SEQ ID NO: 541483 - RNA, 64 nt, Human Herpes Virus 1
uccgccuagccgcagcaaauuaaaaaucgugagucacagcgaccgcaacuucccacccggagcu

SEQ ID NO: 541484 - RNA, 64 nt, Human Herpes Virus 1
ccccugggccggcagucacggggcgcugcuucaucacagcgacgccggccgaaagcacgcggcc

SEQ ID NO: 541485 - RNA, 64 nt, Human Herpes Virus 1
gcgcguguaccacauccaggcgggccuaccggacccguuccagccccccagccucccgaucacg

SEQ ID NO: 541486 - RNA, 64 nt, Human Herpes Virus 1
ccgccgcaccuucagcaacccggggaccgaccagccguuccagggagggccgaggccuuuuuaa

SEQ ID NO: 541487 - RNA, 64 nt, Human Herpes Virus 2
gucacuacgugcgcguguuggugggcccccaccucggggccaucgccgccaccggcaucgucgg

SEQ ID NO: 541488 - RNA, 64 nt, Human Herpes Virus 2
auacgcuguguguuucgucuguccccagggaauccggggccaggacuuuaaccugcuuuucguc

SEQ ID NO: 541489 - RNA, 64 nt, Human Herpes Virus 2
uguaccccgacgcgccgccgcugcgccucugccgcggggccaacgugcgguaccgcgugcgcac

SEQ ID NO: 541490 - RNA, 64 nt, Human Herpes Virus 2
acguccgggcaccagguccgcccccacagcagcccggggccagacccgccgugcgguucaggga

SEQ ID NO: 541491 - RNA, 64 nt, Human Herpes Virus 2
ccuggugacccugaacuccaacuccacgauaucccggggccaguuuugccuccaggagccggac

SEQ ID NO: 541492 - RNA, 64 nt, Human Herpes Virus 2
acgugccggugaccuacggcgagauggucuugaacggggccaaccucgucacggcgcuggugau

SEQ ID NO: 541493 - RNA, 64 nt, Human Herpes Virus 2
uggaccaggcgcuggcgcggaccgcggcgggcggcggggccagggccggcccgccgcccgccga

SEQ ID NO: 541494 - RNA, 64 nt, Human Herpes Virus 2
ggaccccaccguccagcguggggaccugcuccagcggggccagccccgcccccaaggccccgcc

SEQ ID NO: 541495 - RNA, 64 nt, Human Herpes Virus 2
aucgcggggucgaguguaccgagccgguuguguucggggccaaggcgauccuggcccgcacgac

SEQ ID NO: 541496 - RNA, 64 nt, Human Herpes Virus 2; identical to SEQ ID NO: 541489

SEQ ID NO: 541497 - RNA, 64 nt, Human Herpes Virus 1; identical to SEQ ID NO: 541473

SEQ ID NO: 541498 - RNA, 64 nt, Human Herpes Virus 1; identical to SEQ ID NO: 541474

SEQ ID NO: 541499 - RNA, 64 nt, Human Herpes Virus 1; identical to SEQ ID NO: 541475

SEQ ID NO: 541500 - RNA, 56 nt, Human Herpes Virus 1; identical to SEQ ID NO: 541476

SEQ ID NO: 541501 - RNA, 64 nt, Human Herpes Virus 1; identical to SEQ ID NO: 541477

SEQ ID NO: 541502 - RNA, 64 nt, Human Herpes Virus 1; identical to SEQ ID NO: 541478

SEQ ID NO: 541503 - RNA, 64 nt, Human Herpes Virus 1; identical to SEQ ID NO: 541479

SEQ ID NO: 541504 - RNA, 64 nt, Human Herpes Virus 1; identical to SEQ ID NO: 541475

SEQ ID NO: 541505 - RNA, 64 nt, Human Herpes Virus 1; identical to SEQ ID NO: 541474

SEQ ID NO: 541506 - RNA, 64 nt, Human Herpes Virus 1; identical to SEQ ID NO: 541473

SEQ ID NO: 541507 - RNA, 64 nt, Human Herpes Virus 1
guccuccuacagcuaguccccguucgcgguacccugcagcaaagccugucgugucugcgcuuua

SEQ ID NO: 541508 - RNA, 64 nt, Human Herpes Virus 1
augucgacgcugggccagcucuauucgccaacgaugcagcaacugggccgcguggaugcguuaa

SEQ ID NO: 541509 - RNA, 64 nt, Human Herpes Virus 1
cucccgggagcgcggugcuguaccccuuuuuccugcucaacaaacagaagacgcccgccuuuga

SEQ ID NO: 541510 - RNA, 60 nt, Human Herpes Virus 1
ugcccguggcgaagagauuaccaaccggagggagagcaugcagaugcgcgaggcccucga

SEQ ID NO: 541511 - RNA, 60 nt, Human Herpes Virus 1
cacgggccuguuugcggaggacagccccuuggagagcaccgaggucguggacgccguggc

SEQ ID NO: 541512 - RNA, 62 nt, Human Herpes Virus 1
uuuguggggcuaaaggccuggaccagagccccgugaaggacacgggccucccugccggcggg

SEQ ID NO: 541513 - RNA, 64 nt, Human Herpes Virus 2
ccggcggcccucacgcccgcccccgcguacugcggggucgcagacucguccaccaaaaugaugg

SEQ ID NO: 541514 - RNA, 57 nt, Human Herpes Virus 2
cgcgccgccgccgcguuuuuggcacgcggccacaaccucuuccugugggaggaccag

SEQ ID NO: 541515 - RNA, 64 nt, Human Herpes Virus 1
cgggcguuuaucggggccgcguugggccugagcccccuccaaaagcuagccguuuacuacuaua

SEQ ID NO: 541516 - RNA, 64 nt, Human Herpes Virus 1
uuucccugcggcaguucccgcaacuggcgccccccccuccaaccggggccgggauacgcgaaga

SEQ ID NO: 541517 - RNA, 64 nt, Human Herpes Virus 1
uccaaccagccgaacccgcagugguucuggacggcccuccaacgcaaccagcuucccgcccggc

SEQ ID NO: 541518 - RNA, 64 nt, Human Herpes Virus 1
gacgacggacaagcacguaugucaccggcugagucccuccaaucgccgguuccucccgcucggc

SEQ ID NO: 541519 - RNA, 64 nt, Human Herpes Virus 1
agggcgcccuggcguagccccgaugcaacgccacaggccgcacgcccgguccgcgcucggaccg

SEQ ID NO: 541520 - RNA, 64 nt, Human Herpes Virus 1
ccagggaacccccgacguucaguugcgccugacgaggccgcagcucaccaagguccuuaacgcg

SEQ ID NO: 541521 - RNA, 64 nt, Human Herpes Virus 1
gggcuacccucacuaucgagggcgcuuggucgggaggccgcaucgaacgcacacccccauccgg

SEQ ID NO: 541522 - RNA, 64 nt, Human Herpes Virus 1
ugguggccccggccaccuaccucuugaacuacgcaggccgcaucguaucgagcguguuccugca

SEQ ID NO: 541523 - RNA, 64 nt, Human Herpes Virus 1
gggucuguuggggacacuggguucuccuggaacgaggccgcagccuucucccggugccuuuccc

SEQ ID NO: 541524 - RNA, 64 nt, Human Herpes Virus 1
agccccucgggggggcgcgaacggccccuguuuuaggccgcaaccgcccucuaccggcccacgg

SEQ ID NO: 541525 - RNA, 64 nt, Human Herpes Virus 1
gcaucgaccacgcccuuccccacgggagauccaaaaccacaaccucccggggucaaccacgaac

SEQ ID NO: 541526 - RNA, 64 nt, Human Herpes Virus 4 (Epstein Barr virus)
cacguaggcacuagccucuucaugugagguaagagaucgcuaaaaaugggaucaggguauguaa

SEQ ID NO: 541527 - RNA, 64 nt, Human Hepatitis C Virus
ugccaacggaagcggccucgacgaacgccccuacugcuggcacuacccuccaagaccuuguggc

SEQ ID NO: 541528 - RNA, 64 nt, Human Herpes Virus 2
gcagcgccccccgccucacggaggacgacuuugggcuccugaacuacgcgcucgcugagaugcg

SEQ ID NO: 541529 - RNA, 64 nt, Human Herpes Virus 2
cugagaccaccgcggccguccacgcccaguuugggcuccugaagagggccuuucuggggcgaua

SEQ ID NO: 541530 - RNA, 64 nt, Human Herpes Virus 4 (Epstein Barr virus)
accaccacgcaugcaucucccugucuugcaugugccagaccaaucaaugcacccucuuacucau

SEQ ID NO: 541531 - RNA, 64 nt, Human Herpes Virus 4 (Epstein Barr virus)
aagaaggcaccggucgcccaguccuaccagagggggccaagaacccagacgaguccguagaagg

SEQ ID NO: 541532 - RNA, 64 nt, Human Herpes Virus 4 (Epstein Barr virus); identical to SEQ ID NO: 541531

SEQ ID NO: 541533 - RNA, 64 nt, Human Herpes Virus 4 (Epstein Barr virus); identical to SEQ ID NO: 541531

SEQ ID NO: 541534 - RNA, 64 nt, Human Herpes Virus 4 (Epstein Barr virus)
ggaagaccaggagccccgggcggcucaggaucagggccaagacauagagaugguguccggagac

SEQ ID NO: 541535 - RNA, 64 nt, Human Herpes Virus 4 (Epstein Barr virus)
ugggaccguuuggacacccccgggggcccggcccggccaagagcgaagacgaggagucugagcg

SEQ ID NO: 541536 - RNA, 64 nt, Human Herpes Virus 4 (Epstein Barr virus)
agacuggcaauggcugcguggaccuccgcugguuggccaagagcuucuuugagcugacuguccu

SEQ ID NO: 541537 - RNA, 64 nt, Human Herpes Virus 4 (Epstein Barr virus)
acaagcuggacacaguagccaggcaccuacugggggccaagaaggaggaugugcauuacaagga

SEQ ID NO: 541538 - RNA, 64 nt, Human Herpes Virus 4 (Epstein Barr virus)
uggacgccgaagugguccaguuuaugaacagcauggccaagaacaacaucaccuacaaggaccu

SEQ ID NO: 541539 - RNA, 64 nt, Human Herpes Virus 4 (Epstein Barr virus)
ccuucagaagaauguccaaaaggucaaagaacaaggccaagaaggagcguguccccguggagga

SEQ ID NO: 541540 - RNA, 64 nt, Human Herpes Virus 2
uguguacauguccccguuuuacggcuaccgggaggggucgcacaccgagcacaccagcuacgcc

SEQ ID NO: 541541 - RNA, 64 nt, Human Herpes Virus 4 (Epstein Barr virus)
cccauuccaggugugcuucuuuuuggugaaauaaaaacagcauccuuuauaugaaaauguguau

SEQ ID NO: 541542 - RNA, 64 nt, Human Herpes Virus 4 (Epstein Barr virus)
acucauugcgcccgcuggagugcaacgggagaagaaacagcaggcugcgcgacuuugugaagca

SEQ ID NO: 541543 - RNA, 64 nt, Human Herpes Virus 4 (Epstein Barr virus)
gaagcaccucaaccuggagacaauucuacuguucaaacagcagcagcagugguguuugcuugcc

SEQ ID NO: 541544 - RNA, 64 nt, Human Herpes Virus 1
gucgggcgucccacacucucugggcgggcggggacgaucgcaucaaaagcccgauaucgucuuu

SEQ ID NO: 541545 - RNA, 63 nt, Human Herpes Virus 1
ggccgcuauuuggugggugguuggugcuggcgcgcgccuauaaaaaaggacgcaccgccgccc

SEQ ID NO: 541546 - RNA, 63 nt, Human Herpes Virus 1; identical to SEQ ID NO: 541545

SEQ ID NO: 541547 - RNA, 64 nt, Human Herpes Virus 4 (Epstein Barr virus)
ggauggccuggugcaugcaugccugcaggacauuguguuguaaccagucuacuccuuacuaugu

SEQ ID NO: 541548 - RNA, 64 nt, Human Herpes Virus 2
gccccacgggcgcgcccaccgaacaggagagguucgaggggagccgggcgcucuaccgggaugc

SEQ ID NO: 541549 - RNA, 64 nt, Human Herpes Virus 2
uccccgugcuccuggagaaccugaugcgcgcccucgaggggaccgcccccgacgcguucuuuca

SEQ ID NO: 541550 - RNA, 64 nt, Human Herpes Virus 2
acgccgccauguucgcggggcugugcgcguucuucgaggggaugggggacuuggggcgcgcggu

SEQ ID NO: 541551 - RNA, 64 nt, Human Herpes Virus 2
gucgcccccccguacugucugaaugccacguggcaggccgaaaacgcccugcacacgaccaaaa

SEQ ID NO: 541552 - RNA, 64 nt, Human Herpes Virus 2
cccggcacgaaccugguccuggguguccuuccggaggccgaacacgccgaccgccuggccagac

SEQ ID NO: 541553 - RNA, 64 nt, Human Herpes Virus 2
uacgacgcggugcggaccugggggccggacgcggaggccgaaccggaccagauggaaaacacgu

SEQ ID NO: 541554 - RNA, 62 nt, Human Herpes Virus 1
acagcgccccccucggcgcccaucgggccacacggcagcaguaacaccaacaccaccaccaa

SEQ ID NO: 541555 - RNA, 62 nt, Human Herpes Virus 1; identical to SEQ ID NO: 541554

SEQ ID NO: 541556 - RNA, 64 nt, Human Herpes Virus 2; identical to SEQ ID NO: 535849

SEQ ID NO: 541557 - RNA, 64 nt, Human Herpes Virus 2; identical to SEQ ID NO: 535849

SEQ ID NO: 541558 - RNA, 64 nt, Human Herpes Virus 2; identical to SEQ ID NO: 535850

SEQ ID NO: 541559 - RNA, 64 nt, Human Herpes Virus 2; identical to SEQ ID NO: 535851

SEQ ID NO: 541560 - RNA, 64 nt, Human Herpes Virus 2; identical to SEQ ID NO: 535850

SEQ ID NO: 541561 - RNA, 64 nt, Human Herpes Virus 2; identical to SEQ ID NO: 535851

SEQ ID NO: 541562 - RNA, 62 nt, Human Herpes Virus 1
cuggcgagcgucgcggugugcgaagagucccccggcagcagcuggaaggcgggggcguucga

SEQ ID NO: 541563 - RNA, 64 nt, Human Herpes Virus 4 (Epstein Barr virus)
ucccgccccuguccacugccccgguccccccagaagcccccaaaaguagaggcucaggccaugc

SEQ ID NO: 541564 - RNA, 64 nt, Human Herpes Virus 4 (Epstein Barr virus)
gcugcugcuaucuuuagaggggaaaagaggaauaagcccccagacaggggagugggcuuguuug

SEQ ID NO: 541565 - RNA, 64 nt, Human Herpes Virus 4 (Epstein Barr virus); identical to SEQ ID NO: 541563

SEQ ID NO: 541566 - RNA, 64 nt, Human Herpes Virus 4 (Epstein Barr virus); identical to SEQ ID NO: 541564

SEQ ID NO: 541567 - RNA, 64 nt, Human Herpes Virus 4 (Epstein Barr virus)
ccucugcaccaucauggucaucuccccagccccgagcccccauacgccccauuccaacaagauu

SEQ ID NO: 541568 - RNA, 64 nt, Human Herpes Virus 4 (Epstein Barr virus)
uuacccuucuccuggcccaccugcgcaaaaagacagcccccauccacugccgugaugcucaagu

SEQ ID NO: 541569 - RNA, 64 nt, Human Herpes Virus 4 (Epstein Barr virus)
ucucccaccaaguccauccugaaaaaggcaccggagcccccaccuccggagccccaagccaccu

SEQ ID NO: 541570 - RNA, 64 nt, Human Herpes Virus 4 (Epstein Barr virus)
ccaccgaacgaugaggaacgugaaucuaaugaagagcccccaccgccuuaugaggacccauauu

SEQ ID NO: 541571 - RNA, 64 nt, Human Herpes Virus 4 (Epstein Barr virus)
gggugggagcagggagggggcgucccgggaccccagcccccagccggcaauccaggcguaccgg

SEQ ID NO: 541572 - RNA, 64 nt, Human Herpes Virus 4 (Epstein Barr virus)
ggcucggcccuccgcauccuccgacugcagcagcagcccccaccccacugcaaguuuggccgcu

SEQ ID NO: 541573 - RNA, 64 nt, Human Herpes Virus 4 (Epstein Barr virus)
uuaccuucacaagcaccaccucaccuccuucuacagcccccacagugacgcggggguccuuggc

SEQ ID NO: 541574 - RNA, 64 nt, Human Herpes Virus 4 (Epstein Barr virus)
cagggcccuggucaggggaauugcucauauuuuuagcccccacgcucucuauguugucacauau

SEQ ID NO: 541575 - RNA, 64 nt, Human Herpes Virus 4 (Epstein Barr virus)
guaugcaucuuacuguuaucccagccacuaccauagcccccaccacauuagucucccacaccac

SEQ ID NO: 541576 - RNA, 62 nt, Human Herpes Virus 1
gcgacuggcccgccgacgggcccgcggugucgcggcagcacgccuaccuggcgugcgagcug

SEQ ID NO: 541577 - RNA, 62 nt, Human Herpes Virus 1
ugccccggguucacccgaaaacaacgaucgagcggcagcagcacggacccgucaccuucccc

SEQ ID NO: 541578 - RNA, 62 nt, Human Herpes Virus 1; identical to SEQ ID NO: 541576

SEQ ID NO: 541579 - RNA, 64 nt, Human Herpes Virus 1
uggccacaaaacgccuggggggcgaggcgcaccccgaucgcacgcuguucgcgcacgucgcgcu

SEQ ID NO: 541580 - RNA, 64 nt, Human Herpes Virus 1
gcgagaccagugcgcuggagaaguucauaacccacgaucgcaguugccugcgcguguccgaccg

SEQ ID NO: 541581 - RNA, 64 nt, Human Herpes Virus 1
ccgacgacgcgcagccggcguuucugaccugcaccgaucgcagcguccgguuggccgcgcggca

SEQ ID NO: 541582 - RNA, 64 nt, Human Herpes Virus 4 (Epstein Barr virus)
cgccuggcuccccucacugucacuggccucccuccacccagacauaccccaaaccaccgcagau

SEQ ID NO: 541583 - RNA, 64 nt, Human Herpes Virus 4 (Epstein Barr virus)
cccgguauuaaaaacccagaagaccucaccuugccacccagaugugucauggcucacaaaguca

SEQ ID NO: 541584 - RNA, 64 nt, Human Herpes Virus 4 (Epstein Barr virus)
gccgcauucccugcaucgucugcgugggcucucccacccagacagacgccuuucaguccuccuu

SEQ ID NO: 541585 - RNA, 64 nt, Human Herpes Virus 4 (Epstein Barr virus)
ccgggcagagcgacauucagcugacacgcuccugcacccagagcggggacaagcuaaacaccag

SEQ ID NO: 541586 - RNA, 64 nt, Human Herpes Virus 4 (Epstein Barr virus)
cggagcucagccgcaagcucucagccuacaagagcacccagaugccucaccuggccgucuacca

SEQ ID NO: 541587 - RNA, 60 nt, Human Herpes Virus 4 (Epstein Barr virus)
ccugccugguggagauggcccuggccgggcagcggggagugaccaucacuaugccggugg

SEQ ID NO: 541588 - RNA, 60 nt, Human Herpes Virus 4 (Epstein Barr virus)
agggggacucuagacagucacccgacaaugagcggggagauaauguacagacuaccggcg

SEQ ID NO: 541589 - RNA, 60 nt, Human Herpes Virus 4 (Epstein Barr virus)
uguagcuuccgcccgccucacggacuggucagcggggacguacugggacaccuggcccga

SEQ ID NO: 541590 - RNA, 60 nt, Human Herpes Virus 4 (Epstein Barr virus)
gccgcguaccggcgcaucaucgaagagggcagcggggaggugcucgcggucucuggccca

SEQ ID NO: 541591 - RNA, 60 nt, Human Herpes Virus 4 (Epstein Barr virus)
ggcgugguccacgagcggcgugucuuggccagcggggagaggguggaagucuuuuauaag

SEQ ID NO: 541592 - RNA, 60 nt, Human Herpes Virus 4 (Epstein Barr virus)
uuuaguuacccauccuuaaccagugcccaaagcggggacuauucccuggugauuguuaca

SEQ ID NO: 541593 - RNA, 60 nt, Human Herpes Virus 4 (Epstein Barr virus)
gacauucagcugacacgcuccugcacccagagcggggacaagcuaaacaccagcgagccc

SEQ ID NO: 541594 - RNA, 64 nt, Human Herpes Virus 2
ccugucugcucuacgaccuguccaccaccgcccucgagcacauccuccuguuuucgcucggauc

SEQ ID NO: 541595 - RNA, 64 nt, Human Herpes Virus 2
uccgggagcgccacgaacgcgaugacgucauuagcgagcacauacuaucugcucuacgcgaucc

SEQ ID NO: 541596 - RNA, 64 nt, Human Herpes Virus 2
ccccguuuuacggcuaccgggaggggucgcacaccgagcacaccagcuacgccgccgaccgcuu

SEQ ID NO: 541597 - RNA, 64 nt, Human Herpes Virus 2
acgugaaaacguuccggcggauccagggcgccagcgagcacacgcacgggcggcucugugaggc

SEQ ID NO: 541598 - RNA, 64 nt, Human Herpes Virus 1
acguaaaaacuuucaggcggguccagggcgccagcgagcacacgcacgggcggcucugcgaggc

SEQ ID NO: 541599 - RNA, 64 nt, Human Herpes Virus 1
cccucccgucaccgguucguauccacaauaaacacgagcacauacauuacaaaaccugcgguug

SEQ ID NO: 541600 - RNA, 64 nt, Human Herpes Virus 2
ccgaggacggcugggugaagguucaccccacccccgggacgauguuguuccgcgagauucuccu

SEQ ID NO: 541601 - RNA, 64 nt, Human Herpes Virus 2
ggcgcgcgccgucggccgcguaucgcguguuuggcgggacgagcucgucguaacugaacaggag

SEQ ID NO: 541602 - RNA, 64 nt, Human Herpes Virus 2
guccccgaccggccaggcguuugccgcggcggcgcgggacgacugggcccgcgugacgcgggac

SEQ ID NO: 541603 - RNA, 64 nt, Human Herpes Virus 2
guccgacagcgagcucgaggaggacgcucuggagcgggacgaggagggccgccgcgacgacccc

SEQ ID NO: 541604 - RNA, 64 nt, Human Herpes Virus 2
cgugcggaacaacauggagaccaccgcguuucaccgggacgaccacgagaccgacauggagcuc

SEQ ID NO: 541605 - RNA, 64 nt, Human Herpes Virus 2; identical to SEQ ID NO: 541600

SEQ ID NO: 541606 - RNA, 64 nt, Human Herpes Virus 2; identical to SEQ ID NO: 541601

SEQ ID NO: 541607 - RNA, 64 nt, Human Herpes Virus 2; identical to SEQ ID NO: 541602

SEQ ID NO: 541608 - RNA, 64 nt, Human Herpes Virus 2; identical to SEQ ID NO: 541603

SEQ ID NO: 541609 - RNA, 64 nt, Human Herpes Virus 2; identical to SEQ ID NO: 541604

SEQ ID NO: 541610 - RNA, 64 nt, Human Herpes Virus 2
ucgcgcgugccgucggacuccgguucugucgcggggcggcuacgggacccggccuuguccgcug

SEQ ID NO: 541611 - RNA, 64 nt, Human Herpes Virus 2
cggcgaagacgcugacggucgcgcucucggagggggcggcuaucugcgcccccagccuaacggc

SEQ ID NO: 541612 - RNA, 60 nt, Human Herpes Virus 4 (Epstein Barr virus)
ugcauuuaccccacuggacauuaaugccaccacgccaaaaaggccucgaguagaagaaag

SEQ ID NO: 541613 - RNA, 60 nt, Human Herpes Virus 4 (Epstein Barr virus)
uggccccggucaccccagaugccgugaaugcacgccaacagcgaccggcagaucccgcau

SEQ ID NO: 541614 - RNA, 64 nt, Human Herpes Virus 1
cgcgucccccccucgcgccggcaggggccaagagggcggcgacgcacccccccuccgacucagg

SEQ ID NO: 541615 - RNA, 64 nt, Human Herpes Virus 1
uccgguccagcgaggcgaccacccggcagcugcaggcggcgaucuuucacgcgcuccucaacgc

SEQ ID NO: 541616 - RNA, 64 nt, Human Herpes Virus 1
gggcgcggacgaggcgucggcgggccucaccaugggcggcgaugcccuacgagugcccuuuuua

SEQ ID NO: 541617 - RNA, 64 nt, Human Herpes Virus 1
gcaaagccgccgggaaagacaacuaugccacagaggcggcgauuaaaccccaggcagagguagg

SEQ ID NO: 541618 - RNA, 64 nt, Human Herpes Virus 1
acgccagauguaugcgcgcgguaaaggcgaccucggcggcgaugucaaagggcggcaggacggg

SEQ ID NO: 541619 - RNA, 64 nt, Human Herpes Virus 1
caagguucgcaaggcgaccaacagcggggucuuuggcggcgacgacaacauugucugcaugagc

SEQ ID NO: 541620 - RNA, 64 nt, Human Herpes Virus 1
ugcacaggaaggaccccggggacggggcccgguuggcggcgacgcuucggggccucuucuucuc

SEQ ID NO: 541621 - RNA, 64 nt, Human Herpes Virus 1
ccccccucuccgaggccgcgcccaagccccgggcggcggcgaggacccccgcggccuccgcggg

SEQ ID NO: 541622 - RNA, 64 nt, Human Herpes Virus 1
cgggcccgcccccgccgcccaggccgcgugcggcggcggcgacgacgacgauaacccccacccc

SEQ ID NO: 541623 - RNA, 64 nt, Human Herpes Virus 1
gcuguuucgcuacugcgugggccgcgcggacgacggcggcgaggccggcgccgacacgcggcgc

SEQ ID NO: 541624 - RNA, 64 nt, Human Herpes Virus 1
cgagugguuggaucgcggaugggaagcccuggccggcggcgaccggccggacuggcuguggagc

SEQ ID NO: 541625 - RNA, 64 nt, Human Herpes Virus 1
ccccaucuccccggaggagcagcugacggcccccggcggcgacacgaccgcggcccaggacgug

SEQ ID NO: 541626 - RNA, 64 nt, Human Herpes Virus 1
caccaacccggacgcguccggggagggcgaggagggcggcgacuuugacgaggccaagcuagcc

SEQ ID NO: 541627 - RNA, 64 nt, Human Herpes Virus 1
cccccggcacgccuggggucgcggccgcgacccaggcggcgaacgggggcccugccacuccggc

SEQ ID NO: 541628 - RNA, 64 nt, Human Herpes Virus 1
gcgugcgggccgugcccccugcuucagcuucucgggcggcgauccaaccucgccguguaccagg

SEQ ID NO: 541629 - RNA, 64 nt, Human Herpes Virus 1
acccgcagaugcugcgccgcucccguuuguggcgggcggcgaggagcggaggcccggggccccu

SEQ ID NO: 541630 - RNA, 64 nt, Human Herpes Virus 1
cccguaacgucgcgggacccgacaggcgaccgccggcggcgacgugcccccuccucguccggcg

SEQ ID NO: 541631 - RNA, 64 nt, Human Herpes Virus 1; identical to SEQ ID NO: 541614

SEQ ID NO: 541632 - RNA, 64 nt, Human Herpes Virus 1; identical to SEQ ID NO: 541622

SEQ ID NO: 541633 - RNA, 64 nt, Human Herpes Virus 1; identical to SEQ ID NO: 541621

SEQ ID NO: 541634 - RNA, 64 nt, Human Herpes Virus 2
cccggccgagcgccagggcagccccacgcccgccgacgcgcagggauccugugggggugggccc

SEQ ID NO: 541635 - RNA, 64 nt, Human Herpes Virus 2
cgcggccgggcccgcgccgcccgccgugccgguggacgcgcaccgcgcgccccggucgcgcaug

SEQ ID NO: 541636 - RNA, 64 nt, Human Herpes Virus 2
gacgcccauagagucgauugcggggaccgcaccggacgcgcacguggggccucucgacggagag

SEQ ID NO: 541637 - RNA, 64 nt, Human Herpes Virus 2
ggucaucgacaaccgcgccgccccgggcguguuugacgcgcaccgguucaugcgagcgucgcug

SEQ ID NO: 541638 - RNA, 64 nt, Human Herpes Virus 2
ggaggccggggcccgcgcgcugauggacucccucgacgcgcaccccggcgccuggacguccaug

SEQ ID NO: 541639 - RNA, 64 nt, Human Herpes Virus 2
guggacaucuccaugaccccaaacccgccgcgcggacgcgcaucggagccccccggccccccug

SEQ ID NO: 541640 - RNA, 64 nt, Human Herpes Virus 2
ugccuacgcugaccgcggccccggucggccucgagacgcgcaucucguggaccgaaauucuggc

SEQ ID NO: 541641 - RNA, 64 nt, Human Herpes Virus 2
gccgaacgcggcaggcgcacgcggcguuaucggggacgcgcaaugccggggcgacagcgccggu

SEQ ID NO: 541642 - RNA, 64 nt, Human Herpes Virus 2; identical to SEQ ID NO: 541635

SEQ ID NO: 541643 - RNA, 64 nt, Human Herpes Virus 2; identical to SEQ ID NO: 541634

SEQ ID NO: 541644 - RNA, 64 nt, Human Herpes Virus 2; identical to SEQ ID NO: 541634

SEQ ID NO: 541645 - RNA, 64 nt, Human Herpes Virus 2; identical to SEQ ID NO: 541635

SEQ ID NO: 541646 - RNA, 64 nt, Human Herpes Virus 2; identical to SEQ ID NO: 541636

SEQ ID NO: 541647 - RNA, 64 nt, Human Herpes Virus 2; identical to SEQ ID NO: 541637

SEQ ID NO: 541648 - RNA, 64 nt, Human Herpes Virus 2; identical to SEQ ID NO: 541638

SEQ ID NO: 541649 - RNA, 64 nt, Human Herpes Virus 2; identical to SEQ ID NO: 541639

SEQ ID NO: 541650 - RNA, 64 nt, Human Herpes Virus 2; identical to SEQ ID NO: 541640

SEQ ID NO: 541651 - RNA, 64 nt, Human Herpes Virus 2; identical to SEQ ID NO: 541641

SEQ ID NO: 541652 - RNA, 64 nt, Human Herpes Virus 2; identical to SEQ ID NO: 541635

SEQ ID NO: 541653 - RNA, 64 nt, Human Herpes Virus 2; identical to SEQ ID NO: 541634

SEQ ID NO: 541654 - RNA, 58 nt, Human Herpes Virus 1
uucaccgggacgaccacgagaccgacauggagcugaaaccggccaacgccgcgacccg

SEQ ID NO: 541655 - RNA, 58 nt, Human Herpes Virus 1
aggacgaguaccuaagcgaggagaugauggagcugaccgcgcgugcccuggagcgcgg

SEQ ID NO: 541656 - RNA, 64 nt, Human Herpes Virus 1
cggcgaugucaaagggcggcaggacggggcgcggguggcgcaggggcaccucgagcgcgggaaa

SEQ ID NO: 541657 - RNA, 64 nt, Human Herpes Virus 1
agacgacgacgaagcgcugcuugguuccguagugguggcgcaggaccacggagauagaacgacg

SEQ ID NO: 541658 - RNA, 64 nt, Human Herpes Virus 1
ccgggacgcgaguacccacguuaaccccgacggcguggcgcaccacgacgacauaaaccgcgcc

SEQ ID NO: 541659 - RNA, 64 nt, Human Herpes Virus 1
ucggaccagcgcccccuauggaauguacacgccgguggcgcacuaucgcccucaggugggggag

SEQ ID NO: 541660 - RNA, 64 nt, Human Herpes Virus 1
gugcuucagcacgcucucccugagggccgacgcaguggcgcaccuggaggcgggcaaggacuac

SEQ ID NO: 541661 - RNA, 64 nt, Human Herpes Virus 1
ggugauggacagucucgacgccaagcagugguccguggcgcaggcgcucccgugccuggagccc

SEQ ID NO: 541662 - RNA, 64 nt, Human Herpes Virus 1
cuuaucggggccaacgaccacaucccucccccguguggcgcaucuccccccgguauacgacgac

SEQ ID NO: 541663 - RNA, 64 nt, Human Herpes Virus 1
gccgaccauccgccggcaacugacgcuggccgacguggcgcacgaauccuucgucuccggaggc

SEQ ID NO: 541664 - RNA, 64 nt, Human Herpes Virus 1
ucccgaggagugcauggccguguaccgggaccugguggcgcacgucgaggcccuggcccagcug

SEQ ID NO: 541665 - RNA, 64 nt, Human Herpes Virus 1
caacggcgaguggucgacggacgcggcccuggagguggcgcacgaggccgaggcccuagucagc

SEQ ID NO: 541666 - RNA, 64 nt, Human Herpes Virus 1
cuguccacguauacgguccccauugagccuaggacccagcgagcccgucgccgccgcggcggcg

SEQ ID NO: 541667 - RNA, 64 nt, Human Herpes Virus 1; identical to SEQ ID NO: 538817

SEQ ID NO: 541668 - RNA, 63 nt, Human Herpes Virus 1
ccccagagguguucacgcaccucgaggacacccgcgcaugaucuccggacccccgcaacgggg

SEQ ID NO: 541669 - RNA, 64 nt, Human Herpes Virus 1
cgccuggagccaggcgggagugugguucuggaacucccgcgacaacacugaccaucuuggggga

SEQ ID NO: 541670 - RNA, 64 nt, Human Herpes Virus 1
gggcuuggccacgcccccgcggcgggaaguuguggacugggaaggcgccugggacgaagacgac

SEQ ID NO: 541671 - RNA, 64 nt, Human Herpes Virus 1; identical to SEQ ID NO: 541670

SEQ ID NO: 541672 - RNA, 62 nt, Human Herpes Virus 1
caggagcuggccuauggcauugugcgcagugcggccacgaccgggagccccuucgucauguu

SEQ ID NO: 541673 - RNA, 62 nt, Human Herpes Virus 1
accgccaucgcgacugccggguuagcgcggggggccacgaccccguguacgcggcggcaugu

SEQ ID NO: 541674 - RNA, 62 nt, Human Herpes Virus 1
cucgcucgcggggucgacgcgaaagccucgcgggccacgaggcucggcguaaugcccgcccc

SEQ ID NO: 541675 - RNA, 64 nt, Human immunodeficiency virus type 1 (BLAI)
uacagcagcuaccaaugcugcuugugccuggcuagaagcacaagaggaggaggagguggguuuu

SEQ ID NO: 541676 - RNA, 64 nt, Human Herpes Virus 2; identical to SEQ ID NO: 536759

SEQ ID NO: 541677 - RNA, 64 nt, Human Herpes Virus 2; identical to SEQ ID NO: 536760

SEQ ID NO: 541678 - RNA, 64 nt, Human Herpes Virus 2; identical to SEQ ID NO: 536761

SEQ ID NO: 541679 - RNA, 64 nt, Human Herpes Virus 2; identical to SEQ ID NO: 536762

SEQ ID NO: 541680 - RNA, 64 nt, Human Herpes Virus 2; identical to SEQ ID NO: 536763

SEQ ID NO: 541681 - RNA, 64 nt, Human Herpes Virus 2; identical to SEQ ID NO: 536764

SEQ ID NO: 541682 - RNA, 64 nt, Human Herpes Virus 2; identical to SEQ ID NO: 536765

SEQ ID NO: 541683 - RNA, 64 nt, Human Herpes Virus 2; identical to SEQ ID NO: 536766

SEQ ID NO: 541684 - RNA, 64 nt, Human Herpes Virus 2; identical to SEQ ID NO: 536767

SEQ ID NO: 541685 - RNA, 64 nt, Human Herpes Virus 2; identical to SEQ ID NO: 536768

SEQ ID NO: 541686 - RNA, 64 nt, Human Herpes Virus 2; identical to SEQ ID NO: 536769

SEQ ID NO: 541687 - RNA, 64 nt, Human Herpes Virus 2; identical to SEQ ID NO: 536761

SEQ ID NO: 541688 - RNA, 64 nt, Human Herpes Virus 2; identical to SEQ ID NO: 536760

SEQ ID NO: 541689 - RNA, 64 nt, Human Herpes Virus 2; identical to SEQ ID NO: 536759

SEQ ID NO: 541690 - RNA, 64 nt, Human Herpes Virus 1
cccggagacccccaaaccuucccacaccacaccacccagcgaggccgagcgccugugucaucug

SEQ ID NO: 541691 - RNA, 64 nt, Human Herpes Virus 1
augccgggccaaguacgcuuucgaccccauggaccccagcgaccccacggccuccgcguacgag

SEQ ID NO: 541692 - RNA, 64 nt, Human Herpes Virus 1
cggcgccgacacgcggcgcuuuaucuuccacgaacccagcgaccucgccgaagagaacgugcau

SEQ ID NO: 541693 - RNA, 64 nt, Human Herpes Virus 1
gguggucccggagaucgcccccggcgaggagugccccagcgaccccgugacggaccccgcgcac

SEQ ID NO: 541694 - RNA, 64 nt, Human Herpes Virus 1
ccuguaccgggaguguaaauuccuaucaacgcugcccagcgaugugguggaauggggggacgcg

SEQ ID NO: 541695 - RNA, 64 nt, Human Herpes Virus 1
gaggcgucggagcggggccgcucacgccaagccgcccagcgagccgcucggcgcgcccggcgcc

SEQ ID NO: 541696 - RNA, 64 nt, Human Herpes Virus 1; identical to SEQ ID NO: 538818

SEQ ID NO: 541697 - RNA, 64 nt, Human Herpes Virus 1; identical to SEQ ID NO: 538819

SEQ ID NO: 541698 - RNA, 64 nt, Human Herpes Virus 1; identical to SEQ ID NO: 538820

SEQ ID NO: 541699 - RNA, 64 nt, Human Herpes Virus 1
gggccguggaggagcucgggacaccacggccuuuucccgcgagucugagcgcccggcugcggga

SEQ ID NO: 541700 - RNA, 64 nt, Human Herpes Virus 1; identical to SEQ ID NO: 538821

SEQ ID NO: 541701 - RNA, 64 nt, Human Herpes Virus 1; identical to SEQ ID NO: 538819

SEQ ID NO: 541702 - RNA, 64 nt, Human Herpes Virus 1; identical to SEQ ID NO: 538816

SEQ ID NO: 541703 - RNA, 63 nt, Human Herpes Virus 1
cagagcgacguagcggcacaaaugccgacagacgcgcaugaugcgcgugcugucggccgcgua

SEQ ID NO: 541704 - RNA, 64 nt, Human Herpes Virus 1
gccaaacaacaccgacucgaguucccuggugcccggggcccaggauuccgccccgcccggcccc

SEQ ID NO: 541705 - RNA, 64 nt, Human Herpes Virus 1
ccuggcgggcgguuaaaagcagggccucggguaaggggcccacguacauucgcguggccgacag

SEQ ID NO: 541706 - RNA, 64 nt, Human Herpes Virus 1
ccgacccccugggcggcuggcggcggcagcccccggggcccagccacacggcggcgcccgcggc

SEQ ID NO: 541707 - RNA, 64 nt, Human Herpes Virus 1; identical to SEQ ID NO: 541706

SEQ ID NO: 541708 - RNA, 64 nt, Human Herpes Virus 4 (Epstein Barr virus)
aggccaccaugcuaucgguuuaaacgcggaauacagcggcgaugagcuggcggaguuggcccug

SEQ ID NO: 541709 - RNA, 64 nt, Human Herpes Virus 4 (Epstein Barr virus)
cgacgaaagcuggaagcgcccaaggagaggcaggagcggcgagcgaacggccguggccagacaa

SEQ ID NO: 541710 - RNA, 64 nt, Human Herpes Virus 4 (Epstein Barr virus)
ggcacgaagccuucuccuggacccuggaccaacuagcggcgagacccgaggcagacaaggcccc

SEQ ID NO: 541711 - RNA, 64 nt, Human Herpes Virus 2; identical to SEQ ID NO: 541255

SEQ ID NO: 541712 - RNA, 63 nt, Human Herpes Virus 1
agucuagacgcgcgcuacgucucgcgagacggcgcgcaugacgcggccgucugguucgaggau

SEQ ID NO: 541713 - RNA, 64 nt, Human Herpes Virus 2
ggaggauguguucuccuggacgcgguauuguacccccgacgacgugcgcgugguuaucaucggg

SEQ ID NO: 541714 - RNA, 64 nt, Human Herpes Virus 2
guacauccagcgccacggccuguacguucccgcgcccgacgaaccgacguuggccgaugccaug

SEQ ID NO: 541715 - RNA, 64 nt, Human Herpes Virus 2
cgacguuccccgagacaccagcacccgcgugaaccccgacgacguggcccaccgcgacgacguc

SEQ ID NO: 541716 - RNA, 64 nt, Human Herpes Virus 2
cgcggaaccgaccgcccccgcaaccacuacuccccccgacgagauggccacacaagccgcaacg

SEQ ID NO: 541717 - RNA, 64 nt, Human Herpes Virus 2
ggucguggagcccgccccugugccgaccccgacccccgacgacuacgacgaagaagacgacgcg

SEQ ID NO: 541718 - RNA, 64 nt, Human Herpes Virus 2
gcgcgagaacgcggcgcugaccggggcgcgaacccccgacgacggcggcgacgccaaccgccac

SEQ ID NO: 541719 - RNA, 64 nt, Human Herpes Virus 2
ccugggcccgcgggacgggggcccggacgacuuccccgacgacgaccuugacguuaucuucgcc

SEQ ID NO: 541720 - RNA, 64 nt, Human Herpes Virus 2
ggacgcccugaucaucggcggccaggcgacgucgcccgacgaucagaucgaggcgcugauacgc

SEQ ID NO: 541721 - RNA, 64 nt, Human Herpes Virus 2
agccggccuacgagcgccuuggaccugcauguuucccgacgacuggcgccaagggcgccgagcg

SEQ ID NO: 541722 - RNA, 64 nt, Human Herpes Virus 2
cccgcccccggaccaacgcgcuggccaacgacggcccgacgaacgucgccgcccucagcgcccu

SEQ ID NO: 541723 - RNA, 64 nt, Human Herpes Virus 2
cgaaccggaccagauggaaaacacguaucugcugcccgacgaugacgccgccaugcccgcgggc

SEQ ID NO: 541724 - RNA, 64 nt, Human Herpes Virus 2
ccuccagacggucgugcccagcggccuggacauccccgacgacccggcgggcgacugcgacccc

SEQ ID NO: 541725 - RNA, 64 nt, Human Herpes Virus 2; identical to SEQ ID NO: 541718

SEQ ID NO: 541726 - RNA, 64 nt, Human Herpes Virus 1; identical to SEQ ID NO: 538815

SEQ ID NO: 541727 - RNA, 64 nt, Human Herpes Virus 1
agcuguuucggguccugcgggucgcccgggacccccacggcagugccaaccgccugcgccaccu

SEQ ID NO: 541728 - RNA, 63 nt, Human Herpes Virus 1
gcggccccgcgccccuccuuacgugcaacgcaccggucguagccgccgaucaguccgucccca

SEQ ID NO: 541729 - RNA, 62 nt, Human Herpes Virus 2
guccugccccacugguacauggcccacuaccugcuggccaacaauccgccccccguccucuc

SEQ ID NO: 541730 - RNA, 62 nt, Human Herpes Virus 2
agugaguuugucgagucgaucgacuccacggagcuggccauggccaucaacgccgacuacgg

SEQ ID NO: 541731 - RNA, 62 nt, Human Herpes Virus 2
cggcuguacgcggaccgccugaccaagcggucgcuggccagccucgggcgcugcgugcgcga

SEQ ID NO: 541732 - RNA, 62 nt, Human Herpes Virus 2
ucgcccaugcccgcccgcccccggaccaacgcgcuggccaacgacggcccgacgaacgucgc

SEQ ID NO: 541733 - RNA, 64 nt, Human Herpes Virus 1
aacgcgacgccguucggcggcccgggggccccgggaccggcauuugccggccgcaaacgggcgu

SEQ ID NO: 541734 - RNA, 64 nt, Human Herpes Virus 4 (Epstein Barr virus)
auggggggggaggccgccgcaaggacgccgggccggcugggaggugugcaccccccgagcgucu

SEQ ID NO: 541735 - RNA, 64 nt, Human Herpes Virus 4 (Epstein Barr virus)
gagucagucccgggcucugcucuggcgcggccucggcugggacacgggacguggucggcuggca

SEQ ID NO: 541736 - RNA, 60 nt, Human Herpes Virus 2
uucgcagucgcgaggaggugcgcgugucgaccgcccuaagccgcgucagcccgcggucgg

SEQ ID NO: 541737 - RNA, 64 nt, Human Herpes Virus 1
agggguuuuuucaucgcccacacaacgcccccgggggcgcgauuacgccagagcggaccaaugu

SEQ ID NO: 541738 - RNA, 64 nt, Human Herpes Virus 1
gggcgcgccgcugcggcccguguacguggcgcuggggcgcgaggcggugcgcgccggcccggcc

SEQ ID NO: 541739 - RNA, 64 nt, Human Herpes Virus 1
aggagcugcgcgucaagagccgcguguuguucgcgggcgcgagcgccaacgcguccgaggccgc

SEQ ID NO: 541740 - RNA, 64 nt, Human Herpes Virus 1
cuucgaagccagccaggguaagaccccgcggggcgggcgcgacggcggcggcaagggcgcggcg

SEQ ID NO: 541741 - RNA, 64 nt, Human Herpes Virus 1
gucgcuucggccgcguucgcugagccccucgggggggcgcgaggggauuucgcgcggcaugcga

SEQ ID NO: 541742 - RNA, 64 nt, Human Herpes Virus 1
gaugcccuuggaauugacgaguacgguggguagggggcgcgaccggacccgcaucccccgucug

SEQ ID NO: 541743 - RNA, 64 nt, Human Herpes Virus 4 (Epstein Barr virus)
agggccuacagcccacuauguuuaacggggagcugggggccaucaagcaccaggcacuugacac

SEQ ID NO: 541744 - RNA, 64 nt, Human Herpes Virus 4 (Epstein Barr virus)
gcucccaacacggguucccagagaggguaaaagagggggccauaaagcccaggguguaaaacac

SEQ ID NO: 541745 - RNA, 64 nt, Human Herpes Virus 4 (Epstein Barr virus)
ccuaagaaggcaccggucgcccaguccuaccagagggggccaagaacccagacgaguccguaga

SEQ ID NO: 541746 - RNA, 64 nt, Human Herpes Virus 4 (Epstein Barr virus); identical to SEQ ID NO: 541745

SEQ ID NO: 541747 - RNA, 64 nt, Human Herpes Virus 4 (Epstein Barr virus); identical to SEQ ID NO: 541745

SEQ ID NO: 541748 - RNA, 64 nt, Human Herpes Virus 4 (Epstein Barr virus)
cugucaaggugaguaugccucuaacuggguucaugggggccaucuaaggcccacgugugaccca

SEQ ID NO: 541749 - RNA, 64 nt, Human Herpes Virus 4 (Epstein Barr virus)
cguucaccgucagucuauucuuuacggacggggugggggccaaccuagccaucaaugucaauau

SEQ ID NO: 541750 - RNA, 64 nt, Human Herpes Virus 4 (Epstein Barr virus)
cuauuagguacguggcaggggacggaccugcucggggggccaggccaccaugcuaucgguuuaa

SEQ ID NO: 541751 - RNA, 64 nt, Human Herpes Virus 4 (Epstein Barr virus)
gggagcuacagauuuauuaccugucucucuuugagggggccaaaagggcucugaccgacgggca

SEQ ID NO: 541752 - RNA, 64 nt, Human Herpes Virus 4 (Epstein Barr virus)
uuaacccacucuuuuugcccagcuuuaugccggugggggccaaggugcuucgggguaaggggcg

SEQ ID NO: 541753 - RNA, 64 nt, Human Herpes Virus 4 (Epstein Barr virus)
cccuguccaucaacggggacaaguuucaguacacgggggccaugacuucuaaauuucugauggg

SEQ ID NO: 541754 - RNA, 64 nt, Human Herpes Virus 4 (Epstein Barr virus)
ccaugcccucggccucugaccgggacggcuaccagggggccaccgucauccagccccuguccgg

SEQ ID NO: 541755 - RNA, 64 nt, Human Herpes Virus 4 (Epstein Barr virus)
acuacaagcuggacacaguagccaggcaccuacugggggccaagaaggaggaugugcauuacaa

SEQ ID NO: 541756 - RNA, 61 nt, Human Herpes Virus 4 (Epstein Barr virus)
auuucucgugcguguacaccgucucgaguaugucguagacauggaaguccagagggcuucc

SEQ ID NO: 541757 - RNA, 61 nt, Human Herpes Virus 4 (Epstein Barr virus)
agucaagacagcacuacaucccagcuagcccgucguagagacagacaagaugguuccuucu

SEQ ID NO: 541758 - RNA, 64 nt, Human Herpes Virus 1
caaauuuuuuaugcgcaugcgcgacacgcgacaccgcgcacauuccgcccucaagcgcguacgc

SEQ ID NO: 541759 - RNA, 64 nt, Human Herpes Virus 1
auggcggcgguccagcucugggacaugucgcguccgcgcacagacgaagaccucaacgaacucc

SEQ ID NO: 541760 - RNA, 64 nt, Human Herpes Virus 1
gucgucccucgcaugaagcccccaacaugacccagaccggcaccaccgacucucccaccgccau

SEQ ID NO: 541761 - RNA, 64 nt, Human Herpes Virus 1
aggccgcagccuucucccggugccuuucccccccgaccggcacccggccucucacacagcaucc

SEQ ID NO: 541762 - RNA, 64 nt, Human Herpes Virus 1
cacagacccgccuucccgggggggcccuuggagcgaccggcagcggaggcguccgggggagggg

SEQ ID NO: 541763 - RNA, 64 nt, Human Herpes Virus 1
ugggccaccugacgcgccuagccaaccuguggcagaccggcaagcggagcggcgguacguacgg

SEQ ID NO: 541764 - RNA, 62 nt, Human Herpes Virus 2
cgacgcgcccgccccccgcggcuguccuccgagcuggccacggcccugacggaggccugugc

SEQ ID NO: 541765 - RNA, 62 nt, Human Herpes Virus 2
gaucucgccgagggcggguucauccuggacgcgcuggccauggccacccgauccgacauccc

SEQ ID NO: 541766 - RNA, 62 nt, Human Herpes Virus 2
gccgucccccuccgguuggacacgcagagccugcuggccacguacgcaauuacgucuacgcu

SEQ ID NO: 541767 - RNA, 62 nt, Human Herpes Virus 2
gagagccugcugagcauccugcugcgcgacuggcuggccaugcgaaagcagauccgcucgcg

SEQ ID NO: 541768 - RNA, 62 nt, Human Herpes Virus 2
uggggccugcuguggguggguguggucguggugcuggccaaugccucccccggacgcacgau

SEQ ID NO: 541769 - RNA, 62 nt, Human Herpes Virus 2
acggauacgauccguaaggaccugcggcugucgcuggccaaguucagcaucgcguguaccaa

SEQ ID NO: 541770 - RNA, 62 nt, Human Herpes Virus 2
gcguuucucaggcagcacacgcugccccggcagcuggccacggucgccggggccgcggagcg

SEQ ID NO: 541771 - RNA, 62 nt, Human Herpes Virus 2
aagaucaucuggggcgaacuguucggggugcagcuggccaagagcacgcagacguuucccgg

SEQ ID NO: 541772 - RNA, 62 nt, Human Herpes Virus 2
cuggccaugcugugcggguucucuccggcccugcuggccaagaugcuguuuuaccuggagcg

SEQ ID NO: 541773 - RNA, 62 nt, Human Herpes Virus 2
ugcugccccgcgugcagcgcgggcgacgggcggcuggccaccgucagccgcgaggcccucau

SEQ ID NO: 541774 - RNA, 62 nt, Human Herpes Virus 2
acguaccagguauuugugccgaagcccaccgcgcuggccacauuuguccgcgaggccggcgc

SEQ ID NO: 541775 - RNA, 62 nt, Human Herpes Virus 2
ggcggcguggaggugguggggaccgccgcggggcuggccacgccgccgaggcgcgagcccgu

SEQ ID NO: 541776 - RNA, 62 nt, Human Herpes Virus 2
cugugcaaucuguugcuggugcgggccuacuggcuggccaugcgacgccugagggcguccgu

SEQ ID NO: 541777 - RNA, 62 nt, Human Herpes Virus 2
gaccccgacgugccguuucugagugcgucggcgcuggccaucuuccguccggccgucaccgg

SEQ ID NO: 541778 - RNA, 62 nt, Human Herpes Virus 2
uuucccgccgcgaacagccccugggcucccgugcuggccacccaagcggggggguuugacgc

SEQ ID NO: 541779 - RNA, 62 nt, Human Herpes Virus 2; identical to SEQ ID NO: 541775

SEQ ID NO: 541780 - RNA, 64 nt, Human Herpes Virus 1
gggcuuccgacgccccccguggaccccacgacacccaccccaacgccuccccuguugguauagg

SEQ ID NO: 541781 - RNA, 64 nt, Human Herpes Virus 1
uccgcugacaaccaccuuccguccccugccccccccaccccagacgacaucagcuguggacccg

SEQ ID NO: 541782 - RNA, 64 nt, Human Herpes Virus 1
uugggaccaauacgcccgcguuucuuccuuuuccccaccccaacccccaaguucgggugaaggc

SEQ ID NO: 541783 - RNA, 64 nt, Human Herpes Virus 1
caacuuaccuccgggaugguccagacccacgucaccaccccaggcuccauaccgacgaucugcg

SEQ ID NO: 541784 - RNA, 64 nt, Human Herpes Virus 1
ggccagacgcuggacgcccccccgagaaccagcgccaccccaugcguccugacggacgccgcca

SEQ ID NO: 541785 - RNA, 64 nt, Human Herpes Virus 1
gaaaacggaacggcgccucggaugaccuuauggucgccgucauuauggccaucuaccucgcggc

SEQ ID NO: 541786 - RNA, 64 nt, Human Herpes Virus 1
cgcagccccgcuggaacuacuaugacagcuucagcgccgucagcgaggauaaccugggguuccu

SEQ ID NO: 541787 - RNA, 64 nt, Human Herpes Virus 2; identical to SEQ ID NO: 537105

SEQ ID NO: 541788 - RNA, 64 nt, Human Herpes Virus 2; identical to SEQ ID NO: 537106

SEQ ID NO: 541789 - RNA, 64 nt, Human Herpes Virus 2; identical to SEQ ID NO: 537107

SEQ ID NO: 541790 - RNA, 64 nt, Human Herpes Virus 2; identical to SEQ ID NO: 537108

SEQ ID NO: 541791 - RNA, 64 nt, Human Herpes Virus 2; identical to SEQ ID NO: 537109

SEQ ID NO: 541792 - RNA, 64 nt, Human Herpes Virus 2; identical to SEQ ID NO: 537110

SEQ ID NO: 541793 - RNA, 60 nt, Human immunodeficiency virus type 1 (SE8131)
uucagagguaaaaauagcagugguaauaguagcagugaucgauauagauuaauaaauugu

SEQ ID NO: 541794 - RNA, 64 nt, Human Herpes Virus 1
guggaccugggcgugggcuacaccgccgucguggccacggcaaccguccgcaaccccgucaccg

SEQ ID NO: 541795 - RNA, 63 nt, Human Herpes Virus 1
cguggggccaauaccgcgugguuauauacacgacggucguaaccgugggccucagcuucgauc

SEQ ID NO: 541796 - RNA, 62 nt, Human Herpes Virus 2
gaguuuguuucguccgaacccaugcgccuccaucgagauaacgucaugcugucuacggaacc

SEQ ID NO: 541797 - RNA, 64 nt, Human Herpes Virus 1
gccagcgcgccaccguguuucucgucccccggcgccacggcaagaccugguuucuggugccccu

SEQ ID NO: 541798 - RNA, 64 nt, Human Herpes Virus 1
ccggauauccggccgggauucccguucuagaacaccacggcagucaccagcccccacccaggga

SEQ ID NO: 541799 - RNA, 64 nt, Human Herpes Virus 4 (Epstein Barr virus)
cgcgccuaguggccuugcagccccuguccaggcuccccucgaggaaggagacggccgcggcggu

SEQ ID NO: 541800 - RNA, 64 nt, Human Herpes Virus 4 (Epstein Barr virus)
aggacccccgcaucuuuaugagauggacuuugugccccucgagauuuuaugaggccaacggcag

SEQ ID NO: 541801 - RNA, 64 nt, Human Herpes Virus 4 (Epstein Barr virus)
uccagcaguggcgaguugagugucuccccagaacccccucgagagacccaggccuuuuugggga

SEQ ID NO: 541802 - RNA, 64 nt, Human Herpes Virus 4 (Epstein Barr virus)
gaccuugagaggggcccaccgggcccgcgacggcccccucgaggacccccccucuccucuuccc

SEQ ID NO: 541803 - RNA, 62 nt, Human Herpes Virus 4 (Epstein Barr virus)
cgguguaacuacccgcaaugaaauggaaaauauauugcaaaaucugacccuccgcauucaag

SEQ ID NO: 541804 - RNA, 64 nt, Human Herpes Virus 4 (Epstein Barr virus)
cagcccuccucagaaaacucugcauggagaagcuggacgugaaccucccccccagaccugugug

SEQ ID NO: 541805 - RNA, 64 nt, Human Herpes Virus 4 (Epstein Barr virus)
gcauccucaccacccccgaccucagcuccgagugggacgugacccaggcccucuauaggcaccu

SEQ ID NO: 541806 - RNA, 64 nt, Human Herpes Virus 4 (Epstein Barr virus)
caacgccacccgacgugcccgcucccgcucccggggacgugaagcaaagaaagugcaaauuucu

SEQ ID NO: 541807 - RNA, 64 nt, Human Herpes Virus 4 (Epstein Barr virus)
gggucgaggagguaguggaggccgccgggguagaggacgugaaagagccagggggggaagucgu

SEQ ID NO: 541808 - RNA, 64 nt, Human Herpes Virus 4 (Epstein Barr virus)
uggggucucaggccucccagucuauccaggaggaggacgugagugacacugaugagucugacua

SEQ ID NO: 541809 - RNA, 64 nt, Human Herpes Virus 4 (Epstein Barr virus)
ccagccccggccacagaccgaccuccuccccccgggacgugacaggagaugauggcgcugcugg

SEQ ID NO: 541810 - RNA, 64 nt, Human Herpes Virus 4 (Epstein Barr virus)
ucuggaacuggcacuggaggccugccaggacacgcccgagcaauuuaagcugguggagacgcca

SEQ ID NO: 541811 - RNA, 64 nt, Human Herpes Virus 4 (Epstein Barr virus)
ccccgguucuggugguggacuuugccagccucuacccgagcaucauucaggcucauaaucucug

SEQ ID NO: 541812 - RNA, 64 nt, Human Herpes Virus 4 (Epstein Barr virus); identical to SEQ ID NO: 541810

SEQ ID NO: 541813 - RNA, 64 nt, Human Herpes Virus 4 (Epstein Barr virus); identical to SEQ ID NO: 541811

SEQ ID NO: 541814 - RNA, 64 nt, Human Herpes Virus 4 (Epstein Barr virus); identical to SEQ ID NO: 541810

SEQ ID NO: 541815 - RNA, 64 nt, Human Herpes Virus 4 (Epstein Barr virus); identical to SEQ ID NO: 541811

SEQ ID NO: 541816 - RNA, 64 nt, Human Herpes Virus 4 (Epstein Barr virus); identical to SEQ ID NO: 541810

SEQ ID NO: 541817 - RNA, 64 nt, Human Herpes Virus 4 (Epstein Barr virus); identical to SEQ ID NO: 541811

SEQ ID NO: 541818 - RNA, 64 nt, Human Herpes Virus 4 (Epstein Barr virus); identical to SEQ ID NO: 541810

SEQ ID NO: 541819 - RNA, 64 nt, Human Herpes Virus 4 (Epstein Barr virus); identical to SEQ ID NO: 541811

SEQ ID NO: 541820 - RNA, 64 nt, Human Herpes Virus 2; identical to SEQ ID NO: 538849

SEQ ID NO: 541821 - RNA, 64 nt, Human Herpes Virus 2; identical to SEQ ID NO: 538850

SEQ ID NO: 541822 - RNA, 64 nt, Human Herpes Virus 2; identical to SEQ ID NO: 538851

SEQ ID NO: 541823 - RNA, 64 nt, Human Herpes Virus 2; identical to SEQ ID NO: 538852

SEQ ID NO: 541824 - RNA, 64 nt, Human Herpes Virus 2; identical to SEQ ID NO: 538853

SEQ ID NO: 541825 - RNA, 64 nt, Human Herpes Virus 2; identical to SEQ ID NO: 538854

SEQ ID NO: 541826 - RNA, 64 nt, Human Herpes Virus 2; identical to SEQ ID NO: 538855

SEQ ID NO: 541827 - RNA, 64 nt, Human Herpes Virus 2; identical to SEQ ID NO: 538856

SEQ ID NO: 541828 - RNA, 64 nt, Human Herpes Virus 2; identical to SEQ ID NO: 538857

SEQ ID NO: 541829 - RNA, 64 nt, Human Herpes Virus 2; identical to SEQ ID NO: 538858

SEQ ID NO: 541830 - RNA, 64 nt, Human Herpes Virus 2; identical to SEQ ID NO: 538852

SEQ ID NO: 541831 - RNA, 64 nt, Human Herpes Virus 1
ggaccuucaccugccagaugacguggcaucgcgacuccgugacguucucgcgacgcaaugccac

SEQ ID NO: 541832 - RNA, 64 nt, Human Herpes Virus 1
ccuagcguguucguggaaccaugaccucucgccgcuccgugaagucggguccgcgggagguucc

SEQ ID NO: 541833 - RNA, 64 nt, Human Herpes Virus 1
ccuuugguugcagaccccuuucuccccccucuuccgaggccagcaggggggcaggacuuuguga

SEQ ID NO: 541834 - RNA, 64 nt, Human Herpes Virus 1
augcgcggcgcguuucuucugucucuagggaauccgaggccaggacuuuaaccugcucuuuguc

SEQ ID NO: 541835 - RNA, 64 nt, Human Herpes Virus 1
uccgaggccaggacuuuaaccugcucuuugucgacgaggccaacuuuauucgcccggaugcggu

SEQ ID NO: 541836 - RNA, 64 nt, Human Herpes Virus 1
uguuaagcgggucgcugcagggucgcucgguauucgaggccacacgcgucaccuuaauaugcga

SEQ ID NO: 541837 - RNA, 64 nt, Human Herpes Virus 1
gccgggcccugaacgccgccuucagccuggccaccgaggccaucgcccugcucacgggggaggc

SEQ ID NO: 541838 - RNA, 64 nt, Human Herpes Virus 1
cguccggggagggcgaggagggcggcgacuuugacgaggccaagcuagccgaggcccgggagau

SEQ ID NO: 541839 - RNA, 64 nt, Human Herpes Virus 1
aggggaggaacuucaaguuucgcgacggucugggcgaggccaaccacgccaugucccugacgcu

SEQ ID NO: 541840 - RNA, 64 nt, Human Herpes Virus 1
gccgguuugugagccugcuucgggccgcggggcccgaggccaucuuuaagcacauguucuguga

SEQ ID NO: 541841 - RNA, 64 nt, Human Herpes Virus 1
cgggcguccgccccacccggcgguuuguuggcagcgaggccaccgcgccgccggggcgaggcgu

SEQ ID NO: 541842 - RNA, 64 nt, Human Herpes Virus 1
gccauucaccgcaucgacugccccuggugcugcgcgaggccacccgacacguacgccgacaugu

SEQ ID NO: 541843 - RNA, 64 nt, Human Herpes Virus 1
gggacacgcccgaccgccuggggcccuggccccccgaggccaugggggacgcggugagucagua

SEQ ID NO: 541844 - RNA, 64 nt, Human Herpes Virus 1
gggagaucgacccggccauaaugauuccgccgcucgaggccaacaagaugguucgcagccgcga

SEQ ID NO: 541845 - RNA, 64 nt, Human Herpes Virus 1
ucaaauaucagcgccgauaccccaguuacgaccgcgaggccauuacgcuacacugccucugucg

SEQ ID NO: 541846 - RNA, 64 nt, Human Herpes Virus 1; identical to SEQ ID NO: 541833

SEQ ID NO: 541847 - RNA, 64 nt, Human Herpes Virus 1
gggcccgcgcggggagccgcccggcgaggagggcgggcgcgaugggaucgggggcgcgcggugc

SEQ ID NO: 541848 - RNA, 64 nt, Human Herpes Virus 1; identical to SEQ ID NO: 541738

SEQ ID NO: 541849 - RNA, 64 nt, Human Herpes Virus 2
gcuaggaucgcccccaccgcauccgccggcacguaggcggcaaacgccgaacgccacggggugc

SEQ ID NO: 541850 - RNA, 64 nt, Human Herpes Virus 2
gcacccuggggguugucgucggcgggcugacgauaggcggcagugcgcgcuacugguggaucga

SEQ ID NO: 541851 - RNA, 64 nt, Human Herpes Virus 2
auucucgcgggccgcgugucgggcccggagcugcaggcggcauucccccuggaccgccugaccc

SEQ ID NO: 541852 - RNA, 64 nt, Human Herpes Virus 1
gggcgacgugugcgccgugugcacggaugagaucgcgccccaccugcgcugcgacaccuucccg

SEQ ID NO: 541853 - RNA, 64 nt, Human Herpes Virus 1
aacccgcgcacggaugugguuaucacgggccgccgcgccccacgacccaucgccgggucggggg

SEQ ID NO: 541854 - RNA, 64 nt, Human Herpes Virus 1
cucccauuacaaccagcucgucgccggccaugccgcgccccaaccccagccgcauuccgcguuu

SEQ ID NO: 541855 - RNA, 64 nt, Human Herpes Virus 1
aacaaggaggaggucgacaggcaccuacaaugccgcgccccacgagaucucugcgagcgcaugg

SEQ ID NO: 541856 - RNA, 64 nt, Human Herpes Virus 1
acaggcuguaccgcuggcagccggaccugcgggggcgccccaccgcacgcaccuguacguacgc

SEQ ID NO: 541857 - RNA, 64 nt, Human Herpes Virus 1
uguucagcaaggugacccgggacggcgagacgcugcgccccaacacgcuccugcuaaaggaacu

SEQ ID NO: 541858 - RNA, 64 nt, Human Herpes Virus 1
gacggagcggcagggccccaacgauccucaaccagcgccccacaguguguggucgcgccucggg

SEQ ID NO: 541859 - RNA, 64 nt, Human Herpes Virus 1
ucccaggccuccgauucguccgucuucugguaaggcgccccaucccgaggccccacgucggucg

SEQ ID NO: 541860 - RNA, 64 nt, Human Herpes Virus 1
gcaugggagaacuaacggcggagauucugucucugcgccccaaaucuucgggggugccgacgca

SEQ ID NO: 541861 - RNA, 64 nt, Human Herpes Virus 1
ccuacguacacuccaacccccacggggccuccgggcgccccagcggccccucucuccaggacgc

SEQ ID NO: 541862 - RNA, 64 nt, Human Herpes Virus 1
gcgcccucuucugcgagauuuuucuguaucugacgcgccccaaggcgcugcgguugcccccgaa

SEQ ID NO: 541863 - RNA, 64 nt, Human Herpes Virus 1
ggagccccccggcgggggccgcuuuguggccccagcgccccacgggcccgggggcgaggacauc

SEQ ID NO: 541864 - RNA, 64 nt, Human Herpes Virus 1
acacagcagcaaaucgccgccgggccgacggagggcgccccaagcguguuuucgagcgacgugc

SEQ ID NO: 541865 - RNA, 64 nt, Human Herpes Virus 1
ccagcugcaaccugcugcggcccgucauggcggcgcgccccauggucguguugggguugagcau

SEQ ID NO: 541866 - RNA, 64 nt, Human Herpes Virus 1
cgauuacgcguuucucugugccaaaugccugggggcgccccacugcgccgcuagcaucuucgug

SEQ ID NO: 541867 - RNA, 64 nt, Human Herpes Virus 1
acucacgcgcucgcgggccgucagccgccuguccgcgccccaacucguccgacaucgagacgug

SEQ ID NO: 541868 - RNA, 64 nt, Human Herpes Virus 1
cgacccggggccucauguucaacccccagagccagcgccccacgcgcggcaaguuguccgaaac

SEQ ID NO: 541869 - RNA, 64 nt, Human Herpes Virus 1
cggccacggcgacucgagggcguucugcggcgucgcgccccaccgagcgaccucgagccccagc

SEQ ID NO: 541870 - RNA, 64 nt, Human Herpes Virus 1; identical to SEQ ID NO: 541852

SEQ ID NO: 541871 - RNA, 64 nt, Human Herpes Virus 4 (Epstein Barr virus)
cccagggucuccaggcaggguccggcaucuucaggggcagcaggcucaccaccacaggcccccc

SEQ ID NO: 541872 - RNA, 64 nt, Human Herpes Virus 4 (Epstein Barr virus); identical to SEQ ID NO: 541871

SEQ ID NO: 541873 - RNA, 64 nt, Human Herpes Virus 4 (Epstein Barr virus); identical to SEQ ID NO: 541871

SEQ ID NO: 541874 - RNA, 64 nt, Human Herpes Virus 4 (Epstein Barr virus); identical to SEQ ID NO: 541871

SEQ ID NO: 541875 - RNA, 64 nt, Human Herpes Virus 4 (Epstein Barr virus); identical to SEQ ID NO: 541871

SEQ ID NO: 541876 - RNA, 64 nt, Human Herpes Virus 4 (Epstein Barr virus); identical to SEQ ID NO: 541871

SEQ ID NO: 541877 - RNA, 64 nt, Human Herpes Virus 4 (Epstein Barr virus); identical to SEQ ID NO: 541871

SEQ ID NO: 541878 - RNA, 64 nt, Human Herpes Virus 4 (Epstein Barr virus); identical to SEQ ID NO: 541871

SEQ ID NO: 541879 - RNA, 56 nt, Human Herpes Virus 4 (Epstein Barr virus)
ugcaucagcaucgcuuaaguaugagugggcagcagagaggcucgguuauuuugguu

SEQ ID NO: 541880 - RNA, 64 nt, Human Herpes Virus 4 (Epstein Barr virus)
ucgcaaacucggcaguuguucaucaccucccuucgggcagcagcggcaguuacaacgggguggc

SEQ ID NO: 541881 - RNA, 64 nt, Human Herpes Virus 4 (Epstein Barr virus)
cccgcccacccgagggucaugggcucaugcuguggggcagcaccucccguccggucacgucuca

SEQ ID NO: 541882 - RNA, 64 nt, Human Herpes Virus 4 (Epstein Barr virus)
uccccuggccccagcugcauuccaagaggcccgggggcagcaguuugagaccgccacaucucug

SEQ ID NO: 541883 - RNA, 64 nt, Human Herpes Virus 4 (Epstein Barr virus)
cgcucacauccccugcaggcgggugcuggacgaugggcagcagauccgcguguucuccugccuc

SEQ ID NO: 541884 - RNA, 64 nt, Human Herpes Virus 4 (Epstein Barr virus)
ggccgauggggccagcgugugugugaacguguuugggcagcaggccuacuucuacgccagcgcg

SEQ ID NO: 541885 - RNA, 64 nt, Human Herpes Virus 2
aaugguaaacgcaaagccucccggaaagaccacuagcccgcagaggcggcgauugaacccaagg

SEQ ID NO: 541886 - RNA, 64 nt, Human Herpes Virus 1; identical to SEQ ID NO: 540580

SEQ ID NO: 541887 - RNA, 62 nt, Human Herpes Virus 1
acacgacccugaccgucaagcgcggggcggcggcgucccacucuagaaucgguugggaccgu

SEQ ID NO: 541888 - RNA, 64 nt, Human Herpes Virus 1
gcggcaagccccccucgaccauggccaagcuggugacuggcaugggcuuuacgauccacggagc

SEQ ID NO: 541889 - RNA, 64 nt, Human Herpes Virus 1
cgacccuggucgccgagcuaaagcgaagcuucugcgagacgagcuuuuuccugggcaaggcggg

SEQ ID NO: 541890 - RNA, 62 nt, Human Herpes Virus 1
ccgcagaaggucuccgguaauaucaccgcagucgugcggaugcuccagagccuguccacgua

SEQ ID NO: 541891 - RNA, 62 nt, Human Herpes Virus 2
cgucaccaucacgacgaggaccgcgcguuuugcgcgcgaauacaccacccuggcguuuccgc

SEQ ID NO: 541892 - RNA, 64 nt, Human Herpes Virus 2; identical to SEQ ID NO: 540624

SEQ ID NO: 541893 - RNA, 60 nt, Human Herpes Virus 2
aagacgcgcgaaacgaguuccacgcccucaccgcccuagagcagacuuuggggcugggcc

SEQ ID NO: 541894 - RNA, 64 nt, Human Herpes Virus 2
ggggggccgacggcuguucuucgugaaggcccacguacgcgagagccugcugagcauccugcug

SEQ ID NO: 541895 - RNA, 64 nt, Human Herpes Virus 2
uccgcuguauguggagcgccgcaucgccgccgacguacgcgagaccggcgcgcuggagaaguuc

SEQ ID NO: 541896 - RNA, 64 nt, Human Herpes Virus 4 (Epstein Barr virus)
caugcaccgcuaugcugugguccagccccuacauauagaggagcuaaccuucggggcgguugcc

SEQ ID NO: 541897 - RNA, 64 nt, Human Herpes Virus 4 (Epstein Barr virus)
ccguugcaccgauagcauggccgccagaguuccaauagaggagcuccgagagcuccgccaccuc

SEQ ID NO: 541898 - RNA, 64 nt, Human Herpes Virus 4 (Epstein Barr virus)
ccuggaacacaauacuaacaaacuguaugagacgauagaggacaagucccugaaccucugcagc

SEQ ID NO: 541899 - RNA, 64 nt, Human Herpes Virus 2; identical to SEQ ID NO: 541022

SEQ ID NO: 541900 - RNA, 64 nt, Human Herpes Virus 2; identical to SEQ ID NO: 541023

SEQ ID NO: 541901 - RNA, 64 nt, Human Herpes Virus 2; identical to SEQ ID NO: 541024

SEQ ID NO: 541902 - RNA, 64 nt, Human Herpes Virus 2; identical to SEQ ID NO: 541025

SEQ ID NO: 541903 - RNA, 64 nt, Human Herpes Virus 2; identical to SEQ ID NO: 541026

SEQ ID NO: 541904 - RNA, 64 nt, Human Herpes Virus 2; identical to SEQ ID NO: 541027

SEQ ID NO: 541905 - RNA, 64 nt, Human Herpes Virus 2; identical to SEQ ID NO: 541028

SEQ ID NO: 541906 - RNA, 64 nt, Human Herpes Virus 2; identical to SEQ ID NO: 541029

SEQ ID NO: 541907 - RNA, 64 nt, Human Herpes Virus 2; identical to SEQ ID NO: 541030

SEQ ID NO: 541908 - RNA, 64 nt, Human Herpes Virus 2; identical to SEQ ID NO: 541031

SEQ ID NO: 541909 - RNA, 64 nt, Human Herpes Virus 2; identical to SEQ ID NO: 541032

SEQ ID NO: 541910 - RNA, 64 nt, Human Herpes Virus 2; identical to SEQ ID NO: 541033

SEQ ID NO: 541911 - RNA, 64 nt, Human Herpes Virus 1
gggucgacucccggcgcgcggcccgccauucucccgggaccaacgagaccaucacggcgcugau

SEQ ID NO: 541912 - RNA, 64 nt, Human Herpes Virus 1
guuucuguaccugguauucacuuaccgccagcgccgggaccaggagcuguguuguguguacgug

SEQ ID NO: 541913 - RNA, 64 nt, Human Herpes Virus 1
gggcucggcuccccgccgcggccuggguuggcgucgggaccaucaucgggggaguugugaucau

SEQ ID NO: 541914 - RNA, 64 nt, Human Herpes Virus 1
acgcucuuccuuggauccccccggacaacuuucacgggaccaaagcgcuucgaaacuaccccag

SEQ ID NO: 541915 - RNA, 64 nt, Human Herpes Virus 1
acuggaagaggccccccugccuuacguggucuugcgggaccaacacggcuucauguccgucguc

SEQ ID NO: 541916 - RNA, 64 nt, Human Herpes Virus 1
ucgccagcgccgcccgcggagccaucggcgucuucgggaccaugaacagcauguacagcgacug

SEQ ID NO: 541917 - RNA, 64 nt, Human Herpes Virus 1
cuacgccgccuucucggcccugaagcgcgcggacggauccgagaccgcccggaccaucaugcag

SEQ ID NO: 541918 - RNA, 64 nt, Human Herpes Virus 4 (Epstein Barr virus)
cucaacaagcuaccgaugauucuggccaugaaucugacucuaacuccaacgagggcagacacca

SEQ ID NO: 541919 - RNA, 64 nt, Human Herpes Virus 1
cccccgucacccgaacuuuaagcagaucuuggugcagggcuacgugcucgacagccacuucccc

SEQ ID NO: 541920 - RNA, 59 nt, Human Herpes Virus 2
cgacgaugcauguucggcgucgugagucccgcgcacagcaugguggccccggcgaccua

SEQ ID NO: 541921 - RNA, 59 nt, Human Herpes Virus 2
cuguguaccuucgagacccgccacgccugcgcgcacacgacgcugaugcggcugcgggc

SEQ ID NO: 541922 - RNA, 59 nt, Human Herpes Virus 2
aucgucgcgugccacgcccuccgggaacacgcgcacaucugccgucugcgcaacaccgc

SEQ ID NO: 541923 - RNA, 64 nt, Human Herpes Virus 4 (Epstein Barr virus)
gacaagcaacgcaagcccgguggaccuuggagaccagagccaaacaccuccaguccuagcaugc

SEQ ID NO: 541924 - RNA, 64 nt, Human Herpes Virus 4 (Epstein Barr virus)
ucagaugucccgggacagggcccccuuuguggaccagagccaaucucacagccuguuuuugcgu

SEQ ID NO: 541925 - RNA, 64 nt, Human Herpes Virus 4 (Epstein Barr virus)
cugugacuaauaggaacaggacauuuaacgucaccagagccaguggccgaguugaaaggcgccu

SEQ ID NO: 541926 - RNA, 64 nt, Human Herpes Virus 4 (Epstein Barr virus)
acguggccaacuuugacuggcccuacauucuggacagagccaggcacaucuacagcaucaaccc

SEQ ID NO: 541927 - RNA, 64 nt, Human Herpes Virus 4 (Epstein Barr virus)
gggugcacagacuagcgaggauaaucugggcagccagagccagccggguccgugcggcuacauc

SEQ ID NO: 541928 - RNA, 64 nt, Human Herpes Virus 4 (Epstein Barr virus)
cuggcgagccgagauagaucugggccugcccccuggugugcaggugggagauuugcuaagaaau

SEQ ID NO: 541929 - RNA, 64 nt, Human Herpes Virus 4 (Epstein Barr virus)
ggaggccgccgcaaggacgccgggccggcugggaggugugcaccccccgagcgucuggacgacg

SEQ ID NO: 541930 - RNA, 64 nt, Human Herpes Virus 4 (Epstein Barr virus)
ucuugucuugcucaugugcagaggaggggguguuggugugcaauauaguuucuggauuccaaau

SEQ ID NO: 541931 - RNA, 64 nt, Human Herpes Virus 4 (Epstein Barr virus)
cacaaaaacaggaggaagacuguguguuugauguggugugcaaccuuguggaugccaugggcga

SEQ ID NO: 541932 - RNA, 64 nt, Human Herpes Virus 4 (Epstein Barr virus)
cagcucauaugugaagcagccccucugucucuuggcagcauaugcggcaguagccccagccuac

SEQ ID NO: 541933 - RNA, 64 nt, Human Herpes Virus 4 (Epstein Barr virus)
gcuaaacuuacaucacguguaugugguuuuucaugcagcauacagauuagaggggcagguaguu

SEQ ID NO: 541934 - RNA, 64 nt, Human Herpes Virus 4 (Epstein Barr virus); identical to SEQ ID NO: 540041

SEQ ID NO: 541935 - RNA, 64 nt, Human Herpes Virus 4 (Epstein Barr virus); identical to SEQ ID NO: 540042

SEQ ID NO: 541936 - RNA, 64 nt, Human Herpes Virus 4 (Epstein Barr virus); identical to SEQ ID NO: 540041

SEQ ID NO: 541937 - RNA, 64 nt, Human Herpes Virus 4 (Epstein Barr virus); identical to SEQ ID NO: 540042

SEQ ID NO: 541938 - RNA, 64 nt, Human Herpes Virus 2; identical to SEQ ID NO: 540619

SEQ ID NO: 541939 - RNA, 64 nt, Human Herpes Virus 2; identical to SEQ ID NO: 540620

SEQ ID NO: 541940 - RNA, 64 nt, Human Herpes Virus 2; identical to SEQ ID NO: 540621

SEQ ID NO: 541941 - RNA, 64 nt, Human Herpes Virus 2; identical to SEQ ID NO: 540622

SEQ ID NO: 541942 - RNA, 64 nt, Human Herpes Virus 2; identical to SEQ ID NO: 540623

SEQ ID NO: 541943 - RNA, 64 nt, Human Herpes Virus 2; identical to SEQ ID NO: 540625

SEQ ID NO: 541944 - RNA, 64 nt, Human Herpes Virus 2; identical to SEQ ID NO: 540626

SEQ ID NO: 541945 - RNA, 64 nt, Human Herpes Virus 2
gcgucggugccgcuuuaccccgcggccucgcccgucccggcagaagccuacuacucggaaagcg

SEQ ID NO: 541946 - RNA, 64 nt, Human Herpes Virus 2
ugcgcgggccgccuuggagcgcggcccggauagaguggcccagggcccgcagacacgcgaucug

SEQ ID NO: 541947 - RNA, 64 nt, Human Herpes Virus 2
ccgagacaccagcacccgcgugaaccccgacgacguggcccaccgcgacgacgucaaccgcgcc

SEQ ID NO: 541948 - RNA, 64 nt, Human Herpes Virus 2
cccguccaucaaggaccggaucccguacgugaucguggcccagacccgcgagguagaggagacg

SEQ ID NO: 541949 - RNA, 64 nt, Human Herpes Virus 2
cgcgauggacgggcucgaggccaagcaguggucuguggcccaggcccugccuugccuggacccc

SEQ ID NO: 541950 - RNA, 64 nt, Human Herpes Virus 2
cgaccccgccgccgaacagcucgcggacgagcccguggcccacgagcucgacggcgccuaccug

SEQ ID NO: 541951 - RNA, 64 nt, Human Herpes Virus 2
ccccgaggagugcauggccguguaucgggaccugguggcccacgucgaggcccuggcccagcug

SEQ ID NO: 541952 - RNA, 64 nt, Human Herpes Virus 2
gcauggcgaguggucgaccgacgcggcccuggagguggcccacgaggcggaggcccuggucagc

SEQ ID NO: 541953 - RNA, 64 nt, Human Herpes Virus 2
uguuggagcucugcgucaucgggagcgcgccaagguggcccacguuuuugaucgagaacggggc

SEQ ID NO: 541954 - RNA, 62 nt, Human Herpes Virus 4 (Epstein Barr virus)
caauugucaguucuagggagggggaccacugccccugguauaaagugguccugcagcuauuu

SEQ ID NO: 541955 - RNA, 62 nt, Human Herpes Virus 4 (Epstein Barr virus); identical to SEQ ID NO: 541954

SEQ ID NO: 541956 - RNA, 62 nt, Human Herpes Virus 4 (Epstein Barr virus)
ggaacaucaaccaguggguaccguccuucggacccugguacaggaccaugucggcuaaugcc

SEQ ID NO: 541957 - RNA, 62 nt, Human Herpes Virus 4 (Epstein Barr virus)
aacucgagagaggccucugccgcgcugcucgccccugguagaaaggguacccgggucccgcc

SEQ ID NO: 541958 - RNA, 64 nt, Human Herpes Virus 2
gucuccguugggccaccuacagauaaccgcggucucccggcagcucuugagcgccaucgacuac

SEQ ID NO: 541959 - RNA, 62 nt, Human Herpes Virus 1
agcgagcuccgacaacgcggccugcaggacgugcgucccauuggggaggacgagguguuucu

SEQ ID NO: 541960 - RNA, 62 nt, Human Herpes Virus 1
acagcgcccccuacgguccuccccaggguccggcgucccaugcccccacucccccguaugcc

SEQ ID NO: 541961 - RNA, 62 nt, Human Herpes Virus 1
aucuggaggccgccgguucggaccacacgcucgcgucccaguccgacacggaggaugccccc

SEQ ID NO: 541962 - RNA, 64 nt, Human Herpes Virus 4 (Epstein Barr virus)
uuaugaugauccguuaacaaacgaggagauugaucuggccuaugcccgcgggcaggccaugaau

SEQ ID NO: 541963 - RNA, 64 nt, Human Herpes Virus 4 (Epstein Barr virus)
gcaaaugcagggucgauaguucggacucggcgcucuggccuaagcauccgccuacgugacacua

SEQ ID NO: 541964 - RNA, 64 nt, Human Herpes Virus 4 (Epstein Barr virus)
ccucgaguacggccucgagcucucgccggacauccuggccuacgucgaccgcuucgucgucccc

SEQ ID NO: 541965 - RNA, 64 nt, Human Herpes Virus 4 (Epstein Barr virus)
ccucgggguggacuuucagcacguggcccagacccuggccuacaacgggccagccuucagccac

SEQ ID NO: 541966 - RNA, 62 nt, Human Herpes Virus 1
ggcgcggagucgggagauccucugggggccgggcgucccauuggggacgacgagugcgaaca

SEQ ID NO: 541967 - RNA, 62 nt, Human Herpes Virus 1
cguuuggggguuuucucuucccgcgccgucgggcgucccacacucucugggcgggcggggac

SEQ ID NO: 541968 - RNA, 64 nt, Human Herpes Virus 1; identical to SEQ ID NO: 540582

SEQ ID NO: 541969 - RNA, 64 nt, Human Herpes Virus 1; identical to SEQ ID NO: 540584

SEQ ID NO: 541970 - RNA, 64 nt, Human Herpes Virus 4 (Epstein Barr virus); identical to SEQ ID NO: 541962

SEQ ID NO: 541971 - RNA, 64 nt, Human Herpes Virus 4 (Epstein Barr virus); identical to SEQ ID NO: 541963

SEQ ID NO: 541972 - RNA, 64 nt, Human Herpes Virus 1; identical to SEQ ID NO: 540578

SEQ ID NO: 541973 - RNA, 64 nt, Human Herpes Virus 1; identical to SEQ ID NO: 540579

SEQ ID NO: 541974 - RNA, 64 nt, Human Herpes Virus 4 (Epstein Barr virus); identical to SEQ ID NO: 541964

SEQ ID NO: 541975 - RNA, 64 nt, Human Herpes Virus 4 (Epstein Barr virus); identical to SEQ ID NO: 541965

SEQ ID NO: 541976 - RNA, 64 nt, Human Herpes Virus 4 (Epstein Barr virus); identical to SEQ ID NO: 541962

SEQ ID NO: 541977 - RNA, 64 nt, Human Herpes Virus 4 (Epstein Barr virus); identical to SEQ ID NO: 541963

SEQ ID NO: 541978 - RNA, 64 nt, Human Herpes Virus 4 (Epstein Barr virus); identical to SEQ ID NO: 541964

SEQ ID NO: 541979 - RNA, 64 nt, Human Herpes Virus 4 (Epstein Barr virus); identical to SEQ ID NO: 541965

SEQ ID NO: 541980 - RNA, 64 nt, Human Herpes Virus 2
gcaggcgcgggggucgcgcaucuacagcaaauuccgguacaagcacuacuucgagaggugcacg

SEQ ID NO: 541981 - RNA, 64 nt, Human Herpes Virus 4 (Epstein Barr virus); identical to SEQ ID NO: 541962

SEQ ID NO: 541982 - RNA, 64 nt, Human Herpes Virus 4 (Epstein Barr virus); identical to SEQ ID NO: 541963

SEQ ID NO: 541983 - RNA, 64 nt, Human Herpes Virus 4 (Epstein Barr virus); identical to SEQ ID NO: 541964

SEQ ID NO: 541984 - RNA, 64 nt, Human Herpes Virus 4 (Epstein Barr virus); identical to SEQ ID NO: 541965

SEQ ID NO: 541985 - RNA, 64 nt, Human Herpes Virus 4 (Epstein Barr virus); identical to SEQ ID NO: 541962

SEQ ID NO: 541986 - RNA, 64 nt, Human Herpes Virus 4 (Epstein Barr virus); identical to SEQ ID NO: 541963

SEQ ID NO: 541987 - RNA, 64 nt, Human Herpes Virus 4 (Epstein Barr virus); identical to SEQ ID NO: 541964

SEQ ID NO: 541988 - RNA, 64 nt, Human Herpes Virus 4 (Epstein Barr virus); identical to SEQ ID NO: 541965

SEQ ID NO: 541989 - RNA, 64 nt, Human Herpes Virus 4 (Epstein Barr virus); identical to SEQ ID NO: 541962

SEQ ID NO: 541990 - RNA, 64 nt, Human Herpes Virus 4 (Epstein Barr virus); identical to SEQ ID NO: 541963

SEQ ID NO: 541991 - RNA, 64 nt, Human Herpes Virus 4 (Epstein Barr virus); identical to SEQ ID NO: 541964

SEQ ID NO: 541992 - RNA, 64 nt, Human Herpes Virus 4 (Epstein Barr virus); identical to SEQ ID NO: 541965

SEQ ID NO: 541993 - RNA, 64 nt, Human Herpes Virus 1
cggagcgaguacccgccggccugagggccgcccccagcgcgaggugaggggccgggcgccaugu

SEQ ID NO: 541994 - RNA, 64 nt, Human Herpes Virus 1
cggagugugaucuuaguaaucucgagauucaucucagcgcgacaagcgaugaugaaaucuccga

SEQ ID NO: 541995 - RNA, 64 nt, Human Herpes Virus 1
agcagggguuagggaguuguucggucauaagcuucagcgcgaacgaccaacuaccccgaucauc

SEQ ID NO: 541996 - RNA, 64 nt, Human Herpes Virus 1
ucgaugacgucccggcucuccgaucccaacuccucagcgcgauccgacauguccgugccgcuuu

SEQ ID NO: 541997 - RNA, 64 nt, Human Herpes Virus 1
uuugcggggcguacauuucgacgcccucagggcccagcgcgaucuacgggagcugcggugccgg

SEQ ID NO: 541998 - RNA, 64 nt, Human Herpes Virus 1
uaucgaguccaagcggcuggugcgcacccaaaaccagcgcgaccuggggcucgugggggccgug

SEQ ID NO: 541999 - RNA, 64 nt, Human Herpes Virus 1
cgcucaagauggcgccggucccguuggggcagcccagcgcgaaccuuaccaccccggcguacag

SEQ ID NO: 542000 - RNA, 64 nt, Human Herpes Virus 1; identical to SEQ ID NO: 541993

SEQ ID NO: 542001 - RNA, 64 nt, Human Herpes Virus 1
gaagcucuaccagcaccucgaggucaugggguucggcgagcagauacccauccaggagcuggcc

SEQ ID NO: 542002 - RNA, 64 nt, Human Herpes Virus 1
cgcgccccucgucggcggaacccaggaauuugccggcgagcaccuggccaugcuguguggguuu

SEQ ID NO: 542003 - RNA, 64 nt, Human Herpes Virus 4 (Epstein Barr virus)
gcucggggggccaggccaccaugcuaucgguuuaaacgcggaauacagcggcgaugagcuggcg

SEQ ID NO: 542004 - RNA, 64 nt, Human Herpes Virus 4 (Epstein Barr virus)
cggccuuuugauggcccacuccuaucuuccagccaacgcggaagaaggcauagccuacccacca

SEQ ID NO: 542005 - RNA, 62 nt, Human immunodeficiency virus type 1 (BLAI)
agcugaaccaaucuguagaaauuaauuguacaagacccaacaacaauacaagaaaaaguauc

SEQ ID NO: 542006 - RNA, 64 nt, Human Herpes Virus 1; identical to SEQ ID NO: 540577

SEQ ID NO: 542007 - RNA, 64 nt, Human Herpes Virus 1; identical to SEQ ID NO: 540576

SEQ ID NO: 542008 - RNA, 64 nt, Human Herpes Virus 1; identical to SEQ ID NO: 540557

SEQ ID NO: 542009 - RNA, 64 nt, Human Herpes Virus 1
cgggccgccucgggggcgggacuggccaaucggcggccgccagcgcggcggggcccggccaacc

SEQ ID NO: 542010 - RNA, 64 nt, Human Herpes Virus 1
auguugggggacccccgacccuuacacuggaaccggccgccauguugggggacccccacucaua

SEQ ID NO: 542011 - RNA, 64 nt, Human Herpes Virus 1
aagagauacgccaggcgcuggacagucgcaagcaggccgccagccacacaccugugaaggcugg

SEQ ID NO: 542012 - RNA, 64 nt, Human Herpes Virus 1
ggauggccgccgcgacggccgacgaugaggggucggccgccaccauccucaagcaggccaucgc

SEQ ID NO: 542013 - RNA, 64 nt, Human Herpes Virus 1
ugcgcguguuggugggcccccaccugggggccguggccgccacgggcaucgucggccuggccug

SEQ ID NO: 542014 - RNA, 64 nt, Human Herpes Virus 1
gcgcguacgcaguuccaugcgcggaucgcgagacggccgccacaggcccgcacccggcagcccg

SEQ ID NO: 542015 - RNA, 64 nt, Human Herpes Virus 1
ggccgcgcaucagggcggccagagggauucccgcggccgccaggcacucgcuggauaugaugac

SEQ ID NO: 542016 - RNA, 64 nt, Human Herpes Virus 1
ucgccugcgugcagcuggagcgcguccucgagacggccgccagcgcugcgauuuucgagcgccg

SEQ ID NO: 542017 - RNA, 64 nt, Human Herpes Virus 1
gccccgaggaggccgugcuccuggacaagcagcaggccgccaucaaggucguguguaacucggu

SEQ ID NO: 542018 - RNA, 64 nt, Human Herpes Virus 1
caaaccgaaaccccgacuucccccucgcgggccuggccgccaauccccaaaccccgcguugcuc

SEQ ID NO: 542019 - RNA, 64 nt, Human Herpes Virus 1
uccuguccaacgcgcucaccaaggcgggccaggcggccgccaacgccaagacgguguacgggga

SEQ ID NO: 542020 - RNA, 64 nt, Human Herpes Virus 1
cccuggcgcggggguucaugcauaucuggcuucaggccgccacgcuggguuuugcgggaucggu

SEQ ID NO: 542021 - RNA, 64 nt, Human Herpes Virus 1
agaccugcggaauugucaagcgccuccugagacuggccgccacggaacagcagggccccacacc

SEQ ID NO: 542022 - RNA, 64 nt, Human Herpes Virus 1
agacgaggcggccaacgacuuccucguacgcaugggccgccaacagucgguauuaaggcgucga

SEQ ID NO: 542023 - RNA, 64 nt, Human Herpes Virus 1
accgcaacuacccggcgguguuuuaccugcugcaggccgccauacacggcagcgagcacgucuu

SEQ ID NO: 542024 - RNA, 64 nt, Human Herpes Virus 1
gaugggcaaggccgugcgaagucuggacgacgugggccgccaccugcuggagaugcaggaggag

SEQ ID NO: 542025 - RNA, 64 nt, Human Herpes Virus 1
ugaccggaagggugguggcgccggccuguauccuggccgccaucgucggcuacuacguuacgug

SEQ ID NO: 542026 - RNA, 64 nt, Human Herpes Virus 1; identical to SEQ ID NO: 535919

SEQ ID NO: 542027 - RNA, 64 nt, Human Herpes Virus 1
uacguggauauccgcgaucgcucagcgacgcccaggccgccaacgcggcgcgcgaucggaagcg

SEQ ID NO: 542028 - RNA, 64 nt, Human Herpes Virus 1
cuggaggaggugcggacccagccgacgaacuugaggccgccaccgguuaaggaguacuuuuacc

SEQ ID NO: 542029 - RNA, 64 nt, Human Herpes Virus 1
agaguccaggcucuggccaaguccaggugcgccgggccgccaacgguggaggcggaggaucgcc

SEQ ID NO: 542030 - RNA, 64 nt, Human Herpes Virus 1
gacgccuuuuacggggaacuacggcccugggcgcggccgccagccgcggccccgccggccaauc

SEQ ID NO: 542031 - RNA, 64 nt, Human Herpes Virus 1
aaccccggggguccgguccagcccacccaaacguggccgccacgcagggcacauaugaucgcgg

SEQ ID NO: 542032 - RNA, 64 nt, Human Herpes Virus 1
acccgcacuacgaguacauccggcacuacgcuucggccgccacccaggcgcugggcgaggugga

SEQ ID NO: 542033 - RNA, 64 nt, Human Herpes Virus 1; identical to SEQ ID NO: 542010

SEQ ID NO: 542034 - RNA, 64 nt, Human Herpes Virus 1; identical to SEQ ID NO: 542009

SEQ ID NO: 542035 - RNA, 64 nt, Human Herpes Virus 1
cgaucccccgcccccggcuacaggggccauguugggccgccacgcgcggcugguccacacccag

SEQ ID NO: 542036 - RNA, 64 nt, Human Herpes Virus 1; identical to SEQ ID NO: 540583

SEQ ID NO: 542037 - RNA, 64 nt, Human Herpes Virus 1; identical to SEQ ID NO: 540558

SEQ ID NO: 542038 - RNA, 64 nt, Human Herpes Virus 1; identical to SEQ ID NO: 540580

SEQ ID NO: 542039 - RNA, 64 nt, Human Herpes Virus 1; identical to SEQ ID NO: 542009

SEQ ID NO: 542040 - RNA, 64 nt, Human Herpes Virus 1; identical to SEQ ID NO: 542010

SEQ ID NO: 542041 - RNA, 64 nt, Human Herpes Virus 1; identical to SEQ ID NO: 542011

SEQ ID NO: 542042 - RNA, 64 nt, Human Herpes Virus 1; identical to SEQ ID NO: 542012

SEQ ID NO: 542043 - RNA, 64 nt, Human Herpes Virus 1; identical to SEQ ID NO: 542013

SEQ ID NO: 542044 - RNA, 64 nt, Human Herpes Virus 1; identical to SEQ ID NO: 542014

SEQ ID NO: 542045 - RNA, 64 nt, Human Herpes Virus 1; identical to SEQ ID NO: 542015

SEQ ID NO: 542046 - RNA, 64 nt, Human Herpes Virus 1; identical to SEQ ID NO: 542016

SEQ ID NO: 542047 - RNA, 64 nt, Human Herpes Virus 1; identical to SEQ ID NO: 542017

SEQ ID NO: 542048 - RNA, 64 nt, Human Herpes Virus 1; identical to SEQ ID NO: 542018

SEQ ID NO: 542049 - RNA, 64 nt, Human Herpes Virus 1; identical to SEQ ID NO: 542019

SEQ ID NO: 542050 - RNA, 64 nt, Human Herpes Virus 1; identical to SEQ ID NO: 542020

SEQ ID NO: 542051 - RNA, 64 nt, Human Herpes Virus 1; identical to SEQ ID NO: 542021

SEQ ID NO: 542052 - RNA, 64 nt, Human Herpes Virus 1; identical to SEQ ID NO: 542022

SEQ ID NO: 542053 - RNA, 64 nt, Human Herpes Virus 1; identical to SEQ ID NO: 542023

SEQ ID NO: 542054 - RNA, 64 nt, Human Herpes Virus 1; identical to SEQ ID NO: 542024

SEQ ID NO: 542055 - RNA, 64 nt, Human Herpes Virus 1; identical to SEQ ID NO: 542025

SEQ ID NO: 542056 - RNA, 64 nt, Human Herpes Virus 1; identical to SEQ ID NO: 535919

SEQ ID NO: 542057 - RNA, 64 nt, Human Herpes Virus 1; identical to SEQ ID NO: 542027

SEQ ID NO: 542058 - RNA, 64 nt, Human Herpes Virus 1; identical to SEQ ID NO: 542028

SEQ ID NO: 542059 - RNA, 64 nt, Human Herpes Virus 1; identical to SEQ ID NO: 542029

SEQ ID NO: 542060 - RNA, 64 nt, Human Herpes Virus 1; identical to SEQ ID NO: 542030

SEQ ID NO: 542061 - RNA, 64 nt, Human Herpes Virus 1; identical to SEQ ID NO: 542031

SEQ ID NO: 542062 - RNA, 64 nt, Human Herpes Virus 1; identical to SEQ ID NO: 542032

SEQ ID NO: 542063 - RNA, 64 nt, Human Herpes Virus 1; identical to SEQ ID NO: 542010

SEQ ID NO: 542064 - RNA, 64 nt, Human Herpes Virus 1; identical to SEQ ID NO: 542009

SEQ ID NO: 542065 - RNA, 64 nt, Human Herpes Virus 1; identical to SEQ ID NO: 542035

SEQ ID NO: 542066 - RNA, 64 nt, Human Herpes Virus 1
ccagccggacagcuugggucggggguacgauggcgacuggcacacggccgucgcuacucgcggg

SEQ ID NO: 542067 - RNA, 62 nt, Human Herpes Virus 1
guauuuugccaaaaucgcccccgacgggccugcgugcggaaggcugcugccaguguuuguga

SEQ ID NO: 542068 - RNA, 62 nt, Human Herpes Virus 2
ugacggucugcgagggcaagaaccuccugcagcgcgcgaacgaguuggugaaucccgacgcg

SEQ ID NO: 542069 - RNA, 64 nt, Human Herpes Virus 1
gcgguuuuguccggcccggggccugcgcgggcgccuccgccacccgcuggguccggaggggccg

SEQ ID NO: 542070 - RNA, 63 nt, Human Herpes Virus 4 (Epstein Barr virus)
cuugguggaugugcgagccauaaagcaguuucuggaggccacggccgaucgcauccuggguga

SEQ ID NO: 542071 - RNA, 63 nt, Human Herpes Virus 4 (Epstein Barr virus)
ggcuguucagcucgcgaggaaaaggacaucgucggaggccaggcagaagcagaagcaccccaa

SEQ ID NO: 542072 - RNA, 63 nt, Human Herpes Virus 4 (Epstein Barr virus)
ucuaaucaaaugguuggacacggcccugggcagggaggccaccuuuuacgcgugucgggcuau

SEQ ID NO: 542073 - RNA, 63 nt, Human Herpes Virus 4 (Epstein Barr virus)
caggaucccccccuguccgcccuucagcgggcgggaggccagacucaaguuccacuucuucuc

SEQ ID NO: 542074 - RNA, 63 nt, Human Herpes Virus 4 (Epstein Barr virus)
aauuucuggcggcggcagggccgccaaaccuaaggaggccaggcuggcuggaaacagagucuc

SEQ ID NO: 542075 - RNA, 63 nt, Human Herpes Virus 4 (Epstein Barr virus)
aagagcucaagcgacaguaugccucucccgacuggaggccaucggagaccgggcgcaaggaaa

SEQ ID NO: 542076 - RNA, 63 nt, Human Herpes Virus 4 (Epstein Barr virus)
gcggcgggcgguagagauccugggcguguacgcggaggccagcgggggacaaacgccccccgu

SEQ ID NO: 542077 - RNA, 63 nt, Human Herpes Virus 4 (Epstein Barr virus)
caaggcccuuguggccucaaacacugacauugcggaggccauccucgaugccauccucucgcg

SEQ ID NO: 542078 - RNA, 63 nt, Human Herpes Virus 4 (Epstein Barr virus)
gggggaggacgagacgacgguggucgggcgcgcggaggccacagccauccuugaggcugaugc

SEQ ID NO: 542079 - RNA, 63 nt, Human Herpes Virus 4 (Epstein Barr virus)
cauguucauugggaccccaaauguuagccgccgggaggccaggguggacgcgguaaccuuuga

SEQ ID NO: 542080 - RNA, 63 nt, Human Herpes Virus 4 (Epstein Barr virus)
gguggugcgcaacgccggccugcuggccgagcuggaggccauccuccuuccccguuugagacg

SEQ ID NO: 542081 - RNA, 63 nt, Human Herpes Virus 4 (Epstein Barr virus)
cacauaugagauugagaacaucagggcuggccuggaggccauuauaucacaaaaacaggagga

SEQ ID NO: 542082 - RNA, 63 nt, Human Herpes Virus 4 (Epstein Barr virus)
cacgcgggcgguggagucggcagcggccuacgcggaggccaccuccucccuuacugcgaccac

SEQ ID NO: 542083 - RNA, 63 nt, Human Herpes Virus 4 (Epstein Barr virus)
ccuggccaucgacaaggggguccucacggccaaggaggccaagguggugcauggggagcccac

SEQ ID NO: 542084 - RNA, 63 nt, Human Herpes Virus 4 (Epstein Barr virus)
gaaagcggugacagccuggccggcggccacacaggaggccaacaggaggagcugagcgaugaa

SEQ ID NO: 542085 - RNA, 64 nt, Human Herpes Virus 2
cgccgcgacccaccgcacccccgccgcggccgccgccagacaacaccugguucuggccgcggug

SEQ ID NO: 542086 - RNA, 64 nt, Human Herpes Virus 4 (Epstein Barr virus)
gccaagcugcacaccacuguggccaucaauguggccaucauaccuauccugugcucgguggcca

SEQ ID NO: 542087 - RNA, 62 nt, Human Herpes Virus 1
cacaccagcaaaacggacuccgcuugcguggccgugcggaguuaccugguccgcgccuccug

SEQ ID NO: 542088 - RNA, 62 nt, Human Herpes Virus 1
gccugugcgcccccggggacgcuaauggcgcgcgugcggacggacguggccguguuugaucc

SEQ ID NO: 542089 - RNA, 64 nt, Human Herpes Virus 1
ccgagcggcugggcgaggccuggggccagcugauggaggcgaccgcccuggggucggggcgagc

SEQ ID NO: 542090 - RNA, 64 nt, Human Herpes Virus 1
acgccgacgaccccacucccggcgccucuaacgaugccucgacggaaacccguccggguucggg

SEQ ID NO: 542091 - RNA, 64 nt, Human Herpes Virus 1
gaccgcgugggccccgcuggcguuucgccggcgccuccgccaaacaacaccgacucgaguuccc

SEQ ID NO: 542092 - RNA, 64 nt, Human Herpes Virus 1
ugacgcccgcccccgcguauugcggggccguggacuccgccaccaaaaugauggggcguuuggc

SEQ ID NO: 542093 - RNA, 64 nt, Human Herpes Virus 1; identical to SEQ ID NO: 542092

SEQ ID NO: 542094 - RNA, 64 nt, Human Herpes Virus 1; identical to SEQ ID NO: 542069

SEQ ID NO: 542095 - RNA, 64 nt, Human Herpes Virus 1; identical to SEQ ID NO: 542091

SEQ ID NO: 542096 - RNA, 64 nt, Human Herpes Virus 1
cggacuacaccccccggcccggcgaccucaaacacgagacgacgggggaggcgcugugugagcg

SEQ ID NO: 542097 - RNA, 64 nt, Human Herpes Virus 4 (Epstein Barr virus)
guugacaggaaagaaucucagcccacgccgguuggugacagagccugacccacgaugucaggug

SEQ ID NO: 542098 - RNA, 64 nt, Human Herpes Virus 4 (Epstein Barr virus)
ggacgaguucuaugauaacaaguaugcagcccccgugacagauauagcucucaagugcgggcug

SEQ ID NO: 542099 - RNA, 64 nt, Human Herpes Virus 1
cgccagagcggaccaaugugauccugggcuccaccgagacgacggggcugucccucggcgaccu

SEQ ID NO: 542100 - RNA, 64 nt, Human Herpes Virus 1; identical to SEQ ID NO: 542099

SEQ ID NO: 542101 - RNA, 64 nt, Human Herpes Virus 1; identical to SEQ ID NO: 541889

SEQ ID NO: 542102 - RNA, 64 nt, Human Herpes Virus 1; identical to SEQ ID NO: 542096

SEQ ID NO: 542103 - RNA, 62 nt, Human Herpes Virus 4 (Epstein Barr virus)
gucgaaaugaccaagcguccccgcagcggggcucccaacacggguucccagagaggguaaaa

SEQ ID NO: 542104 - RNA, 62 nt, Human Herpes Virus 4 (Epstein Barr virus)
acuuucuucccuguuugcuuuauggaaugcccucccaacaucugguagacaauccuccaggg

SEQ ID NO: 542105 - RNA, 62 nt, Human Herpes Virus 4 (Epstein Barr virus)
ucuggccaucugucuugucaccauuuucguccucccaacauggggcaauugggcauacccau

SEQ ID NO: 542106 - RNA, 62 nt, Human Herpes Virus 4 (Epstein Barr virus)
cgacucuuucuccuccuccaaggacccaagccucccaacagucagccgccccggcuccuucu

SEQ ID NO: 542107 - RNA, 62 nt, Human Herpes Virus 4 (Epstein Barr virus)
ggugacauucacugggacaacugucacaccagucccaacaacuuccaacgcauccaccauca

SEQ ID NO: 542108 - RNA, 62 nt, Human Herpes Virus 4 (Epstein Barr virus)
gccggcgacuaccacaagaucacccucucccaucccaacagugugugucacguggccacgug

SEQ ID NO: 542109 - RNA, 64 nt, Human Herpes Virus 1
ccggcuggagccgccgcacccugcuccccgagaccgcggguaaccacgugaugccccccgagua

SEQ ID NO: 542110 - RNA, 64 nt, Human Herpes Virus 1
aauguggggggcggagccuguuuccgcgccggcgcgcggguauaagaacggggccccggagucc

SEQ ID NO: 542111 - RNA, 64 nt, Human Herpes Virus 1
gcaaccacgcccauaucugcuacgccaaucuuaucgcggguagggucgugcccuuccagguccc

SEQ ID NO: 542112 - RNA, 64 nt, Human Herpes Virus 1
cccuagcgugcguuacgugugccugccguccgaacgcggguaggguauggggcgggggaugggg

SEQ ID NO: 542113 - RNA, 64 nt, Human Herpes Virus 1; identical to SEQ ID NO: 542109

SEQ ID NO: 542114 - RNA, 62 nt, Human Herpes Virus 2
aagcgggcccuggcggcgcacgggggcgaagacgcgcgaaacgaguuccacgcccucaccgc

SEQ ID NO: 542115 - RNA, 64 nt, Human Herpes Virus 2; identical to SEQ ID NO: 541221

SEQ ID NO: 542116 - RNA, 56 nt, Human Herpes Virus 2; identical to SEQ ID NO: 541222

SEQ ID NO: 542117 - RNA, 64 nt, Human Herpes Virus 2; identical to SEQ ID NO: 541223

SEQ ID NO: 542118 - RNA, 64 nt, Human Herpes Virus 2; identical to SEQ ID NO: 541224

SEQ ID NO: 542119 - RNA, 64 nt, Human Herpes Virus 2; identical to SEQ ID NO: 541225

SEQ ID NO: 542120 - RNA, 64 nt, Human Herpes Virus 2; identical to SEQ ID NO: 541226

SEQ ID NO: 542121 - RNA, 64 nt, Human Herpes Virus 2; identical to SEQ ID NO: 541227

SEQ ID NO: 542122 - RNA, 64 nt, Human Herpes Virus 2; identical to SEQ ID NO: 541228

SEQ ID NO: 542123 - RNA, 64 nt, Human Herpes Virus 2; identical to SEQ ID NO: 541229

SEQ ID NO: 542124 - RNA, 64 nt, Human Herpes Virus 2; identical to SEQ ID NO: 541230

SEQ ID NO: 542125 - RNA, 64 nt, Human Herpes Virus 2; identical to SEQ ID NO: 541231

SEQ ID NO: 542126 - RNA, 64 nt, Human Herpes Virus 2; identical to SEQ ID NO: 541232

SEQ ID NO: 542127 - RNA, 64 nt, Human Herpes Virus 2; identical to SEQ ID NO: 541233

SEQ ID NO: 542128 - RNA, 64 nt, Human Herpes Virus 2; identical to SEQ ID NO: 541226

SEQ ID NO: 542129 - RNA, 64 nt, Human Herpes Virus 2; identical to SEQ ID NO: 541225

SEQ ID NO: 542130 - RNA, 64 nt, Human Herpes Virus 2
ucaucgccaagaaaaaguacaucggcgucaucugcgggggcaagaugcucaucaagggcgugga

SEQ ID NO: 542131 - RNA, 64 nt, Human Herpes Virus 2
ucaccggcaacgugagcgccauccucgcccgcaacgggggcaucgggcugugcaugcaggcguu

SEQ ID NO: 542132 - RNA, 64 nt, Human Herpes Virus 1
gauggcacgaguucaaccucgggugcauauccugggauccgacccccauggagcacgagcaggc

SEQ ID NO: 542133 - RNA, 64 nt, Human Herpes Virus 4 (Epstein Barr virus)
gaacuuugcgugccugaggcauacccacagggccagcuccaagaaugugaggguguuucuggua

SEQ ID NO: 542134 - RNA, 64 nt, Human Herpes Virus 4 (Epstein Barr virus)
acaccugaacaggauggagaaggaaggccuccuaagcuccaaguucaaggccuuuugcaagugg

SEQ ID NO: 542135 - RNA, 64 nt, Human Herpes Virus 4 (Epstein Barr virus)
caucaccucccaggaaguccaaaacuccaucuugagcuccaacuacuuugauuuugacaaccuc

SEQ ID NO: 542136 - RNA, 64 nt, Human Herpes Virus 4 (Epstein Barr virus)
gcuggaauacaacaacaccuacgaggccccccugagcuccaagauuacggccguugucgugucc

SEQ ID NO: 542137 - RNA, 64 nt, Human Herpes Virus 4 (Epstein Barr virus)
uggguacgacgccuacagcgcccuaccgagggaaagcuccaagccgggggacuucuuccccgaa

SEQ ID NO: 542138 - RNA, 64 nt, Human Herpes Virus 1; identical to SEQ ID NO: 541069

SEQ ID NO: 542139 - RNA, 64 nt, Human Herpes Virus 1
gcgacccaauugcaggagcgcgaccgcgagcuccggcgcgcaacagcgggggcccuggagcgcc

SEQ ID NO: 542140 - RNA, 64 nt, Human Herpes Virus 1
ugugaaaaaaggcgucgggggcgguccccucgacggcgcgcaucagguucucgaggagaauggg

SEQ ID NO: 542141 - RNA, 64 nt, Human Herpes Virus 1
ggagagucuagacgcgcgcuacgucucgcgagacggcgcgcaugacgcggccgucugguucgag

SEQ ID NO: 542142 - RNA, 64 nt, Human Herpes Virus 1
cccguccccguguucgggugcgcccaggugccgcggcgcgcagggauggaccacggccaggacg

SEQ ID NO: 542143 - RNA, 64 nt, Human Herpes Virus 1
gcucacgggggaggcccuggacgggacggguaucggcgcgcaucgccaguugcgcgccauccaa

SEQ ID NO: 542144 - RNA, 64 nt, Human Herpes Virus 1
ccaccccaggcuccauaccgacgaucugcgaccuggcgcgcacguuugcccgggagauggggga

SEQ ID NO: 542145 - RNA, 64 nt, Human Herpes Virus 1
aacagugcgacgaggaggcgcugcgucgcgugcuggcgcgcaugggggcggggggcgcggcgga

SEQ ID NO: 542146 - RNA, 64 nt, Human Herpes Virus 1
gacgacaugcggguccuggaccacuggacgagcuggcgcgcagcgcaccgggcacgcuacucgg

SEQ ID NO: 542147 - RNA, 64 nt, Human Herpes Virus 1
ugcugcugcggcccacccuggcgccaaagcugcuggcgcgcaccccguucaagagcggggccgu

SEQ ID NO: 542148 - RNA, 64 nt, Human Herpes Virus 1
accaugucggcucgcgaacccgcggggcgcaggaggcgcgcauccacccgcccccgcgccucgc

SEQ ID NO: 542149 - RNA, 64 nt, Human Herpes Virus 2
aggcuggccgagccucugauggacuugcccaaauucacccgaccgaucgugcgaacccgcuccu

SEQ ID NO: 542150 - RNA, 64 nt, Human Herpes Virus 4 (Epstein Barr virus)
cugaagacccagcggccauucucucugguaacgagcagagaagaaguagaggcccgcggccauu

SEQ ID NO: 542151 - RNA, 64 nt, Human Herpes Virus 4 (Epstein Barr virus); identical to SEQ ID NO: 542150

SEQ ID NO: 542152 - RNA, 64 nt, Human Herpes Virus 4 (Epstein Barr virus); identical to SEQ ID NO: 542150

SEQ ID NO: 542153 - RNA, 64 nt, Human Herpes Virus 4 (Epstein Barr virus)
aaugauuaucuagguuugauagucugaaggcugggcagagaauguuuguaauuuuuauucaccu

SEQ ID NO: 542154 - RNA, 64 nt, Human Herpes Virus 2
caucgccgccaccggcaucgucggccuggccugcgagcacuaccacaccggugguuacuacgug

SEQ ID NO: 542155 - RNA, 64 nt, Human Herpes Virus 2; identical to SEQ ID NO: 540170

SEQ ID NO: 542156 - RNA, 64 nt, Human Herpes Virus 1
ggggguacgaccccgagcccgccgaggaccccguguacagcaccguccgccguugguagcuguu

SEQ ID NO: 542157 - RNA, 64 nt, Human Herpes Virus 4 (Epstein Barr virus)
uccagggacaagcaacgcaagcccgguggaccuuggagaccagagccaaacaccuccaguccua

SEQ ID NO: 542158 - RNA, 64 nt, Human Herpes Virus 4 (Epstein Barr virus)
uugcgccaauuguuaacggggggcgucaagaaagggagaccaucacuuaaguuacaggccgccc

SEQ ID NO: 542159 - RNA, 64 nt, Human Herpes Virus 4 (Epstein Barr virus)
aguuuccuggcuuuuuacgauuccggucccugguggagaccaucuaagcaucccuugaccaaca

SEQ ID NO: 542160 - RNA, 64 nt, Human Herpes Virus 4 (Epstein Barr virus)
cgacgcuggggagauggcuggucaccguauacgcggagaccaaccgcuaccccugggcggcugc

SEQ ID NO: 542161 - RNA, 64 nt, Human Herpes Virus 4 (Epstein Barr virus)
ccaauuuguggccuuguacggcuaccggguuaacggagaccacgaccacgauuuccgucugcac

SEQ ID NO: 542162 - RNA, 64 nt, Human Herpes Virus 4 (Epstein Barr virus)
aguccucugccugcggccugcccggcucuucuacggagaccaggccuagccaccccugccccga

SEQ ID NO: 542163 - RNA, 63 nt, Human Herpes Virus 4 (Epstein Barr virus)
aggugggagauuugcuaagaaaugagcagacgaugggcucacugagacagguuuauuugcucg

SEQ ID NO: 542164 - RNA, 63 nt, Human Herpes Virus 4 (Epstein Barr virus)
ucuggcuguaagcggcaucgagauggacgagaaugggcucaaggcccugcuggacaaacaggc

SEQ ID NO: 542165 - RNA, 63 nt, Human Herpes Virus 4 (Epstein Barr virus)
ccucaaguggaaauaacaccauauaagcccacuugggcucagauagggcacauuccauaucag

SEQ ID NO: 542166 - RNA, 63 nt, Human Herpes Virus 4 (Epstein Barr virus)
ccuaggccucuaugcccgcccacccgagggucaugggcucaugcuguggggcagcaccucccg

SEQ ID NO: 542167 - RNA, 64 nt, Human Herpes Virus 1
ccgguacgaggcggggccgucggaguccuacugcgaccaggacgaaccggacgcggacuacccg

SEQ ID NO: 542168 - RNA, 64 nt, Human Herpes Virus 1
ucuguaccugguauucacuuaccgccagcgccgggaccaggagcuguguuguguguacgugauc

SEQ ID NO: 542169 - RNA, 64 nt, Human Herpes Virus 1
auccgagacagcaucggauucgaccgagucuggggaccaggaugaagccccccgcaucgguggc

SEQ ID NO: 542170 - RNA, 64 nt, Human Herpes Virus 1
cgccagccgcaucaccaacuacucgcagagccaggaccaggacgcggggcacaugcgcugcgag

SEQ ID NO: 542171 - RNA, 64 nt, Human Herpes Virus 1
ugagcgccuggacgccguggacgaucgucuugcggaccaggaggagcaacucgaggaagcagcg

SEQ ID NO: 542172 - RNA, 64 nt, Human Herpes Virus 4 (Epstein Barr virus)
ucgcuccacccuagaccccagcuucuggccuccccggguccaccaggccagccggagggacccc

SEQ ID NO: 542173 - RNA, 64 nt, Human Herpes Virus 4 (Epstein Barr virus)
cucccacccgagcccccucagcuugccuccccaccggguccaucaggccggccggagggacccc

SEQ ID NO: 542174 - RNA, 64 nt, Human Herpes Virus 4 (Epstein Barr virus); identical to SEQ ID NO: 542172

SEQ ID NO: 542175 - RNA, 64 nt, Human Herpes Virus 4 (Epstein Barr virus); identical to SEQ ID NO: 542173

SEQ ID NO: 542176 - RNA, 64 nt, Human Herpes Virus 4 (Epstein Barr virus); identical to SEQ ID NO: 542172

SEQ ID NO: 542177 - RNA, 64 nt, Human Herpes Virus 4 (Epstein Barr virus); identical to SEQ ID NO: 542173

SEQ ID NO: 542178 - RNA, 64 nt, Human Herpes Virus 4 (Epstein Barr virus); identical to SEQ ID NO: 542172

SEQ ID NO: 542179 - RNA, 64 nt, Human Herpes Virus 4 (Epstein Barr virus); identical to SEQ ID NO: 542173

SEQ ID NO: 542180 - RNA, 64 nt, Human Herpes Virus 4 (Epstein Barr virus); identical to SEQ ID NO: 542172

SEQ ID NO: 542181 - RNA, 64 nt, Human Herpes Virus 4 (Epstein Barr virus); identical to SEQ ID NO: 542173

SEQ ID NO: 542182 - RNA, 64 nt, Human Herpes Virus 4 (Epstein Barr virus); identical to SEQ ID NO: 542172

SEQ ID NO: 542183 - RNA, 64 nt, Human Herpes Virus 4 (Epstein Barr virus); identical to SEQ ID NO: 542173

SEQ ID NO: 542184 - RNA, 64 nt, Human Herpes Virus 4 (Epstein Barr virus); identical to SEQ ID NO: 542172

SEQ ID NO: 542185 - RNA, 64 nt, Human Herpes Virus 4 (Epstein Barr virus); identical to SEQ ID NO: 542173

SEQ ID NO: 542186 - RNA, 64 nt, Human Herpes Virus 4 (Epstein Barr virus); identical to SEQ ID NO: 542172

SEQ ID NO: 542187 - RNA, 64 nt, Human Herpes Virus 4 (Epstein Barr virus); identical to SEQ ID NO: 542173

SEQ ID NO: 542188 - RNA, 64 nt, Human Herpes Virus 4 (Epstein Barr virus)
ccccucgguucucgccgccuuugcucgcacggcccggguccagacccaccaccucgugccggcc

SEQ ID NO: 542189 - RNA, 64 nt, Human Herpes Virus 4 (Epstein Barr virus)
cucugaccagcaagaugcucuccaccauggcccccggguccaccguggggacccugguggccaa

SEQ ID NO: 542190 - RNA, 64 nt, Human Herpes Virus 4 (Epstein Barr virus)
gacggucgcccucagccccccagacagaccccagggucuccaggcaggguccggcaucuucagg

SEQ ID NO: 542191 - RNA, 64 nt, Human Herpes Virus 4 (Epstein Barr virus); identical to SEQ ID NO: 542190

SEQ ID NO: 542192 - RNA, 64 nt, Human Herpes Virus 4 (Epstein Barr virus); identical to SEQ ID NO: 542190

SEQ ID NO: 542193 - RNA, 64 nt, Human Herpes Virus 4 (Epstein Barr virus); identical to SEQ ID NO: 542190

SEQ ID NO: 542194 - RNA, 64 nt, Human Herpes Virus 4 (Epstein Barr virus); identical to SEQ ID NO: 542190

SEQ ID NO: 542195 - RNA, 64 nt, Human Herpes Virus 4 (Epstein Barr virus); identical to SEQ ID NO: 542190

SEQ ID NO: 542196 - RNA, 64 nt, Human Herpes Virus 4 (Epstein Barr virus); identical to SEQ ID NO: 542190

SEQ ID NO: 542197 - RNA, 64 nt, Human Herpes Virus 4 (Epstein Barr virus); identical to SEQ ID NO: 542190

SEQ ID NO: 542198 - RNA, 64 nt, Human Herpes Virus 4 (Epstein Barr virus)
aucggcuggugacagcgggcaaguuuugugggcgggucuccaucaagucccugauguucucuau

SEQ ID NO: 542199 - RNA, 64 nt, Human Herpes Virus 4 (Epstein Barr virus)
ugcucuuggccugcaccaucuuugcccuguccguggucuccagggcccuggaggugucggcugu

SEQ ID NO: 542200 - RNA, 64 nt, Human Herpes Virus 4 (Epstein Barr virus)
cacacccgagucauugcuccgggcuaucgugacgggucuccaaaaauuguggguggauucgugc

SEQ ID NO: 542201 - RNA, 64 nt, Human Herpes Virus 4 (Epstein Barr virus)
cccaggagucccaguagucagucaucaucauccgggucuccaccgcgcaggcccccuccaggua

SEQ ID NO: 542202 - RNA, 64 nt, Human Herpes Virus 4 (Epstein Barr virus)
gccccaagggcccccagggugccuagagcaccgaggucuccaagagcuccccgaagcaacagag

SEQ ID NO: 542203 - RNA, 24 nt, Human Herpes Virus 4 (Epstein Barr virus)
cagacagaccccagggucuccagg

SEQ ID NO: 542204 - RNA, 24 nt, Human Herpes Virus 4 (Epstein Barr virus)
cagacagaccccagggucuccagg

SEQ ID NO: 542205 - RNA, 24 nt, Human Herpes Virus 4 (Epstein Barr virus)
cagacagaccccagggucuccagg

SEQ ID NO: 542206 - RNA, 24 nt, Human Herpes Virus 4 (Epstein Barr virus)
cagacagaccccagggucuccagg

SEQ ID NO: 542207 - RNA, 24 nt, Human Herpes Virus 4 (Epstein Barr virus)
cagacagaccccagggucuccagg

SEQ ID NO: 542208 - RNA, 24 nt, Human Herpes Virus 4 (Epstein Barr virus)
cagacagaccccagggucuccagg

SEQ ID NO: 542209 - RNA, 24 nt, Human Herpes Virus 4 (Epstein Barr virus)
cagacagaccccagggucuccagg

SEQ ID NO: 542210 - RNA, 24 nt, Human Herpes Virus 4 (Epstein Barr virus)
cagacagaccccagggucuccagg

SEQ ID NO: 542211 - RNA, 24 nt, Human Herpes Virus 4 (Epstein Barr virus)
aaguuuugugggcgggucuccauc

SEQ ID NO: 542212 - RNA, 24 nt, Human Herpes Virus 4 (Epstein Barr virus)
uuugcccuguccguggucuccagg

SEQ ID NO: 542213 - RNA, 24 nt, Human Herpes Virus 4 (Epstein Barr virus)
gggcuaucgugacgggucuccaaa

SEQ ID NO: 542214 - RNA, 24 nt, Human Herpes Virus 4 (Epstein Barr virus)
gucaucaucauccgggucuccacc

SEQ ID NO: 542215 - RNA, 24 nt, Human Herpes Virus 4 (Epstein Barr virus)
gccuagagcaccgaggucuccaag

SEQ ID NO: 542216 - RNA, 64 nt, Human Herpes Virus 2; identical to SEQ ID NO: 542149

SEQ ID NO: 542217 - RNA, 64 nt, Human Herpes Virus 2
gcucgcagacccuguguggggcaguggaggggcugcccuccaugaagcgacauuuacucugcuc

SEQ ID NO: 542218 - RNA, 64 nt, Human Herpes Virus 2
gcgcaccgcggccgcggcggcccuggagaacgccgcccuccaggccgccgagcugcccgucgac

SEQ ID NO: 542219 - RNA, 64 nt, Human Herpes Virus 2
accucgcggcggcucccccgcggccuuucccguggcccuccacgccguggacgcccccucccaa

SEQ ID NO: 542220 - RNA, 64 nt, Human Herpes Virus 2
gucccugcgcgcgaccacccccuccgucgcgacggcccuccaccacugcuucacagaccuggcg

SEQ ID NO: 542221 - RNA, 64 nt, Human Herpes Virus 2
gucgaaccagccgaacccgcagugguucuggaccgcccuccagcgcaaccagcuccccgcccgg

SEQ ID NO: 542222 - RNA, 64 nt, Human Herpes Virus 2
ccucgugggcgccaugguguucagcaccaauucggcccuccaccugaccgagguggacgacgcc

SEQ ID NO: 542223 - RNA, 62 nt, Human Herpes Virus 2
gccgucgcgcgccuggcgggcaucaacaucacccgcaccaucuacgacggccagcagauccg

SEQ ID NO: 542224 - RNA, 62 nt, Human Herpes Virus 2
aacaacgaccaggcgcgccgcgccuauguggcccgcaccaucaaccacccggccauucgcgu

SEQ ID NO: 542225 - RNA, 62 nt, Human Herpes Virus 2
acuggcacaucccgucgauccaggacgucgcgccgcaccacgcccccgccgcccccagcaac

SEQ ID NO: 542226 - RNA, 62 nt, Human Herpes Virus 2
cugcgccuaaacagcgcguacguagccaugucccgcaccaccucauccgaguuccugcacau

SEQ ID NO: 542227 - RNA, 62 nt, Human Herpes Virus 2
accuucgcgcuggaccgccccugucuggucugccgcaccaucgagcuguacaagcaggccua

SEQ ID NO: 542228 - RNA, 64 nt, Human Herpes Virus 1
gggaacucgugggugcugauugacgcgggaaauccccccccauucuuacccgccccccuuuuuu

SEQ ID NO: 542229 - RNA, 64 nt, Human Herpes Virus 1
uacguaccgcccgccccccgccggacgccccgcgcccccccacgcagaggcgccgccgcgcccc

SEQ ID NO: 542230 - RNA, 64 nt, Human Herpes Virus 1
ccuuccgggccuccagccucacggagaccacgggcccccccaaaaaacgggccaagguggacgu

SEQ ID NO: 542231 - RNA, 64 nt, Human Herpes Virus 1
ccccuuccguguggggcgggaguaccguggaacucccccccacaacacgcgauaccgcgggaca

SEQ ID NO: 542232 - RNA, 64 nt, Human Herpes Virus 1
uuugccggugcgcccgcgaggaaaccaagcgugucccccccaggacauucggcagccccccucg

SEQ ID NO: 542233 - RNA, 64 nt, Human Herpes Virus 1
caacaacccccaagcccaccuccacgcccaaaagcccccccacguccacccccgaccccaaacc

SEQ ID NO: 542234 - RNA, 64 nt, Human Herpes Virus 1
cgccuccagauauggcguuacuccauggguccgucccccccaaucgcuccggcucccgaccuag

SEQ ID NO: 542235 - RNA, 64 nt, Human Herpes Virus 1
accagacccuauuguuucugggggccccgacgcacccccccaacgggggcuggcgcaaccacgc

SEQ ID NO: 542236 - RNA, 64 nt, Human Herpes Virus 1
cgcgucaagauuaaaauuaaggcgugaucuccaacccccccaugaauguguguaacccccccca

SEQ ID NO: 542237 - RNA, 64 nt, Human Herpes Virus 1
cgugaucuccaacccccccaugaauguguguaaccccccccaaaaaaauaaagagccguaaccc

SEQ ID NO: 542238 - RNA, 64 nt, Human Herpes Virus 1
gccucggagccgagcucaaaucgcauccgagcaccccccccaaaucccggcgccggucgucacg

SEQ ID NO: 542239 - RNA, 64 nt, Human Herpes Virus 1
caucgacacgcgcguccuucuugucgucucucuucccccccaucaccccgcaauuugcacccag

SEQ ID NO: 542240 - RNA, 64 nt, Human Herpes Virus 1
gggcuacgugcucgacagccacuuccccgacugccccccccacccgcaucuggugacguuuauc

SEQ ID NO: 542241 - RNA, 64 nt, Human Herpes Virus 1
agucuuccgcugacaaccaccuuccguccccugccccccccaccccagacgacaucagcugugg

SEQ ID NO: 542242 - RNA, 64 nt, Human Herpes Virus 1
cccuggccgaggacaccccucguggccccgacagcccccccaagcgcccccgcccuaacagucu

SEQ ID NO: 542243 - RNA, 55 nt, Human Herpes Virus 1
ucaucuuccuguuagggacgaugggcccccccagaagggucugucgggcgggccu

SEQ ID NO: 542244 - RNA, 64 nt, Human Herpes Virus 1
cgcccgcagacccgcccaucgucggggcguccgacccccccaucuccccggaggagcagcugac

SEQ ID NO: 542245 - RNA, 64 nt, Human Herpes Virus 1
cccgcgugauucuguuuaguuacgacgagcucgucccccccaacacgcgcuacgcggccgacag

SEQ ID NO: 542246 - RNA, 64 nt, Human Herpes Virus 1
ggcccugccacuccggcgccgcccgccccuggcgcccccccaacgggggacccgaaaccgaaga

SEQ ID NO: 542247 - RNA, 64 nt, Human Herpes Virus 1
gggcgcaugugucucccaagggucccgcgccaaccccccccaggcugcauguuuccggacgacu

SEQ ID NO: 542248 - RNA, 64 nt, Human Herpes Virus 1
gccgacagguuucuggagcaguugcggacccaggcccccccacccgcguucuacaaggacgucc

SEQ ID NO: 542249 - RNA, 64 nt, Human Herpes Virus 1
caggggcuggccagaaagcugcacuuuagcaccgcccccccaaaccccgacgcgccauggaccc

SEQ ID NO: 542250 - RNA, 64 nt, Human Herpes Virus 1; identical to SEQ ID NO: 542229

SEQ ID NO: 542251 - RNA, 64 nt, Human Herpes Virus 1; identical to SEQ ID NO: 542228

SEQ ID NO: 542252 - RNA, 64 nt, Human Herpes Virus 2
gaaggacauucuucacuacuacguggagcaggaaugcaucgaggucguccacucgcgcgucuac

SEQ ID NO: 542253 - RNA, 64 nt, Human Herpes Virus 2
guucgcgucagaacugcuggggcgaauagucgcgugcaucgaggcucacuuucccgagcacgcg

SEQ ID NO: 542254 - RNA, 64 nt, Human Herpes Virus 2
guucgacacguggcgaugcacgcucaggacgacgcugcuggacuuugcccacggggugguagac

SEQ ID NO: 542255 - RNA, 64 nt, Human Herpes Virus 2
guguggccuauaacccggccggcgucaugggaagcugcuggaauuccaaggaccugcguucggc

SEQ ID NO: 542256 - RNA, 64 nt, Human Herpes Virus 2
cccccugccccaaacggccuuccgcggaggcgcccugcuggacgcggagcaauacuggagacgc

SEQ ID NO: 542257 - RNA, 64 nt, Human Herpes Virus 2
cguuaaaaaccucaccaagcgagccaucguggagcugcuggacgcccaccgcaucgaccacagc

SEQ ID NO: 542258 - RNA, 64 nt, Human Herpes Virus 2
ccuggucggccgcacgcgguucaucuaccuggugcugcuggaggccugucuucgcguccccaug

SEQ ID NO: 542259 - RNA, 64 nt, Human Herpes Virus 2
gcuggcggucgaucucuacgcccuggggcagacgcugcuggagcugcugguuagcguguacgug

SEQ ID NO: 542260 - RNA, 64 nt, Human Herpes Virus 2
ggccgugcggagccuggacgacgugggccgccaccugcuggauaugcaggaggagcaacucgag

SEQ ID NO: 542261 - RNA, 64 nt, Human Herpes Virus 2
ggucuacacgcgccacgagaucaaggacagcggccugcuggacuacacggagguccagcgccgc

SEQ ID NO: 542262 - RNA, 64 nt, Human Herpes Virus 2
cgauagcucuucuguccgcgaggaggccgacgcccugcuggaggcgcaugacguguuucaggcc

SEQ ID NO: 542263 - RNA, 64 nt, Human Herpes Virus 2
cacccagcagcugcagaucgaggacuggcuggcgcugcuggaggacgaguaccugagcgaggaa

SEQ ID NO: 542264 - RNA, 64 nt, Human Herpes Virus 2
gcgaggugggcuucuucggggcccggccgcggcccugcuggacuacgcaaugccccgcgcacac

SEQ ID NO: 542265 - RNA, 64 nt, Human Herpes Virus 1
ccagcucgaccgguacggagauuccgacggggagccgauuuacgacgagguggcggacgaccaa

SEQ ID NO: 542266 - RNA, 64 nt, Human Herpes Virus 1
cagaugucaacgccgcuaccgacgcucccgucgcccgauuuacagcccccagaugcccacgggc

SEQ ID NO: 542267 - RNA, 64 nt, Human Herpes Virus 1
cggcgcgcguuuacggaucgguguauaaauuaccagcacacacacaaggcgauacugucgucgg

SEQ ID NO: 542268 - RNA, 64 nt, Human Herpes Virus 2
ugccccggccccccuccccaacccccgccgauuuccgggcgagcgcguccccgcggggcggguc

SEQ ID NO: 542269 - RNA, 64 nt, Human Herpes Virus 2
cacguuggugcgccacggggugcuaccggcggccccgggcgacguuccccgagacaccagcacc

SEQ ID NO: 542270 - RNA, 64 nt, Human Herpes Virus 2
ggccggguuuuuggcccuguacgacagcggggacccgggcgagcuggcccuggacccagacacg

SEQ ID NO: 542271 - RNA, 64 nt, Human Herpes Virus 2
ccgugacgagccggaccgggacuucccguauuacccgggcgaggcccgccccgagccgcgcccg

SEQ ID NO: 542272 - RNA, 64 nt, Human Herpes Virus 2
agauguacacccgcaucgccggguuucuggcgugccgggcgacccgcggcaugcgccacaucgc

SEQ ID NO: 542273 - RNA, 64 nt, Human Herpes Virus 2
ggacgugcgcguggugauccucuacucgccgcugccgggcgaggaccuggccgcgggccgcgcc

SEQ ID NO: 542274 - RNA, 64 nt, Human Herpes Virus 2
gagccccccacgugggcaacccgacggcggggccccgggcgaaaaggcccggcccgcguccccg

SEQ ID NO: 542275 - RNA, 60 nt, Human Herpes Virus 2
gacggcgaccuggcggacggauggaugaguccgggcgacagcgaccugcuagucaugugg

SEQ ID NO: 542276 - RNA, 64 nt, Human Herpes Virus 2
gggggacggcgaccuggcggacggauggaugaguccgggcgacagcgaccugcuagucaugugg

SEQ ID NO: 542277 - RNA, 64 nt, Human Herpes Virus 2
aucucgacaacgggcgccuggcgaccaggguugcccgggcgacccuggucgccgagcugaagcg

SEQ ID NO: 542278 - RNA, 64 nt, Human Herpes Virus 2
cgccagcgacccccagcgcggacgcuuggcgcccccgggcgaacucaaccugacuacggcaucc

SEQ ID NO: 542279 - RNA, 64 nt, Human Herpes Virus 2
cgaacacgccgaccgccuggccagacgccaacgcccgggcgagcggcuugaccuggccaugcug

SEQ ID NO: 542280 - RNA, 64 nt, Human Herpes Virus 2
ccgcaggcggggcacccaaacggauccaggcccgccgggcgaucagcagcccuggaggggaccc

SEQ ID NO: 542281 - RNA, 64 nt, Human Herpes Virus 2; identical to SEQ ID NO: 542273

SEQ ID NO: 542282 - RNA, 64 nt, Human Herpes Virus 1
gaggucguuuucaugcccggucucgcuuugccgggaacgcuagccgaucccucgcgagggggag

SEQ ID NO: 542283 - RNA, 64 nt, Human Herpes Virus 2
ggcccacguacgcgagagccugcugagcauccugcugcgcgacuggcuggccaugcgaaagcag

SEQ ID NO: 542284 - RNA, 64 nt, Human Herpes Virus 2
guucgacgggacguuucggaccuucgaggcugugcugcgcgacgacagcuucgugaagacccag

SEQ ID NO: 542285 - RNA, 64 nt, Human Herpes Virus 4 (Epstein Barr virus)
augaacagcgugacaucgccgagguucuugaccaccucaagacgaaucgggaccuggggcugga

SEQ ID NO: 542286 - RNA, 64 nt, Human Herpes Virus 4 (Epstein Barr virus); identical to SEQ ID NO: 542285

SEQ ID NO: 542287 - RNA, 62 nt, Human Herpes Virus 2
gcuccccgccuccacccugguccgccuucucguccacgcauauaagcgcggccugaagacgg

SEQ ID NO: 542288 - RNA, 64 nt, Human Herpes Virus 4 (Epstein Barr virus)
acuaaccaagauuaauccaaccaccgucauguccagcaucuacgguaaggcgguggcggccaag

SEQ ID NO: 542289 - RNA, 64 nt, Human Herpes Virus 1; identical to SEQ ID NO: 541852

SEQ ID NO: 542290 - RNA, 64 nt, Human Herpes Virus 1; identical to SEQ ID NO: 541853

SEQ ID NO: 542291 - RNA, 64 nt, Human Herpes Virus 1; identical to SEQ ID NO: 541854

SEQ ID NO: 542292 - RNA, 64 nt, Human Herpes Virus 1; identical to SEQ ID NO: 541855

SEQ ID NO: 542293 - RNA, 64 nt, Human Herpes Virus 1; identical to SEQ ID NO: 541856

SEQ ID NO: 542294 - RNA, 64 nt, Human Herpes Virus 1; identical to SEQ ID NO: 541857

SEQ ID NO: 542295 - RNA, 64 nt, Human Herpes Virus 1; identical to SEQ ID NO: 541858

SEQ ID NO: 542296 - RNA, 64 nt, Human Herpes Virus 1; identical to SEQ ID NO: 541859

SEQ ID NO: 542297 - RNA, 64 nt, Human Herpes Virus 1; identical to SEQ ID NO: 541860

SEQ ID NO: 542298 - RNA, 64 nt, Human Herpes Virus 1; identical to SEQ ID NO: 541861

SEQ ID NO: 542299 - RNA, 64 nt, Human Herpes Virus 1; identical to SEQ ID NO: 541862

SEQ ID NO: 542300 - RNA, 64 nt, Human Herpes Virus 1; identical to SEQ ID NO: 541863

SEQ ID NO: 542301 - RNA, 64 nt, Human Herpes Virus 1; identical to SEQ ID NO: 541864

SEQ ID NO: 542302 - RNA, 64 nt, Human Herpes Virus 1; identical to SEQ ID NO: 541865

SEQ ID NO: 542303 - RNA, 64 nt, Human Herpes Virus 1; identical to SEQ ID NO: 541866

SEQ ID NO: 542304 - RNA, 64 nt, Human Herpes Virus 1; identical to SEQ ID NO: 541867

SEQ ID NO: 542305 - RNA, 64 nt, Human Herpes Virus 1; identical to SEQ ID NO: 541868

SEQ ID NO: 542306 - RNA, 64 nt, Human Herpes Virus 1; identical to SEQ ID NO: 541869

SEQ ID NO: 542307 - RNA, 64 nt, Human Herpes Virus 1; identical to SEQ ID NO: 541852

SEQ ID NO: 542308 - RNA, 64 nt, Human Herpes Virus 4 (Epstein Barr virus)
agacacaucuggaccagaaggcuccggcggcaguggaccucaaagaagagggggugauaaccau

SEQ ID NO: 542309 - RNA, 64 nt, Human Herpes Virus 4 (Epstein Barr virus)
acaaggagcugaagcgcgccccauccgaagcccgggaccucaugcagagccucuuucugaccuc

SEQ ID NO: 542310 - RNA, 64 nt, Human Herpes Virus 4 (Epstein Barr virus)
caacagccugcggagguucggccgccgcgggccaggaccucaucagcgucccccgcaacaccuu

SEQ ID NO: 542311 - RNA, 64 nt, Human Herpes Virus 4 (Epstein Barr virus)
ucuccgaccuccgccccaccgugggcaugaucagggaccucagcgccucauucaugaccugccc

SEQ ID NO: 542312 - RNA, 64 nt, Human Herpes Virus 4 (Epstein Barr virus)
agggcgugccccagcuccgccaguuuuacaacucggaccucagccgcugcaugcacgaggcgcu

SEQ ID NO: 542313 - RNA, 64 nt, Human Herpes Virus 4 (Epstein Barr virus); identical to SEQ ID NO: 537373

SEQ ID NO: 542314 - RNA, 64 nt, Human Herpes Virus 4 (Epstein Barr virus); identical to SEQ ID NO: 537374

SEQ ID NO: 542315 - RNA, 64 nt, Human Herpes Virus 4 (Epstein Barr virus); identical to SEQ ID NO: 537375

SEQ ID NO: 542316 - RNA, 63 nt, Human Herpes Virus 1
cugcuccccgagaccgcggguaaccacgugaugccccccgaguacccgacggcccccgcgucg

SEQ ID NO: 542317 - RNA, 63 nt, Human Herpes Virus 1
ggucccgcuggugugacguuuuccucguccgcgccccccgacccucccauggauuuaacaaac

SEQ ID NO: 542318 - RNA, 63 nt, Human Herpes Virus 1
cgcgggacagggccugcuucggcgcguccugcgccccccgaucucucgccgcgacggcccagg

SEQ ID NO: 542319 - RNA, 63 nt, Human Herpes Virus 1
cuuauccacaugaagccacuguuuuccgccccaccccccgacgccagcuuuccgcugagccuc

SEQ ID NO: 542320 - RNA, 63 nt, Human Herpes Virus 1
cccagagcgacccgggguucccgggcccccgucccccccgaccccccaacgaucccacgggcc

SEQ ID NO: 542321 - RNA, 63 nt, Human Herpes Virus 1
ccugguguuuacgaacgaguuugacgcggaggcccccccgagcgagcgcgggaccggggguuu

SEQ ID NO: 542322 - RNA, 63 nt, Human Herpes Virus 1
cuggaccucuccgacagcgaucuggacgaggacccccccgagccggcggagagccgccgcgac

SEQ ID NO: 542323 - RNA, 63 nt, Human Herpes Virus 1
cagcgggaccccccggcucccgccuccccccgcccccccgaggucuuggcccagcgcccccga

SEQ ID NO: 542324 - RNA, 63 nt, Human Herpes Virus 1
acgagcuaaucgcgauuuccgacgaacgcggacccccccgacaugaccgcccgccccucgcca

SEQ ID NO: 542325 - RNA, 63 nt, Human Herpes Virus 1
ggucgucgggggacggugcggcgcggacaacauccccccgaccagcgccggguggcgccugug

SEQ ID NO: 542326 - RNA, 63 nt, Human Herpes Virus 1
gaacgaggccgcagccuucucccggugccuuucccccccgaccggcacccggccucucacaca

SEQ ID NO: 542327 - RNA, 63 nt, Human Herpes Virus 1
cgagccacccgagcgggccgcgugauacaccgcccccccgaccgccgguuggggcccggcggc

SEQ ID NO: 542328 - RNA, 63 nt, Human Herpes Virus 1
gcguuccacggggaugacccguuuggggaggggccccccgacaaaaagggagaccugacguug

SEQ ID NO: 542329 - RNA, 63 nt, Human Herpes Virus 1
cuuuaacgagaacgacgugcaaguuccccggcgccccccgaugccggaacacauuuacaccuu

SEQ ID NO: 542330 - RNA, 63 nt, Human Herpes Virus 1
ucuucgcgcccuagacgcccggacccccccggcccccccgacgggccaagaggccgacccgca

SEQ ID NO: 542331 - RNA, 63 nt, Human Herpes Virus 1
gucggggacacgcccgaccgccuggggcccuggccccccgaggccaugggggacgcggugagu

SEQ ID NO: 542332 - RNA, 63 nt, Human Herpes Virus 1
cugcggccccugguccagcugcagccccccccgccccccgaggugggcaccagccuccuguug

SEQ ID NO: 542333 - RNA, 63 nt, Human Herpes Virus 1
cguggaggaugugcugcgcgaaugucacuggacccccccgagucgcucucagacccggcgggc

SEQ ID NO: 542334 - RNA, 63 nt, Human Herpes Virus 1
ccccgcgggacacacgcgcagacugucgacggcccccccgaccgaugucagccugggggacga

SEQ ID NO: 542335 - RNA, 63 nt, Human Herpes Virus 1
gggccggacgcacacccaccaccgccccccgggccccccgaacccagcggguggcgacuaagg

SEQ ID NO: 542336 - RNA, 63 nt, Human Herpes Virus 1; identical to SEQ ID NO: 542316

SEQ ID NO: 542337 - RNA, 64 nt, Human Herpes Virus 2
cgagcgccgcuucagcgccggccagcccagccuccugcgcgagacggcgcucaucuggcucgac

SEQ ID NO: 542338 - RNA, 64 nt, Human Herpes Virus 2
gccgcacgccgacgcgccccgccugcgcgccuggcugcgcgagcugcgguucgugcgcgacgcg

SEQ ID NO: 542339 - RNA, 64 nt, Human Herpes Virus 4 (Epstein Barr virus)
cccagcggggccaccccccacccggagcggggcagcggcccagcggacccaccggcggccgccc

SEQ ID NO: 542340 - RNA, 64 nt, Human Herpes Virus 4 (Epstein Barr virus); identical to SEQ ID NO: 542339

SEQ ID NO: 542341 - RNA, 64 nt, Human Herpes Virus 4 (Epstein Barr virus); identical to SEQ ID NO: 542339

SEQ ID NO: 542342 - RNA, 64 nt, Human Herpes Virus 4 (Epstein Barr virus)
acccccucuccuucaaggcgggcaagcggcggcggcggcccagacagaggagaggcggaggcac

SEQ ID NO: 542343 - RNA, 64 nt, Human Herpes Virus 4 (Epstein Barr virus)
cggaggggcggguauagagcauaugccgguggccgcggcccaggucgagcacccuaaaacguau

SEQ ID NO: 542344 - RNA, 64 nt, Human Herpes Virus 4 (Epstein Barr virus)
ggcgcucgucguucaggaacagccuccgccgccugcggcccacugaaaaaccagacacgucguu

SEQ ID NO: 542345 - RNA, 64 nt, Human Herpes Virus 4 (Epstein Barr virus)
caccuguuggaggcugaggagaaggcgaggccgggcggcccagaggagggcgcggucccgggcc

SEQ ID NO: 542346 - RNA, 64 nt, Human Herpes Virus 1
ggcaauuggaccggcgcccccgacgugucggcgcugggcgcacagggcgugcugcugcugucca

SEQ ID NO: 542347 - RNA, 64 nt, Human Herpes Virus 1; identical to SEQ ID NO: 542346

SEQ ID NO: 542348 - RNA, 62 nt, Human immunodeficiency virus type 1 (BLAI); identical to SEQ ID NO: 542005

SEQ ID NO: 542349 - RNA, 64 nt, Human Herpes Virus 4 (Epstein Barr virus)
ccggccgccgccucccucugauuccaucuacaggggcccgcacggaucagcugccacgcaccca

SEQ ID NO: 542350 - RNA, 64 nt, Human Herpes Virus 4 (Epstein Barr virus)
acgccaccaagggcgucgaguuugaccuggaggcggcccgcagagaggaaaaagggauugggca

SEQ ID NO: 542351 - RNA, 64 nt, Human Herpes Virus 4 (Epstein Barr virus)
ugggcaaccccagggccgcgaccuacguggacguggcccgcaacugggcccucuucaucaacaa

SEQ ID NO: 542352 - RNA, 64 nt, Human Herpes Virus 4 (Epstein Barr virus)
ucgaccgggaugugauggguggagaggccaccguggcccgcagacacauucgggugaaggcucg

SEQ ID NO: 542353 - RNA, 64 nt, Human Herpes Virus 4 (Epstein Barr virus)
ugcgcgucuggggggacguggucuacugggagcuggcccgcaugcgcaaccacuuccucuacag

SEQ ID NO: 542354 - RNA, 64 nt, Human Herpes Virus 2; identical to SEQ ID NO: 541487

SEQ ID NO: 542355 - RNA, 64 nt, Human Herpes Virus 2; identical to SEQ ID NO: 541488

SEQ ID NO: 542356 - RNA, 64 nt, Human Herpes Virus 2; identical to SEQ ID NO: 541489

SEQ ID NO: 542357 - RNA, 64 nt, Human Herpes Virus 2; identical to SEQ ID NO: 541490

SEQ ID NO: 542358 - RNA, 64 nt, Human Herpes Virus 2; identical to SEQ ID NO: 541491

SEQ ID NO: 542359 - RNA, 64 nt, Human Herpes Virus 2; identical to SEQ ID NO: 541492

SEQ ID NO: 542360 - RNA, 64 nt, Human Herpes Virus 2; identical to SEQ ID NO: 541493

SEQ ID NO: 542361 - RNA, 64 nt, Human Herpes Virus 2; identical to SEQ ID NO: 541494

SEQ ID NO: 542362 - RNA, 64 nt, Human Herpes Virus 2; identical to SEQ ID NO: 541495

SEQ ID NO: 542363 - RNA, 64 nt, Human Herpes Virus 2; identical to SEQ ID NO: 541489

SEQ ID NO: 542364 - RNA, 62 nt, Human Herpes Virus 2
agggcaggacgccccccgcgagacagccccgcgcggcccaggagccccccauagucaucagc

SEQ ID NO: 542365 - RNA, 62 nt, Human Herpes Virus 2
ugcccacggggugguagacugcuuugcgccgggcggcccaagcggaccgaccagcuucccca

SEQ ID NO: 542366 - RNA, 62 nt, Human Herpes Virus 2
acguccugcacuuugcgugccucguguaucucgcggcccauuuuugcaccagggggguccug

SEQ ID NO: 542367 - RNA, 62 nt, Human Herpes Virus 2
cggaggccggcgccuuaguuaacgccagcagcgcggcccacgugaacguggacacggcccgg

SEQ ID NO: 542368 - RNA, 62 nt, Human Herpes Virus 2
cggacccgcgcgcgucggccgacuccgauuccgcggcccacgccgccgcaccccaggcggac

SEQ ID NO: 542369 - RNA, 62 nt, Human Herpes Virus 2
cuagguuuguuggcgccuuuauggccgccaaggcggcccacuuggaauuggaggcgcggcua

SEQ ID NO: 542370 - RNA, 62 nt, Human Herpes Virus 2
gcccuuuucugcgagaucuuccuguaccugacgcggcccaaggcgcugcgccugccuucgaa

SEQ ID NO: 542371 - RNA, 62 nt, Human Herpes Virus 2
agcgcgucgugcgcccccaccagcugucccccgcggcccagacggcgcugcugcgucgcuuu

SEQ ID NO: 542372 - RNA, 62 nt, Human Herpes Virus 2
gggccgcggcucccgccgccgcgacggaggcggcggcccaccugucccuggggaugggggaa

SEQ ID NO: 542373 - RNA, 62 nt, Human Herpes Virus 2
ugcucgccucgucgggguuugcguucgucaacgcggcccacgcccacgacgcgauucgccuc

SEQ ID NO: 542374 - RNA, 62 nt, Human Herpes Virus 2
acgcgcguucgaggacgcagccaguacgcaccgcggcccaucgcgccugaccccgcaucccg

SEQ ID NO: 542375 - RNA, 62 nt, Human Herpes Virus 2
cccccgcccccccucgccacacggcgaagauggcggcccagccgggaccugcuccagcgggg

SEQ ID NO: 542376 - RNA, 62 nt, Human Herpes Virus 2
cgacggcgcaccucgggguaugcgacgagcuggcggcccaggucucgcacgaggguaacgug

SEQ ID NO: 542377 - RNA, 62 nt, Human Herpes Virus 2
aguacgccgccgcgguggcgggguugcgcgacgcggcccacaggcuccagcaguacauguuc

SEQ ID NO: 542378 - RNA, 62 nt, Human Herpes Virus 2
ggcgacugcgaccccagccugcacgugcugcugcggcccacccugcucccgaagcugcuggu

SEQ ID NO: 542379 - RNA, 62 nt, Human Herpes Virus 2; identical to SEQ ID NO: 542364

SEQ ID NO: 542380 - RNA, 64 nt, Human Herpes Virus 4 (Epstein Barr virus)
aguaggugccuccagagccccuuuugccccccuggcggcccagcccgacccccgggcgccccca

SEQ ID NO: 542381 - RNA, 64 nt, Human Herpes Virus 4 (Epstein Barr virus); identical to SEQ ID NO: 542380

SEQ ID NO: 542382 - RNA, 64 nt, Human Herpes Virus 4 (Epstein Barr virus)
ggcgcgggucugggaugggacuuacgccccgaaagcggcccagcagauccagggcccguuccag

SEQ ID NO: 542383 - RNA, 64 nt, Human Herpes Virus 4 (Epstein Barr virus); identical to SEQ ID NO: 542339

SEQ ID NO: 542384 - RNA, 64 nt, Human Herpes Virus 4 (Epstein Barr virus); identical to SEQ ID NO: 542339

SEQ ID NO: 542385 - RNA, 64 nt, Human Herpes Virus 4 (Epstein Barr virus); identical to SEQ ID NO: 542339

SEQ ID NO: 542386 - RNA, 64 nt, Human Herpes Virus 4 (Epstein Barr virus); identical to SEQ ID NO: 542339

SEQ ID NO: 542387 - RNA, 64 nt, Human Herpes Virus 4 (Epstein Barr virus); identical to SEQ ID NO: 542339

SEQ ID NO: 542388 - RNA, 64 nt, Human Herpes Virus 4 (Epstein Barr virus); identical to SEQ ID NO: 542339

SEQ ID NO: 542389 - RNA, 64 nt, Human Herpes Virus 4 (Epstein Barr virus); identical to SEQ ID NO: 542339

SEQ ID NO: 542390 - RNA, 64 nt, Human Herpes Virus 4 (Epstein Barr virus); identical to SEQ ID NO: 542339

SEQ ID NO: 542391 - RNA, 64 nt, Human Herpes Virus 4 (Epstein Barr virus); identical to SEQ ID NO: 542339

SEQ ID NO: 542392 - RNA, 64 nt, Human Herpes Virus 2
uccgggcacgccugugcguuuguuguauguaaccugaccggagucccggugacccuacaagccg

SEQ ID NO: 542393 - RNA, 64 nt, Human Herpes Virus 2
gagccacguaaagaacuuuuugcugaucgauacgggcguguacgcccacggccacagccugcgc

SEQ ID NO: 542394 - RNA, 64 nt, Human Herpes Virus 2
guucgucucccugccggucgcgugcgacgcccaaggcguguacgacccguacacggucgcggcg

SEQ ID NO: 542395 - RNA, 64 nt, Human Herpes Virus 2
ccggcccugcaacccgcggggacgcgcggccggcggcguguacgcgggggacaaggagggggac

SEQ ID NO: 542396 - RNA, 64 nt, Human Herpes Virus 2
cccgaccuccgaaggucuguaccgcuacccgccgggcguguaccucacguacaacuccgacugu

SEQ ID NO: 542397 - RNA, 64 nt, Human Herpes Virus 1
ucugcccggccaucaagaaguacgaggguggggucgacgccaccacccgguucauccuggacaa

SEQ ID NO: 542398 - RNA, 64 nt, Human Herpes Virus 1
gccgguggucccucagcgguagacccacacgcgccgacgccagaggccggcgcuggucuugcgg

SEQ ID NO: 542399 - RNA, 64 nt, Human Herpes Virus 1
gcgggaagcgccuccuggaggugauggacagucucgacgccaagcagugguccguggcgcaggc

SEQ ID NO: 542400 - RNA, 64 nt, Human Herpes Virus 1
uccacaugaagccacuguuuuccgccccaccccccgacgccagcuuuccgcugagccucauguc

SEQ ID NO: 542401 - RNA, 64 nt, Human Herpes Virus 1
ccccggagcgaaaggcgcccgccgccgacaccaucgacgccaccacgcgguugguccugcgcuc

SEQ ID NO: 542402 - RNA, 64 nt, Human Herpes Virus 1
ugcgcaacaccauacgggagguggaggcucgauucgacgccaccgcggaacccgugugcaagcu

SEQ ID NO: 542403 - RNA, 64 nt, Human Herpes Virus 1
agcgccgccgggcccgcgcggcgguggccggccgcgacgccacgggccgcuucacggccgggca

SEQ ID NO: 542404 - RNA, 64 nt, Human Herpes Virus 1
cgcuggacggccgggcggcggccucggggaccaccgacgccauggcgcccggcgcgccggacuu

SEQ ID NO: 542405 - RNA, 64 nt, Human Herpes Virus 1
ugcgcuucgccgacaucgacacggucauccacgccgacgccaacgccgccauguuugcgggccu

SEQ ID NO: 542406 - RNA, 64 nt, Human Herpes Virus 1
uggaccugggggacugcaucggcaaggacgcccgcgacgccauggaccgcaucuucgcccgcag

SEQ ID NO: 542407 - RNA, 64 nt, Human Herpes Virus 1
gcuccgaguacggcggcuccuuccgauucucuuccgacgccauauccaccaccuucaccaccaa

SEQ ID NO: 542408 - RNA, 64 nt, Human Herpes Virus 1
cagcgcgcccccgacgaccagacgacgaagacuccgacgccaccccccggcccuguggaccuug

SEQ ID NO: 542409 - RNA, 64 nt, Human Herpes Virus 1
gagucggccucgaccgucaccccacgcuauucaccgacgccacccaaccggcuucagcuggccc

SEQ ID NO: 542410 - RNA, 64 nt, Human Herpes Virus 1
gggacgcggugagucaguacugcagcauguaucacgacgccaagcgcgcgcuggucgcgucccu

SEQ ID NO: 542411 - RNA, 64 nt, Human Herpes Virus 1
gcuggaagagcaccgcaguuauguggccaacccgcgacgccacgucauccacgacgccccagag

SEQ ID NO: 542412 - RNA, 64 nt, Human Herpes Virus 1; identical to SEQ ID NO: 542404

SEQ ID NO: 542413 - RNA, 64 nt, Human Herpes Virus 1; identical to SEQ ID NO: 542403

SEQ ID NO: 542414 - RNA, 64 nt, Human Herpes Virus 2
cccgcgcgaucucugcgagcgccuggcggcggcccugcgcgagucgccgggggcgucguuccgc

SEQ ID NO: 542415 - RNA, 64 nt, Human Herpes Virus 1
ggccaaucggcggccgccagcgcggcggggcccggccaaccagcguccgccgagucuucggggc

SEQ ID NO: 542416 - RNA, 64 nt, Human Herpes Virus 1
ggaccagaagcgcucccuccugagcguguuucgcgccaaccaguacccggaccuacgucgggug

SEQ ID NO: 542417 - RNA, 64 nt, Human Herpes Virus 1
gcaaugccaccgggcuggcccuggugcugccgcggccaaccaucaccauggaauuugggguccg

SEQ ID NO: 542418 - RNA, 64 nt, Human Herpes Virus 1
gaggaacuucaaguuucgcgacggucugggcgaggccaaccacgccaugucccugacgcuggac

SEQ ID NO: 542419 - RNA, 64 nt, Human Herpes Virus 1
ggauuuuagccgugucaucgcagagccguucaacgccaaccaccgaucgaucggggagaaauuu

SEQ ID NO: 542420 - RNA, 64 nt, Human Herpes Virus 1
uccaggcucuggccaaauuuaggugcgccgggccgccaaccaacgaggcggaggaucgccagau

SEQ ID NO: 542421 - RNA, 64 nt, Human Herpes Virus 1
cccccaagacccccgccgcauccugacggacgccgccaaccaaggacaugcggguccuggagau

SEQ ID NO: 542422 - RNA, 64 nt, Human Herpes Virus 1; identical to SEQ ID NO: 542415

SEQ ID NO: 542423 - RNA, 64 nt, Human Herpes Virus 1
aaacuuacgacaggccauucgccgcaccgugagugccaaccaacgagcaccccgaacgacgggc

SEQ ID NO: 542424 - RNA, 64 nt, Human Herpes Virus 1
ccacgcgcggcugguccacacccaguggcuccgggccaaccaagagacgucgccccuguggccc

SEQ ID NO: 542425 - RNA, 64 nt, Human Herpes Virus 2
auuucgaguacgugcuucgcgccccccgagcgggcgcgcucaucaccggcuccgaugucauccu

SEQ ID NO: 542426 - RNA, 64 nt, Human Herpes Virus 2
ucauuaucuucgcccuggagcacuuuuuccuccgcgcgcucacgggaucggcccccgcggacau

SEQ ID NO: 542427 - RNA, 64 nt, Human Herpes Virus 2
cgcgguuucugggggacgccgucgaccgcgagcccgcgcucaugcuggaguacuucugucggug

SEQ ID NO: 542428 - RNA, 64 nt, Human Herpes Virus 2
ugaugaaacacggccugcgcaacagccaguucaucgcgcucaugcccaccgccgccucggccca

SEQ ID NO: 542429 - RNA, 64 nt, Human Herpes Virus 2
uugccacuauggcagacauccccccggacccgcccgcgcucaacacgacgccugcgaaucaugc

SEQ ID NO: 542430 - RNA, 64 nt, Human Herpes Virus 2
ggucaucggcgguauugcguuuuggguacgccgccgcgcucagauggcccccaagcgccuacgu

SEQ ID NO: 542431 - RNA, 64 nt, Human Herpes Virus 2
accuccggccggacgucgcgccggccgagguggucgcgcucaugcgcggccucaacagccuggu

SEQ ID NO: 542432 - RNA, 64 nt, Human Herpes Virus 2
gcgagagcgcggcgggggagaacgcgcugaccuacgcgcucauggcgggguacuucaagaugag

SEQ ID NO: 542433 - RNA, 64 nt, Human Herpes Virus 2
acaucaacucgggucagcuggaggccgacgacgccugcgcgaaccucuaucauaccaacacggu

SEQ ID NO: 542434 - RNA, 64 nt, Human Herpes Virus 2
gcucgagcccgacggcgacgcgcccccgcuggugcugcgcgacgacgcggacgcgggcccgccc

SEQ ID NO: 542435 - RNA, 64 nt, Human Herpes Virus 2
cucugggccugcgaauggcaaugccgcgggacuucugcgcgauuauucacgcccccgcgguauc

SEQ ID NO: 542436 - RNA, 64 nt, Human Herpes Virus 2
gagccacguacgaucugcaggccgugaaagacaucugcgcgaccuacgcaaucccccacgaccc

SEQ ID NO: 542437 - RNA, 64 nt, Human Herpes Virus 2
ucaucgucggcaccgcucucaucucccggggcgccugcgcgaucacacacccccuguuucuaac

SEQ ID NO: 542438 - RNA, 64 nt, Human Herpes Virus 2
ccccguggacugcgcccaucaccugcgcgagauccugcgcgagauucaacugguguuuacgggg

SEQ ID NO: 542439 - RNA, 64 nt, Human Herpes Virus 2
cuuggugcucccccccguggacugcgcccaucaccugcgcgagauccugcgcgagauucaacug

SEQ ID NO: 542440 - RNA, 64 nt, Human Herpes Virus 2
ccacguggccaacgcgcccaacuuccccccggcccugcgcgaccuggcgcgcgacgucccccug

SEQ ID NO: 542441 - RNA, 64 nt, Human Herpes Virus 2; identical to SEQ ID NO: 542338

SEQ ID NO: 542442 - RNA, 64 nt, Human Herpes Virus 2; identical to SEQ ID NO: 542434

SEQ ID NO: 542443 - RNA, 64 nt, Human Herpes Virus 2
ccccaauaacaccuacgcguccgucgaggacgugcugcgcgagugucacuggaccgccccgagc

SEQ ID NO: 542444 - RNA, 64 nt, Human Herpes Virus 2
ccgcgccccugcucguugauggccggacgccgcccugcgcgacgcgggccucuucuucccccga

SEQ ID NO: 542445 - RNA, 64 nt, Human Herpes Virus 2
cacgaugcagauggccgacaacaucgagcagcugcugcgcgagcuguacgugaucgccaggggg

SEQ ID NO: 542446 - RNA, 64 nt, Human Herpes Virus 4 (Epstein Barr virus)
caauagaaguggaaacccucagucacgggacauuaaccucaaccacaaaauggggguuggagaa

SEQ ID NO: 542447 - RNA, 64 nt, Human Herpes Virus 4 (Epstein Barr virus)
uugcagauccuggcguauggguuaccgcacgcauaaccucaaaguaaacaguuuugagucaggg

SEQ ID NO: 542448 - RNA, 62 nt, Human Herpes Virus 2
cagagcucugcguugcaguugcccgggcccgucccccgcacggacuguguggccuauaaccc

SEQ ID NO: 542449 - RNA, 62 nt, Human Herpes Virus 2
ccccggucccgcucccccgcuacaucagcccucccccgcacacgcccaccccccuccgccgc

SEQ ID NO: 542450 - RNA, 62 nt, Human Herpes Virus 2
cccccccuccgcugauggcgcugucccugacccccccgcacgcggacggccgcgccccgguc

SEQ ID NO: 542451 - RNA, 62 nt, Human Herpes Virus 2
gaugcgucagacggcugguugguugacacacccccccgcaaauccaagcgaccccgaaucaa

SEQ ID NO: 542452 - RNA, 62 nt, Human Herpes Virus 2
acccucagucgacccaagcgcggaaccgaccgcccccgcaaccacuacuccccccgacgaga

SEQ ID NO: 542453 - RNA, 62 nt, Human Herpes Virus 2
uggugcugcgcgacgacgcggacgcgggcccgcccccgcagauacgcugggcgucggccgcg

SEQ ID NO: 542454 - RNA, 62 nt, Human Herpes Virus 2
agcguguuuguggcgaccgucaagagccugggcccccgcacccagcagcugcagaucgagga

SEQ ID NO: 542455 - RNA, 62 nt, Human Herpes Virus 2
gcgaguuugggugucgcuggaccccgcugccccccccgcacggagcggcggcgccgcguccg

SEQ ID NO: 542456 - RNA, 61 nt, Human Herpes Virus 2
ucguggcgggcgcggcacaccaccggauacccccccgcagucaccccacgaugaagcgcca

SEQ ID NO: 542457 - RNA, 62 nt, Human Herpes Virus 2
ggugcaggcgccaccgcgaggaccuccccgagcccccgcacgucgacgcggccgaccggggu

SEQ ID NO: 542458 - RNA, 62 nt, Human Herpes Virus 2
ccgcgcaugucguuucucuccgcgggacaacgcccccgcagacuguccaccaccgcccccau

SEQ ID NO: 542459 - RNA, 62 nt, Human Herpes Virus 2; identical to SEQ ID NO: 542453

SEQ ID NO: 542460 - RNA, 62 nt, Human Herpes Virus 2
cgcuugaagggcacucgcuuccgaccgacgggcccccgcaccggggcggcgaccaugauccg

SEQ ID NO: 542461 - RNA, 64 nt, Human Herpes Virus 4 (Epstein Barr virus)
gcaaaucuugaggauguucagcgggaguuuuccgggcugcgaguaauuggugaugaggacgagg

SEQ ID NO: 542462 - RNA, 64 nt, Human Herpes Virus 4 (Epstein Barr virus)
uacacgcggagaagagcuccccccacggccgucgggcugcgacccccgcgaaaccccgucuucc

SEQ ID NO: 542463 - RNA, 64 nt, Human Herpes Virus 2
gccagcuccagguggcccgccacgaaacgggcgggggggucaacuucacgcucacccagccgcg

SEQ ID NO: 542464 - RNA, 64 nt, Human Herpes Virus 2
cguguccggauagcgcguucgggcugucgcgcgugggggucaugcacuuugccuccccggccga

SEQ ID NO: 542465 - RNA, 64 nt, Human Herpes Virus 2
ggugccgaucugggaccgcgccgcggagacauucgaguaccagaucgaacucggcggcgagcug

SEQ ID NO: 542466 - RNA, 64 nt, Human Herpes Virus 1
ccugcagcagggcgaggcguuggccugguauaucacgggcgaugggauucuugaccugacggau

SEQ ID NO: 542467 - RNA, 61 nt, Human Herpes Virus 1
ucacugccucccccgcccuggacacccucuucgucgucagcaccgucauccacaccuuauc

SEQ ID NO: 542468 - RNA, 61 nt, Human Herpes Virus 1
gccgcgcccgccggcccagccgccgcggagacgucgucacggccgguggcggccaucggcg

SEQ ID NO: 542469 - RNA, 61 nt, Human Herpes Virus 1
uggucuugcgggaccaacacggcuucauguccgucgucaacaccaacaucagcgaguuugu

SEQ ID NO: 542470 - RNA, 61 nt, Human Herpes Virus 1
uccugguacccaucacccacaacgccagcuacgucgucacccacuccccucugccccgggg

SEQ ID NO: 542471 - RNA, 61 nt, Human Herpes Virus 1
uggcagaccgcggucucccguccgaggcccccgucgucacgaccucacccgccgguccgcc

SEQ ID NO: 542472 - RNA, 61 nt, Human Herpes Virus 1; identical to SEQ ID NO: 542468

SEQ ID NO: 542473 - RNA, 64 nt, Human Herpes Virus 1
cgauaacaucugcauuuuuucgucgacggucuccuucgcggagaucguggcccgguucugccgu

SEQ ID NO: 542474 - RNA, 64 nt, Human Herpes Virus 1
ucgggcguccgucgucgugccgggauuaccuccguucgcggaccgauugacaaaaggacaugga

SEQ ID NO: 542475 - RNA, 64 nt, Human Herpes Virus 4 (Epstein Barr virus)
agaucgcccccuuuuccgcaucagagcaccccgccuucuccaugguugaguccguaaaacgagu

SEQ ID NO: 542476 - RNA, 64 nt, Human Herpes Virus 4 (Epstein Barr virus)
gguugccguagcccauaauggaacggcgcgugaccuucuccaccgagacccggcaggggguccu

SEQ ID NO: 542477 - RNA, 64 nt, Human Herpes Virus 4 (Epstein Barr virus)
cggccgcccccugaccucccagccgccccggcuccuucuccacuacgagggggcgcggcuggau

SEQ ID NO: 542478 - RNA, 64 nt, Human Herpes Virus 4 (Epstein Barr virus)
cauccagugcgucagcaacuagccgccccggcuccuucuccacuuccuggccggccgcccccug

SEQ ID NO: 542479 - RNA, 64 nt, Human Herpes Virus 4 (Epstein Barr virus); identical to SEQ ID NO: 541962

SEQ ID NO: 542480 - RNA, 64 nt, Human Herpes Virus 4 (Epstein Barr virus); identical to SEQ ID NO: 541963

SEQ ID NO: 542481 - RNA, 64 nt, Human Herpes Virus 4 (Epstein Barr virus); identical to SEQ ID NO: 541964

SEQ ID NO: 542482 - RNA, 64 nt, Human Herpes Virus 4 (Epstein Barr virus); identical to SEQ ID NO: 541965

SEQ ID NO: 542483 - RNA, 64 nt, Human Herpes Virus 1
acacggugagggcccugucgcccacccacccggagcccaccacggacgaggaugacgacgaccu

SEQ ID NO: 542484 - RNA, 64 nt, Human Herpes Virus 1
ggcgcugcggcaccccgccgaccugccucaccuggcccaccagcgcgccccgccaggccggcag

SEQ ID NO: 542485 - RNA, 64 nt, Human Herpes Virus 1
agguccuuaacgcgaccggggccgauagugccacgcccaccacguucgagcucgggguuaacgg

SEQ ID NO: 542486 - RNA, 64 nt, Human Herpes Virus 1
ccucaccaaacagacaaucgugggguuguuggacgcccaccacaucgaccacagcgccugccgg

SEQ ID NO: 542487 - RNA, 64 nt, Human Herpes Virus 1
accacggccuuuucccgcgacagccgguggccacgcccaccacagcuguuugacucacgcgcuc

SEQ ID NO: 542488 - RNA, 64 nt, Human Herpes Virus 1; identical to SEQ ID NO: 542483

SEQ ID NO: 542489 - RNA, 64 nt, Human Herpes Virus 2; identical to SEQ ID NO: 536887

SEQ ID NO: 542490 - RNA, 64 nt, Human Herpes Virus 2; identical to SEQ ID NO: 536892

SEQ ID NO: 542491 - RNA, 64 nt, Human Herpes Virus 2; identical to SEQ ID NO: 536896

SEQ ID NO: 542492 - RNA, 64 nt, Human Herpes Virus 2; identical to SEQ ID NO: 536900

SEQ ID NO: 542493 - RNA, 64 nt, Human Herpes Virus 2; identical to SEQ ID NO: 536906

SEQ ID NO: 542494 - RNA, 64 nt, Human Herpes Virus 2; identical to SEQ ID NO: 536911

SEQ ID NO: 542495 - RNA, 64 nt, Human Herpes Virus 2; identical to SEQ ID NO: 536917

SEQ ID NO: 542496 - RNA, 64 nt, Human Herpes Virus 2; identical to SEQ ID NO: 536889

SEQ ID NO: 542497 - RNA, 64 nt, Human Herpes Virus 2; identical to SEQ ID NO: 536908

SEQ ID NO: 542498 - RNA, 62 nt, Human Herpes Virus 2
uugagccgaagcggcuggugcgcaccgaaaaccggcgcgaccucggccucgugggggccgug

SEQ ID NO: 542499 - RNA, 62 nt, Human Herpes Virus 2
gcgggagcugccgggacaagauacaacggacccggcgcgacaacgcacccccgccgcucccc

SEQ ID NO: 542500 - RNA, 64 nt, Human Herpes Virus 1
ugugcaccuuugacggcgcggccguugugcgguccggagacauggcccccguuauacgcuaucc

SEQ ID NO: 542501 - RNA, 64 nt, Human Herpes Virus 1
caaggacccugggggaggaggaggaggagggggggggagggaggaauaggcgggcgggcgagga

SEQ ID NO: 542502 - RNA, 64 nt, Human Herpes Virus 1
cuuccgccuccucgggcggggccgucggugcccugggagggagacaagaggaaaccucccucgg

SEQ ID NO: 542503 - RNA, 64 nt, Human Herpes Virus 1
gaccccgugguuacccgggggguugucggugaaggggagggauucauuccccaaccccggucuc

SEQ ID NO: 542504 - RNA, 64 nt, Human Herpes Virus 1; identical to SEQ ID NO: 542502

SEQ ID NO: 542505 - RNA, 64 nt, Human Herpes Virus 1; identical to SEQ ID NO: 542501

SEQ ID NO: 542506 - RNA, 64 nt, Human Herpes Virus 4 (Epstein Barr virus); identical to SEQ ID NO: 542133

SEQ ID NO: 542507 - RNA, 64 nt, Human Herpes Virus 4 (Epstein Barr virus); identical to SEQ ID NO: 542134

SEQ ID NO: 542508 - RNA, 64 nt, Human Herpes Virus 4 (Epstein Barr virus); identical to SEQ ID NO: 542135

SEQ ID NO: 542509 - RNA, 64 nt, Human Herpes Virus 4 (Epstein Barr virus); identical to SEQ ID NO: 542136

SEQ ID NO: 542510 - RNA, 64 nt, Human Herpes Virus 4 (Epstein Barr virus); identical to SEQ ID NO: 542137

SEQ ID NO: 542511 - RNA, 64 nt, Human Herpes Virus 4 (Epstein Barr virus)
uccucacccucugggagagcguggccgcaaaucaggaggucacggaugccauuacccugccuga

SEQ ID NO: 542512 - RNA, 64 nt, Human Herpes Virus 4 (Epstein Barr virus)
uacauuaagguguguaaccaggugggugguaccuggaggucauucuauugggauaacgagagga

SEQ ID NO: 542513 - RNA, 62 nt, Human Herpes Virus 2
aacguggaccccggggacgcggacgccgcgcacggcgcgauccaggacgcccgccgggcccu

SEQ ID NO: 542514 - RNA, 64 nt, Human Herpes Virus 4 (Epstein Barr virus)
ggcucacggaccgcucauucccugcauaccucgaggaggucauguaugugaugguucaguagag

SEQ ID NO: 542515 - RNA, 64 nt, Human Herpes Virus 4 (Epstein Barr virus)
caaucucuggaccgaggcucacccuccuccaguaggaggucagggugacucgcucacccaagaa

SEQ ID NO: 542516 - RNA, 62 nt, Human Herpes Virus 2
gaccuguguuaaaauucgcguggaagagcaagcggcgcgacgugauuuucuaaccgcacacc

SEQ ID NO: 542517 - RNA, 62 nt, Human Herpes Virus 2
cugcgccgcgugcuggcgcggcugggggccggcggcgcgaccgggggggccgaggaggaaga

SEQ ID NO: 542518 - RNA, 62 nt, Human Herpes Virus 2
aucgcguucauuaagagguucucccuggacuacggcgcgauuaacuuuaucaaccuggcccc

SEQ ID NO: 542519 - RNA, 62 nt, Human Herpes Virus 2
cgaacggucuccgccaugcaacgccgggcgcgcggcgcgagcucccugcggcuggcgcggug

SEQ ID NO: 542520 - RNA, 62 nt, Human Herpes Virus 2
auugacgccccgcccccauacgagaguguggccggcgcgagcgcgggccaguuugucguuau

SEQ ID NO: 542521 - RNA, 64 nt, Human Herpes Virus 2; identical to SEQ ID NO: 536887

SEQ ID NO: 542522 - RNA, 64 nt, Human Herpes Virus 2; identical to SEQ ID NO: 536919

SEQ ID NO: 542523 - RNA, 64 nt, Human Herpes Virus 2; identical to SEQ ID NO: 536890

SEQ ID NO: 542524 - RNA, 64 nt, Human Herpes Virus 2; identical to SEQ ID NO: 536910

SEQ ID NO: 542525 - RNA, 64 nt, Human Herpes Virus 4 (Epstein Barr virus)
gccgguggccuccgacuaccucccggagauguuugcagagcaccccggccugguguuugaggug

SEQ ID NO: 542526 - RNA, 64 nt, Human Herpes Virus 4 (Epstein Barr virus)
aguuacaccugaauaaugaagaaagcguggcucagcagagcacagcaagccgaugccggggggg

SEQ ID NO: 542527 - RNA, 64 nt, Human Herpes Virus 4 (Epstein Barr virus)
agcccccagccggcaauccaggcguaccgggccagcagagcaagcggaccacgcccauucgaac

SEQ ID NO: 542528 - RNA, 64 nt, Human Herpes Virus 4 (Epstein Barr virus)
gcagcucagagggcggccggacccucaguggccagcagagcauugcaggcagccagggaccguu

SEQ ID NO: 542529 - RNA, 64 nt, Human Herpes Virus 2; identical to SEQ ID NO: 536888

SEQ ID NO: 542530 - RNA, 64 nt, Human Herpes Virus 2; identical to SEQ ID NO: 536889

SEQ ID NO: 542531 - RNA, 64 nt, Human Herpes Virus 2; identical to SEQ ID NO: 536890

SEQ ID NO: 542532 - RNA, 64 nt, Human Herpes Virus 2; identical to SEQ ID NO: 536891

SEQ ID NO: 542533 - RNA, 64 nt, Human Herpes Virus 2; identical to SEQ ID NO: 536893

SEQ ID NO: 542534 - RNA, 64 nt, Human Herpes Virus 2; identical to SEQ ID NO: 536894

SEQ ID NO: 542535 - RNA, 64 nt, Human Herpes Virus 2; identical to SEQ ID NO: 536895

SEQ ID NO: 542536 - RNA, 64 nt, Human Herpes Virus 2; identical to SEQ ID NO: 536897

SEQ ID NO: 542537 - RNA, 64 nt, Human Herpes Virus 2; identical to SEQ ID NO: 536901

SEQ ID NO: 542538 - RNA, 64 nt, Human Herpes Virus 2; identical to SEQ ID NO: 536902

SEQ ID NO: 542539 - RNA, 64 nt, Human Herpes Virus 2; identical to SEQ ID NO: 536903

SEQ ID NO: 542540 - RNA, 64 nt, Human Herpes Virus 2; identical to SEQ ID NO: 536907

SEQ ID NO: 542541 - RNA, 64 nt, Human Herpes Virus 2; identical to SEQ ID NO: 536908

SEQ ID NO: 542542 - RNA, 64 nt, Human Herpes Virus 2; identical to SEQ ID NO: 536909

SEQ ID NO: 542543 - RNA, 64 nt, Human Herpes Virus 2; identical to SEQ ID NO: 536898

SEQ ID NO: 542544 - RNA, 64 nt, Human Herpes Virus 2; identical to SEQ ID NO: 536899

SEQ ID NO: 542545 - RNA, 64 nt, Human Herpes Virus 2; identical to SEQ ID NO: 536912

SEQ ID NO: 542546 - RNA, 64 nt, Human Herpes Virus 2; identical to SEQ ID NO: 536913

SEQ ID NO: 542547 - RNA, 64 nt, Human Herpes Virus 2; identical to SEQ ID NO: 536914

SEQ ID NO: 542548 - RNA, 64 nt, Human Herpes Virus 2; identical to SEQ ID NO: 536915

SEQ ID NO: 542549 - RNA, 64 nt, Human Herpes Virus 2; identical to SEQ ID NO: 536916

SEQ ID NO: 542550 - RNA, 64 nt, Human Herpes Virus 2; identical to SEQ ID NO: 536918

SEQ ID NO: 542551 - RNA, 64 nt, Human Herpes Virus 4 (Epstein Barr virus)
ccccacgcgcgcauaauggcggaccuaggccuaaaacccccaggaagcgggucuaugguuggcu

SEQ ID NO: 542552 - RNA, 64 nt, Human Herpes Virus 4 (Epstein Barr virus); identical to SEQ ID NO: 542551

SEQ ID NO: 542553 - RNA, 64 nt, Human Herpes Virus 4 (Epstein Barr virus)
caaagcugcucgggggaugaugggcgggaccaacaacccccaccuguugauggcuucggguccg

SEQ ID NO: 542554 - RNA, 64 nt, Human Herpes Virus 2; identical to SEQ ID NO: 536888

SEQ ID NO: 542555 - RNA, 64 nt, Human Herpes Virus 2; identical to SEQ ID NO: 536904

SEQ ID NO: 542556 - RNA, 64 nt, Human Herpes Virus 2; identical to SEQ ID NO: 536905

SEQ ID NO: 542557 - RNA, 64 nt, Human Herpes Virus 1; identical to SEQ ID NO: 536543

SEQ ID NO: 542558 - RNA, 64 nt, Human Herpes Virus 1; identical to SEQ ID NO: 536544

SEQ ID NO: 542559 - RNA, 64 nt, Human Herpes Virus 1; identical to SEQ ID NO: 536545

SEQ ID NO: 542560 - RNA, 64 nt, Human Herpes Virus 1; identical to SEQ ID NO: 536546

SEQ ID NO: 542561 - RNA, 64 nt, Human Herpes Virus 1; identical to SEQ ID NO: 536547

SEQ ID NO: 542562 - RNA, 64 nt, Human Herpes Virus 1; identical to SEQ ID NO: 536548

SEQ ID NO: 542563 - RNA, 62 nt, Human Herpes Virus 1; identical to SEQ ID NO: 536549

SEQ ID NO: 542564 - RNA, 64 nt, Human Herpes Virus 1; identical to SEQ ID NO: 536550

SEQ ID NO: 542565 - RNA, 64 nt, Human Herpes Virus 1; identical to SEQ ID NO: 536551

SEQ ID NO: 542566 - RNA, 64 nt, Human Herpes Virus 1; identical to SEQ ID NO: 536552

SEQ ID NO: 542567 - RNA, 64 nt, Human Herpes Virus 1; identical to SEQ ID NO: 536553

SEQ ID NO: 542568 - RNA, 64 nt, Human Herpes Virus 1; identical to SEQ ID NO: 536554

SEQ ID NO: 542569 - RNA, 64 nt, Human Herpes Virus 1; identical to SEQ ID NO: 536555

SEQ ID NO: 542570 - RNA, 64 nt, Human Herpes Virus 1; identical to SEQ ID NO: 536556

SEQ ID NO: 542571 - RNA, 64 nt, Human Herpes Virus 1; identical to SEQ ID NO: 536557

SEQ ID NO: 542572 - RNA, 64 nt, Human Herpes Virus 1; identical to SEQ ID NO: 536543

SEQ ID NO: 542573 - RNA, 64 nt, Human Herpes Virus 1; identical to SEQ ID NO: 536548

SEQ ID NO: 542574 - RNA, 64 nt, Human Herpes Virus 1; identical to SEQ ID NO: 536547

SEQ ID NO: 542575 - RNA, 64 nt, Human Herpes Virus 1
ggcccccacaucggggucccccgggucagccgccagcccggaggucacccccacaucgacccca

SEQ ID NO: 542576 - RNA, 64 nt, Human Herpes Virus 1
ucccuccaaucgccgguuccucccgcucggcggcagcccggaggcgcccgcggaaacguucgcg

SEQ ID NO: 542577 - RNA, 64 nt, Human Herpes Virus 1; identical to SEQ ID NO: 542575

SEQ ID NO: 542578 - RNA, 64 nt, Human Herpes Virus 1; identical to SEQ ID NO: 542576

SEQ ID NO: 542579 - RNA, 64 nt, Human Herpes Virus 4 (Epstein Barr virus)
gggccccaucagucugcgcccucucggugauggaugcugguaaggcccagcccauagaaaguuc

SEQ ID NO: 542580 - RNA, 64 nt, Human Herpes Virus 1
gggccuccggguccgacucgggggccaucaagagcggagacaacaaucuggaggcgcuaugugc

SEQ ID NO: 542581 - RNA, 64 nt, Human Herpes Virus 2
cuaggaucgcccccaccgcauccgccggcacguaggcggcaaacgccgaacgccacggggugca

SEQ ID NO: 542582 - RNA, 64 nt, Human Herpes Virus 2
gacgaucccgggcccuuggguuccgcggacgccgggcggcaagaccugccccggcgcgucgucc

SEQ ID NO: 542583 - RNA, 64 nt, Human Herpes Virus 2
cauccguggagucgucgccacuccccgccgcggcggcggcaacgcccggggccgggcacacgaa

SEQ ID NO: 542584 - RNA, 64 nt, Human Herpes Virus 2
cguguuucaggccgggaacugggccagccugcugggcggcaaaaacgcgugcccgcugcugauc

SEQ ID NO: 542585 - RNA, 64 nt, Human Herpes Virus 1
ggacagggcaggaggaaggaggaggccgucccgccggagacaaagccgucccggguguuuccuc

SEQ ID NO: 542586 - RNA, 64 nt, Human Herpes Virus 1
acggccauuacguuuuugacuacuacagcacaagcggagacacgcugcggcuuaacaaucgucc

SEQ ID NO: 542587 - RNA, 64 nt, Human Herpes Virus 2
gccagagcaugaugaaacacggccugcgcaacagccaguucaucgcgcucaugcccaccgccgc

SEQ ID NO: 542588 - RNA, 64 nt, Human Herpes Virus 4 (Epstein Barr virus)
aaccccgccuguuccaacgucuucauuacagugaggcagcgaggggagaagaucaacggccgua

SEQ ID NO: 542589 - RNA, 64 nt, Human Herpes Virus 4 (Epstein Barr virus)
cucucuggccgcccugcgcuggcuggucuccuucggcagcgaccuggcccucccuucccccgag

SEQ ID NO: 542590 - RNA, 56 nt, Human Herpes Virus 4 (Epstein Barr virus)
cagacugcgaucuggacccuauggagggcagcgaagaacacuccacagauggagag

SEQ ID NO: 542591 - RNA, 64 nt, Human Herpes Virus 4 (Epstein Barr virus)
caccaacacagacugcgaucuggacccuauggagggcagcgaagaacacuccacagauggagag

SEQ ID NO: 542592 - RNA, 64 nt, Human Herpes Virus 1; identical to SEQ ID NO: 540687

SEQ ID NO: 542593 - RNA, 64 nt, Human Herpes Virus 1; identical to SEQ ID NO: 535681

SEQ ID NO: 542594 - RNA, 64 nt, Human Herpes Virus 1; identical to SEQ ID NO: 535682

SEQ ID NO: 542595 - RNA, 64 nt, Human Herpes Virus 1; identical to SEQ ID NO: 535683

SEQ ID NO: 542596 - RNA, 64 nt, Human Herpes Virus 1; identical to SEQ ID NO: 535684

SEQ ID NO: 542597 - RNA, 64 nt, Human Herpes Virus 1; identical to SEQ ID NO: 535685

SEQ ID NO: 542598 - RNA, 64 nt, Human Herpes Virus 1; identical to SEQ ID NO: 535686

SEQ ID NO: 542599 - RNA, 64 nt, Human Herpes Virus 1; identical to SEQ ID NO: 535687

SEQ ID NO: 542600 - RNA, 64 nt, Human Herpes Virus 1; identical to SEQ ID NO: 535681

SEQ ID NO: 542601 - RNA, 64 nt, Human Herpes Virus 4 (Epstein Barr virus)
gcccgcucuccuccgccaggggccccgugaugaagguguacaggcugugcgucagcgcgugcag

SEQ ID NO: 542602 - RNA, 64 nt, Human Herpes Virus 4 (Epstein Barr virus)
gaaaucugaaugccauugagucccuuugggucgggguguacagggugggagaagggaacuggac

SEQ ID NO: 542603 - RNA, 64 nt, Human Herpes Virus 4 (Epstein Barr virus)
cucuggacuuccaugucuacgacauacucgagacgguguacacgcacgagaaaugcgccgucau

SEQ ID NO: 542604 - RNA, 64 nt, Human Herpes Virus 2
ccuuggagcgcggcccggauagaguggcccagggcccgcagacacgcgaucuggaugcgcgcga

SEQ ID NO: 542605 - RNA, 64 nt, Human Herpes Virus 2
ccacaggcuccagcaguacauguucuuuaugcgccccgcagacccgagccggccgagcacggac

SEQ ID NO: 542606 - RNA, 64 nt, Human Herpes Virus 4 (Epstein Barr virus); identical to SEQ ID NO: 541400

SEQ ID NO: 542607 - RNA, 64 nt, Human Herpes Virus 4 (Epstein Barr virus); identical to SEQ ID NO: 541401

SEQ ID NO: 542608 - RNA, 64 nt, Human Herpes Virus 4 (Epstein Barr virus); identical to SEQ ID NO: 541402

SEQ ID NO: 542609 - RNA, 64 nt, Human Herpes Virus 4 (Epstein Barr virus); identical to SEQ ID NO: 541403

SEQ ID NO: 542610 - RNA, 64 nt, Human Herpes Virus 2
ccgcgcaugucguuucucuccgcgggacaacgcccccgcagacuguccaccaccgcccccauua

SEQ ID NO: 542611 - RNA, 64 nt, Human Herpes Virus 2
uggugcugcgcgacgacgcggacgcgggcccgcccccgcagauacgcugggcgucggccgcggg

SEQ ID NO: 542612 - RNA, 64 nt, Human Herpes Virus 2
gggggggcgggggccgggguccgcccgcggcccgcccgcagaccccacggcagagggacucuug

SEQ ID NO: 542613 - RNA, 64 nt, Human Herpes Virus 2
cgccccccguccucucggcccuguuuugcgccaccccgcagagcucugcguugcaguugcccgg

SEQ ID NO: 542614 - RNA, 64 nt, Human Herpes Virus 2
ugguaaacgcaaagccucccggaaagaccacuagcccgcagaggcggcgauugaacccaaggca

SEQ ID NO: 542615 - RNA, 64 nt, Human Herpes Virus 2
cguauccggagcggccgccgcguuagccgagcgccccgcagaggaguggcuggcgcgaccccug

SEQ ID NO: 542616 - RNA, 64 nt, Human Herpes Virus 2; identical to SEQ ID NO: 542611

SEQ ID NO: 542617 - RNA, 64 nt, Human Herpes Virus 2
gggcccucuucgucccgcugcgccugggcugggacccgcagacgggucuggucgugagggucga

SEQ ID NO: 542618 - RNA, 64 nt, Human Herpes Virus 2
cgaggcccuggcguccgcggaugagacgcuggcguggugcaagaugugcauucaccacaaucug

SEQ ID NO: 542619 - RNA, 64 nt, Human Herpes Virus 1
cuuuacgggacacaauccccgacugcgcgcugcggucccagacccuggagagucuagacgcgcg

SEQ ID NO: 542620 - RNA, 64 nt, Human Herpes Virus 1
ggccgagaccaacacccacggccuggcguaugacgucccagagggcauccggcgccaccuccgc

SEQ ID NO: 542621 - RNA, 64 nt, Human Herpes Virus 1
gcguccguguugugcguguaugggcaugcccgaggucccagacgagcaacccacaucgccgggc

SEQ ID NO: 542622 - RNA, 64 nt, Human Herpes Virus 1; identical to SEQ ID NO: 542619

SEQ ID NO: 542623 - RNA, 64 nt, Human Herpes Virus 1; identical to SEQ ID NO: 542620

SEQ ID NO: 542624 - RNA, 64 nt, Human Herpes Virus 1; identical to SEQ ID NO: 542621

SEQ ID NO: 542625 - RNA, 64 nt, Human Herpes Virus 2
ccgcgucggaguggaacagccucuggaugaccccggugggcaacaugcucuuugaccagggcac

SEQ ID NO: 542626 - RNA, 64 nt, Human Herpes Virus 2
ccgcgguccagcugccucccccccagccucccgaggugggcagcagccugcugcugaucagcau

SEQ ID NO: 542627 - RNA, 64 nt, Human Herpes Virus 2
uggccgcguuugacggcgggucgacggcccccgaggugggcacguacaccccccugcgcuacgc

SEQ ID NO: 542628 - RNA, 64 nt, Human Herpes Virus 2; identical to SEQ ID NO: 542625

SEQ ID NO: 542629 - RNA, 64 nt, Human Herpes Virus 2
caaaucgauuucuuccggggacacggccagcaaacgcgaacagcggaccacgggcaugaagcag

SEQ ID NO: 542630 - RNA, 64 nt, Human Herpes Virus 2
gguggaccuggacuucgggcugacggaaaggcuucgcgaacacgaggcccagcuaaugauccug

SEQ ID NO: 542631 - RNA, 64 nt, Human Herpes Virus 2
ugcaagaccccuuuggcgggaugccguuucccgccgcgaacagccccugggcucccgugcuggc

SEQ ID NO: 542632 - RNA, 64 nt, Human Herpes Virus 2
gggcucggggggguacggcgaggugcaguugauucgcgaacacaagcucgccgugaagaccauc

SEQ ID NO: 542633 - RNA, 64 nt, Human Herpes Virus 2
uuccgacggggacccgaucuacgacgaaguggcccccgaccacgaggccgagcucuacgcccga

SEQ ID NO: 542634 - RNA, 64 nt, Human Herpes Virus 2
aggacaugacccccgccgaacuagagguuauauucccgaccacggacgccaagcugaacuaccu

SEQ ID NO: 542635 - RNA, 64 nt, Human Herpes Virus 2
cgcgggggugcgauaacgcaccccuggacguccgcccgaccacaccccccgcccccguaucccc

SEQ ID NO: 542636 - RNA, 64 nt, Human Herpes Virus 2
ucgugggccgggacggcgcggaaagcgucauccgcccgaccagcgccggguggcgccucugcgu

SEQ ID NO: 542637 - RNA, 64 nt, Human Herpes Virus 2
uguggaccugcauguuuccccuuccgcgcguccucccgaccagcuucgacgcccuccuggccgc

SEQ ID NO: 542638 - RNA, 64 nt, Human Herpes Virus 2
uagauaccuggaacgaggaccuguucucuggguucccgaccaacgccgacauguaccgggagug

SEQ ID NO: 542639 - RNA, 64 nt, Human Herpes Virus 1
cguccgcgagaccagugcgcuggagaaguucauaacccacgaucgcaguugccugcgcgugucc

SEQ ID NO: 542640 - RNA, 64 nt, Human Herpes Virus 4 (Epstein Barr virus); identical to SEQ ID NO: 538738

SEQ ID NO: 542641 - RNA, 64 nt, Human Herpes Virus 4 (Epstein Barr virus); identical to SEQ ID NO: 538739

SEQ ID NO: 542642 - RNA, 64 nt, Human Herpes Virus 4 (Epstein Barr virus); identical to SEQ ID NO: 538738

SEQ ID NO: 542643 - RNA, 64 nt, Human Herpes Virus 4 (Epstein Barr virus); identical to SEQ ID NO: 538739

SEQ ID NO: 542644 - RNA, 64 nt, Human Herpes Virus 4 (Epstein Barr virus); identical to SEQ ID NO: 538738

SEQ ID NO: 542645 - RNA, 64 nt, Human Herpes Virus 4 (Epstein Barr virus); identical to SEQ ID NO: 538739

SEQ ID NO: 542646 - RNA, 64 nt, Human Herpes Virus 4 (Epstein Barr virus); identical to SEQ ID NO: 538738

SEQ ID NO: 542647 - RNA, 64 nt, Human Herpes Virus 4 (Epstein Barr virus); identical to SEQ ID NO: 538738

SEQ ID NO: 542648 - RNA, 64 nt, Human Herpes Virus 4 (Epstein Barr virus); identical to SEQ ID NO: 538738

SEQ ID NO: 542649 - RNA, 64 nt, Human Herpes Virus 4 (Epstein Barr virus); identical to SEQ ID NO: 538738

SEQ ID NO: 542650 - RNA, 64 nt, Human Herpes Virus 4 (Epstein Barr virus); identical to SEQ ID NO: 538738

SEQ ID NO: 542651 - RNA, 64 nt, Human Herpes Virus 4 (Epstein Barr virus); identical to SEQ ID NO: 538749

SEQ ID NO: 542652 - RNA, 64 nt, Human Herpes Virus 4 (Epstein Barr virus); identical to SEQ ID NO: 538750

SEQ ID NO: 542653 - RNA, 64 nt, Human Herpes Virus 4 (Epstein Barr virus); identical to SEQ ID NO: 538750

SEQ ID NO: 542654 - RNA, 64 nt, Human Herpes Virus 4 (Epstein Barr virus); identical to SEQ ID NO: 538750

SEQ ID NO: 542655 - RNA, 64 nt, Human Herpes Virus 4 (Epstein Barr virus); identical to SEQ ID NO: 538750

SEQ ID NO: 542656 - RNA, 64 nt, Human Herpes Virus 4 (Epstein Barr virus); identical to SEQ ID NO: 538750

SEQ ID NO: 542657 - RNA, 64 nt, Human Herpes Virus 4 (Epstein Barr virus); identical to SEQ ID NO: 538750

SEQ ID NO: 542658 - RNA, 64 nt, Human Herpes Virus 4 (Epstein Barr virus); identical to SEQ ID NO: 538750

SEQ ID NO: 542659 - RNA, 64 nt, Human Herpes Virus 4 (Epstein Barr virus); identical to SEQ ID NO: 538750

SEQ ID NO: 542660 - RNA, 64 nt, Human Herpes Virus 4 (Epstein Barr virus); identical to SEQ ID NO: 538750

SEQ ID NO: 542661 - RNA, 64 nt, Human Herpes Virus 4 (Epstein Barr virus); identical to SEQ ID NO: 538750

SEQ ID NO: 542662 - RNA, 64 nt, Human Herpes Virus 4 (Epstein Barr virus); identical to SEQ ID NO: 538750

SEQ ID NO: 542663 - RNA, 64 nt, Human Herpes Virus 4 (Epstein Barr virus); identical to SEQ ID NO: 538750

SEQ ID NO: 542664 - RNA, 64 nt, Human Herpes Virus 4 (Epstein Barr virus); identical to SEQ ID NO: 538762

SEQ ID NO: 542665 - RNA, 64 nt, Human Herpes Virus 4 (Epstein Barr virus); identical to SEQ ID NO: 538763

SEQ ID NO: 542666 - RNA, 64 nt, Human Herpes Virus 4 (Epstein Barr virus); identical to SEQ ID NO: 538764

SEQ ID NO: 542667 - RNA, 64 nt, Human Herpes Virus 4 (Epstein Barr virus); identical to SEQ ID NO: 538765

SEQ ID NO: 542668 - RNA, 64 nt, Human Herpes Virus 1
ccccggaccuugacucuauguggucggcgucggugauccccaacgcgcugcccucccauauacu

SEQ ID NO: 542669 - RNA, 64 nt, Human Herpes Virus 1
uccacgaccugguuggccacccggggccuguugagauccccagguagguacguguauuucuccc

SEQ ID NO: 542670 - RNA, 63 nt, Human Herpes Virus 1
ccugggaccuuacggacccgcugcuguuuguucacgccggacugcaggucaucaaccucgggu

SEQ ID NO: 542671 - RNA, 63 nt, Human Herpes Virus 1
ccaccaacaugcgcauauucgacggggcguugcacgccggaauccugcugauggccccccagc

SEQ ID NO: 542672 - RNA, 63 nt, Human Herpes Virus 1
gaccggagucucccagggaccuggagguccgcgacgccggaaacagucuccccgcgccuaugc

SEQ ID NO: 542673 - RNA, 63 nt, Human Herpes Virus 1
gagcgcccuccugaccaagcuuaaacgcgaaggacgccggagccggugaacgccuccgcccgu

SEQ ID NO: 542674 - RNA, 64 nt, Human Herpes Virus 1
cccgcgccuagccacgcaucuucgggccgugacgacccacgaccccaaccccgcggccagcacg

SEQ ID NO: 542675 - RNA, 64 nt, Human Herpes Virus 4 (Epstein Barr virus)
gccccagcagacaugcucucaguuaacgagcagagggaaugaaagcucacggcgaaacuugggc

SEQ ID NO: 542676 - RNA, 64 nt, Human Herpes Virus 4 (Epstein Barr virus)
ccaccccugcggcgccuggugucuggaaacacuugggaaugagacgcagguacuccuugucagg

SEQ ID NO: 542677 - RNA, 64 nt, Human Herpes Virus 4 (Epstein Barr virus)
agaucaaagucuguacuugggauugcaacacgacgggaaugacgggcucccucccccucccuac

SEQ ID NO: 542678 - RNA, 64 nt, Human Herpes Virus 4 (Epstein Barr virus)
guccggagccgacaggauggacgaggagcucauggggaaugaugggggugccucucacaccgag

SEQ ID NO: 542679 - RNA, 64 nt, Human Herpes Virus 1
cccuggugcccggggcccaggauuccgccccgcccggccccacgcuaagggagcuguggugggu

SEQ ID NO: 542680 - RNA, 64 nt, Human Herpes Virus 1
aacacgauucacggcaccgaggacaugacgcccccggccccaaaccgaaaccccgacuuccccc

SEQ ID NO: 542681 - RNA, 64 nt, Human Herpes Virus 1
aagcgcgggccccgguugggggacaggaggccggcggccccagcgcagccacccagggggaggc

SEQ ID NO: 542682 - RNA, 64 nt, Human Herpes Virus 1
cgucccacgcucuccccugcugccauggauuccgcggccccagcccucucccccgcucugacgg

SEQ ID NO: 542683 - RNA, 64 nt, Human Herpes Virus 1
acgagguugccuacuuugaccugugccacgaagucggccccacggcggaaccucgcgaaacgga

SEQ ID NO: 542684 - RNA, 64 nt, Human Herpes Virus 1
acccgggaaacgcagccccgggcccccaccccgucggccccaagcccaaaugcaaugcuacggc

SEQ ID NO: 542685 - RNA, 64 nt, Human Herpes Virus 1
ccguccacaacgcguccuuguucucggccccccgcggccccaaaaggggcccgugcgacaguca

SEQ ID NO: 542686 - RNA, 64 nt, Human Herpes Virus 1
gcuccggucccgcuggcgauggcguacgcccccccggccccaucugcgaccgggggucuacgaa

SEQ ID NO: 542687 - RNA, 64 nt, Human Herpes Virus 1
cgccaaguggccucggugguccugguggugcaaccggccccaguuccgaccccacccccgaccc

SEQ ID NO: 542688 - RNA, 64 nt, Human Herpes Virus 1
ggaaagcgcguccccgcguccgcagcccuuggcccggccccacgcgggggcgcccgcagacccg

SEQ ID NO: 542689 - RNA, 64 nt, Human Herpes Virus 1
ucacccuccucgaaccggccgcccggggcggccucggccccacuaugcagauggccgacaacau

SEQ ID NO: 542690 - RNA, 64 nt, Human Herpes Virus 1
aacaccgcuacauuaaguacgucauaucgcuuaucggccccaaggagcgggggccguggacucu

SEQ ID NO: 542691 - RNA, 64 nt, Human Herpes Virus 1
cccuggauccccgggacguuaccgggggccaccccggccccaggucguccuccucggagauacu

SEQ ID NO: 542692 - RNA, 64 nt, Human Herpes Virus 1
cccguggcucucgagaugagccagacccaacccccggccccaguugggccgggcgacccagaug

SEQ ID NO: 542693 - RNA, 64 nt, Human Herpes Virus 1
ccgcgggucugcgggccaggaccagggggggcgggcgccgcagcuucgccaggccuuccgcacg

SEQ ID NO: 542694 - RNA, 64 nt, Human Herpes Virus 1
gcgccacccggcgcuggucggggggauguuguccgcgccgcaccgucccccgacgaccucuugc

SEQ ID NO: 542695 - RNA, 64 nt, Human Herpes Virus 1
guccacggacauaccgcccggcucgaucgcugccgcgccgcagggugaccggugcccaaucguc

SEQ ID NO: 542696 - RNA, 64 nt, Human Herpes Virus 1
gaacgcccgggcccauccgauucuggggcgggucgcgccgcagaagaccgcaagugucuggacg

SEQ ID NO: 542697 - RNA, 64 nt, Human Herpes Virus 1
aaagcccucaccuucgacggcgcgcuucgccccagcgccgcagagcugcuuuguuugccgcugu

SEQ ID NO: 542698 - RNA, 64 nt, Human Herpes Virus 1
uucggcccucuuggaggaccccguggggacgguggcgccgcaaaucccaccaaacuggcacaua

SEQ ID NO: 542699 - RNA, 64 nt, Human Herpes Virus 1
gccucuuuggcccccugcgcgccucgggcccgcugcgccgcauggcggccuggaugcgccagau

SEQ ID NO: 542700 - RNA, 64 nt, Human Herpes Virus 1
agugcgccgugcgcuggccggcggcgcgggaccugcgccgcacggugcuggccucgggccgcgu

SEQ ID NO: 542701 - RNA, 64 nt, Human Herpes Virus 1
uccucggcgcuggccacggcccugaccgaggccugcgccgcagaacgcgucgugcgcccccacc

SEQ ID NO: 542702 - RNA, 64 nt, Human Herpes Virus 1
ucagcgccaaggucaccgacauggucaugcgcaagcgccgcaacaccaacuacacccaaguucc

SEQ ID NO: 542703 - RNA, 64 nt, Human Herpes Virus 1
aggacagcggccugcuggacuacacggagguccagcgccgcaaccagcugcacgaccugcgcuu

SEQ ID NO: 542704 - RNA, 64 nt, Human Herpes Virus 1
guuggucggcaccgggcacgaacgaccaacaggcgcgccgcagcccgccgacccaccuggacuc

SEQ ID NO: 542705 - RNA, 64 nt, Human Herpes Virus 1; identical to SEQ ID NO: 542700

SEQ ID NO: 542706 - RNA, 64 nt, Human Herpes Virus 1; identical to SEQ ID NO: 542699

SEQ ID NO: 542707 - RNA, 64 nt, Human Herpes Virus 4 (Epstein Barr virus)
cagagaccaggcugcuaaacaaaccccccaccgugcugacuagguuggugauggacugacccac

SEQ ID NO: 542708 - RNA, 64 nt, Human Herpes Virus 4 (Epstein Barr virus)
gaggcugccgggagccggaacuggacacggaaacgcugacuaccauguuugagguuucuguggc

SEQ ID NO: 542709 - RNA, 64 nt, Human Herpes Virus 4 (Epstein Barr virus)
accuuguggaugccaugggcgaggcaugcgccucgcugacuagggacgacgcggaguacuuauu

SEQ ID NO: 542710 - RNA, 63 nt, Human Herpes Virus 1
accgacgaaucccccaagggggaggggccauuuuacgaggaggagggguauaacaaagucugu

SEQ ID NO: 542711 - RNA, 63 nt, Human Herpes Virus 1
gcgccgucgccgcuguuccuagaggagcugcaguacgaggaggacgacuacccggaagccguc

SEQ ID NO: 542712 - RNA, 63 nt, Human Herpes Virus 2
gaaccaucaaggacgucuccggugcaucccccgcgggggaauacacgauaaacgguaucgugu

SEQ ID NO: 542713 - RNA, 64 nt, Human Herpes Virus 1; identical to SEQ ID NO: 542694

SEQ ID NO: 542714 - RNA, 64 nt, Human Herpes Virus 1; identical to SEQ ID NO: 542700

SEQ ID NO: 542715 - RNA, 64 nt, Human Herpes Virus 1; identical to SEQ ID NO: 542699

SEQ ID NO: 542716 - RNA, 64 nt, Human Herpes Virus 2; identical to SEQ ID NO: 540060

SEQ ID NO: 542717 - RNA, 64 nt, Human Herpes Virus 2; identical to SEQ ID NO: 540061

SEQ ID NO: 542718 - RNA, 64 nt, Human Herpes Virus 2; identical to SEQ ID NO: 540062

SEQ ID NO: 542719 - RNA, 64 nt, Human Herpes Virus 2; identical to SEQ ID NO: 540063

SEQ ID NO: 542720 - RNA, 64 nt, Human Herpes Virus 2
ugcuaccggcggccccgggcgacguuccccgagacaccagcacccgcgugaaccccgacgacgu

SEQ ID NO: 542721 - RNA, 64 nt, Human Herpes Virus 2
agaaaaacgucaccuggucccuguucgaccgggacaccagcaugucgcucgccgacuuucacgg

SEQ ID NO: 542722 - RNA, 64 nt, Human Herpes Virus 2
cggcggcggcaacgcccggggccgggcacacgaacaccagcagcgccuccgcagcgaaaacgcc

SEQ ID NO: 542723 - RNA, 64 nt, Human Herpes Virus 2
aaaucgccggguggcacggccccaagcccccguacaccagcacccugcugccgccggagcuguc

SEQ ID NO: 542724 - RNA, 64 nt, Human Herpes Virus 2
cgagaccaugggucuggcccgacccuguccguaccaccagcagauccggcugcagacguacggc

SEQ ID NO: 542725 - RNA, 64 nt, Human Herpes Virus 2
acuucaacuuuuccgccccgagcaugcucaucugccugacgacgcuguucgcccugcuugucgu

SEQ ID NO: 542726 - RNA, 64 nt, Human Herpes Virus 2
uaccgguccccgccccguacguugugcacggcucccugacgaugcgugggguggcgagggugau

SEQ ID NO: 542727 - RNA, 64 nt, Human Herpes Virus 2
ccgacugccagcucugggcccugcuucggcggggccugacgaccgccuccacgcugcggugggg

SEQ ID NO: 542728 - RNA, 64 nt, Human Herpes Virus 2
ugacuuacuggcaggugcugggggccuccgagacccugacgaacaucuacaacacgcagcaccg

SEQ ID NO: 542729 - RNA, 64 nt, Human Herpes Virus 2
ucgaggcgcugauacgcgcgugcuacgaccaccaccugacgacgccgcugcugcggcggcucgu

SEQ ID NO: 542730 - RNA, 64 nt, Human Herpes Virus 2
gggcccuguuuacgcuggcgcugguggacgacuaccugacgacccccgaucggggcgcgguggu

SEQ ID NO: 542731 - RNA, 64 nt, Human Herpes Virus 1; identical to SEQ ID NO: 541911

SEQ ID NO: 542732 - RNA, 64 nt, Human Herpes Virus 1; identical to SEQ ID NO: 541912

SEQ ID NO: 542733 - RNA, 64 nt, Human Herpes Virus 1; identical to SEQ ID NO: 541913

SEQ ID NO: 542734 - RNA, 64 nt, Human Herpes Virus 1; identical to SEQ ID NO: 541914

SEQ ID NO: 542735 - RNA, 64 nt, Human Herpes Virus 1; identical to SEQ ID NO: 541915

SEQ ID NO: 542736 - RNA, 64 nt, Human Herpes Virus 1; identical to SEQ ID NO: 541916

SEQ ID NO: 542737 - RNA, 63 nt, Human Herpes Virus 1
cgccgaaacccgccgcgucuguugaaauggccagccgcccagccgcauccucucccgucgaag

SEQ ID NO: 542738 - RNA, 62 nt, Human Herpes Virus 1; identical to SEQ ID NO: 536549

SEQ ID NO: 542739 - RNA, 63 nt, Human Herpes Virus 1
cugcucgcgacgucggguuuugcuuucgugaacgccgcccacgcaaacggcgcggucugccuc

SEQ ID NO: 542740 - RNA, 63 nt, Human Herpes Virus 1
ucgaucgccgcgcggugcgccgggcccgcccccgccgcccaggccgcgugcggcggcggcgac

SEQ ID NO: 542741 - RNA, 64 nt, Human Herpes Virus 1; identical to SEQ ID NO: 542697

SEQ ID NO: 542742 - RNA, 64 nt, Human Herpes Virus 1; identical to SEQ ID NO: 542702

SEQ ID NO: 542743 - RNA, 63 nt, Human Herpes Virus 1
uuuggauuccccugacggggcggggccuuggcggccgcccaacucucgcaccaucccggguua

SEQ ID NO: 542744 - RNA, 62 nt, Human Herpes Virus 1; identical to SEQ ID NO: 536549

SEQ ID NO: 542745 - RNA, 63 nt, Human Herpes Virus 1
cauguguucgaucgucgagcccuggccgacguggccgcccaucggggcgcgcggcggacugcg

SEQ ID NO: 542746 - RNA, 63 nt, Human Herpes Virus 1
gcgccccggcuccccgggccccaccgacgggccgccgcccaccccgagcccagaccgcgacga

SEQ ID NO: 542747 - RNA, 64 nt, Human Herpes Virus 1
cggcgcccaucgggccacacggcagcaguaacaccaacaccaccaccaacagcagcggcggcgg

SEQ ID NO: 542748 - RNA, 64 nt, Human Herpes Virus 1
ugcuggcgcagcaggcacgcauuggcuugggcuccaacaccaagcguuucuccgcguucaacgu

SEQ ID NO: 542749 - RNA, 64 nt, Human Herpes Virus 1
cccccacguccacccccgaccccaaacccaagaacaacaccacccccgccaagucgggccgccc

SEQ ID NO: 542750 - RNA, 64 nt, Human Herpes Virus 1
agguguccggcggaaccuggggcaugcaccugcgcaacaccauacgggagguggaggcucgauu

SEQ ID NO: 542751 - RNA, 64 nt, Human Herpes Virus 1
ucuugcgggaccaacacggcuucauguccgucgucaacaccaacaucagcgaguuugucgaguc

SEQ ID NO: 542752 - RNA, 64 nt, Human Herpes Virus 1
ccaaacucucgggcgccuuucucagccgacccaucaacaccaucuuucaugaauuuggguuucg

SEQ ID NO: 542753 - RNA, 64 nt, Human Herpes Virus 1
ccaaggucaccgacauggucaugcgcaagcgccgcaacaccaacuacacccaaguucccaacaa

SEQ ID NO: 542754 - RNA, 64 nt, Human Herpes Virus 1
agcgccgagcgggccggggcgucguggcgcuccgcaacaccacgggcccaacacgccgaccuga

SEQ ID NO: 542755 - RNA, 64 nt, Human Herpes Virus 1; identical to SEQ ID NO: 542747

SEQ ID NO: 542756 - RNA, 64 nt, Human Herpes Virus 1
ugguguucgggaccugguaccgcacuauccaggaccgcaccaucacggacuuuccccugaccac

SEQ ID NO: 542757 - RNA, 64 nt, Human Herpes Virus 1
gcggccugggucuuccgcggagcucccgggagcuccgcaccaagccgcucuccggagagacgau

SEQ ID NO: 542758 - RNA, 57 nt, Human Herpes Virus 4 (Epstein Barr virus)
ccggcucucuuuacugcgaaauggggaagguccuaagaaagccguuugcaaaggcug

SEQ ID NO: 542759 - RNA, 64 nt, Human Herpes Virus 4 (Epstein Barr virus)
ugggagugcugugccucggguaccccuauccuauagguccuaccggagcuccuugucuugauaa

SEQ ID NO: 542760 - RNA, 64 nt, Human Herpes Virus 1
cgacccuguuggucggggagugcguucuacgcgccggccgcacccacaacauccgcggcuucau

SEQ ID NO: 542761 - RNA, 63 nt, Human Herpes Virus 1
cccauggaccccagcgaccccacggccuccgcguacgaggacuugauggcacaccgguccccg

SEQ ID NO: 542762 - RNA, 63 nt, Human Herpes Virus 1
cugacuacggcaucucugccccuucuucgcugguacgaggagcgcuuuuguuuuguauugguc

SEQ ID NO: 542763 - RNA, 63 nt, Human Herpes Virus 1
aagucggguccgcgggagguuccgcgcgaugaguacgaggaucuguacuacaccccgucuuca

SEQ ID NO: 542764 - RNA, 63 nt, Human Herpes Virus 1
uacgagacggugagcgaggacggggggcgugucuacgaggaaauaccauggaugcgggucuac

SEQ ID NO: 542765 - RNA, 63 nt, Human Herpes Virus 1
cacgccgccucggcccgcgaacggcacgcccccuacgaggacgacgagucaauauacgagacg

SEQ ID NO: 542766 - RNA, 64 nt, Human Herpes Virus 4 (Epstein Barr virus)
uauacccagugaguaucuauuuguuacuccuguuuaguugaagaaaacaagcuauuggauugua

SEQ ID NO: 542767 - RNA, 64 nt, Human Herpes Virus 1
auacucgacgccgcucgcccggcgguccgcccgucucguccagaagaccccggcguacccagca

SEQ ID NO: 542768 - RNA, 64 nt, Human Herpes Virus 1
ucgagcuccccaacuuccucccgcccaucugccccucguccagccugcgcugugucuucucgcg

SEQ ID NO: 542769 - RNA, 64 nt, Human Herpes Virus 4 (Epstein Barr virus)
ggcuguuccuggcaagagucuugcaggcuguacagcagcacaagcugcuggaagacaccaucgu

SEQ ID NO: 542770 - RNA, 64 nt, Human Herpes Virus 4 (Epstein Barr virus)
cagucacugcuaucaagccuacucaguucccaacgcagcacauaccccccgccucuccugccau

SEQ ID NO: 542771 - RNA, 64 nt, Human Herpes Virus 4 (Epstein Barr virus)
ccagccaggacgagugccugccuuaccugcuggcgcagcacacgcccccauuucuaaagucaua

SEQ ID NO: 542772 - RNA, 63 nt, Human Herpes Virus 1
gcucuacugcagaugcagagugucacgcgggaggccgcccagcucauucaccccgaagccccg

SEQ ID NO: 542773 - RNA, 63 nt, Human Herpes Virus 1
gcuuuuccacuuuaucgccaccaaccaaaugcugccgcccaccgauccccugcgcacacgggc

SEQ ID NO: 542774 - RNA, 63 nt, Human Herpes Virus 1
uugggaggcacggcccugugugccuuguucgccgccgcccacgagaccuucaguccggacggg

SEQ ID NO: 542775 - RNA, 63 nt, Human Herpes Virus 1; identical to SEQ ID NO: 542739

SEQ ID NO: 542776 - RNA, 63 nt, Human Herpes Virus 1
cgagucuaucgugucgauggccgucuuugacgagccgcccaccgacaucuccgcguggccgcu

SEQ ID NO: 542777 - RNA, 63 nt, Human Herpes Virus 1
cgaugccgaaacguggacgccguggcccgcgcggccgcccaccuggcguuugacgaaaaccac

SEQ ID NO: 542778 - RNA, 63 nt, Human Herpes Virus 1
ggcgaggcgucggagcggggccgcucacgccaagccgcccagcgagccgcucggcgcgcccgg

SEQ ID NO: 542779 - RNA, 63 nt, Human Herpes Virus 1
ccauugggcgggaguuaccgcccaaugggccgggccgcccacuucccgguaugguaauuaaaa

SEQ ID NO: 542780 - RNA, 63 nt, Human Herpes Virus 1; identical to SEQ ID NO: 542740

SEQ ID NO: 542781 - RNA, 64 nt, Human Herpes Virus 2
uguaccuggaacccuggcacagcgacguucgggccgugcucagaaugaagggcguccucgccgg

SEQ ID NO: 542782 - RNA, 64 nt, Human Herpes Virus 1
cggccgucgcgcgcuuggcggguauuaacaucacccgcaccaucuacgacggccagcagauccg

SEQ ID NO: 542783 - RNA, 64 nt, Human Herpes Virus 1
accugcgccucaacagcgcguacguggccaugucccgcaccaccuccuccgaauuccuucgcau

SEQ ID NO: 542784 - RNA, 64 nt, Human Herpes Virus 1
cccacccgcaucuggugacguuuaucggcaggcaccgcaccagcgcggaggagggcguaacguu

SEQ ID NO: 542785 - RNA, 64 nt, Human Herpes Virus 1
gucguccuccucggagauacucaccccgcccgagcucguccaggucccgaacgcgcagcugcug

SEQ ID NO: 542786 - RNA, 63 nt, Human Herpes Virus 1; identical to SEQ ID NO: 542740

SEQ ID NO: 542787 - RNA, 63 nt, Human Herpes Virus 1; identical to SEQ ID NO: 542779

SEQ ID NO: 542788 - RNA, 63 nt, Human Herpes Virus 1
agcgggccugcagccgaagccccucaccacgccgccgcccaucaucgccacgucggaccccac

SEQ ID NO: 542789 - RNA, 63 nt, Human Herpes Virus 1; identical to SEQ ID NO: 542737

SEQ ID NO: 542790 - RNA, 64 nt, Human Hepatitis C Virus (M1LE)
uaccgucuucaaggucaggauguauguggggggcauugagcacaggcucgaugcugcaugcaau

SEQ ID NO: 542791 - RNA, 63 nt, Human Herpes Virus 1; identical to SEQ ID NO: 542746

SEQ ID NO: 542792 - RNA, 63 nt, Human Herpes Virus 2
uuuauuccguagggcggccucgggauucucagccgggggaaauugccaaguuuggccuggugg

SEQ ID NO: 542793 - RNA, 63 nt, Human Herpes Virus 2
gccucccccggacgcacgauaacggugggcccgcgggggaacgcgagcaaugccgcccccucc

SEQ ID NO: 542794 - RNA, 62 nt, Human Herpes Virus 1
cggcaccgcuuucauaucccggggggcaugugcgaucacauacccccuguuucugaccauca

SEQ ID NO: 542795 - RNA, 64 nt, Human Herpes Virus 1; identical to SEQ ID NO: 542701

SEQ ID NO: 542796 - RNA, 64 nt, Human Herpes Virus 4 (Epstein Barr virus)
ugcagaguaccgggaguggcaccgcucgcccaugggcaaauacgcggccgaaugucuuccuucc

SEQ ID NO: 542797 - RNA, 64 nt, Human Herpes Virus 1; identical to SEQ ID NO: 542693

SEQ ID NO: 542798 - RNA, 64 nt, Human Herpes Virus 1; identical to SEQ ID NO: 542694

SEQ ID NO: 542799 - RNA, 63 nt, Human Herpes Virus 1; identical to SEQ ID NO: 542773

SEQ ID NO: 542800 - RNA, 63 nt, Human Herpes Virus 1; identical to SEQ ID NO: 542774

SEQ ID NO: 542801 - RNA, 64 nt, Human Herpes Virus 1; identical to SEQ ID NO: 542698

SEQ ID NO: 542802 - RNA, 64 nt, Human Herpes Virus 1; identical to SEQ ID NO: 542699

SEQ ID NO: 542803 - RNA, 64 nt, Human Herpes Virus 1; identical to SEQ ID NO: 542700

SEQ ID NO: 542804 - RNA, 64 nt, Human Herpes Virus 1; identical to SEQ ID NO: 542703

SEQ ID NO: 542805 - RNA, 64 nt, Human Herpes Virus 1; identical to SEQ ID NO: 542704

SEQ ID NO: 542806 - RNA, 64 nt, Human Herpes Virus 1; identical to SEQ ID NO: 542700

SEQ ID NO: 542807 - RNA, 64 nt, Human Herpes Virus 1; identical to SEQ ID NO: 542699

SEQ ID NO: 542808 - RNA, 64 nt, Human Herpes Virus 1; identical to SEQ ID NO: 542695

SEQ ID NO: 542809 - RNA, 64 nt, Human Herpes Virus 1; identical to SEQ ID NO: 542696

SEQ ID NO: 542810 - RNA, 63 nt, Human Herpes Virus 1; identical to SEQ ID NO: 542779

SEQ ID NO: 542811 - RNA, 63 nt, Human Herpes Virus 1; identical to SEQ ID NO: 542743

SEQ ID NO: 542812 - RNA, 63 nt, Human Herpes Virus 1; identical to SEQ ID NO: 542746

SEQ ID NO: 542813 - RNA, 63 nt, Human Herpes Virus 1; identical to SEQ ID NO: 542740

SEQ ID NO: 542814 - RNA, 63 nt, Human Herpes Virus 1; identical to SEQ ID NO: 542772

SEQ ID NO: 542815 - RNA, 63 nt, Human Herpes Virus 1; identical to SEQ ID NO: 542776

SEQ ID NO: 542816 - RNA, 63 nt, Human Herpes Virus 1; identical to SEQ ID NO: 542777

SEQ ID NO: 542817 - RNA, 63 nt, Human Herpes Virus 1; identical to SEQ ID NO: 542745

SEQ ID NO: 542818 - RNA, 63 nt, Human Herpes Virus 1; identical to SEQ ID NO: 542778

SEQ ID NO: 542819 - RNA, 63 nt, Human Herpes Virus 1; identical to SEQ ID NO: 542779

SEQ ID NO: 542820 - RNA, 63 nt, Human Herpes Virus 1; identical to SEQ ID NO: 542746

SEQ ID NO: 542821 - RNA, 64 nt, Human Herpes Virus 2
ucggcagcggcucaucaucgaagagcugacccuggagacccagggcauguacuacugggugugg

SEQ ID NO: 542822 - RNA, 64 nt, Human Herpes Virus 2
acgcagcgcccgcgauggggaggcccacgcgcgagagacccacuuuacgcaguaucucaucuac

SEQ ID NO: 542823 - RNA, 64 nt, Human Herpes Virus 2
ucaacguggaccccggggacgcggacgccgcgcacggcgcgauccaggacgcccgccgggcccu

SEQ ID NO: 542824 - RNA, 64 nt, Human Herpes Virus 2
gcgaccuguguuaaaauucgcguggaagagcaagcggcgcgacgugauuuucuaaccgcacacc

SEQ ID NO: 542825 - RNA, 64 nt, Human Herpes Virus 2
gauugagccgaagcggcuggugcgcaccgaaaaccggcgcgaccucggccucgugggggccgug

SEQ ID NO: 542826 - RNA, 64 nt, Human Herpes Virus 2
cgcugcgccgcgugcuggcgcggcugggggccggcggcgcgaccgggggggccgaggaggaaga

SEQ ID NO: 542827 - RNA, 64 nt, Human Herpes Virus 2
ccaucgcguucauuaagagguucucccuggacuacggcgcgauuaacuuuaucaaccuggcccc

SEQ ID NO: 542828 - RNA, 64 nt, Human Herpes Virus 2
cggcgggagcugccgggacaagauacaacggacccggcgcgacaacgcacccccgccgcucccc

SEQ ID NO: 542829 - RNA, 64 nt, Human Herpes Virus 2
accgaacggucuccgccaugcaacgccgggcgcgcggcgcgagcucccugcggcuggcgcggug

SEQ ID NO: 542830 - RNA, 64 nt, Human Herpes Virus 2
ugauugacgccccgcccccauacgagaguguggccggcgcgagcgcgggccaguuugucguuau

SEQ ID NO: 542831 - RNA, 63 nt, Human Herpes Virus 1; identical to SEQ ID NO: 542788

SEQ ID NO: 542832 - RNA, 64 nt, Human Herpes Virus 4 (Epstein Barr virus)
gagccauucacggguggaacacgugccccccgagacccgggagacggugguggggggagcaugg

SEQ ID NO: 542833 - RNA, 64 nt, Human Herpes Virus 4 (Epstein Barr virus)
cuacggcaccguuaccggccuacuccagcguucgacccgggagaauggcacucccauuaccggu

SEQ ID NO: 542834 - RNA, 64 nt, Human Herpes Virus 4 (Epstein Barr virus)
caggggcuuugcggagcacaugcgcaccuacuucacccgggagacuuaccuggcugagcaugug

SEQ ID NO: 542835 - RNA, 64 nt, Human Herpes Virus 4 (Epstein Barr virus)
cuaccucauguucagggccauguacgcgguguucacccgggaugagaaagaccugccuuugcca

SEQ ID NO: 542836 - RNA, 64 nt, Human Herpes Virus 2; identical to SEQ ID NO: 540476

SEQ ID NO: 542837 - RNA, 64 nt, Human Herpes Virus 2; identical to SEQ ID NO: 540477

SEQ ID NO: 542838 - RNA, 64 nt, Human Herpes Virus 2; identical to SEQ ID NO: 540478

SEQ ID NO: 542839 - RNA, 64 nt, Human Herpes Virus 1; identical to SEQ ID NO: 542695

SEQ ID NO: 542840 - RNA, 64 nt, Human Herpes Virus 1; identical to SEQ ID NO: 542696

SEQ ID NO: 542841 - RNA, 64 nt, Human Herpes Virus 1; identical to SEQ ID NO: 542697

SEQ ID NO: 542842 - RNA, 64 nt, Human Herpes Virus 1; identical to SEQ ID NO: 542701

SEQ ID NO: 542843 - RNA, 64 nt, Human Herpes Virus 1; identical to SEQ ID NO: 542702

SEQ ID NO: 542844 - RNA, 64 nt, Human Herpes Virus 1; identical to SEQ ID NO: 542703

SEQ ID NO: 542845 - RNA, 64 nt, Human Herpes Virus 1; identical to SEQ ID NO: 542693

SEQ ID NO: 542846 - RNA, 64 nt, Human Herpes Virus 1; identical to SEQ ID NO: 542698

SEQ ID NO: 542847 - RNA, 64 nt, Human Herpes Virus 1; identical to SEQ ID NO: 542699

SEQ ID NO: 542848 - RNA, 64 nt, Human Herpes Virus 1; identical to SEQ ID NO: 542704

SEQ ID NO: 542849 - RNA, 64 nt, Human Herpes Virus 1; identical to SEQ ID NO: 542700

SEQ ID NO: 542850 - RNA, 64 nt, Human Herpes Virus 4 (Epstein Barr virus)
uaucggcccuccaccccggcuacaccauuccuauggaaaucacgcgagagacagauuuacugau

SEQ ID NO: 542851 - RNA, 64 nt, Human Herpes Virus 1
ugacggacauuuacaaggucccccuggacggguacggccgcaugaacggccggggcguguuucg

SEQ ID NO: 542852 - RNA, 64 nt, Human Herpes Virus 1; identical to SEQ ID NO: 542757

SEQ ID NO: 542853 - RNA, 54 nt, Human Herpes Virus 1
gcuccccgccggccgccgccaugaccgcaccacgcucgcgggcccccacuacgc

SEQ ID NO: 542854 - RNA, 64 nt, Human Herpes Virus 1
acaccuucgcgcuggaccggcccugucuggucugccgcaccaucgagcuguacaagcaaaccua

SEQ ID NO: 542855 - RNA, 64 nt, Human Herpes Virus 1
uuuaggggcgccgggggggaggcgcccaagcguccggccgcagcccgggaggacgaggagcggc

SEQ ID NO: 542856 - RNA, 64 nt, Human Herpes Virus 4 (Epstein Barr virus); identical to SEQ ID NO: 542380

SEQ ID NO: 542857 - RNA, 64 nt, Human Herpes Virus 4 (Epstein Barr virus); identical to SEQ ID NO: 542380

SEQ ID NO: 542858 - RNA, 64 nt, Human Herpes Virus 4 (Epstein Barr virus); identical to SEQ ID NO: 542382

SEQ ID NO: 542859 - RNA, 64 nt, Human Herpes Virus 4 (Epstein Barr virus); identical to SEQ ID NO: 542339

SEQ ID NO: 542860 - RNA, 64 nt, Human Herpes Virus 4 (Epstein Barr virus); identical to SEQ ID NO: 542339

SEQ ID NO: 542861 - RNA, 64 nt, Human Herpes Virus 4 (Epstein Barr virus); identical to SEQ ID NO: 542339

SEQ ID NO: 542862 - RNA, 64 nt, Human Herpes Virus 4 (Epstein Barr virus); identical to SEQ ID NO: 542339

SEQ ID NO: 542863 - RNA, 64 nt, Human Herpes Virus 4 (Epstein Barr virus); identical to SEQ ID NO: 542339

SEQ ID NO: 542864 - RNA, 64 nt, Human Herpes Virus 4 (Epstein Barr virus); identical to SEQ ID NO: 542339

SEQ ID NO: 542865 - RNA, 64 nt, Human Herpes Virus 4 (Epstein Barr virus); identical to SEQ ID NO: 542339

SEQ ID NO: 542866 - RNA, 64 nt, Human Herpes Virus 4 (Epstein Barr virus); identical to SEQ ID NO: 542339

SEQ ID NO: 542867 - RNA, 64 nt, Human Herpes Virus 4 (Epstein Barr virus); identical to SEQ ID NO: 542339

SEQ ID NO: 542868 - RNA, 64 nt, Human Herpes Virus 4 (Epstein Barr virus); identical to SEQ ID NO: 542339

SEQ ID NO: 542869 - RNA, 64 nt, Human Herpes Virus 4 (Epstein Barr virus); identical to SEQ ID NO: 542339

SEQ ID NO: 542870 - RNA, 64 nt, Human Herpes Virus 4 (Epstein Barr virus); identical to SEQ ID NO: 542339

SEQ ID NO: 542871 - RNA, 64 nt, Human Herpes Virus 4 (Epstein Barr virus); identical to SEQ ID NO: 542342

SEQ ID NO: 542872 - RNA, 64 nt, Human Herpes Virus 4 (Epstein Barr virus); identical to SEQ ID NO: 542343

SEQ ID NO: 542873 - RNA, 64 nt, Human Herpes Virus 4 (Epstein Barr virus); identical to SEQ ID NO: 542344

SEQ ID NO: 542874 - RNA, 64 nt, Human Herpes Virus 4 (Epstein Barr virus); identical to SEQ ID NO: 542345

SEQ ID NO: 542875 - RNA, 64 nt, Human Herpes Virus 4 (Epstein Barr virus)
agcccauaccuauagauccugggccccccggaggggcggguauagagcauaugccgguggccgc

SEQ ID NO: 542876 - RNA, 64 nt, Human Herpes Virus 1
gccgcccugaugcgcggccgccccggacucgggacggccgcaaacuuccaggucgaaauccaga

SEQ ID NO: 542877 - RNA, 64 nt, Human Herpes Virus 1
cacccaggcccgagccgcggacgccgcggaugaccggccgcaccggggggcggacuggaccgug

SEQ ID NO: 542878 - RNA, 64 nt, Human Herpes Virus 1
ucggcggcccgggggccccgggaccggcauuugccggccgcaaacgggcguuccacggggauga

SEQ ID NO: 542879 - RNA, 64 nt, Human Herpes Virus 1
gagaaacccacggacgcggagauuccgaccgugucggccgcagacauuuauuguaaaaugaggg

SEQ ID NO: 542880 - RNA, 64 nt, Human Herpes Virus 1
uggaccgcgacugucgcguggccgcccgcuaugccggccgcaugacguaccuggccaccggggc

SEQ ID NO: 542881 - RNA, 64 nt, Human Herpes Virus 2
aaagccagguacucuccgcuccacaacgaggacgaggccggagacgaagacgagcucuaaggga

SEQ ID NO: 542882 - RNA, 64 nt, Human Herpes Virus 4 (Epstein Barr virus)
uuagggacaacacguuccucgacaaguacgugggucuggccaucggaggaguucauggggccag

SEQ ID NO: 542883 - RNA, 64 nt, Human Herpes Virus 4 (Epstein Barr virus)
ccuuuaugcgcuuugccgggguggaaaacuccacucuggccagcugcauccucaccacccccga

SEQ ID NO: 542884 - RNA, 64 nt, Human Herpes Virus 4 (Epstein Barr virus)
ugcagcccucgaggaagucuguggccaccugcaaucuggccaacaucugccucccgcgcugccu

SEQ ID NO: 542885 - RNA, 64 nt, Human Herpes Virus 4 (Epstein Barr virus)
cgaccagcacguggguuucugcccccugucucuuucuggccaaccugccucucuuaugccugug

SEQ ID NO: 542886 - RNA, 64 nt, Human Herpes Virus 4 (Epstein Barr virus)
ccccaguagacaucaugcgugcuguugguguauuucuggccaucugucuugucaccauuuucgu

SEQ ID NO: 542887 - RNA, 64 nt, Human Herpes Virus 4 (Epstein Barr virus)
gccuggcgccuggaggccgagagcugagguuggcucuggccacgacagcucgaggccuuucugg

SEQ ID NO: 542888 - RNA, 64 nt, Human Herpes Virus 4 (Epstein Barr virus)
cagaucaucgccucccugccaucgagaccggcccucuggccagacauugaaugggacuaucgcg

SEQ ID NO: 542889 - RNA, 64 nt, Human Herpes Virus 4 (Epstein Barr virus)
aggagcaguaccugcgccagguggccaccgagggucuggccaagcugcaguccugccuggcgca

SEQ ID NO: 542890 - RNA, 64 nt, Human Herpes Virus 4 (Epstein Barr virus)
gagggcagggcuccgggggcagacgcaagcgccgucuggccaccguucuccccggacucgaggu

SEQ ID NO: 542891 - RNA, 64 nt, Human Herpes Virus 4 (Epstein Barr virus)
cucccucccgcacccucaacaagcuaccgaugauucuggccaugaaucugacucuaacuccaac

SEQ ID NO: 542892 - RNA, 64 nt, Human Herpes Virus 1
cccaguccacgcgucccccccucgcgccggcaggggccaagagggcggcgacgcacccccccuc

SEQ ID NO: 542893 - RNA, 64 nt, Human Herpes Virus 1
cuguuuuaaaauucugugucaccgcaacaaccagggccaagagacgucgaucucguacuccagc

SEQ ID NO: 542894 - RNA, 64 nt, Human Herpes Virus 1
cggaguccugucccugcgucgccccgugucugugggccaagauggcccaguguacccuggcggu

SEQ ID NO: 542895 - RNA, 64 nt, Human Herpes Virus 1
cccuggugucugccauggagcgcacggaacacaaggccaagaagaagggcacgagcgcgcugcu

SEQ ID NO: 542896 - RNA, 64 nt, Human Herpes Virus 1
uggccaugcuguguggguuuuccccggcgcugcuggccaagaugcuguuuuaccuggagcgcug

SEQ ID NO: 542897 - RNA, 64 nt, Human Herpes Virus 1
cggugacccuugcccuggagcguccgccccacccggccaagaggacccccgagaaccagcgcca

SEQ ID NO: 542898 - RNA, 64 nt, Human Herpes Virus 1
cugaagaaccuguucgccgagucccggcgaccguggccaagacggcaguucuucgccgaucacg

SEQ ID NO: 542899 - RNA, 64 nt, Human Herpes Virus 1; identical to SEQ ID NO: 542892

SEQ ID NO: 542900 - RNA, 64 nt, Human Herpes Virus 1; identical to SEQ ID NO: 542851

SEQ ID NO: 542901 - RNA, 64 nt, Human Herpes Virus 1; identical to SEQ ID NO: 542855

SEQ ID NO: 542902 - RNA, 64 nt, Human Herpes Virus 1; identical to SEQ ID NO: 542760

SEQ ID NO: 542903 - RNA, 64 nt, Human Herpes Virus 1; identical to SEQ ID NO: 542876

SEQ ID NO: 542904 - RNA, 64 nt, Human Herpes Virus 1; identical to SEQ ID NO: 542877

SEQ ID NO: 542905 - RNA, 64 nt, Human Herpes Virus 1; identical to SEQ ID NO: 542878

SEQ ID NO: 542906 - RNA, 64 nt, Human Herpes Virus 1; identical to SEQ ID NO: 542879

SEQ ID NO: 542907 - RNA, 64 nt, Human Herpes Virus 1; identical to SEQ ID NO: 542880

SEQ ID NO: 542908 - RNA, 64 nt, Human Herpes Virus 1; identical to SEQ ID NO: 542892

SEQ ID NO: 542909 - RNA, 64 nt, Human Herpes Virus 1; identical to SEQ ID NO: 542893

SEQ ID NO: 542910 - RNA, 64 nt, Human Herpes Virus 1; identical to SEQ ID NO: 542894

SEQ ID NO: 542911 - RNA, 64 nt, Human Herpes Virus 1; identical to SEQ ID NO: 542895

SEQ ID NO: 542912 - RNA, 64 nt, Human Herpes Virus 1; identical to SEQ ID NO: 542896

SEQ ID NO: 542913 - RNA, 64 nt, Human Herpes Virus 1; identical to SEQ ID NO: 542897

SEQ ID NO: 542914 - RNA, 64 nt, Human Herpes Virus 1; identical to SEQ ID NO: 542898

SEQ ID NO: 542915 - RNA, 64 nt, Human Herpes Virus 1; identical to SEQ ID NO: 542892

SEQ ID NO: 542916 - RNA, 64 nt, Human Herpes Virus 2; identical to SEQ ID NO: 537165

SEQ ID NO: 542917 - RNA, 64 nt, Human Herpes Virus 2
gcgaccccgaaaggcggccgugcgacaaccagaucgcgcgcaucauccgacaggcccagguaca

SEQ ID NO: 542918 - RNA, 64 nt, Human Herpes Virus 2
ccaucgccuccgccaccgucggccggcgggugagcgcgcgcaugcucggagacgucauggccgu

SEQ ID NO: 542919 - RNA, 64 nt, Human Herpes Virus 2
ccgcguggagccgccgcacccugcuccccgagcacgcgcgcaacugcgugaggccccccgacua

SEQ ID NO: 542920 - RNA, 64 nt, Human Herpes Virus 2
agcagggccaggaaacgucgaucucguacucuagcggggcgaucgccuccuucguggccccgua

SEQ ID NO: 542921 - RNA, 64 nt, Human Herpes Virus 2
ccagggugcgcugggccauauuggaccacaugcacggggcgacgcagggacaggccuccgccac

SEQ ID NO: 542922 - RNA, 64 nt, Human Herpes Virus 2
gcgugccugcagugggacucgauggccggggggucggggcgaaccuuuagccccgaggacgugc

SEQ ID NO: 542923 - RNA, 64 nt, Human Herpes Virus 2
caacgcgcagcugguggacuuucugugcagccuccggggcgaaaagaacguucacguggucauc

SEQ ID NO: 542924 - RNA, 64 nt, Human Herpes Virus 2
accgcgaggggcuuacguucccgcggggagacgacggggcgaccgagaggcacccggacggccg

SEQ ID NO: 542925 - RNA, 64 nt, Human Herpes Virus 2
gguuuaucgacuaccacgagagcugcugcgccgccggggcgaggaugacgagcgugcccggccu

SEQ ID NO: 542926 - RNA, 64 nt, Human Herpes Virus 2
aggacgaaccguucgucgaguggcccaguuugcccggggcgaagcugcggggcgagaucggggg

SEQ ID NO: 542927 - RNA, 64 nt, Human Herpes Virus 2
aggcgcacgcggcguuaucggggacgcgcaaugccggggcgacagcgccggugugguguccguc

SEQ ID NO: 542928 - RNA, 64 nt, Human Herpes Virus 1
cacccgcgaggagguacgugccguacguggguuccgggagcaggcguggaaacuguuuggcucc

SEQ ID NO: 542929 - RNA, 64 nt, Human Herpes Virus 1
ccuccccuguugguauagguccacggccacuggccgggagcaccacauaaccgaccgcaguccc

SEQ ID NO: 542930 - RNA, 64 nt, Human Herpes Virus 2; identical to SEQ ID NO: 541242

SEQ ID NO: 542931 - RNA, 64 nt, Human Herpes Virus 2; identical to SEQ ID NO: 541246

SEQ ID NO: 542932 - RNA, 64 nt, Human Herpes Virus 2; identical to SEQ ID NO: 541251

SEQ ID NO: 542933 - RNA, 64 nt, Human Herpes Virus 2
gcgccuccgcagcgaaaacgccccccaccacaccagcccccacgacccccccgcccacgucuac

SEQ ID NO: 542934 - RNA, 64 nt, Human Herpes Virus 2
guuggcgugggcgcgccuggccgccauucgcgacagcccccagugcgcguccuccgccucgcuc

SEQ ID NO: 542935 - RNA, 64 nt, Human Herpes Virus 2
acagcgaccugcuagucauguggcagcugacaucagcccccaaggugcacaccgacgcuccuuc

SEQ ID NO: 542936 - RNA, 64 nt, Human Herpes Virus 2
ucacgcgagaagccgcccagcucauccaccccgaagcccccaugcugaugcaggacggcgaacg

SEQ ID NO: 542937 - RNA, 64 nt, Human Herpes Virus 2
auucuaccggcuugcccaagccccccucgccaccagcccccaggccguccagcguggaggaucu

SEQ ID NO: 542938 - RNA, 64 nt, Human Herpes Virus 2
ugcgcgggcggcgggucgccugccgcaggauaaccgcguccacggggugcccgaagaggagcug

SEQ ID NO: 542939 - RNA, 64 nt, Human Herpes Virus 2
gggcugcccuccaugaagcgacauuuacucugcucgcguccauugacgucaccgucaaucacca

SEQ ID NO: 542940 - RNA, 64 nt, Human Herpes Virus 2
gggagacgccgucgcaugccgaccccccgggaggcgcguccaagccccgcaagcugcugguguc

SEQ ID NO: 542941 - RNA, 64 nt, Human Herpes Virus 2
ccgugcggccgccaagcaccuggccgcucugacacgcguccaggcggagagaucgucggguuac

SEQ ID NO: 542942 - RNA, 64 nt, Human Herpes Virus 1
cggucuaacguuacacccgaggcggccugggucuuccgcggagcucccgggagcuccgcaccaa

SEQ ID NO: 542943 - RNA, 64 nt, Human Herpes Virus 1
gcgcgaguccccgggcgcgucguuccgcggcaucuccgcggaccacuucgaggcggagguggug

SEQ ID NO: 542944 - RNA, 64 nt, Human Herpes Virus 1
cgucaccgcgacggagcugcgggauuucuacggcuccgcggacgucuccguccaggccgucgug

SEQ ID NO: 542945 - RNA, 64 nt, Human Herpes Virus 1
cgagggccgggccccauaaaacccaagccgggacuccgcggacggauucgcucucggugcgucu

SEQ ID NO: 542946 - RNA, 64 nt, Human Herpes Virus 1
gcagauguacauguccgugggggcggcugacaaguccgcggaugugcucgucucccaggcuauu

SEQ ID NO: 542947 - RNA, 64 nt, Human Herpes Virus 1; identical to SEQ ID NO: 542942

SEQ ID NO: 542948 - RNA, 64 nt, Human Herpes Virus 2
aguggccucucuucccccugcggccggcggggggcgcgcgcaggcgcggcgggugggcgaagac

SEQ ID NO: 542949 - RNA, 64 nt, Human Herpes Virus 2; identical to SEQ ID NO: 542919

SEQ ID NO: 542950 - RNA, 64 nt, Human Herpes Virus 2
acgugcuggcggcgguuaaaaauuguuaccccgacgcgcgcaugagcggccgcggcugccugga

SEQ ID NO: 542951 - RNA, 64 nt, Human Herpes Virus 2
agcucggccccaacggcaaguuuuccguguuuaacgcgcgcaccugcgucaccuuugccgcccg

SEQ ID NO: 542952 - RNA, 64 nt, Human Herpes Virus 2
ggcggccgccguggccaugagccgccgcuacgaccgcgcgcagaagggcuuccugcugaccagc

SEQ ID NO: 542953 - RNA, 64 nt, Human Herpes Virus 2
cgcccccgucgccccccucgcacauccugucccucgcgcgcauccacaagcuaugcauccccgu

SEQ ID NO: 542954 - RNA, 64 nt, Human Herpes Virus 2
gcgcccccgacccggggcccgaagccgaccucgucgcgcgcaucgccaacucugucuucgugug

SEQ ID NO: 542955 - RNA, 64 nt, Human Herpes Virus 2
agcccuuugacaucgcggccgagguggccuucgucgcgcgcauccagaucgcgugucugcgggc

SEQ ID NO: 542956 - RNA, 64 nt, Human Herpes Virus 2
gccugcaucgccagcugcgcgccauccagcagcucgcgcgcaacguccaggccguccugggggc

SEQ ID NO: 542957 - RNA, 64 nt, Human Herpes Virus 2
caacgcgaccgucgccgccggccacgccacgcugcgcgcgcaccugcgggaaaucaaggucgag

SEQ ID NO: 542958 - RNA, 64 nt, Human Herpes Virus 2
cccuggcgggagacgcggccgccgccuaccugcgcgcgcgcacguaugccccggcggcccucac

SEQ ID NO: 542959 - RNA, 64 nt, Human Herpes Virus 2; identical to SEQ ID NO: 542948

SEQ ID NO: 542960 - RNA, 64 nt, Human Herpes Virus 2; identical to SEQ ID NO: 542952

SEQ ID NO: 542961 - RNA, 64 nt, Human Herpes Virus 2
cucgcgagggggaguuuguuguguuuacccuccccgugcucacguuugugucggucaaagaguu

SEQ ID NO: 542962 - RNA, 64 nt, Human Herpes Virus 2
aaaaacugcgaugcuccguccggcagagcgaaaacgugcucacguaccucaucugcaaccgcac

SEQ ID NO: 542963 - RNA, 64 nt, Human Herpes Virus 2
gcccccgggccgcgggcgaggacguccucaacgacgugcucacccucgugccggggaccgccaa

SEQ ID NO: 542964 - RNA, 64 nt, Human Herpes Virus 2
aggacgcgccccccagcccggccgcagaccucgucgugcucacgaaccgucaugaccugggggc

SEQ ID NO: 542965 - RNA, 63 nt, Human Herpes Virus 4 (Epstein Barr virus)
cacggggagacuuaugcuaacauuuuaaacaugcucuuugauggggacagggcggcgaugaac

SEQ ID NO: 542966 - RNA, 63 nt, Human Herpes Virus 4 (Epstein Barr virus)
gccauaaaccugaccggacaaaaguuugacacccucuuugagauuaucaaccagaagcuuuua

SEQ ID NO: 542967 - RNA, 62 nt, Human Herpes Virus 4 (Epstein Barr virus)
aauggaauauuaauaaauaucuuccugucggcucucuuugaagugguugccaugguuucauu

SEQ ID NO: 542968 - RNA, 63 nt, Human Herpes Virus 4 (Epstein Barr virus)
cugguuggggagcuacagauuuauuaccugucucucuuugagggggccaaaagggcucugacc

SEQ ID NO: 542969 - RNA, 63 nt, Human Herpes Virus 4 (Epstein Barr virus)
aaugagaaugucaucuccggggucagcgaggcccucuuugaucaggagggggcgcugaggccu

SEQ ID NO: 542970 - RNA, 63 nt, Human Herpes Virus 4 (Epstein Barr virus)
acgguggcccgcgucuacguggcggugggaggucucuuugagcaggaggucucugaggugcag

SEQ ID NO: 542971 - RNA, 63 nt, Human Herpes Virus 4 (Epstein Barr virus)
cugcuccaaggagcggccaacauccuccagugccucuuugauaacaacuccggggccgcccuc

SEQ ID NO: 542972 - RNA, 64 nt, Human Herpes Virus 2
ggugcugccgccgcgggaggauguguucuccuggacgcgguauuguacccccgacgacgugcgc

SEQ ID NO: 542973 - RNA, 64 nt, Human Herpes Virus 2
gccaccaccggaagccccuucaucauguuuaaggacgcgguaaaccgccacuacaucuacgaca

SEQ ID NO: 542974 - RNA, 64 nt, Human Herpes Virus 2
uggguggaggagagcgucagcgccauuacccuauacgcgguauggcugcccccgcgcacgcgcg

SEQ ID NO: 542975 - RNA, 64 nt, Human Herpes Virus 2
agcgccgggccucccgcaagagccugccgucgcacgcgcgcaggcuggagcucugccugcacga

SEQ ID NO: 542976 - RNA, 64 nt, Human Herpes Virus 4 (Epstein Barr virus)
auaaaagaacacguaauccagaacgcauuucgaaaggcacaaauacaggguuuaucaauguuag

SEQ ID NO: 542977 - RNA, 64 nt, Human Herpes Virus 4 (Epstein Barr virus)
gggccccugccuccuggcccccauguuuggacuaaggcacaagaaugccucacggaccaucugc

SEQ ID NO: 542978 - RNA, 64 nt, Human Herpes Virus 4 (Epstein Barr virus)
guggcaguucgacggccucggcggggaacgugacaggcacaacggcugugacuacaccaucacc

SEQ ID NO: 542979 - RNA, 64 nt, Human Herpes Virus 1
cagcgccugugucuggacguuccuccggucccgccgaacgcauacaugcccuauuaucucaggg

SEQ ID NO: 542980 - RNA, 64 nt, Human Herpes Virus 2; identical to SEQ ID NO: 539925

SEQ ID NO: 542981 - RNA, 64 nt, Human Herpes Virus 2; identical to SEQ ID NO: 539925

SEQ ID NO: 542982 - RNA, 64 nt, Human Herpes Virus 1
cgcgucgggauccacaccgcgguucgcgucccgcccaccggaagcccaacccacacgcacuugc

SEQ ID NO: 542983 - RNA, 64 nt, Human Herpes Virus 2; identical to SEQ ID NO: 541247

SEQ ID NO: 542984 - RNA, 64 nt, Human Herpes Virus 2; identical to SEQ ID NO: 541248

SEQ ID NO: 542985 - RNA, 64 nt, Human Herpes Virus 2; identical to SEQ ID NO: 541249

SEQ ID NO: 542986 - RNA, 64 nt, Human Herpes Virus 2; identical to SEQ ID NO: 541250

SEQ ID NO: 542987 - RNA, 64 nt, Human Herpes Virus 2; identical to SEQ ID NO: 541252

SEQ ID NO: 542988 - RNA, 64 nt, Human Herpes Virus 2; identical to SEQ ID NO: 541241

SEQ ID NO: 542989 - RNA, 64 nt, Human Herpes Virus 2; identical to SEQ ID NO: 541245

SEQ ID NO: 542990 - RNA, 64 nt, Human Herpes Virus 2; identical to SEQ ID NO: 541244

SEQ ID NO: 542991 - RNA, 64 nt, Human Herpes Virus 2; identical to SEQ ID NO: 541245

SEQ ID NO: 542992 - RNA, 64 nt, Human Herpes Virus 2; identical to SEQ ID NO: 541241

SEQ ID NO: 542993 - RNA, 64 nt, Human Herpes Virus 2; identical to SEQ ID NO: 541243

SEQ ID NO: 542994 - RNA, 64 nt, Human Herpes Virus 4 (Epstein Barr virus)
uugaguccguaaaacgaguccgggucgaugagggagcaaacacccggcgcaccauccgggauau

SEQ ID NO: 542995 - RNA, 64 nt, Human Herpes Virus 4 (Epstein Barr virus)
gcauagaagccggcccuccuuccgucaguuccaggccaucaaucaccuuguccuguuugacaac

SEQ ID NO: 542996 - RNA, 64 nt, Human Herpes Virus 4 (Epstein Barr virus)
ccuacagcccacuauguuuaacggggagcugggggccaucaagcaccaggcacuugacacugug

SEQ ID NO: 542997 - RNA, 64 nt, Human Herpes Virus 4 (Epstein Barr virus)
gaggcaaaacucuaggccuguggagcgcugcuuugccaucaagaauuaugucccgggccuggac

SEQ ID NO: 542998 - RNA, 64 nt, Human Herpes Virus 4 (Epstein Barr virus)
cgucuuugucuccgccaagcugcacaccacuguggccaucaauguggccaucauaccuauccug

SEQ ID NO: 542999 - RNA, 64 nt, Human Herpes Virus 4 (Epstein Barr virus)
ccaggguagccugagccgcacugugcgugacgaugccaucaaccagcuggagcucugccggguu

SEQ ID NO: 543000 - RNA, 64 nt, Human Herpes Virus 4 (Epstein Barr virus)
cgauccgguccucuaucucaucucccagaucagggccaucaagcccaucccucuccgcgacggu

SEQ ID NO: 543001 - RNA, 64 nt, Human Herpes Virus 4 (Epstein Barr virus)
ucuauucuuuacggacggggugggggccaaccuagccaucaaugucaauaucaguggcaccuau

SEQ ID NO: 543002 - RNA, 64 nt, Human Herpes Virus 4 (Epstein Barr virus)
ggcugucaaugucgacgaagaugccaucuacgaggccaucaaggaccuggaauguggggaugag

SEQ ID NO: 543003 - RNA, 64 nt, Human Herpes Virus 4 (Epstein Barr virus)
cuuccacaagcaccuguucugcgacccccugugugccaucaaccacagcaucacgaauccgagc

SEQ ID NO: 543004 - RNA, 64 nt, Human Herpes Virus 4 (Epstein Barr virus)
gcgccaggcgcacgguuccucacugggcccggacgccaucaagagcuggugggagagguugugc

SEQ ID NO: 543005 - RNA, 64 nt, Human Herpes Virus 4 (Epstein Barr virus)
guuuaugcccaaucccaaguacacgaccuccgccgccaucaaaaugcuggacaaccccacacag

SEQ ID NO: 543006 - RNA, 64 nt, Human Herpes Virus 4 (Epstein Barr virus)
gcgccaaaggaccauccucgacaagcagcagcuggccaucaagugcacgugcaacgccgucuac

SEQ ID NO: 543007 - RNA, 64 nt, Human Herpes Virus 4 (Epstein Barr virus)
uagucuguugaccuccuggcuggccaagcgcaaggccaucaagaagcugcuggcggccugcgag

SEQ ID NO: 543008 - RNA, 64 nt, Human Herpes Virus 1
ccucuaccgacggagcccgcguucccccccgccgccaccggaucccaaccggaggcauccaacg

SEQ ID NO: 543009 - RNA, 64 nt, Human Herpes Virus 1
ugcgcguccgccgcuucgcugaccguuaacaucaccaccggaaccgcgcuauuugcgcgcgaau

SEQ ID NO: 543010 - RNA, 64 nt, Human Herpes Virus 2; identical to SEQ ID NO: 539924

SEQ ID NO: 543011 - RNA, 64 nt, Human Herpes Virus 2; identical to SEQ ID NO: 539928

SEQ ID NO: 543012 - RNA, 64 nt, Human Herpes Virus 2; identical to SEQ ID NO: 539929

SEQ ID NO: 543013 - RNA, 64 nt, Human Herpes Virus 1
ucacuaucgagggcgcuuggucgggaggccgcaucgaacgcacacccccauccggugguccgug

SEQ ID NO: 543014 - RNA, 64 nt, Human Herpes Virus 1
cuccuacaacaagucucugggggccugucccauccgaacgcagccccgcuggaacuacuaugac

SEQ ID NO: 543015 - RNA, 64 nt, Human Herpes Virus 1
ugcucacgcugcaggugcuggcccacaacauggccgaacgcacaacggcgcugcucugcucggc

SEQ ID NO: 543016 - RNA, 64 nt, Human Herpes Virus 1
cgguuguuauggccgcgagaacgcgcagccuggucgaacgcagacgcguguugauggcaggggu

SEQ ID NO: 543017 - RNA, 64 nt, Human Herpes Virus 2; identical to SEQ ID NO: 539926

SEQ ID NO: 543018 - RNA, 64 nt, Human Herpes Virus 2; identical to SEQ ID NO: 539927

SEQ ID NO: 543019 - RNA, 64 nt, Human Herpes Virus 2; identical to SEQ ID NO: 539928

SEQ ID NO: 543020 - RNA, 64 nt, Human Herpes Virus 2; identical to SEQ ID NO: 539924

SEQ ID NO: 543021 - RNA, 64 nt, Human Herpes Virus 4 (Epstein Barr virus)
gcgggcugggggaggcggcgcaagggcuggauaccccugugaauggacagguacuaacacgcaa

SEQ ID NO: 543022 - RNA, 64 nt, Human Herpes Virus 4 (Epstein Barr virus)
acggggaauccacagacauccgcuacuuuggcuccccugugauuauuccuccuaauuucaucac

SEQ ID NO: 543023 - RNA, 64 nt, Human Herpes Virus 1
gcgaugugguggaauggggggacgcguacguccccgaacgcacccaaaucgacauucgcgccca

SEQ ID NO: 543024 - RNA, 64 nt, Human Herpes Virus 1
gccguccggggcuuuggcgcccgacgaccagcgacgaacgcaaaacucgggcgcguggcggccu

SEQ ID NO: 543025 - RNA, 64 nt, Human Herpes Virus 2; identical to SEQ ID NO: 539926

SEQ ID NO: 543026 - RNA, 64 nt, Human Herpes Virus 2; identical to SEQ ID NO: 539927

SEQ ID NO: 543027 - RNA, 64 nt, Human Herpes Virus 2; identical to SEQ ID NO: 539929

SEQ ID NO: 543028 - RNA, 64 nt, Human Herpes Virus 1
ugccgggggcggggggagggcaaaccccagaggcgggggccaacggcgcggggaggagugggug

SEQ ID NO: 543029 - RNA, 64 nt, Human Herpes Virus 1
cacgcggaaggaggccagggugugccggcacgacgggggccagaagcucccccaccgcauccgc

SEQ ID NO: 543030 - RNA, 64 nt, Human Herpes Virus 1
guuucuggccgauuccuucaugcaggagaucaucgggggccaggccagggagaccggcgacgac

SEQ ID NO: 543031 - RNA, 64 nt, Human Herpes Virus 1
aggccaucgcccguggggccuccggguccgacucgggggccaucaagagcggagacaacaaucu

SEQ ID NO: 543032 - RNA, 64 nt, Human Herpes Virus 1
ccagcccacucgaggcgcagauagccgcguuggugggggccauagccgcggaccgccaggcggg

SEQ ID NO: 543033 - RNA, 64 nt, Human Herpes Virus 1
cgcgggagaccgccggcaggcacgugggguaccagggggccaggguccuugaccccacuuccgg

SEQ ID NO: 543034 - RNA, 64 nt, Human Herpes Virus 1
acuaccugcuucaggcccagcgucuggggggcgcgggggccacguacgaccugcaggccaucaa

SEQ ID NO: 543035 - RNA, 64 nt, Human Herpes Virus 1
cuuacgccgcgcuccugggggccuggcccgcggugggggccagggucguccuccccccgcgagc

SEQ ID NO: 543036 - RNA, 64 nt, Human Herpes Virus 1
gcggcccgucuccggacgccucuccggaggcccggggggccacguucuuuggggagcuggaagc

SEQ ID NO: 543037 - RNA, 64 nt, Human Herpes Virus 1
ugucgcggcaggucccccugguccccccggcucugggggccaacuacuuuucgucgauccgaca

SEQ ID NO: 543038 - RNA, 64 nt, Human Herpes Virus 1
ccuggaccgccaucgcgacugccggguuagcgcggggggccacgaccccguguacgcggcggca

SEQ ID NO: 543039 - RNA, 64 nt, Human Herpes Virus 1
ucggggcguaccuggcgcgcgccgcgggacucgugggggccaugguauuuagcaccaacucggc

SEQ ID NO: 543040 - RNA, 64 nt, Human Herpes Virus 1
cccgcggcuguuguuuuacccggaccccacuuacgggggccacaugcuguacgucaucuuuccc

SEQ ID NO: 543041 - RNA, 64 nt, Human Herpes Virus 1
cgaggaccucccccuggauccccgggacguuaccgggggccaccccggccccaggucguccucc

SEQ ID NO: 543042 - RNA, 64 nt, Human Herpes Virus 4 (Epstein Barr virus)
gcgcaggccuccucgcugagugcggcggccgucuggcgcgcagggcugcuggccccgggggagg

SEQ ID NO: 543043 - RNA, 64 nt, Human Herpes Virus 4 (Epstein Barr virus)
agcuuuuauuucacgacccggcugccaugcuggcggcgcgcacacagcugcgucuagccuucga

SEQ ID NO: 543044 - RNA, 64 nt, Human Herpes Virus 4 (Epstein Barr virus)
gaagcggcaguguaaucugcacaaagaggcgcggggcgcgcaacguugggaggucguuggcggc

SEQ ID NO: 543045 - RNA, 64 nt, Human Herpes Virus 1
uacgccgacauguuucggguagcuuuuuggucccggauggaacgucugcggcuggcgggggggc

SEQ ID NO: 543046 - RNA, 63 nt, Human Herpes Virus 1
caccguuaaccuucgcaacaccucccccguagaucucuguaacggggaccccaucagccucgu

SEQ ID NO: 543047 - RNA, 64 nt, Human Herpes Virus 2; identical to SEQ ID NO: 538137

SEQ ID NO: 543048 - RNA, 64 nt, Human Herpes Virus 2; identical to SEQ ID NO: 538143

SEQ ID NO: 543049 - RNA, 62 nt, Human Herpes Virus 2
gcgcuggggacgcgcggcaggagguccgggugcgccgggaugacgggggcuaggaucgcccc

SEQ ID NO: 543050 - RNA, 62 nt, Human Herpes Virus 2
uaggggagcugacggcagaacuccugucgcuacgccgggacgccgccggcgcaucggcaacc

SEQ ID NO: 543051 - RNA, 62 nt, Human Herpes Virus 2
ccguuacggccaggagccaguccguucgcggacgccgggacagcgccaucacgcgggccccg

SEQ ID NO: 543052 - RNA, 64 nt, Human Herpes Virus 2; identical to SEQ ID NO: 540060

SEQ ID NO: 543053 - RNA, 64 nt, Human Herpes Virus 2; identical to SEQ ID NO: 540061

SEQ ID NO: 543054 - RNA, 64 nt, Human Herpes Virus 2; identical to SEQ ID NO: 540062

SEQ ID NO: 543055 - RNA, 64 nt, Human Herpes Virus 2; identical to SEQ ID NO: 540063

SEQ ID NO: 543056 - RNA, 64 nt, Human Herpes Virus 2; identical to SEQ ID NO: 542720

SEQ ID NO: 543057 - RNA, 64 nt, Human Herpes Virus 2; identical to SEQ ID NO: 542721

SEQ ID NO: 543058 - RNA, 64 nt, Human Herpes Virus 2; identical to SEQ ID NO: 542722

SEQ ID NO: 543059 - RNA, 64 nt, Human Herpes Virus 2; identical to SEQ ID NO: 542723

SEQ ID NO: 543060 - RNA, 64 nt, Human Herpes Virus 2; identical to SEQ ID NO: 542724

SEQ ID NO: 543061 - RNA, 64 nt, Human Herpes Virus 2; identical to SEQ ID NO: 538135

SEQ ID NO: 543062 - RNA, 64 nt, Human Herpes Virus 2; identical to SEQ ID NO: 538136

SEQ ID NO: 543063 - RNA, 62 nt, Human Herpes Virus 2
cucccccgcacacgcccaccccccuccgccgccgccgggacccacgccuccccccgccgcga

SEQ ID NO: 543064 - RNA, 62 nt, Human Herpes Virus 2
cuccacgagcgauuuauggacgccaucacgcccgccgggaccgucaucacgcuucugggucu

SEQ ID NO: 543065 - RNA, 62 nt, Human Herpes Virus 2
gucgggugucgagacgcccuguugcgccucaccgccgggaugaucccaacccgcgucacaac

SEQ ID NO: 543066 - RNA, 62 nt, Human Herpes Virus 2
agccaggguaagccccagcggggcgcgcgcgacgccgggaacaagggcccggcgggcggguu

SEQ ID NO: 543067 - RNA, 62 nt, Human Herpes Virus 2
gacaagacccggcggcggucgcgcuuuuccgccgccgggaaccccggcguggagcgccgggc

SEQ ID NO: 543068 - RNA, 62 nt, Human Herpes Virus 2
ggucgcuuuggccgcguccgcucgggacccagcgccgggacggagggguuccgcgccaugca

SEQ ID NO: 543069 - RNA, 62 nt, Human Herpes Virus 2
agauggcgagcgaagagccgcccccgcgccgucgccgggaggcccgcggucaccccgggucc

SEQ ID NO: 543070 - RNA, 62 nt, Human Herpes Virus 2
ccaggcccggguaccgcccgcguucccggaaccgccgggaaccaagcggaggcaccccgggg

SEQ ID NO: 543071 - RNA, 62 nt, Human Herpes Virus 2
gaccccgaggacucggcccucuuagaggaucccgccgggacggugucuucgcagaucccccc

SEQ ID NO: 543072 - RNA, 64 nt, Human Herpes Virus 2; identical to SEQ ID NO: 538138

SEQ ID NO: 543073 - RNA, 64 nt, Human Herpes Virus 2; identical to SEQ ID NO: 538139

SEQ ID NO: 543074 - RNA, 64 nt, Human Herpes Virus 2; identical to SEQ ID NO: 538140

SEQ ID NO: 543075 - RNA, 64 nt, Human Herpes Virus 2; identical to SEQ ID NO: 538144

SEQ ID NO: 543076 - RNA, 64 nt, Human Herpes Virus 2; identical to SEQ ID NO: 538145

SEQ ID NO: 543077 - RNA, 64 nt, Human Herpes Virus 2; identical to SEQ ID NO: 538141

SEQ ID NO: 543078 - RNA, 64 nt, Human Herpes Virus 2; identical to SEQ ID NO: 538141

SEQ ID NO: 543079 - RNA, 64 nt, Human Herpes Virus 2; identical to SEQ ID NO: 538142

SEQ ID NO: 543080 - RNA, 62 nt, Human Herpes Virus 2
gcgcucgcgcgcccacccgaaaacgccaucaacgccgggagccccgacgcacccggagccgc

SEQ ID NO: 543081 - RNA, 64 nt, Human Herpes Virus 2; identical to SEQ ID NO: 538147

SEQ ID NO: 543082 - RNA, 64 nt, Human Herpes Virus 4 (Epstein Barr virus)
uugggacuuggauaacuuuucagaagcugagaccgaagacgaggcgaguuacgcuccuuggagg

SEQ ID NO: 543083 - RNA, 64 nt, Human Herpes Virus 4 (Epstein Barr virus)
cgugagugacacugaugagucugacuacucagaugaagacgaggagauugauuuggaggaagag

SEQ ID NO: 543084 - RNA, 64 nt, Human Herpes Virus 4 (Epstein Barr virus)
uggacacccccgggggcccggcccggccaagagcgaagacgaggagucugagcgucgagacgcc

SEQ ID NO: 543085 - RNA, 64 nt, Human Herpes Virus 4 (Epstein Barr virus)
aggcaaggccggggacgcaggagccgagggugcagaagacgaagagggcgggggccccuggggg

SEQ ID NO: 543086 - RNA, 64 nt, Human Herpes Virus 4 (Epstein Barr virus)
cuccgggguccacugcaauuacucugcaggggaagaagacgaccaauaccaugccaaccggacc

SEQ ID NO: 543087 - RNA, 64 nt, Human Herpes Virus 2; identical to SEQ ID NO: 538134

SEQ ID NO: 543088 - RNA, 63 nt, Human Herpes Virus 4 (Epstein Barr virus)
cucguacuucucaugcauggucuuguucaccugcucuucgaugcacuugaaggcguccgggag

SEQ ID NO: 543089 - RNA, 63 nt, Human Herpes Virus 4 (Epstein Barr virus)
caaaagaaugguggcaaggguaagccuucuggucucuucgaacaccuggccgcccaugggcgc

SEQ ID NO: 543090 - RNA, 64 nt, Human Herpes Virus 2
cggcgagugccuggugcugugccccccccuguggaccggcgaccgccuggucuucgauucgccc

SEQ ID NO: 543091 - RNA, 64 nt, Human Herpes Virus 2
gccgugcuucggugcacgcgcgccuaccuguaucaccggcgacaccacacuaaauuuuucgugc

SEQ ID NO: 543092 - RNA, 64 nt, Human Herpes Virus 2
caugcaggagaucaucggggggcaggcccgcgagaccggcgacgaccggcccguccuaacaaag

SEQ ID NO: 543093 - RNA, 64 nt, Human Herpes Virus 2
cggccgcuacgcgugcuacuuucgcgaccuccagaccggcgacgcgagccccagcccccucucc

SEQ ID NO: 543094 - RNA, 64 nt, Human Herpes Virus 2
cuuccgggucgaaacccagacccgggcccacgcgaccggcgacugcaccccguggcguucggcg

SEQ ID NO: 543095 - RNA, 64 nt, Human Herpes Virus 2
guccgccgccgggcccccggucaccgacgccaccaccggcgagcuucaacgagaacgacgugcu

SEQ ID NO: 543096 - RNA, 64 nt, Human Herpes Virus 1
gcaugcgcgcggcccaguuccacgcgcgguuuauggacgccaucacaccgacggggaccgucau

SEQ ID NO: 543097 - RNA, 64 nt, Human Herpes Virus 1
cccccgccgagcuggagguugucuucccgacuacggacgccaagcugaacuaccugucgcggac

SEQ ID NO: 543098 - RNA, 64 nt, Human Herpes Virus 1
agauuggggccacgggauuuaccgcggaagagcuggacgccauggacagggaggcggcucgagc

SEQ ID NO: 543099 - RNA, 64 nt, Human Herpes Virus 1
cucggaggugcuucuguuuggcgcccccgaccucggacgccacaccaucucccccguguccugg

SEQ ID NO: 543100 - RNA, 64 nt, Human Herpes Virus 1
guuccgggacgcccggggccuggagcugggggugggacgccacgccauggcccccgccaccauc

SEQ ID NO: 543101 - RNA, 64 nt, Human Herpes Virus 1
guaaccacgucacccagcaggcgcaggugcggcuggacgccaacgagcugcggcgguaccugcc

SEQ ID NO: 543102 - RNA, 64 nt, Human Herpes Virus 1
ccgagcgcgcagacccccugauucgccaacuggaggacgccaucgugcugcugcggcugcacau

SEQ ID NO: 543103 - RNA, 64 nt, Human Herpes Virus 1
caucaacuucgacuggcccuucuugcuggccaagcugacggacauuuacaaggucccccuggac

SEQ ID NO: 543104 - RNA, 64 nt, Human Herpes Virus 1
cgugcgggaguuucuccgcggucaggcggcggcgcugacggaccuuggucuggcccacgcaaac

SEQ ID NO: 543105 - RNA, 64 nt, Human Herpes Virus 1
cuccccgcgccaucaucuaacccgccaagugauccugacggaucugugccaacccaacgcggau

SEQ ID NO: 543106 - RNA, 64 nt, Human Herpes Virus 1
gcugcgauccaaggaaguggcccuggauuuuggccugacggaaaggcuucgcgagcacgaagcc

SEQ ID NO: 543107 - RNA, 64 nt, Human Herpes Virus 1
ccagguguuucucggaggccauguggcgguggcccugacggagcugugucaggcgcuuccgccc

SEQ ID NO: 543108 - RNA, 64 nt, Human Herpes Virus 1
caacgcgcuggaacacuuugggcgacgcgagacccugacggagguccugggucgguacaacgua

SEQ ID NO: 543109 - RNA, 64 nt, Human Herpes Virus 1
cgccucccuccgcccccaagccuggcucuccguccugacggacggaagaugacgacgacaugcg

SEQ ID NO: 543110 - RNA, 64 nt, Human Herpes Virus 1
ggccugguauaucacgggcgaugggauucuugaccugacggaucgucgaacaaaaaccagcccc

SEQ ID NO: 543111 - RNA, 64 nt, Human Herpes Virus 1; identical to SEQ ID NO: 543103

SEQ ID NO: 543112 - RNA, 64 nt, Human Herpes Virus 1; identical to SEQ ID NO: 543104

SEQ ID NO: 543113 - RNA, 64 nt, Human Herpes Virus 1; identical to SEQ ID NO: 543105

SEQ ID NO: 543114 - RNA, 64 nt, Human Herpes Virus 1; identical to SEQ ID NO: 543106

SEQ ID NO: 543115 - RNA, 64 nt, Human Herpes Virus 1; identical to SEQ ID NO: 543107

SEQ ID NO: 543116 - RNA, 64 nt, Human Herpes Virus 1; identical to SEQ ID NO: 543108

SEQ ID NO: 543117 - RNA, 64 nt, Human Herpes Virus 1; identical to SEQ ID NO: 543109

SEQ ID NO: 543118 - RNA, 64 nt, Human Herpes Virus 1; identical to SEQ ID NO: 543110

SEQ ID NO: 543119 - RNA, 64 nt, Human Herpes Virus 4 (Epstein Barr virus)
accugccccucuuggccacgcaccccgggccaggccaccuuagacccggccaagccccaucccu

SEQ ID NO: 543120 - RNA, 64 nt, Human Herpes Virus 4 (Epstein Barr virus); identical to SEQ ID NO: 543119

SEQ ID NO: 543121 - RNA, 64 nt, Human Herpes Virus 4 (Epstein Barr virus); identical to SEQ ID NO: 543119

SEQ ID NO: 543122 - RNA, 64 nt, Human Hepatitis C Virus
guuggcggcguccuggcugcucuggccgcguauugccugucaacaggcugcguggucauagugg

SEQ ID NO: 543123 - RNA, 64 nt, Human Hepatitis C Virus
uggaauuucaucagugggauacaauacuuggcgggccugucaacgcugccugguaaccccgcca

SEQ ID NO: 543124 - RNA, 64 nt, Human Herpes Virus 1
uugcgaaccgucccguuccgggaugccgugccgcccguugcagggccuggugcucgugggccuc

SEQ ID NO: 543125 - RNA, 64 nt, Human Herpes Virus 1
aggcggggcggaggugcaccgcauacccguguacccguugcagcuguucaugccggauuuuagc

SEQ ID NO: 543126 - RNA, 64 nt, Human Herpes Virus 4 (Epstein Barr virus)
ugccuguaauuguugcgcccuaccucuuuuggcuggcggcuauugccgccucguguuucacggc

SEQ ID NO: 543127 - RNA, 64 nt, Human Herpes Virus 4 (Epstein Barr virus)
cuacgguccuggggccggagcggucgccccggccggcggcuacuuuaccuccccaggagguuac

SEQ ID NO: 543128 - RNA, 64 nt, Human Herpes Virus 4 (Epstein Barr virus)
gcucuggggucugcgcaccgagacggcacgccagggcggcuagcagcacgaccacgcuuagcac

SEQ ID NO: 543129 - RNA, 64 nt, Human Herpes Virus 4 (Epstein Barr virus)
cccugccuuccaggugcaccggaccagcagacccggcggcuacccccaggguggggccagcgga

SEQ ID NO: 543130 - RNA, 64 nt, Human Herpes Virus 4 (Epstein Barr virus)
ccgugaggucaguauauacuaacacgaaugcccaggcggcuagcgucccaaacauaaaugcccc

SEQ ID NO: 543131 - RNA, 64 nt, Human Herpes Virus 4 (Epstein Barr virus); identical to SEQ ID NO: 543126

SEQ ID NO: 543132 - RNA, 64 nt, Human Herpes Virus 4 (Epstein Barr virus); identical to SEQ ID NO: 543127

SEQ ID NO: 543133 - RNA, 64 nt, Human Herpes Virus 4 (Epstein Barr virus); identical to SEQ ID NO: 543128

SEQ ID NO: 543134 - RNA, 64 nt, Human Herpes Virus 4 (Epstein Barr virus); identical to SEQ ID NO: 543129

SEQ ID NO: 543135 - RNA, 64 nt, Human Herpes Virus 4 (Epstein Barr virus); identical to SEQ ID NO: 543130

SEQ ID NO: 543136 - RNA, 64 nt, Human Herpes Virus 1; identical to SEQ ID NO: 542012

SEQ ID NO: 543137 - RNA, 64 nt, Human Herpes Virus 1; identical to SEQ ID NO: 542018

SEQ ID NO: 543138 - RNA, 64 nt, Human Herpes Virus 1; identical to SEQ ID NO: 542022

SEQ ID NO: 543139 - RNA, 64 nt, Human Herpes Virus 4 (Epstein Barr virus)
gggaggaggggagacggaccucuauccaccgccgccccggaacacugaaucugaggccucuggc

SEQ ID NO: 543140 - RNA, 64 nt, Human Herpes Virus 1; identical to SEQ ID NO: 542028

SEQ ID NO: 543141 - RNA, 64 nt, Human Herpes Virus 1; identical to SEQ ID NO: 542010

SEQ ID NO: 543142 - RNA, 64 nt, Human Herpes Virus 2
ccgccgggaaccccggcguggagcgccgggccucccgcaagagccugccgucgcacgcgcgcag

SEQ ID NO: 543143 - RNA, 62 nt, Human Herpes Virus 2
ugcgccugcgcggggaccugcgcguggccggcggcagcgaggccgccguggccgccgugcgc

SEQ ID NO: 543144 - RNA, 64 nt, Human Herpes Virus 2
ccgccugcucgacugcaccgagggcaagcgcgggggcggagacagcugcugcacgcgcgccgcc

SEQ ID NO: 543145 - RNA, 64 nt, Human Herpes Virus 4 (Epstein Barr virus)
uaagguuucagguaccgugauuacauugggagaacagggguacaaagugucguuggaucugagg

SEQ ID NO: 543146 - RNA, 64 nt, Human Herpes Virus 4 (Epstein Barr virus)
cagcaagaagaggaggugguaagcgguucaccuucagggguaaguaaccugaccucuccagggc

SEQ ID NO: 543147 - RNA, 64 nt, Human Herpes Virus 4 (Epstein Barr virus); identical to SEQ ID NO: 543146

SEQ ID NO: 543148 - RNA, 64 nt, Human Herpes Virus 4 (Epstein Barr virus); identical to SEQ ID NO: 543146

SEQ ID NO: 543149 - RNA, 64 nt, Human Herpes Virus 4 (Epstein Barr virus)
gcacgagaaaugcgccgucauuccaucggauaaacagggguauguggugccauguggcaucguc

SEQ ID NO: 543150 - RNA, 64 nt, Human Herpes Virus 1; identical to SEQ ID NO: 538565

SEQ ID NO: 543151 - RNA, 64 nt, Human Herpes Virus 1; identical to SEQ ID NO: 538572

SEQ ID NO: 543152 - RNA, 63 nt, Human Herpes Virus 2
cggcggggauggccgaaccgccgucguggcgcucggcggaaccucgggcccguccgcgacuac

SEQ ID NO: 543153 - RNA, 64 nt, Human Herpes Virus 1
agcaccccccccaaaucccggcgccggucgucacgcacgccaaugcccucccugacggccaucg

SEQ ID NO: 543154 - RNA, 61 nt, Human Herpes Virus 2
gcgccaccguguuucuaguccccaggcgccacggaaagaccugguuuuuggugccccucau

SEQ ID NO: 543155 - RNA, 64 nt, Human Herpes Virus 4 (Epstein Barr virus)
gccgugugccugcaaagaaaccgaggaaacugccuuggcccacgcccaagacgcacccagugaa

SEQ ID NO: 543156 - RNA, 64 nt, Human Herpes Virus 4 (Epstein Barr virus)
agauuucuaguuaccacagguagaauaucgggcguuggcccauaaaaauaagugcauggauaua

SEQ ID NO: 543157 - RNA, 64 nt, Human Herpes Virus 4 (Epstein Barr virus)
gccucuggagcuggggaucuuuggacugggggauuuggcccagccggugcuggugcgcgauuuu

SEQ ID NO: 543158 - RNA, 64 nt, Human Herpes Virus 4 (Epstein Barr virus)
ccuggccucggccgaucucgugcgcuacgucuauuuggcccacgcacagugcuucaacgaggga

SEQ ID NO: 543159 - RNA, 64 nt, Human Herpes Virus 4 (Epstein Barr virus)
caaagaugagguuauaggucaggccuugcaaauauuggcccacucccaaaccuggaccucccug

SEQ ID NO: 543160 - RNA, 64 nt, Human Herpes Virus 4 (Epstein Barr virus)
uuacagacuuuagacuauuuuucgaagucacccugggucggagaaucgcagauugcguuguggu

SEQ ID NO: 543161 - RNA, 64 nt, Human Herpes Virus 1; identical to SEQ ID NO: 542020

SEQ ID NO: 543162 - RNA, 64 nt, Human Herpes Virus 1; identical to SEQ ID NO: 542021

SEQ ID NO: 543163 - RNA, 64 nt, Human Herpes Virus 1; identical to SEQ ID NO: 542032

SEQ ID NO: 543164 - RNA, 64 nt, Human Herpes Virus 1; identical to SEQ ID NO: 542009

SEQ ID NO: 543165 - RNA, 64 nt, Human Herpes Virus 1; identical to SEQ ID NO: 542013

SEQ ID NO: 543166 - RNA, 64 nt, Human Herpes Virus 1; identical to SEQ ID NO: 542014

SEQ ID NO: 543167 - RNA, 64 nt, Human Herpes Virus 1; identical to SEQ ID NO: 542015

SEQ ID NO: 543168 - RNA, 64 nt, Human Herpes Virus 1; identical to SEQ ID NO: 542010

SEQ ID NO: 543169 - RNA, 64 nt, Human Herpes Virus 1; identical to SEQ ID NO: 542011

SEQ ID NO: 543170 - RNA, 64 nt, Human Herpes Virus 1; identical to SEQ ID NO: 542019

SEQ ID NO: 543171 - RNA, 64 nt, Human Herpes Virus 1; identical to SEQ ID NO: 542023

SEQ ID NO: 543172 - RNA, 64 nt, Human Herpes Virus 1; identical to SEQ ID NO: 542024

SEQ ID NO: 543173 - RNA, 64 nt, Human Herpes Virus 1; identical to SEQ ID NO: 542025

SEQ ID NO: 543174 - RNA, 64 nt, Human Herpes Virus 1; identical to SEQ ID NO: 542029

SEQ ID NO: 543175 - RNA, 64 nt, Human Herpes Virus 1; identical to SEQ ID NO: 542030

SEQ ID NO: 543176 - RNA, 64 nt, Human Herpes Virus 1; identical to SEQ ID NO: 542031

SEQ ID NO: 543177 - RNA, 64 nt, Human Herpes Virus 1; identical to SEQ ID NO: 535919

SEQ ID NO: 543178 - RNA, 64 nt, Human Herpes Virus 1; identical to SEQ ID NO: 542027

SEQ ID NO: 543179 - RNA, 64 nt, Human Herpes Virus 1; identical to SEQ ID NO: 542016

SEQ ID NO: 543180 - RNA, 64 nt, Human Herpes Virus 1; identical to SEQ ID NO: 542017

SEQ ID NO: 543181 - RNA, 64 nt, Human Herpes Virus 1; identical to SEQ ID NO: 542009

SEQ ID NO: 543182 - RNA, 64 nt, Human Herpes Virus 1; identical to SEQ ID NO: 542035

SEQ ID NO: 543183 - RNA, 64 nt, Human Herpes Virus 4 (Epstein Barr virus)
caaucaucuucauauccaggauaugcgggucccuggaccccaaggucucaacauccauguuaua

SEQ ID NO: 543184 - RNA, 64 nt, Human Herpes Virus 4 (Epstein Barr virus)
gggaaccgggugggagcagggagggggcgucccgggaccccagcccccagccggcaauccaggc

SEQ ID NO: 543185 - RNA, 64 nt, Human Herpes Virus 4 (Epstein Barr virus)
gaggccgaaggcuuuaagccgcucuggccacguuggaccccaagcuuucuggacacugccccca

SEQ ID NO: 543186 - RNA, 64 nt, Human Herpes Virus 4 (Epstein Barr virus)
cgggaagugccagaggcagaauugaccgcauccuggaccccaugucuugugacagugguccucg

SEQ ID NO: 543187 - RNA, 64 nt, Human Herpes Virus 4 (Epstein Barr virus)
uuggggagagagaauuuggagaauugcugagcugggaccccacugaccuuccccggacgguggc

SEQ ID NO: 543188 - RNA, 64 nt, Human Herpes Virus 4 (Epstein Barr virus)
aggugggcgcucagcgcaaugggacgcugcuucgggaccccaggacauaccuggcagguaugac

SEQ ID NO: 543189 - RNA, 64 nt, Human Herpes Virus 4 (Epstein Barr virus)
uuuagcuccagggccucaacauccauguucauugggaccccaaauguuagccgccgggaggcca

SEQ ID NO: 543190 - RNA, 64 nt, Human Herpes Virus 4 (Epstein Barr virus); identical to SEQ ID NO: 543160

SEQ ID NO: 543191 - RNA, 64 nt, Human Herpes Virus 4 (Epstein Barr virus); identical to SEQ ID NO: 543183

SEQ ID NO: 543192 - RNA, 64 nt, Human Herpes Virus 4 (Epstein Barr virus); identical to SEQ ID NO: 543184

SEQ ID NO: 543193 - RNA, 64 nt, Human Herpes Virus 4 (Epstein Barr virus); identical to SEQ ID NO: 543185

SEQ ID NO: 543194 - RNA, 64 nt, Human Herpes Virus 4 (Epstein Barr virus); identical to SEQ ID NO: 543186

SEQ ID NO: 543195 - RNA, 64 nt, Human Herpes Virus 4 (Epstein Barr virus); identical to SEQ ID NO: 543187

SEQ ID NO: 543196 - RNA, 64 nt, Human Herpes Virus 4 (Epstein Barr virus); identical to SEQ ID NO: 543188

SEQ ID NO: 543197 - RNA, 64 nt, Human Herpes Virus 4 (Epstein Barr virus); identical to SEQ ID NO: 543189

SEQ ID NO: 543198 - RNA, 64 nt, Human Herpes Virus 2
ugugugcagaccgcgcccccuauguugaucacagccaauccaugacucuguaugucacagagaa

SEQ ID NO: 543199 - RNA, 64 nt, Human Herpes Virus 4 (Epstein Barr virus)
uugagucccgcuggcugaacauuagcaucccggcgaccaccagcucugucaugcugcguggccu

SEQ ID NO: 543200 - RNA, 64 nt, Human Herpes Virus 4 (Epstein Barr virus)
gaaccagaaaaaaaccaucccagaaggagcucgagaccaccagaggagauauccccaucaccuc

SEQ ID NO: 543201 - RNA, 64 nt, Human Herpes Virus 4 (Epstein Barr virus)
aggcuaguguagggcggcucaccuuggucaacaagaccaccauccugcugcgcccgaugaagac

SEQ ID NO: 543202 - RNA, 64 nt, Human Herpes Virus 4 (Epstein Barr virus)
agguccugagagacaugcaccaggggcagcuauggaccaccaaugugaucgugguggacgaagc

SEQ ID NO: 543203 - RNA, 64 nt, Human Herpes Virus 4 (Epstein Barr virus)
auuuugacaaccuccacguucacuaucugcugcugaccaccaacgggacugucauggaaauugc

SEQ ID NO: 543204 - RNA, 64 nt, Human Herpes Virus 4 (Epstein Barr virus)
uggccaaguccaacagccccuucgacuucuuugugaccaccaccgggcagacuguggaaauguc

SEQ ID NO: 543205 - RNA, 64 nt, Human Herpes Virus 2
cccagaaccaugauccuggcgcgucgccgaauacgacgcccauagagucgauugcggggaccgc

SEQ ID NO: 543206 - RNA, 64 nt, Human Herpes Virus 2
cgcugcgcgucccuuuuuuggauuuugccaccgcgacgcccaagcgccaccagaccgugguccc

SEQ ID NO: 543207 - RNA, 64 nt, Human Herpes Virus 2
ccaguuguuuccggggcuggccgcccugugccuggacgcccaggcggggcggccacuggcgucg

SEQ ID NO: 543208 - RNA, 64 nt, Human Herpes Virus 2
cgagggacugcaggcguucggggccguccucguagacgcccaucggcgcaucaccgacccggag

SEQ ID NO: 543209 - RNA, 64 nt, Human Herpes Virus 2
accucgaccugcuacacgaacagauaccagcggcgacgcccagcgaaccggacuccgucgugug

SEQ ID NO: 543210 - RNA, 64 nt, Human Herpes Virus 2
acgcgcuaguacccagaggcuggagcgcuggugggacgcccauauguacgcguaccccuuugac

SEQ ID NO: 543211 - RNA, 64 nt, Human Herpes Virus 2
aaaccucaccaagcgagccaucguggagcugcuggacgcccaccgcaucgaccacagcgccugc

SEQ ID NO: 543212 - RNA, 64 nt, Human Herpes Virus 2
ccaguggcucacccacaacgccagccugcggcuggacgcccagucgucggcggugauguucggg

SEQ ID NO: 543213 - RNA, 64 nt, Human Herpes Virus 2
uccuacauacacucccucagccgccgggcguccggacgcccaagcggccccuccccccgagacg

SEQ ID NO: 543214 - RNA, 64 nt, Human Herpes Virus 2
cagcgacgacauccccgcccgcuucgccgacuccgacgcccacuacgcguuugacuacuacagc

SEQ ID NO: 543215 - RNA, 64 nt, Human Herpes Virus 2
gggcgggcuguucgucucccugccggucgcgugcgacgcccaaggcguguacgacccguacacg

SEQ ID NO: 543216 - RNA, 64 nt, Human Herpes Virus 2
cgugcgcggcggcguuggagagcuggcccucagcgacgcccaggaacacggcguacgccgagua

SEQ ID NO: 543217 - RNA, 64 nt, Human Herpes Virus 2
gagcgacgggcaccgccuguacgccguggucgcagacgcccacgagcgccuggggcccuggcgc

SEQ ID NO: 543218 - RNA, 62 nt, Human Herpes Virus 2
gcacaccccggucggaggcgaugucggcggagcagcggaagaagaagaagacgacgacgacg

SEQ ID NO: 543219 - RNA, 62 nt, Human Herpes Virus 2; identical to SEQ ID NO: 543218

SEQ ID NO: 543220 - RNA, 64 nt, Human Herpes Virus 1
acccugcagcgacccgcuuaacagcgucaacagcgugccgcagaucuugguggcgugaaacucc

SEQ ID NO: 543221 - RNA, 64 nt, Human Herpes Virus 1
caagcccggcccuguggagcuuccugcuuaggcagugccgcauuuuggcaucagaaccccuggg

SEQ ID NO: 543222 - RNA, 64 nt, Human Herpes Virus 1; identical to SEQ ID NO: 543220

SEQ ID NO: 543223 - RNA, 64 nt, Human Herpes Virus 1; identical to SEQ ID NO: 543221

SEQ ID NO: 543224 - RNA, 64 nt, Human Herpes Virus 1
cuccgcaucaccacagaagccccgccuacguugcgacccccagggacccuccguccgcgacccu

SEQ ID NO: 543225 - RNA, 64 nt, Human Herpes Virus 1
gggacccuccguccgcgacccuccagccgcauacgacccccauggagccccgccccggagcgag

SEQ ID NO: 543226 - RNA, 64 nt, Human Herpes Virus 1
gacccuuacacuggaaccggccgccauguugggggacccccacucauacacgggagccgggcgc

SEQ ID NO: 543227 - RNA, 64 nt, Human Herpes Virus 1
ggucgccaugugacccccugacuuuauauauacagacccccaacacauacacauggccccuuug

SEQ ID NO: 543228 - RNA, 64 nt, Human Herpes Virus 1
cagcgggucguucagcaccaucccgaucgugaacgacccccagacccgcauggaggccgaggag

SEQ ID NO: 543229 - RNA, 64 nt, Human Herpes Virus 1
cccuacgagugcccuuuuuagauuucgcgaccgcgacccccaagcgccaccagaccgugguccc

SEQ ID NO: 543230 - RNA, 64 nt, Human Herpes Virus 1
gccuggacggcacagacgcgcccccuggggcgcugacccccaacgacgauaccgaacaggcccu

SEQ ID NO: 543231 - RNA, 64 nt, Human Herpes Virus 1
acuccugguguacgacagcgcccccaaccuaacggacccccacgugcucugggcggagggggcc

SEQ ID NO: 543232 - RNA, 64 nt, Human Herpes Virus 1
acgaguucaaccucgggugcauauccugggauccgacccccauggagcacgagcaggcggucgg

SEQ ID NO: 543233 - RNA, 64 nt, Human Herpes Virus 1
cggggaguguuccucgucggacgaggacauggaagacccccacggagaggacggaccggagccg

SEQ ID NO: 543234 - RNA, 64 nt, Human Herpes Virus 1
caaucagcuguuucggguccugcgggucgcccgggacccccacggcagugccaaccgccugcgc

SEQ ID NO: 543235 - RNA, 64 nt, Human Herpes Virus 1
ccgaggacgcgugccuggacuccccgcccccggagacccccaaaccuucccacaccacaccacc

SEQ ID NO: 543236 - RNA, 64 nt, Human Herpes Virus 1
acacgagcacccugcugcccccggagcuguccgagacccccaacgccacgcagccagaacucgc

SEQ ID NO: 543237 - RNA, 64 nt, Human Herpes Virus 1
cgaugggggugcguucuggggugucuuuaacguggacccccaagacgcggaugcggcuuccggg

SEQ ID NO: 543238 - RNA, 64 nt, Human Herpes Virus 1
ggcccuggccgaccucggggggagcgggcuggcggacccccacggccggacgggccuagcaaga

SEQ ID NO: 543239 - RNA, 64 nt, Human Herpes Virus 1
ugcgagguuggucgcccgucucugcuacgccgcugacccccaccgcgcuccucccgccacccga

SEQ ID NO: 543240 - RNA, 64 nt, Human Herpes Virus 1
gaacaccgggcgucuguggcugccaaacacccccgacccccaaaaaccaccgcgcggauuucug

SEQ ID NO: 543241 - RNA, 64 nt, Human Herpes Virus 1
gggccacggcgccgaccacccggaaccugcucacgacccccaaguucaccguggccugggacug

SEQ ID NO: 543242 - RNA, 64 nt, Human Herpes Virus 1
cuauguguuucagauagagcugcuccggcggugcgacccccacaucggacgggggaagcucccc

SEQ ID NO: 543243 - RNA, 62 nt, Human Herpes Virus 1
ggagcacacccuguguaccuauguaugacaccgacccccaucgccgcggcucccggcccggg

SEQ ID NO: 543244 - RNA, 64 nt, Human Herpes Virus 1; identical to SEQ ID NO: 543228

SEQ ID NO: 543245 - RNA, 64 nt, Human Herpes Virus 1; identical to SEQ ID NO: 543227

SEQ ID NO: 543246 - RNA, 64 nt, Human Herpes Virus 1; identical to SEQ ID NO: 543226

SEQ ID NO: 543247 - RNA, 64 nt, Human Herpes Virus 4 (Epstein Barr virus)
caccugcagcguuccuagcaaugagucggucucucggaucgaguugggccggggauacacuccc

SEQ ID NO: 543248 - RNA, 64 nt, Human Herpes Virus 2
ugagccgcgagauccuaugggccgcguacgccgagcagaugaugcggcccgaucuguucgacgg

SEQ ID NO: 543249 - RNA, 60 nt, Human Herpes Virus 4 (Epstein Barr virus)
aggguccggcaucuucaggggcagcaggcucaccaccacaggccccccagacccgggucu

SEQ ID NO: 543250 - RNA, 60 nt, Human Herpes Virus 4 (Epstein Barr virus); identical to SEQ ID NO: 543249

SEQ ID NO: 543251 - RNA, 60 nt, Human Herpes Virus 4 (Epstein Barr virus); identical to SEQ ID NO: 543249

SEQ ID NO: 543252 - RNA, 60 nt, Human Herpes Virus 4 (Epstein Barr virus); identical to SEQ ID NO: 543249

SEQ ID NO: 543253 - RNA, 60 nt, Human Herpes Virus 4 (Epstein Barr virus); identical to SEQ ID NO: 543249

SEQ ID NO: 543254 - RNA, 60 nt, Human Herpes Virus 4 (Epstein Barr virus); identical to SEQ ID NO: 543249

SEQ ID NO: 543255 - RNA, 60 nt, Human Herpes Virus 4 (Epstein Barr virus); identical to SEQ ID NO: 543249

SEQ ID NO: 543256 - RNA, 60 nt, Human Herpes Virus 4 (Epstein Barr virus); identical to SEQ ID NO: 543249

SEQ ID NO: 543257 - RNA, 60 nt, Human Herpes Virus 4 (Epstein Barr virus)
gggugcccccaccacucccaccaccccccccaccaccacccccaccacccccaccacccc

SEQ ID NO: 543258 - RNA, 60 nt, Human Herpes Virus 4 (Epstein Barr virus)
ccccaccacccccaccaccuccaccaccuucaccaccacccccgcccccaccacccccac

SEQ ID NO: 543259 - RNA, 60 nt, Human Herpes Virus 4 (Epstein Barr virus)
aaaggccuaccgaacuucaacccacaccaucaccaccacgcaugcaucucccugucuugc

SEQ ID NO: 543260 - RNA, 60 nt, Human Herpes Virus 4 (Epstein Barr virus)
caccuaugccauuaccccccucacaauugccaccaccagcagcaccagcacagccaccuc

SEQ ID NO: 543261 - RNA, 60 nt, Human Herpes Virus 4 (Epstein Barr virus)
aagugcccagauacgucccucauccgcccccaccaccaacuucucaccaggcagcucagg

SEQ ID NO: 543262 - RNA, 60 nt, Human Herpes Virus 4 (Epstein Barr virus)
auccuugccgcuaugcuauuacgauuucggcaccaccaacgggagagacugcgaucccug

SEQ ID NO: 543263 - RNA, 60 nt, Human Herpes Virus 4 (Epstein Barr virus)
uccgcauccuaggcacggcccagcagcccccaccaccacgcaaguuuggccgcuuugccg

SEQ ID NO: 543264 - RNA, 60 nt, Human Herpes Virus 4 (Epstein Barr virus)
guccaccaguucgccagcaccccgcccaggcaccaccagccaagcgucaggcccuggaaa

SEQ ID NO: 543265 - RNA, 60 nt, Human Herpes Virus 4 (Epstein Barr virus)
caagguuauauucuccaaggcacccgagagcaccaccaccuccccuaccuugaauacaac

SEQ ID NO: 543266 - RNA, 60 nt, Human Herpes Virus 4 (Epstein Barr virus)
gacuagcaaugucaccaccagguccuccuccaccaccagugcuacuacccguauuaccaa

SEQ ID NO: 543267 - RNA, 60 nt, Human Herpes Virus 4 (Epstein Barr virus)
aggaaccuccacgggugugacuagcaaugucaccaccagguccuccuccaccaccagugc

SEQ ID NO: 543268 - RNA, 60 nt, Human Herpes Virus 4 (Epstein Barr virus)
uauuaccauggacaacgacacagugaugaacaccaccacgaugacucccucccgcacccu

SEQ ID NO: 543269 - RNA, 64 nt, Human Herpes Virus 2
acgacgcggacuacgccggcaacgacgacgcagagugggcgaacagccccccgagcgagggcgg

SEQ ID NO: 543270 - RNA, 64 nt, Human Herpes Virus 2
ugcggccggcggggggcgcgcgcaggcgcggcgggugggcgaagacgccgcggcggcggagggc

SEQ ID NO: 543271 - RNA, 64 nt, Human Herpes Virus 2
gcggcucaucaucaacaugaagggcaugcgccacgugggcgacaucaacgacacgguacgcgcc

SEQ ID NO: 543272 - RNA, 64 nt, Human Herpes Virus 2
gcuucgcacgagccuuuuggacucgcuccuggucgugggcgaccgaggcauccuuguacauaac

SEQ ID NO: 543273 - RNA, 64 nt, Human Herpes Virus 2
acacggucgcggcgcugcgccuggcguggggcccgugggcgaccugugcccgcgugcuccuguu

SEQ ID NO: 543274 - RNA, 64 nt, Human Herpes Virus 2
ccccuccgaggacgcagauuccauuuacgagucggugggcgaggauggggggcgcgucuacgag

SEQ ID NO: 543275 - RNA, 64 nt, Human Herpes Virus 2; identical to SEQ ID NO: 543270

SEQ ID NO: 543276 - RNA, 64 nt, Human Herpes Virus 2; identical to SEQ ID NO: 543269

SEQ ID NO: 543277 - RNA, 64 nt, Human Herpes Virus 2
cguuugccugguuccugggggacgacuccucgccggcggagaagguggccgucgcgucccagac

SEQ ID NO: 543278 - RNA, 64 nt, Human Herpes Virus 2
ccgccaagcaccuggccgcucugacacgcguccaggcggagagaucgucggguuacuggugggu

SEQ ID NO: 543279 - RNA, 64 nt, Human Herpes Virus 2
uggcggacgaggacgggggacgucuccgggccgcggcggagacgaccggcggccccggaucucc

SEQ ID NO: 543280 - RNA, 64 nt, Human Herpes Virus 2
uggggcgccuggcggacgaccguaucugcgcgccggcggagacccgguacgugccguucuucca

SEQ ID NO: 543281 - RNA, 64 nt, Human Herpes Virus 2
ucgccccuguccuuccucgccaggcgcgcucgguggcggagaucguauguaaaggcgacucggc

SEQ ID NO: 543282 - RNA, 64 nt, Human Herpes Virus 2; identical to SEQ ID NO: 543279

SEQ ID NO: 543283 - RNA, 64 nt, Human Herpes Virus 4 (Epstein Barr virus)
ucauugauuacuucaccuuucagcacaaacaccugaaggugaccaacauugaugacaugacgga

SEQ ID NO: 543284 - RNA, 64 nt, Human Herpes Virus 4 (Epstein Barr virus)
cagaacccccucgagagacccaggccuuuuuggggaaggugacugucauugauuacuucaccuu

SEQ ID NO: 543285 - RNA, 62 nt, Human Herpes Virus 2
caaacaccaagcgauucgccacguucaacgugggcagcgacuacgaccuguuguacuuuuug

SEQ ID NO: 543286 - RNA, 62 nt, Human Herpes Virus 2
gucaccgacaaacucggcgcgugcgguuugugggcagcgagggccugcgugcggcccccgcu

SEQ ID NO: 543287 - RNA, 62 nt, Human Herpes Virus 2; identical to SEQ ID NO: 543143

SEQ ID NO: 543288 - RNA, 63 nt, Human Herpes Virus 2
cccacugacucaucgccgcgaugacggggaaacccgcaagacugggccgcuggguggugcugu

SEQ ID NO: 543289 - RNA, 64 nt, Human Herpes Virus 4 (Epstein Barr virus)
ggacaucgucggaggccaggcagaagcagaagcaccccaagaaagugaagcaggccuuuaaccc

SEQ ID NO: 543290 - RNA, 64 nt, Human Herpes Virus 4 (Epstein Barr virus)
uacagcagcacaagcugcuggaagacaccaucguccccaagaucuuaaagaagcuggcuuauuu

SEQ ID NO: 543291 - RNA, 64 nt, Human Herpes Virus 4 (Epstein Barr virus)
ugagacuucaaagucugguccuggguucugagacccccaagauuugucaugcacaccugcacac

SEQ ID NO: 543292 - RNA, 64 nt, Human Herpes Virus 4 (Epstein Barr virus)
uccucggucggccccuaacucgcaagcacaaaggccccaagauguuuaaccugaagacccuggg

SEQ ID NO: 543293 - RNA, 64 nt, Human Herpes Virus 4 (Epstein Barr virus)
cauuugacauuacugucucgggucuuggcacggcccccaagacacucauuaucacacgaacggc

SEQ ID NO: 543294 - RNA, 64 nt, Human Herpes Virus 2
caccuucuucggggagcuggaggcgcgccuggccggcggagauaacgucugcaucuucucgucg

SEQ ID NO: 543295 - RNA, 64 nt, Human Herpes Virus 2
aaucucgagaccaacggcggcucgacgagcgaugaugagauaucggaugcgacggacucggacg

SEQ ID NO: 543296 - RNA, 64 nt, Human Herpes Virus 2
ccggcgccaugaucacggauuguuucgaagcagacaucgcgauccccucggguaucucgcgccc

SEQ ID NO: 543297 - RNA, 64 nt, Human Herpes Virus 2
agccaggggcgcaggggccggagagcuggggcgacaucgcgacgcgggccgccgcggacgugcg

SEQ ID NO: 543298 - RNA, 64 nt, Human Herpes Virus 2
ccccuggguccuguuuggccacccccgcgccgaccaucgcgacgagcugcagcuucacaaggcc

SEQ ID NO: 543299 - RNA, 64 nt, Human Herpes Virus 1
cuauauauacagggaccggggucgcccuguugggggucgccaugugacccccugacuuuauaua

SEQ ID NO: 543300 - RNA, 64 nt, Human Herpes Virus 1
uggucguucgagggacaggcccagacgaccgcguggucgccaacuauguacgaagcgagcuccg

SEQ ID NO: 543301 - RNA, 64 nt, Human Herpes Virus 1
ccaucacgcgcucccagggccuuagccuggacaaggucgccaucugcuuuacgcccggcaaccu

SEQ ID NO: 543302 - RNA, 64 nt, Human Herpes Virus 1
uccacggcgaggugcugcccgcgacguucgccgcggucgccaacggcuuugcggcgcgcgcgcg

SEQ ID NO: 543303 - RNA, 64 nt, Human Herpes Virus 1; identical to SEQ ID NO: 538528

SEQ ID NO: 543304 - RNA, 64 nt, Human Herpes Virus 1; identical to SEQ ID NO: 543299

SEQ ID NO: 543305 - RNA, 64 nt, Human Herpes Virus 4 (Epstein Barr virus)
acccgaggucccagcacccggucccuccggggggcagagacaggcagggccccccggcagcugg

SEQ ID NO: 543306 - RNA, 64 nt, Human Herpes Virus 4 (Epstein Barr virus); identical to SEQ ID NO: 543305

SEQ ID NO: 543307 - RNA, 64 nt, Human Herpes Virus 4 (Epstein Barr virus); identical to SEQ ID NO: 543305

SEQ ID NO: 543308 - RNA, 64 nt, Human Herpes Virus 4 (Epstein Barr virus)
cauguguugcuugaggagauaauugaacgaaauucagagacauuuacagaaacuuggaacagau

SEQ ID NO: 543309 - RNA, 64 nt, Human Herpes Virus 4 (Epstein Barr virus)
ccuaggaccccuacuugggagaguccggcaaggccagagacacccucgccugccauucccagcc

SEQ ID NO: 543310 - RNA, 64 nt, Human Herpes Virus 4 (Epstein Barr virus)
uaguaggggacgccuucuguauaaaggucagccccagagacacgguauaugagaaggcugucaa

SEQ ID NO: 543311 - RNA, 64 nt, Human Herpes Virus 4 (Epstein Barr virus)
accucuuccaugucacugagacccaguucaaacccagagacacucagccccuccaccagugaca

SEQ ID NO: 543312 - RNA, 64 nt, Human Herpes Virus 4 (Epstein Barr virus)
gaggccuucugcguccagacgcgauggcacacgccagagacaaggcaggcgcuguuauggccau

SEQ ID NO: 543313 - RNA, 61 nt, Human Herpes Virus 4 (Epstein Barr virus)
gauccaauucuaccuggaggaagucaugccacaggcugaaaaccaggacccugaagccaaa

SEQ ID NO: 543314 - RNA, 61 nt, Human Herpes Virus 4 (Epstein Barr virus)
cccugaugcccuauaugcccccggccagcgacaggcugaggaacgagcagaugauugggca

SEQ ID NO: 543315 - RNA, 64 nt, Human Herpes Virus 4 (Epstein Barr virus); identical to SEQ ID NO: 543305

SEQ ID NO: 543316 - RNA, 64 nt, Human Herpes Virus 4 (Epstein Barr virus); identical to SEQ ID NO: 543305

SEQ ID NO: 543317 - RNA, 64 nt, Human Herpes Virus 4 (Epstein Barr virus); identical to SEQ ID NO: 543305

SEQ ID NO: 543318 - RNA, 64 nt, Human Herpes Virus 4 (Epstein Barr virus); identical to SEQ ID NO: 543308

SEQ ID NO: 543319 - RNA, 64 nt, Human Herpes Virus 4 (Epstein Barr virus); identical to SEQ ID NO: 543309

SEQ ID NO: 543320 - RNA, 64 nt, Human Herpes Virus 4 (Epstein Barr virus); identical to SEQ ID NO: 543310

SEQ ID NO: 543321 - RNA, 64 nt, Human Herpes Virus 4 (Epstein Barr virus); identical to SEQ ID NO: 543311

SEQ ID NO: 543322 - RNA, 64 nt, Human Herpes Virus 4 (Epstein Barr virus); identical to SEQ ID NO: 543312

SEQ ID NO: 543323 - RNA, 61 nt, Human Herpes Virus 4 (Epstein Barr virus); identical to SEQ ID NO: 543313

SEQ ID NO: 543324 - RNA, 61 nt, Human Herpes Virus 4 (Epstein Barr virus); identical to SEQ ID NO: 543314

SEQ ID NO: 543325 - RNA, 64 nt, Human Herpes Virus 4 (Epstein Barr virus); identical to SEQ ID NO: 543305

SEQ ID NO: 543326 - RNA, 64 nt, Human Herpes Virus 4 (Epstein Barr virus); identical to SEQ ID NO: 543305

SEQ ID NO: 543327 - RNA, 64 nt, Human Herpes Virus 4 (Epstein Barr virus); identical to SEQ ID NO: 543305

SEQ ID NO: 543328 - RNA, 64 nt, Human Herpes Virus 4 (Epstein Barr virus); identical to SEQ ID NO: 543308

SEQ ID NO: 543329 - RNA, 64 nt, Human Herpes Virus 4 (Epstein Barr virus); identical to SEQ ID NO: 543309

SEQ ID NO: 543330 - RNA, 64 nt, Human Herpes Virus 4 (Epstein Barr virus); identical to SEQ ID NO: 543310

SEQ ID NO: 543331 - RNA, 64 nt, Human Herpes Virus 4 (Epstein Barr virus); identical to SEQ ID NO: 543311

SEQ ID NO: 543332 - RNA, 64 nt, Human Herpes Virus 4 (Epstein Barr virus); identical to SEQ ID NO: 543312

SEQ ID NO: 543333 - RNA, 61 nt, Human Herpes Virus 2
ccgcgguguuaaugguaaacgcaaagccucccggaaagaccacuagcccgcagaggcggcg

SEQ ID NO: 543334 - RNA, 61 nt, Human Herpes Virus 2
cggcguaucucaucaccggcaacgccggauccggaaagaguacgugcgugcagacccucaa

SEQ ID NO: 543335 - RNA, 64 nt, Human Herpes Virus 2
acaccccggccggggaggucaugucggugcugcugguggacacggaugccacccaacagcagcu

SEQ ID NO: 543336 - RNA, 61 nt, Human Herpes Virus 4 (Epstein Barr virus); identical to SEQ ID NO: 543313

SEQ ID NO: 543337 - RNA, 61 nt, Human Herpes Virus 4 (Epstein Barr virus); identical to SEQ ID NO: 543314

SEQ ID NO: 543338 - RNA, 64 nt, Human Herpes Virus 2
ccgacagccugaacaacgaguaccuuacggcggcgguggacagccaggagcgcuucugcaggac

SEQ ID NO: 543339 - RNA, 64 nt, Human Herpes Virus 4 (Epstein Barr virus); identical to SEQ ID NO: 543305

SEQ ID NO: 543340 - RNA, 64 nt, Human Herpes Virus 4 (Epstein Barr virus); identical to SEQ ID NO: 543305

SEQ ID NO: 543341 - RNA, 64 nt, Human Herpes Virus 4 (Epstein Barr virus); identical to SEQ ID NO: 543305

SEQ ID NO: 543342 - RNA, 64 nt, Human Herpes Virus 4 (Epstein Barr virus); identical to SEQ ID NO: 543308

SEQ ID NO: 543343 - RNA, 64 nt, Human Herpes Virus 4 (Epstein Barr virus); identical to SEQ ID NO: 543309

SEQ ID NO: 543344 - RNA, 64 nt, Human Herpes Virus 4 (Epstein Barr virus); identical to SEQ ID NO: 543310

SEQ ID NO: 543345 - RNA, 64 nt, Human Herpes Virus 4 (Epstein Barr virus); identical to SEQ ID NO: 543311

SEQ ID NO: 543346 - RNA, 64 nt, Human Herpes Virus 4 (Epstein Barr virus); identical to SEQ ID NO: 543312

SEQ ID NO: 543347 - RNA, 61 nt, Human Herpes Virus 4 (Epstein Barr virus); identical to SEQ ID NO: 543313

SEQ ID NO: 543348 - RNA, 61 nt, Human Herpes Virus 4 (Epstein Barr virus); identical to SEQ ID NO: 543314

SEQ ID NO: 543349 - RNA, 64 nt, Human Herpes Virus 2; identical to SEQ ID NO: 536700

SEQ ID NO: 543350 - RNA, 64 nt, Human Herpes Virus 2
ccuggagaacgccgcccuccaggccgccgagcugcccgucgacaucgagcgccggauacgcccg

SEQ ID NO: 543351 - RNA, 64 nt, Human Herpes Virus 2
auucaacgcgggaugcgucgcgugggaccccacccccgucgagcacgagcaggcggucggcggc

SEQ ID NO: 543352 - RNA, 64 nt, Human Herpes Virus 2
aaccgcacggggggaagguggcccgcauccaacccccgucgaccaaggcaccgcauccccgagg

SEQ ID NO: 543353 - RNA, 64 nt, Human Herpes Virus 2
cggugucuucgcagauccccccaaacuggcacaucccgucgauccaggacgucgcgccgcacca

SEQ ID NO: 543354 - RNA, 64 nt, Human Herpes Virus 2
gguggaacagcaccucccccagcgccagcccgagcccgucgagcccacccgcccgcacgugaga

SEQ ID NO: 543355 - RNA, 64 nt, Human Herpes Virus 2
gcacgccggcaccgucaaucuccgcaacaccucccccgucgaccucugcaacggggaucccguc

SEQ ID NO: 543356 - RNA, 64 nt, Human Herpes Virus 2
caucgacgcggccgucgggggcgugaaccacgaccccgucgaggccgcgaauccguacggggcg

SEQ ID NO: 543357 - RNA, 64 nt, Human Herpes Virus 2
ccaccagccccucaucgcccgcgacggcccgcaccccgucgagcagcccgugcauaauuacaug

SEQ ID NO: 543358 - RNA, 64 nt, Human Herpes Virus 2
gugggcuucuucggggagccgccgcggcccugcuggacuucaccaugccccgcgcacacguucu

SEQ ID NO: 543359 - RNA, 64 nt, Human Herpes Virus 1
uugcuuggguccccuggcugccaucaaaaccccacccucgcagcggcauacgcccccuccgcgu

SEQ ID NO: 543360 - RNA, 64 nt, Human Herpes Virus 1
caccacccaaccccaacuccagaccaccggucgucccucgcaugaagcccccaacaugacccag

SEQ ID NO: 543361 - RNA, 64 nt, Human Herpes Virus 1
aucccaggcggcguuaaccgcaccccccucgucccccucgcacauccucacccucacgcgcauc

SEQ ID NO: 543362 - RNA, 64 nt, Human Herpes Virus 1
gcucggggguaccgcggugucccugaaacugacgcccucgcacuacagcucguccguguacguc

SEQ ID NO: 543363 - RNA, 64 nt, Human Herpes Virus 1
uacguccucaccgucaucaaggcgagcccguccccccucgcaugcgcccaggccgccaacuuuc

SEQ ID NO: 543364 - RNA, 64 nt, Human Herpes Virus 1
ggugaucaacacccugaucgacgcuggguucacgcccucgcacugcacgcacuaccuuucggcc

SEQ ID NO: 543365 - RNA, 64 nt, Human Herpes Virus 1
gccgccgucuggcugcggcccgcauggccaugccgcacgccacgcugaucgccggaaacgucug

SEQ ID NO: 543366 - RNA, 64 nt, Human Herpes Virus 1
gcacgcuggagcuguuccaaaaaaugauccuuaugcacgccaccuacuuucuggccgccgugcu

SEQ ID NO: 543367 - RNA, 64 nt, Human Herpes Virus 1
gcgcggcccggauggccuggcccagggcccggaggcacgccagauguaugcgcgcgguaaaggc

SEQ ID NO: 543368 - RNA, 64 nt, Human Herpes Virus 1
ccucguguuacaucuacaacaacuaccucggcgggcacgccaagcccccgcccgaccgcgugua

SEQ ID NO: 543369 - RNA, 64 nt, Human Herpes Virus 1
aaccgccugcacacgcuguuuaccauugacgccggcacgccaugcucgccguccguucccugca

SEQ ID NO: 543370 - RNA, 64 nt, Human Herpes Virus 1
gcucccauucgcccguuaaccccccacgugaucagcacgccaccgacaccgcagacgaaaagcc

SEQ ID NO: 543371 - RNA, 64 nt, Human Herpes Virus 1
uggucauguggcagcuaaccucagcccccaaggugcacgccaacgguccuucaaggauuggcuc

SEQ ID NO: 543372 - RNA, 64 nt, Human Herpes Virus 4 (Epstein Barr virus)
ucaucuccccagccccgagcccccauacgccccauuccaacaagauuccccccucccccuaugc

SEQ ID NO: 543373 - RNA, 64 nt, Human Herpes Virus 4 (Epstein Barr virus)
ccggggauggacaacugcccuuggccguagcuacuuccaacaacggaacucauauaacuaacgg

SEQ ID NO: 543374 - RNA, 64 nt, Human Herpes Virus 4 (Epstein Barr virus)
cgggccagacccucaagcugacgguccggaacauuuccaacaaccccauaacgaucgugaccgg

SEQ ID NO: 543375 - RNA, 64 nt, Human Herpes Virus 1
gaccggcgacgaccggcccguucugaccaagucugcgggggagcgguuucuguuguaccgcccc

SEQ ID NO: 543376 - RNA, 64 nt, Human Herpes Virus 1
ugugccugccguccgaacgcggguaggguauggggcgggggauggggagagcccacaugcggaa

SEQ ID NO: 543377 - RNA, 64 nt, Human Herpes Virus 2
uucagaagcgcagcaagaucaaggugaacgggauggugaacaucgacauguacggcaucaucac

SEQ ID NO: 543378 - RNA, 64 nt, Human Herpes Virus 2
ggcuccgcgacgccgugcaggcgugcgugcugauggugaacaucaugaucgacagcacgcuaca

SEQ ID NO: 543379 - RNA, 64 nt, Human Herpes Virus 2
cgauuaucggcaaccgcgaggcccugcacacgguggugaacaacaucaagcagcugguggaucg

SEQ ID NO: 543380 - RNA, 57 nt, Human Herpes Virus 2; identical to SEQ ID NO: 540684

SEQ ID NO: 543381 - RNA, 64 nt, Human Herpes Virus 2; identical to SEQ ID NO: 540681

SEQ ID NO: 543382 - RNA, 64 nt, Human Herpes Virus 2; identical to SEQ ID NO: 540682

SEQ ID NO: 543383 - RNA, 64 nt, Human Herpes Virus 2; identical to SEQ ID NO: 540683

SEQ ID NO: 543384 - RNA, 64 nt, Human Herpes Virus 4 (Epstein Barr virus)
cggauguuuuaaaggguccaguccuccucagaucucaaacaaugauggaaacacccgcggagag

SEQ ID NO: 543385 - RNA, 64 nt, Human Herpes Virus 1
accaccuuccguccccugccccccccaccccagacgacaucagcuguggacccgagcucccauu

SEQ ID NO: 543386 - RNA, 64 nt, Human Herpes Virus 1
aggaguacgcguacucccaccagcugagccgcgccgacaucaccaccgucagcaccuucaucga

SEQ ID NO: 543387 - RNA, 64 nt, Human Herpes Virus 1
uguuucuuccggaaaccaggcuuguggccccacccgacaucacaagggaccucuugucgggccu

SEQ ID NO: 543388 - RNA, 64 nt, Human Herpes Virus 1
aaggggggaaagguggacagucgauaagucgguagcgggggacgcgcaccuguuccgccugucg

SEQ ID NO: 543389 - RNA, 64 nt, Human Herpes Virus 1
caacccccggggacgcgccgccgggggcguuuacgcgggggacaaggagggggaugucaccgcc

SEQ ID NO: 543390 - RNA, 64 nt, Human Herpes Virus 1
ccggcccuuugucccccggaggccguguaucgccccccaccacacagcgcccccuacgguccuc

SEQ ID NO: 543391 - RNA, 64 nt, Human Herpes Virus 1
cgauucgucaggcagcggccuugucgaaucucgaccccaccacucgccggacccgccgacgucc

SEQ ID NO: 543392 - RNA, 64 nt, Human Herpes Virus 1
ccgcgcgccccgagaccagucgcccgaagacaccccccaccauuaucgggccgcuggcaacucg

SEQ ID NO: 543393 - RNA, 64 nt, Human Herpes Virus 1
gaccgaggccugcgccgcagaacgcgucgugcgcccccaccagcugucucccgcugggcaggcg

SEQ ID NO: 543394 - RNA, 64 nt, Human Herpes Virus 1
ugcucggccggcccccgaacgcgagccugcccgcccccaccacggucgagccgaccgcccagcc

SEQ ID NO: 543395 - RNA, 64 nt, Human Herpes Virus 1
cccuguacccgcuaaccaccaaggagcucaagaaccccaccaacccggacgcguccggggaggg

SEQ ID NO: 543396 - RNA, 64 nt, Human Herpes Virus 1
ucgacguguauggucagacccacugggacaucacccccaccaccccggccacgccgcuguccgc

SEQ ID NO: 543397 - RNA, 64 nt, Human Herpes Virus 2; identical to SEQ ID NO: 542821

SEQ ID NO: 543398 - RNA, 64 nt, Human Herpes Virus 2; identical to SEQ ID NO: 542822

SEQ ID NO: 543399 - RNA, 64 nt, Human Herpes Virus 2; identical to SEQ ID NO: 542823

SEQ ID NO: 543400 - RNA, 64 nt, Human Herpes Virus 2; identical to SEQ ID NO: 542824

SEQ ID NO: 543401 - RNA, 64 nt, Human Herpes Virus 2; identical to SEQ ID NO: 542825

SEQ ID NO: 543402 - RNA, 64 nt, Human Herpes Virus 2; identical to SEQ ID NO: 542826

SEQ ID NO: 543403 - RNA, 64 nt, Human Herpes Virus 2; identical to SEQ ID NO: 542827

SEQ ID NO: 543404 - RNA, 64 nt, Human Herpes Virus 2; identical to SEQ ID NO: 542828

SEQ ID NO: 543405 - RNA, 64 nt, Human Herpes Virus 2; identical to SEQ ID NO: 542829

SEQ ID NO: 543406 - RNA, 64 nt, Human Herpes Virus 2; identical to SEQ ID NO: 542830

SEQ ID NO: 543407 - RNA, 64 nt, Human Herpes Virus 1; identical to SEQ ID NO: 538563

SEQ ID NO: 543408 - RNA, 64 nt, Human Herpes Virus 1; identical to SEQ ID NO: 538564

SEQ ID NO: 543409 - RNA, 64 nt, Human Herpes Virus 1; identical to SEQ ID NO: 538575

SEQ ID NO: 543410 - RNA, 64 nt, Human Herpes Virus 1; identical to SEQ ID NO: 538576

SEQ ID NO: 543411 - RNA, 64 nt, Human Herpes Virus 1; identical to SEQ ID NO: 538566

SEQ ID NO: 543412 - RNA, 64 nt, Human Herpes Virus 1; identical to SEQ ID NO: 538567

SEQ ID NO: 543413 - RNA, 64 nt, Human Herpes Virus 1; identical to SEQ ID NO: 538568

SEQ ID NO: 543414 - RNA, 64 nt, Human Herpes Virus 1; identical to SEQ ID NO: 538569

SEQ ID NO: 543415 - RNA, 64 nt, Human Herpes Virus 1; identical to SEQ ID NO: 538570

SEQ ID NO: 543416 - RNA, 64 nt, Human Herpes Virus 1; identical to SEQ ID NO: 538571

SEQ ID NO: 543417 - RNA, 64 nt, Human Herpes Virus 1; identical to SEQ ID NO: 538569

SEQ ID NO: 543418 - RNA, 64 nt, Human Herpes Virus 1; identical to SEQ ID NO: 538568

SEQ ID NO: 543419 - RNA, 64 nt, Human Herpes Virus 4 (Epstein Barr virus)
aggcuggugccuuggcuuuaaaggggagauguuagacagguaacucacuaaacauugcaccuug

SEQ ID NO: 543420 - RNA, 64 nt, Human Herpes Virus 4 (Epstein Barr virus)
gaggcggcgcaagggcuggauaccccugugaauggacagguacuaacacgcaauaaaguuuacu

SEQ ID NO: 543421 - RNA, 63 nt, Human Herpes Virus 2
cggguacgaggggcgccccacggcgccccucgucggcggaacccaggaguucgccggcgagca

SEQ ID NO: 543422 - RNA, 64 nt, Human Herpes Virus 1
ugggaggcaacugugcuauccccaucacggucauggaguacaccgaaugcuccuacaacaaguc

SEQ ID NO: 543423 - RNA, 64 nt, Human Herpes Virus 4 (Epstein Barr virus)
ccacgccuucguucucccgaccacgcacccgggcaccuccgaggccgccggcucccgcgccggu

SEQ ID NO: 543424 - RNA, 64 nt, Human Herpes Virus 4 (Epstein Barr virus)
cguccugccuuguugggugcaaggcucgugccugggccugcaauuuacuaaccucgggaugcca

SEQ ID NO: 543425 - RNA, 64 nt, Human Herpes Virus 4 (Epstein Barr virus)
ggguggcgguggaguaugcuucgucggggggcugggccugcagccgugccccgccgaugcgcgc

SEQ ID NO: 543426 - RNA, 64 nt, Human Herpes Virus 4 (Epstein Barr virus)
ucaaggccggcagccccuucauccuuuugaaggaggccugcaacgcccacuuuuggcgcgaccu

SEQ ID NO: 543427 - RNA, 64 nt, Human Herpes Virus 4 (Epstein Barr virus)
uacaccaaagguucuuugaacuuggguugcucuuggccugcaccaucuuugcccuguccguggu

SEQ ID NO: 543428 - RNA, 64 nt, Human Herpes Virus 4 (Epstein Barr virus)
gcuucucuucacagcugggucucuuuuacgcccuggccugcaaccgcagcccacccacacuucc

SEQ ID NO: 543429 - RNA, 64 nt, Human Herpes Virus 4 (Epstein Barr virus)
augggcaggacaaggcccugguggacuaccugucggccugcacguccugccacgcccuguuuau

SEQ ID NO: 543430 - RNA, 64 nt, Human Herpes Virus 4 (Epstein Barr virus)
cccugaugaaggggguggagcucguccggaagacggccugcaaguuugugcagacacgcugccg

SEQ ID NO: 543431 - RNA, 64 nt, Human Herpes Virus 4 (Epstein Barr virus)
cccugaggaaggauaggaagcuguacgcggagcuggccugcaggacagccgacaucgggggcaa

SEQ ID NO: 543432 - RNA, 64 nt, Human Herpes Virus 1; identical to SEQ ID NO: 536007

SEQ ID NO: 543433 - RNA, 64 nt, Human Herpes Virus 1; identical to SEQ ID NO: 536008

SEQ ID NO: 543434 - RNA, 64 nt, Human Herpes Virus 1; identical to SEQ ID NO: 536009

SEQ ID NO: 543435 - RNA, 64 nt, Human Herpes Virus 1; identical to SEQ ID NO: 536010

SEQ ID NO: 543436 - RNA, 64 nt, Human Herpes Virus 1; identical to SEQ ID NO: 536011

SEQ ID NO: 543437 - RNA, 64 nt, Human Herpes Virus 1; identical to SEQ ID NO: 536012

SEQ ID NO: 543438 - RNA, 64 nt, Human Herpes Virus 1; identical to SEQ ID NO: 536013

SEQ ID NO: 543439 - RNA, 64 nt, Human Herpes Virus 1; identical to SEQ ID NO: 536014

SEQ ID NO: 543440 - RNA, 64 nt, Human Herpes Virus 1; identical to SEQ ID NO: 536015

SEQ ID NO: 543441 - RNA, 64 nt, Human Herpes Virus 1; identical to SEQ ID NO: 536016

SEQ ID NO: 543442 - RNA, 64 nt, Human Herpes Virus 1; identical to SEQ ID NO: 536007

SEQ ID NO: 543443 - RNA, 64 nt, Human Herpes Virus 1; identical to SEQ ID NO: 536008

SEQ ID NO: 543444 - RNA, 64 nt, Human Herpes Virus 1; identical to SEQ ID NO: 536009

SEQ ID NO: 543445 - RNA, 64 nt, Human Herpes Virus 1; identical to SEQ ID NO: 536010

SEQ ID NO: 543446 - RNA, 64 nt, Human Herpes Virus 1; identical to SEQ ID NO: 536011

SEQ ID NO: 543447 - RNA, 64 nt, Human Herpes Virus 1; identical to SEQ ID NO: 536012

SEQ ID NO: 543448 - RNA, 64 nt, Human Herpes Virus 1; identical to SEQ ID NO: 536013

SEQ ID NO: 543449 - RNA, 64 nt, Human Herpes Virus 1; identical to SEQ ID NO: 536014

SEQ ID NO: 543450 - RNA, 64 nt, Human Herpes Virus 1; identical to SEQ ID NO: 536015

SEQ ID NO: 543451 - RNA, 64 nt, Human Herpes Virus 1; identical to SEQ ID NO: 536016

SEQ ID NO: 543452 - RNA, 64 nt, Human Herpes Virus 1
gucgccugccgaccccccgggaggcgcguccaagccccgcaagcugcugguguccgagcuggcc

SEQ ID NO: 543453 - RNA, 64 nt, Human Herpes Virus 1
gcguccuucuugucgucucucuucccccccaucaccccgcaauuugcacccagccuuuaacuac

SEQ ID NO: 543454 - RNA, 64 nt, Human Herpes Virus 1
gggcgacggaggggguucgggcgggcgcggaggaccccgcaacccgcccccggaucccuguggg

SEQ ID NO: 543455 - RNA, 64 nt, Human Herpes Virus 1
cgagagguaauggcgcaugcgcccgaggacgcccccccgcaaagccccgcggccgaccgcgucg

SEQ ID NO: 543456 - RNA, 64 nt, Human Herpes Virus 1
gcaccucgaggacacccgcgcaugaucuccggacccccgcaacggggugauaaugaucaagcgg

SEQ ID NO: 543457 - RNA, 64 nt, Human Herpes Virus 1
uaugcacgccaccuacuuucuggccgccgugcuccucggggaccacgcggagcaggucaacacg

SEQ ID NO: 543458 - RNA, 64 nt, Human Herpes Virus 1
ggcggccgguggagcggcccuuguucuguggagucucggggagcccggcacgcagccgggggcc

SEQ ID NO: 543459 - RNA, 64 nt, Human Herpes Virus 1
gcccgacggcguaguggaggaagaccugcuuauucucggggagcuucgcuuugugggggaccag

SEQ ID NO: 543460 - RNA, 64 nt, Human Herpes Virus 1
ccgugcugccggcgcuggacggccgggcggcggccucggggaccaccgacgccauggcgcccgg

SEQ ID NO: 543461 - RNA, 64 nt, Human Herpes Virus 1
ggaccgcgugcuguugcuucacucgcucaccccccucggggacgugaccacguggggccaauac

SEQ ID NO: 543462 - RNA, 64 nt, Human Herpes Virus 1
agucuuccagccugccgucuccagccugcugcagcucggggagcagcccuccgccggcgcccag

SEQ ID NO: 543463 - RNA, 64 nt, Human Herpes Virus 1
uuuccaacaugcgccggcgcggcaccucucuggccucggggacccgggggacggccggguccgg

SEQ ID NO: 543464 - RNA, 64 nt, Human Herpes Virus 1; identical to SEQ ID NO: 543460

SEQ ID NO: 543465 - RNA, 64 nt, Human Herpes Virus 1
uagcgugcgcgcgaacgugccgccucccccgagucuucggaaugucuuggcggccgucaagaac

SEQ ID NO: 543466 - RNA, 64 nt, Human Herpes Virus 1
gggacaggaggccggcggccccagcgcagccacccagggggaggccgccggggccccucucgcc

SEQ ID NO: 543467 - RNA, 64 nt, Human Herpes Virus 1
uaaaucaccggugcgccccccaaaccauguccggcagggggaugggggggcaaugcggagggca

SEQ ID NO: 543468 - RNA, 64 nt, Human Herpes Virus 1
ggcaguguugcgugacgacagcuuuguaaagacucagggggagacuucgguggaguuugccuac

SEQ ID NO: 543469 - RNA, 64 nt, Human Herpes Virus 1
gugggccaagauggcccaguguacccuggcgguccagggggaugcuagccuguguccgcuucuc

SEQ ID NO: 543470 - RNA, 64 nt, Human Herpes Virus 1; identical to SEQ ID NO: 543466

SEQ ID NO: 543471 - RNA, 64 nt, Human Herpes Virus 1; identical to SEQ ID NO: 543467

SEQ ID NO: 543472 - RNA, 64 nt, Human Herpes Virus 1; identical to SEQ ID NO: 543468

SEQ ID NO: 543473 - RNA, 64 nt, Human Herpes Virus 1; identical to SEQ ID NO: 543469

SEQ ID NO: 543474 - RNA, 64 nt, Human Herpes Virus 1
ggagcggccagaggaggagggggaggacgaggacgaacgcgaggagggcgggggcgagcgggag

SEQ ID NO: 543475 - RNA, 64 nt, Human Herpes Virus 1
ccaccgggcccacgaucaccgcgggagcggugacgaacgcgagcgaggcccccacaucgggguc

SEQ ID NO: 543476 - RNA, 64 nt, Human Herpes Virus 1
gcuguacgcggacuggagcucggacagcgagggagaacgcgaccaggucccguggcuggccccc

SEQ ID NO: 543477 - RNA, 64 nt, Human Herpes Virus 1
acaucccgaagaccuaccugcucggccggcccccgaacgcgagccugcccgcccccaccacggu

SEQ ID NO: 543478 - RNA, 64 nt, Human Herpes Virus 2
agcgauuuauggacgccaucacgcccgccgggaccgucaucacgcuucugggucugacccccga

SEQ ID NO: 543479 - RNA, 64 nt, Human Herpes Virus 2
ucuccggggcgcggcccugcugcugccgacacaacgucaucaccaccgacggcggggaggucgu

SEQ ID NO: 543480 - RNA, 64 nt, Human Herpes Virus 2
cccgggacccgagcagccccgccucgcugauucacgucaucaucuccagcgagugccuggcggc

SEQ ID NO: 543481 - RNA, 64 nt, Human Herpes Virus 2
ccgagacccccgaggcggccuuccgggagauggacgucaucaaggacacgguccuggcgaucac

SEQ ID NO: 543482 - RNA, 62 nt, Human Herpes Virus 1
cuguccgggcgcaccugggcgcccggcguggaggcgcugacccacacgcugcuuuccaccgc

SEQ ID NO: 543483 - RNA, 62 nt, Human Herpes Virus 1
cgccauucucccgggaccaacgagaccaucacggcgcugaugggggcggugacgucucugca

SEQ ID NO: 543484 - RNA, 62 nt, Human Herpes Virus 1
gccgugcgggaguuucuccgcggucaggcggcggcgcugacggaccuuggucuggcccacgc

SEQ ID NO: 543485 - RNA, 62 nt, Human Herpes Virus 1
cuuggccuggacggcacagacgcgcccccuggggcgcugacccccaacgacgauaccgaaca

SEQ ID NO: 543486 - RNA, 62 nt, Human Herpes Virus 1
gccuacgcgccccuguuggcgcgcgagaacgcggcgcugacgggggccgcggggagccccgg

SEQ ID NO: 543487 - RNA, 62 nt, Human Herpes Virus 1; identical to SEQ ID NO: 543486

SEQ ID NO: 543488 - RNA, 64 nt, Human Herpes Virus 1
augccgacagacgcgcaugaugcgcgugcugucggccgcguagcgcguguugggggggacgagc

SEQ ID NO: 543489 - RNA, 64 nt, Human Herpes Virus 1
cacgcuauacguccaccacgaggugcgcgugcuugccgcguaccgcagggcguauuauggaagc

SEQ ID NO: 543490 - RNA, 64 nt, Human Herpes Virus 1
uuuguaucuauuuuugacccgcgagauccuaugggccgcguacgccgagcagaugaugcggccc

SEQ ID NO: 543491 - RNA, 64 nt, Human Herpes Virus 2
aaggucgggccgugucccucccggccauccccggcgccaugagccgccgggucaugaacgugca

SEQ ID NO: 543492 - RNA, 64 nt, Human Herpes Virus 2
gggaguccucgccgcuguggcccuggcggacggccgccaugaauuuuaucgccgcggcugcgcc

SEQ ID NO: 543493 - RNA, 64 nt, Human Herpes Virus 2
cucccuccagcaccucacgaccgucaucuucauaacggccuacggccucgugcucgcgugguac

SEQ ID NO: 543494 - RNA, 64 nt, Human Herpes Virus 2
ccgacugcccccugcaaccgcaccuggugacguuccucggcaggcaccgcgcgggcgcggagga

SEQ ID NO: 543495 - RNA, 64 nt, Human Herpes Virus 2
agcgccagaucguguuccccgcguacgacauggaccucggcaaguacaucggccagcuggcguc

SEQ ID NO: 543496 - RNA, 64 nt, Human Herpes Virus 2
ccgcgggcuugccuagcccgguccccuacgccccccucggcagcccggaccccucaucgccgcg

SEQ ID NO: 543497 - RNA, 64 nt, Human Herpes Virus 2
gugggaaccgccugugucgucggacgaugaagcgagcucgcagucgaagccccucgccacccag

SEQ ID NO: 543498 - RNA, 64 nt, Human Herpes Virus 2
aaacguugacuuuccgcucgccgucccggccgcgagcucgcaauccccgcggugcucggcgagc

SEQ ID NO: 543499 - RNA, 62 nt, Human Herpes Virus 1
cagaccggcaccaccgacucucccaccgccaucagccuuaccacgcccgaccacacaccccc

SEQ ID NO: 543500 - RNA, 62 nt, Human Herpes Virus 1
uuugagagaugcacgcuggcgugucucucggacagccuuaacauccuucacaugcugcugac

SEQ ID NO: 543501 - RNA, 64 nt, Human Herpes Virus 2; identical to SEQ ID NO: 543090

SEQ ID NO: 543502 - RNA, 64 nt, Human Herpes Virus 2; identical to SEQ ID NO: 543091

SEQ ID NO: 543503 - RNA, 64 nt, Human Herpes Virus 2; identical to SEQ ID NO: 543092

SEQ ID NO: 543504 - RNA, 64 nt, Human Herpes Virus 2; identical to SEQ ID NO: 543093

SEQ ID NO: 543505 - RNA, 64 nt, Human Herpes Virus 2; identical to SEQ ID NO: 543094

SEQ ID NO: 543506 - RNA, 64 nt, Human Herpes Virus 2; identical to SEQ ID NO: 543095

SEQ ID NO: 543507 - RNA, 63 nt, Human Herpes Virus 1
cugccucaccuggcccaccagcgcgccccgccaggccggcagaccgagcggcugggcgaggcc

SEQ ID NO: 543508 - RNA, 63 nt, Human Herpes Virus 1
cuccucgcgcggcgaaagcgcccggagcgccacggccggcauuuugaccguggucuggaccgc

SEQ ID NO: 543509 - RNA, 63 nt, Human Herpes Virus 1
guugggguugagcaucagcaaguacuacggcauggccggcaacgaccguguguuucaggccgg

SEQ ID NO: 543510 - RNA, 63 nt, Human Herpes Virus 1
cacuacagcucguccguguacgucuuucacggcggccggcaccuggaccccagcacccaggcc

SEQ ID NO: 543511 - RNA, 63 nt, Human Herpes Virus 1
gucgcgaccacucucacgcgccgcggcccccugggccggcaguagcuggaaugggggggugac

SEQ ID NO: 543512 - RNA, 61 nt, Human Herpes Virus 2
cccggaaugacccggaggccggcccccgcuuccgacggacgggggucacccugccgugucc

SEQ ID NO: 543513 - RNA, 61 nt, Human Herpes Virus 2
gacgcuggcgcgcaucaugggcccggccgugccgacggaacaccuggcgagccugcggcgc

SEQ ID NO: 543514 - RNA, 61 nt, Human Herpes Virus 2
acgaccggcggccccggaucuccggauccagccgacggaccgccgcccaccccgaacccgg

SEQ ID NO: 543515 - RNA, 64 nt, Human Herpes Virus 4 (Epstein Barr virus)
cucgagcuuccaagauagcguguaagugcccuuguccaggaaggcucggcguucgccuugcggg

SEQ ID NO: 543516 - RNA, 64 nt, Human Herpes Virus 4 (Epstein Barr virus)
auccggcaugagcaucacgaccucuugaaucucuuccaggaaauggugccggaugagauagccc

SEQ ID NO: 543517 - RNA, 61 nt, Human Herpes Virus 4 (Epstein Barr virus)
acagaccccgggugggauccauggcuggauuuccaggaaaggaggccggcccgcccggcgg

SEQ ID NO: 543518 - RNA, 64 nt, Human Herpes Virus 4 (Epstein Barr virus)
auucgcagggccccugccuccuggcccccauguuuggacuaaggcacaagaaugccucacggac

SEQ ID NO: 543519 - RNA, 64 nt, Human Herpes Virus 1
gggccuccgcggcccuacagcaccugcgcuccaucagcuccagcggcauggccgcccgcgcggc

SEQ ID NO: 543520 - RNA, 64 nt, Human Herpes Virus 1
agcuggccauggccauaaacgccgacuacggcaucagcuccaagcuugccaugaccaucacgcg

SEQ ID NO: 543521 - RNA, 64 nt, Human Herpes Virus 1
cucggagcgcgcgucggaggcguacuuccugggccagcuccagguggcccggcacgaaacuggc

SEQ ID NO: 543522 - RNA, 62 nt, Human Herpes Virus 1
ccgccuggaggacggcgccggggcucucggggccgcaggacccagcaaggcguccauucucc

SEQ ID NO: 543523 - RNA, 64 nt, Human Herpes Virus 4 (Epstein Barr virus)
gauugagaaugccaagagccccuccauaggccucugccgggaggugcugggucgccugacccuc

SEQ ID NO: 543524 - RNA, 64 nt, Human Herpes Virus 4 (Epstein Barr virus)
cuuuuggacuaccaacuuucccucggugguguccugccgggacggucucaacguguccugguuu

SEQ ID NO: 543525 - RNA, 64 nt, Human Herpes Virus 4 (Epstein Barr virus)
gagggagagggaggggaggcagaucucaggggcgugccgggaggaggaggagaaggagcauacg

SEQ ID NO: 543526 - RNA, 64 nt, Human Herpes Virus 4 (Epstein Barr virus)
gcuaaagagcgucguggagggcauccaggaugugugccgggacgccgccgccaggugggcccug

SEQ ID NO: 543527 - RNA, 64 nt, Human Herpes Virus 4 (Epstein Barr virus)
ccagaaacugguccugcuggagaugaagggaggcugccgggagccggaacuggacacggaaacg

SEQ ID NO: 543528 - RNA, 64 nt, Human Herpes Virus 4 (Epstein Barr virus)
caccggccucauccccaucgacauguacgccgugugccgggacaagcucagccucucagacuac

SEQ ID NO: 543529 - RNA, 64 nt, Human Herpes Virus 4 (Epstein Barr virus); identical to SEQ ID NO: 543523

SEQ ID NO: 543530 - RNA, 64 nt, Human Herpes Virus 4 (Epstein Barr virus); identical to SEQ ID NO: 543524

SEQ ID NO: 543531 - RNA, 64 nt, Human Herpes Virus 4 (Epstein Barr virus); identical to SEQ ID NO: 543525

SEQ ID NO: 543532 - RNA, 64 nt, Human Herpes Virus 4 (Epstein Barr virus); identical to SEQ ID NO: 543526

SEQ ID NO: 543533 - RNA, 64 nt, Human Herpes Virus 4 (Epstein Barr virus); identical to SEQ ID NO: 543527

SEQ ID NO: 543534 - RNA, 64 nt, Human Herpes Virus 4 (Epstein Barr virus); identical to SEQ ID NO: 543528

SEQ ID NO: 543535 - RNA, 64 nt, Human Herpes Virus 1
cuucgucauguucaaagacgcggugaaccgccacuacaucuacgacacccagggggcggccauc

SEQ ID NO: 543536 - RNA, 64 nt, Human Herpes Virus 1
ccgggacgaggccgugcacacgacggccucguguuacaucuacaacaacuaccucggcgggcac

SEQ ID NO: 543537 - RNA, 64 nt, Human Herpes Virus 1
uugccugcgcguguccgaccgugaauucauuacguacaucuaccuggcccauuuugaguguuuc

SEQ ID NO: 543538 - RNA, 64 nt, Human Herpes Virus 2
gccaggcgggugggcuuccggcggccgccggagaccacgggauccgggggucggcgaagcgccg

SEQ ID NO: 543539 - RNA, 64 nt, Human Herpes Virus 2
cauccguggggacccagacguccggggaguuccuccacgggaacccaaggacccccgaacccca

SEQ ID NO: 543540 - RNA, 64 nt, Human Herpes Virus 2
acgacccccacgggugcccagggagccuagacccccacgggaaccccgcgcaacccgcgggcuu

SEQ ID NO: 543541 - RNA, 64 nt, Human Herpes Virus 4 (Epstein Barr virus)
uaaggugguuauuuugggccaggaccccuaucacgggggucaagcaaacggccuggcauucagc

SEQ ID NO: 543542 - RNA, 64 nt, Human Herpes Virus 4 (Epstein Barr virus)
ugugacuuauuaccccaacaacacggacagccaugggggucaugguggauuugaggcggcugcc

SEQ ID NO: 543543 - RNA, 64 nt, Human Herpes Virus 4 (Epstein Barr virus)
ugguagcggccguguccggggagagcgugcucaagggggucaguaccuacacgaccgccaaggg

SEQ ID NO: 543544 - RNA, 64 nt, Human Herpes Virus 4 (Epstein Barr virus)
uugucacgcugccagugaccaucaacaaguacacgggggucaacggcaacaaccagauauucca

SEQ ID NO: 543545 - RNA, 62 nt, Human Herpes Virus 4 (Epstein Barr virus)
aguccaucuccuucaccuccgccaccuccuaggaccccuacuugggagaguccggcaaggcc

SEQ ID NO: 543546 - RNA, 62 nt, Human Herpes Virus 4 (Epstein Barr virus)
ccucugauauuaaggugguuauuuugggccaggaccccuaucacgggggucaagcaaacggc

SEQ ID NO: 543547 - RNA, 62 nt, Human Herpes Virus 4 (Epstein Barr virus)
aacggggcgcgcugggccgcggcugcccccuggaccccuaggccugugccauggggaccccc

SEQ ID NO: 543548 - RNA, 62 nt, Human Herpes Virus 4 (Epstein Barr virus)
gcuucccccccgucauguccacgcagcggagggaccccuaugugaucucgggggccucgggc

SEQ ID NO: 543549 - RNA, 64 nt, Human Herpes Virus 4 (Epstein Barr virus); identical to SEQ ID NO: 543541

SEQ ID NO: 543550 - RNA, 64 nt, Human Herpes Virus 4 (Epstein Barr virus); identical to SEQ ID NO: 543542

SEQ ID NO: 543551 - RNA, 64 nt, Human Herpes Virus 4 (Epstein Barr virus); identical to SEQ ID NO: 543543

SEQ ID NO: 543552 - RNA, 64 nt, Human Herpes Virus 4 (Epstein Barr virus); identical to SEQ ID NO: 543544

SEQ ID NO: 543553 - RNA, 62 nt, Human Herpes Virus 4 (Epstein Barr virus); identical to SEQ ID NO: 543545

SEQ ID NO: 543554 - RNA, 62 nt, Human Herpes Virus 4 (Epstein Barr virus); identical to SEQ ID NO: 543546

SEQ ID NO: 543555 - RNA, 62 nt, Human Herpes Virus 4 (Epstein Barr virus); identical to SEQ ID NO: 543547

SEQ ID NO: 543556 - RNA, 62 nt, Human Herpes Virus 4 (Epstein Barr virus); identical to SEQ ID NO: 543548

SEQ ID NO: 543557 - RNA, 64 nt, Human Herpes Virus 4 (Epstein Barr virus); identical to SEQ ID NO: 543541

SEQ ID NO: 543558 - RNA, 64 nt, Human Herpes Virus 4 (Epstein Barr virus); identical to SEQ ID NO: 543542

SEQ ID NO: 543559 - RNA, 64 nt, Human Herpes Virus 4 (Epstein Barr virus); identical to SEQ ID NO: 543543

SEQ ID NO: 543560 - RNA, 64 nt, Human Herpes Virus 4 (Epstein Barr virus); identical to SEQ ID NO: 543544

SEQ ID NO: 543561 - RNA, 62 nt, Human Herpes Virus 4 (Epstein Barr virus); identical to SEQ ID NO: 543545

SEQ ID NO: 543562 - RNA, 62 nt, Human Herpes Virus 4 (Epstein Barr virus); identical to SEQ ID NO: 543546

SEQ ID NO: 543563 - RNA, 62 nt, Human Herpes Virus 4 (Epstein Barr virus); identical to SEQ ID NO: 543547

SEQ ID NO: 543564 - RNA, 62 nt, Human Herpes Virus 4 (Epstein Barr virus); identical to SEQ ID NO: 543548

SEQ ID NO: 543565 - RNA, 64 nt, Human Herpes Virus 2
acgcguauagccgcgggcggaccagaaacaauuacggaucgacaaucgagggccugcucgaccu

SEQ ID NO: 543566 - RNA, 64 nt, Human Herpes Virus 4 (Epstein Barr virus)
caagguucggaaaucuguugacgguguaacuacccgcaaugaaauggaaaauauauugcaaaau

SEQ ID NO: 543567 - RNA, 61 nt, Human Herpes Virus 2
auacagccgucccuccgcguauugcgcgcggccgacggaccagaggccugcuaugugcugg

SEQ ID NO: 543568 - RNA, 61 nt, Human Herpes Virus 2; identical to SEQ ID NO: 543514

SEQ ID NO: 543569 - RNA, 64 nt, Human Herpes Virus 2; identical to SEQ ID NO: 541374

SEQ ID NO: 543570 - RNA, 64 nt, Human Herpes Virus 2; identical to SEQ ID NO: 541348

SEQ ID NO: 543571 - RNA, 64 nt, Human Herpes Virus 2; identical to SEQ ID NO: 541371

SEQ ID NO: 543572 - RNA, 64 nt, Human Herpes Virus 2; identical to SEQ ID NO: 541372

SEQ ID NO: 543573 - RNA, 64 nt, Human Herpes Virus 2; identical to SEQ ID NO: 541373

SEQ ID NO: 543574 - RNA, 64 nt, Human Herpes Virus 2; identical to SEQ ID NO: 541375

SEQ ID NO: 543575 - RNA, 61 nt, Human Herpes Virus 2
uaucgagaucggguucauccgaucccaggccccgacggacagcucuauccugaguccgggg

SEQ ID NO: 543576 - RNA, 61 nt, Human Herpes Virus 2
acgcuggugcagcgcauauggacgaccgcguccgacggagaggccguggagcuugccagcg

SEQ ID NO: 543577 - RNA, 64 nt, Human Herpes Virus 4 (Epstein Barr virus)
acgucauagauguggugccuggcaaccuggucacuuacgccaagcagaggcucaacaacgccau

SEQ ID NO: 543578 - RNA, 64 nt, Human Herpes Virus 2
cgcggagguguccguugguucguccgaccugcaggacuucuacggcucccccgacgucucggcc

SEQ ID NO: 543579 - RNA, 64 nt, Human Herpes Virus 2
agucuacccuaccccggcucauggaaccccggcccggcacgagcucccgggcggaccccggccc

SEQ ID NO: 543580 - RNA, 64 nt, Human Herpes Virus 2
gccacucgaccagcgaucgcggcuuggcgguccccggcacgagggugagcacgucguugaggac

SEQ ID NO: 543581 - RNA, 64 nt, Human Herpes Virus 2
uggcguucguggcccucaugcccccgaccgcgcccggcacgaaccugguccuggguguccuucc

SEQ ID NO: 543582 - RNA, 64 nt, Human Herpes Virus 2
acaaccccucgcggguggaggcguuccaucgguacggcacgacggucaacugcaucgucgagga

SEQ ID NO: 543583 - RNA, 64 nt, Human Herpes Virus 2; identical to SEQ ID NO: 543579

SEQ ID NO: 543584 - RNA, 64 nt, Human Herpes Virus 2; identical to SEQ ID NO: 543269

SEQ ID NO: 543585 - RNA, 64 nt, Human Herpes Virus 2; identical to SEQ ID NO: 543270

SEQ ID NO: 543586 - RNA, 64 nt, Human Herpes Virus 2; identical to SEQ ID NO: 543271

SEQ ID NO: 543587 - RNA, 64 nt, Human Herpes Virus 2; identical to SEQ ID NO: 543272

SEQ ID NO: 543588 - RNA, 64 nt, Human Herpes Virus 2; identical to SEQ ID NO: 543273

SEQ ID NO: 543589 - RNA, 64 nt, Human Herpes Virus 2; identical to SEQ ID NO: 543274

SEQ ID NO: 543590 - RNA, 64 nt, Human Herpes Virus 2; identical to SEQ ID NO: 543270

SEQ ID NO: 543591 - RNA, 64 nt, Human Herpes Virus 2; identical to SEQ ID NO: 543269

SEQ ID NO: 543592 - RNA, 64 nt, Human Herpes Virus 2; identical to SEQ ID NO: 540737

SEQ ID NO: 543593 - RNA, 64 nt, Human Herpes Virus 2; identical to SEQ ID NO: 540738

SEQ ID NO: 543594 - RNA, 64 nt, Human Herpes Virus 2; identical to SEQ ID NO: 540739

SEQ ID NO: 543595 - RNA, 64 nt, Human Herpes Virus 2; identical to SEQ ID NO: 540740

SEQ ID NO: 543596 - RNA, 64 nt, Human Herpes Virus 2; identical to SEQ ID NO: 540741

SEQ ID NO: 543597 - RNA, 64 nt, Human Herpes Virus 2; identical to SEQ ID NO: 540742

SEQ ID NO: 543598 - RNA, 64 nt, Human Herpes Virus 2; identical to SEQ ID NO: 540743

SEQ ID NO: 543599 - RNA, 64 nt, Human Herpes Virus 2; identical to SEQ ID NO: 540744

SEQ ID NO: 543600 - RNA, 64 nt, Human Herpes Virus 2; identical to SEQ ID NO: 540745

SEQ ID NO: 543601 - RNA, 64 nt, Human Herpes Virus 2; identical to SEQ ID NO: 540746

SEQ ID NO: 543602 - RNA, 64 nt, Human Herpes Virus 2; identical to SEQ ID NO: 540747

SEQ ID NO: 543603 - RNA, 64 nt, Human Herpes Virus 2; identical to SEQ ID NO: 540748

SEQ ID NO: 543604 - RNA, 62 nt, Human Herpes Virus 2
agggcgaccccgacguccagcugcgccucacgaagccccagcucacgaagguggugaacgcc

SEQ ID NO: 543605 - RNA, 62 nt, Human Herpes Virus 2
ccuacccgccccgggcgcgugucgcgcaacggaagccccagaacgcgaggacgggugccgaa

SEQ ID NO: 543606 - RNA, 62 nt, Human Herpes Virus 2
uuacguucacggccuucgaggccagccaggguaagccccagcggggcgcgcgcgacgccggg

SEQ ID NO: 543607 - RNA, 62 nt, Human Herpes Virus 2
ggcccgcugugcgucgagcuccgacacgccccaagccccagggugguguggcgggacguguc

SEQ ID NO: 543608 - RNA, 61 nt, Human Herpes Virus 1
gggucgcgcggcccgaaaacgucugggugcccguggucaccuuucugggggcgggcgcgcu

SEQ ID NO: 543609 - RNA, 64 nt, Human Herpes Virus 2; identical to SEQ ID NO: 543295

SEQ ID NO: 543610 - RNA, 64 nt, Human Herpes Virus 2; identical to SEQ ID NO: 543296

SEQ ID NO: 543611 - RNA, 64 nt, Human Herpes Virus 2; identical to SEQ ID NO: 543297

SEQ ID NO: 543612 - RNA, 64 nt, Human Herpes Virus 2; identical to SEQ ID NO: 543298

SEQ ID NO: 543613 - RNA, 62 nt, Human Herpes Virus 1
gaggccaggacuuuaaccugcucuuugucgacgaggccaacuuuauucgcccggaugcgguc

SEQ ID NO: 543614 - RNA, 62 nt, Human Herpes Virus 1
ccgccgccccucgcgccgcucuccuggucgcggaggccaacauugacaucgacccuauggcc

SEQ ID NO: 543615 - RNA, 62 nt, Human Herpes Virus 1
ccggggagggcgaggagggcggcgacuuugacgaggccaagcuagccgaggcccgggagaug

SEQ ID NO: 543616 - RNA, 62 nt, Human Herpes Virus 1
ggaggaacuucaaguuucgcgacggucugggcgaggccaaccacgccaugucccugacgcug

SEQ ID NO: 543617 - RNA, 62 nt, Human Herpes Virus 1
uggucgugggccugaccguggagagcggcuuugaggccaacguggccguggucguggguucu

SEQ ID NO: 543618 - RNA, 62 nt, Human Herpes Virus 1
agaucgacccggccauaaugauuccgccgcucgaggccaacaagaugguucgcagccgcgag

SEQ ID NO: 543619 - RNA, 61 nt, Human Herpes Virus 1
ugcucgccagcgccggcgaccggcggcucaucguggucaacaccgugcgcgccugcgacug

SEQ ID NO: 543620 - RNA, 61 nt, Human Herpes Virus 1
agcacauacuaucggcucugcgcgauccgaacguggucauugucuauuaacccgccguccc

SEQ ID NO: 543621 - RNA, 61 nt, Human Herpes Virus 1
agcccgucuuuacgcccaugcuccuuaaucacguggucaguuccugcggccaguggcccgc

SEQ ID NO: 543622 - RNA, 61 nt, Human Herpes Virus 1
ucgguacgcucgacgaggacgucgccgccgacguggucaccgcccccucaagggcccgcgg

SEQ ID NO: 543623 - RNA, 61 nt, Human Herpes Virus 1
cccaggcuauucggagcauggccgagagugacguggucauggaggauguggccaucgccga

SEQ ID NO: 543624 - RNA, 61 nt, Human Herpes Virus 1; identical to SEQ ID NO: 543619

SEQ ID NO: 543625 - RNA, 64 nt, Human Herpes Virus 1
agaggcggagcagcgcacgauggacccccgaccugggcuacaugcgccaguguaucaaucagcu

SEQ ID NO: 543626 - RNA, 64 nt, Human Herpes Virus 1
cgucgaccgcgcccucgccacacccgcgacccccgggcuacacggccguugucuccccgauggc

SEQ ID NO: 543627 - RNA, 64 nt, Human Herpes Virus 1
ucacccagccgcgcgcgaacguggaccugggcgugggcuacaccgccgucguggccacggcaac

SEQ ID NO: 543628 - RNA, 64 nt, Human Herpes Virus 2; identical to SEQ ID NO: 542392

SEQ ID NO: 543629 - RNA, 64 nt, Human Herpes Virus 4 (Epstein Barr virus)
gaggccgcccgaacggccguaaugaggccugggccagaauuaggugaggaggacguccgcuuuu

SEQ ID NO: 543630 - RNA, 64 nt, Human Herpes Virus 4 (Epstein Barr virus)
ggugaggguccaggcauuaaucccauuaguaagacagaauuacaagccaucauguuagcgcugc

SEQ ID NO: 543631 - RNA, 64 nt, Human Herpes Virus 1
uuaagaggaucgcggcgcucuucugcgugcccguggccaccaagaccaaaccccgagccgccuc

SEQ ID NO: 543632 - RNA, 64 nt, Human Herpes Virus 1
gcguccgggcgcuuggcaugcgcgggcucgucuuggccaccaauaacucucaguuuaucaugga

SEQ ID NO: 543633 - RNA, 64 nt, Human Herpes Virus 1
ccagggggaggccgccggggccccucucgcccacggccaccacguguacugccagcgagucaau

SEQ ID NO: 543634 - RNA, 64 nt, Human Herpes Virus 1
acuacaccuccagcugcuaccugguaaacccccaggccaccacaaacaaggcgacccugcgggc

SEQ ID NO: 543635 - RNA, 64 nt, Human Herpes Virus 1
ugccgaugcaacgauaccuggacaacggccgccuggccaccaggguggcccgggcgacccuggu

SEQ ID NO: 543636 - RNA, 64 nt, Human Herpes Virus 1
ucuucaaggagaacaucgccccguacaaguucaaggccaccauguacuacaaagacgucaccgu

SEQ ID NO: 543637 - RNA, 64 nt, Human Herpes Virus 1
ccgacgcccugcuggaggcgcacgacguguuucaggccaccacgcccggccuguacgccaucag

SEQ ID NO: 543638 - RNA, 64 nt, Human Herpes Virus 1
auucaccgcaucgacuggagcuggugcugcgcgaggccaccagucacguacgccgacauguuuc

SEQ ID NO: 543639 - RNA, 64 nt, Human Herpes Virus 1
aggacaagaugcggcgccuggcggacacguguauggccaccauccugcagauguacauguccgu

SEQ ID NO: 543640 - RNA, 64 nt, Human Herpes Virus 2
cagcaccaucccgauagugaacgacccccggacccgcguggaggccgaggcggccgugcgggcc

SEQ ID NO: 543641 - RNA, 64 nt, Human Herpes Virus 2
ggaacguggcggaccugcugcgggccgcggcccccgcguggagccgccgcacccugcuccccga

SEQ ID NO: 543642 - RNA, 64 nt, Human Herpes Virus 2
cuccggccgcguguucgggccgggggucuucgcgcgcguggaggccgcgcacgcgcgccuguac

SEQ ID NO: 543643 - RNA, 64 nt, Human Herpes Virus 2
gaugaugcgacagcgagcgaccuguguuaaaauucgcguggaagagcaagcggcgcgacgugau

SEQ ID NO: 543644 - RNA, 64 nt, Human Herpes Virus 2
cagccuccagagcgccuaccagaagcccgacaagcgcguggacauccuccucggaccgcugggc

SEQ ID NO: 543645 - RNA, 64 nt, Human Herpes Virus 2
cgaccccggauaccgcgacgcggcggcguuggagcgcguggaccuucgugguggugcugaagac

SEQ ID NO: 543646 - RNA, 64 nt, Human Herpes Virus 2; identical to SEQ ID NO: 543641

SEQ ID NO: 543647 - RNA, 64 nt, Human Herpes Virus 2; identical to SEQ ID NO: 543640

SEQ ID NO: 543648 - RNA, 64 nt, Human Herpes Virus 2; identical to SEQ ID NO: 543642

SEQ ID NO: 543649 - RNA, 64 nt, Human Herpes Virus 1; identical to SEQ ID NO: 538485

SEQ ID NO: 543650 - RNA, 64 nt, Human Herpes Virus 1; identical to SEQ ID NO: 538486

SEQ ID NO: 543651 - RNA, 64 nt, Human Herpes Virus 1; identical to SEQ ID NO: 538487

SEQ ID NO: 543652 - RNA, 64 nt, Human Herpes Virus 1; identical to SEQ ID NO: 538488

SEQ ID NO: 543653 - RNA, 64 nt, Human Herpes Virus 1; identical to SEQ ID NO: 538489

SEQ ID NO: 543654 - RNA, 64 nt, Human Herpes Virus 1; identical to SEQ ID NO: 538490

SEQ ID NO: 543655 - RNA, 64 nt, Human Herpes Virus 1; identical to SEQ ID NO: 538491

SEQ ID NO: 543656 - RNA, 64 nt, Human Herpes Virus 1; identical to SEQ ID NO: 538492

SEQ ID NO: 543657 - RNA, 64 nt, Human Herpes Virus 1; identical to SEQ ID NO: 538493

SEQ ID NO: 543658 - RNA, 64 nt, Human Herpes Virus 1; identical to SEQ ID NO: 538494

SEQ ID NO: 543659 - RNA, 64 nt, Human Herpes Virus 1; identical to SEQ ID NO: 538495

SEQ ID NO: 543660 - RNA, 64 nt, Human Herpes Virus 1; identical to SEQ ID NO: 538496

SEQ ID NO: 543661 - RNA, 64 nt, Human Herpes Virus 1; identical to SEQ ID NO: 538497

SEQ ID NO: 543662 - RNA, 64 nt, Human Herpes Virus 1; identical to SEQ ID NO: 538498

SEQ ID NO: 543663 - RNA, 64 nt, Human Herpes Virus 1; identical to SEQ ID NO: 538499

SEQ ID NO: 543664 - RNA, 64 nt, Human Herpes Virus 1; identical to SEQ ID NO: 538500

SEQ ID NO: 543665 - RNA, 64 nt, Human Herpes Virus 1; identical to SEQ ID NO: 538501

SEQ ID NO: 543666 - RNA, 64 nt, Human Herpes Virus 1; identical to SEQ ID NO: 538502

SEQ ID NO: 543667 - RNA, 64 nt, Human Herpes Virus 1; identical to SEQ ID NO: 538503

SEQ ID NO: 543668 - RNA, 64 nt, Human Herpes Virus 1; identical to SEQ ID NO: 538493

SEQ ID NO: 543669 - RNA, 64 nt, Human Herpes Virus 1; identical to SEQ ID NO: 538485

SEQ ID NO: 543670 - RNA, 64 nt, Human Herpes Virus 1; identical to SEQ ID NO: 538486

SEQ ID NO: 543671 - RNA, 64 nt, Human Herpes Virus 1; identical to SEQ ID NO: 538487

SEQ ID NO: 543672 - RNA, 64 nt, Human Herpes Virus 1; identical to SEQ ID NO: 538488

SEQ ID NO: 543673 - RNA, 64 nt, Human Herpes Virus 1; identical to SEQ ID NO: 538489

SEQ ID NO: 543674 - RNA, 64 nt, Human Herpes Virus 1; identical to SEQ ID NO: 538490

SEQ ID NO: 543675 - RNA, 64 nt, Human Herpes Virus 1; identical to SEQ ID NO: 538491

SEQ ID NO: 543676 - RNA, 64 nt, Human Herpes Virus 1; identical to SEQ ID NO: 538492

SEQ ID NO: 543677 - RNA, 64 nt, Human Herpes Virus 1; identical to SEQ ID NO: 538493

SEQ ID NO: 543678 - RNA, 64 nt, Human Herpes Virus 1; identical to SEQ ID NO: 538494

SEQ ID NO: 543679 - RNA, 64 nt, Human Herpes Virus 1; identical to SEQ ID NO: 538495

SEQ ID NO: 543680 - RNA, 64 nt, Human Herpes Virus 1; identical to SEQ ID NO: 538496

SEQ ID NO: 543681 - RNA, 64 nt, Human Herpes Virus 1; identical to SEQ ID NO: 538497

SEQ ID NO: 543682 - RNA, 64 nt, Human Herpes Virus 1; identical to SEQ ID NO: 538498

SEQ ID NO: 543683 - RNA, 61 nt, Human Herpes Virus 2
ggccccccgcguccccgcccgcggacgcgccgcgcgggaagguacgccuccccuccgaccc

SEQ ID NO: 543684 - RNA, 61 nt, Human Herpes Virus 2
gccguggacaagauccucaggggagcccggcgcgcgggagggcugaccguccccggcgccc

SEQ ID NO: 543685 - RNA, 64 nt, Human Herpes Virus 1; identical to SEQ ID NO: 538499

SEQ ID NO: 543686 - RNA, 64 nt, Human Herpes Virus 1; identical to SEQ ID NO: 538500

SEQ ID NO: 543687 - RNA, 64 nt, Human Herpes Virus 1; identical to SEQ ID NO: 538501

SEQ ID NO: 543688 - RNA, 64 nt, Human Herpes Virus 1; identical to SEQ ID NO: 538502

SEQ ID NO: 543689 - RNA, 64 nt, Human Herpes Virus 1; identical to SEQ ID NO: 538503

SEQ ID NO: 543690 - RNA, 64 nt, Human Herpes Virus 1; identical to SEQ ID NO: 538493

SEQ ID NO: 543691 - RNA, 63 nt, Human Herpes Virus 2
caggaaacgcccgcggcccgcgccggcgccgucggggcguaccuggcgcgcgccgcgggccuc

SEQ ID NO: 543692 - RNA, 64 nt, Human Herpes Virus 2
ggcgaagacgcgcgaaacgaguuccacgcccucaccgcccuagagcagacuuuggggcugggcc

SEQ ID NO: 543693 - RNA, 64 nt, Human Herpes Virus 2
augguucgcagucgcgaggaggugcgcgugucgaccgcccuaagccgcgucagcccgcggucgg

SEQ ID NO: 543694 - RNA, 61 nt, Human Herpes Virus 2
cgcggcggccgcggccgaagaggcggaugccgcgcgggacgccgaggcgaggggggagggc

SEQ ID NO: 543695 - RNA, 61 nt, Human Herpes Virus 2
guccccgaccggccaggcguuugccgcggcggcgcgggacgacugggcccgcgugacgcgg

SEQ ID NO: 543696 - RNA, 61 nt, Human Herpes Virus 2
cgcgugcaucgaggcucacuuucccgagcacgcgcgggaauaucaggccguguccguucgc

SEQ ID NO: 543697 - RNA, 61 nt, Human Herpes Virus 2
cgccgugcagugcgccgugcgcuggccggcggcgcgggaccugcgccgcaccgugcuggcc

SEQ ID NO: 543698 - RNA, 64 nt, Human Herpes Virus 2
gggaagcucuggccggcggcgaccggcccgacuggcuguggagccgucgcuccaucuccguggu

SEQ ID NO: 543699 - RNA, 64 nt, Human Herpes Virus 2
gugucggggcugcgggcccagccgcuuuggccgcgcuguggacccagguaccagggcguccugg

SEQ ID NO: 543700 - RNA, 64 nt, Human Herpes Virus 2
acgucuccguguuguaccauugggccucguggaugcuguggacggcggacaaguacgugugucg

SEQ ID NO: 543701 - RNA, 64 nt, Human Herpes Virus 2
caggcucagaccgacacccaagcacagagucugggccgggcaggcgcgaccgacgcgcgcgggu

SEQ ID NO: 543702 - RNA, 64 nt, Human Herpes Virus 2
gccacuccccgccgcggcggcggcaacgcccggggccgggcacacgaacaccagcagcgccucc

SEQ ID NO: 543703 - RNA, 64 nt, Human Herpes Virus 2
ggaccuggcccugagccagugccacgggguguucgccgggcagucggucgaggggcgcaacuuu

SEQ ID NO: 543704 - RNA, 64 nt, Human Herpes Virus 2
gggugccgucgagcgccgccgugcgcgaagagucgccgggcagcagcuggaaggagggcgcguu

SEQ ID NO: 543705 - RNA, 64 nt, Human Herpes Virus 2; identical to SEQ ID NO: 543701

SEQ ID NO: 543706 - RNA, 64 nt, Human Herpes Virus 1
ccacugucgucgccgucccacgcucuccccugcugccauggauuccgcggccccagcccucucc

SEQ ID NO: 543707 - RNA, 64 nt, Human Herpes Virus 1
cgccggugaugaggagugggcggaggacccgggcgccauggacacaucccacgaucccccggac

SEQ ID NO: 543708 - RNA, 64 nt, Human Herpes Virus 1
uggggccacgggauuuaccgcggaagagcuggacgccauggacagggaggcggcucgagccauc

SEQ ID NO: 543709 - RNA, 64 nt, Human Herpes Virus 1
gcuacgccugcugcgcaucuguccucggaucaucgccauggacgcaaccgccaacgcgcaguug

SEQ ID NO: 543710 - RNA, 64 nt, Human Herpes Virus 1
guggcaccuccccagcggccagaucuacugcugggccauggacagcgaccuggggucgcucugu

SEQ ID NO: 543711 - RNA, 64 nt, Human Herpes Virus 1
cgccgccaccaacguucccuacccccuggugggcgccauggaccugacguucguccugccccug

SEQ ID NO: 543712 - RNA, 64 nt, Human Herpes Virus 1
ccgggagaugauacgguacauggcccuggugucugccauggagcgcacggaacacaaggccaag

SEQ ID NO: 543713 - RNA, 64 nt, Human Herpes Virus 1
ccugggggacugcaucggcaaggacgcccgcgacgccauggaccgcaucuucgcccgcagguac

SEQ ID NO: 543714 - RNA, 64 nt, Human Herpes Virus 1
gagcccagcgggacuacgagcggcgcgcguuacggccauggaccguccugggcgccaagagcgc

SEQ ID NO: 543715 - RNA, 64 nt, Human Herpes Virus 1
ccgccuccguuccggagccuugcggcaggcgcgggccauggaugccggccgggccgccggucgc

SEQ ID NO: 543716 - RNA, 64 nt, Human Herpes Virus 1
ugcacuuuagcaccgcccccccaaaccccgacgcgccauggaccccccggguggccggcuuuaa

SEQ ID NO: 543717 - RNA, 64 nt, Human Herpes Virus 4 (Epstein Barr virus)
cgaggacccaccagauuauggagaucaagguaaugugacacaggugggaucugagccuauuuca

SEQ ID NO: 543718 - RNA, 64 nt, Human Herpes Virus 4 (Epstein Barr virus)
aggggguuccccaacggccauggccgccucagcggugacacaggcacccacggaauauaccagg

SEQ ID NO: 543719 - RNA, 64 nt, Human Herpes Virus 4 (Epstein Barr virus)
gacacccgugcuugucuugcagccacguggccacgugacacacacuguugggaugggagagggu

SEQ ID NO: 543720 - RNA, 61 nt, Human Herpes Virus 2
cgccgccgauccagcuuccgggagcggcuucgcgcgggacugucccgauggcgagugagcc

SEQ ID NO: 543721 - RNA, 61 nt, Human Herpes Virus 2
caccuaucucaccgccaccugcgaagggcacgcgcgggagauugagccgaagcggcuggug

SEQ ID NO: 543722 - RNA, 61 nt, Human Herpes Virus 2
cccccgagaaccagcgccacaguuccggggcgcgcgggaacgccauccaccgccucggcug

SEQ ID NO: 543723 - RNA, 61 nt, Human Herpes Virus 2
cggcgcacccggggcuguugugcucaacgacgcgcgggagcuuugagcgcguccucgccuu

SEQ ID NO: 543724 - RNA, 61 nt, Human Herpes Virus 2
ugcccuugcgggggcgaacguguucgggcucgcgcgggaguacgggcacuacgccggcuac

SEQ ID NO: 543725 - RNA, 61 nt, Human Herpes Virus 2
cccgugggggccgccgccgugccgcugcucagcgcgggaggggccgcgcccccccaccccg

SEQ ID NO: 543726 - RNA, 61 nt, Human Herpes Virus 2
cauggcgcaguuuuuccgcggugagcugcgggcgcgggaggagagcuaccggaccguguug

SEQ ID NO: 543727 - RNA, 61 nt, Human Herpes Virus 2
gcuccgucaagucguguccgcgggaagcgccgcgcgggacccacgaggagcuguacuaugg

SEQ ID NO: 543728 - RNA, 61 nt, Human Herpes Virus 2
acggggcgcggguggcgcaggggucccucgagcgcgggaaagcgacgcagcagcgccgucu

SEQ ID NO: 543729 - RNA, 64 nt, Human Herpes Virus 2
caggacgcggggcacgugcgcugugaggugcacagcaagcaacagcuagucguggcccggaacg

SEQ ID NO: 543730 - RNA, 61 nt, Human Herpes Virus 2; identical to SEQ ID NO: 543683

SEQ ID NO: 543731 - RNA, 61 nt, Human Herpes Virus 2; identical to SEQ ID NO: 543697

SEQ ID NO: 543732 - RNA, 62 nt, Human Herpes Virus 1
cauccgcggcuucaucgcgccccucggguucucgcugcaacaacgacagauaguguuccccg

SEQ ID NO: 543733 - RNA, 62 nt, Human Herpes Virus 1
uuucgaaccguggucgaggugucucgcaugugcgcugcaaacgugcgcgaucccccgccccc

SEQ ID NO: 543734 - RNA, 64 nt, Human Herpes Virus 1; identical to SEQ ID NO: 541854

SEQ ID NO: 543735 - RNA, 64 nt, Human Herpes Virus 1; identical to SEQ ID NO: 541859

SEQ ID NO: 543736 - RNA, 64 nt, Human Herpes Virus 1; identical to SEQ ID NO: 541864

SEQ ID NO: 543737 - RNA, 62 nt, Human Herpes Virus 1; identical to SEQ ID NO: 540611

SEQ ID NO: 543738 - RNA, 64 nt, Human Herpes Virus 1
gccgguccgcugugccaucgcgcccccucaucccaccccccaucuuguccccaaauaaaacaag

SEQ ID NO: 543739 - RNA, 64 nt, Human Herpes Virus 1
gcgacccgggguucccgggcccccgucccccccgaccccccaacgaucccacgggccgccggcc

SEQ ID NO: 543740 - RNA, 64 nt, Human Herpes Virus 1
cggaacacgccuaccggccccugggccccgggacaccccccaugcgggcucggcuccccgccgc

SEQ ID NO: 543741 - RNA, 64 nt, Human Herpes Virus 1
gcgucuggaggaugaguuuggggaguuugacuggaccccccaggagggcucccagcccuggcug

SEQ ID NO: 543742 - RNA, 64 nt, Human Herpes Virus 1
ccaccgccaucagccuuaccacgcccgaccacacaccccccaugccaaguauuggacuggagga

SEQ ID NO: 543743 - RNA, 64 nt, Human Herpes Virus 1
cccccgcgcgccccgagaccagucgcccgaagacaccccccaccauuaucgggccgcuggcaac

SEQ ID NO: 543744 - RNA, 64 nt, Human Herpes Virus 1
gccguccgcagcuacgcgggguguuccagaacaaaccccccaccgcgcuguucggccgaggcuc

SEQ ID NO: 543745 - RNA, 64 nt, Human Herpes Virus 1
guauugcugguggaugauuaacgcccuguaccacaccccccaguacgcggcccgccugcggccc

SEQ ID NO: 543746 - RNA, 64 nt, Human Herpes Virus 1
gcuggcgugggcgcgccuggcggccauucgcgacaccccccagugcgcguccgccgcuucgcug

SEQ ID NO: 543747 - RNA, 64 nt, Human Herpes Virus 1
gaccuucggccccgaugacgugcuggaccuacugaccccccacuacgaccgcuacaugcagcug

SEQ ID NO: 543748 - RNA, 64 nt, Human Herpes Virus 1
cccccggaggcgccugccccgccacccaguuuccaccccccauguccgauagcgaauaaaaacc

SEQ ID NO: 543749 - RNA, 64 nt, Human Herpes Virus 1
ucagcuguggacccgagcucccauucgcccguuaaccccccacgugaucagcacgccaccgaca

SEQ ID NO: 543750 - RNA, 64 nt, Human Herpes Virus 1
cuacccggccgcgcgauaccuuaugggcagcaugaccccccaggccgugcuggcguucguggcc

SEQ ID NO: 543751 - RNA, 64 nt, Human Herpes Virus 1
cggagaacaccgaugcaaacuuuuacgugugcccaccccccacgggcgccacgguggugcaguu

SEQ ID NO: 543752 - RNA, 64 nt, Human Herpes Virus 1
guugggggacggggauuccccggggccgggauuuaccccccacgacuccgcccccuacggcgcu

SEQ ID NO: 543753 - RNA, 64 nt, Human Herpes Virus 1
ggccucccgacguacgccgaggcuaugucggaccaccccccaaccuaugccacugucguggccg

SEQ ID NO: 543754 - RNA, 64 nt, Human Herpes Virus 1; identical to SEQ ID NO: 541852

SEQ ID NO: 543755 - RNA, 64 nt, Human Herpes Virus 1; identical to SEQ ID NO: 541853

SEQ ID NO: 543756 - RNA, 62 nt, Human Herpes Virus 1; identical to SEQ ID NO: 540612

SEQ ID NO: 543757 - RNA, 62 nt, Human Herpes Virus 1; identical to SEQ ID NO: 540613

SEQ ID NO: 543758 - RNA, 62 nt, Human Herpes Virus 1; identical to SEQ ID NO: 540614

SEQ ID NO: 543759 - RNA, 62 nt, Human Herpes Virus 1; identical to SEQ ID NO: 540615

SEQ ID NO: 543760 - RNA, 63 nt, Human Herpes Virus 2
guccgcggaccggagacgacguccgcgguccgcggggcguacccggaccccauggccagccug

SEQ ID NO: 543761 - RNA, 63 nt, Human Herpes Virus 2; identical to SEQ ID NO: 543760

SEQ ID NO: 543762 - RNA, 63 nt, Human Herpes Virus 2
aaccacgaccccgucgaggccgcgaauccguacggggcguacgucgcggccccggccggcccc

SEQ ID NO: 543763 - RNA, 64 nt, Human Herpes Virus 1; identical to SEQ ID NO: 541855

SEQ ID NO: 543764 - RNA, 64 nt, Human Herpes Virus 1; identical to SEQ ID NO: 541856

SEQ ID NO: 543765 - RNA, 64 nt, Human Herpes Virus 1; identical to SEQ ID NO: 541857

SEQ ID NO: 543766 - RNA, 64 nt, Human Herpes Virus 1; identical to SEQ ID NO: 541858

SEQ ID NO: 543767 - RNA, 64 nt, Human Herpes Virus 1; identical to SEQ ID NO: 541860

SEQ ID NO: 543768 - RNA, 64 nt, Human Herpes Virus 1; identical to SEQ ID NO: 541861

SEQ ID NO: 543769 - RNA, 64 nt, Human Herpes Virus 1; identical to SEQ ID NO: 541865

SEQ ID NO: 543770 - RNA, 64 nt, Human Herpes Virus 1; identical to SEQ ID NO: 541866

SEQ ID NO: 543771 - RNA, 64 nt, Human Herpes Virus 1; identical to SEQ ID NO: 541867

SEQ ID NO: 543772 - RNA, 64 nt, Human Herpes Virus 1; identical to SEQ ID NO: 541868

SEQ ID NO: 543773 - RNA, 64 nt, Human Herpes Virus 1; identical to SEQ ID NO: 541869

SEQ ID NO: 543774 - RNA, 64 nt, Human Herpes Virus 1; identical to SEQ ID NO: 541852

SEQ ID NO: 543775 - RNA, 63 nt, Human Herpes Virus 2
acgcuguucgugcaccacgaggcgcgcgugcugggggcguaccgccgggcguauuaugggagc

SEQ ID NO: 543776 - RNA, 63 nt, Human Herpes Virus 2
accaacggcuccgucuguauacccccauagcgaggggcguaaaucucgccgcccgcucaccac

SEQ ID NO: 543777 - RNA, 64 nt, Human Herpes Virus 1; identical to SEQ ID NO: 541862

SEQ ID NO: 543778 - RNA, 64 nt, Human Herpes Virus 1; identical to SEQ ID NO: 541863

SEQ ID NO: 543779 - RNA, 64 nt, Human Herpes Virus 4 (Epstein Barr virus)
gcccucccucgacucucagucacccuaccuggagagggggcagucggugauggauucucgcuag

SEQ ID NO: 543780 - RNA, 64 nt, Human Herpes Virus 4 (Epstein Barr virus)
accaugaaggggaugagggugggggggcuguuggagggggcaggagucugcacucccuguauuc

SEQ ID NO: 543781 - RNA, 64 nt, Human Herpes Virus 4 (Epstein Barr virus)
uucucucuuguuuuauuaauagaaucucagccaggaccuauaccugagacuucaaagucugguc

SEQ ID NO: 543782 - RNA, 64 nt, Human Herpes Virus 2
acguuuggccgagacgcaccuccgggccgagguguacagggaccagacccugcagcuacaccgg

SEQ ID NO: 543783 - RNA, 64 nt, Human Herpes Virus 2
guugacgagcuucgcgguacuacucccccagggcgaccccgacguccagcugcgccucacgaag

SEQ ID NO: 543784 - RNA, 64 nt, Human Herpes Virus 2
ggcgguucagcuguuguuucccgcggcccgcguagaccccgacgccuaucccuguuauuuuuuc

SEQ ID NO: 543785 - RNA, 64 nt, Human Herpes Virus 2
cgcucuggagcgggacgaggagggccgccgcgacgaccccgaguccgacagcagcggggagugu

SEQ ID NO: 543786 - RNA, 64 nt, Human Herpes Virus 2
ugguugguugacacacccccccgcaaauccaagcgaccccgaaucaaccugcgauuaacgagcu

SEQ ID NO: 543787 - RNA, 64 nt, Human Herpes Virus 2
cguccacaccgcguccuuguucucggccccgcgcgaccccgaaaggcggccgugcgacaaccag

SEQ ID NO: 543788 - RNA, 64 nt, Human Herpes Virus 2
accccgcccgcgguuucgacgcgcccugcggacagaccccgagggggucgaccccgacguucgg

SEQ ID NO: 543789 - RNA, 64 nt, Human Herpes Virus 2
ucgacgcgcccugcggacagaccccgagggggucgaccccgacguucgggccccccgaaccggg

SEQ ID NO: 543790 - RNA, 64 nt, Human Herpes Virus 2
caccaacgccacgcaacccgaacucguuccggaagaccccgaggacucggcccucuuagaggau

SEQ ID NO: 543791 - RNA, 64 nt, Human Herpes Virus 2
cggugguucuggucguggagcccgccccugugccgaccccgacccccgacgacuacgacgaaga

SEQ ID NO: 543792 - RNA, 64 nt, Human Herpes Virus 2
ggcccagcgggaucugcgggagcugcgcugccaggaccccgacacgucccugucggcccaggcc

SEQ ID NO: 543793 - RNA, 64 nt, Human Herpes Virus 2
ugcacgugcgguucuggggccacgacgccgcgcugaccccgaggaacuuuugucuguuuuugcg

SEQ ID NO: 543794 - RNA, 64 nt, Human Herpes Virus 2
aucggaccccccaucgcgucacaccagacggcgggaccccgacguggcccgcccuccugccacg

SEQ ID NO: 543795 - RNA, 64 nt, Human Herpes Virus 2
cgccaucgacccggacugcagccccggucccccggaccccgacccgauguggucggcgucggcg

SEQ ID NO: 543796 - RNA, 64 nt, Human Herpes Virus 2
acccggcgccaagcgccccgcggaccccgcccgcgaccccgauagucccccgaagcggccccga

SEQ ID NO: 543797 - RNA, 64 nt, Human Herpes Virus 2
cgagccgcugugccagguggcccuuccggaccccgaccccgagcgugcccuuuucugcgagauc

SEQ ID NO: 543798 - RNA, 64 nt, Human Herpes Virus 2
ccucaccgagccgcugugccagguggcccuuccggaccccgaccccgagcgugcccuuuucugc

SEQ ID NO: 543799 - RNA, 64 nt, Human Herpes Virus 2
gcugacgggggucgccgcggcgaccccgcgccccgaccccgaggacggcgcggggucucugccc

SEQ ID NO: 543800 - RNA, 64 nt, Human Herpes Virus 2
cugcauagugccggucguggaccagcucgaggcggaccccgaggcgcagcccggggacgggggc

SEQ ID NO: 543801 - RNA, 64 nt, Human Herpes Virus 2
gauggcgcgcgugcggacggacgcggccgucuucgaccccgacgugccguuucugagugcgucg

SEQ ID NO: 543802 - RNA, 64 nt, Human Herpes Virus 2
cccuggagacccagggcauguacuacuggguguggggccggacggaccgcccguccgcguacgg

SEQ ID NO: 543803 - RNA, 64 nt, Human Herpes Virus 2
ccccgccgcgcggcccggguucggguggcacggugggccggaggagaacgaagacgaggccgac

SEQ ID NO: 543804 - RNA, 64 nt, Human Herpes Virus 2
cagcauguucgccuacgugaaacccaugaacuacgggccggacaugguguccguguaccagucg

SEQ ID NO: 543805 - RNA, 64 nt, Human Herpes Virus 2
ggacggggagcgcggccccgagccaggggcgcaggggccggagagcuggggcgacaucgcgacg

SEQ ID NO: 543806 - RNA, 64 nt, Human Herpes Virus 2
gcgcggaguccgcgcccgcgacucgcgccccggcgggccggacgcucgacgcccgcgcccgggc

SEQ ID NO: 543807 - RNA, 64 nt, Human Herpes Virus 2
ggccgccggggucuacgacgcggugcggaccugggggccggacgcggaggccgaaccggaccag

SEQ ID NO: 543808 - RNA, 64 nt, Human Herpes Virus 2; identical to SEQ ID NO: 543803

SEQ ID NO: 543809 - RNA, 60 nt, Human Herpes Virus 2
cgagcuggugcgcugcuucaagauucugcgccaccgcaacaagcagggccaggaaacguc

SEQ ID NO: 543810 - RNA, 60 nt, Human Herpes Virus 2
gcuguugcagaucacaguccugcugcuggcccaccgcaucagccagcuggcccaccuuau

SEQ ID NO: 543811 - RNA, 60 nt, Human Herpes Virus 2
gcgccgggaugacgggggcuaggaucgcccccaccgcauccgccggcacguaggcggcaa

SEQ ID NO: 543812 - RNA, 60 nt, Human Herpes Virus 2
caagcgagccaucguggagcugcuggacgcccaccgcaucgaccacagcgccugccggac

SEQ ID NO: 543813 - RNA, 60 nt, Human Herpes Virus 2
cuccauccugaguacgaucgagguggcgucccaccgcagacucuuugauuuuuucgccgc

SEQ ID NO: 543814 - RNA, 60 nt, Human Herpes Virus 2
acgcccuggggggccugcugccgccgcgacccaccgcacccgcggaccuggccccguggg

SEQ ID NO: 543815 - RNA, 64 nt, Human Herpes Virus 2
acccccggucccgcucccccgcuacaucagcccucccccgcacacgcccaccccccuccgccgc

SEQ ID NO: 543816 - RNA, 64 nt, Human Herpes Virus 2
gcagcguguuuguggcgaccgucaagagccugggcccccgcacccagcagcugcagaucgagga

SEQ ID NO: 543817 - RNA, 64 nt, Human Herpes Virus 2
gcuggugcugcgcgacgacgcggacgcgggcccgcccccgcagauacgcugggcgucggccgcg

SEQ ID NO: 543818 - RNA, 63 nt, Human Herpes Virus 4 (Epstein Barr virus)
ugcuacccggauacagauuaggauagcauauacuacccagauauagauuaggauagcauaugc

SEQ ID NO: 543819 - RNA, 63 nt, Human Herpes Virus 4 (Epstein Barr virus)
uacuacccagauauagauuaggauagcauaugcuacccagauauagauuaggauagccuaugc

SEQ ID NO: 543820 - RNA, 63 nt, Human Herpes Virus 4 (Epstein Barr virus)
ugcuacccagauauagauuaggauagccuaugcuacccagauauaaauuaggauagcauauac

SEQ ID NO: 543821 - RNA, 63 nt, Human Herpes Virus 4 (Epstein Barr virus)
ugcuacccagauauaaauuaggauagcauauacuacccagauauagauuaggauagcauaugc

SEQ ID NO: 543822 - RNA, 63 nt, Human Herpes Virus 4 (Epstein Barr virus); identical to SEQ ID NO: 543819

SEQ ID NO: 543823 - RNA, 63 nt, Human Herpes Virus 4 (Epstein Barr virus)
ugcuacccagauauagauuaggauagccuaugcuacccagauauagauuaggauagcauaugc

SEQ ID NO: 543824 - RNA, 63 nt, Human Herpes Virus 4 (Epstein Barr virus)
ugcuacccagauauagauuaggauagcauaugcuacccagauauagauuaggauagcauaugc

SEQ ID NO: 543825 - RNA, 63 nt, Human Herpes Virus 4 (Epstein Barr virus)
cauaugcuauccagauauuuggguaguauaugcuacccagauauaaauuaggauagcauauac

SEQ ID NO: 543826 - RNA, 63 nt, Human Herpes Virus 4 (Epstein Barr virus); identical to SEQ ID NO: 543818

SEQ ID NO: 543827 - RNA, 63 nt, Human Herpes Virus 4 (Epstein Barr virus); identical to SEQ ID NO: 543819

SEQ ID NO: 543828 - RNA, 63 nt, Human Herpes Virus 4 (Epstein Barr virus); identical to SEQ ID NO: 543820

SEQ ID NO: 543829 - RNA, 63 nt, Human Herpes Virus 4 (Epstein Barr virus); identical to SEQ ID NO: 543821

SEQ ID NO: 543830 - RNA, 63 nt, Human Herpes Virus 4 (Epstein Barr virus); identical to SEQ ID NO: 543819

SEQ ID NO: 543831 - RNA, 63 nt, Human Herpes Virus 4 (Epstein Barr virus); identical to SEQ ID NO: 543823

SEQ ID NO: 543832 - RNA, 63 nt, Human Herpes Virus 4 (Epstein Barr virus)
uguguccgacgccugcggacucaggccaccgucuacccagaggaggacaugugcauggccugg

SEQ ID NO: 543833 - RNA, 63 nt, Human Herpes Virus 4 (Epstein Barr virus)
ugcugacuagguuggugauggacugacccacgcuacccagacuguccauaaguucccccaggc

SEQ ID NO: 543834 - RNA, 63 nt, Human Herpes Virus 4 (Epstein Barr virus)
ggcccgcgucagcucgguuaccuuuuauaauguuacccagaccgcagggcgguggugggcgau

SEQ ID NO: 543835 - RNA, 63 nt, Human Herpes Virus 4 (Epstein Barr virus)
ugagaauuccaaguacaucaaaacacaccuguuuacccagacccugagcucggagcaccugca

SEQ ID NO: 543836 - RNA, 64 nt, Human Herpes Virus 1
ggacguuguguuuuacgucacaacggaccgaaaccgggccuacuuugugugcgggggguguguu

SEQ ID NO: 543837 - RNA, 64 nt, Human Herpes Virus 1
ggacgcagcggcuggccucccuccugacguacgccgggccuauaaaagcgcccgacgacgccgc

SEQ ID NO: 543838 - RNA, 64 nt, Human Herpes Virus 1
gggucggggcgagccgagagcgggugcacgcgcgcgggccuagugucguuuaacuuccuggugg

SEQ ID NO: 543839 - RNA, 64 nt, Human Herpes Virus 1
ccuccggggguccggcgcguguaccacauccaggcgggccuaccggacccguuccagcccccca

SEQ ID NO: 543840 - RNA, 64 nt, Human Herpes Virus 1
ggggggagcgggcuggcggacccccacggccggacgggccuagcaagacuggacgcgcuggugg

SEQ ID NO: 543841 - RNA, 64 nt, Human Herpes Virus 2
ccagggcgaccccgacguccagcugcgccucacgaagccccagcucacgaagguggugaacgcc

SEQ ID NO: 543842 - RNA, 64 nt, Human Herpes Virus 2
ggccuacccgccccgggcgcgugucgcgcaacggaagccccagaacgcgaggacgggugccgaa

SEQ ID NO: 543843 - RNA, 64 nt, Human Herpes Virus 2
cauuacguucacggccuucgaggccagccaggguaagccccagcggggcgcgcgcgacgccggg

SEQ ID NO: 543844 - RNA, 64 nt, Human Herpes Virus 2
gcggcccgcugugcgucgagcuccgacacgccccaagccccagggugguguggcgggacguguc

SEQ ID NO: 543845 - RNA, 62 nt, Human Herpes Virus 2
guaucgacggcucacgcagcaacccacgcugaccauggaaaaguggaucacggccaacgcca

SEQ ID NO: 543846 - RNA, 64 nt, Human Herpes Virus 2
ugaggugcacagcaagcaacagcuagucguggcccggaacgacaucacguacguccucaacagc

SEQ ID NO: 543847 - RNA, 64 nt, Human Herpes Virus 2
ucgcgagcgccgcccggggggccauuggggucuucggaacgaugaacagcgcguacagcgacug

SEQ ID NO: 543848 - RNA, 64 nt, Human Herpes Virus 2; identical to SEQ ID NO: 535391

SEQ ID NO: 543849 - RNA, 64 nt, Human Herpes Virus 2; identical to SEQ ID NO: 535392

SEQ ID NO: 543850 - RNA, 64 nt, Human Herpes Virus 2; identical to SEQ ID NO: 535393

SEQ ID NO: 543851 - RNA, 64 nt, Human Herpes Virus 2; identical to SEQ ID NO: 535394

SEQ ID NO: 543852 - RNA, 64 nt, Human Herpes Virus 2; identical to SEQ ID NO: 535395

SEQ ID NO: 543853 - RNA, 64 nt, Human Herpes Virus 2; identical to SEQ ID NO: 535392

SEQ ID NO: 543854 - RNA, 64 nt, Human Herpes Virus 2; identical to SEQ ID NO: 543815

SEQ ID NO: 543855 - RNA, 64 nt, Human Herpes Virus 2; identical to SEQ ID NO: 543816

SEQ ID NO: 543856 - RNA, 64 nt, Human Herpes Virus 2
cacgcuugaagggcacucgcuuccgaccgacgggcccccgcaccggggcggcgaccaugauccg

SEQ ID NO: 543857 - RNA, 64 nt, Human Herpes Virus 2
acauaacgcgauuuucggcgagcagguguuucugccccucgaccauucgcaguucagucgcuau

SEQ ID NO: 543858 - RNA, 64 nt, Human Herpes Virus 2
cguacgcggugugaaagaacgcgucgggggcgguccccucgagggcgcgcaucagguucuccag

SEQ ID NO: 543859 - RNA, 64 nt, Human Herpes Virus 2
ggugcgggagaucgacccggcuaucaugaucccgccccucgaggccaccaaaaugguucgcagu

SEQ ID NO: 543860 - RNA, 64 nt, Human Herpes Virus 2
uggggagccugaccaaccuccgccggccgcccucccccucgagcgagccggcgggcagcgcgga

SEQ ID NO: 543861 - RNA, 64 nt, Human Herpes Virus 2
ggcccccgcccgcucggcuucccguccccgccgcccccucgaguagcgaccccgaccgcguuca

SEQ ID NO: 543862 - RNA, 64 nt, Human Herpes Virus 2
ggcccccccuccgcugauggcgcugucccugacccccccgcacgcggacggccgcgccccgguc

SEQ ID NO: 543863 - RNA, 64 nt, Human Herpes Virus 2
augaugcgucagacggcugguugguugacacacccccccgcaaauccaagcgaccccgaaucaa

SEQ ID NO: 543864 - RNA, 64 nt, Human Herpes Virus 2
gcacccucagucgacccaagcgcggaaccgaccgcccccgcaaccacuacuccccccgacgaga

SEQ ID NO: 543865 - RNA, 64 nt, Human Herpes Virus 2
gcgcgaguuugggugucgcuggaccccgcugccccccccgcacggagcggcggcgccgcguccg

SEQ ID NO: 543866 - RNA, 61 nt, Human Herpes Virus 2; identical to SEQ ID NO: 542456

SEQ ID NO: 543867 - RNA, 64 nt, Human Herpes Virus 2
gaggugcaggcgccaccgcgaggaccuccccgagcccccgcacgucgacgcggccgaccggggu

SEQ ID NO: 543868 - RNA, 64 nt, Human Herpes Virus 2
cgcagagcucugcguugcaguugcccgggcccgucccccgcacggacuguguggccuauaaccc

SEQ ID NO: 543869 - RNA, 64 nt, Human Herpes Virus 2
cgccgcgcaugucguuucucuccgcgggacaacgcccccgcagacuguccaccaccgcccccau

SEQ ID NO: 543870 - RNA, 64 nt, Human Herpes Virus 2; identical to SEQ ID NO: 543817

SEQ ID NO: 543871 - RNA, 64 nt, Human Herpes Virus 2; identical to SEQ ID NO: 543856

SEQ ID NO: 543872 - RNA, 64 nt, Human Herpes Virus 2; identical to SEQ ID NO: 543867

SEQ ID NO: 543873 - RNA, 64 nt, Human Herpes Virus 2; identical to SEQ ID NO: 543869

SEQ ID NO: 543874 - RNA, 64 nt, Human Herpes Virus 2; identical to SEQ ID NO: 543864

SEQ ID NO: 543875 - RNA, 64 nt, Human Herpes Virus 2; identical to SEQ ID NO: 543817

SEQ ID NO: 543876 - RNA, 64 nt, Human Herpes Virus 2; identical to SEQ ID NO: 543868

SEQ ID NO: 543877 - RNA, 64 nt, Human Herpes Virus 2; identical to SEQ ID NO: 543862

SEQ ID NO: 543878 - RNA, 64 nt, Human Herpes Virus 2; identical to SEQ ID NO: 543863

SEQ ID NO: 543879 - RNA, 64 nt, Human Herpes Virus 4 (Epstein Barr virus)
aggccgguuccucgccccuuccccgggcuucagagcccaggaugucccccagaagggacccuag

SEQ ID NO: 543880 - RNA, 64 nt, Human Herpes Virus 4 (Epstein Barr virus); identical to SEQ ID NO: 543879

SEQ ID NO: 543881 - RNA, 64 nt, Human Herpes Virus 4 (Epstein Barr virus); identical to SEQ ID NO: 543879

SEQ ID NO: 543882 - RNA, 64 nt, Human Herpes Virus 4 (Epstein Barr virus); identical to SEQ ID NO: 543879

SEQ ID NO: 543883 - RNA, 64 nt, Human Herpes Virus 4 (Epstein Barr virus); identical to SEQ ID NO: 543879

SEQ ID NO: 543884 - RNA, 64 nt, Human Herpes Virus 4 (Epstein Barr virus); identical to SEQ ID NO: 543879

SEQ ID NO: 543885 - RNA, 64 nt, Human Herpes Virus 4 (Epstein Barr virus); identical to SEQ ID NO: 543879

SEQ ID NO: 543886 - RNA, 64 nt, Human Herpes Virus 4 (Epstein Barr virus); identical to SEQ ID NO: 543879

SEQ ID NO: 543887 - RNA, 64 nt, Human Herpes Virus 4 (Epstein Barr virus)
acuggucgugcugcgggcucuggcucuuuggccggcccaggaauagauacagccagcucccuga

SEQ ID NO: 543888 - RNA, 64 nt, Human Herpes Virus 4 (Epstein Barr virus)
ucccacaaacgcggcggcggcuucccugacugaagcccaggaccaguucuacuccuacacaugu

SEQ ID NO: 543889 - RNA, 64 nt, Human Herpes Virus 4 (Epstein Barr virus)
ccagggggagaggucguggacguggagaaaagaggcccaggagucccaguagucagucaucauc

SEQ ID NO: 543890 - RNA, 64 nt, Human Herpes Virus 4 (Epstein Barr virus)
ugugacccgcuucuccccggucuggguggucaaggcccaggacaacucuauuccccaggacacc

SEQ ID NO: 543891 - RNA, 64 nt, Human Herpes Virus 4 (Epstein Barr virus)
gguccagagauugaggucagcugguuuaaacugggcccaggagaggagcaggugcuuauugggc

SEQ ID NO: 543892 - RNA, 64 nt, Human Herpes Virus 4 (Epstein Barr virus)
augagaagaagcugcggcagccaucauccaggaggcccaggaagaaggagaagcuccgagaaca

SEQ ID NO: 543893 - RNA, 64 nt, Human Herpes Virus 4 (Epstein Barr virus)
ugaagauaaucuuggcauccuucugaagcauaaagcccaggaucgccggcagggccuccuucuu

SEQ ID NO: 543894 - RNA, 64 nt, Human Herpes Virus 4 (Epstein Barr virus)
aaggagugaagguguggggaucggcaaagauugcgcccaggaucacgccugccccgucccaccc

SEQ ID NO: 543895 - RNA, 64 nt, Human Herpes Virus 4 (Epstein Barr virus)
cuuucuggagggaguguggggugggcccggggcagcccaggacaacuuuaucagcguggccgag

SEQ ID NO: 543896 - RNA, 64 nt, Human Herpes Virus 2; identical to SEQ ID NO: 543865

SEQ ID NO: 543897 - RNA, 61 nt, Human Herpes Virus 2; identical to SEQ ID NO: 542456

SEQ ID NO: 543898 - RNA, 64 nt, Human Herpes Virus 4 (Epstein Barr virus)
aggaggugguaagcgguucaccuucagggguaaguaaccugaccucuccagggcucacauaaag

SEQ ID NO: 543899 - RNA, 64 nt, Human Herpes Virus 4 (Epstein Barr virus); identical to SEQ ID NO: 543898

SEQ ID NO: 543900 - RNA, 64 nt, Human Herpes Virus 4 (Epstein Barr virus); identical to SEQ ID NO: 543898

SEQ ID NO: 543901 - RNA, 50 nt, Human Herpes Virus 4 (Epstein Barr virus)
gaauaaggacggcuccuuauuaaccugaucagccccggaguugccuguuu

SEQ ID NO: 543902 - RNA, 64 nt, Human Herpes Virus 4 (Epstein Barr virus)
gcuacuuuaacgcacugguugauuacggggcacuuaaccugaccaauuacaaccuggcccacca

SEQ ID NO: 543903 - RNA, 64 nt, Human Herpes Virus 4 (Epstein Barr virus)
aggggccuggcgcuuggggcucucaauaucuguuuaaccugaagccucaaggacaagcugcugc

SEQ ID NO: 543904 - RNA, 64 nt, Human Herpes Virus 2; identical to SEQ ID NO: 543817

SEQ ID NO: 543905 - RNA, 64 nt, Human Herpes Virus 4 (Epstein Barr virus); identical to SEQ ID NO: 542675

SEQ ID NO: 543906 - RNA, 64 nt, Human Herpes Virus 4 (Epstein Barr virus); identical to SEQ ID NO: 542676

SEQ ID NO: 543907 - RNA, 64 nt, Human Herpes Virus 4 (Epstein Barr virus); identical to SEQ ID NO: 542677

SEQ ID NO: 543908 - RNA, 64 nt, Human Herpes Virus 4 (Epstein Barr virus); identical to SEQ ID NO: 542678

SEQ ID NO: 543909 - RNA, 64 nt, Human Herpes Virus 2
gacggccgcgcgccuggcccgacggggguccugggcgcgcgagcgggccgaccgcgaccgguuc

SEQ ID NO: 543910 - RNA, 64 nt, Human Herpes Virus 2
agagacgaacgcgggucuggcgacccagcugcaggcgcgcgaccgcgagcugcggcgcgcccag

SEQ ID NO: 543911 - RNA, 64 nt, Human Herpes Virus 2
gaacgacgcgccacacgaagacagaguuggcgaugcgcgcgacgaggucggcuucgggccccgg

SEQ ID NO: 543912 - RNA, 64 nt, Human Herpes Virus 2
aguggcccagggcccgcagacacgcgaucuggaugcgcgcgacgaaggccaccucggccgcgau

SEQ ID NO: 543913 - RNA, 64 nt, Human Herpes Virus 2
agcccgggggugcuggugaccggggugcgcgugcgcgcgcgagacagggucaucgagcuauuug

SEQ ID NO: 543914 - RNA, 64 nt, Human Herpes Virus 2
cggggacgaggacggggacgagcgcgaggaggucgcgcgcgagaccgggggccggcacguuggg

SEQ ID NO: 543915 - RNA, 64 nt, Human Herpes Virus 2
cuuucugguggccgcgugcgccgccgccuacgaugcgcgcgacgccgccgaggcgguccgggcc

SEQ ID NO: 543916 - RNA, 64 nt, Human Herpes Virus 2
gaccagccugcgccgcgccuacgcgccccugcuggcgcgcgagaacgcggcgcugaccggggcg

SEQ ID NO: 543917 - RNA, 64 nt, Human Herpes Virus 2
cgccgucaccaucacgacgaggaccgcgcguuuugcgcgcgaauacaccacccuggcguuuccg

SEQ ID NO: 543918 - RNA, 64 nt, Human Herpes Virus 2
accucggcaaguacaucggccagcuggcgucccugcgcgcgaccacccccuccgucgcgacggc

SEQ ID NO: 543919 - RNA, 64 nt, Human Herpes Virus 2
cgcgcccaacuuccccccggcccugcgcgaccuggcgcgcgacgucccccugguccccccggcc

SEQ ID NO: 543920 - RNA, 64 nt, Human Herpes Virus 2
gggcuggcguucgggugcgacgccgcgcucgugcgcgcgcgauacgggaagggcuucauggggc

SEQ ID NO: 543921 - RNA, 64 nt, Human Herpes Virus 2
cgccgaccgcuucaagcaggucgacggcuucuacgcgcgcgaccucaccacgaaggcccgggcc

SEQ ID NO: 543922 - RNA, 64 nt, Human Herpes Virus 2
cugccccacgccgccgggcugucggacgccgcccgcgcgcgagcgcucugugugcuggaccagg

SEQ ID NO: 543923 - RNA, 64 nt, Human Herpes Virus 2
cuucgaggccagccaggguaagccccagcggggcgcgcgcgacgccgggaacaagggcccggcg

SEQ ID NO: 543924 - RNA, 64 nt, Human Herpes Virus 2
cgucgcgcccgcccccccgcggccgcgcggggccgcgcgcgaggcuucgggggggcgggggccg

SEQ ID NO: 543925 - RNA, 64 nt, Human Herpes Virus 2
ggagcgccgccgucgcgacggggaggcgcuggccgcgcgcgagcgcggccgugcgggcgcaugg

SEQ ID NO: 543926 - RNA, 64 nt, Human Herpes Virus 2
gucuucuuuucgacguggggcgguccggcucgcggcgcgcgauggccaucgagggaugucuggu

SEQ ID NO: 543927 - RNA, 64 nt, Human Herpes Virus 2
ccccaucgaguuugcccugcgggugcuggccugggcgcgcgacuucggccugggcuaucucccc

SEQ ID NO: 543928 - RNA, 64 nt, Human Herpes Virus 2
agaccgccgcccuccgggcgcacguguccgggaggcgcgcgaccgggcugggcggcccgccacg

SEQ ID NO: 543929 - RNA, 64 nt, Human Herpes Virus 2
gcgugacggucugcgagggcaagaaccuccugcagcgcgcgaacgaguuggugaaucccgacgc

SEQ ID NO: 543930 - RNA, 64 nt, Human Herpes Virus 2; identical to SEQ ID NO: 543909

SEQ ID NO: 543931 - RNA, 64 nt, Human Herpes Virus 2; identical to SEQ ID NO: 543916

SEQ ID NO: 543932 - RNA, 64 nt, Human Herpes Virus 2
ccuucgugacccggcaggaccgacguggggcgccucgauggacggugcgcgccaaacagcagcg

SEQ ID NO: 543933 - RNA, 64 nt, Human Herpes Virus 1
cgagcuccggcgcgcaacagcgggggcccuggagcgccagcagcgcgcggccgaccuggcggcc

SEQ ID NO: 543934 - RNA, 64 nt, Human Herpes Virus 1
ccacaaagcggcccccgccggggggcuccagacccgccagcaccgcaucugcgucagccgcccc

SEQ ID NO: 543935 - RNA, 64 nt, Human Herpes Virus 1
uaaagacaugcaaauauauuucuuccggggacaccgccagcaaacgcgagcaacgggccacggg

SEQ ID NO: 543936 - RNA, 64 nt, Human Herpes Virus 1
aggcauccaacgcggaggccggggcccuugucaacgccagcagcgcagcacacguggacguuga

SEQ ID NO: 543937 - RNA, 64 nt, Human Herpes Virus 1; identical to SEQ ID NO: 537060

SEQ ID NO: 543938 - RNA, 64 nt, Human Herpes Virus 1; identical to SEQ ID NO: 537061

SEQ ID NO: 543939 - RNA, 64 nt, Human Herpes Virus 1; identical to SEQ ID NO: 537062

SEQ ID NO: 543940 - RNA, 64 nt, Human Herpes Virus 1; identical to SEQ ID NO: 537063

SEQ ID NO: 543941 - RNA, 64 nt, Human Herpes Virus 1; identical to SEQ ID NO: 537064

SEQ ID NO: 543942 - RNA, 64 nt, Human Herpes Virus 1; identical to SEQ ID NO: 537065

SEQ ID NO: 543943 - RNA, 64 nt, Human Herpes Virus 1; identical to SEQ ID NO: 537066

SEQ ID NO: 543944 - RNA, 64 nt, Human Herpes Virus 2
cgucaacauuuccucgcgcuucgcguacacccccucccccuacguauucgcccuggcccaggcg

SEQ ID NO: 543945 - RNA, 64 nt, Human Herpes Virus 2
cagcccacugugggaacggaccccggcuacccagucccccuagaacucacgcccgagaacgcgg

SEQ ID NO: 543946 - RNA, 64 nt, Human Herpes Virus 2
gcguggaggcgcucacacacacgcugcucuccaccgccgucaacaacaugaugcugcgugaccg

SEQ ID NO: 543947 - RNA, 64 nt, Human Herpes Virus 2
cgcagccccgcuggagcuacuaugacagcuuuagcgccgucagcgaggauaaccugggauuccu

SEQ ID NO: 543948 - RNA, 64 nt, Human Herpes Virus 2
gcgacagcccccagugcgcguccuccgccucgcucgccgucaccaucacgacgaggaccgcgcg

SEQ ID NO: 543949 - RNA, 64 nt, Human Herpes Virus 2
ucgcgcgcauccacaagcuaugcauccccguauucgccgucaaccccgcccuccgcuacacgac

SEQ ID NO: 543950 - RNA, 64 nt, Human Herpes Virus 2
ccaccggggcucugcucgcccgcuucaaccccggcgccgucaaaugcgugcucccgcgggaggc

SEQ ID NO: 543951 - RNA, 64 nt, Human Herpes Virus 2; identical to SEQ ID NO: 543946

SEQ ID NO: 543952 - RNA, 64 nt, Human Herpes Virus 2; identical to SEQ ID NO: 543947

SEQ ID NO: 543953 - RNA, 64 nt, Human Herpes Virus 2; identical to SEQ ID NO: 543948

SEQ ID NO: 543954 - RNA, 64 nt, Human Herpes Virus 2; identical to SEQ ID NO: 543949

SEQ ID NO: 543955 - RNA, 64 nt, Human Herpes Virus 2; identical to SEQ ID NO: 543950

SEQ ID NO: 543956 - RNA, 64 nt, Human Herpes Virus 2
ugugcaugcaggcguucaacgacgccagccccggcaccgccagcaucaugccggcccugaaggu

SEQ ID NO: 543957 - RNA, 64 nt, Human Herpes Virus 2
ucuuccucacggccgacguccccagcgugugugucaccgccaccggccccaacgcggugucggc

SEQ ID NO: 543958 - RNA, 64 nt, Human Herpes Virus 2
cccaaccccgcaaggcgacgaaaaguaaggccuccaccgccaaaccggccccgccccccaagac

SEQ ID NO: 543959 - RNA, 64 nt, Human Herpes Virus 2
ccgucgcgucccagacaucgugcgggcgccccggcaccgccacgauccgcuccacccugccggu

SEQ ID NO: 543960 - RNA, 64 nt, Human Herpes Virus 2
cugcauggcgggucucauugaaauacuggacacgcaccgccaggaguguuccagucgcgugugc

SEQ ID NO: 543961 - RNA, 64 nt, Human Herpes Virus 2
ccgcuccggagaagacgccccucccugugucggccaccgccauggcacccucagucgacccaag

SEQ ID NO: 543962 - RNA, 64 nt, Human Herpes Virus 2
ggcccucggccgccaacguuucggucgccgcgaccaccgccacgcccggaacccggggcaccgc

SEQ ID NO: 543963 - RNA, 64 nt, Human Herpes Virus 2
ugcgcacgugcccgcggaucaucgccauggacgccaccgccaacgcgcagcugguggacuuucu

SEQ ID NO: 543964 - RNA, 64 nt, Human Herpes Virus 2
agacguucagucccgacgggcuuuuccauuggaucaccgccagccagcugcugccccgcacgga

SEQ ID NO: 543965 - RNA, 64 nt, Human Herpes Virus 2
uugacguccgccgcccgcuguuuaucaccuaucucaccgccaccugcgaagggcacgcgcggga

SEQ ID NO: 543966 - RNA, 64 nt, Human Herpes Virus 2
guaccgguaccugcgcgccagcguucggcagcuacaccgccaggcacacaugcggggccgcaac

SEQ ID NO: 543967 - RNA, 62 nt, Human Herpes Virus 1
cucccggcggccccgggggacgucccccgggacgcgaguacccacguuaaccccgacggcgu

SEQ ID NO: 543968 - RNA, 62 nt, Human Herpes Virus 1
cgaccaucggccgcgagaugcugcucgcgacccgcgaguacguccacgcgcgcugggcggcc

SEQ ID NO: 543969 - RNA, 62 nt, Human Herpes Virus 1
uggugcuuuuccacaacaacgaccaggcgcgccgcgaguacguggccgguaccaucaaccac

SEQ ID NO: 543970 - RNA, 62 nt, Human Herpes Virus 1
gaaugucuguccccggccgacgcgccgugcgccgcgaguacguggacgucucgccuggccgu

SEQ ID NO: 543971 - RNA, 62 nt, Human Herpes Virus 1
ucggcccggacacgccggugcccauguccccgcgcgaguaccgccgggccgugcugccggcg

SEQ ID NO: 543972 - RNA, 62 nt, Human Herpes Virus 1
ugcucacguaccucaucugcaaccgcacgcugcgcgaguacgcccgccucucguauagcugg

SEQ ID NO: 543973 - RNA, 62 nt, Human Herpes Virus 1
cccuuuacgcgguauggcugcccccccgcgcucgcgaguacuuccacgcccugguguauuuu

SEQ ID NO: 543974 - RNA, 62 nt, Human Herpes Virus 1; identical to SEQ ID NO: 543971

SEQ ID NO: 543975 - RNA, 64 nt, Human Herpes Virus 2
gggggcccggguccucgaccccaccuccggguuucacgucgaccccguggugguguuugacuuu

SEQ ID NO: 543976 - RNA, 64 nt, Human Herpes Virus 2
ccagaucgcgcgcaucauccgacaggcccagguacacgucgacgaguuuccgacgcacgcggaa

SEQ ID NO: 543977 - RNA, 64 nt, Human Herpes Virus 2
ggcgucccaucggggaugacgagugcgagcaguacacgucgaguguaucgcuggcgcggaugcu

SEQ ID NO: 543978 - RNA, 64 nt, Human Herpes Virus 2
ggagugcauggccguguaucgggaccugguggcccacgucgaggcccuggcccagcugguggac

SEQ ID NO: 543979 - RNA, 64 nt, Human Herpes Virus 2
auggcggaucgggucccgagccucucucgcgcuucacgucgacucaggcggacccggggguccu

SEQ ID NO: 543980 - RNA, 64 nt, Human Herpes Virus 2
caggcgccaccgcgaggaccuccccgagcccccgcacgucgacgcggccgaccggggucccgag

SEQ ID NO: 543981 - RNA, 60 nt, Human Herpes Virus 2
gacgacagcgacgacgcggacuacgccggcaacgacgacgcagagugggcgaacagcccc

SEQ ID NO: 543982 - RNA, 60 nt, Human Herpes Virus 2
uucuguaucuagcguucgucgcccuucaccaacgacgaugcauguucggcgucgugaguc

SEQ ID NO: 543983 - RNA, 60 nt, Human Herpes Virus 2
cccuccaugcgcgccgauuauggcgaggagaacgacgacgacgacgacgacgacgaugac

SEQ ID NO: 543984 - RNA, 60 nt, Human Herpes Virus 2
uacugcgugggccgcgcggacgcgggcgucaacgacgacgccgacgccgggcgcuucguc

SEQ ID NO: 543985 - RNA, 60 nt, Human Herpes Virus 2
ucucccgaaagccauggacaccaagcccaaaacgacgaccaccgucaagguuccuccggg

SEQ ID NO: 543986 - RNA, 60 nt, Human Herpes Virus 2; identical to SEQ ID NO: 543981

SEQ ID NO: 543987 - RNA, 60 nt, Human Herpes Virus 2; identical to SEQ ID NO: 543983

SEQ ID NO: 543988 - RNA, 64 nt, Human Herpes Virus 2
ugugucguuuaacuuucugguggccgcgugcgccgccgccuacgaugcgcgcgacgccgccgag

SEQ ID NO: 543989 - RNA, 64 nt, Human Herpes Virus 2
uccgggcccggcgacccagugccuggcgcucggggccgccuacgcggcgcugcuggugcuggcc

SEQ ID NO: 543990 - RNA, 64 nt, Human Herpes Virus 2
ccccagggaaaccgcccuggcgggagacgcggccgccgccuaccugcgcgcgcgcacguaugcc

SEQ ID NO: 543991 - RNA, 64 nt, Human Herpes Virus 2
ggccuggacgcgacccagaggacccuggccuacggccgccuaggggagcugacggcagaacucc

SEQ ID NO: 543992 - RNA, 64 nt, Human Herpes Virus 2
gaccggcgacugcaccccguggcguucggcguuugccgccuacgugccggcggaugcggugggg

SEQ ID NO: 543993 - RNA, 64 nt, Human Herpes Virus 2
cggccacgccgcuguccgcgcugcuccccgucgggccgccuagccacgcccccucgguucaccu

SEQ ID NO: 543994 - RNA, 64 nt, Human Herpes Virus 2
acgcuccccgccuccacccugguccgccuucucguccacgcauauaagcgcggccugaagacgg

SEQ ID NO: 543995 - RNA, 64 nt, Human Herpes Virus 2
ccguuccagccccccagcaucccgaucacuguguacuacgcagugcuggaacgugccugccgca

SEQ ID NO: 543996 - RNA, 64 nt, Human Herpes Virus 2
uccgacgcccacuacgcguuugacuacuacagcaccagcggagacacgcugcgccucaccaacc

SEQ ID NO: 543997 - RNA, 64 nt, Human Herpes Virus 2
guuugugcucguggucagacgcaacgcagagaaaccagcggacgcggaaauuccgaccgugucg

SEQ ID NO: 543998 - RNA, 64 nt, Human Herpes Virus 1
cgcuggacgcacgcggaaggaggccagggugugccggcacgacgggggccagaagcucccccac

SEQ ID NO: 543999 - RNA, 64 nt, Human Herpes Virus 1
ggaggcguacuuccugggccagcuccagguggcccggcacgaaacuggcggggggguaaacuuc

SEQ ID NO: 544000 - RNA, 64 nt, Human Herpes Virus 1
aaacguucgcgcgccaucuggaccggggucccagcggcacgaccggcuccaugcagugcauggc

SEQ ID NO: 544001 - RNA, 64 nt, Human Herpes Virus 1
cgccuggucaccucccccaaccacgcgcguuggucggggccaaagucauagcgcaggcgcugug

SEQ ID NO: 544002 - RNA, 64 nt, Human Herpes Virus 1
cgacauaaaccgcgccgccgccgcguuccucagccggggccacaaccuauuccugugggaggac

SEQ ID NO: 544003 - RNA, 64 nt, Human Herpes Virus 1
agacgcugucacacgccuccucggacguguccggcggggccacguacgacgacgcccuugacuc

SEQ ID NO: 544004 - RNA, 64 nt, Human Herpes Virus 1
gcgccacggcgcggacauucgucgcgcugagcgucggggccaacaaccgccugugcguguccuu

SEQ ID NO: 544005 - RNA, 64 nt, Human Herpes Virus 1
uuuuucugcccggggacgcgaccgguccccuuaucggggccaacgaccacaucccucccccgug

SEQ ID NO: 544006 - RNA, 64 nt, Human Herpes Virus 1
acgugccggugacguacggcgagaugguccugaacggggccaaccuggucacggcgcucgugau

SEQ ID NO: 544007 - RNA, 64 nt, Human Herpes Virus 1
gccgcaagcccccaaaccccacgcccccgccgcccggggccagcgccaacgcguccguggagcg

SEQ ID NO: 544008 - RNA, 64 nt, Human Herpes Virus 1
cccccuccgccgacccacccgggaucugauccagcggggccagaccaccaccgccucccuccgc

SEQ ID NO: 544009 - RNA, 64 nt, Human Herpes Virus 4 (Epstein Barr virus)
acggaagcccucuggacuuccaugucuacgacauacucgagacgguguacacgcacgagaaaug

SEQ ID NO: 544010 - RNA, 64 nt, Human Herpes Virus 4 (Epstein Barr virus)
gcccugucccuggagcuggugcaccugcuagagaacucgagagaggccucugccgcgcugcucg

SEQ ID NO: 544011 - RNA, 64 nt, Human Herpes Virus 2
cgcacgggggcgaagacgcgcgaaacgaguuccacgcccucaccgcccuagagcagacuuuggg

SEQ ID NO: 544012 - RNA, 64 nt, Human Herpes Virus 2
gacgugcggauccaggcccggagggggaccaugccgcccucaucggaguacuuccaccggggag

SEQ ID NO: 544013 - RNA, 64 nt, Human Herpes Virus 2
acgcgcuggccaacgacggcccgacgaacgucgccgcccucagcgcccuguugacgaagcucaa

SEQ ID NO: 544014 - RNA, 64 nt, Human Herpes Virus 4 (Epstein Barr virus)
gggaggagauggauacccgaguuauccacccucagcccccuacauucuugggccugguccacaa

SEQ ID NO: 544015 - RNA, 64 nt, Human Herpes Virus 4 (Epstein Barr virus)
ccaccagagaaaacgaaaagacacggaucuggaggcccccuacgaucgaggcaauguugggccu

SEQ ID NO: 544016 - RNA, 64 nt, Human Herpes Virus 4 (Epstein Barr virus)
ccggaugggcuuuaccucacguacgacucugaccgcccccuaauucuucuguauaagggcaggg

SEQ ID NO: 544017 - RNA, 64 nt, Human Herpes Virus 1
gauucuagccucguggggcuggacguucgacacgccaaaccacgagucggggauaucgccagau

SEQ ID NO: 544018 - RNA, 64 nt, Human Herpes Virus 1
ccagcuggcaugguauaaaucaccggugcgccccccaaaccauguccggcagggggaugggggg

SEQ ID NO: 544019 - RNA, 64 nt, Human Herpes Virus 1; identical to SEQ ID NO: 544017

SEQ ID NO: 544020 - RNA, 64 nt, Human Herpes Virus 1; identical to SEQ ID NO: 544018

SEQ ID NO: 544021 - RNA, 64 nt, Human Herpes Virus 1
agccaaccuguggcagaccggcaagcggagcggcgguacguacgggaccguggauaccgucgua

SEQ ID NO: 544022 - RNA, 64 nt, Human Herpes Virus 4 (Epstein Barr virus)
uggacggagauuuacaugcaggcauugaagaauccggcaauacgaucucaguuuuucgauuggg

SEQ ID NO: 544023 - RNA, 64 nt, Human Herpes Virus 2
cccuguauuccgcccccgcccccgacgccagcuuuccccucagccucauguccaccgacaaaca

SEQ ID NO: 544024 - RNA, 64 nt, Human Herpes Virus 2
ugaccgucggugccagaccgaagaggugcugccgccgcgggaggauguguucuccuggacgcgg

SEQ ID NO: 544025 - RNA, 64 nt, Human Herpes Virus 2
cguccuccgggcgccguuccuggcgggcgcgcccucggccgagcagcgggaacgcgcccgccgg

SEQ ID NO: 544026 - RNA, 64 nt, Human Herpes Virus 2
uugucaccuucggcugguaccgccucaagcccggccgcgggaacgcgccggcccaaccgcgccc

SEQ ID NO: 544027 - RNA, 64 nt, Human Herpes Virus 1
agcgcgcguauguggccuucgaucccagccuccuggcucuuaacgaggcucucugcgccgagcu

SEQ ID NO: 544028 - RNA, 64 nt, Human Herpes Virus 2
gguccuagagcaccacggcagccaccagcccccgccgcgggaccccaccgagcggcaggugauc

SEQ ID NO: 544029 - RNA, 64 nt, Human Herpes Virus 2
gggccgcgucucucugggccugcgaauggcaaugccgcgggacuucugcgcgauuauucacgcc

SEQ ID NO: 544030 - RNA, 64 nt, Human Herpes Virus 2
cggacgacgucgccgugcuccaagacgcccugggccgcgggaccccauugcucccggcccacgu

SEQ ID NO: 544031 - RNA, 64 nt, Human Herpes Virus 2
ccacuuucacgccccgcccauguuuuccgcggccccgcgggagauccgcguccuccacagccug

SEQ ID NO: 544032 - RNA, 64 nt, Human Herpes Virus 2
ggcgggagaccuacgcggcgggcgccgucgcuccccgcgggagcucggggggagguauuuuuug

SEQ ID NO: 544033 - RNA, 64 nt, Human Herpes Virus 2
gcggcgacgccaaccgccacgacggcgacgacgcccgcgggaagcccgccgccgccgccgcccc

SEQ ID NO: 544034 - RNA, 64 nt, Human Herpes Virus 2
cgggccgcguggccguggagugccuggccgccugccgcgggauccuggaggcgcuggcggaggg

SEQ ID NO: 544035 - RNA, 61 nt, Human Herpes Virus 4 (Epstein Barr virus)
cgucguuaucuuggagaaugucggccaggggcaacagcagacucuggagugcggaggaacu

SEQ ID NO: 544036 - RNA, 61 nt, Human Herpes Virus 4 (Epstein Barr virus)
acuuggaggaggugaagguagccguggagggcaacagcagucaggacucugcgguggccau

SEQ ID NO: 544037 - RNA, 61 nt, Human Herpes Virus 4 (Epstein Barr virus)
aaaacaccguagagaacauagucuuuugccucaacagcaucuguuccaccucuacacuccc

SEQ ID NO: 544038 - RNA, 64 nt, Human Herpes Virus 1
gcggccggccacaguaccgcuaccgcgacgacaagcuccccaagacgcaguucgcggccggcgg

SEQ ID NO: 544039 - RNA, 64 nt, Human Herpes Virus 1
ugcgccccccgaucucucgccgcgacggcccagggcuccccagggggucgggaccccggagggc

SEQ ID NO: 544040 - RNA, 64 nt, Human Herpes Virus 1
gaccaccauccccgcucccucgaccaccauccccgcuccccaagcaucgaccacgcccuucccc

SEQ ID NO: 544041 - RNA, 64 nt, Human Herpes Virus 1
acgcugacaucauccuggaggcggcgcugucggagcuccccaccgaggccuggcccaugaugca

SEQ ID NO: 544042 - RNA, 64 nt, Human Herpes Virus 1
cgucucuccugcgacaccagguggacccggcccugcuccccagcaucacccaucgcuucuucga

SEQ ID NO: 544043 - RNA, 64 nt, Human Herpes Virus 1
gcguucccgagcggcgcaucuucggcgggugucugcuccccaccccggaggggcuccuuagcgc

SEQ ID NO: 544044 - RNA, 64 nt, Human Herpes Virus 2
gcacucgccgcugcgucgggcgacgcgauuuacggccugccaacaccacgucaacgugggaacc

SEQ ID NO: 544045 - RNA, 63 nt, Human Herpes Virus 4 (Epstein Barr virus)
guucagcucgcgaggaaaaggacaucgucggaggccaggcagaagcagaagcaccccaagaaa

SEQ ID NO: 544046 - RNA, 63 nt, Human Herpes Virus 4 (Epstein Barr virus)
gacacacaacacaucuugugcuucgugauggcagccaggcagcgucuucaggacauucgacgu

SEQ ID NO: 544047 - RNA, 63 nt, Human Herpes Virus 4 (Epstein Barr virus)
ggaugggggugcgcucccaggccggacccuggugccaggcagggaccccgcgccacccgcuuc

SEQ ID NO: 544048 - RNA, 63 nt, Human Herpes Virus 4 (Epstein Barr virus)
cacagggucucggucagggucucgcucuguugcgccaggcaggacugcagcuuggccagaccc

SEQ ID NO: 544049 - RNA, 63 nt, Human Herpes Virus 4 (Epstein Barr virus)
gauauuuacauuggcagggaugccggggagagggccaggcacagggcugugcaccggcuaaug

SEQ ID NO: 544050 - RNA, 63 nt, Human Herpes Virus 4 (Epstein Barr virus)
cucagccucucagacuacaagcuggacacaguagccaggcaccuacugggggccaagaaggag

SEQ ID NO: 544051 - RNA, 63 nt, Human Herpes Virus 4 (Epstein Barr virus)
gccaacuuugacuggcccuacauucuggacagagccaggcacaucuacagcaucaacccagcc

SEQ ID NO: 544052 - RNA, 63 nt, Human Herpes Virus 4 (Epstein Barr virus)
ccaccagaaggcauuccugacuucccugauauggccaggcaucgagccgagcgacuggauaga

SEQ ID NO: 544053 - RNA, 64 nt, Human Herpes Virus 2
cgcggccgacucgcucgccgcgcccgccuccgcgccgcgggaggcgcgcaagcgcaagagcccc

SEQ ID NO: 544054 - RNA, 64 nt, Human Herpes Virus 2
gggggagcgugcguucaauuuuaagcaccugggcccgcgggacgggggcccggacgacuucccc

SEQ ID NO: 544055 - RNA, 64 nt, Human Herpes Virus 2
acgccagcuacgucgucacccacacccccuugccccgcgggaucggauacaagcuuacgggcgu

SEQ ID NO: 544056 - RNA, 64 nt, Human Herpes Virus 2
ccucgauggacgcggcggccccgccgcccgcgacccgcgggaccaccacccucacgcgcgaguu

SEQ ID NO: 544057 - RNA, 64 nt, Human Herpes Virus 2
ccgcuucaaccccggcgccgucaaaugcgugcucccgcgggaggccgcguuugcggggcgcguc

SEQ ID NO: 544058 - RNA, 64 nt, Human Herpes Virus 2
gccgggcugguggcgccgcgcaugucguuucucuccgcgggacaacgcccccgcagacugucca

SEQ ID NO: 544059 - RNA, 64 nt, Human Herpes Virus 2
gaccaugaccucucgccgcuccgucaagucguguccgcgggaagcgccgcgcgggacccacgag

SEQ ID NO: 544060 - RNA, 64 nt, Human Herpes Virus 2; identical to SEQ ID NO: 544053

SEQ ID NO: 544061 - RNA, 64 nt, Human Herpes Virus 2; identical to SEQ ID NO: 544034

SEQ ID NO: 544062 - RNA, 64 nt, Human Herpes Virus 2; identical to SEQ ID NO: 544033

SEQ ID NO: 544063 - RNA, 64 nt, Human Herpes Virus 1
uguacgugaaucgcaacgagauauucaacggcgcgcuggcaaucacaaacaucauccuggaucu

SEQ ID NO: 544064 - RNA, 64 nt, Human Herpes Virus 1
gucgcccgaagacaccccccaccauuaucgggccgcuggcaacucgccccacgacccgacucac

SEQ ID NO: 544065 - RNA, 64 nt, Human Herpes Virus 1
cgcguccgccagugcgccguggaguggauagaccgcuggcaaaccgucaccaagagcugcuugg

SEQ ID NO: 544066 - RNA, 64 nt, Human Herpes Virus 1
uagccccucggcguacgacgcaguggcgcccagcgcagcccaucucaucgacgcccuguaugcc

SEQ ID NO: 544067 - RNA, 64 nt, Human Herpes Virus 1
cggccacgccgcuguccgcgcuucuccccgucgggcagcccagccacgcccccucuguccaccu

SEQ ID NO: 544068 - RNA, 64 nt, Human Herpes Virus 1
agacgucgcucaagauggcgccggucccguuggggcagcccagcgcgaaccuuaccaccccggc

SEQ ID NO: 544069 - RNA, 64 nt, Human Herpes Virus 1
ugcgcgugcugucggccgcguagcgcguguugggggggacgagcucgucguaacuaaacagaau

SEQ ID NO: 544070 - RNA, 64 nt, Human Herpes Virus 1
ucaccucaagcgcgcccccaagguguacugcgggggggacgagcgcgacguccuccgcgucggg

SEQ ID NO: 544071 - RNA, 64 nt, Human Herpes Virus 1
ggccgcccuccgcgagcuagacgccgccgccccaggggacgagcccgccccccccgcggcccug

SEQ ID NO: 544072 - RNA, 64 nt, Human Herpes Virus 1
uaaccgcuggcuggaaaccgagcuuguuuucgugggggacgaggaggacgucuccaagcuuucc

SEQ ID NO: 544073 - RNA, 64 nt, Human Herpes Virus 1
cguccccgagggcgugacguuugccugguuccugggggacgaccccucaccggcggcuaagucg

SEQ ID NO: 544074 - RNA, 64 nt, Human Herpes Virus 1
ggcccucggguggggcgcggagacggaggagggcggggacgaccccgaccacgaccccgaccac

SEQ ID NO: 544075 - RNA, 64 nt, Human Herpes Virus 1
ccggacccccgccuuucgagccgacgacgaugacggggacgaguacgacgacgcagccgacgcc

SEQ ID NO: 544076 - RNA, 64 nt, Human Herpes Virus 1
gucgggagauccucugggggccgggcgucccauuggggacgacgagugcgaacaguacacgucg

SEQ ID NO: 544077 - RNA, 64 nt, Human Herpes Virus 1
acugucgacggcccccccgaccgaugucagccugggggacgagcuccacuuagacggcgaggac

SEQ ID NO: 544078 - RNA, 64 nt, Human Herpes Virus 1
gcgccgucgggcgucccacacucucugggcgggcggggacgaucgcaucaaaagcccgauaucg

SEQ ID NO: 544079 - RNA, 64 nt, Human Herpes Virus 1; identical to SEQ ID NO: 544075

SEQ ID NO: 544080 - RNA, 64 nt, Human Herpes Virus 1; identical to SEQ ID NO: 544074

SEQ ID NO: 544081 - RNA, 64 nt, Human Herpes Virus 1
gaacaugcuguucgaccagggcacccuagugggcgcccuggacuuccgcagccugcggucucgg

SEQ ID NO: 544082 - RNA, 64 nt, Human Herpes Virus 1
gcgcgaccgcgagcuccggcgcgcaacagcgggggcccuggagcgccagcagcgcgcggccgac

SEQ ID NO: 544083 - RNA, 64 nt, Human Herpes Virus 1
cguggucggcgccgugaccucccgcuacgaccgcgcccuggacgcgggccgccgucuggcugcg

SEQ ID NO: 544084 - RNA, 64 nt, Human Herpes Virus 1
cgucgggcgguaccgcgacgauuauaucaucuucgcccuggagcacuuuuuucuccgcgcgcuc

SEQ ID NO: 544085 - RNA, 64 nt, Human Herpes Virus 1
cguccuacaggcccagcgcacagcggcugccgcugcccuggagaacgccgccaugcaggcggcc

SEQ ID NO: 544086 - RNA, 64 nt, Human Herpes Virus 1
cccgaucgaacggaacgugcacgagaucgcaggcgcccuggaggcgcuggagacggcggcggcc

SEQ ID NO: 544087 - RNA, 64 nt, Human Herpes Virus 1
gggggcccgccaggcggcgcuggugcgccucaccgcccuggaacucaucaaccgcacccgcaca

SEQ ID NO: 544088 - RNA, 64 nt, Human Herpes Virus 1
gauauccugucugcucuacgaccuguccaccaccgcccuggagcacguccuccuguuuucgcuc

SEQ ID NO: 544089 - RNA, 64 nt, Human Herpes Virus 1
uggggcgcugacccccaacgacgauaccgaacaggcccuggacaagauccugcggggcaccaug

SEQ ID NO: 544090 - RNA, 64 nt, Human Herpes Virus 1
caagagccagcuccccccgcgcggguuggagccggcccuggagcggcuguuugggcgccuccgg

SEQ ID NO: 544091 - RNA, 64 nt, Human Herpes Virus 1
cuccuuugaggaguggcugcgauccaaggaaguggcccuggauuuuggccugacggaaaggcuu

SEQ ID NO: 544092 - RNA, 64 nt, Human Herpes Virus 1
uaccccgcuguucucguuccucacugccucccccgcccuggacacccucuucgucgucagcacc

SEQ ID NO: 544093 - RNA, 64 nt, Human Herpes Virus 1
ggggcccagccacacggcggcgcccgcggccgccgcccuggaggccuacugcuccccgcgcgcc

SEQ ID NO: 544094 - RNA, 64 nt, Human Herpes Virus 1
gguagaggugcugcgggagauucaacugagccccgcccuggaauacgcagacaaacuuuugggg

SEQ ID NO: 544095 - RNA, 64 nt, Human Herpes Virus 1
cgaggaguugcggaacgaguuucgcgcccuggccgcccuggaacggacccugggguuggccgag

SEQ ID NO: 544096 - RNA, 64 nt, Human Herpes Virus 1
ucuguggcgggcgcuguacgcgugcguccuggcggcccuggagcgccagaccgggccgguggcc

SEQ ID NO: 544097 - RNA, 64 nt, Human Herpes Virus 1
cgugugggacugugacgcccugaugcggcgcgcggcccuggaccgccaucgcgacugccggguu

SEQ ID NO: 544098 - RNA, 64 nt, Human Herpes Virus 1
gguguccaucggcgagaagcuggucuuucuggaggcccuggagaagcgcaucuacgccgccacc

SEQ ID NO: 544099 - RNA, 64 nt, Human Herpes Virus 1
ggccaccgaggccaucgcccugcucacgggggaggcccuggacgggacggguaucggcgcgcau

SEQ ID NO: 544100 - RNA, 64 nt, Human Herpes Virus 1
ggagcgcggcaacggcgaguggucgacggacgcggcccuggagguggcgcacgaggccgaggcc

SEQ ID NO: 544101 - RNA, 64 nt, Human Herpes Virus 1
ccuaagcgaggagaugauggagcugaccgcgcgugcccuggagcgcggcaacggcgaguggucg

SEQ ID NO: 544102 - RNA, 64 nt, Human Herpes Virus 1
cgaucgcgaccagccccacgaggcggugacccuugcccuggagacagcggggccagacgcugga

SEQ ID NO: 544103 - RNA, 64 nt, Human Herpes Virus 1
ggcuucuggagcgcucgcagaggcgacucgguuggcccuggacgcccgccaccccgacgcaccc

SEQ ID NO: 544104 - RNA, 64 nt, Human Herpes Virus 1
aacgcguccucgccuuucucggcaguaccgagaugcccuggagcacccaggccgggguggccgg

SEQ ID NO: 544105 - RNA, 64 nt, Human Herpes Virus 1
gagggauguuuggucgagggacccugaacaugcugcccuggaaagggcccugggccgccgcgca

SEQ ID NO: 544106 - RNA, 64 nt, Human Herpes Virus 1
guucacgcccucgcacugcacgcacuaccuuucggcccuggagggguuucuggcggcgggcguc

SEQ ID NO: 544107 - RNA, 64 nt, Human Herpes Virus 1
ccauaagcuccucccgauaaaaagcgccccgauggcccuggacgcggcauaacuccgaccggcg

SEQ ID NO: 544108 - RNA, 64 nt, Human Herpes Virus 1; identical to SEQ ID NO: 544081

SEQ ID NO: 544109 - RNA, 64 nt, Human Herpes Virus 1; identical to SEQ ID NO: 544093

SEQ ID NO: 544110 - RNA, 64 nt, Human Herpes Virus 1
cgcuuccugcucgucgggggggagcaugucgugggcccuggaaauggcggacaccuuccuggac

SEQ ID NO: 544111 - RNA, 64 nt, Human Herpes Virus 1
agucagcggcccgccaguuaccacccgccgaccaaacccccaccuccacggagggcgggggggu

SEQ ID NO: 544112 - RNA, 64 nt, Human Herpes Virus 1
ccaaaccccgcguugcucggcuggccaggucacgaacccccaguucgccgacaggcuguaccgc

SEQ ID NO: 544113 - RNA, 64 nt, Human Herpes Virus 1
ccgcaacuacuacaccuccagcugcuaccugguaaacccccaggccaccacaaacaaggcgacc

SEQ ID NO: 544114 - RNA, 64 nt, Human Herpes Virus 1
aaaccacccccaccgagccggccagccccccaacaacccccaagcccaccuccacgcccaaaag

SEQ ID NO: 544115 - RNA, 64 nt, Human Herpes Virus 1
cccgagcagcacgggggcaagguggcccgccuccaacccccaccgaccaaagcccagccugccc

SEQ ID NO: 544116 - RNA, 64 nt, Human Herpes Virus 1
gauccaaaaccacaaccucccggggucaaccacgaacccccaucuaaugccacgcgagcgaccc

SEQ ID NO: 544117 - RNA, 64 nt, Human Herpes Virus 1
ccaggccgcgugcggcggcggcgacgacgacgauaacccccacccccacggggccgccgggggc

SEQ ID NO: 544118 - RNA, 64 nt, Human Herpes Virus 1
cuucaaggauuggcucgcauccuacguacacuccaacccccacggggccuccgggcgccccagc

SEQ ID NO: 544119 - RNA, 64 nt, Human Herpes Virus 1
caauacgcccgcguuucuuccuuuuccccaccccaacccccaaguucgggugaaggcccagggc

SEQ ID NO: 544120 - RNA, 64 nt, Human Herpes Virus 1
ggggacccgaaaccgaagaagaacagaaaaccgaaacccccaaagccgccgcgccccgccggcg

SEQ ID NO: 544121 - RNA, 64 nt, Human Herpes Virus 1
ggccggaggcccuccgaccccccggccccucccaaacccccagauggcagacuggcgccgcggc

SEQ ID NO: 544122 - RNA, 64 nt, Human Herpes Virus 1
uauuggcgagccuagccggccuucgccaaccgccaacccccacggccgagacggcaaacggggc

SEQ ID NO: 544123 - RNA, 64 nt, Human Herpes Virus 1; identical to SEQ ID NO: 544117

SEQ ID NO: 544124 - RNA, 64 nt, Human Herpes Virus 1
uccgguuaccacccuuuagcccccggugccaauaaacccccaaacaccccccauguccgcgugg

SEQ ID NO: 544125 - RNA, 64 nt, Human Herpes Virus 1
caacggaacgucuggacggaccccgguucugccgccggacgaugaagcgggccugcagccgaag

SEQ ID NO: 544126 - RNA, 64 nt, Human Herpes Virus 1
gggggaaggcgcccgcuagcgagaccggccguucccggacgacaccuugcgacaaaaccuaagg

SEQ ID NO: 544127 - RNA, 64 nt, Human Herpes Virus 1
guuaaaaagguuuauucccgaaguguggcaccccccggacgacguggccgcgcggcuccggacc

SEQ ID NO: 544128 - RNA, 64 nt, Human Herpes Virus 1
gcagagucccuucugguuucuuagcaaauucgggccggacgaaaaaagccuggugcucaccacu

SEQ ID NO: 544129 - RNA, 64 nt, Human Herpes Virus 1
ggacccgggcgccauggacacaucccacgaucccccggacgacgagguugccuacuuugaccug

SEQ ID NO: 544130 - RNA, 64 nt, Human Herpes Virus 1
cgcggaugccgcggacgaugucgacgaggacgccccggacgacguggccuauccggaggaauac

SEQ ID NO: 544131 - RNA, 64 nt, Human Herpes Virus 1
uggcucugcuggccuccaugguagaggaggccguccggacgaucccgacgcccgaccccgcggc

SEQ ID NO: 544132 - RNA, 64 nt, Human Herpes Virus 1
ugauuuuaagcaacuggggccgcgggacgggggcccggacgauuuucccgacgacgaccucgac

SEQ ID NO: 544133 - RNA, 64 nt, Human Herpes Virus 1
cccccaaaaaccaccgcgcggauuucuggcgccgccggacgaacuaaaccugacuacggcaucu

SEQ ID NO: 544134 - RNA, 64 nt, Human Herpes Virus 1
aggcgcucuucgacacccguggaccugcauguuuccggacgacuucucucgaggaggccgaggc

SEQ ID NO: 544135 - RNA, 64 nt, Human Herpes Virus 1
gucucgccggacgacgugguccgcggggccucccccggacgacauggccagcggcccggggggg

SEQ ID NO: 544136 - RNA, 64 nt, Human Herpes Virus 1
acuacgaguccauccugcggcucguggcgucucgccggacgacgugguccgcggggccuccccc

SEQ ID NO: 544137 - RNA, 64 nt, Human Herpes Virus 1
uuacgggucuaccaucgagggccugcucgaucucccggacgacgacgcccccgaagaggcgggg

SEQ ID NO: 544138 - RNA, 64 nt, Human Herpes Virus 1; identical to SEQ ID NO: 544131

SEQ ID NO: 544139 - RNA, 64 nt, Human Herpes Virus 2
ccgggcggccgggggaggcgcgggccgcccggcggaggcggaucuucuccgggccgacuacgac

SEQ ID NO: 544140 - RNA, 64 nt, Human Herpes Virus 2
ggaggcgcuggagaccgcggcggccgcggccgaagaggcggaugccgcgcgggacgccgaggcg

SEQ ID NO: 544141 - RNA, 64 nt, Human Herpes Virus 2
ggcgucguuccgcggcaucuccgcggaccacuucgaggcggaggugguggagcgcgccgacgug

SEQ ID NO: 544142 - RNA, 64 nt, Human Herpes Virus 2
gcucucccugcggcccgaggccgucgcgcaccuggaggcggaccgggacuaccuggagaucgag

SEQ ID NO: 544143 - RNA, 64 nt, Human Herpes Virus 2
auccguucaacgccagacccuggugcagcuguucgaggcggauccggucaccuucuuguaccac

SEQ ID NO: 544144 - RNA, 64 nt, Human Herpes Virus 2
gggcgacagccgccccggccucuggggggcgcccgaggcggaggaggcgcgggcccgguucgag

SEQ ID NO: 544145 - RNA, 64 nt, Human Herpes Virus 2
guggucgaccgacgcggcccuggagguggcccacgaggcggaggcccuggucagccagcucggc

SEQ ID NO: 544146 - RNA, 64 nt, Human Herpes Virus 2
cuucgacugcauagugccggucguggaccagcucgaggcggaccccgaggcgcagcccggggac

SEQ ID NO: 544147 - RNA, 64 nt, Human Herpes Virus 2
acgaggcuggguucgggggccccuggaggaggccgaggcggaguggggaccauucccccagcgg

SEQ ID NO: 544148 - RNA, 64 nt, Human Herpes Virus 2
ggcgcguggccaucacccacaagagaugcgggucgaggcggaggcucggggcgcucuuugucgg

SEQ ID NO: 544149 - RNA, 64 nt, Human Herpes Virus 2
ccugccgggagacgccccggacuccccguacaucgaggcggaaaauccccuguacgacuggggc

SEQ ID NO: 544150 - RNA, 64 nt, Human Herpes Virus 2
auaugagaugauucgggccgcggcuccgcccucggaggcggagccgcggcugcaggaggcccug

SEQ ID NO: 544151 - RNA, 64 nt, Human Herpes Virus 2; identical to SEQ ID NO: 544144

SEQ ID NO: 544152 - RNA, 64 nt, Human Herpes Virus 2; identical to SEQ ID NO: 541175

SEQ ID NO: 544153 - RNA, 64 nt, Human Herpes Virus 2; identical to SEQ ID NO: 541176

SEQ ID NO: 544154 - RNA, 64 nt, Human Herpes Virus 2; identical to SEQ ID NO: 541177

SEQ ID NO: 544155 - RNA, 64 nt, Human Herpes Virus 2; identical to SEQ ID NO: 541178

SEQ ID NO: 544156 - RNA, 64 nt, Human Herpes Virus 2; identical to SEQ ID NO: 541179

SEQ ID NO: 544157 - RNA, 64 nt, Human Herpes Virus 2; identical to SEQ ID NO: 541180

SEQ ID NO: 544158 - RNA, 64 nt, Human Herpes Virus 2; identical to SEQ ID NO: 541181

SEQ ID NO: 544159 - RNA, 64 nt, Human Herpes Virus 2; identical to SEQ ID NO: 541182

SEQ ID NO: 544160 - RNA, 64 nt, Human Herpes Virus 2; identical to SEQ ID NO: 541183

SEQ ID NO: 544161 - RNA, 64 nt, Human Herpes Virus 2; identical to SEQ ID NO: 541184

SEQ ID NO: 544162 - RNA, 64 nt, Human Herpes Virus 2; identical to SEQ ID NO: 541180

SEQ ID NO: 544163 - RNA, 64 nt, Human Herpes Virus 1
cgagaccggccguucccggacgacaccuugcgacaaaaccuaaggacagcggcccgcgcgacgg

SEQ ID NO: 544164 - RNA, 64 nt, Human Herpes Virus 2
cccccgacgagauggccacacaagccgcaacggucgccguuacgccggaggaaacggcagucgc

SEQ ID NO: 544165 - RNA, 64 nt, Human Herpes Virus 2
ggagcgcgcgcuggucguggcgcgcuucgccagcucggccgaucagcgcaccgcagccauucag

SEQ ID NO: 544166 - RNA, 64 nt, Human Herpes Virus 2
cacggcgugccucaagaugggccuggaucuggagucggccgaguuccgggaccugaacacacac

SEQ ID NO: 544167 - RNA, 64 nt, Human Herpes Virus 2
ucgcugcguucugcaccccgcccucuuugucaacucggccgagaccaacacccacggccuggcg

SEQ ID NO: 544168 - RNA, 64 nt, Human Herpes Virus 2
caccgggccgggcuccgcgacggacccgcgcgcgucggccgacuccgauuccgcggcccacgcc

SEQ ID NO: 544169 - RNA, 64 nt, Human Herpes Virus 2
cgacgcgagccccagcccccucuccgccuuccgggguccccaaagacccccauacggcuuuggg

SEQ ID NO: 544170 - RNA, 64 nt, Human Herpes Virus 2
ccucggagauacucaccccgcccgagcucgugcagguccccaacgcgcagcgggucgcggaaca

SEQ ID NO: 544171 - RNA, 61 nt, Human Herpes Virus 2
ccacuagcccgcagaggcggcgauugaacccaaggcagagguacgcguagcucucucccgg

SEQ ID NO: 544172 - RNA, 64 nt, Human Herpes Virus 2
cgacgagcugcucaacguggucaccuauauaugcgacgaccacaugccgcggguggugacgcac

SEQ ID NO: 544173 - RNA, 64 nt, Human Herpes Virus 2
gucuucugcccugccugcacguggccgccaccgugacgaccaucggccgcgagaugcuccucgc

SEQ ID NO: 544174 - RNA, 64 nt, Human Herpes Virus 2
cacccccacccccccgagacauggggaacccccagacgaccaucgcguacagccuacaucaccc

SEQ ID NO: 544175 - RNA, 64 nt, Human Herpes Virus 2
gcggaacaacauggagaccaccgcguuucaccgggacgaccacgagaccgacauggagcucaag

SEQ ID NO: 544176 - RNA, 64 nt, Human Herpes Virus 2
aucucccgaaagccauggacaccaagcccaaaacgacgaccaccgucaagguuccuccggggcc

SEQ ID NO: 544177 - RNA, 64 nt, Human Herpes Virus 2
ccaagcgggcccuggcggcgcacgggggcgaagacgcgcgaaacgaguuccacgcccucaccgc

SEQ ID NO: 544178 - RNA, 64 nt, Human Herpes Virus 2
gccgucaccaucacgacgaggaccgcgcguuuugcgcgcgaauacaccacccuggcguuuccgc

SEQ ID NO: 544179 - RNA, 64 nt, Human Herpes Virus 2
cgugacggucugcgagggcaagaaccuccugcagcgcgcgaacgaguuggugaaucccgacgcg

SEQ ID NO: 544180 - RNA, 64 nt, Human Herpes Virus 2
ugugcguuaacuauguacuuccgcuguaucaggcagaccccacggucgagcugacccaguuguu

SEQ ID NO: 544181 - RNA, 64 nt, Human Herpes Virus 2
ggcgggggccgggguccgcccgcggcccgcccgcagaccccacggcagagggacucuuggacac

SEQ ID NO: 544182 - RNA, 64 nt, Human Herpes Virus 2
gaggcggucuuuaagaaaacccgccugcagacguaccugacagacgucgcggcccuguucgugg

SEQ ID NO: 544183 - RNA, 64 nt, Human Herpes Virus 2; identical to SEQ ID NO: 544180

SEQ ID NO: 544184 - RNA, 64 nt, Human Herpes Virus 2; identical to SEQ ID NO: 544181

SEQ ID NO: 544185 - RNA, 64 nt, Human Herpes Virus 2; identical to SEQ ID NO: 544182

SEQ ID NO: 544186 - RNA, 64 nt, Human Herpes Virus 2
gccgggaugcccgcgaggccaucgaccgcauguuugcgcgcaaguacaacgccacgcacaucaa

SEQ ID NO: 544187 - RNA, 64 nt, Human Herpes Virus 2
cugcaaccuguguaccuucgagacccgccacgccugcgcgcacacgacgcugaugcggcugcgg

SEQ ID NO: 544188 - RNA, 64 nt, Human Herpes Virus 2
ucucccccgccccgauacgccccggaggacgccgagcggccaacagaccacggaccccuguuac

SEQ ID NO: 544189 - RNA, 64 nt, Human Herpes Virus 2
guccaugguuucggccgccccccugcccggagccagcggccauccuccuguuccgggccgcgca

SEQ ID NO: 544190 - RNA, 64 nt, Human Herpes Virus 2; identical to SEQ ID NO: 544186

SEQ ID NO: 544191 - RNA, 64 nt, Human Herpes Virus 2; identical to SEQ ID NO: 544187

SEQ ID NO: 544192 - RNA, 64 nt, Human Herpes Virus 2; identical to SEQ ID NO: 544188

SEQ ID NO: 544193 - RNA, 64 nt, Human Herpes Virus 2; identical to SEQ ID NO: 544189

SEQ ID NO: 544194 - RNA, 64 nt, Human Herpes Virus 2
ggacccgccuggggccgcgcacguggggccgccugcugcagaucucgggcggaaccugggacgu

SEQ ID NO: 544195 - RNA, 64 nt, Human Herpes Virus 2
ccgcggggguccgcuucgaccgcguguacgccacgcugcagaacaugguggucccggagaucgc

SEQ ID NO: 544196 - RNA, 64 nt, Human Herpes Virus 2
acaugcuggggcgcaucgccgucgcguggugcgagcugcagaaccacgagcugacucucuggaa

SEQ ID NO: 544197 - RNA, 64 nt, Human Herpes Virus 2
uggcccgacccuguccguaccaccagcagauccggcugcagacguacggcggggacguccgcau

SEQ ID NO: 544198 - RNA, 64 nt, Human Herpes Virus 2
cgaccgucaagagccugggcccccgcacccagcagcugcagaucgaggacuggcuggcgcugcu

SEQ ID NO: 544199 - RNA, 64 nt, Human Herpes Virus 2
gggacgcggagguucaccgcauccccguguauccgcugcagauguuuaugccggauuuuagccg

SEQ ID NO: 544200 - RNA, 64 nt, Human Herpes Virus 1
ccucaccgaaaccgucucccccaacacugacguccguacguauuccggaaaacggaacggcgcc

SEQ ID NO: 544201 - RNA, 64 nt, Human Herpes Virus 1
gcgacccgcgacucgcgauacgcgcuaacggugacccagauaauccagauagccauccccgcgu

SEQ ID NO: 544202 - RNA, 64 nt, Human Herpes Virus 1
ucggccggggacgcggcggugguaaugacaagcgcccagauaacaaugggcaugccuuaugccg

SEQ ID NO: 544203 - RNA, 63 nt, Human Herpes Virus 1
gccgauucccgaaacuucaucacccccgaguucccccgggacuuuuggaugucgcccgucuuu

SEQ ID NO: 544204 - RNA, 63 nt, Human Herpes Virus 1
cgggacuuuuggaugucgcccgucuuuaaccucccccgggagacggcggcggagcaggugguc

SEQ ID NO: 544205 - RNA, 63 nt, Human Herpes Virus 1
cacggggugcucccggcggccccgggggacgucccccgggacgcgaguacccacguuaacccc

SEQ ID NO: 544206 - RNA, 63 nt, Human Herpes Virus 1; identical to SEQ ID NO: 540945

SEQ ID NO: 544207 - RNA, 63 nt, Human Herpes Virus 1
ccccccgcggcccugcccuccccggccaagcgcccccgggagacgccgucgccugccgacccc

SEQ ID NO: 544208 - RNA, 63 nt, Human Herpes Virus 1
agcgcccccgggagacgccgucgccugccgaccccccgggaggcgcguccaagccccgcaagc

SEQ ID NO: 544209 - RNA, 63 nt, Human Herpes Virus 1
guggagcaaugacaccgcgccccuggauguuugccccgggacccccggcccgggcgccgacgc

SEQ ID NO: 544210 - RNA, 63 nt, Human Herpes Virus 1
cgggcuaugcgugcaggcguuuaacgacuccggccccgggaccgccagcgucaugcccgcccu

SEQ ID NO: 544211 - RNA, 63 nt, Human Herpes Virus 1
gcgggcaucggaacacgccuaccggccccugggccccgggacaccccccaugcgggcucggcu

SEQ ID NO: 544212 - RNA, 63 nt, Human Herpes Virus 1
ggucguagcgccuaaaaggacgcgggaauuugcccccgggacccugcgggucgacgugacguu

SEQ ID NO: 544213 - RNA, 63 nt, Human Herpes Virus 1
aauaucggggaguacgucaaacacaacgugaccccccgggagaccguccuggauggcgauacg

SEQ ID NO: 544214 - RNA, 63 nt, Human Herpes Virus 1
cauuuucacgccccgcccaccuaucucgcuuccccccgggagauccguguccugcacagccug

SEQ ID NO: 544215 - RNA, 63 nt, Human Herpes Virus 1
gggcucccauuuuacccgaagaucggcugcuauccccgggacauggaucgcggggcgguggug

SEQ ID NO: 544216 - RNA, 63 nt, Human Herpes Virus 1
gggcgccgcgccuccacccccgacaaccgccugccccgggacggccgaguuucuccagcccac

SEQ ID NO: 544217 - RNA, 63 nt, Human Herpes Virus 1
acgacaacgcgacgccguucggcggcccgggggccccgggaccggcauuugccggccgcaaac

SEQ ID NO: 544218 - RNA, 63 nt, Human Herpes Virus 1
ggcaugcccagaagcaacccaagcccucgcccuccccgggagccgccaaggugcaguacucca

SEQ ID NO: 544219 - RNA, 63 nt, Human Herpes Virus 1
gccugucuucgaccagcacagcacggcuacaacccccgggacugccauucccgccccgccccc

SEQ ID NO: 544220 - RNA, 63 nt, Human Herpes Virus 1
ggauacgaagacgacgaggaccucccccuggauccccgggacguuaccgggggccaccccggc

SEQ ID NO: 544221 - RNA, 63 nt, Human Herpes Virus 1
ggacgccuccgcugccggucgcuccaagggcccccccgggaaggcgggucuguggaccguagg

SEQ ID NO: 544222 - RNA, 63 nt, Human Herpes Virus 1
agggagccccggucuccccgggagccccggucuccccgggagccccggaccccacgcaccccc

SEQ ID NO: 544223 - RNA, 63 nt, Human Herpes Virus 1
cgacaaccccggucucccagggagccccggucuccccgggagccccggucuccccgggagccc

SEQ ID NO: 544224 - RNA, 63 nt, Human Herpes Virus 1
cgaccgccaacaauccccaggacaccgcguguuccccgggagccccggguuccgcgaccaccc

SEQ ID NO: 544225 - RNA, 64 nt, Human Herpes Virus 1
aaccaccugcgcucccucagcauccuuaaccgcuggcuggaaaccgagcuuguuuucguggggg

SEQ ID NO: 544226 - RNA, 64 nt, Human Herpes Virus 2; identical to SEQ ID NO: 540101

SEQ ID NO: 544227 - RNA, 64 nt, Human Herpes Virus 2; identical to SEQ ID NO: 540065

SEQ ID NO: 544228 - RNA, 64 nt, Human Herpes Virus 2; identical to SEQ ID NO: 540099

SEQ ID NO: 544229 - RNA, 64 nt, Human Herpes Virus 2; identical to SEQ ID NO: 540100

SEQ ID NO: 544230 - RNA, 64 nt, Human Herpes Virus 2; identical to SEQ ID NO: 540102

SEQ ID NO: 544231 - RNA, 64 nt, Human Herpes Virus 2; identical to SEQ ID NO: 540066

SEQ ID NO: 544232 - RNA, 64 nt, Human Herpes Virus 2; identical to SEQ ID NO: 540101

SEQ ID NO: 544233 - RNA, 64 nt, Human Herpes Virus 2; identical to SEQ ID NO: 540065

SEQ ID NO: 544234 - RNA, 64 nt, Human Herpes Virus 2; identical to SEQ ID NO: 540099

SEQ ID NO: 544235 - RNA, 64 nt, Human Herpes Virus 2; identical to SEQ ID NO: 540100

SEQ ID NO: 544236 - RNA, 64 nt, Human Herpes Virus 2; identical to SEQ ID NO: 540102

SEQ ID NO: 544237 - RNA, 64 nt, Human Herpes Virus 2; identical to SEQ ID NO: 540066

SEQ ID NO: 544238 - RNA, 64 nt, Human Herpes Virus 4 (Epstein Barr virus)
ugaaucugaggccucuggccccuuagucaggcuagccgaguacuuagagaagguggccccuggc

SEQ ID NO: 544239 - RNA, 64 nt, Human Herpes Virus 4 (Epstein Barr virus)
cccucugcgcaucuucaucguccccccucccgcggccgaguaugagcagguggcgggggaccuu

SEQ ID NO: 544240 - RNA, 64 nt, Human Herpes Virus 1
uuguauucugcggcggggcccggcccccaagaacgcagacaaggccgccgccccggggcgaucc

SEQ ID NO: 544241 - RNA, 64 nt, Human Herpes Virus 1
gcgggagauucaacugagccccgcccuggaauacgcagacaaacuuuugggguccuaggauccc

SEQ ID NO: 544242 - RNA, 64 nt, Human Herpes Virus 1
ccggcaacgcuggcuccggaaagagcacgugcgugcagacaaucaacgaggucuuggacugugu

SEQ ID NO: 544243 - RNA, 64 nt, Human Herpes Virus 1
cugguuuuuggguuuagugggacguuccgggccuucgaggcaguguugcgugacgacagcuuug

SEQ ID NO: 544244 - RNA, 64 nt, Human Herpes Virus 1
cgugcuccgcugcacccgcgccuaucuguaucacaggcggcaccacaccaaauuuuuuaugcgc

SEQ ID NO: 544245 - RNA, 64 nt, Human Herpes Virus 1
gccagaagcucccccaccgcauccgcgggcacguaggcggcaaacgccgugcaccacgggguac

SEQ ID NO: 544246 - RNA, 64 nt, Human Herpes Virus 1
cgcacggguguuugccuuugcggacgagcugcggaggcggcacgcgacggccaacguggccgag

SEQ ID NO: 544247 - RNA, 64 nt, Human Herpes Virus 1
ccaggcgaacgacggguuuagcugaugugucccgaggcggcaugaccugucggaagacuugggg

SEQ ID NO: 544248 - RNA, 64 nt, Human Herpes Virus 1
cgggucugaccuggacgacagggcggccgagcugaggcggcaguucgcgagccucacggcguug

SEQ ID NO: 544249 - RNA, 64 nt, Human Herpes Virus 1; identical to SEQ ID NO: 544244

SEQ ID NO: 544250 - RNA, 64 nt, Human Herpes Virus 1; identical to SEQ ID NO: 544245

SEQ ID NO: 544251 - RNA, 64 nt, Human Herpes Virus 1; identical to SEQ ID NO: 544246

SEQ ID NO: 544252 - RNA, 64 nt, Human Herpes Virus 1; identical to SEQ ID NO: 544247

SEQ ID NO: 544253 - RNA, 64 nt, Human Herpes Virus 1; identical to SEQ ID NO: 544248

SEQ ID NO: 544254 - RNA, 64 nt, Human Herpes Virus 1
ggcuuccggccugggggccguccugugugggauugcgugguaugugacgucaauugcccgaggc

SEQ ID NO: 544255 - RNA, 64 nt, Human Herpes Virus 1
gccaacacggucaacgccauguuucacaacgggcgcgugguaguggacgggcccgccaugcuca

SEQ ID NO: 544256 - RNA, 64 nt, Human Herpes Virus 1
gcggucggcaagguggugaugggcaucgugggcggcgugguaucggccgugucgggcguguccu

SEQ ID NO: 544257 - RNA, 64 nt, Human Herpes Virus 1
gagacccugcucagccgguacgaauaccaguacggcgugguacugcccgggacaaacggacggg

SEQ ID NO: 544258 - RNA, 64 nt, Human Herpes Virus 2; identical to SEQ ID NO: 538582

SEQ ID NO: 544259 - RNA, 64 nt, Human Herpes Virus 2; identical to SEQ ID NO: 538583

SEQ ID NO: 544260 - RNA, 64 nt, Human Herpes Virus 1
cccugucgccucccaacccccuaagacccaccccccguccuaugcgagguuggucgcccgucuc

SEQ ID NO: 544261 - RNA, 64 nt, Human Herpes Virus 1
ggcccugggccagcagcuggcgacuaccacgaggccguccuacacgcccggcgcgucgcccuac

SEQ ID NO: 544262 - RNA, 64 nt, Human Herpes Virus 2; identical to SEQ ID NO: 538584

SEQ ID NO: 544263 - RNA, 64 nt, Human Herpes Virus 2; identical to SEQ ID NO: 538585

SEQ ID NO: 544264 - RNA, 64 nt, Human Herpes Virus 2; identical to SEQ ID NO: 538586

SEQ ID NO: 544265 - RNA, 64 nt, Human Herpes Virus 2; identical to SEQ ID NO: 538587

SEQ ID NO: 544266 - RNA, 64 nt, Human Herpes Virus 1
gccacagaggcggcgauuaaaccccaggcagagguaggcguagcuuuccccgggcagguauugc

SEQ ID NO: 544267 - RNA, 64 nt, Human Herpes Virus 4 (Epstein Barr virus)
agacaugcgacggcuuuagccuggccuccuuaaauucaccuaagaaugggagcaaccagcuggu

SEQ ID NO: 544268 - RNA, 64 nt, Human Herpes Virus 4 (Epstein Barr virus)
caucgacguaucgcuggaaaccggugggccgcuguucaccuaaagugacgcaaggucugucagc

SEQ ID NO: 544269 - RNA, 64 nt, Human Herpes Virus 4 (Epstein Barr virus)
cucccugcgacccccuuaacucaucuggaaguguuucaccuauccaggagccgcucaacuacau

SEQ ID NO: 544270 - RNA, 64 nt, Human Herpes Virus 4 (Epstein Barr virus)
aagcuccaaguucaaggccuuuugcaaguggguguucaccuaucccguccucgaggagauguuc

SEQ ID NO: 544271 - RNA, 64 nt, Human Herpes Virus 4 (Epstein Barr virus)
ggacguauacaucaggacaccgcguggggauguuuucaccuauuccaccgagacucccgacgac

SEQ ID NO: 544272 - RNA, 64 nt, Human Herpes Virus 4 (Epstein Barr virus)
ucaccaccagguccuccuccaccaccagugcuacuacccguauuaccaacgcuaccaccuuggc

SEQ ID NO: 544273 - RNA, 64 nt, Human Herpes Virus 1
cccccgacgccagcuuuccgcugagccucauguccaccgacaaacacaccaauuuuuucgagug

SEQ ID NO: 544274 - RNA, 64 nt, Human Herpes Virus 1
aaccucgcgaaacggauucgcccguguguuccugcaccgacaagaucggacugcgggugugcau

SEQ ID NO: 544275 - RNA, 64 nt, Human Herpes Virus 1
auucgcccguuaaccccccacgugaucagcacgccaccgacaccgcagacgaaaagccccgggc

SEQ ID NO: 544276 - RNA, 64 nt, Human Herpes Virus 1
ccgucguggccacggcaaccguccgcaaccccgucaccgacaugggcaaccuuccccaaaacuu

SEQ ID NO: 544277 - RNA, 64 nt, Human Herpes Virus 1
agaagggcacgagcgcgcugcucagcgccaaggucaccgacauggucaugcgcaagcgccgcaa

SEQ ID NO: 544278 - RNA, 64 nt, Human Herpes Virus 1
cuaucgugucgauggccgucuuugacgagccgcccaccgacaucuccgcguggccgcuguucga

SEQ ID NO: 544279 - RNA, 64 nt, Human Herpes Virus 1
ucaacgcgacccucaccggguacggcgucugggccaccgacagccugaacaacgaguaucugcg

SEQ ID NO: 544280 - RNA, 64 nt, Human Herpes Virus 1
ucuuuaugcgcccggcggacccaagccgccccagcaccgacaccgcacugcggcucaacgagcu

SEQ ID NO: 544281 - RNA, 64 nt, Human Herpes Virus 1
cuuuaucaccaccauggccccccgcguccaaacccaccgacacaugcacgaccuguugauggcc

SEQ ID NO: 544282 - RNA, 64 nt, Human Herpes Virus 1; identical to SEQ ID NO: 542091

SEQ ID NO: 544283 - RNA, 64 nt, Human Herpes Virus 1; identical to SEQ ID NO: 542092

SEQ ID NO: 544284 - RNA, 64 nt, Human Herpes Virus 1; identical to SEQ ID NO: 542069

SEQ ID NO: 544285 - RNA, 64 nt, Human Herpes Virus 1; identical to SEQ ID NO: 541317

SEQ ID NO: 544286 - RNA, 64 nt, Human Herpes Virus 1; identical to SEQ ID NO: 541318

SEQ ID NO: 544287 - RNA, 64 nt, Human Herpes Virus 1; identical to SEQ ID NO: 541319

SEQ ID NO: 544288 - RNA, 64 nt, Human Herpes Virus 1; identical to SEQ ID NO: 541320

SEQ ID NO: 544289 - RNA, 64 nt, Human Herpes Virus 1; identical to SEQ ID NO: 541321

SEQ ID NO: 544290 - RNA, 64 nt, Human Herpes Virus 1; identical to SEQ ID NO: 541322

SEQ ID NO: 544291 - RNA, 64 nt, Human Herpes Virus 1; identical to SEQ ID NO: 541323

SEQ ID NO: 544292 - RNA, 64 nt, Human Herpes Virus 1; identical to SEQ ID NO: 541324

SEQ ID NO: 544293 - RNA, 64 nt, Human Herpes Virus 2
ugcuguaguagucaaacgcguagugggcgucggagucggcgaagcgggcggggaugucgucgcu

SEQ ID NO: 544294 - RNA, 64 nt, Human Herpes Virus 2
uuccggcggccgccggagaccacgggauccgggggucggcgaagcgccgccgacacgaggugga

SEQ ID NO: 544295 - RNA, 64 nt, Human Herpes Virus 2
guccucugguaaggcgucuuccgacgacgcggacgucggcgaugaacugauugccaucgcggac

SEQ ID NO: 544296 - RNA, 64 nt, Human Herpes Virus 2
ccggucccccggaccccgacccgauguggucggcgucggcgauccccaacgcacugccccccca

SEQ ID NO: 544297 - RNA, 64 nt, Human Herpes Virus 2
ggcgcgucauggaccuguucaacaacggguuccugucggcgaagacgcugacggucgcgcucuc

SEQ ID NO: 544298 - RNA, 63 nt, Human Herpes Virus 2
cucguccuggacgaagucaugucgacguugggccaacuguacucgccgacgaugcagcagcug

SEQ ID NO: 544299 - RNA, 59 nt, Human Herpes Virus 4 (Epstein Barr virus)
gggggaaaggcacgugcccuuagaaaacuuagcugcaaaaauucuauuguguugggaga

SEQ ID NO: 544300 - RNA, 59 nt, Human Herpes Virus 4 (Epstein Barr virus)
ugguggauuugaggcggcugcccuucauguagcugcacuuuuugagucugggugcccaa

SEQ ID NO: 544301 - RNA, 63 nt, Human Herpes Virus 4 (Epstein Barr virus)
ugcgggggauggugagccagacacggcgggugggggaaggagcugacacgauugaguagaaag

SEQ ID NO: 544302 - RNA, 63 nt, Human Herpes Virus 4 (Epstein Barr virus)
aagggauugggcaaagauaggaucaggaggcgggggaaggagggccgccgccucccucugucc

SEQ ID NO: 544303 - RNA, 64 nt, Human Herpes Virus 1
cccccgggagauccguguccugcacagccuggguggggacuaugugagcuucuuugaaaggaag

SEQ ID NO: 544304 - RNA, 64 nt, Human Herpes Virus 1
cgugcuuacgagccgucgcgaccuaggggccuggggggacuacagccucggcccccugggccag

SEQ ID NO: 544305 - RNA, 64 nt, Human Herpes Virus 1
gcgacaaaaccuaaggacagcggcccgcgcgacgggguccgagaggcuaagguaggccgcgaug

SEQ ID NO: 544306 - RNA, 64 nt, Human Herpes Virus 1
cgucccuucggaggccaucgcccguggggccuccggguccgacucgggggccaucaagagcgga

SEQ ID NO: 544307 - RNA, 64 nt, Human Herpes Virus 1
cuccaggugcgccuuucaguuucauggccaugacggguccgacgagucguuucccaucgaguau

SEQ ID NO: 544308 - RNA, 64 nt, Human Herpes Virus 1
gcggccgugguuaaccggagucugguuauucacgggguccgagagacggacagcggccuguaua

SEQ ID NO: 544309 - RNA, 64 nt, Human Herpes Virus 1
uugaacgccugggggcagcgccuggcccacgggcggguccgaugggucgcggaaggccagauga

SEQ ID NO: 544310 - RNA, 64 nt, Human Herpes Virus 1
gggccgcuguccuuagguuuugucgcaaggugucguccgggaacggccggucucgcuagcgggc

SEQ ID NO: 544311 - RNA, 64 nt, Human Herpes Virus 1
ugcgccccgccuccucagcgccccgggcccccguguccgggacggcagaccccgccuuucuucu

SEQ ID NO: 544312 - RNA, 64 nt, Human Herpes Virus 1; identical to SEQ ID NO: 543933

SEQ ID NO: 544313 - RNA, 64 nt, Human Herpes Virus 1; identical to SEQ ID NO: 543934

SEQ ID NO: 544314 - RNA, 64 nt, Human Herpes Virus 1; identical to SEQ ID NO: 543935

SEQ ID NO: 544315 - RNA, 64 nt, Human Herpes Virus 1; identical to SEQ ID NO: 543936

SEQ ID NO: 544316 - RNA, 64 nt, Human Herpes Virus 4 (Epstein Barr virus)
agcgaaacucugcaaagaugcuggcucaucugaaucagguuaccaggaucccccccuguccgcc

SEQ ID NO: 544317 - RNA, 64 nt, Human Herpes Virus 4 (Epstein Barr virus)
gccguaacgcuaacuuuuuaacgagguguaagcaucagguuaaucuaagacagucaccuauuuu

SEQ ID NO: 544318 - RNA, 64 nt, Human Herpes Virus 2
cgcagacccuguguggggcaguggaggggcugcccuccaugaagcgacauuuacucugcucgcg

SEQ ID NO: 544319 - RNA, 64 nt, Human Herpes Virus 2
gaucugccguucgccaccagguccucguggacaucuccaugaccgcugcaguacgcgcuaugcu

SEQ ID NO: 544320 - RNA, 61 nt, Human Herpes Virus 2
ggcaaccgaauauguucuucguaguguuauugccaaagaggugggggacauacuaagagug

SEQ ID NO: 544321 - RNA, 64 nt, Human Herpes Virus 2
gcgcgggggcggcggugcgggggcgacccgcggaaccucccagcccgccgcgacccgaccggcg

SEQ ID NO: 544322 - RNA, 64 nt, Human Herpes Virus 2
uccggugugccccacccccgagcgguacuucuacaccucccagugccccgacaucaaccaccuu

SEQ ID NO: 544323 - RNA, 64 nt, Human Herpes Virus 2
cucugccccgaccgccgcccacauacaaacacccaccucccagugggauggcggaucggguccc

SEQ ID NO: 544324 - RNA, 64 nt, Human Herpes Virus 2; identical to SEQ ID NO: 544321

SEQ ID NO: 544325 - RNA, 64 nt, Human Herpes Virus 2
ggcgggacgagcucgucguaacugaacaggagcacgcgggcacaggucgcccacgggccccacg

SEQ ID NO: 544326 - RNA, 64 nt, Human Herpes Virus 2
gcacggaacgcagggugcggugcgagaguuucuucgcgggcaggccgcggcgcugacggaccuc

SEQ ID NO: 544327 - RNA, 64 nt, Human Herpes Virus 2
uggcccgcggugggcgccagggucguccugcccccgcgggcauggccggccguggccucggagg

SEQ ID NO: 544328 - RNA, 64 nt, Human Herpes Virus 2
cguuccugguccucaagccgcuggagcugguggccgcgggcauguauuacggguggaccggacg

SEQ ID NO: 544329 - RNA, 64 nt, Human Herpes Virus 2
cggcgcgcgcgcgcuucugcgcccugacggcgggcgcgggcacggucaucgacaaccgcgccgc

SEQ ID NO: 544330 - RNA, 64 nt, Human Herpes Virus 2
ggaaaugauggaguuuaccacccgcgcccuggagcgcgggcauggcgaguggucgaccgacgcg

SEQ ID NO: 544331 - RNA, 64 nt, Human Herpes Virus 2
caggcccaguuucgccuuuuccaacaugcgccgccgcgggcacgccuucgccccgggggaccgg

SEQ ID NO: 544332 - RNA, 59 nt, Human Herpes Virus 2
aaaucgggccuccggccaccauguccgugcgcgggcaugccguacgccggaggcgcgcc

SEQ ID NO: 544333 - RNA, 62 nt, Human Herpes Virus 2
ccccgagcggcgccacggccgcgcuggagcgcguccgggaguuuaugguggcggcggugggg

SEQ ID NO: 544334 - RNA, 62 nt, Human Herpes Virus 2
gacgaggagaccgccgcccuccgggcgcacguguccgggaggcgcgcgaccgggcugggcgg

SEQ ID NO: 544335 - RNA, 64 nt, Human Herpes Virus 2; identical to SEQ ID NO: 544325

SEQ ID NO: 544336 - RNA, 64 nt, Human Herpes Virus 2; identical to SEQ ID NO: 544326

SEQ ID NO: 544337 - RNA, 64 nt, Human Herpes Virus 2; identical to SEQ ID NO: 544327

SEQ ID NO: 544338 - RNA, 64 nt, Human Herpes Virus 2; identical to SEQ ID NO: 544328

SEQ ID NO: 544339 - RNA, 64 nt, Human Herpes Virus 2; identical to SEQ ID NO: 544329

SEQ ID NO: 544340 - RNA, 64 nt, Human Herpes Virus 2; identical to SEQ ID NO: 544330

SEQ ID NO: 544341 - RNA, 64 nt, Human Herpes Virus 2; identical to SEQ ID NO: 544331

SEQ ID NO: 544342 - RNA, 59 nt, Human Herpes Virus 2; identical to SEQ ID NO: 544332

SEQ ID NO: 544343 - RNA, 62 nt, Human Herpes Virus 2; identical to SEQ ID NO: 544333

SEQ ID NO: 544344 - RNA, 62 nt, Human Herpes Virus 2; identical to SEQ ID NO: 544334

SEQ ID NO: 544345 - RNA, 64 nt, Human Herpes Virus 2
cuggggcgaacuguucggggugcagcuggccaagagcacgcagacguuucccggggcggggcgc

SEQ ID NO: 544346 - RNA, 64 nt, Human Herpes Virus 2
cggccgccccaccgucggggcggccgcgcacgagggcggacagcgggacccccgccgccgccag

SEQ ID NO: 544347 - RNA, 64 nt, Human Herpes Virus 2
ucggaaccucgagcgacgucgaguuuaacugcacggcggacaaccuggccgucgagggggccau

SEQ ID NO: 544348 - RNA, 64 nt, Human Herpes Virus 2
gggccucggcgacgggccccacuuacauucgcguggcggacagcgagcuguacgcggacuggag

SEQ ID NO: 544349 - RNA, 64 nt, Human Herpes Virus 2
uguuguaccauugggccucguggaugcuguggacggcggacaaguacgugugucgccgccuggg

SEQ ID NO: 544350 - RNA, 64 nt, Human Herpes Virus 2
ccguugcggcgcaucgggacaagaugcgccgccuggcggacacgugcauggccaccauccugca

SEQ ID NO: 544351 - RNA, 64 nt, Human Herpes Virus 2
cacgcuguucgugcaccacgaggcgcgcgugcugggggcguaccgccgggcguauuaugggagc

SEQ ID NO: 544352 - RNA, 64 nt, Human Herpes Virus 2
caccaacggcuccgucuguauacccccauagcgaggggcguaaaucucgccgcccgcucaccac

SEQ ID NO: 544353 - RNA, 64 nt, Human Herpes Virus 2
gguccgcggaccggagacgacguccgcgguccgcggggcguacccggaccccauggccagccug

SEQ ID NO: 544354 - RNA, 64 nt, Human Herpes Virus 2
gaaccacgaccccgucgaggccgcgaauccguacggggcguacgucgcggccccggccggcccc

SEQ ID NO: 544355 - RNA, 64 nt, Human Herpes Virus 2
ccaggaaacgcccgcggcccgcgccggcgccgucggggcguaccuggcgcgcgccgcgggccuc

SEQ ID NO: 544356 - RNA, 64 nt, Human Herpes Virus 2; identical to SEQ ID NO: 544353

SEQ ID NO: 544357 - RNA, 64 nt, Human Herpes Virus 1
cgagucggcacgggaccuggugcgcggggccgcggccgcuuacgccgcgcuccugggggccugg

SEQ ID NO: 544358 - RNA, 64 nt, Human Herpes Virus 1
cgcccccgagccccacgcaaggcgcagcgccgccacggcguacgggucauagacgcccugcgcg

SEQ ID NO: 544359 - RNA, 64 nt, Human Herpes Virus 1
ggcgagcugacgccgguucagacggaacacggggacggcguacgagaagccaucgccuuccuuc

SEQ ID NO: 544360 - RNA, 64 nt, Human Herpes Virus 1
uucccugcagcaccucucaaccgucgucuugauaacggcguacggccucgugcucgugugguac

SEQ ID NO: 544361 - RNA, 64 nt, Human Herpes Virus 1
aacucauuuguggacgccggggccuuggggcccgacggcguaguggaggaagaccugcuuauuc

SEQ ID NO: 544362 - RNA, 64 nt, Human Herpes Virus 1
ggcuaaaggccuguccggccgccccgugaaggacacggcguacgcugccggcgggcuggucgga

SEQ ID NO: 544363 - RNA, 64 nt, Human Herpes Virus 2
gcugacggccugguggaccagggcgcccuggcggagccccgaggcgacgccggaggccgcgugc

SEQ ID NO: 544364 - RNA, 64 nt, Human Herpes Virus 2
gcgggaaaaccaugaaaaccaagccacucccgacagccccgauggcgugggccgagagugccgu

SEQ ID NO: 544365 - RNA, 64 nt, Human Herpes Virus 2
cgggcuaccgcggaaccguccuggccguggucguagccccgaacgggacgcgcggguuugcccc

SEQ ID NO: 544366 - RNA, 64 nt, Human Herpes Virus 2
ggacucgauggccggggggucggggcgaaccuuuagccccgaggacgugcuggagcugcugaac

SEQ ID NO: 544367 - RNA, 64 nt, Human Herpes Virus 2
ccaccugacgacgccgcugcugcggcggcucgucagccccgagcagugcgacgaggaggcgcug

SEQ ID NO: 544368 - RNA, 64 nt, Human Herpes Virus 4 (Epstein Barr virus)
guacgaggcccugcucugggaccagacuuacggcgucccagacucggucaucgaggccuuccug

SEQ ID NO: 544369 - RNA, 64 nt, Human Herpes Virus 4 (Epstein Barr virus)
agcccugcagcgggccaggccggagauugagagugacauggagguguuugauuacuacuuugag

SEQ ID NO: 544370 - RNA, 64 nt, Human Herpes Virus 4 (Epstein Barr virus)
ucucgugcguguacaccgucucgaguaugucguagacauggaaguccagagggcuuccgugggu

SEQ ID NO: 544371 - RNA, 64 nt, Human Herpes Virus 4 (Epstein Barr virus)
gccaauucuaccaccgguggaaagcacaccacaggacauggagcccggacaaguacagagccca

SEQ ID NO: 544372 - RNA, 64 nt, Human Herpes Virus 1
acgucgcgccugggugccgguugcgguucguucuggacgggagucccgaggacgccuaugugac

SEQ ID NO: 544373 - RNA, 64 nt, Human Herpes Virus 1
gccaauccaugacccuguaugucacggagaaggcggacgggacccucccagccuccacccuggu

SEQ ID NO: 544374 - RNA, 64 nt, Human Herpes Virus 1
ucccccuggacacggaggacgacuccgaugcggcggacgggacggcggcccgucccgccgcucc

SEQ ID NO: 544375 - RNA, 64 nt, Human Herpes Virus 1
ccgaccacccccacgaccucgacgacgcccggcgggacgggagggcccccgcggcgggcaccga

SEQ ID NO: 544376 - RNA, 64 nt, Human Herpes Virus 1
ccgaggccaucgcccugcucacgggggaggcccuggacgggacggguaucggcgcgcaucgcca

SEQ ID NO: 544377 - RNA, 64 nt, Human Herpes Virus 1; identical to SEQ ID NO: 544375

SEQ ID NO: 544378 - RNA, 64 nt, Human Herpes Virus 1
auaccaguacggcgugguacugcccgggacaaacggacgggagcgcgauuguaugcgcuggcug

SEQ ID NO: 544379 - RNA, 64 nt, Human Herpes Virus 1
ggcggggggggaggacgagcuggccuuuccgguggccgggcacccggaggaccuggucauccag

SEQ ID NO: 544380 - RNA, 64 nt, Human Herpes Virus 1
gguggccggccgcgacgccacgggccgcuucacggccgggcagccccggcgggucgagcuggac

SEQ ID NO: 544381 - RNA, 64 nt, Human Herpes Virus 1
ggaccuggcccugagucagugccacgggguguucgccgggcagucggucgaggggcgcaacuuu

SEQ ID NO: 544382 - RNA, 64 nt, Human Herpes Virus 1
ccaacacgaguacaugcauccgcgcgccgacaccgccgggcacgacgcagcagauuccaugcua

SEQ ID NO: 544383 - RNA, 64 nt, Human Herpes Virus 1
acacgucugucagaucugccagaggcuacuggcugccgggcacgccugaacccgcccugugugg

SEQ ID NO: 544384 - RNA, 64 nt, Human Herpes Virus 1; identical to SEQ ID NO: 544380

SEQ ID NO: 544385 - RNA, 64 nt, Human Herpes Virus 2
cgucgcccccccguacugucugaaugccacguggcaggccgaaaacgcccugcacacgaccaaa

SEQ ID NO: 544386 - RNA, 64 nt, Human Herpes Virus 2
gcuuaugggauuuuacgaggcggcgacgcaaaaccaggccgacugccagcucugggcccugcuu

SEQ ID NO: 544387 - RNA, 64 nt, Human Herpes Virus 2
uacccugccgggcccggagcugggcgggcaggcucaggccgagcugaaucaccugaugcgcgac

SEQ ID NO: 544388 - RNA, 64 nt, Human Herpes Virus 2
gcggggugcccgggcgccacgcccagaagcaacccaggccgacgcccuccccgggcgccgccaa

SEQ ID NO: 544389 - RNA, 64 nt, Human Herpes Virus 2
ggcgaccgaccccgcccgcggcaggcgacccgcccaggccgacuccgccgugcuccuagacgcc

SEQ ID NO: 544390 - RNA, 64 nt, Human Herpes Virus 1
ccggagcguccccugcugcgcucucccgggcugcugcccgaaaucgcccccaacgcauccuugg

SEQ ID NO: 544391 - RNA, 64 nt, Human Herpes Virus 2
cccggggccuccucuauccggggcgguccccccacccucguaucccccaguugcgguuaccccc

SEQ ID NO: 544392 - RNA, 64 nt, Human Herpes Virus 4 (Epstein Barr virus)
gcaggggccuguacaccgcccugugcugccaccugccuaccagaaaccgaguucagcauccauu

SEQ ID NO: 544393 - RNA, 64 nt, Human Herpes Virus 4 (Epstein Barr virus)
auacaacgacaggucuacccagcucuacucacgugccuaccaaccucaccgcaccugcaagcac

SEQ ID NO: 544394 - RNA, 64 nt, Human Herpes Virus 4 (Epstein Barr virus)
gcuagcagcaagagaaacaccucuccgccuuucgccagaggacacuguaguucugcguuaucau

SEQ ID NO: 544395 - RNA, 64 nt, Human Herpes Virus 4 (Epstein Barr virus)
agucuguuaguuauauguaguuauuuauuuaucuccagaggaagacacuaaucuauacauuuuc

SEQ ID NO: 544396 - RNA, 64 nt, Human Herpes Virus 4 (Epstein Barr virus)
agccguuugcuccaucugucagcaacgccaagcuccagaggacgcccgcgacgagccucaccug

SEQ ID NO: 544397 - RNA, 64 nt, Human Herpes Virus 4 (Epstein Barr virus)
ugacgcuguggccgaguggcagaaucaccagagcccagaggaggccccggccgccgugucauuu

SEQ ID NO: 544398 - RNA, 64 nt, Human Herpes Virus 4 (Epstein Barr virus)
uguccgacgccugcggacucaggccaccgucuacccagaggaggacaugugcauggccugggcc

SEQ ID NO: 544399 - RNA, 64 nt, Human Herpes Virus 4 (Epstein Barr virus)
cccauucgaacccuaccggcggaugcagcgacccccagaggagccccagaaccaggcaagccgg

SEQ ID NO: 544400 - RNA, 64 nt, Human Herpes Virus 4 (Epstein Barr virus)
aacuuaacauccaaaaccucucacaggucaggcuccagaggaugggaagagcgggagaguucca

SEQ ID NO: 544401 - RNA, 64 nt, Human Herpes Virus 4 (Epstein Barr virus)
accacaucgcggaugaugggcgugacuaucuaauccagaggacccgcgagacccugccccccac

SEQ ID NO: 544402 - RNA, 64 nt, Human Herpes Virus 4 (Epstein Barr virus)
aaaugcaucugcgaaacuugcagagggccacaguccagaggaggaccugguuaaagaacccgcg

SEQ ID NO: 544403 - RNA, 64 nt, Human Herpes Virus 4 (Epstein Barr virus)
acugacacacaggccuggcggguggagauagggaccagaggacuaauguucucuaacugugucc

SEQ ID NO: 544404 - RNA, 64 nt, Human Herpes Virus 4 (Epstein Barr virus)
guuggaggcugaggagaaggcgaggccgggcggcccagaggagggcgcggucccgggcccgggg

SEQ ID NO: 544405 - RNA, 64 nt, Human Herpes Virus 2
aggcgggggggcaccugaucgacacccccgccgucgaccacacccucccuggguucggcaaggg

SEQ ID NO: 544406 - RNA, 64 nt, Human Herpes Virus 2
ugccggcgcaacucagggggcgugacuuugggggcgaccacacggccaagcuggaguuccuggc

SEQ ID NO: 544407 - RNA, 64 nt, Human Herpes Virus 2
acgagcugcucaacguggucaccuauauaugcgacgaccacaugccgcggguggugacgcacac

SEQ ID NO: 544408 - RNA, 64 nt, Human Herpes Virus 2
cgggggugcgauaacgcaccccuggacguccgcccgaccacaccccccgcccccguauccccaa

SEQ ID NO: 544409 - RNA, 64 nt, Human Herpes Virus 2
gagccaucguggagcugcuggacgcccaccgcaucgaccacagcgccugccggacgcacagaca

SEQ ID NO: 544410 - RNA, 64 nt, Human Herpes Virus 4 (Epstein Barr virus)
aagauccugugcaugggcacacccaggguccaugggaucccagggcaccacaucucccaccuca

SEQ ID NO: 544411 - RNA, 64 nt, Human Herpes Virus 4 (Epstein Barr virus)
aaggccugcuagacugcgccucccuccugcgccuggaucccagcuguaucaaccgaaucgccuc

SEQ ID NO: 544412 - RNA, 52 nt, Human Herpes Virus 4 (Epstein Barr virus)
ccuuuccuggaaauccagccauggaucccacccggggucugugugcccucuc

SEQ ID NO: 544413 - RNA, 64 nt, Human Herpes Virus 4 (Epstein Barr virus)
cuuuggccccccuccacccgugccuccuuacuacggaucccacuugcgggcagacuacgucccc

SEQ ID NO: 544414 - RNA, 64 nt, Human Herpes Virus 4 (Epstein Barr virus)
augccccucccauguuuauccugcagacccuggcggaucccaccuucacugagaggggguucuc

SEQ ID NO: 544415 - RNA, 64 nt, Human Herpes Virus 4 (Epstein Barr virus)
ccaagagagcgaugagagacccauauucccccaccccucaaagcccaccuuucuuccucccguu

SEQ ID NO: 544416 - RNA, 64 nt, Human Herpes Virus 2
gguggggaagggaccggagacgcaccaaaagcagaggggccagcgcguguaugaguuggggggg

SEQ ID NO: 544417 - RNA, 64 nt, Human Herpes Virus 2
ccgugccgguggacgcgcaccgcgcgccccggucgcgcaugacccaggcucagaccgacaccca

SEQ ID NO: 544418 - RNA, 64 nt, Human Herpes Virus 2
ugcuggcggcgguuaaaaauuguuaccccgacgcgcgcaugagcggccgcggcugccuggaaaa

SEQ ID NO: 544419 - RNA, 64 nt, Human Herpes Virus 2
gccgcgcgacguagcgacaaaaguggcgacagaggcgcaugaggcgcgcgccgucggccgcgua

SEQ ID NO: 544420 - RNA, 64 nt, Human Herpes Virus 2
cggagaucuacaaggucccgcucgacggguacgggcgcaugaacggccgggguguguuccgcgu

SEQ ID NO: 544421 - RNA, 64 nt, Human Herpes Virus 2
uucuguccgcgaggaggccgacgcccugcuggaggcgcaugacguguuucaggccacuacgccc

SEQ ID NO: 544422 - RNA, 64 nt, Human Herpes Virus 2
uucuucgccggccccugggcuuccuggcguccacgcgcaugagcccugaccaucggcccccugg

SEQ ID NO: 544423 - RNA, 64 nt, Human Herpes Virus 2
ggcgcgacugucgcguggccgcccgcuacgcggggcgcaugacguacaucgccaccggggcucu

SEQ ID NO: 544424 - RNA, 64 nt, Human Herpes Virus 2; identical to SEQ ID NO: 544417

SEQ ID NO: 544425 - RNA, 64 nt, Human Herpes Virus 2
ucgacgcccuguacgccgaguuucucggcggccgcgcgcuaaccgccccgaugguccgccgagc

SEQ ID NO: 544426 - RNA, 64 nt, Human Herpes Virus 2; identical to SEQ ID NO: 544425

SEQ ID NO: 544427 - RNA, 64 nt, Human Herpes Virus 4 (Epstein Barr virus)
ucccggggaagguguguccgguaaacgccauacgccgcgguaagggcuacguccgagucuccgu

SEQ ID NO: 544428 - RNA, 64 nt, Human Herpes Virus 1
ccggcccccaccgcccggcgugggcccggggggcggggcugaccccucccacccccccucgcgc

SEQ ID NO: 544429 - RNA, 64 nt, Human Herpes Virus 1
ccguggucgacgacccccgcgggccguuuuuuguggggcugaucgccugcgugcagcuggagcg

SEQ ID NO: 544430 - RNA, 62 nt, Human Herpes Virus 1
auuaaccgguuccuggaccugcaccagauucugcggggcugacgcgcgugcuguugggcggg

SEQ ID NO: 544431 - RNA, 64 nt, Human Herpes Virus 1
ggggcugcgagaugcugaccggcucgccgcgcggggggcugauguccgucgcccugcagacgga

SEQ ID NO: 544432 - RNA, 64 nt, Human Herpes Virus 1; identical to SEQ ID NO: 544428

SEQ ID NO: 544433 - RNA, 64 nt, Human Herpes Virus 2; identical to SEQ ID NO: 540455

SEQ ID NO: 544434 - RNA, 64 nt, Human Herpes Virus 2; identical to SEQ ID NO: 540461

SEQ ID NO: 544435 - RNA, 64 nt, Human Herpes Virus 2
gcagcggaccccaggaggccacacacaccggccacccgggcaggccccguucggccguuaccau

SEQ ID NO: 544436 - RNA, 64 nt, Human Herpes Virus 2
cguuuaaggcgacgugcacggccgccaccuacuacccgggcaaccgcgcggaguucgucugguu

SEQ ID NO: 544437 - RNA, 64 nt, Human Herpes Virus 2
gggccauggaugaugaccuggggucgcucugucccccgggcagccgggcccgccauuuaggaug

SEQ ID NO: 544438 - RNA, 64 nt, Human Herpes Virus 2
cguguuggucaccacggccgaguuuccucgggaccccgggcagcugcuuuacaucccaaagacc

SEQ ID NO: 544439 - RNA, 64 nt, Human Herpes Virus 2; identical to SEQ ID NO: 540460

SEQ ID NO: 544440 - RNA, 64 nt, Human Herpes Virus 2; identical to SEQ ID NO: 541221

SEQ ID NO: 544441 - RNA, 56 nt, Human Herpes Virus 2; identical to SEQ ID NO: 541222

SEQ ID NO: 544442 - RNA, 64 nt, Human Herpes Virus 2; identical to SEQ ID NO: 541223

SEQ ID NO: 544443 - RNA, 64 nt, Human Herpes Virus 2; identical to SEQ ID NO: 541224

SEQ ID NO: 544444 - RNA, 64 nt, Human Herpes Virus 2; identical to SEQ ID NO: 541225

SEQ ID NO: 544445 - RNA, 64 nt, Human Herpes Virus 2; identical to SEQ ID NO: 541226

SEQ ID NO: 544446 - RNA, 64 nt, Human Herpes Virus 2; identical to SEQ ID NO: 541227

SEQ ID NO: 544447 - RNA, 64 nt, Human Herpes Virus 2; identical to SEQ ID NO: 541228

SEQ ID NO: 544448 - RNA, 64 nt, Human Herpes Virus 2; identical to SEQ ID NO: 541229

SEQ ID NO: 544449 - RNA, 64 nt, Human Herpes Virus 2; identical to SEQ ID NO: 541230

SEQ ID NO: 544450 - RNA, 64 nt, Human Herpes Virus 2; identical to SEQ ID NO: 541231

SEQ ID NO: 544451 - RNA, 64 nt, Human Herpes Virus 2; identical to SEQ ID NO: 541232

SEQ ID NO: 544452 - RNA, 64 nt, Human Herpes Virus 2; identical to SEQ ID NO: 541233

SEQ ID NO: 544453 - RNA, 64 nt, Human Herpes Virus 2; identical to SEQ ID NO: 541226

SEQ ID NO: 544454 - RNA, 64 nt, Human Herpes Virus 2; identical to SEQ ID NO: 541225

SEQ ID NO: 544455 - RNA, 64 nt, Human Herpes Virus 2; identical to SEQ ID NO: 540463

SEQ ID NO: 544456 - RNA, 64 nt, Human Herpes Virus 1
uggucgcccacggcccgagccucuaucgcacuuuugccggcaauccucgggccgcaucgaccgc

SEQ ID NO: 544457 - RNA, 64 nt, Human Herpes Virus 2
cauuacccuauacgcgguauggcugcccccgcgcacgcgcgacugccuccacgcccugcuguau

SEQ ID NO: 544458 - RNA, 64 nt, Human Herpes Virus 1
cggcgcuggacgcacgcggaaggaggccagggugugccggcacgacgggggccagaagcucccc

SEQ ID NO: 544459 - RNA, 64 nt, Human Herpes Virus 1
gcggaugcggugggggagcuucuggcccccgucgugccggcacacccuggccuccuuccgcgug

SEQ ID NO: 544460 - RNA, 64 nt, Human Herpes Virus 4 (Epstein Barr virus)
cgagaacaggaagacaaggagucacccaggccaggggccacaccggcgaaugaggccugggcca

SEQ ID NO: 544461 - RNA, 64 nt, Human Herpes Virus 4 (Epstein Barr virus)
uaguuauaguaaaugcaucugcgaaacuugcagagggccacaguccagaggaggaccugguuaa

SEQ ID NO: 544462 - RNA, 64 nt, Human Herpes Virus 4 (Epstein Barr virus)
caggcccgagguucucuucacuaaggcaguccaggggccacacagccugacucucauguacuuu

SEQ ID NO: 544463 - RNA, 64 nt, Human Herpes Virus 4 (Epstein Barr virus)
uuagggagguggccacacuggggaccggcuacgcgggccacaggugccugacggugccgcuccu

SEQ ID NO: 544464 - RNA, 64 nt, Human Herpes Virus 2; identical to SEQ ID NO: 540455

SEQ ID NO: 544465 - RNA, 64 nt, Human Herpes Virus 2; identical to SEQ ID NO: 540456

SEQ ID NO: 544466 - RNA, 64 nt, Human Herpes Virus 2; identical to SEQ ID NO: 540457

SEQ ID NO: 544467 - RNA, 64 nt, Human Herpes Virus 2; identical to SEQ ID NO: 540458

SEQ ID NO: 544468 - RNA, 64 nt, Human Herpes Virus 2; identical to SEQ ID NO: 540459

SEQ ID NO: 544469 - RNA, 64 nt, Human Herpes Virus 2; identical to SEQ ID NO: 540461

SEQ ID NO: 544470 - RNA, 64 nt, Human Herpes Virus 2; identical to SEQ ID NO: 540462

SEQ ID NO: 544471 - RNA, 64 nt, Human Herpes Virus 2; identical to SEQ ID NO: 540462

SEQ ID NO: 544472 - RNA, 64 nt, Human Herpes Virus 2; identical to SEQ ID NO: 540463

SEQ ID NO: 544473 - RNA, 64 nt, Human Herpes Virus 4 (Epstein Barr virus); identical to SEQ ID NO: 544460

SEQ ID NO: 544474 - RNA, 64 nt, Human Herpes Virus 4 (Epstein Barr virus); identical to SEQ ID NO: 544461

SEQ ID NO: 544475 - RNA, 64 nt, Human Herpes Virus 4 (Epstein Barr virus); identical to SEQ ID NO: 544462

SEQ ID NO: 544476 - RNA, 64 nt, Human Herpes Virus 4 (Epstein Barr virus); identical to SEQ ID NO: 544463

SEQ ID NO: 544477 - RNA, 64 nt, Human Herpes Virus 4 (Epstein Barr virus); identical to SEQ ID NO: 544460

SEQ ID NO: 544478 - RNA, 64 nt, Human Herpes Virus 4 (Epstein Barr virus); identical to SEQ ID NO: 544461

SEQ ID NO: 544479 - RNA, 64 nt, Human Herpes Virus 4 (Epstein Barr virus); identical to SEQ ID NO: 544462

SEQ ID NO: 544480 - RNA, 64 nt, Human Herpes Virus 4 (Epstein Barr virus); identical to SEQ ID NO: 544463

SEQ ID NO: 544481 - RNA, 64 nt, Human Herpes Virus 4 (Epstein Barr virus); identical to SEQ ID NO: 544460

SEQ ID NO: 544482 - RNA, 64 nt, Human Herpes Virus 4 (Epstein Barr virus); identical to SEQ ID NO: 544461

SEQ ID NO: 544483 - RNA, 64 nt, Human Herpes Virus 4 (Epstein Barr virus); identical to SEQ ID NO: 544462

SEQ ID NO: 544484 - RNA, 64 nt, Human Herpes Virus 4 (Epstein Barr virus); identical to SEQ ID NO: 544463

SEQ ID NO: 544485 - RNA, 64 nt, Human Herpes Virus 2
cccuggcgauggcuaggacgggacgccgcgcggccgucgguaggcccgcucgcacgagcagccu

SEQ ID NO: 544486 - RNA, 64 nt, Human Herpes Virus 2; identical to SEQ ID NO: 540456

SEQ ID NO: 544487 - RNA, 64 nt, Human Herpes Virus 2; identical to SEQ ID NO: 540457

SEQ ID NO: 544488 - RNA, 64 nt, Human Herpes Virus 2; identical to SEQ ID NO: 540458

SEQ ID NO: 544489 - RNA, 64 nt, Human Herpes Virus 2; identical to SEQ ID NO: 540459

SEQ ID NO: 544490 - RNA, 64 nt, Human Herpes Virus 2; identical to SEQ ID NO: 540460

SEQ ID NO: 544491 - RNA, 64 nt, Human Herpes Virus 1
gcccccccgaccgaugucagccugggggacgagcuccacuuagacggcgaggacguggcgaugg

SEQ ID NO: 544492 - RNA, 64 nt, Human Herpes Virus 2
gcuccucgcgacgcgcgcguacgugcacgcgcgcugggcggaguucgaucagcugcuggccgac

SEQ ID NO: 544493 - RNA, 64 nt, Human Herpes Virus 2
cagcgcccccaaccgaacggacccgcacgugaucugggcggagggcgccggcccgggcgccagc

SEQ ID NO: 544494 - RNA, 64 nt, Human Herpes Virus 2
gccccuguacgcgcggaccacccccgccaaauuuugggcggacgugcgcgccgccgcggaacac

SEQ ID NO: 544495 - RNA, 61 nt, Human Herpes Virus 4 (Epstein Barr virus)
gcugcuucgggaauacgucuggagacggaccagggggaaaaaagaccuggcagacaacccc

SEQ ID NO: 544496 - RNA, 61 nt, Human Herpes Virus 4 (Epstein Barr virus)
caggcggucggacugcgcccccucaacuuagagggggaaggcaaggccggggacgcaggag

SEQ ID NO: 544497 - RNA, 61 nt, Human Herpes Virus 4 (Epstein Barr virus)
ccaccuguugauggcuucggguccgagauggagggggaacagacaugcccccaugcucaga

SEQ ID NO: 544498 - RNA, 64 nt, Human Herpes Virus 1
gccugagcuggcgaaccccuuaaccgcccaccuccuggccgaauauaaucgucggugccagacc

SEQ ID NO: 544499 - RNA, 64 nt, Human Herpes Virus 1
ggacggggcgguucgccggaccgccgauuuguuucuggccgauuccuucaugcaggagaucauc

SEQ ID NO: 544500 - RNA, 64 nt, Human Herpes Virus 1
uaacacgaacgacguggaagugcuggacgaaugucuggccgaguacugcaccucgcugcgaacc

SEQ ID NO: 544501 - RNA, 64 nt, Human Herpes Virus 1
agggguacgaagccauacgcgcuucuacaaggcgcuggccgaagaggugcgggaguuucacgcc

SEQ ID NO: 544502 - RNA, 64 nt, Human Herpes Virus 1
ccagcagauccgcgucuuuacgugccugcugcgccuggccgaccagaagggcuuuauucugccg

SEQ ID NO: 544503 - RNA, 64 nt, Human Herpes Virus 1
cguccacgcgcgcugggcggccuucgaacagcuccuggccgauuucccggaggcggccgacaug

SEQ ID NO: 544504 - RNA, 64 nt, Human Herpes Virus 1
cgcguccaagccccgcaagcugcugguguccgagcuggccgaggaucccgcauacgccauugcc

SEQ ID NO: 544505 - RNA, 64 nt, Human Herpes Virus 1
ggacgacugggcccgcauaacgcgggacgcucgccuggccgaagcggucguguccgccgaagcg

SEQ ID NO: 544506 - RNA, 64 nt, Human Herpes Virus 1
gugccuggccgccugccgcgggauccuggaggcgcuggccgagggcuucgacggcgaccuggcg

SEQ ID NO: 544507 - RNA, 64 nt, Human Herpes Virus 1
cuuccccggacuucgcgcccagcuccuggcggcccuggccgaccucggggggagcgggcuggcg

SEQ ID NO: 544508 - RNA, 64 nt, Human Herpes Virus 1
gccgggacgcaccgugacuaagcgucccugggcccuggccgaggacaccccucguggccccgac

SEQ ID NO: 544509 - RNA, 64 nt, Human Herpes Virus 1
agcgaccaacgcuucucuguggggagacggcgaccuggccgaaggauggaugagucccgcagac

SEQ ID NO: 544510 - RNA, 64 nt, Human Herpes Virus 1
ccgagaugccgcccacgcggcccugcgccgacgccuggccgagacgcaccuccgagccgagauu

SEQ ID NO: 544511 - RNA, 64 nt, Human Herpes Virus 1
gguauuccugccgaccauccgccggcaacugacgcuggccgacguggcgcacgaauccuucguc

SEQ ID NO: 544512 - RNA, 64 nt, Human Herpes Virus 1
cccugccggcgggcuggucgugacccgacaggaccuggccgauagcgcccccugagguuacggc

SEQ ID NO: 544513 - RNA, 64 nt, Human Herpes Virus 1
cacgcuacucggccggccuugccgcagcucgggucuggccgagcacuccgccuuccagcgucga

SEQ ID NO: 544514 - RNA, 64 nt, Human Herpes Virus 1
cugggccgccgcgcauguguccacgcgccugagccuggccgacgcucgaguacccaggggcgcg

SEQ ID NO: 544515 - RNA, 64 nt, Human Herpes Virus 1; identical to SEQ ID NO: 544506

SEQ ID NO: 544516 - RNA, 64 nt, Human Herpes Virus 2
cacugucgguauccguucuccaaaaccugcuggcucggggcauccgcggcccuacaacaccuuc

SEQ ID NO: 544517 - RNA, 64 nt, Human Herpes Virus 2
gccugucucgucguggcccuccuaucuggaggguucggggcacuuuugguguggcugcuccgcu

SEQ ID NO: 544518 - RNA, 62 nt, Human Herpes Virus 4 (Epstein Barr virus)
ggacucucuagauaccugccccucuuucucuguggggcgauggccuccggggggcuguaccu

SEQ ID NO: 544519 - RNA, 64 nt, Human Herpes Virus 1
gcguucgaccaggcugcgcguucucgcggccauaacaaccgacguacggcguugcgcccucgcc

SEQ ID NO: 544520 - RNA, 64 nt, Human Herpes Virus 4 (Epstein Barr virus)
cagggacaagcaacgcaagcccgguggaccuuggagaccagagccaaacaccuccaguccuagc

SEQ ID NO: 544521 - RNA, 64 nt, Human Herpes Virus 4 (Epstein Barr virus)
cguuacaagauagcauggccguggggugugacucaucagguacagcaugcccaagcaugcccuu

SEQ ID NO: 544522 - RNA, 64 nt, Human Herpes Virus 4 (Epstein Barr virus)
caccaccggccuccacagacccagccaccaugcuaucagguaacgcaggagaaggagcaacagc

SEQ ID NO: 544523 - RNA, 55 nt, Human Herpes Virus 4 (Epstein Barr virus)
ccuccacagacccagccaccaugcuaucagguaacgcaggagaaggagcaacagc

SEQ ID NO: 544524 - RNA, 64 nt, Human Herpes Virus 4 (Epstein Barr virus); identical to SEQ ID NO: 544521

SEQ ID NO: 544525 - RNA, 64 nt, Human Herpes Virus 4 (Epstein Barr virus); identical to SEQ ID NO: 544522

SEQ ID NO: 544526 - RNA, 55 nt, Human Herpes Virus 4 (Epstein Barr virus); identical to SEQ ID NO: 544523

SEQ ID NO: 544527 - RNA, 64 nt, Human Herpes Virus 1; identical to SEQ ID NO: 541614

SEQ ID NO: 544528 - RNA, 64 nt, Human Herpes Virus 1; identical to SEQ ID NO: 541615

SEQ ID NO: 544529 - RNA, 64 nt, Human Herpes Virus 1; identical to SEQ ID NO: 541616

SEQ ID NO: 544530 - RNA, 64 nt, Human Herpes Virus 1; identical to SEQ ID NO: 541617

SEQ ID NO: 544531 - RNA, 64 nt, Human Herpes Virus 1; identical to SEQ ID NO: 541618

SEQ ID NO: 544532 - RNA, 64 nt, Human Herpes Virus 1; identical to SEQ ID NO: 541619

SEQ ID NO: 544533 - RNA, 64 nt, Human Herpes Virus 1; identical to SEQ ID NO: 541620

SEQ ID NO: 544534 - RNA, 64 nt, Human Herpes Virus 1; identical to SEQ ID NO: 541621

SEQ ID NO: 544535 - RNA, 64 nt, Human Herpes Virus 1; identical to SEQ ID NO: 541622

SEQ ID NO: 544536 - RNA, 64 nt, Human Herpes Virus 1; identical to SEQ ID NO: 541623

SEQ ID NO: 544537 - RNA, 64 nt, Human Herpes Virus 1; identical to SEQ ID NO: 541624

SEQ ID NO: 544538 - RNA, 64 nt, Human Herpes Virus 1; identical to SEQ ID NO: 541625

SEQ ID NO: 544539 - RNA, 64 nt, Human Herpes Virus 1; identical to SEQ ID NO: 541626

SEQ ID NO: 544540 - RNA, 64 nt, Human Herpes Virus 1; identical to SEQ ID NO: 541627

SEQ ID NO: 544541 - RNA, 64 nt, Human Herpes Virus 1; identical to SEQ ID NO: 541628

SEQ ID NO: 544542 - RNA, 64 nt, Human Herpes Virus 1; identical to SEQ ID NO: 541629

SEQ ID NO: 544543 - RNA, 64 nt, Human Herpes Virus 1; identical to SEQ ID NO: 541630

SEQ ID NO: 544544 - RNA, 64 nt, Human Herpes Virus 1; identical to SEQ ID NO: 541614

SEQ ID NO: 544545 - RNA, 64 nt, Human Herpes Virus 1; identical to SEQ ID NO: 541622

SEQ ID NO: 544546 - RNA, 64 nt, Human Herpes Virus 1; identical to SEQ ID NO: 541621

SEQ ID NO: 544547 - RNA, 64 nt, Human Herpes Virus 4 (Epstein Barr virus)
ccaggggagcccagccaccagcacccgcacaccaaaagccuacugccccuaccccgaagccccg

SEQ ID NO: 544548 - RNA, 64 nt, Human Herpes Virus 2
gcccugcuacgcagcgcccgcgauggggaggcccacgcgcgagagacccacuuuacgcaguauc

SEQ ID NO: 544549 - RNA, 64 nt, Human Herpes Virus 2
ccaaacagcagcgcgcggagucgccaccacccucacgcgcgagucugcgggaggcgcuggccgc

SEQ ID NO: 544550 - RNA, 64 nt, Human Herpes Virus 2
uaaaggcgacucggcuggccaucagaccgagaaaacgcgcgagcgagcucacgacccugggguc

SEQ ID NO: 544551 - RNA, 64 nt, Human Herpes Virus 4 (Epstein Barr virus)
uucuguuugcauugcuggccgcagcuggcggacuacaaggcauuuacgguuagugugccucugu

SEQ ID NO: 544552 - RNA, 64 nt, Human Herpes Virus 4 (Epstein Barr virus)
aaggccagcgacgccccggaccuacaaaagccggacaaggcacuucagagcccaccaccggccu

SEQ ID NO: 544553 - RNA, 64 nt, Human Herpes Virus 4 (Epstein Barr virus)
cuugauaaucccuguaaacacacaccaccuaagaacaaggcauuguuaaccuuugguggaaccu

SEQ ID NO: 544554 - RNA, 64 nt, Human Herpes Virus 4 (Epstein Barr virus)
cuucugcguccagacgcgauggcacacgccagagacaaggcaggcgcuguuauggccaugauac

SEQ ID NO: 544555 - RNA, 64 nt, Human Herpes Virus 2
gacgugucuggggcugguucccauauugcgcaagacgcgcgagggggaggcgacgcagcgccug

SEQ ID NO: 544556 - RNA, 64 nt, Human Herpes Virus 2
uagccgccccgcgacagaaccggaguccgacggcacgcgcgacggggucugcgaggcugaggua

SEQ ID NO: 544557 - RNA, 64 nt, Human Herpes Virus 2
ggcgcuggaggagccccacgccgagucgggauugacgcgcgaggagguccgcgccgugcauggg

SEQ ID NO: 544558 - RNA, 64 nt, Human Herpes Virus 2
ggccaucgcuccguuucgccaccuggacccggcgacgcgcgagggggugcgacgcgaggccgcc

SEQ ID NO: 544559 - RNA, 64 nt, Human Herpes Virus 2
ggcgcggcagccgcuucugcggguucgaacggcaacgcgcgacuaugccggucuguauguccug

SEQ ID NO: 544560 - RNA, 64 nt, Human Herpes Virus 2
accaagcgggcccuggcggcgcacgggggcgaagacgcgcgaaacgaguuccacgcccucaccg

SEQ ID NO: 544561 - RNA, 64 nt, Human Herpes Virus 1
acgacgagguggcggacgaccaaaccgacguauuguacgccaagauacaacacccgcggcaccu

SEQ ID NO: 544562 - RNA, 64 nt, Human Herpes Virus 1
ugacgggcgccacgcgcauugcggcccaaaacauguacgccaaacucucgggcgccuuucucag

SEQ ID NO: 544563 - RNA, 64 nt, Human Herpes Virus 1
ggggcgaaaaaaacgugcaugugguggucggcgaguacgccaugcccggguuuucggcgcgccg

SEQ ID NO: 544564 - RNA, 64 nt, Human Herpes Virus 1
cgcacgacguguuucaggccaccacgcccggccuguacgccaucagcgaauugcgauucuggcu

SEQ ID NO: 544565 - RNA, 64 nt, Human Herpes Virus 1
uuugacguggucgagcuccgggcuuauauagcgcguacgccaaggcacggcuacaacccccggg

SEQ ID NO: 544566 - RNA, 64 nt, Human Hepatitis C Virus (M1LE)
cuacccgucuccgcccggaggggaagggagauacuccugggaccagccgauagucuugaggggc

SEQ ID NO: 544567 - RNA, 64 nt, Human Herpes Virus 2; identical to SEQ ID NO: 540276

SEQ ID NO: 544568 - RNA, 64 nt, Human Herpes Virus 2; identical to SEQ ID NO: 540277

SEQ ID NO: 544569 - RNA, 64 nt, Human Herpes Virus 2; identical to SEQ ID NO: 540278

SEQ ID NO: 544570 - RNA, 64 nt, Human Herpes Virus 2; identical to SEQ ID NO: 540279

SEQ ID NO: 544571 - RNA, 64 nt, Human Herpes Virus 2; identical to SEQ ID NO: 540280

SEQ ID NO: 544572 - RNA, 64 nt, Human Herpes Virus 2; identical to SEQ ID NO: 540281

SEQ ID NO: 544573 - RNA, 64 nt, Human Herpes Virus 2; identical to SEQ ID NO: 540282

SEQ ID NO: 544574 - RNA, 64 nt, Human Herpes Virus 2; identical to SEQ ID NO: 540283

SEQ ID NO: 544575 - RNA, 64 nt, Human Herpes Virus 2; identical to SEQ ID NO: 540284

SEQ ID NO: 544576 - RNA, 64 nt, Human Herpes Virus 2; identical to SEQ ID NO: 540285

SEQ ID NO: 544577 - RNA, 64 nt, Human Herpes Virus 2; identical to SEQ ID NO: 540286

SEQ ID NO: 544578 - RNA, 64 nt, Human Herpes Virus 2; identical to SEQ ID NO: 540287

SEQ ID NO: 544579 - RNA, 64 nt, Human Herpes Virus 2; identical to SEQ ID NO: 540288

SEQ ID NO: 544580 - RNA, 64 nt, Human Herpes Virus 2; identical to SEQ ID NO: 540289

SEQ ID NO: 544581 - RNA, 64 nt, Human Herpes Virus 2; identical to SEQ ID NO: 540290

SEQ ID NO: 544582 - RNA, 64 nt, Human Herpes Virus 2; identical to SEQ ID NO: 540291

SEQ ID NO: 544583 - RNA, 64 nt, Human Herpes Virus 2; identical to SEQ ID NO: 540292

SEQ ID NO: 544584 - RNA, 64 nt, Human Herpes Virus 2; identical to SEQ ID NO: 540293

SEQ ID NO: 544585 - RNA, 64 nt, Human Herpes Virus 2; identical to SEQ ID NO: 540294

SEQ ID NO: 544586 - RNA, 64 nt, Human Herpes Virus 2; identical to SEQ ID NO: 540295

SEQ ID NO: 544587 - RNA, 64 nt, Human Herpes Virus 2; identical to SEQ ID NO: 540296

SEQ ID NO: 544588 - RNA, 64 nt, Human Herpes Virus 2; identical to SEQ ID NO: 540277

SEQ ID NO: 544589 - RNA, 64 nt, Human Herpes Virus 2; identical to SEQ ID NO: 540276

SEQ ID NO: 544590 - RNA, 63 nt, Human Herpes Virus 2
cgagcgcggcgggcuguccugccugcuggcggcccugggcaaccggcucugcgggcccgccac

SEQ ID NO: 544591 - RNA, 63 nt, Human Herpes Virus 2
gcugaagcggagcuuuugcgacacgagcuucuuccugggcaaggcgggccaucgccgcgaggc

SEQ ID NO: 544592 - RNA, 63 nt, Human Herpes Virus 2
cguggagcaggaggcgcuguuucgcgcccugccccugggcagccccggggucguggcggccga

SEQ ID NO: 544593 - RNA, 63 nt, Human Herpes Virus 2; identical to SEQ ID NO: 544590

SEQ ID NO: 544594 - RNA, 64 nt, Human Herpes Virus 2; identical to SEQ ID NO: 541718

SEQ ID NO: 544595 - RNA, 64 nt, Human Herpes Virus 2; identical to SEQ ID NO: 541724

SEQ ID NO: 544596 - RNA, 64 nt, Human Herpes Virus 2
ccugcgcauccccccggcagcgugccucaccucgaaggccuaccaacagggcgugacggucgac

SEQ ID NO: 544597 - RNA, 57 nt, Human Herpes Virus 4 (Epstein Barr virus)
agacagucaccuauuuuccugacccuccugaggcacauccgccgacgucugggccug

SEQ ID NO: 544598 - RNA, 57 nt, Human Herpes Virus 4 (Epstein Barr virus)
ggauuucugagaaaccgcguggagacucugaggcaggacagggguguggccaauauc

SEQ ID NO: 544599 - RNA, 57 nt, Human Herpes Virus 4 (Epstein Barr virus)
caugcccggggcaggaacuuugcgugccugaggcauacccacagggccagcuccaag

SEQ ID NO: 544600 - RNA, 63 nt, Human Herpes Virus 4 (Epstein Barr virus)
aggugcccacccacuggccccccuugauggcuccgaccggacugucuggggagagggugccgu

SEQ ID NO: 544601 - RNA, 60 nt, Human immunodeficiency virus type 1 (BLAI)
ccuggggauuugggguugcucuggaaaacucauuugcaccacugcugugccuuggaaugc

SEQ ID NO: 544602 - RNA, 60 nt, Human immunodeficiency virus type 1 (BLAI); identical to SEQ ID NO: 544601

SEQ ID NO: 544603 - RNA, 64 nt, Human Herpes Virus 1
cggguuccgcgaccaccccgagaaccuagggaacccagaguaccgcgagcucccagagacccca

SEQ ID NO: 544604 - RNA, 64 nt, Human Herpes Virus 2
ccucgccgaggagaacgugcacgcgugcgggguccucauggacggccacacgggcauggugggg

SEQ ID NO: 544605 - RNA, 64 nt, Human Herpes Virus 2; identical to SEQ ID NO: 541713

SEQ ID NO: 544606 - RNA, 64 nt, Human Herpes Virus 2; identical to SEQ ID NO: 541714

SEQ ID NO: 544607 - RNA, 64 nt, Human Herpes Virus 2; identical to SEQ ID NO: 541715

SEQ ID NO: 544608 - RNA, 64 nt, Human Herpes Virus 2; identical to SEQ ID NO: 541719

SEQ ID NO: 544609 - RNA, 64 nt, Human Herpes Virus 2; identical to SEQ ID NO: 541720

SEQ ID NO: 544610 - RNA, 64 nt, Human Herpes Virus 2; identical to SEQ ID NO: 541721

SEQ ID NO: 544611 - RNA, 64 nt, Human Herpes Virus 2; identical to SEQ ID NO: 541718

SEQ ID NO: 544612 - RNA, 64 nt, Human Herpes Virus 2; identical to SEQ ID NO: 541716

SEQ ID NO: 544613 - RNA, 64 nt, Human Herpes Virus 2; identical to SEQ ID NO: 541717

SEQ ID NO: 544614 - RNA, 64 nt, Human Herpes Virus 2; identical to SEQ ID NO: 541722

SEQ ID NO: 544615 - RNA, 64 nt, Human Herpes Virus 2; identical to SEQ ID NO: 541723

SEQ ID NO: 544616 - RNA, 62 nt, Human Herpes Virus 2
ucgagguggggggccgacggcuguucuucgugaaggcccacguacgcgagagccugcugagc

SEQ ID NO: 544617 - RNA, 64 nt, Human Herpes Virus 2
ggacucgcaacgccugaccccggggggguccgucucgcccgagcacgucauguaccucggcgcg

SEQ ID NO: 544618 - RNA, 64 nt, Human Herpes Virus 2
ggcgugagaagccauacccgcuucuacaaggcguucgcccgagaggugcgggaguucaacgcca

SEQ ID NO: 544619 - RNA, 64 nt, Human Herpes Virus 2
acgcaggacaccgcgugcgugcacggcgagcugcucgcccgaaagcgcgaacgguucgcggcgg

SEQ ID NO: 544620 - RNA, 64 nt, Human Herpes Virus 2
guccugugcgggauugcguuuuacgugacgucaaucgcccgaggcgcauaaagguccggcggcc

SEQ ID NO: 544621 - RNA, 64 nt, Human Herpes Virus 2
gguggacgcccugaucaucggcggccaggcgacgucgcccgacgaucagaucgaggcgcugaua

SEQ ID NO: 544622 - RNA, 64 nt, Human Herpes Virus 2
ggcgguuuggcggcggcggcgggggcggccggcgucgcccgaaagcgggcguuucacggcgacg

SEQ ID NO: 544623 - RNA, 62 nt, Human Herpes Virus 2
cugggcaugcugaucccgggagccgucccggcggaggccaucgcucggggggcguccggauu

SEQ ID NO: 544624 - RNA, 62 nt, Human Herpes Virus 2
gcuagcgucaccgccgucugcagcggaccccaggaggccacacacaccggccacccgggcag

SEQ ID NO: 544625 - RNA, 62 nt, Human Herpes Virus 2
gacauggaagaccccugcggagacggaggggcggaggccaucgacgcggcgauucccaaagg

SEQ ID NO: 544626 - RNA, 62 nt, Human Herpes Virus 2
gugcgcgggguaacgguccauauggagacccuggaggccauucuguuugcccccggggagac

SEQ ID NO: 544627 - RNA, 62 nt, Human Herpes Virus 2
ccggccgcuccucgcgccgcccuccuggacguggaggccaaggucgacgucgacccgcuggc

SEQ ID NO: 544628 - RNA, 62 nt, Human Herpes Virus 2
cacuacaacgcccugauccgcgccuucgucccggaggccacccaccaguguagcggcccguc

SEQ ID NO: 544629 - RNA, 62 nt, Human Herpes Virus 2
cgcccccacaaucgccaaagacagcagcgcgcggaggccacccgggagcgccgccgucgcga

SEQ ID NO: 544630 - RNA, 62 nt, Human Herpes Virus 2
ccggggcccccccccggaagccggaaugacccggaggccaccccugugggggcugcuggggc

SEQ ID NO: 544631 - RNA, 62 nt, Human Herpes Virus 2
gcccgcacgacggcccagugccgcacggacgaggaggccagugacguagacgccucgccgcc

SEQ ID NO: 544632 - RNA, 64 nt, Human Herpes Virus 1
ggcgacuggcgacuuuguguacauguccccguuuuacggcuaccgggaggggucgcacaccgaa

SEQ ID NO: 544633 - RNA, 64 nt, Human Herpes Virus 2
gggaggcgacgcagcgccugggggcguuucucaggcagcacacgcugccccggcagcuggccac

SEQ ID NO: 544634 - RNA, 64 nt, Human Herpes Virus 2
ccacacggcggcguucguuugucuggucgccuuggcagcacaacuuuggcgcggccgggcgggg

SEQ ID NO: 544635 - RNA, 64 nt, Human Herpes Virus 4 (Epstein Barr virus)
acuuuuggcgcgaccugcagggcgaggccaugaacgccgccaaccugugcgccgaggugcugca

SEQ ID NO: 544636 - RNA, 64 nt, Human Herpes Virus 4 (Epstein Barr virus)
agccguuugcaaaggcugugccacugcucuuccucgccgccaccuggcuucugaccggggugcu

SEQ ID NO: 544637 - RNA, 64 nt, Human Herpes Virus 4 (Epstein Barr virus)
cacacacguaccccccuuaucucucggcggcugccgccgccagccgcguaagaccccggaccag

SEQ ID NO: 544638 - RNA, 64 nt, Human Herpes Virus 4 (Epstein Barr virus)
ucguggagggcauccaggaugugugccgggacgccgccgccaggugggcccuggccacggccga

SEQ ID NO: 544639 - RNA, 64 nt, Human Herpes Virus 4 (Epstein Barr virus)
uuucauuuagaacccgagaccgcagacucuuguccgccgccaggguggaggaugagcagggccu

SEQ ID NO: 544640 - RNA, 64 nt, Human Herpes Virus 4 (Epstein Barr virus)
gccuguuuaugcccaaucccaaguacacgaccuccgccgccaucaaaaugcuggacaaccccac

SEQ ID NO: 544641 - RNA, 64 nt, Human Herpes Virus 4 (Epstein Barr virus)
caccguccagauccaauuugccuacgacucccugcgccgccagaucaaccgcaugcugggagac

SEQ ID NO: 544642 - RNA, 62 nt, Human Herpes Virus 2
gggcguuucucggggccgcgcuggcccugagcccgacccaaaagcucgccgucuacuacuau

SEQ ID NO: 544643 - RNA, 62 nt, Human Herpes Virus 2
ggacccucgagcguauacacccccggagccucccgacccaccccuccacggacaacgacacc

SEQ ID NO: 544644 - RNA, 62 nt, Human Herpes Virus 2
gccugcggccggugcuggugugcguggggucgccgacccagacggccucgcuggaguccacc

SEQ ID NO: 544645 - RNA, 62 nt, Human Herpes Virus 2
gcccgcgaccccgauagucccccgaagcggccccgacccaacagccuagaucuggcgaccgu

SEQ ID NO: 544646 - RNA, 62 nt, Human Herpes Virus 2
gcgggaugagguggugcgcaccacgcccucuaccgacccacgugacgcccuggggggccugc

SEQ ID NO: 544647 - RNA, 62 nt, Human Herpes Virus 2
gcgcgugggggucaugcacuuugccuccccggccgacccaaagguguuuuuccgccagacgc

SEQ ID NO: 544648 - RNA, 62 nt, Human Herpes Virus 2
ugcuuugucaagcagcccgccgccccgcacgccugggggaugcucaacgacaugcaguggcu

SEQ ID NO: 544649 - RNA, 62 nt, Human Herpes Virus 2
uggcuggcgccgcgcgggucgucaauaaggcgcugggggaggaugacgagacgaaggccggc

SEQ ID NO: 544650 - RNA, 62 nt, Human Herpes Virus 2
cgcccgagaacgcggaggcgguggcgcgguuucugggggacgccgucgaccgcgagcccgcg

SEQ ID NO: 544651 - RNA, 62 nt, Human Herpes Virus 2
gugugcccgagggggugacguuugccugguuccugggggacgacuccucgccggcggagaag

SEQ ID NO: 544652 - RNA, 62 nt, Human Herpes Virus 2
acaucuucaucaacacccccgagaacaucugucugggggacuuuggggcggcgugcuuugug

SEQ ID NO: 544653 - RNA, 62 nt, Human Herpes Virus 2
uuggucucaauggaucgguaugccguucggaccugggggauugugggaauccucgggugugc

SEQ ID NO: 544654 - RNA, 62 nt, Human Herpes Virus 2
cgacggccccggccgccuccccgcuggagccccugggggacccgacccuguggcgggcgcug

SEQ ID NO: 544655 - RNA, 62 nt, Human Herpes Virus 2
ccgacgcccuggacgacuucgacuuggagaugcugggggacguggagucccccuccccggga

SEQ ID NO: 544656 - RNA, 62 nt, Human Herpes Virus 2; identical to SEQ ID NO: 544648

SEQ ID NO: 544657 - RNA, 64 nt, Human Herpes Virus 2
acuacuacacguccagcugcuaccugguaaacccccaggccaccacuaaccaggccacccuccg

SEQ ID NO: 544658 - RNA, 64 nt, Human Herpes Virus 2
gcugcuaccugguaaacccccaggccaccacuaaccaggccacccuccgggccaucaccggcaa

SEQ ID NO: 544659 - RNA, 64 nt, Human Herpes Virus 2
gcggcgaaguccccccggccgguccgggggcgauccaggccaccuggcgcguggucaacggcaa

SEQ ID NO: 544660 - RNA, 64 nt, Human Herpes Virus 2
accggcuugcccaagcgccgcucgccaccagcccccaggccauccagcguggaggaucugaccu

SEQ ID NO: 544661 - RNA, 64 nt, Human Herpes Virus 2
uuugcggacgcggacgggguuucgccaccgccccccaggccagccgggggucccaagaacaccc

SEQ ID NO: 544662 - RNA, 64 nt, Human Herpes Virus 2
gggccgcggacaagucggcggacgugcucgucucccaggccauucggagcauggccgagagcga

SEQ ID NO: 544663 - RNA, 63 nt, Human Herpes Virus 2
ccccgcccgcucggcuucccguccccgccgcccccucgaguagcgaccccgaccgcguucaga

SEQ ID NO: 544664 - RNA, 64 nt, Human Herpes Virus 2; identical to SEQ ID NO: 536565

SEQ ID NO: 544665 - RNA, 64 nt, Human Herpes Virus 2; identical to SEQ ID NO: 536566

SEQ ID NO: 544666 - RNA, 64 nt, Human Herpes Virus 2; identical to SEQ ID NO: 536567

SEQ ID NO: 544667 - RNA, 64 nt, Human Herpes Virus 2; identical to SEQ ID NO: 536568

SEQ ID NO: 544668 - RNA, 64 nt, Human Herpes Virus 2; identical to SEQ ID NO: 536569

SEQ ID NO: 544669 - RNA, 64 nt, Human Herpes Virus 2; identical to SEQ ID NO: 536570

SEQ ID NO: 544670 - RNA, 64 nt, Human Herpes Virus 2; identical to SEQ ID NO: 536571

SEQ ID NO: 544671 - RNA, 64 nt, Human Herpes Virus 2; identical to SEQ ID NO: 536572

SEQ ID NO: 544672 - RNA, 64 nt, Human Herpes Virus 2; identical to SEQ ID NO: 536573

SEQ ID NO: 544673 - RNA, 64 nt, Human Herpes Virus 2; identical to SEQ ID NO: 536574

SEQ ID NO: 544674 - RNA, 64 nt, Human Herpes Virus 2; identical to SEQ ID NO: 536565

SEQ ID NO: 544675 - RNA, 64 nt, Human Herpes Virus 2; identical to SEQ ID NO: 536576

SEQ ID NO: 544676 - RNA, 64 nt, Human Herpes Virus 1; identical to SEQ ID NO: 539372

SEQ ID NO: 544677 - RNA, 64 nt, Human Herpes Virus 1; identical to SEQ ID NO: 539373

SEQ ID NO: 544678 - RNA, 64 nt, Human Herpes Virus 1; identical to SEQ ID NO: 539374

SEQ ID NO: 544679 - RNA, 64 nt, Human Herpes Virus 1; identical to SEQ ID NO: 539375

SEQ ID NO: 544680 - RNA, 64 nt, Human Herpes Virus 1; identical to SEQ ID NO: 539376

SEQ ID NO: 544681 - RNA, 64 nt, Human Herpes Virus 1; identical to SEQ ID NO: 539377

SEQ ID NO: 544682 - RNA, 64 nt, Human Herpes Virus 1; identical to SEQ ID NO: 539378

SEQ ID NO: 544683 - RNA, 64 nt, Human Herpes Virus 1; identical to SEQ ID NO: 539379

SEQ ID NO: 544684 - RNA, 64 nt, Human Herpes Virus 1; identical to SEQ ID NO: 539380

SEQ ID NO: 544685 - RNA, 64 nt, Human Herpes Virus 1; identical to SEQ ID NO: 539381

SEQ ID NO: 544686 - RNA, 64 nt, Human Herpes Virus 1; identical to SEQ ID NO: 539382

SEQ ID NO: 544687 - RNA, 64 nt, Human Herpes Virus 1; identical to SEQ ID NO: 539383

SEQ ID NO: 544688 - RNA, 64 nt, Human Herpes Virus 1; identical to SEQ ID NO: 539384

SEQ ID NO: 544689 - RNA, 64 nt, Human Herpes Virus 1; identical to SEQ ID NO: 539385

SEQ ID NO: 544690 - RNA, 64 nt, Human Herpes Virus 2
uguuggugggcccccaccucggggccaucgccgccaccggcaucgucggccuggccugcgagca

SEQ ID NO: 544691 - RNA, 64 nt, Human Herpes Virus 2
acccggcguucacggccaacacgcgcgccuccggcaccggcaucgcggucgucgggagguaccg

SEQ ID NO: 544692 - RNA, 64 nt, Human Herpes Virus 2
aggccaccacuaaccaggccacccuccgggccaucaccggcaacgugagcgccauccucgcccg

SEQ ID NO: 544693 - RNA, 64 nt, Human Herpes Virus 2
cgcuccgggaguuuccguucgcggcguaucucaucaccggcaacgccggauccggaaagaguac

SEQ ID NO: 544694 - RNA, 64 nt, Human Herpes Virus 2
cuucgcgcgcuucgcccugaccaucaacgacauccaccggcauuucuuucuccacugcugcuuc

SEQ ID NO: 544695 - RNA, 64 nt, Human Herpes Virus 2
uccccuggggcaacccggcgccaaccugaccaccccggcguacagccugcucuucccguccccg

SEQ ID NO: 544696 - RNA, 64 nt, Human Herpes Virus 2
gucgccuccccgcccgcgacugcauccguggagucgucgccacuccccgccgcggcggcggcaa

SEQ ID NO: 544697 - RNA, 64 nt, Human Herpes Virus 2; identical to SEQ ID NO: 540731

SEQ ID NO: 544698 - RNA, 64 nt, Human Herpes Virus 2; identical to SEQ ID NO: 540732

SEQ ID NO: 544699 - RNA, 64 nt, Human Herpes Virus 2
accugauagugggcgugaccgccagcgggucguucagcaccaucccgauagugaacgacccccg

SEQ ID NO: 544700 - RNA, 64 nt, Human Herpes Virus 2
cauggacgacgacacguacguggccaacaguuuccagcaccaguacauccccgcguacggccag

SEQ ID NO: 544701 - RNA, 64 nt, Human Herpes Virus 2
aggucccgauggccgccccgcaguuucaccgccccagcaccauuaccgccgacaacguccgggc

SEQ ID NO: 544702 - RNA, 64 nt, Human Herpes Virus 2
ucaccuuugccgcccgcgaggagggcgcgucguccagcaccagcgcccagguccagauucugac

SEQ ID NO: 544703 - RNA, 64 nt, Human Herpes Virus 2
agugggggcccagggcgauccuuguccagacggacagcaccaaccggaaugccgauggggacug

SEQ ID NO: 544704 - RNA, 64 nt, Human Herpes Virus 2
cggccuccccugcucuagauauccucuuuaucaucagcaccaccauccacacggcggcguucgu

SEQ ID NO: 544705 - RNA, 64 nt, Human Herpes Virus 2
acgucgcccccgucugggagcuguuccgucugugcagcaccauggccgcgugccugcaguggga

SEQ ID NO: 544706 - RNA, 64 nt, Human Herpes Virus 2
ccgacuccgacgcccacuacgcguuugacuacuacagcaccagcggagacacgcugcgccucac

SEQ ID NO: 544707 - RNA, 64 nt, Human Herpes Virus 2
cgcgcgccgcgggccucgugggcgccaugguguucagcaccaauucggcccuccaccugaccga

SEQ ID NO: 544708 - RNA, 64 nt, Human Herpes Virus 2; identical to SEQ ID NO: 544699

SEQ ID NO: 544709 - RNA, 64 nt, Human Herpes Virus 2; identical to SEQ ID NO: 543858

SEQ ID NO: 544710 - RNA, 64 nt, Human Herpes Virus 2; identical to SEQ ID NO: 543857

SEQ ID NO: 544711 - RNA, 64 nt, Human Herpes Virus 2; identical to SEQ ID NO: 543859

SEQ ID NO: 544712 - RNA, 64 nt, Human Herpes Virus 2; identical to SEQ ID NO: 543860

SEQ ID NO: 544713 - RNA, 64 nt, Human Herpes Virus 2; identical to SEQ ID NO: 543861

SEQ ID NO: 544714 - RNA, 55 nt, Human Herpes Virus 2
cgacgcagauggccgagacgaugaacgucgccaccugcacacaccagacccacca

SEQ ID NO: 544715 - RNA, 64 nt, Human Herpes Virus 2
gacgcaguggugcgcgccaacuguacgucgcccucgucgccaccgcgggucauggcgggccugc

SEQ ID NO: 544716 - RNA, 61 nt, Human Herpes Virus 4 (Epstein Barr virus)
uggcuucuaacaucucccagccaauccuggcccaugggauaucguacagcaacacuacgca

SEQ ID NO: 544717 - RNA, 61 nt, Human Herpes Virus 4 (Epstein Barr virus)
ucaagauccugugcaugggcacacccaggguccaugggaucccagggcaccacaucuccca

SEQ ID NO: 544718 - RNA, 61 nt, Human Herpes Virus 4 (Epstein Barr virus)
cucaccuacaugucaaccgccucuacccuccccaugggauggcggcgguuauguuuucccc

SEQ ID NO: 544719 - RNA, 61 nt, Human Herpes Virus 4 (Epstein Barr virus)
aggcgcaucaccggugacaccaaguccaucuccaugggacaacggcacagaaaguaaggcc

SEQ ID NO: 544720 - RNA, 62 nt, Human Herpes Virus 2
gaccugcugcgggccgcggcccccgcguggagccgccgcacccugcuccccgagcacgcgcg

SEQ ID NO: 544721 - RNA, 62 nt, Human Herpes Virus 2
ggacggccgcgcgccagcgcaagcgcggagcaccgccgcaacgcacaugcguaccacgcagc

SEQ ID NO: 544722 - RNA, 62 nt, Human Herpes Virus 2
cccgcuaccccgccaaggccgucuaucugccgccgccgcacaucgcccccccggggccuccu

SEQ ID NO: 544723 - RNA, 62 nt, Human Herpes Virus 2
cgcgucggccgacuccgauuccgcggcccacgccgccgcaccccaggcggacguggcgccgg

SEQ ID NO: 544724 - RNA, 62 nt, Human Herpes Virus 2
ccccgcgcccggggcccgcgggcgcggccgccccgccgcacgccgacgcgccccgccugcgc

SEQ ID NO: 544725 - RNA, 62 nt, Human Herpes Virus 2
caacggucgugacggugggccuuagcuucgauccgccgcacuuugacagcauguucgccuac

SEQ ID NO: 544726 - RNA, 57 nt, Human Herpes Virus 2; identical to SEQ ID NO: 537182

SEQ ID NO: 544727 - RNA, 62 nt, Human Herpes Virus 2
aaacacggggcgcgugcccggauccgcgcaugccgccgcauagcccucgccacccacaccga

SEQ ID NO: 544728 - RNA, 62 nt, Human Herpes Virus 2
cgcgccccggcgggccggaccggccgcgguuuccgccgcagccguccgacaucgagacgugg

SEQ ID NO: 544729 - RNA, 62 nt, Human Herpes Virus 2; identical to SEQ ID NO: 544720

SEQ ID NO: 544730 - RNA, 62 nt, Human Herpes Virus 2; identical to SEQ ID NO: 544724

SEQ ID NO: 544731 - RNA, 64 nt, Human Herpes Virus 4 (Epstein Barr virus)
ggagcauggcguuauucuuggcgcgccacaccuuaucuggcacgggugcuggcugucacggccg

SEQ ID NO: 544732 - RNA, 64 nt, Human Herpes Virus 4 (Epstein Barr virus)
ugauuugauagaacuguguggcucucugcaccacaucuggcaaaacuugcuccagaccgaggag

SEQ ID NO: 544733 - RNA, 64 nt, Human Herpes Virus 4 (Epstein Barr virus)
ugcguggcuggacggaggacgauagcccaggcacaucuggcaccuguccuugucugcugccaug

SEQ ID NO: 544734 - RNA, 64 nt, Human Herpes Virus 4 (Epstein Barr virus)
cuuauuggagaugcucuggcgacuuggugccaccaucuggcagcuuuuggccuucuuccuagcc

SEQ ID NO: 544735 - RNA, 64 nt, Human Herpes Virus 4 (Epstein Barr virus)
cucgaaccagaaaaaaaccaaaacagaaggagcucgagaccaccaacggagauauccccaucac

SEQ ID NO: 544736 - RNA, 64 nt, Human Herpes Virus 4 (Epstein Barr virus)
cccuuugccuggggcucagacuuagggccggggccgagaccaaggcggcugcugagaccucugu

SEQ ID NO: 544737 - RNA, 64 nt, Human Herpes Virus 4 (Epstein Barr virus)
ucacccugcgcaagagcaugagggucccuggcuccgagaccaugugcuacucgcgcccccuggu

SEQ ID NO: 544738 - RNA, 64 nt, Human Herpes Virus 4 (Epstein Barr virus)
ucuuugaggggccgggucucgaggcccucuguggcgagaccagggagguguuuggguacgacgc

SEQ ID NO: 544739 - RNA, 64 nt, Human Herpes Virus 4 (Epstein Barr virus)
aucauauaagccugaagcccgugagcuggccugacgagaccaugaggccagccaagucuacaga

SEQ ID NO: 544740 - RNA, 64 nt, Human Hepatitis C Virus (HCV-N)
ccugcuccucuugacauuaccaccacgagcuuacgccauggaccgggagauggcugcaucgugc

SEQ ID NO: 544741 - RNA, 64 nt, Human Hepatitis C Virus (M1LE)
ucugcuccuguuggcguugccgccacgugcuuacgccauggaccgggagauggcugcaucaugu

SEQ ID NO: 544742 - RNA, 64 nt, Human Herpes Virus 1; identical to SEQ ID NO: 540722

SEQ ID NO: 544743 - RNA, 64 nt, Human Herpes Virus 1; identical to SEQ ID NO: 540723

SEQ ID NO: 544744 - RNA, 64 nt, Human Herpes Virus 1; identical to SEQ ID NO: 540724

SEQ ID NO: 544745 - RNA, 64 nt, Human Herpes Virus 1; identical to SEQ ID NO: 540725

SEQ ID NO: 544746 - RNA, 64 nt, Human Herpes Virus 1; identical to SEQ ID NO: 540726

SEQ ID NO: 544747 - RNA, 64 nt, Human Herpes Virus 1; identical to SEQ ID NO: 540727

SEQ ID NO: 544748 - RNA, 64 nt, Human Herpes Virus 1; identical to SEQ ID NO: 540728

SEQ ID NO: 544749 - RNA, 64 nt, Human Herpes Virus 1; identical to SEQ ID NO: 540729

SEQ ID NO: 544750 - RNA, 64 nt, Human Herpes Virus 1; identical to SEQ ID NO: 540730

SEQ ID NO: 544751 - RNA, 64 nt, Human Herpes Virus 2
cccgcauuuuggcuucgcggacuacgcgccccggcccugcgaccuaaagcacgagacgacgggg

SEQ ID NO: 544752 - RNA, 64 nt, Human Herpes Virus 4 (Epstein Barr virus)
gggaaugugugacaugcuauggugccggggcccacgugaacauccugcguggcuggacggagga

SEQ ID NO: 544753 - RNA, 61 nt, Human Herpes Virus 1
gcccuggcccgacagucuggucgcauuugcaccucggcacucggagcgagacgcagcagcc

SEQ ID NO: 544754 - RNA, 64 nt, Human Herpes Virus 1
uccgcgucgcccucgcccuggucgccgccuuugcccucggcauggccgugcuccgcugcacccg

SEQ ID NO: 544755 - RNA, 64 nt, Human Herpes Virus 1
ucgcgcacgucgcgcugugcgcgaucgggcggcgccucggcacuaucgucaccuacgacaccgg

SEQ ID NO: 544756 - RNA, 63 nt, Human Herpes Virus 2
cuauauaugcgacgaccacaugccgcggguggugacgcacaccaacgccacggccuguuccug

SEQ ID NO: 544757 - RNA, 63 nt, Human Herpes Virus 2
ggacgcccaccgcaucgaccacagcgccugccggacgcacagacagcuguacgcgcugcugau

SEQ ID NO: 544758 - RNA, 64 nt, Human Herpes Virus 4 (Epstein Barr virus)
acauucucgccuucuuugaccagcuuugccuccaucugggcacuucugacgcuugucuuaguca

SEQ ID NO: 544759 - RNA, 64 nt, Human Herpes Virus 4 (Epstein Barr virus)
gagccaggcacaucuacagcaucaacccagccucucugggcaaaauuagggcugggggcgucug

SEQ ID NO: 544760 - RNA, 64 nt, Human Herpes Virus 4 (Epstein Barr virus)
gcaucaugcagggugcacagacuagcgaggauaaucugggcagccagagccagccggguccgug

SEQ ID NO: 544761 - RNA, 64 nt, Human Herpes Virus 2
cguguuuaucacgauggacggcgccguucgccggacggccgaucuguuucugcccgacuccuuc

SEQ ID NO: 544762 - RNA, 64 nt, Human Herpes Virus 2
ccaggucggcggggggacccucaaguucuuccucacggccgacguccccagcgugugugucacc

SEQ ID NO: 544763 - RNA, 64 nt, Human Herpes Virus 2
aaccccggguccggugggcgccuccgccgcgcccacggccgauuccccccucaccgccucgccc

SEQ ID NO: 544764 - RNA, 64 nt, Human Herpes Virus 2
cgagcccgucuacgcggcggcgugcaacguggcgacggccgacuuuaaccgcaacgacggccgg

SEQ ID NO: 544765 - RNA, 64 nt, Human Herpes Virus 2
cguccaggccguccugggggcguuugagcgcggcacggccgaccagaugcugcacgugcuguug

SEQ ID NO: 544766 - RNA, 64 nt, Human Herpes Virus 2
cggggagacgacggggcgaccgagaggcacccggacggccgacgcaacgcgccgcccccggggc

SEQ ID NO: 544767 - RNA, 64 nt, Human Herpes Virus 2
guacgccgagcgcuuuuguuucguguuggucaccacggccgaguuuccucgggaccccgggcag

SEQ ID NO: 544768 - RNA, 64 nt, Human Herpes Virus 2
ucgccgacgcccccgagacgugacccggcaggacacggccgagagaucacgcccccacaaucgc

SEQ ID NO: 544769 - RNA, 64 nt, Human Herpes Virus 2
gagccugcggcgcacgcucgugggggaguuugagacggccgagcgccgcuucagcgccggccag

SEQ ID NO: 544770 - RNA, 64 nt, Human Herpes Virus 2
gccuuuacgcccccgcgaccucuuaugcgaaggcgaacgccacggucgaggugcgcgggggugu

SEQ ID NO: 544771 - RNA, 64 nt, Human Herpes Virus 2
caccgcauccgccggcacguaggcggcaaacgccgaacgccacggggugcagucgccggucgcg

SEQ ID NO: 544772 - RNA, 64 nt, Human Herpes Virus 2
accgggccggccgcuuucacugggagcgcuuuucgaacgccagcccgcgguacgagggcgagug

SEQ ID NO: 544773 - RNA, 64 nt, Human Herpes Virus 2
ccgccgccgagcccgugugcgagcugcccugucugaacgccaggcguuacggccccgaguguga

SEQ ID NO: 544774 - RNA, 64 nt, Human Herpes Virus 2
uguauguccugcgcguaugggucggcagcgcgacgaacgccagccgguuuguuuuggggguggc

SEQ ID NO: 544775 - RNA, 64 nt, Human Herpes Virus 2
ugaacugauugccaucgcggacgcacgcggggacccgccagagacccugccccccggcgcgggc

SEQ ID NO: 544776 - RNA, 64 nt, Human Herpes Virus 2
ugcgcgccgcccagcuccacgagcgauuuauggacgccaucacgcccgccgggaccgucaucac

SEQ ID NO: 544777 - RNA, 64 nt, Human Herpes Virus 2
ccgaggaggccguccuccucgacaagcaacaggccgccaucaagguggugugcaacucggugua

SEQ ID NO: 544778 - RNA, 64 nt, Human Herpes Virus 2
acacccucagugccgcguccuugaccucguucgccgccaucacucgguucuguugcacgagcca

SEQ ID NO: 544779 - RNA, 64 nt, Human Herpes Virus 2
gcuguggagccgucgcuccaucuccgugguccugcgccaucacuacgggaccaagcagcgcuuc

SEQ ID NO: 544780 - RNA, 64 nt, Human Herpes Virus 2
ggcggccggucgacggggugcuggucaccaccgccgccaucaaacagcgccuccugcaguccuu

SEQ ID NO: 544781 - RNA, 64 nt, Human Herpes Virus 2
augacguguuucaggccacuacgcccggccuguacgccaucagcgagcugcgcuucuggcuggc

SEQ ID NO: 544782 - RNA, 64 nt, Human Herpes Virus 2
ccaucuucaagcacauguucugcgauccgaugugcgccaucacggagauggaagucgaccccug

SEQ ID NO: 544783 - RNA, 64 nt, Human Herpes Virus 2
uggcuccuggagcgcucgcgaaagccgugucaaacgccaucaacccccgccaccccgacgcacc

SEQ ID NO: 544784 - RNA, 64 nt, Human Herpes Virus 2
ccaggagccaguccguucgcggacgccgggacagcgccaucacgcgggccccgcggggaggcua

SEQ ID NO: 544785 - RNA, 64 nt, Human Herpes Virus 1
acgccccgcgccaccacagacgcggggcguuccagcgcggcacgcgggcgccgcgcagcaacaa

SEQ ID NO: 544786 - RNA, 64 nt, Human Herpes Virus 1
cccgcaucgccggcuuuuuggccugccgggccacgcgcggcaugcgccacaucgcccuggggcg

SEQ ID NO: 544787 - RNA, 64 nt, Human Herpes Virus 1
cggacggccccggcgccccccauggcgaggcguggcgcggcagugagcagcccgacccacccgg

SEQ ID NO: 544788 - RNA, 64 nt, Human Herpes Virus 1
cugcgcuccaucagcuccagcggcauggccgcccgcgcggcagagcaucgacgcgucaagauua

SEQ ID NO: 544789 - RNA, 64 nt, Human Herpes Virus 1
accauuuacgggucgcccccagaggagacgccaggcgcggcacacggggugggcgccgcgccuc

SEQ ID NO: 544790 - RNA, 64 nt, Human Herpes Virus 1
gcuggugucccgccugugucacaccaacccgugcgcgcggcacgcgcugucgugagaaucagcg

SEQ ID NO: 544791 - RNA, 64 nt, Human Herpes Virus 1
cucgcaacguccaggccguccucggggcguuugagcgcggcacggccgaccagaugcugcacgu

SEQ ID NO: 544792 - RNA, 64 nt, Human Herpes Virus 1
aggagaugauggagcugaccgcgcgugcccuggagcgcggcaacggcgaguggucgacggacgc

SEQ ID NO: 544793 - RNA, 64 nt, Human Herpes Virus 1
cgccgaccuugucguccagggcccgagggauuucgcgcggcaugagggagagcaugccucccug

SEQ ID NO: 544794 - RNA, 64 nt, Human Herpes Virus 1
ccagacccagcucugccuuuuccaacaugcgccggcgcggcaccucucuggccucggggacccg

SEQ ID NO: 544795 - RNA, 64 nt, Human Herpes Virus 1
ucugaccugcaccgaucgcagcguccgguuggccgcgcggcaacacaacacgguucccgagagu

SEQ ID NO: 544796 - RNA, 64 nt, Human Herpes Virus 2
ccccgccucgcccgcgauguuuggccagcagcuggcguccgacgugcagcaguaccuggagcgc

SEQ ID NO: 544797 - RNA, 64 nt, Human Herpes Virus 2
gccgggcggcuccaggcccgccagcaccgccuccgcguccgacgcgcccagggcucccccgcug

SEQ ID NO: 544798 - RNA, 64 nt, Human Herpes Virus 2
guuucgcacgcuggugcagcgcauauggacgaccgcguccgacggagaggccguggagcuugcc

SEQ ID NO: 544799 - RNA, 64 nt, Human Herpes Virus 2
gugugcugcuguuggggccgcacccaccggccccgcguccgauacaacaaacgcgaccgcacgc

SEQ ID NO: 544800 - RNA, 64 nt, Human Herpes Virus 2
gagccgcguguuguucgcgggcgcgagcgccaacgcguccgaggccgccaaggcgcgggucgcc

SEQ ID NO: 544801 - RNA, 64 nt, Human Herpes Virus 2
acgugcuggucgcgcugguggccuggaggagcuggcguccgacgaacuucuggcgccuggaccu

SEQ ID NO: 544802 - RNA, 64 nt, Human Herpes Virus 2
ccgggaggcccgcggucaccccgggucccgacgcgcguccgaggcccgggcggcggcgcccccc

SEQ ID NO: 544803 - RNA, 64 nt, Human Herpes Virus 2
cguucugccccgcgucgggauccauaacgcgcccgcguccgacacccgggccccaaagcgugcc

SEQ ID NO: 544804 - RNA, 64 nt, Human Herpes Virus 4 (Epstein Barr virus)
gauguuuuacacgaggaucucuuaaauuucuaacucccguuauugaaaccacgccugcuucacg

SEQ ID NO: 544805 - RNA, 64 nt, Human Herpes Virus 4 (Epstein Barr virus)
uauucccccaccccucaaagcccaccuuucuuccucccguuaaaaggaagaagggccucaggga

SEQ ID NO: 544806 - RNA, 64 nt, Human Herpes Virus 4 (Epstein Barr virus)
gcgcggcccccgggguuugcccaacucuuauucuucccguuaacaggaagaaugaugguggggg

SEQ ID NO: 544807 - RNA, 64 nt, Human Herpes Virus 4 (Epstein Barr virus)
caccugugcucguauaguaagcuggaguuccaucucccguuaccugagagcauggccuccgugu

SEQ ID NO: 544808 - RNA, 64 nt, Human Herpes Virus 2
uucucauccaccgagccgugaccgucccggccaacggcgccacggucauacagccgucccuccg

SEQ ID NO: 544809 - RNA, 64 nt, Human Herpes Virus 2
ucgaaggucgggccgugucccucccggccauccccggcgccaugagccgccgggucaugaacgu

SEQ ID NO: 544810 - RNA, 64 nt, Human Herpes Virus 2
gucgccaccccgcgucggcgcggacggacggccccggcgccacccacggcgaggcgcggcgcgg

SEQ ID NO: 544811 - RNA, 64 nt, Human Herpes Virus 2
ggcugcucguaaaaauggcggccgccgcaacacccggcgccaagcgccccgcggaccccgcccg

SEQ ID NO: 544812 - RNA, 64 nt, Human Herpes Virus 2
ccacggccuggcguaugacgugccggagggcauccggcgccaccuucgcaaucccaagauucgg

SEQ ID NO: 544813 - RNA, 64 nt, Human Herpes Virus 2
agcugaacuacugccaccucaucacccccccgagcggcgccacggccgcgcuggagcgcguccg

SEQ ID NO: 544814 - RNA, 64 nt, Human Herpes Virus 2
uugcuggaaucgcuaccggccugggcaaggucaucggcgccacgcgcucagcgcgccgcgcucc

SEQ ID NO: 544815 - RNA, 64 nt, Human Herpes Virus 2
cgcuuaagauguccccgguuccccuggggcaacccggcgccaaccugaccaccccggcguacag

SEQ ID NO: 544816 - RNA, 64 nt, Human Herpes Virus 2
uggcgcggugccugacgccggccaaccucauccgcggcgccaacgcgggcguccccgagcggcg

SEQ ID NO: 544817 - RNA, 64 nt, Human Herpes Virus 2; identical to SEQ ID NO: 544751

SEQ ID NO: 544818 - RNA, 63 nt, Human Herpes Virus 2; identical to SEQ ID NO: 544590

SEQ ID NO: 544819 - RNA, 63 nt, Human Herpes Virus 2; identical to SEQ ID NO: 544591

SEQ ID NO: 544820 - RNA, 63 nt, Human Herpes Virus 2; identical to SEQ ID NO: 544592

SEQ ID NO: 544821 - RNA, 63 nt, Human Herpes Virus 2; identical to SEQ ID NO: 544590

SEQ ID NO: 544822 - RNA, 64 nt, Human Herpes Virus 2
uuucggucgccgcgaccaccgccacgcccggaacccggggcaccgcccguacccccccaacgga

SEQ ID NO: 544823 - RNA, 64 nt, Human Herpes Virus 2
cccuggcccgcgagauagucgcgcggcuggucgcccggggcauccgggaccucaaccccgaccc

SEQ ID NO: 544824 - RNA, 64 nt, Human Herpes Virus 2
gcggggcccacgagcauucgcugugcgagcagcuccggggcaucauugcggagggcggggcggc

SEQ ID NO: 544825 - RNA, 64 nt, Human Herpes Virus 2
acucggcgccgcgucgacgccuggccgacuggcgccggggcaagcgaggcggagugggacgagg

SEQ ID NO: 544826 - RNA, 64 nt, Human Herpes Virus 2
cucgccaccagcccccaggcgcggcccagcgcgcccggggcagcgcggggccagccccuagaug

SEQ ID NO: 544827 - RNA, 64 nt, Human Herpes Virus 2
acuuugccuccccggccgacccaaagguguuuuuccgccagacgcugcagcagggcgaggcgcu

SEQ ID NO: 544828 - RNA, 64 nt, Human Herpes Virus 2
guacgcucucguaaaugcuucccugcuggugccgaucugggaccgcgccgcggagacauucgag

SEQ ID NO: 544829 - RNA, 64 nt, Human Herpes Virus 4 (Epstein Barr virus)
cagaaucuccuagcucagaugaagauuauguggagggacccaguaaaagaccucgccccuccau

SEQ ID NO: 544830 - RNA, 64 nt, Human Herpes Virus 4 (Epstein Barr virus)
ugcggaugcagccaaucccauuuaaucauccagugggacccacuccccaucagacaccucaagu

SEQ ID NO: 544831 - RNA, 64 nt, Human Herpes Virus 4 (Epstein Barr virus)
accccaaaaacguccaaguugcauuggcugcaaagggacccacgguggaacaggagcaggagca

SEQ ID NO: 544832 - RNA, 64 nt, Human Herpes Virus 4 (Epstein Barr virus)
gggagcaacuggccucuuuuuugucucugcccccgggacccacguuuacagacuuuagacuauu

SEQ ID NO: 544833 - RNA, 64 nt, Human Herpes Virus 4 (Epstein Barr virus)
ucugcccaaccacggcaacccuuccacggcagaggggacccacgucuccuguaaccaccuggcg

SEQ ID NO: 544834 - RNA, 64 nt, Human Herpes Virus 4 (Epstein Barr virus); identical to SEQ ID NO: 544829

SEQ ID NO: 544835 - RNA, 64 nt, Human Herpes Virus 4 (Epstein Barr virus); identical to SEQ ID NO: 544830

SEQ ID NO: 544836 - RNA, 64 nt, Human Herpes Virus 4 (Epstein Barr virus); identical to SEQ ID NO: 544831

SEQ ID NO: 544837 - RNA, 64 nt, Human Herpes Virus 4 (Epstein Barr virus); identical to SEQ ID NO: 544832

SEQ ID NO: 544838 - RNA, 64 nt, Human Herpes Virus 4 (Epstein Barr virus); identical to SEQ ID NO: 544833

SEQ ID NO: 544839 - RNA, 64 nt, Human Herpes Virus 2
cagacccggcggucgcggcgccgggucgccgcgaccgccagaccgcaaaggccccccuccccga

SEQ ID NO: 544840 - RNA, 64 nt, Human Herpes Virus 2; identical to SEQ ID NO: 544775

SEQ ID NO: 544841 - RNA, 64 nt, Human Herpes Virus 2
gccgccgcgacccaccgcaccgccgccgcggccgccgccagacaggaccugguucuggccgcgg

SEQ ID NO: 544842 - RNA, 64 nt, Human Herpes Virus 2; identical to SEQ ID NO: 544839

SEQ ID NO: 544843 - RNA, 64 nt, Human Herpes Virus 2; identical to SEQ ID NO: 544841

SEQ ID NO: 544844 - RNA, 64 nt, Human Herpes Virus 2; identical to SEQ ID NO: 544827

SEQ ID NO: 544845 - RNA, 64 nt, Human Herpes Virus 4 (Epstein Barr virus); identical to SEQ ID NO: 544829

SEQ ID NO: 544846 - RNA, 64 nt, Human Herpes Virus 4 (Epstein Barr virus); identical to SEQ ID NO: 544830

SEQ ID NO: 544847 - RNA, 64 nt, Human Herpes Virus 4 (Epstein Barr virus); identical to SEQ ID NO: 544831

SEQ ID NO: 544848 - RNA, 64 nt, Human Herpes Virus 4 (Epstein Barr virus); identical to SEQ ID NO: 544832

SEQ ID NO: 544849 - RNA, 64 nt, Human Herpes Virus 4 (Epstein Barr virus); identical to SEQ ID NO: 544833

SEQ ID NO: 544850 - RNA, 64 nt, Human Herpes Virus 2
aaucgaccuaggauuggaccuguccgacagcgagcucgaggaggacgcucuggagcgggacgag

SEQ ID NO: 544851 - RNA, 64 nt, Human Herpes Virus 2
auuuguaaucggacgaugaggcucuggccacggcccgcgcgaccgcggggcagcucguugcaaa

SEQ ID NO: 544852 - RNA, 64 nt, Human Herpes Virus 2
ccuccgucgcggcggcgggagccgcggcccccagccgcgcgacguagcgacaaaaguggcgaca

SEQ ID NO: 544853 - RNA, 64 nt, Human Herpes Virus 2
ggcggagguggaucggcaccugcagugccgugccccgcgcgaucucugcgagcgccuggcggcg

SEQ ID NO: 544854 - RNA, 64 nt, Human Herpes Virus 2
gugggccgagagugccguggaaaccaccaccagcccgcgcgagcucgcgggccacgccccgcuc

SEQ ID NO: 544855 - RNA, 64 nt, Human Herpes Virus 2
cgccgccccccuuucggaggacgcgaucccgucgccgcgcgagcggacggaagacuggccgccc

SEQ ID NO: 544856 - RNA, 64 nt, Human Herpes Virus 2
accuuugcgggcgcgcucgcgcuggccgccugcgccgcgcgagggucugacgcggcuccgucag

SEQ ID NO: 544857 - RNA, 64 nt, Human Herpes Virus 2
gaccgccguccacaccgcguccuuguucucggccccgcgcgaccccgaaaggcggccgugcgac

SEQ ID NO: 544858 - RNA, 64 nt, Human Herpes Virus 2
gcgcuucggccccgacacgcuggugcccauguccccgcgcgaguaccgccgcgccgugcucccg

SEQ ID NO: 544859 - RNA, 64 nt, Human Herpes Virus 2
caccaccuccgcgcagcugauggaggcccuggggccgcgcgacaauaucgucuacguccccgag

SEQ ID NO: 544860 - RNA, 64 nt, Human Herpes Virus 2
cgggcgaucgagagcgcgguaucgaugccgcggcccgcgcgacgcguauacagcgcgaaggccc

SEQ ID NO: 544861 - RNA, 64 nt, Human Herpes Virus 2
ccccccccuccagcccccggacgucgccggugggccgcgcgacggcgcccggucguccuccucg

SEQ ID NO: 544862 - RNA, 64 nt, Human Herpes Virus 2
gcacguacaccccccugcgcuacgcgugcguccuccgcgcgacccagccccuguacgcgcggac

SEQ ID NO: 544863 - RNA, 64 nt, Human Herpes Virus 2
accugacggaucggcgggcaaaaaccagccccucccgcgcgauggguuuucugguggacgccau

SEQ ID NO: 544864 - RNA, 64 nt, Human Herpes Virus 2
gacucgucuucggacgacgacgagucccgggauaccgcgcgaccgcgucguucggcguccgucg

SEQ ID NO: 544865 - RNA, 64 nt, Human Herpes Virus 2
cuauggcccggucuccccggcggacccagagaguccgcgcgacgacuuccgccgcggcgcuggc

SEQ ID NO: 544866 - RNA, 64 nt, Human Herpes Virus 2; identical to SEQ ID NO: 544858

SEQ ID NO: 544867 - RNA, 64 nt, Human Herpes Virus 2; identical to SEQ ID NO: 541713

SEQ ID NO: 544868 - RNA, 64 nt, Human Herpes Virus 2; identical to SEQ ID NO: 541714

SEQ ID NO: 544869 - RNA, 64 nt, Human Herpes Virus 2; identical to SEQ ID NO: 541715

SEQ ID NO: 544870 - RNA, 64 nt, Human Herpes Virus 2; identical to SEQ ID NO: 541716

SEQ ID NO: 544871 - RNA, 64 nt, Human Herpes Virus 2; identical to SEQ ID NO: 541717

SEQ ID NO: 544872 - RNA, 64 nt, Human Herpes Virus 2; identical to SEQ ID NO: 541718

SEQ ID NO: 544873 - RNA, 64 nt, Human Herpes Virus 2; identical to SEQ ID NO: 541719

SEQ ID NO: 544874 - RNA, 64 nt, Human Herpes Virus 2; identical to SEQ ID NO: 541720

SEQ ID NO: 544875 - RNA, 64 nt, Human Herpes Virus 2; identical to SEQ ID NO: 541721

SEQ ID NO: 544876 - RNA, 64 nt, Human Herpes Virus 2; identical to SEQ ID NO: 541722

SEQ ID NO: 544877 - RNA, 64 nt, Human Herpes Virus 2; identical to SEQ ID NO: 541723

SEQ ID NO: 544878 - RNA, 64 nt, Human Herpes Virus 2; identical to SEQ ID NO: 541724

SEQ ID NO: 544879 - RNA, 64 nt, Human Herpes Virus 2; identical to SEQ ID NO: 541718

SEQ ID NO: 544880 - RNA, 64 nt, Human Herpes Virus 1
cugaagcgcggcccggauggccuggcccagggcccggaggcacgccagauguaugcgcgcggua

SEQ ID NO: 544881 - RNA, 64 nt, Human Herpes Virus 1
cccgcguucccccccgccgccaccggaucccaaccggaggcauccaacgcggaggccggggccc

SEQ ID NO: 544882 - RNA, 64 nt, Human Herpes Virus 1
gcacccuggggauggucgucggcgggcugacgaucggaggcagcgcgcgcuacugguggaucgg

SEQ ID NO: 544883 - RNA, 64 nt, Human Herpes Virus 1
ugggccugacaacggcaugcgugccggaggaggacgcacucacggcccggggccuuauggagga

SEQ ID NO: 544884 - RNA, 64 nt, Human Herpes Virus 1
cuacgcgugcccgcgugggggcgcuguuugcgcacgcacucauccagcgccaaccccaacgcug

SEQ ID NO: 544885 - RNA, 64 nt, Human Herpes Virus 1; identical to SEQ ID NO: 544883

SEQ ID NO: 544886 - RNA, 64 nt, Human Herpes Virus 1; identical to SEQ ID NO: 544884

SEQ ID NO: 544887 - RNA, 64 nt, Human Herpes Virus 4 (Epstein Barr virus)
acgcgggucucagggcagcccugcagcgggccaggccggagauugagagugacauggagguguu

SEQ ID NO: 544888 - RNA, 64 nt, Human Herpes Virus 4 (Epstein Barr virus)
acagccagauuuucaaguuuuuggaaacgaagcugccggagaaccacgagaggugcccgggcau

SEQ ID NO: 544889 - RNA, 64 nt, Human Herpes Virus 4 (Epstein Barr virus)
ggcuccgugacaagguggcggccgccgucacccugccggagaagauucuuguguuccugcugau

SEQ ID NO: 544890 - RNA, 64 nt, Human Herpes Virus 4 (Epstein Barr virus)
ggcccaggaauagauacagccagcucccugaggagccggagaccuuugagugcccggaccgcug

SEQ ID NO: 544891 - RNA, 64 nt, Human Herpes Virus 4 (Epstein Barr virus)
cccaccaccugacccccacgcucuaucuggagccgccggagauguuugucuacaucacacuggu

SEQ ID NO: 544892 - RNA, 64 nt, Human Herpes Virus 4 (Epstein Barr virus)
uugaugacaugacggagacccucuauguaaagcugccggagaacaugacgcgcugugaucaccu

SEQ ID NO: 544893 - RNA, 64 nt, Human Herpes Virus 4 (Epstein Barr virus)
cggccagagcauggcccaggccuuuuucaucuacgccggagaccccucuaucagcaccaucaug

SEQ ID NO: 544894 - RNA, 64 nt, Human Herpes Virus 4 (Epstein Barr virus)
gucaugcuuccucugcggcugaccaggcuggggugccggagagagguagaaagcgggcccauga

SEQ ID NO: 544895 - RNA, 64 nt, Human Herpes Virus 4 (Epstein Barr virus)
uuugccagggacagaagagcucucugaccccggugccggagacgggcagcuacguggcgggggc

SEQ ID NO: 544896 - RNA, 64 nt, Human Herpes Virus 2
ucgacgucagcaaguccauggacgacgacacguacguggccaacaguuuccagcaccaguacau

SEQ ID NO: 544897 - RNA, 64 nt, Human Herpes Virus 2
cuacgggccccccgaagaaacgggccaagguggacguggccacccacgggcagacguacggcac

SEQ ID NO: 544898 - RNA, 64 nt, Human Herpes Virus 2
cgacgcgcucggcggcacaggccuccgucagggccguggccagcucggaggacagccgcggggg

SEQ ID NO: 544899 - RNA, 64 nt, Human Herpes Virus 2
uggcggucgagggcaacagcagccaggacucggccguggccaucgccacacacgugcauaccga

SEQ ID NO: 544900 - RNA, 64 nt, Human Herpes Virus 2
uugcgcuccacgcuaacaucaucauggcucucaccguggccaucguccacaacgcccccgcccg

SEQ ID NO: 544901 - RNA, 64 nt, Human Herpes Virus 2
gcuucggcuggggccuggcgcacguggcggccgccguggccaugagccgccgcuacgaccgcgc

SEQ ID NO: 544902 - RNA, 64 nt, Human Herpes Virus 2
uguuugcaacgagcugccccgcggucgcgcgggccguggccagagccucaucguccgauuacaa

SEQ ID NO: 544903 - RNA, 64 nt, Human Herpes Virus 2
ggcaggaugccgugugugaguucaucgccacccccguggccacggacaucaacuacuuucgccg

SEQ ID NO: 544904 - RNA, 64 nt, Human Herpes Virus 2
ugcccguccacgcgcuguuugcgggcgccgaccacguggccaacgcgcccaacuuccccccggc

SEQ ID NO: 544905 - RNA, 64 nt, Human Herpes Virus 2
ucggcccugggcgcggccgcgccgucccggcgaccguggccaagcuuccucgcggugcuggccg

SEQ ID NO: 544906 - RNA, 64 nt, Human Herpes Virus 2; identical to SEQ ID NO: 544901

SEQ ID NO: 544907 - RNA, 64 nt, Human Herpes Virus 2
acgcccugggccgcgggaccccauugcucccggcccacgucacagcaacucuggacuuggaggc

SEQ ID NO: 544908 - RNA, 64 nt, Human Herpes Virus 2
cgggcccgugccccccgcggacccuacaccggacccacgucaucgcacguccgcccccaaacgc

SEQ ID NO: 544909 - RNA, 64 nt, Human Herpes Virus 2
ccaucgcccgccgccuggcggaccgcaucuguaaccacgucacccaacaggcccaggugcggcu

SEQ ID NO: 544910 - RNA, 64 nt, Human Herpes Virus 2
cggaacaccgcggcuaugucgccggacgucgccgccacgucauccacgacgccccggaggcccu

SEQ ID NO: 544911 - RNA, 64 nt, Human Herpes Virus 2
ugcgucgggcgacgcgauuuacggccugccaacaccacgucaacgugggaaccgccugugucgu

SEQ ID NO: 544912 - RNA, 64 nt, Human Herpes Virus 2
gccugcggggcugguuuggcucgucccggguggaccacgucaagggggaaaccaucucguucuc

SEQ ID NO: 544913 - RNA, 64 nt, Human Herpes Virus 2
accgucuuugggccccgccccgccccaccccgccccacgucaccgggggccccggguucccauu

SEQ ID NO: 544914 - RNA, 64 nt, Human Herpes Virus 1
guggacgaucgcgcaguagcggcgcucgcgguuaaagaaaaagagggcaaagaagguguucggg

SEQ ID NO: 544915 - RNA, 64 nt, Human Herpes Virus 1
cgaaaagacguucaccaagcugcugcugaucgccaagaaaaaguacaucggcgucaucuacggg

SEQ ID NO: 544916 - RNA, 64 nt, Human Herpes Virus 4 (Epstein Barr virus)
caugucaguuaucaggcaguugacgguaguucuuguucuguaaguccauaucaaccacccgggg

SEQ ID NO: 544917 - RNA, 63 nt, Human Herpes Virus 2
ggaagagcucgacaccauggaccgggaggcacuucgggccaucagccgcgggugcaagccccc

SEQ ID NO: 544918 - RNA, 63 nt, Human Herpes Virus 2
caggagauggacguguuucgcuacgucgcggacucgggccagaccgacgugcccugcaaccug

SEQ ID NO: 544919 - RNA, 63 nt, Human Herpes Virus 2
acaggaggcgcagcugguucauacccaauggcuucgggccaacagggaguccucgccgcugug

SEQ ID NO: 544920 - RNA, 64 nt, Human Herpes Virus 4 (Epstein Barr virus)
agcaaggagcacuuggucaggcacacggacagggucagcggaggacgcguggcacagcagcccg

SEQ ID NO: 544921 - RNA, 64 nt, Human Herpes Virus 2
aaaucuuaagccgcucguccccccgaacgacgcgccacacgaagacagaguuggcgaugcgcgc

SEQ ID NO: 544922 - RNA, 64 nt, Human Herpes Virus 1
cccccacaccaccuacuacgaugggggcguagagcuguggcacuaccccaugggacacaaaugc

SEQ ID NO: 544923 - RNA, 64 nt, Human Herpes Virus 1
acgccuaccucugccugggguuuaaucgccgccucuguggcauaguugucuuucccggcggcuu

SEQ ID NO: 544924 - RNA, 64 nt, Human Herpes Virus 1
cgacguccugggccaccugacgcgccuagccaaccuguggcagaccggcaagcggagcggcggu

SEQ ID NO: 544925 - RNA, 57 nt, Human Herpes Virus 2
uggcgaucggcgggaaaaccaugaaaaccaagccacucccgacagccccgauggcgu

SEQ ID NO: 544926 - RNA, 64 nt, Human Herpes Virus 1
cagcgacucugaggcggagaccgaagugggggggcggggggacgccgaccaccaugacgacgac

SEQ ID NO: 544927 - RNA, 64 nt, Human Herpes Virus 1
ccggcaguugcgggggcgcccccccucgagaggacggggggagcgacgagggcgacgugugcgc

SEQ ID NO: 544928 - RNA, 64 nt, Human Herpes Virus 1
cgcaccacgcucgcgggcccccacuacgcgugcgcggggggacacggaagcgcugugcuccccc

SEQ ID NO: 544929 - RNA, 64 nt, Human Herpes Virus 1
aagagaagacacacaggcgccacccggcgcuggucggggggauguuguccgcgccgcaccgucc

SEQ ID NO: 544930 - RNA, 64 nt, Human Herpes Virus 1
ggccgccggggucccagcugcgccaugccgggggcggggggagggcaaaccccagaggcggggg

SEQ ID NO: 544931 - RNA, 50 nt, Human Herpes Virus 1
accgcuuccugcucgucgggcggggggaagccacugugguccuccgggac

SEQ ID NO: 544932 - RNA, 64 nt, Human Herpes Virus 1
uucgcgcccagcuccuggcggcccuggccgaccucggggggagcgggcuggcggacccccacgg

SEQ ID NO: 544933 - RNA, 64 nt, Human Herpes Virus 1; identical to SEQ ID NO: 544927

SEQ ID NO: 544934 - RNA, 64 nt, Human Herpes Virus 1; identical to SEQ ID NO: 544926

SEQ ID NO: 544935 - RNA, 64 nt, Human Herpes Virus 4 (Epstein Barr virus)
ugcgguugaucuggcggcgcagggagucguaggcaaauuggaucuggacgguggcgggauuguu

SEQ ID NO: 544936 - RNA, 64 nt, Human Herpes Virus 4 (Epstein Barr virus)
ugacaugauuagaaaugccaaccucggcuacuacaaauuggaguuucugaaauccauccucacc

SEQ ID NO: 544937 - RNA, 60 nt, Human Herpes Virus 4 (Epstein Barr virus)
gcauagaagccggcccuccuuccgucaguuccaggccaucaaucaccuuguccuguuuga

SEQ ID NO: 544938 - RNA, 60 nt, Human Herpes Virus 4 (Epstein Barr virus)
gcacggauucauucaugccgcggggaccauccaggccaacugcccacagcuguuuaugag

SEQ ID NO: 544939 - RNA, 60 nt, Human Herpes Virus 4 (Epstein Barr virus)
caggggcaccucagggugccuccccgggucccaggccagccggagggaccccggcagccc

SEQ ID NO: 544940 - RNA, 60 nt, Human Herpes Virus 4 (Epstein Barr virus)
agaccccagcuucuggccuccccggguccaccaggccagccggagggaccccggcagccc

SEQ ID NO: 544941 - RNA, 60 nt, Human Herpes Virus 4 (Epstein Barr virus)
uaccugccccucuuggccacgcaccccgggccaggccaccuuagacccggccaagcccca

SEQ ID NO: 544942 - RNA, 60 nt, Human Herpes Virus 4 (Epstein Barr virus); identical to SEQ ID NO: 544939

SEQ ID NO: 544943 - RNA, 60 nt, Human Herpes Virus 4 (Epstein Barr virus); identical to SEQ ID NO: 544940

SEQ ID NO: 544944 - RNA, 60 nt, Human Herpes Virus 4 (Epstein Barr virus); identical to SEQ ID NO: 544941

SEQ ID NO: 544945 - RNA, 60 nt, Human Herpes Virus 4 (Epstein Barr virus); identical to SEQ ID NO: 544939

SEQ ID NO: 544946 - RNA, 60 nt, Human Herpes Virus 4 (Epstein Barr virus); identical to SEQ ID NO: 544940

SEQ ID NO: 544947 - RNA, 60 nt, Human Herpes Virus 4 (Epstein Barr virus); identical to SEQ ID NO: 544941

SEQ ID NO: 544948 - RNA, 60 nt, Human Herpes Virus 4 (Epstein Barr virus); identical to SEQ ID NO: 544939

SEQ ID NO: 544949 - RNA, 60 nt, Human Herpes Virus 4 (Epstein Barr virus); identical to SEQ ID NO: 544940

SEQ ID NO: 544950 - RNA, 60 nt, Human Herpes Virus 4 (Epstein Barr virus); identical to SEQ ID NO: 544939

SEQ ID NO: 544951 - RNA, 60 nt, Human Herpes Virus 4 (Epstein Barr virus); identical to SEQ ID NO: 544940

SEQ ID NO: 544952 - RNA, 60 nt, Human Herpes Virus 4 (Epstein Barr virus); identical to SEQ ID NO: 544939

SEQ ID NO: 544953 - RNA, 60 nt, Human Herpes Virus 4 (Epstein Barr virus); identical to SEQ ID NO: 544940

SEQ ID NO: 544954 - RNA, 60 nt, Human Herpes Virus 4 (Epstein Barr virus); identical to SEQ ID NO: 544939

SEQ ID NO: 544955 - RNA, 60 nt, Human Herpes Virus 4 (Epstein Barr virus); identical to SEQ ID NO: 544940

SEQ ID NO: 544956 - RNA, 60 nt, Human Herpes Virus 4 (Epstein Barr virus); identical to SEQ ID NO: 544939

SEQ ID NO: 544957 - RNA, 60 nt, Human Herpes Virus 4 (Epstein Barr virus); identical to SEQ ID NO: 544940

SEQ ID NO: 544958 - RNA, 60 nt, Human Herpes Virus 4 (Epstein Barr virus)
cgccggucaggggacgggccucagcaccucccaggccaccagccccaguucagcaaucca

SEQ ID NO: 544959 - RNA, 60 nt, Human Herpes Virus 4 (Epstein Barr virus)
uaucuucaucucgucugugaacucggcugaccaggccaccagcuuucuuuauaagcugaa

SEQ ID NO: 544960 - RNA, 60 nt, Human Herpes Virus 4 (Epstein Barr virus)
acguggcaggggacggaccugcucggggggccaggccaccaugcuaucgguuuaaacgcg

SEQ ID NO: 544961 - RNA, 60 nt, Human Herpes Virus 4 (Epstein Barr virus)
agcuccgagaacaggaagacaucuggucacccaggccaggagcgcgagaggcgaaugagg

SEQ ID NO: 544962 - RNA, 60 nt, Human Herpes Virus 4 (Epstein Barr virus)
gugacacuauacagcagauuacgaucuccuccaggccacggaugaacauccugaaaucca

SEQ ID NO: 544963 - RNA, 60 nt, Human Herpes Virus 4 (Epstein Barr virus)
ccacgacaaccccgaagccacacuaaugacccaggccagggcggcccucaccauccccgu

SEQ ID NO: 544964 - RNA, 60 nt, Human Herpes Virus 4 (Epstein Barr virus)
cacgcuucaaggguuucuaugcuuggccggccaggccaccugccggggccaguggaaucc

SEQ ID NO: 544965 - RNA, 60 nt, Human Herpes Virus 4 (Epstein Barr virus)
caucaagaugucccccauggccuauauugcccaggccaagcucaagauccacccaggggu

SEQ ID NO: 544966 - RNA, 60 nt, Human Herpes Virus 4 (Epstein Barr virus)
ucugaaucuggaugaugcccaagacacccgccaggccaaggcucagaggaaggagagcau

SEQ ID NO: 544967 - RNA, 60 nt, Human Herpes Virus 4 (Epstein Barr virus)
caucucagucucccagugcgugcccguuaaccaggccaccgucacccugcgcaagagcau

SEQ ID NO: 544968 - RNA, 60 nt, Human Herpes Virus 4 (Epstein Barr virus)
ggagcugcuggagaagcagagccugcaggaccaggccaagguggccaagguggccccccu

SEQ ID NO: 544969 - RNA, 64 nt, Human Herpes Virus 2
acgugcacgaggccguaaacugcuuggaggcccucugggacacccagaugcgccugguggucgu

SEQ ID NO: 544970 - RNA, 64 nt, Human Herpes Virus 2
cgcgugggacgaguccgugcgcucggcccuggcccugggacauccggccggguucuacccgugu

SEQ ID NO: 544971 - RNA, 64 nt, Human Herpes Virus 2
caacgccuacuacagcguccugaacacguuucaggcccugcaccgcuccgaagccuuucggcag

SEQ ID NO: 544972 - RNA, 64 nt, Human Herpes Virus 2
acguccugcggcucaugaacgacugggccgaugugcccugcaaccccuaccugcgcgugcagaa

SEQ ID NO: 544973 - RNA, 64 nt, Human Herpes Virus 2
guacugucugaaugccacguggcaggccgaaaacgcccugcacacgaccaaaacggaccccgcg

SEQ ID NO: 544974 - RNA, 64 nt, Human Herpes Virus 2
gaccggcucgccgcgcggggggcugauguccguggcccugcagacggacaacuacacgcugaug

SEQ ID NO: 544975 - RNA, 64 nt, Human Herpes Virus 2
cccccguggccacggacaucaacuacuuucgccggcccugcaacccgcggggacgcgcggccgg

SEQ ID NO: 544976 - RNA, 64 nt, Human Herpes Virus 2
ggggaggcuggagacgauuaucggcaaccgcgaggcccugcacacgguggugaacaacaucaag

SEQ ID NO: 544977 - RNA, 64 nt, Human Herpes Virus 2
cgcggccaccgagcgcgucauggccgagcucgaggcccugcaguacguggaccaggcggugccc

SEQ ID NO: 544978 - RNA, 64 nt, Human Herpes Virus 2
uucgcuacgucgcggacucgggccagaccgacgugcccugcaaccuguguaccuucgagacccg

SEQ ID NO: 544979 - RNA, 64 nt, Human Herpes Virus 2
ccacgcgacgccgcgccgacacgagcagcugcgcgcccugcaggcugacggcgaagauggcggc

SEQ ID NO: 544980 - RNA, 64 nt, Human Herpes Virus 2
cggccgcggucgugcccaugcccccagcgggcgcgcccugcagggccuuugaccaacacacgcg

SEQ ID NO: 544981 - RNA, 64 nt, Human Herpes Virus 2
ccccgcccgcgaagcccucguauacagcgcgaaggcccugcaggccaccgcacgccgccccgcc

SEQ ID NO: 544982 - RNA, 63 nt, Human Herpes Virus 2
cuacgcgcuggcccuccgggcacgccugugcguuuguuguauguaaccugaccggagucccgg

SEQ ID NO: 544983 - RNA, 60 nt, Human Herpes Virus 2
cacgggccuaauauaccgacaugggcguuguuguuguaagugugguuacccuccuagacc

SEQ ID NO: 544984 - RNA, 64 nt, Human Hepatitis C Virus (HCV-N)
uacuuagcgggcuuauccacccugccugggaaccccgcgauagcaucacugauggcauucacag

SEQ ID NO: 544985 - RNA, 64 nt, Human Herpes Virus 4 (Epstein Barr virus)
ccugaugaggaugaucaacagccacguggaguaccacaacuauggcugcaagaggccggucagu

SEQ ID NO: 544986 - RNA, 64 nt, Human Herpes Virus 4 (Epstein Barr virus)
gauuguuacaaccuuugugcauuaugccaacuuucacaacuacuuuguacccaaccugaaggau

SEQ ID NO: 544987 - RNA, 64 nt, Human Herpes Virus 2; identical to SEQ ID NO: 544194

SEQ ID NO: 544988 - RNA, 64 nt, Human Herpes Virus 2; identical to SEQ ID NO: 544195

SEQ ID NO: 544989 - RNA, 64 nt, Human Herpes Virus 2; identical to SEQ ID NO: 544196

SEQ ID NO: 544990 - RNA, 64 nt, Human Herpes Virus 2; identical to SEQ ID NO: 544197

SEQ ID NO: 544991 - RNA, 64 nt, Human Herpes Virus 2; identical to SEQ ID NO: 544198

SEQ ID NO: 544992 - RNA, 64 nt, Human Herpes Virus 2; identical to SEQ ID NO: 544199

SEQ ID NO: 544993 - RNA, 64 nt, Human Herpes Virus 2
aucuccggccgacgcgccgugcgccguaaguuccugggcguaccgccuggcgguccgcagcuac

SEQ ID NO: 544994 - RNA, 64 nt, Human Herpes Virus 2
cggggcgcuggcgcaggggggugagccggagacgugggcguacgccgaccugauccugcugcug

SEQ ID NO: 544995 - RNA, 64 nt, Human Herpes Virus 2
guccuggugcccuuuuaucuaggcaugaccucgaugggcguauguaugaucgcgcacguguauc

SEQ ID NO: 544996 - RNA, 64 nt, Human Herpes Virus 2
ugggggggcgagggaggcagggaggagcccgagagcgggggacagggggggagacgaggggucg

SEQ ID NO: 544997 - RNA, 64 nt, Human Herpes Virus 2
uuacgacaccguggagggguaugcgccaagguccgcgggggagccgguguacagcaccguucgg

SEQ ID NO: 544998 - RNA, 64 nt, Human Herpes Virus 2
cgcgggaaagcgacgcagcagcgccgucugggccgcgggggacagcuggugggggcgcacgacg

SEQ ID NO: 544999 - RNA, 64 nt, Human Herpes Virus 2
gaccggcgacgaccggcccguccuaacaaagucggcgggggagcgguuucugcuguaccgcccc

SEQ ID NO: 545000 - RNA, 64 nt, Human Herpes Virus 2
aagucuagacgcgcgcuacgucucgcgagacggcgcgggggacgcggccgucugguucgaggac

SEQ ID NO: 545001 - RNA, 64 nt, Human Herpes Virus 2
ccgacgcgugugugcgcguggcugaggcuggucggcgggggagcggccguggcccuguggagcc

SEQ ID NO: 545002 - RNA, 64 nt, Human Herpes Virus 2
augccucccccggacgcacgauaacggugggcccgcgggggaacgcgagcaaugccgcccccuc

SEQ ID NO: 545003 - RNA, 64 nt, Human Herpes Virus 2
gccgggggggcgguggcccugccggccagacggcgcgggggaucgcuggucuacgcgggcgagc

SEQ ID NO: 545004 - RNA, 64 nt, Human Herpes Virus 2
cggaaccaucaaggacgucuccggugcaucccccgcgggggaauacacgauaaacgguaucgug

SEQ ID NO: 545005 - RNA, 64 nt, Human Herpes Virus 2
ccacgcccugcuguaucuggucugucgcgacgccgcgggggaggcgcgcgcgcgcuucgcggag

SEQ ID NO: 545006 - RNA, 64 nt, Human Herpes Virus 2
ccgcgcugaccccgaggaacuuuugucuguuuuugcgggggauacauuuugaugcccugagggc

SEQ ID NO: 545007 - RNA, 64 nt, Human Herpes Virus 2
cuccgccagggcgcccugguccaccaggccgucagcgggggagcccugggcgcgucggacgcgg

SEQ ID NO: 545008 - RNA, 64 nt, Human Herpes Virus 2
caacccgcggggacgcgcggccggcggcguguacgcgggggacaaggagggggacgucauagcc

SEQ ID NO: 545009 - RNA, 61 nt, Human Herpes Virus 4 (Epstein Barr virus)
cccucgaggccgcccuggccgcuucaucuucuuccaggacgucauggcccuaccggaaauc

SEQ ID NO: 545010 - RNA, 61 nt, Human Herpes Virus 4 (Epstein Barr virus)
ccggcaugagcaucacgaccucuugaaucucuuccaggaaauggugccggaugagauagcc

SEQ ID NO: 545011 - RNA, 60 nt, Human Herpes Virus 4 (Epstein Barr virus)
acagaccccgggugggauccauggcuggauuuccaggaaaggaggccggcccgcccggcg

SEQ ID NO: 545012 - RNA, 61 nt, Human Herpes Virus 4 (Epstein Barr virus)
gggcggcacgcccucucucuggggguuuacauuccaggaggcggcgugcgaccaaugggug

SEQ ID NO: 545013 - RNA, 64 nt, Human Herpes Virus 2; identical to SEQ ID NO: 543493

SEQ ID NO: 545014 - RNA, 64 nt, Human Herpes Virus 1; identical to SEQ ID NO: 539804

SEQ ID NO: 545015 - RNA, 64 nt, Human Herpes Virus 1; identical to SEQ ID NO: 539805

SEQ ID NO: 545016 - RNA, 64 nt, Human Herpes Virus 1; identical to SEQ ID NO: 539806

SEQ ID NO: 545017 - RNA, 64 nt, Human Herpes Virus 1; identical to SEQ ID NO: 539807

SEQ ID NO: 545018 - RNA, 64 nt, Human Herpes Virus 1; identical to SEQ ID NO: 539808

SEQ ID NO: 545019 - RNA, 64 nt, Human Herpes Virus 1; identical to SEQ ID NO: 539809

SEQ ID NO: 545020 - RNA, 64 nt, Human Herpes Virus 1; identical to SEQ ID NO: 539810

SEQ ID NO: 545021 - RNA, 64 nt, Human Herpes Virus 1; identical to SEQ ID NO: 539811

SEQ ID NO: 545022 - RNA, 64 nt, Human Herpes Virus 1; identical to SEQ ID NO: 539812

SEQ ID NO: 545023 - RNA, 64 nt, Human Herpes Virus 1; identical to SEQ ID NO: 539813

SEQ ID NO: 545024 - RNA, 64 nt, Human Herpes Virus 1; identical to SEQ ID NO: 539814

SEQ ID NO: 545025 - RNA, 64 nt, Human Herpes Virus 1; identical to SEQ ID NO: 539815

SEQ ID NO: 545026 - RNA, 64 nt, Human Herpes Virus 1; identical to SEQ ID NO: 539816

SEQ ID NO: 545027 - RNA, 64 nt, Human Herpes Virus 1; identical to SEQ ID NO: 539817

SEQ ID NO: 545028 - RNA, 64 nt, Human Herpes Virus 1; identical to SEQ ID NO: 539818

SEQ ID NO: 545029 - RNA, 64 nt, Human Herpes Virus 1; identical to SEQ ID NO: 539819

SEQ ID NO: 545030 - RNA, 64 nt, Human Herpes Virus 1; identical to SEQ ID NO: 539820

SEQ ID NO: 545031 - RNA, 64 nt, Human Herpes Virus 1; identical to SEQ ID NO: 539811

SEQ ID NO: 545032 - RNA, 61 nt, Human Herpes Virus 1
aaucgugaaggcggggugguacacgagcacgagccacgaggcgcgacugcugaggcgacug

SEQ ID NO: 545033 - RNA, 61 nt, Human Herpes Virus 1
acuuuuaccggggggccguagcgcccgcaguagccacgagcgccagcgacaacaacgaccg

SEQ ID NO: 545034 - RNA, 64 nt, Human Herpes Virus 2
ccagcccguggugcagcacgcccgcgagagcgcggcgggggagaacgcgcugaccuacgcgcuc

SEQ ID NO: 545035 - RNA, 64 nt, Human Herpes Virus 2
aggcggccugcgugcggccccguuuguggcuaccgcgggggacgucggccccgacggucacggc

SEQ ID NO: 545036 - RNA, 64 nt, Human Herpes Virus 2
guuuaacguggacgacgacagcgaggucgaggccgcgggggagauggcgagcgaagagccgccc

SEQ ID NO: 545037 - RNA, 64 nt, Human Herpes Virus 2; identical to SEQ ID NO: 544996

SEQ ID NO: 545038 - RNA, 64 nt, Human Herpes Virus 2
uuuuuugccccccacaacccccggggagccacccagacggcaccgccgccuugccgccggcaga

SEQ ID NO: 545039 - RNA, 64 nt, Human Herpes Virus 2
cggagagaucgucggguuacuggugggugaacggagacggcauccggaccugucugagacucgu

SEQ ID NO: 545040 - RNA, 62 nt, Human Herpes Virus 2
gcggugcgagaguuucuucgcgggcaggccgcggcgcugacggaccucggggugacccacgc

SEQ ID NO: 545041 - RNA, 62 nt, Human Herpes Virus 2
ccgaacacgcucgucgagcgggggcugcagucggcgcugaaguacgaagaguuuuaccucaa

SEQ ID NO: 545042 - RNA, 62 nt, Human Herpes Virus 2
gccuacgcgccccugcuggcgcgcgagaacgcggcgcugaccggggcgcgaacccccgacga

SEQ ID NO: 545043 - RNA, 62 nt, Human Herpes Virus 2
ccgacgccgccgccgcggccgccgcgccccgcggcgcugacccgccggcccgccgagggccc

SEQ ID NO: 545044 - RNA, 62 nt, Human Herpes Virus 2
ucgcccgcuucaucaugggcgcgggggguucgggcgcugauugggccgucagcgaguuucaa

SEQ ID NO: 545045 - RNA, 62 nt, Human Herpes Virus 2
ggccaggcgacgucgcccgacgaucagaucgaggcgcugauacgcgcgugcuacgaccacca

SEQ ID NO: 545046 - RNA, 62 nt, Human Herpes Virus 2; identical to SEQ ID NO: 545043

SEQ ID NO: 545047 - RNA, 62 nt, Human Herpes Virus 2; identical to SEQ ID NO: 545042

SEQ ID NO: 545048 - RNA, 63 nt, Human Herpes Virus 2
ccccaggcgccacggaaagaccugguuuuuggugccccucaucgcgcugucgcucgcguccuu

SEQ ID NO: 545049 - RNA, 63 nt, Human Herpes Virus 2
gaacgaagggcgugugcaguucgagguccaccagccccucaucgcccgcgacggcccgcaccc

SEQ ID NO: 545050 - RNA, 63 nt, Human Herpes Virus 2
ggcgcgcagcggcgacgcggacgucgccgucgcgccccucaucgucggccugaccguggagag

SEQ ID NO: 545051 - RNA, 63 nt, Human Herpes Virus 2
ccuacacgcuccugaccaucuggccgcccaccggccccucaucccgggacggcgacacggccu

SEQ ID NO: 545052 - RNA, 63 nt, Human Herpes Virus 2
ggugcgaagugcggcggcggaggaacccggggcgccccucacgaccccgcccguccugcaggg

SEQ ID NO: 545053 - RNA, 64 nt, Human Herpes Virus 2; identical to SEQ ID NO: 535901

SEQ ID NO: 545054 - RNA, 64 nt, Human Herpes Virus 2; identical to SEQ ID NO: 535902

SEQ ID NO: 545055 - RNA, 64 nt, Human Herpes Virus 2; identical to SEQ ID NO: 535903

SEQ ID NO: 545056 - RNA, 64 nt, Human Herpes Virus 2; identical to SEQ ID NO: 535904

SEQ ID NO: 545057 - RNA, 64 nt, Human Herpes Virus 2; identical to SEQ ID NO: 535905

SEQ ID NO: 545058 - RNA, 64 nt, Human Herpes Virus 2; identical to SEQ ID NO: 535906

SEQ ID NO: 545059 - RNA, 64 nt, Human Herpes Virus 2; identical to SEQ ID NO: 535907

SEQ ID NO: 545060 - RNA, 64 nt, Human Herpes Virus 2; identical to SEQ ID NO: 535908

SEQ ID NO: 545061 - RNA, 64 nt, Human Herpes Virus 2; identical to SEQ ID NO: 535909

SEQ ID NO: 545062 - RNA, 64 nt, Human Herpes Virus 2; identical to SEQ ID NO: 535910

SEQ ID NO: 545063 - RNA, 64 nt, Human Herpes Virus 2; identical to SEQ ID NO: 535911

SEQ ID NO: 545064 - RNA, 64 nt, Human Herpes Virus 2; identical to SEQ ID NO: 535912

SEQ ID NO: 545065 - RNA, 64 nt, Human Herpes Virus 2; identical to SEQ ID NO: 535913

SEQ ID NO: 545066 - RNA, 64 nt, Human Herpes Virus 2; identical to SEQ ID NO: 535914

SEQ ID NO: 545067 - RNA, 64 nt, Human Herpes Virus 2; identical to SEQ ID NO: 535915

SEQ ID NO: 545068 - RNA, 64 nt, Human Herpes Virus 2; identical to SEQ ID NO: 535916

SEQ ID NO: 545069 - RNA, 64 nt, Human Herpes Virus 2; identical to SEQ ID NO: 535917

SEQ ID NO: 545070 - RNA, 64 nt, Human Herpes Virus 2; identical to SEQ ID NO: 535918

SEQ ID NO: 545071 - RNA, 64 nt, Human Herpes Virus 2; identical to SEQ ID NO: 535919

SEQ ID NO: 545072 - RNA, 64 nt, Human Herpes Virus 2; identical to SEQ ID NO: 535920

SEQ ID NO: 545073 - RNA, 64 nt, Human Herpes Virus 2; identical to SEQ ID NO: 535921

SEQ ID NO: 545074 - RNA, 64 nt, Human Herpes Virus 2; identical to SEQ ID NO: 535922

SEQ ID NO: 545075 - RNA, 64 nt, Human Herpes Virus 2; identical to SEQ ID NO: 535923

SEQ ID NO: 545076 - RNA, 64 nt, Human Herpes Virus 2; identical to SEQ ID NO: 535924

SEQ ID NO: 545077 - RNA, 62 nt, Human Herpes Virus 2
gccgaguuccgggaccugaacacacacaucgccgaggugaugcugcucgcggccaugaagac

SEQ ID NO: 545078 - RNA, 62 nt, Human Herpes Virus 2
cccgaggcggggcccacgucccguccccccgccgaggugacccagcucaagggacugucgca

SEQ ID NO: 545079 - RNA, 64 nt, Human Herpes Virus 1
cgaccuggaaucggacagcagcggggaguguuccucgucggacgaggacauggaagacccccac

SEQ ID NO: 545080 - RNA, 64 nt, Human Herpes Virus 2; identical to SEQ ID NO: 543729

SEQ ID NO: 545081 - RNA, 64 nt, Human Herpes Virus 1
gucacucccuccgggaacacgcgcacgucugccggcugcgcaauaccgcguccgucaaggugcu

SEQ ID NO: 545082 - RNA, 64 nt, Human Herpes Virus 1
ccgaacuuaauggaauccuacaggcguuugccccgcugcgcacgagccuucuggacucgcuucu

SEQ ID NO: 545083 - RNA, 64 nt, Human Herpes Virus 1
accgagccaagggcuccuguaaguacgcccucccgcugcgcauccccccgucagccugccucuc

SEQ ID NO: 545084 - RNA, 64 nt, Human Herpes Virus 1
aacugggccgcguggaugcguuaaugcuacgccugcugcgcaucuguccucggaucaucgccau

SEQ ID NO: 545085 - RNA, 64 nt, Human Herpes Virus 2
cagccaguucaucgcgcucaugcccaccgccgccucggcccagaucucggacgucagcgagggc

SEQ ID NO: 545086 - RNA, 64 nt, Human Herpes Virus 2
ggagcugcgcugccaggaccccgacacgucccugucggcccaggccgccgagacggaggaggug

SEQ ID NO: 545087 - RNA, 64 nt, Human Herpes Virus 2
gggccacaugcuguacgucaucuuccccggcacgucggcccaccugcacuaccggcucaucgau

SEQ ID NO: 545088 - RNA, 64 nt, Human Herpes Virus 2
gcggugcgggggcgacccgcggaaccucccagcccgccgcgacccgaccggcgcccccuggcgc

SEQ ID NO: 545089 - RNA, 64 nt, Human Herpes Virus 2
ccaaggucccguuugggacgugccagcauuuccucgccgcgaaucgcuaccucgaaacccggga

SEQ ID NO: 545090 - RNA, 64 nt, Human Herpes Virus 2
cacaggucgcccacgggccccacgccaggcgcagcgccgcgaccguguacgggucguacacgcc

SEQ ID NO: 545091 - RNA, 64 nt, Human Herpes Virus 2
cggaaccgcagacccggcggucgcggcgccgggucgccgcgaccgccagaccgcaaaggccccc

SEQ ID NO: 545092 - RNA, 64 nt, Human Herpes Virus 2
aaaccggcgccccgggugccauggacacaucccccgccgcgagcguucccgcgccgcaggucgc

SEQ ID NO: 545093 - RNA, 64 nt, Human Herpes Virus 2
ccccuccgccgccgccgggacccacgccuccccccgccgcgagcuuaccccaacccgaggcgcc

SEQ ID NO: 545094 - RNA, 64 nt, Human Herpes Virus 2
cccgcuccggcgcguccugcgcccgcccaucgcucgccgcgacggcccggugcuuuugggggac

SEQ ID NO: 545095 - RNA, 64 nt, Human Herpes Virus 2
cgaggaggacgcucuggagcgggacgaggagggccgccgcgacgaccccgaguccgacagcagc

SEQ ID NO: 545096 - RNA, 64 nt, Human Herpes Virus 2
ucaugcaagaccccuuuggcgggaugccguuucccgccgcgaacagccccugggcucccgugcu

SEQ ID NO: 545097 - RNA, 64 nt, Human Herpes Virus 2
ccgcgccggggcccucggccgccaacguuucggucgccgcgaccaccgccacgcccggaacccg

SEQ ID NO: 545098 - RNA, 64 nt, Human Herpes Virus 2
cgcagcuacgccggcuguuccaggacuacgcccccgccgcgauguuuugccgaggcucgcaugg

SEQ ID NO: 545099 - RNA, 64 nt, Human Herpes Virus 2
cgcggggcguacccggaccccauggccagccugucgccgcgacccccggcgccccgccgacacc

SEQ ID NO: 545100 - RNA, 64 nt, Human Herpes Virus 2
acgucucggcccccggggccgucgcggccgcccgcgccgcgacggccccggccgccuccccgcu

SEQ ID NO: 545101 - RNA, 64 nt, Human Herpes Virus 2
cucucccguggccuggagcuccggggagcugguucgccgcgagcccaucuucgccaacccccgc

SEQ ID NO: 545102 - RNA, 64 nt, Human Herpes Virus 2
gcuacgucgcgcggcugggggccgcggcucccgccgccgcgacggaggcggcggcccaccuguc

SEQ ID NO: 545103 - RNA, 64 nt, Human Herpes Virus 2
cgacacgagcuucuuccugggcaaggcgggccaucgccgcgaggccaucgaggccuggcucgug

SEQ ID NO: 545104 - RNA, 64 nt, Human Herpes Virus 2
uccucugcgccaagugccugggcgcgccccacugcgccgcgagcaucuucguggccgccuucga

SEQ ID NO: 545105 - RNA, 64 nt, Human Herpes Virus 2
gagaugaacuuugacgcccuguggccgugcuggccgccgcgacccgcggcggccgcggaccugg

SEQ ID NO: 545106 - RNA, 64 nt, Human Herpes Virus 2
ccgcccgccaaggccaagaaucgguccugaccgacgccgcgaccccccgucgccgccgaggucc

SEQ ID NO: 545107 - RNA, 64 nt, Human Herpes Virus 2
ccgcggccgcccggggccgccccgcggggcgugccgccgcgaccgcacgggcccccgcccgcuc

SEQ ID NO: 545108 - RNA, 64 nt, Human Herpes Virus 2; identical to SEQ ID NO: 545088

SEQ ID NO: 545109 - RNA, 64 nt, Human Herpes Virus 2; identical to SEQ ID NO: 545099

SEQ ID NO: 545110 - RNA, 64 nt, Human Herpes Virus 2
cucccagagucaggaccaggacgcggggcacgugcgcugugaggugcacagcaagcaacagcua

SEQ ID NO: 545111 - RNA, 64 nt, Human Herpes Virus 2
gccgcccgcgacccgcgggacaccucccaguguccgcugugacugggucccgaggaccccgcug

SEQ ID NO: 545112 - RNA, 64 nt, Human Herpes Virus 2; identical to SEQ ID NO: 535855

SEQ ID NO: 545113 - RNA, 64 nt, Human Herpes Virus 2; identical to SEQ ID NO: 535856

SEQ ID NO: 545114 - RNA, 64 nt, Human Herpes Virus 2; identical to SEQ ID NO: 535857

SEQ ID NO: 545115 - RNA, 64 nt, Human Herpes Virus 2; identical to SEQ ID NO: 535858

SEQ ID NO: 545116 - RNA, 64 nt, Human Herpes Virus 2; identical to SEQ ID NO: 535859

SEQ ID NO: 545117 - RNA, 64 nt, Human Herpes Virus 2; identical to SEQ ID NO: 535860

SEQ ID NO: 545118 - RNA, 64 nt, Human Herpes Virus 2; identical to SEQ ID NO: 535861

SEQ ID NO: 545119 - RNA, 58 nt, Human Herpes Virus 2; identical to SEQ ID NO: 535862

SEQ ID NO: 545120 - RNA, 64 nt, Human Herpes Virus 2; identical to SEQ ID NO: 535863

SEQ ID NO: 545121 - RNA, 64 nt, Human Herpes Virus 2; identical to SEQ ID NO: 535864

SEQ ID NO: 545122 - RNA, 64 nt, Human Herpes Virus 2; identical to SEQ ID NO: 535855

SEQ ID NO: 545123 - RNA, 64 nt, Human Herpes Virus 1
ucgugcccuuccaggucccaccugacgccaugaaucgucggaucaugaacguccacgaggcagu

SEQ ID NO: 545124 - RNA, 64 nt, Human Herpes Virus 4 (Epstein Barr virus)
uugagggggccaaaagggcucugaccgacgggcaucuuaucagagaggccucugggguccagga

SEQ ID NO: 545125 - RNA, 64 nt, Human Herpes Virus 1
cuugguugcugcagaucaccguccuguugcuggcccaucgcaucagccagcuggcccaccuggu

SEQ ID NO: 545126 - RNA, 64 nt, Human Herpes Virus 1
ccgccaacgccaagacgguguacggggaaaauacccaucgcaccuucucuguggucgucgacga

SEQ ID NO: 545127 - RNA, 64 nt, Human Herpes Virus 1
cccggcggcgacacgaccgcggcccaggacguguccaucgcacaggagaacgaggagauccucg

SEQ ID NO: 545128 - RNA, 64 nt, Human Herpes Virus 1
acuuugggcugggcuaucuccccacgguugagggccaucgcaccaaacugggcgcgcugaucac

SEQ ID NO: 545129 - RNA, 64 nt, Human Herpes Virus 1
ucacggccgguggcggccaucggcgucaucgaccucgucggacuccggguccucguccucgucg

SEQ ID NO: 545130 - RNA, 64 nt, Human Herpes Virus 1
acucuccggacacgagugugcucgucgucuccugucgucggaguuuuacccagacccuagcgac

SEQ ID NO: 545131 - RNA, 64 nt, Human Herpes Virus 1; identical to SEQ ID NO: 545129

SEQ ID NO: 545132 - RNA, 64 nt, Human Herpes Virus 1
acgacuuugacgucguggauaucgaguccgaagaggaagguaauuucuacgugcccccggauau

SEQ ID NO: 545133 - RNA, 64 nt, Human Herpes Virus 4 (Epstein Barr virus)
acagaagugccaacaccuucuuuuuaguagucaccgcugccaacaucucccaugacggcaacua

SEQ ID NO: 545134 - RNA, 64 nt, Human Herpes Virus 4 (Epstein Barr virus)
ggcugaugccacuugguggcucuacgaauuggcccgcugccaccucucugccaggggcgccccc

SEQ ID NO: 545135 - RNA, 64 nt, Human Herpes Virus 4 (Epstein Barr virus)
agaagauacauccaacggcagggcugcgcgcucacgcugccagggaacauuguuguggagagcu

SEQ ID NO: 545136 - RNA, 64 nt, Human Herpes Virus 4 (Epstein Barr virus)
cuuagccaggucugcaaggcccguccgguugucacgcugccagugaccaucaacaaguacacgg

SEQ ID NO: 545137 - RNA, 64 nt, Human Herpes Virus 1; identical to SEQ ID NO: 536543

SEQ ID NO: 545138 - RNA, 64 nt, Human Herpes Virus 1; identical to SEQ ID NO: 536544

SEQ ID NO: 545139 - RNA, 64 nt, Human Herpes Virus 1; identical to SEQ ID NO: 536545

SEQ ID NO: 545140 - RNA, 64 nt, Human Herpes Virus 1; identical to SEQ ID NO: 536546

SEQ ID NO: 545141 - RNA, 64 nt, Human Herpes Virus 1; identical to SEQ ID NO: 536547

SEQ ID NO: 545142 - RNA, 64 nt, Human Herpes Virus 1; identical to SEQ ID NO: 536548

SEQ ID NO: 545143 - RNA, 62 nt, Human Herpes Virus 1; identical to SEQ ID NO: 536549

SEQ ID NO: 545144 - RNA, 64 nt, Human Herpes Virus 1; identical to SEQ ID NO: 536550

SEQ ID NO: 545145 - RNA, 64 nt, Human Herpes Virus 1; identical to SEQ ID NO: 536551

SEQ ID NO: 545146 - RNA, 64 nt, Human Herpes Virus 1; identical to SEQ ID NO: 536552

SEQ ID NO: 545147 - RNA, 64 nt, Human Herpes Virus 1; identical to SEQ ID NO: 536553

SEQ ID NO: 545148 - RNA, 64 nt, Human Herpes Virus 1; identical to SEQ ID NO: 536554

SEQ ID NO: 545149 - RNA, 64 nt, Human Herpes Virus 1; identical to SEQ ID NO: 536555

SEQ ID NO: 545150 - RNA, 64 nt, Human Herpes Virus 1; identical to SEQ ID NO: 536556

SEQ ID NO: 545151 - RNA, 64 nt, Human Herpes Virus 1; identical to SEQ ID NO: 536557

SEQ ID NO: 545152 - RNA, 64 nt, Human Herpes Virus 1; identical to SEQ ID NO: 536543

SEQ ID NO: 545153 - RNA, 64 nt, Human Herpes Virus 1; identical to SEQ ID NO: 536548

SEQ ID NO: 545154 - RNA, 64 nt, Human Herpes Virus 1; identical to SEQ ID NO: 536547

SEQ ID NO: 545155 - RNA, 64 nt, Human Herpes Virus 1
uauugaccaguuuugcgaggagcccgcccuucgcauaugcuacuauccccgcagucccgggggc

SEQ ID NO: 545156 - RNA, 64 nt, Human Herpes Virus 1
gcagccgacagcccggucauggcgacugacauugauaugcuaauugaccucggccuggaccucu

SEQ ID NO: 545157 - RNA, 62 nt, Human Herpes Virus 1
cgccgaccugccucaccuggcccaccagcgcgccccgccaggccggcagaccgagcggcugg

SEQ ID NO: 545158 - RNA, 62 nt, Human Herpes Virus 1
cgccucuacgaccaccagaucguaccgucgacccccgccaugcugaaccuggggacccgcaa

SEQ ID NO: 545159 - RNA, 62 nt, Human Herpes Virus 1
acccccgaccccaaacccaagaacaacaccacccccgccaagucgggccgccccacuaaacc

SEQ ID NO: 545160 - RNA, 62 nt, Human Herpes Virus 1
gagacggacccggucaccuucuuguaccaccgccccgccaucggggucaucguaggcugcga

SEQ ID NO: 545161 - RNA, 62 nt, Human Herpes Virus 1
cgcuucgucgucccggaaaacuacaucaccaaccccgccaaccuccccggcuggacgcggcu

SEQ ID NO: 545162 - RNA, 62 nt, Human Herpes Virus 1
cacacucaccggcggacccccggaggcgccugccccgccacccaguuuccaccccccauguc

SEQ ID NO: 545163 - RNA, 62 nt, Human Herpes Virus 1
cuggagcugggggugggacgccacgccauggcccccgccaccaucgccgccguucgcggggc

SEQ ID NO: 545164 - RNA, 62 nt, Human Herpes Virus 1
cccccggccacccggauccccgcgccuucccgccccgccagcuguuuuuuugggggaaggac

SEQ ID NO: 545165 - RNA, 62 nt, Human Herpes Virus 1
gagguugaccccuggguucuguucggccauccccccgccacccaucccgacgagcugcugcu

SEQ ID NO: 545166 - RNA, 62 nt, Human Herpes Virus 1
cgacaccgcauaccuuuuugcacccuuuuugcccccgccacccacccccgcguucaucgcca

SEQ ID NO: 545167 - RNA, 62 nt, Human Herpes Virus 1
cgagcgacccagccccuguacgcgcgcaccacccccgccaaguucugggcggacguccgcgc

SEQ ID NO: 545168 - RNA, 64 nt, Human Herpes Virus 1
accgcuggcagccggaccugcgggggcgccccaccgcacgcaccuguacguacgccgccuuugc

SEQ ID NO: 545169 - RNA, 64 nt, Human Herpes Virus 1
caagcuacgcgugcccgcgugggggcgcuguuugcgcacgcacucauccagcgccaaccccaac

SEQ ID NO: 545170 - RNA, 64 nt, Human Herpes Virus 1
acccccugaccccgcuccugugcacccucacguucgcacgcauacgggcggccacccccccgga

SEQ ID NO: 545171 - RNA, 64 nt, Human Herpes Virus 2
aggacguccucgcccgcggcccgggggcccccccggcuggcaaagcgccccccgccgggcggcu

SEQ ID NO: 545172 - RNA, 64 nt, Human Herpes Virus 2
ucgguccucguggggacucucgccgugcgacagcggcuggcaggaauucaacgcgggaugcguc

SEQ ID NO: 545173 - RNA, 64 nt, Human Herpes Virus 2
auuauagccgccguccucgccuacuaugucacguggcuggcacgggcgcuccuccuguacguga

SEQ ID NO: 545174 - RNA, 64 nt, Human Herpes Virus 1
accgcccggcgugggcccggggggcggggcugaccccucccacccccccucgcgccccuuccgc

SEQ ID NO: 545175 - RNA, 64 nt, Human Herpes Virus 1
cuggugugacguuuuccucguccgcgccccccgacccucccauggauuuaacaaacgggggggu

SEQ ID NO: 545176 - RNA, 64 nt, Human Herpes Virus 1
augacccuguaugucacggagaaggcggacgggacccucccagccuccacccugguccgccuuc

SEQ ID NO: 545177 - RNA, 64 nt, Human Herpes Virus 1
gcggcgcaguaccggaacgcggugguggaacagccccucccacagcgcggcgcggauuuggccg

SEQ ID NO: 545178 - RNA, 64 nt, Human Herpes Virus 1
uauguggucggcgucggugauccccaacgcgcugcccucccauauacuagccgagacguucgag

SEQ ID NO: 545179 - RNA, 64 nt, Human Herpes Virus 1
gcguuuucggccggaggcccgcgcgccccccggccccucccaaacacgcggcuggcagacuggc

SEQ ID NO: 545180 - RNA, 64 nt, Human Herpes Virus 1
cggcuacggaggagccaggggcgccguugacgaccccucccacccugcauggcaaccaggcccg

SEQ ID NO: 545181 - RNA, 64 nt, Human Herpes Virus 1; identical to SEQ ID NO: 545174

SEQ ID NO: 545182 - RNA, 64 nt, Human Herpes Virus 1
aacaucggagccggcagcgacggcgggaccgccgucguggcauucgggggaaccccacgucgcu

SEQ ID NO: 545183 - RNA, 62 nt, Human Herpes Virus 1
cuggccgccgugcuccucggggaccacgcggagcaggucaacacguuccugcgucucguguu

SEQ ID NO: 545184 - RNA, 62 nt, Human Herpes Virus 1
acggacccgcugcuguuuguucacgccggacugcaggucaucaaccucggguugguguuucg

SEQ ID NO: 545185 - RNA, 64 nt, Human Herpes Virus 4 (Epstein Barr virus)
cgggggcgacugccgccgccuccgccgccgcagccgucgauaccgggucagguggcgggggaca

SEQ ID NO: 545186 - RNA, 64 nt, Human Herpes Virus 1
uccaugaagcgacauuuacucugcucgcguuuacugacgucaccauccaucgccacggcgauug

SEQ ID NO: 545187 - RNA, 64 nt, Human Herpes Virus 1
cugggggccguccugugugggauugcgugguaugugacgucaauugcccgaggcgcauaaaggg

SEQ ID NO: 545188 - RNA, 64 nt, Human Herpes Virus 1
acuuaaauccgcuccgggagcgccacgagcgcgaugacgucauuagugagcacauacuaucggc

SEQ ID NO: 545189 - RNA, 58 nt, Human Herpes Virus 1
aucguccaaucgccguggcgauggauggugacgucaguaaacgcgagcagaguaaaug

SEQ ID NO: 545190 - RNA, 64 nt, Human Herpes Virus 1
uuaacaaucguccaaucgccguggcgauggauggugacgucaguaaacgcgagcagaguaaaug

SEQ ID NO: 545191 - RNA, 64 nt, Human Herpes Virus 2
ggguacguaccugcggcuagugaagauaaacgacuggacggagaucacacaauuuauccuggag

SEQ ID NO: 545192 - RNA, 64 nt, Human Herpes Virus 2
ccuggugggcguugccgggggccaugacacguacuggacggagcaaaucgacccgugguuuuug

SEQ ID NO: 545193 - RNA, 64 nt, Human Herpes Virus 2
cggcgacggccccggcccccguugccgacguuuuuggacggagggggcgcucuuugauacucgg

SEQ ID NO: 545194 - RNA, 64 nt, Human Herpes Virus 1
ggccguguaugccguggucggcgccgugaccucccgcuacgaccgcgcccuggacgcgggccgc

SEQ ID NO: 545195 - RNA, 64 nt, Human Herpes Virus 1
gagauggagguccagaucgugcgcaacgacccgccgcuacgauacgacaccaaccuccccgugg

SEQ ID NO: 545196 - RNA, 64 nt, Human Herpes Virus 1
gcuccccaagacgcaguucgcggccggcgggggccgcuacgaacacggagcgcuggcgucgcac

SEQ ID NO: 545197 - RNA, 63 nt, Human Herpes Virus 1
agggccuccgaccccagacauuccgcuaucuccugggggcacccacgcccgcgacccggacgc

SEQ ID NO: 545198 - RNA, 63 nt, Human Herpes Virus 1
gccgcagacaugcagcagcuguuuuugaacgccugggggcagcgccuggcccacgggcggguc

SEQ ID NO: 545199 - RNA, 64 nt, Human Herpes Virus 2
ggucaucuacacaacggucgugacggugggccuuagcuucgauccgccgcacuuugacagcaug

SEQ ID NO: 545200 - RNA, 64 nt, Human Herpes Virus 2
ccuaacggccggccagacggcccccgccgagagcagcuucgagggcgacguugcccgcgugacc

SEQ ID NO: 545201 - RNA, 64 nt, Human Herpes Virus 2
ggccgcagacauuuauugcaagaugcgggacaucagcuucgacggggggcucaugcuagaguau

SEQ ID NO: 545202 - RNA, 64 nt, Human Herpes Virus 2
ccagguaccagggcguccugacaccgaguacgacagcuucgacggaggccguggaggagcuggg

SEQ ID NO: 545203 - RNA, 64 nt, Human Herpes Virus 1
ccguggggcggccgugugccucgcagcccggggagauugccaaguuuggucuggucguucgagg

SEQ ID NO: 545204 - RNA, 64 nt, Human Herpes Virus 1; identical to SEQ ID NO: 541350

SEQ ID NO: 545205 - RNA, 64 nt, Human Herpes Virus 1; identical to SEQ ID NO: 541351

SEQ ID NO: 545206 - RNA, 64 nt, Human Herpes Virus 1; identical to SEQ ID NO: 545203

SEQ ID NO: 545207 - RNA, 64 nt, Human Herpes Virus 1; identical to SEQ ID NO: 541350

SEQ ID NO: 545208 - RNA, 64 nt, Human Herpes Virus 1; identical to SEQ ID NO: 541351

SEQ ID NO: 545209 - RNA, 64 nt, Human Herpes Virus 1
ugcgacgcgcgggcggggagggggcgccggagccccccgcgacccccgcgacccccgcgacccc

SEQ ID NO: 545210 - RNA, 64 nt, Human Herpes Virus 1
cguggaugggggggcggucucgggggggagccccccccgcgaggaagaccccggcaguugcggg

SEQ ID NO: 545211 - RNA, 64 nt, Human Herpes Virus 1
caguggucggcgagcuggauggcgcguaucugguccccgcgaagacccccccggagccgggcgc

SEQ ID NO: 545212 - RNA, 64 nt, Human Herpes Virus 1; identical to SEQ ID NO: 545209

SEQ ID NO: 545213 - RNA, 64 nt, Human Herpes Virus 4 (Epstein Barr virus)
ucaccugcucuucgaugcacuugaaggcguccgggagcucuaugcccacgguuguguuggucac

SEQ ID NO: 545214 - RNA, 64 nt, Human Herpes Virus 4 (Epstein Barr virus)
cagugugccaguguacugcgaugagggccuuccagagcucuacaaccccuuccacguggccgcc

SEQ ID NO: 545215 - RNA, 64 nt, Human Herpes Virus 4 (Epstein Barr virus)
ggccaacggggugcgccgcuacgccagccagacggagcucuaugacgcccccgggugguugaua

SEQ ID NO: 545216 - RNA, 64 nt, Human Herpes Virus 2
aagggcacgcucggggucgggguccggaagggccaccuggcacagcggcucggugaggaccgug

SEQ ID NO: 545217 - RNA, 62 nt, Human Herpes Virus 2
ugggcucgcgacggcgugcuguuguugaacacgacccugaccgucaagcgcggggcggcggc

SEQ ID NO: 545218 - RNA, 62 nt, Human Herpes Virus 2
cgcaacgcccuggagcacuuugggcgacgcgagacccugacggagguucugggccgcuacga

SEQ ID NO: 545219 - RNA, 62 nt, Human Herpes Virus 2
cggccggccguccuggccgacuuuagccuggugacccugaacuccaacuccacgauaucccg

SEQ ID NO: 545220 - RNA, 62 nt, Human Herpes Virus 2
augacuuacuggcaggugcugggggccuccgagacccugacgaacaucuacaacacgcagca

SEQ ID NO: 545221 - RNA, 64 nt, Human Herpes Virus 2
ggcgccguuccuggcgggcgcgcccucggccgagcagcgggaacgcgcccgccggggccuccuc

SEQ ID NO: 545222 - RNA, 64 nt, Human Herpes Virus 1
uggagcacgagcaggcggucggcggcuguagcgccccggcgacccugaucccccgcgcggcugc

SEQ ID NO: 545223 - RNA, 64 nt, Human Herpes Virus 1
cagacacaucgaccgccuggccaaacgccagcgccccggcgagcggcuugaccuggcuaugcug

SEQ ID NO: 545224 - RNA, 64 nt, Human Herpes Virus 2
ccccaccgucggggcggccgcgcacgagggcggacagcgggacccccgccgccgccaggcacuc

SEQ ID NO: 545225 - RNA, 64 nt, Human Herpes Virus 2
uuugcgggggauacauuuugaugcccugagggcccagcgggaucugcgggagcugcgcugccag

SEQ ID NO: 545226 - RNA, 64 nt, Human Herpes Virus 4 (Epstein Barr virus)
cugaauaaaauggcaaaacagcucugccugcugccucaggaacccuuuugcaucacucgugugu

SEQ ID NO: 545227 - RNA, 64 nt, Human Herpes Virus 2
gccugggccccgccgaucgccgguucguggcgcucagcgggagucuggaggcgcccgcggagac

SEQ ID NO: 545228 - RNA, 64 nt, Human Herpes Virus 1; identical to SEQ ID NO: 543706

SEQ ID NO: 545229 - RNA, 64 nt, Human Herpes Virus 1; identical to SEQ ID NO: 543707

SEQ ID NO: 545230 - RNA, 64 nt, Human Herpes Virus 1; identical to SEQ ID NO: 543708

SEQ ID NO: 545231 - RNA, 64 nt, Human Herpes Virus 1; identical to SEQ ID NO: 543709

SEQ ID NO: 545232 - RNA, 64 nt, Human Herpes Virus 1; identical to SEQ ID NO: 543710

SEQ ID NO: 545233 - RNA, 64 nt, Human Herpes Virus 1; identical to SEQ ID NO: 543711

SEQ ID NO: 545234 - RNA, 64 nt, Human Herpes Virus 1; identical to SEQ ID NO: 543712

SEQ ID NO: 545235 - RNA, 64 nt, Human Herpes Virus 1; identical to SEQ ID NO: 543713

SEQ ID NO: 545236 - RNA, 64 nt, Human Herpes Virus 1; identical to SEQ ID NO: 543714

SEQ ID NO: 545237 - RNA, 64 nt, Human Herpes Virus 1; identical to SEQ ID NO: 543715

SEQ ID NO: 545238 - RNA, 64 nt, Human Herpes Virus 1; identical to SEQ ID NO: 543716

SEQ ID NO: 545239 - RNA, 64 nt, Human Herpes Virus 1
gcgucagacaaacccuaaccaccgcuuaagcggcccccgcgagguccgaagacucauuuggauc

SEQ ID NO: 545240 - RNA, 64 nt, Human Herpes Virus 1
gccuggcccgcggugggggccagggucguccuccccccgcgagccuggcccggcguggccucgg

SEQ ID NO: 545241 - RNA, 64 nt, Human Herpes Virus 1
gcacccgcaacgagucacggcacgggugcugcugccccgcgauuacgacuacuuuguaagcgcc

SEQ ID NO: 545242 - RNA, 64 nt, Human Herpes Virus 1
ccccggggccgccgcucggacggcgcccgugggcccccgcgacgguuuccuuuaacgagaacga

SEQ ID NO: 545243 - RNA, 64 nt, Human Herpes Virus 1; identical to SEQ ID NO: 545210

SEQ ID NO: 545244 - RNA, 64 nt, Human Herpes Virus 1
ccgcgacccccgcgacccccgcgacccccgcgacccccgcgacccccgcgcgggugcgcuucuc

SEQ ID NO: 545245 - RNA, 64 nt, Human Herpes Virus 1
cggagccccccgcgacccccgcgacccccgcgacccccgcgacccccgcgacccccgcgcgggu

SEQ ID NO: 545246 - RNA, 64 nt, Human Herpes Virus 1
agggggcgccggagccccccgcgacccccgcgacccccgcgacccccgcgacccccgcgacccc

SEQ ID NO: 545247 - RNA, 64 nt, Human Herpes Virus 1
cgggcggggagggggcgccggagccccccgcgacccccgcgacccccgcgacccccgcgacccc

SEQ ID NO: 545248 - RNA, 64 nt, Human Herpes Virus 4 (Epstein Barr virus); identical to SEQ ID NO: 537321

SEQ ID NO: 545249 - RNA, 64 nt, Human Herpes Virus 1
ccggucuccccgggagccccggaccccacgcaccccccgcgaaccacguacggcucgcgggucu

SEQ ID NO: 545250 - RNA, 64 nt, Human Herpes Virus 1; identical to SEQ ID NO: 545246

SEQ ID NO: 545251 - RNA, 64 nt, Human Herpes Virus 1; identical to SEQ ID NO: 545245

SEQ ID NO: 545252 - RNA, 64 nt, Human Herpes Virus 1; identical to SEQ ID NO: 545244

SEQ ID NO: 545253 - RNA, 64 nt, Human Herpes Virus 4 (Epstein Barr virus)
gccauugaagaggaacacagaaagaagaaggcagccagaacagagcagccaagagccacgccug

SEQ ID NO: 545254 - RNA, 64 nt, Human Herpes Virus 4 (Epstein Barr virus)
ugguucugaccucucagcaucccucuccccuggcccagaacagcacccgaaagagugcccagca

SEQ ID NO: 545255 - RNA, 64 nt, Human Herpes Virus 4 (Epstein Barr virus)
aggaguucucgucuaccggucucugccuuuugacccagaacaugauguucuugggccugaugug

SEQ ID NO: 545256 - RNA, 64 nt, Human Herpes Virus 4 (Epstein Barr virus)
acaggguggucuucacgggggagaaugccgcccuccagaacagcuucaucaaguccacuaccag

SEQ ID NO: 545257 - RNA, 64 nt, Human Herpes Virus 1; identical to SEQ ID NO: 545247

SEQ ID NO: 545258 - RNA, 64 nt, Human Herpes Virus 1
cccggaugucuggguguuucccugcgaccgagaccugccggacagcagcgacucugaggcggag

SEQ ID NO: 545259 - RNA, 64 nt, Human Herpes Virus 1
ccugcugcgccuggccgaccagaagggcuuuauucugccggacacccaggggcgauuuaggggc

SEQ ID NO: 545260 - RNA, 64 nt, Human Herpes Virus 1
gucgcgccgcagaagaccgcaagugucuggacggcugccggaaaaugcgcuucuccaccgccug

SEQ ID NO: 545261 - RNA, 64 nt, Human Herpes Virus 1
gguuguuggacgcccaccacaucgaccacagcgccugccggacccacaggcagcuguacgcccu

SEQ ID NO: 545262 - RNA, 64 nt, Human Herpes Virus 1; identical to SEQ ID NO: 545258

SEQ ID NO: 545263 - RNA, 64 nt, Human Herpes Virus 1
acgccgccgcccaucaucgccacgucggaccccaccccgcgacgggacgccgccacaaaaagca

SEQ ID NO: 545264 - RNA, 64 nt, Human Herpes Virus 1
cguuauugaucuggacacccccacggacccaccuccaccguacucugcugggccccuguugucc

SEQ ID NO: 545265 - RNA, 64 nt, Human Herpes Virus 4 (Epstein Barr virus)
ucgcccccgaggcccuucagcucaggacccacccuauggccauucuggagggcccggucgcauu

SEQ ID NO: 545266 - RNA, 64 nt, Human Herpes Virus 4 (Epstein Barr virus)
guuuaugccccaguucagaugcagucuccaggauuauggccacuggcaugaugguaguauugag

SEQ ID NO: 545267 - RNA, 64 nt, Human Herpes Virus 4 (Epstein Barr virus)
cgauggcacacgccagagacaaggcaggcgcuguuauggccaugauacucaucugugagacaag

SEQ ID NO: 545268 - RNA, 64 nt, Human Herpes Virus 4 (Epstein Barr virus)
cugccccaccagaaggcauuccugacuucccugauauggccaggcaucgagccgagcgacugga

SEQ ID NO: 545269 - RNA, 63 nt, Human Herpes Virus 1
cgcgagauucuccacgggcagcugggguauaccgagggccaggggguguacaacgucguccgg

SEQ ID NO: 545270 - RNA, 63 nt, Human Herpes Virus 1
ggggaccccaucagccucgucccgcccguguucgagggccaagcgacggacgugcgccuggau

SEQ ID NO: 545271 - RNA, 63 nt, Human Herpes Virus 1
ccgcccaccgacaucuccgcguggccgcuguucgagggccaggacacggccgcggcccgcgcc

SEQ ID NO: 545272 - RNA, 63 nt, Human Herpes Virus 1
cgggacuuugggcugggcuaucuccccacgguugagggccaucgcaccaaacugggcgcgcug

SEQ ID NO: 545273 - RNA, 63 nt, Human Herpes Virus 1
cuacguucuggcccugguggucggggacgcgcugagggccacguguagcgcggccuaccuucc

SEQ ID NO: 545274 - RNA, 64 nt, Human Herpes Virus 1
aggcccgugcccgggcccuggcccgcggagccggcccggcgaacucggucuaacguuacacccg

SEQ ID NO: 545275 - RNA, 64 nt, Human Herpes Virus 1
gacuggccgccacggaacagcagggccccacacccccggcgaucgcggcgcuuauccguaaugc

SEQ ID NO: 545276 - RNA, 64 nt, Human Herpes Virus 1
ccagcgccccacaguguguggucgcgccucggggcccggcgaccgucuugcucccccgagcagc

SEQ ID NO: 545277 - RNA, 64 nt, Human Herpes Virus 1
gccacgaggcgcgacugcugaggcgacuggaccacccggcgauccugccccuccuggaccugca

SEQ ID NO: 545278 - RNA, 64 nt, Human Herpes Virus 1
cgaaacugcuuccgucuucggccccgcgucuggccccggcgagcguauaccaacccgccccuaa

SEQ ID NO: 545279 - RNA, 64 nt, Human Herpes Virus 1
gacgcaggcgucgguaauggccgacgcaggcgcccccggcgagcgugcguuugauuuuaagcaa

SEQ ID NO: 545280 - RNA, 64 nt, Human Herpes Virus 1
cacccugcagaacaugguggucccggagaucgcccccggcgaggagugccccagcgaccccgug

SEQ ID NO: 545281 - RNA, 64 nt, Human Herpes Virus 1
ccgccauuuuggcuuuucggacuacaccccccggcccggcgaccucaaacacgagacgacgggg

SEQ ID NO: 545282 - RNA, 64 nt, Human Herpes Virus 1
cgaccgucacggccauguacucaccgacgccacccccggcgagccagcuggcccucagcgacgc

SEQ ID NO: 545283 - RNA, 64 nt, Human Herpes Virus 1
uucgugguggugcugaagaaaagguggucgccgucccggcgaccuccguuucucuugcaguucu

SEQ ID NO: 545284 - RNA, 64 nt, Human Herpes Virus 1
agcggcgggagacgcgggcccgcgcggggagccgcccggcgaggagggcgggcgcgaugggauc

SEQ ID NO: 545285 - RNA, 64 nt, Human Herpes Virus 1; identical to SEQ ID NO: 545274

SEQ ID NO: 545286 - RNA, 64 nt, Human Herpes Virus 1
ccccguugucauucuggaaggcgugguguggcgccccggcgaguggcgggcaugcgcgugagcg

SEQ ID NO: 545287 - RNA, 64 nt, Human Herpes Virus 4 (Epstein Barr virus)
aacucaaggccaagcauuucacaccugcaaaugcaccauguaaccacagaucuaaacugaaagu

SEQ ID NO: 545288 - RNA, 64 nt, Human Herpes Virus 4 (Epstein Barr virus)
gcaacaacguacagugcuggcauuguacagauaccacgaauaucagaccaaaaccaaaagaucg

SEQ ID NO: 545289 - RNA, 64 nt, Human Herpes Virus 2; identical to SEQ ID NO: 542941

SEQ ID NO: 545290 - RNA, 64 nt, Human Herpes Virus 1
cggcgccuucuccgccuuccgggggggcccccaaaccccguaugguuuuggauuccccugacgg

SEQ ID NO: 545291 - RNA, 64 nt, Human Herpes Virus 2
cgcgcaggcgcggcgggugggcgaagacgccgcggcggcggagggcaggacgccccccgcgaga

SEQ ID NO: 545292 - RNA, 64 nt, Human Herpes Virus 2
cgcccaggcgggggcgcuggagcgggagcagcgcgcggcggaccgggcggccgggggaggcgcg

SEQ ID NO: 545293 - RNA, 64 nt, Human Herpes Virus 2
gauguugcccguguucaacaucccccgggagacggcggcggagcgggcggcagugcugcaggcc

SEQ ID NO: 545294 - RNA, 64 nt, Human Herpes Virus 2
uucgguucaugggccccgaggacgccguucgcacgcggcggauccugugucgcgccgccgagca

SEQ ID NO: 545295 - RNA, 64 nt, Human Herpes Virus 2
gucgcccccccucuccgcgagauacggacccgaggcggcggagggugguggggacggcggccgc

SEQ ID NO: 545296 - RNA, 64 nt, Human Herpes Virus 2
cccggcucgccagcccccccaccccccgaacaucgcggcggacccgaggaguuugagggcgccg

SEQ ID NO: 545297 - RNA, 64 nt, Human Herpes Virus 2
gauggcggacgaggacgggggacgucuccgggccgcggcggagacgaccggcggccccggaucu

SEQ ID NO: 545298 - RNA, 64 nt, Human Herpes Virus 2
guaccucgaucccgcgcuuagcgagcgccuggacgcggcggacgaucgucuugcggaccaggag

SEQ ID NO: 545299 - RNA, 64 nt, Human Herpes Virus 2
cgccugcgcggccggcgccgccauguggguggcggcggcggacugcuuugccgccuuuaccaac

SEQ ID NO: 545300 - RNA, 64 nt, Human Herpes Virus 2
cgagcaccugaaccucccgcuggugcgaagugcggcggcggaggaacccggggcgccccucacg

SEQ ID NO: 545301 - RNA, 64 nt, Human Herpes Virus 2; identical to SEQ ID NO: 545291

SEQ ID NO: 545302 - RNA, 64 nt, Human Herpes Virus 2; identical to SEQ ID NO: 545297

SEQ ID NO: 545303 - RNA, 64 nt, Human Herpes Virus 2
cccccaccggcuauaccaccuguggguggucggggcggcggaccugugugugccguuuuucgag

SEQ ID NO: 545304 - RNA, 64 nt, Human Herpes Virus 1
cguuccgacaucgggcaccccggcccccgcgccgcccggcgacgggagcuaccuguggaucccg

SEQ ID NO: 545305 - RNA, 64 nt, Human Herpes Virus 2; identical to SEQ ID NO: 545291

SEQ ID NO: 545306 - RNA, 64 nt, Human Herpes Virus 2; identical to SEQ ID NO: 545292

SEQ ID NO: 545307 - RNA, 64 nt, Human Herpes Virus 2; identical to SEQ ID NO: 545293

SEQ ID NO: 545308 - RNA, 64 nt, Human Herpes Virus 2; identical to SEQ ID NO: 545294

SEQ ID NO: 545309 - RNA, 64 nt, Human Herpes Virus 2; identical to SEQ ID NO: 545295

SEQ ID NO: 545310 - RNA, 64 nt, Human Herpes Virus 2; identical to SEQ ID NO: 545296

SEQ ID NO: 545311 - RNA, 64 nt, Human Herpes Virus 2; identical to SEQ ID NO: 545297

SEQ ID NO: 545312 - RNA, 64 nt, Human Herpes Virus 2; identical to SEQ ID NO: 545298

SEQ ID NO: 545313 - RNA, 64 nt, Human Herpes Virus 2; identical to SEQ ID NO: 545299

SEQ ID NO: 545314 - RNA, 64 nt, Human Herpes Virus 2; identical to SEQ ID NO: 545300

SEQ ID NO: 545315 - RNA, 64 nt, Human Herpes Virus 2; identical to SEQ ID NO: 545291

SEQ ID NO: 545316 - RNA, 64 nt, Human Herpes Virus 2; identical to SEQ ID NO: 545297

SEQ ID NO: 545317 - RNA, 64 nt, Human Herpes Virus 2; identical to SEQ ID NO: 545303

SEQ ID NO: 545318 - RNA, 64 nt, Human Herpes Virus 2
cgccgugcugugucuguaucugcuguaccgaaccacccacgaguccucccccgaucgcgaucgc

SEQ ID NO: 545319 - RNA, 64 nt, Human Herpes Virus 2
ggugaucgaggugucccgccugugugcucucaacacccacgacccaccgcccccgcuggcggga

SEQ ID NO: 545320 - RNA, 64 nt, Human Herpes Virus 4 (Epstein Barr virus); identical to SEQ ID NO: 544460

SEQ ID NO: 545321 - RNA, 64 nt, Human Herpes Virus 4 (Epstein Barr virus); identical to SEQ ID NO: 544461

SEQ ID NO: 545322 - RNA, 64 nt, Human Herpes Virus 4 (Epstein Barr virus); identical to SEQ ID NO: 544462

SEQ ID NO: 545323 - RNA, 64 nt, Human Herpes Virus 4 (Epstein Barr virus); identical to SEQ ID NO: 544463

SEQ ID NO: 545324 - RNA, 64 nt, Human Herpes Virus 2
cagagaguccgcgcgacgacuuccgccgcggcgcuggcccgaugcgcgcgcgcccgaggggcga

SEQ ID NO: 545325 - RNA, 64 nt, Human Herpes Virus 4 (Epstein Barr virus); identical to SEQ ID NO: 544460

SEQ ID NO: 545326 - RNA, 64 nt, Human Herpes Virus 4 (Epstein Barr virus); identical to SEQ ID NO: 544461

SEQ ID NO: 545327 - RNA, 64 nt, Human Herpes Virus 4 (Epstein Barr virus); identical to SEQ ID NO: 544462

SEQ ID NO: 545328 - RNA, 64 nt, Human Herpes Virus 4 (Epstein Barr virus); identical to SEQ ID NO: 544463

SEQ ID NO: 545329 - RNA, 64 nt, Human Herpes Virus 4 (Epstein Barr virus)
gcgggcacccgaggucccagcacccggucccuccggggggcagagacaggcagggccccccggc

SEQ ID NO: 545330 - RNA, 64 nt, Human Herpes Virus 4 (Epstein Barr virus); identical to SEQ ID NO: 545329

SEQ ID NO: 545331 - RNA, 64 nt, Human Herpes Virus 4 (Epstein Barr virus); identical to SEQ ID NO: 545329

SEQ ID NO: 545332 - RNA, 64 nt, Human Herpes Virus 4 (Epstein Barr virus)
gcguggcucagcagagcacagcaagccgaugccgggggggcaucuggcuccgaggacccaccag

SEQ ID NO: 545333 - RNA, 64 nt, Human Herpes Virus 4 (Epstein Barr virus)
ggaugaacccuggggcaacagacugcggggaggaggggggcagugauaagucaugacaauuuua

SEQ ID NO: 545334 - RNA, 64 nt, Human Herpes Virus 4 (Epstein Barr virus)
uguugagggugcccagggacuucccgggggccguggggggcaccggugugguggcguuccccgc

SEQ ID NO: 545335 - RNA, 64 nt, Human Herpes Virus 4 (Epstein Barr virus)
cacacggcucuggaggccguccagccuccgggagggggggcaugccccgacgaugaacuccgga

SEQ ID NO: 545336 - RNA, 64 nt, Human Herpes Virus 4 (Epstein Barr virus)
cccgccaccgaggaacagcucccaagcgggucgcggggggcaagcaacaaagagcucaagcgac

SEQ ID NO: 545337 - RNA, 64 nt, Human Herpes Virus 4 (Epstein Barr virus)
cagaccaaggccgauugagccucccgcggggggaggggggcacggaugagcccaauccucgcca

SEQ ID NO: 545338 - RNA, 64 nt, Human Herpes Virus 4 (Epstein Barr virus)
cacgggccgccgaggggcaggcugcggccgcccaggggggcaaauugcgugucuggggccgccu

SEQ ID NO: 545339 - RNA, 64 nt, Human Herpes Virus 4 (Epstein Barr virus)
uacccccucagucgcguacucuguggaguuuuacggggggcauaaagucgauguaaguuugugc

SEQ ID NO: 545340 - RNA, 64 nt, Human Herpes Virus 4 (Epstein Barr virus)
cuacuacaaauuggaguuucugaaauccauccucaccggccaguccccggccaacuucugcuuc

SEQ ID NO: 545341 - RNA, 64 nt, Human Herpes Virus 4 (Epstein Barr virus)
uccuccaacgaggaucccgcagguaagaagcuacaccggccaguggccggggccguggagccgg

SEQ ID NO: 545342 - RNA, 64 nt, Human Herpes Virus 4 (Epstein Barr virus)
cgcaauccucagcagcgggccguggaagccuucaaccggccagagcagcucuuugcagaguacc

SEQ ID NO: 545343 - RNA, 64 nt, Human Herpes Virus 4 (Epstein Barr virus)
ccggaacauuuccaacaaccccauaacgaucgugaccggccagagcauggcccaggccuuuuuc

SEQ ID NO: 545344 - RNA, 64 nt, Human Herpes Virus 1
gggugugccggcacgacgggggccagaagcucccccaccgcauccgcgggcacguaggcggcaa

SEQ ID NO: 545345 - RNA, 64 nt, Human Herpes Virus 1
cuguaccgcuggcagccggaccugcgggggcgccccaccgcacgcaccuguacguacgccgccu

SEQ ID NO: 545346 - RNA, 64 nt, Human Herpes Virus 1
gacacggcccuaaagaaaccuaagacggggucgcccaccgcacccccgcccgcagauccagucc

SEQ ID NO: 545347 - RNA, 64 nt, Human Herpes Virus 1
gccagacgccggguagcguacggaccgccucgguccaccgcauacuccggccgcgguacagauc

SEQ ID NO: 545348 - RNA, 64 nt, Human Herpes Virus 1
gacaccaccaacacugugucccggccgccgccacccaccgcacccgagcgccuucccgccaagu

SEQ ID NO: 545349 - RNA, 64 nt, Human Herpes Virus 4 (Epstein Barr virus)
gacgccugcggacucaggccaccgucuacccagaggaggacaugugcauggccugggcccgcuu

SEQ ID NO: 545350 - RNA, 64 nt, Human Herpes Virus 4 (Epstein Barr virus)
cugaggcgggagcagccgggaacucuggaccccgggaggacaccaacccucagcagcccaccac

SEQ ID NO: 545351 - RNA, 64 nt, Human Herpes Virus 4 (Epstein Barr virus)
cccgccgcuuucuggucucgggugagacccucucggaggacaucucgcgcuugacgggggcagc

SEQ ID NO: 545352 - RNA, 64 nt, Human Herpes Virus 4 (Epstein Barr virus)
uggcugccuucagauaugccaccccccagauggaggaggacaagggucccaucaaccaccccca

SEQ ID NO: 545353 - RNA, 64 nt, Human Herpes Virus 4 (Epstein Barr virus)
acucaucuacggaggcaucuacgcuuuuagccacggaggacauucucucugugaaaacggggaa

SEQ ID NO: 545354 - RNA, 64 nt, Human Herpes Virus 4 (Epstein Barr virus)
uccucuacagacgggccuucgucucgggucccugggaggacaggcgcgccggcgagggugccgc

SEQ ID NO: 545355 - RNA, 64 nt, Human Herpes Virus 1
cuuugucgacgaggccaacuuuauucgcccggaugcgguccagacgauuaugggcuuucucaac

SEQ ID NO: 545356 - RNA, 64 nt, Human Herpes Virus 1
ccacgccccagugcacccgcggcaacgacaaccugcgguccaugggaaucggcaugcagggccu

SEQ ID NO: 545357 - RNA, 64 nt, Human Herpes Virus 1
gugucugugggccaagauggcccaguguacccuggcgguccagggggaugcuagccuguguccg

SEQ ID NO: 545358 - RNA, 64 nt, Human Herpes Virus 1
cgggccagcacgucgccgugcucccccgccucccgcgguccaaccccgcggcgcgcguuacggc

SEQ ID NO: 545359 - RNA, 64 nt, Human Herpes Virus 1
cgggcgccuggcggccaugcaugcccggauggcggcgguccagcucugggacaugucgcguccg

SEQ ID NO: 545360 - RNA, 64 nt, Human Herpes Virus 2
uccgggacuucgagcucgucugccugcugauguaccuggagaacuguccccggagccacgccac

SEQ ID NO: 545361 - RNA, 64 nt, Human Herpes Virus 2
agcuggcguccgacgugcagcaguaccuggagcgccuggagaaacagaggcaacagaagguggg

SEQ ID NO: 545362 - RNA, 64 nt, Human Herpes Virus 2
ugcugcaggcccagcgcaccgcggccgcggcggcccuggagaacgccgcccuccaggccgccga

SEQ ID NO: 545363 - RNA, 64 nt, Human Herpes Virus 2
aggccgucgcgcaccuggaggcggaccgggacuaccuggagaucgagguggggggccgacggcu

SEQ ID NO: 545364 - RNA, 64 nt, Human Herpes Virus 2
ugggucggcagcggcucaucaucgaagagcugacccuggagacccagggcauguacuacugggu

SEQ ID NO: 545365 - RNA, 64 nt, Human Herpes Virus 2
ccguggucaacgagagucuggucaucuacggggcccuggagacggacagcggucuguacacccu

SEQ ID NO: 545366 - RNA, 64 nt, Human Herpes Virus 2
uauucgccgucaaccccgcccuccgcuacacgacccuggagauccccggggcccgcagcuucgg

SEQ ID NO: 545367 - RNA, 64 nt, Human Herpes Virus 2
ggcuaggggaggugacgcggcgcuuccccgugcuccuggagaaccugaugcgcgcccucgaggg

SEQ ID NO: 545368 - RNA, 64 nt, Human Herpes Virus 2
uggccauaggcgacaggcuggucuuccuggaggcccuggagagacgcaucuacgccgccaccaa

SEQ ID NO: 545369 - RNA, 64 nt, Human Herpes Virus 2
gggcggcccggcgggagcgcgccaacucgcgcucccuggagagcaugccuacgcugaccgcggc

SEQ ID NO: 545370 - RNA, 64 nt, Human Herpes Virus 2
ugcggcccgaucuguucgacggccucugcugcgaccuggagagcuggcgccaguuggcgugucu

SEQ ID NO: 545371 - RNA, 64 nt, Human Herpes Virus 4 (Epstein Barr virus)
auuccuuguacgauugagacccuggcgcaccucacggagcuauuuacuuccgagucuggucaga

SEQ ID NO: 545372 - RNA, 64 nt, Human Herpes Virus 4 (Epstein Barr virus)
acaagguuauuacccaguccuuguaugccugguguccccuuagugggacgcaggccuagguagc

SEQ ID NO: 545373 - RNA, 64 nt, Human Herpes Virus 4 (Epstein Barr virus)
cagagugggggaugcuagccaauuuagcuuccccuccccuuaacagggggucucgcggggugcc

SEQ ID NO: 545374 - RNA, 64 nt, Human Herpes Virus 4 (Epstein Barr virus); identical to SEQ ID NO: 537043

SEQ ID NO: 545375 - RNA, 64 nt, Human Herpes Virus 2
cccgagugcaacgccccgggccugugcccgacgccgagcccauuuacgacaccguggaggggua

SEQ ID NO: 545376 - RNA, 64 nt, Human Herpes Virus 2
aacagcaccucccccagcgccagcccgagcccgucgagcccacccgcccgcacgugagagcccc

SEQ ID NO: 545377 - RNA, 64 nt, Human Herpes Virus 2
ccguggccuggagcuccggggagcugguucgccgcgagcccaucuucgccaacccccgccaccc

SEQ ID NO: 545378 - RNA, 64 nt, Human Herpes Virus 2
ucgccauggcggccgcgcccccggccgcgguuuccgagcccacugcggcccgacagaaacuguu

SEQ ID NO: 545379 - RNA, 64 nt, Human Herpes Virus 4 (Epstein Barr virus)
gagcccauccucgcccacaucgcucucccuggcuuuucccuaugcgggcccgccccccguggcg

SEQ ID NO: 545380 - RNA, 64 nt, Human Herpes Virus 2
acccccauagcgaggggcguaaaucucgccgcccgcucaccaccuuugguucgggaagcccggg

SEQ ID NO: 545381 - RNA, 64 nt, Human Herpes Virus 2
aacugcaacgcaaucccaugaaggcccuguauccgcucaccaccaaggaacucaagacuuccga

SEQ ID NO: 545382 - RNA, 64 nt, Human Herpes Virus 2
gccaucgagggaugucuggugccgcguguucgcagcucaccaucggccgcgggcuccgggccgc

SEQ ID NO: 545383 - RNA, 64 nt, Human Herpes Virus 1; identical to SEQ ID NO: 543933

SEQ ID NO: 545384 - RNA, 64 nt, Human Herpes Virus 1; identical to SEQ ID NO: 543934

SEQ ID NO: 545385 - RNA, 64 nt, Human Herpes Virus 1; identical to SEQ ID NO: 543935

SEQ ID NO: 545386 - RNA, 64 nt, Human Herpes Virus 1; identical to SEQ ID NO: 543936

SEQ ID NO: 545387 - RNA, 64 nt, Human Herpes Virus 4 (Epstein Barr virus)
ggaugugcgagccauaaagcaguuucuggaggccacggccgaucgcauccugggugacauuggu

SEQ ID NO: 545388 - RNA, 64 nt, Human Herpes Virus 4 (Epstein Barr virus)
gugccgggacgccgccgccaggugggcccuggccacggccgacacggccacccucagaaggcgc

SEQ ID NO: 545389 - RNA, 64 nt, Human Herpes Virus 4 (Epstein Barr virus)
gguggauccuccaccgccgguuaacuuuaacaagacggccgagcaggaguauggggacaaagag

SEQ ID NO: 545390 - RNA, 64 nt, Human Herpes Virus 4 (Epstein Barr virus)
cauggugugugacaugauucagauugggaaggccacggccgaggaugggcaggacaaggcccug

SEQ ID NO: 545391 - RNA, 64 nt, Human Herpes Virus 1
ugcggucucggcacccgugguccggggagcagggggcgucgacccgggacgagggaaaacaaua

SEQ ID NO: 545392 - RNA, 64 nt, Human Herpes Virus 1
cucguacgcaugggccgccaacagucgguauuaaggcgucgacgcagacgcacccgcugcgucg

SEQ ID NO: 545393 - RNA, 64 nt, Human Herpes Virus 1
cccucugccccgggggaucggcuacaagcucaccggcgucgacguccgacgcccacuguuccua

SEQ ID NO: 545394 - RNA, 64 nt, Human Herpes Virus 1
gguuucuguccgucguguccggcauucacgcccgggcgucgaagcugcugucgggagaccaggu

SEQ ID NO: 545395 - RNA, 64 nt, Human Herpes Virus 1; identical to SEQ ID NO: 545391

SEQ ID NO: 545396 - RNA, 64 nt, Human Herpes Virus 2; identical to SEQ ID NO: 542938

SEQ ID NO: 545397 - RNA, 64 nt, Human Herpes Virus 2; identical to SEQ ID NO: 542939

SEQ ID NO: 545398 - RNA, 64 nt, Human Herpes Virus 2; identical to SEQ ID NO: 542940

SEQ ID NO: 545399 - RNA, 64 nt, Human Herpes Virus 1
ggccgaggcucacauggagcccgucccggggcuggcguggcaggcggccuccgucaaucuggag

SEQ ID NO: 545400 - RNA, 64 nt, Human Herpes Virus 4 (Epstein Barr virus)
cuccaucugucagcaacgccaagcuccagaggacgcccgcgacgagccucaccuguucuccucc

SEQ ID NO: 545401 - RNA, 64 nt, Human Herpes Virus 4 (Epstein Barr virus)
uggagaucauucuacagaguaacggcggagggaggcccgcgagcuuccaguuccccuccucccc

SEQ ID NO: 545402 - RNA, 64 nt, Human Herpes Virus 4 (Epstein Barr virus)
ucuauugggauaacgagaggaggaggggcuagaggcccgcgagauuugggguaggcggagccuc

SEQ ID NO: 545403 - RNA, 64 nt, Human Herpes Virus 4 (Epstein Barr virus)
aggauggaacacgaccuugagaggggcccaccgggcccgcgacggcccccucgaggaccccccc

SEQ ID NO: 545404 - RNA, 64 nt, Human Herpes Virus 4 (Epstein Barr virus); identical to SEQ ID NO: 545400

SEQ ID NO: 545405 - RNA, 64 nt, Human Herpes Virus 4 (Epstein Barr virus); identical to SEQ ID NO: 545401

SEQ ID NO: 545406 - RNA, 64 nt, Human Herpes Virus 4 (Epstein Barr virus); identical to SEQ ID NO: 545402

SEQ ID NO: 545407 - RNA, 64 nt, Human Herpes Virus 4 (Epstein Barr virus); identical to SEQ ID NO: 545403

SEQ ID NO: 545408 - RNA, 64 nt, Human Herpes Virus 4 (Epstein Barr virus)
uuggccacgcaccccgggccaggccaccuuagacccggccaagccccaucccugaagacccagc

SEQ ID NO: 545409 - RNA, 64 nt, Human Herpes Virus 4 (Epstein Barr virus); identical to SEQ ID NO: 545408

SEQ ID NO: 545410 - RNA, 64 nt, Human Herpes Virus 4 (Epstein Barr virus); identical to SEQ ID NO: 545408

SEQ ID NO: 545411 - RNA, 64 nt, Human Herpes Virus 4 (Epstein Barr virus)
ucugggaccguuuggacacccccgggggcccggcccggccaagagcgaagacgaggagucugag

SEQ ID NO: 545412 - RNA, 64 nt, Human Herpes Virus 4 (Epstein Barr virus)
ggaguuucugaaauccauccucaccggccaguccccggccaacuucugcuucaaguccaugugg

SEQ ID NO: 545413 - RNA, 64 nt, Human Herpes Virus 4 (Epstein Barr virus)
acagacgucgaggcauacugccggucccugagggccggccaaacggcgcgcgcggauccggccu

SEQ ID NO: 545414 - RNA, 64 nt, Human Herpes Virus 2
uuuuucgaggagcucgcgauccgcauaugcuacuacccacgaagccccggcggguuuguccgcu

SEQ ID NO: 545415 - RNA, 64 nt, Human Herpes Virus 2
cccgcgccuggccacgcaucuccgggccgugaccacccacgaccccagccccgcggccagcacg

SEQ ID NO: 545416 - RNA, 64 nt, Human Herpes Virus 2
gcucgugggggagugcgcucuucgcggcggccgcacccacgacauccgcggcuuuaucaccccg

SEQ ID NO: 545417 - RNA, 64 nt, Human Herpes Virus 2
uggaggcccaagaugccggcgguagcacccccgaacccacgacacccggcccacaggacacgca

SEQ ID NO: 545418 - RNA, 64 nt, Human Herpes Virus 2
gcugggggacguggagucccccuccccgggaaugacccacgaccccgucucguauggggcuuug

SEQ ID NO: 545419 - RNA, 64 nt, Human Herpes Virus 2
cgucaagucguguccgcgggaagcgccgcgcgggacccacgaggagcuguacuauggcccgguc

SEQ ID NO: 545420 - RNA, 64 nt, Human Herpes Virus 2
ccagacccuggaaagucuagacgcgcgcuacgucucgcgagacggcgcgggggacgcggccguc

SEQ ID NO: 545421 - RNA, 64 nt, Human Herpes Virus 2
aagcucgcgcacguggcgacccccgcuugucaauucgcgagagcuguaccgggcccaacgcgcg

SEQ ID NO: 545422 - RNA, 63 nt, Human Herpes Virus 4 (Epstein Barr virus)
cccagugaguaucuauuuguuacuccuguuuaguugaagaaaacaagcuauuggauuguaaca

SEQ ID NO: 545423 - RNA, 63 nt, Human Herpes Virus 4 (Epstein Barr virus)
aggaccagaaugagcaugccgccgaagggguuuuugaagaaggagaugaaaccagagaccagg

SEQ ID NO: 545424 - RNA, 63 nt, Human Herpes Virus 4 (Epstein Barr virus)
ccuggccacgaaggacgcgguuaccugcagaaauugaagaauaaugcuggcugaaauucccca

SEQ ID NO: 545425 - RNA, 63 nt, Human Herpes Virus 4 (Epstein Barr virus)
ccuggaugcuggacggagauuuacaugcaggcauugaagaauccggcaauacgaucucaguuu

SEQ ID NO: 545426 - RNA, 64 nt, Human Herpes Virus 4 (Epstein Barr virus)
ccccgcgaaaccccgucuucgccggcgcagcagccuccgcuacuccugagaaaucuuaugccuu

SEQ ID NO: 545427 - RNA, 63 nt, Human Herpes Virus 4 (Epstein Barr virus)
gguaugggggcccguuuauuaugguaaggcucuucgggcaagauggagaggcaaacauacagg

SEQ ID NO: 545428 - RNA, 63 nt, Human Herpes Virus 4 (Epstein Barr virus)
gacugcggugacagcaguuccagcagcagugacucgggcaacagugacaccgagcagagcgag

SEQ ID NO: 545429 - RNA, 64 nt, Human Herpes Virus 1
cgccgacgagacgcuggcguggugcaagaugugcauccaccacaaccugccgcugcgcccccag

SEQ ID NO: 545430 - RNA, 64 nt, Human Herpes Virus 1
uuggggggcgguuuuuucuggacaugucggcggaauccaccacggggacggaaacggaugcguc

SEQ ID NO: 545431 - RNA, 64 nt, Human Herpes Virus 1
agucaggccuggucgacuuugucaccuacuucucauccaccaauuacauuaugaacgaccgccc

SEQ ID NO: 545432 - RNA, 64 nt, Human Herpes Virus 1
acggcggcuccuuccgauucucuuccgacgccauauccaccaccuucaccaccaaccugaccga

SEQ ID NO: 545433 - RNA, 64 nt, Human Herpes Virus 2
gugugacguacuaccggcucacccgcgccugccgucagcccauccuccuucggcaguauggagg

SEQ ID NO: 545434 - RNA, 60 nt, Human Herpes Virus 2
ccgggccggcgucgggcccacgaugcagauggccgacaacaucgagcagcugcugcgcga

SEQ ID NO: 545435 - RNA, 64 nt, Human Herpes Virus 4 (Epstein Barr virus)
gccuucuuugaggacuaugcccugcucugcuacuacugucuaaaugccccacgagccuggaucu

SEQ ID NO: 545436 - RNA, 64 nt, Human Herpes Virus 4 (Epstein Barr virus)
cauccaugucaucaucucuauuuacucacaaaagacugucuacggggcccuguuauuuaaaucc

SEQ ID NO: 545437 - RNA, 64 nt, Human Herpes Virus 2
cgccaucugguggccugggagacggccgcgcgccuggcccgacggggguccugggcgcgcgagc

SEQ ID NO: 545438 - RNA, 64 nt, Human Herpes Virus 2
uccaguggggucugcaaccugggaagcgugaaucuggcccgaugcgucuccaggcagacguuug

SEQ ID NO: 545439 - RNA, 64 nt, Human Herpes Virus 2
ucgugcugcuguccgucaguccucggccccgcaguggcccgacggccccccaagaggucuaggu

SEQ ID NO: 545440 - RNA, 64 nt, Human Herpes Virus 2
gacgucucugccuuuuucaccgagaccaugggucuggcccgacccuguccguaccaccagcaga

SEQ ID NO: 545441 - RNA, 64 nt, Human Herpes Virus 2; identical to SEQ ID NO: 545437

SEQ ID NO: 545442 - RNA, 64 nt, Human Herpes Virus 4 (Epstein Barr virus)
uaucuuggagaaugucggccaggggcaacagcagacucuggagugcggaggaacugcuaaacag

SEQ ID NO: 545443 - RNA, 64 nt, Human Herpes Virus 4 (Epstein Barr virus)
gaguccacgaucccugaggcgggagcagccgggaacucuggaccccgggaggacaccaacccuc

SEQ ID NO: 545444 - RNA, 64 nt, Human Herpes Virus 4 (Epstein Barr virus)
uaggcugguccugacugauuaugggacugcuucccuccacgaccgcaacaagaugcuggaugug

SEQ ID NO: 545445 - RNA, 64 nt, Human Herpes Virus 4 (Epstein Barr virus)
uccgcaaaacuucgugcacagaaggaggugcggacuccacgagccggagcuucauguaccagaa

SEQ ID NO: 545446 - RNA, 64 nt, Human Herpes Virus 2
ugugggacaucggccagagccacuuucagaagcgcagcaagaucaaggugaacgggauggugaa

SEQ ID NO: 545447 - RNA, 64 nt, Human Herpes Virus 2; identical to SEQ ID NO: 541139

SEQ ID NO: 545448 - RNA, 64 nt, Human Herpes Virus 2; identical to SEQ ID NO: 541140

SEQ ID NO: 545449 - RNA, 64 nt, Human Herpes Virus 2; identical to SEQ ID NO: 541141

SEQ ID NO: 545450 - RNA, 64 nt, Human Herpes Virus 2; identical to SEQ ID NO: 541142

SEQ ID NO: 545451 - RNA, 64 nt, Human Herpes Virus 2; identical to SEQ ID NO: 541143

SEQ ID NO: 545452 - RNA, 63 nt, Human Herpes Virus 2
ugcgguuucgggagugcgcgccggaggacgccgugccccaacgcaacgccuacuacagcgucc

SEQ ID NO: 545453 - RNA, 63 nt, Human Herpes Virus 2
uucugacccccccaggcgaggccgacgacccccugccccaaacggccuuccgcggaggcgccc

SEQ ID NO: 545454 - RNA, 64 nt, Human Herpes Virus 1
aacugcgcgaggcgcgccggaccagggcgggggcaucgggcaccgggauggccgccgcgacggc

SEQ ID NO: 545455 - RNA, 64 nt, Human Herpes Virus 1
ccccgguacugccccccaugaaccccguuccgacaucgggcaccccggcccccgcgccgcccgg

SEQ ID NO: 545456 - RNA, 62 nt, Human Herpes Virus 1
cguccccguguucguccacgaguucgucucguccgagccaaugcgccuccaccgagauaacg

SEQ ID NO: 545457 - RNA, 62 nt, Human Herpes Virus 1
uggacggagauuacacaguuuauccuggagcaccgagccaagggcuccuguaaguacgcccu

SEQ ID NO: 545458 - RNA, 64 nt, Human Herpes Virus 4 (Epstein Barr virus)
ucccccaccccucaaagcccaccuuucuuccucccguuaaaaggaagaagggccucagggauag

SEQ ID NO: 545459 - RNA, 64 nt, Human Herpes Virus 4 (Epstein Barr virus)
ugaccacggcccacgucuuuaccaccucaaccgccguuaaaacaguagaagaacugcaagauau

SEQ ID NO: 545460 - RNA, 64 nt, Human Herpes Virus 4 (Epstein Barr virus)
gagucuaauuuccgcaggcccucuucucauuccgcguuaaaacaaaagaaugguggcaagggua

SEQ ID NO: 545461 - RNA, 64 nt, Human Herpes Virus 4 (Epstein Barr virus)
cgacucuacagcggaaaccugguggccauuccaucguuaaaacaggagguagcgguggggcagu

SEQ ID NO: 545462 - RNA, 64 nt, Human Herpes Virus 1
gccaacagacagccaggacuccgcgucggacgcggucagccacggcgauccggaagaccucgau

SEQ ID NO: 545463 - RNA, 64 nt, Human Herpes Virus 4 (Epstein Barr virus)
cuaagagaugccuucagucguguuaaaaccuuuuuccagacaaaggacgagguagauaaccuuu

SEQ ID NO: 545464 - RNA, 64 nt, Human Herpes Virus 4 (Epstein Barr virus)
agcccacccuccaggggaggcuggaggcggauuuuccagacaguccccugcuuccuaaauuuca

SEQ ID NO: 545465 - RNA, 64 nt, Human Herpes Virus 4 (Epstein Barr virus)
aauucagaccugaucagggaagcguucuucacuguccagacacggguuaguugggaaaguuguu

SEQ ID NO: 545466 - RNA, 64 nt, Human Herpes Virus 4 (Epstein Barr virus)
gacaaggaguaccugcgucucauucccaaguguuuccagacaccaggcgccgcagggguggugg

SEQ ID NO: 545467 - RNA, 64 nt, Human Herpes Virus 1
ggcccuggagguggcgcacgaggccgaggcccuagucagccaacucggcaacgccggggaggug

SEQ ID NO: 545468 - RNA, 59 nt, Human Herpes Virus 4 (Epstein Barr virus)
gccaugcucaucaggauaugccggauuuucaaaagcaugcgccagggcacugacuaugu

SEQ ID NO: 545469 - RNA, 60 nt, Human Herpes Virus 2
uuuggaggacuugagucacucuguguuuccggccgacacccaggaaacaacgacgcgccg

SEQ ID NO: 545470 - RNA, 60 nt, Human Herpes Virus 2
caaggacgugccgguggggagcgacgcgcgggccgacagcgccgcccugcugcgcuuugu

SEQ ID NO: 545471 - RNA, 60 nt, Human Herpes Virus 2
cuuccagaaccagagccugcgcccccugcuggccgacaccgucgccgcggccgacucgcu

SEQ ID NO: 545472 - RNA, 60 nt, Human Herpes Virus 2
ccucagccccugcuucaaguucuucaccgcggccgacaucacggccaaacaucgcugccu

SEQ ID NO: 545473 - RNA, 60 nt, Human Herpes Virus 2
cucagcgcccuguugacgaagcucaaacgcggccgacaccagagccauuaaaaaaaugcg

SEQ ID NO: 545474 - RNA, 60 nt, Human Herpes Virus 2
ggggcucauccugcagcggcugcugggccuggccgacacgguggucgcgugcguggcccu

SEQ ID NO: 545475 - RNA, 60 nt, Human Herpes Virus 2; identical to SEQ ID NO: 545471

SEQ ID NO: 545476 - RNA, 60 nt, Human Herpes Virus 2
gucgcuccccuucagccuggaccagaccguggccgacaacugccugacccucucgggcau

SEQ ID NO: 545477 - RNA, 64 nt, Human Herpes Virus 4 (Epstein Barr virus)
ggccccggcuggccaucgagauuguuuacaucugcccggcuauacaccaaagguucuuugaacu

SEQ ID NO: 545478 - RNA, 64 nt, Human Herpes Virus 4 (Epstein Barr virus)
ccacacacgaccuggcaaaauuucacagucuucccccggcuagaaaggcggcagguaagcgagc

SEQ ID NO: 545479 - RNA, 64 nt, Human Herpes Virus 4 (Epstein Barr virus)
ccguccggucacgucucauguuggcaucaucgaucccggcuacacgggggaacuccggcuaauc

SEQ ID NO: 545480 - RNA, 64 nt, Human Herpes Virus 4 (Epstein Barr virus)
ggccuuucugcuugaugugauaucggcccuccaccccggcuacaccauuccuauggaaaucacg

SEQ ID NO: 545481 - RNA, 64 nt, Human Herpes Virus 1
gcaaaacuuuuacaaccccuaccucgccccagucgggacgcaacagaagccgaccgggccaacc

SEQ ID NO: 545482 - RNA, 64 nt, Human Herpes Virus 1
uugucgcgcucaugcgcaaccucaacagccugaugggacgcacgcgguuuauuuaccuggcguu

SEQ ID NO: 545483 - RNA, 64 nt, Human Herpes Virus 1
aaauggaguccacgguaggcccagcauguccgccgggacgcaccgugacuaagcgucccugggc

SEQ ID NO: 545484 - RNA, 64 nt, Human Herpes Virus 4 (Epstein Barr virus)
ggcaaggggguuccccaacggccauggccgccucagcggugacacaggcacccacggaauauac

SEQ ID NO: 545485 - RNA, 64 nt, Human Herpes Virus 4 (Epstein Barr virus)
cucuggcgacggaagaggaggaggaggcggugguagcggugaaggaaaagagcguuucauccuc

SEQ ID NO: 545486 - RNA, 64 nt, Human Herpes Virus 4 (Epstein Barr virus)
aguaggaggucagggugacucgcucacccaagaaagcggugacagccuggccggcggccacaca

SEQ ID NO: 545487 - RNA, 64 nt, Human Herpes Virus 4 (Epstein Barr virus)
cuagugguuucggacacaccgccaacgcucagugcggugcuaccgacccgaggucaagucccgg

SEQ ID NO: 545488 - RNA, 64 nt, Human Herpes Virus 4 (Epstein Barr virus)
gccuccagcccuccccucuuguccguguagaugccggugcuaagcacccccgggguccccgcuc

SEQ ID NO: 545489 - RNA, 64 nt, Human Herpes Virus 2
cgaauccccaccauggcguugggggcugggcaugcccacgcaugcagggaugacggagaugaua

SEQ ID NO: 545490 - RNA, 64 nt, Human Herpes Virus 2
ccccgcaucaucccgcccgcauccggcgacccaccccacgcagcgcccguguuuuacgugcaug

SEQ ID NO: 545491 - RNA, 65 nt, Human Herpes Virus 4 (Epstein Barr virus)
ccuagugguuucggacacaccgccaacgcucagugcggugcuaccgacccgaggucaagucccgg

SEQ ID NO: 545492 - RNA, 65 nt, Human Herpes Virus 4 (Epstein Barr virus)
ggccuccagcccuccccucugguccguguagaugccggugcuaagcacccccgggguccccgcuc

SEQ ID NO: 545493 - RNA, 64 nt, Human Herpes Virus 4 (Epstein Barr virus); identical to SEQ ID NO: 545484

SEQ ID NO: 545494 - RNA, 64 nt, Human Herpes Virus 4 (Epstein Barr virus); identical to SEQ ID NO: 545485

SEQ ID NO: 545495 - RNA, 64 nt, Human Herpes Virus 4 (Epstein Barr virus); identical to SEQ ID NO: 545486

SEQ ID NO: 545496 - RNA, 64 nt, Human Herpes Virus 4 (Epstein Barr virus); identical to SEQ ID NO: 545487

SEQ ID NO: 545497 - RNA, 64 nt, Human Herpes Virus 4 (Epstein Barr virus); identical to SEQ ID NO: 545488

SEQ ID NO: 545498 - RNA, 65 nt, Human Herpes Virus 4 (Epstein Barr virus); identical to SEQ ID NO: 545491

SEQ ID NO: 545499 - RNA, 65 nt, Human Herpes Virus 4 (Epstein Barr virus); identical to SEQ ID NO: 545492

SEQ ID NO: 545500 - RNA, 64 nt, Human Herpes Virus 2
cccggucccccccaacgcauacacgcccuaucaucugagggaguaugcgacgcggcugguuaac

SEQ ID NO: 545501 - RNA, 64 nt, Human Herpes Virus 2
acaaccucuuccugugggaggaccagacgcugcugcgggcgaccgccaacaccauuacggcccu

SEQ ID NO: 545502 - RNA, 64 nt, Human Herpes Virus 2
cgccaacaacacguucgccccgcagccuauguucgcgggcgacgccgcggccgaauggcugcgg

SEQ ID NO: 545503 - RNA, 64 nt, Human Herpes Virus 2
gaccgacagccaggacuccuccuccgagccggacgcgggcgaccgcggcgccccagaagaagaa

SEQ ID NO: 545504 - RNA, 64 nt, Human Herpes Virus 2
gccggccagacggcgcgggggaucgcuggucuacgcgggcgagcuaacgcaggugaccaccgag

SEQ ID NO: 545505 - RNA, 64 nt, Human Herpes Virus 2
gggccguauccgccgguggggcccuaccaccacccccacgcagacacggagacccccgcccaac

SEQ ID NO: 545506 - RNA, 64 nt, Human Herpes Virus 2
cgcguccgauacaacaaacgcgaccgcacgccuccccacgcaccccccacucauccguuccggg

SEQ ID NO: 545507 - RNA, 64 nt, Human Herpes Virus 2
aagcgccugucggccccgcgcgccgcccgucugugcgggcgacgggcccucggccgguggcgac

SEQ ID NO: 545508 - RNA, 64 nt, Human Herpes Virus 2
accgcucgccauagcauacagucccccguuccccgcgggcgacgagggacuguauucggaguug

SEQ ID NO: 545509 - RNA, 64 nt, Human Herpes Virus 2
cccggcgcuggacggccgggccgccgccucgggcgcgggcgacgccauggcgcccggcgcgccg

SEQ ID NO: 545510 - RNA, 64 nt, Human Herpes Virus 2
cccgaccacaccccccgcccccguauccccaacggcgggcgaguucccagcaaacacaacagac

SEQ ID NO: 545511 - RNA, 64 nt, Human Herpes Virus 2
gucgucgucuccuacgagaauucgguggcguggggcgggcgacgcgcccgccccccgcggcugu

SEQ ID NO: 545512 - RNA, 64 nt, Human Herpes Virus 2
ggggcgcuuugccagccgggggggcccccgggccgcgggcgaggacguccucaacgacgugcuc

SEQ ID NO: 545513 - RNA, 64 nt, Human Herpes Virus 2
gggcggguuugagcagcgccuggccucggugauggcgggcgacgccgcccuggcccuggagucc

SEQ ID NO: 545514 - RNA, 64 nt, Human Herpes Virus 2
ccuggggaucgggggcugcugccccgcgugcagcgcgggcgacgggcggcuggccaccgucagc

SEQ ID NO: 545515 - RNA, 64 nt, Human Herpes Virus 2
ucgcuccggaggcgcgcuccuggaaauggcccaggcgggcgacgcuggaggcgaugcucaacga

SEQ ID NO: 545516 - RNA, 64 nt, Human Herpes Virus 2
caucucguggaccgaaauucuggcccaacagaucgcgggcgaggacgacuacgaagaagacccc

SEQ ID NO: 545517 - RNA, 64 nt, Human Herpes Virus 2
cgugcccagcggccuggacauccccgacgacccggcgggcgacugcgaccccagccugcacgug

SEQ ID NO: 545518 - RNA, 64 nt, Human Herpes Virus 2; identical to SEQ ID NO: 545509

SEQ ID NO: 545519 - RNA, 64 nt, Human Herpes Virus 4 (Epstein Barr virus)
uuugaaagugguagugucucucuccucucgucuguauaccgaugagauugccaagaugcaacag

SEQ ID NO: 545520 - RNA, 64 nt, Human Herpes Virus 4 (Epstein Barr virus)
uguuuaugagacgccagcaccccggccucuuucccuucguuaaugcaauagcaucaucgcuggg

SEQ ID NO: 545521 - RNA, 64 nt, Human Herpes Virus 4 (Epstein Barr virus)
gagcggaagacaacgagguauuccucaagcccuucuucguuaugcacucugaccaggacaucgu

SEQ ID NO: 545522 - RNA, 64 nt, Human Herpes Virus 2
ccgagguggacgacgccgggccggcggaccccaaggaccacagcaagcccuccuuuuaccgcuu

SEQ ID NO: 545523 - RNA, 64 nt, Human Herpes Virus 4 (Epstein Barr virus)
aauguuaagaccucugauagaucugauaaggcagaagcacaaagcaccccugaaaggccgggcc

SEQ ID NO: 545524 - RNA, 64 nt, Human Herpes Virus 4 (Epstein Barr virus)
ggcggcggccuuccucgguccccccaaaaaacgcaagcacaaagcucaauaucuguuuaaccug

SEQ ID NO: 545525 - RNA, 62 nt, Human Herpes Virus 2
ucgggagguaccgcgacgauuucauuaucuucgcccuggagcacuuuuuccuccgcgcgcuc

SEQ ID NO: 545526 - RNA, 62 nt, Human Herpes Virus 2
ggcccagccacacgccggcgcccucggccgccgcccuggaggccuacugcgccccgcgggcc

SEQ ID NO: 545527 - RNA, 62 nt, Human Herpes Virus 2
uggccucggugauggcgggcgacgccgcccuggcccuggaguccaucgugucgauggcgguc

SEQ ID NO: 545528 - RNA, 62 nt, Human Herpes Virus 2
accuggccgcggccaccaagauccgcuucccggcccuggagggcauccaccccaacguccuc

SEQ ID NO: 545529 - RNA, 64 nt, Human Herpes Virus 1; identical to SEQ ID NO: 538568

SEQ ID NO: 545530 - RNA, 64 nt, Human Herpes Virus 1; identical to SEQ ID NO: 538568

SEQ ID NO: 545531 - RNA, 64 nt, Human Herpes Virus 2
acacgcucuugcugaaggaacucgagcgcacguucggcgggaagcggcuccuggacgcgaugga

SEQ ID NO: 545532 - RNA, 64 nt, Human Herpes Virus 2
cgccccgagccgaucccaggcccgccgggcggcccggcgggagcgcgccaacucgcgcucccug

SEQ ID NO: 545533 - RNA, 64 nt, Human Herpes Virus 2; identical to SEQ ID NO: 536846

SEQ ID NO: 545534 - RNA, 64 nt, Human Herpes Virus 2; identical to SEQ ID NO: 536853

SEQ ID NO: 545535 - RNA, 62 nt, Human Herpes Virus 2
gcgcgccgcugcggcccgucuacguggcgcuggggcgcgacgccgugcgcggcggcccggcg

SEQ ID NO: 545536 - RNA, 64 nt, Human Herpes Virus 4 (Epstein Barr virus)
uugcgggggauggugagccagacacggcgggugggggaaggagcugacacgauugaguagaaag

SEQ ID NO: 545537 - RNA, 64 nt, Human Herpes Virus 4 (Epstein Barr virus)
aaagggauugggcaaagauaagaucaggaggcgggggaaggagggccgccgccucccucugucc

SEQ ID NO: 545538 - RNA, 64 nt, Human Herpes Virus 1
aacgcucggcccccccugcccugcgcccggcgcgucgcccuaccaaaggcaaaacccccgucgg

SEQ ID NO: 545539 - RNA, 64 nt, Human Herpes Virus 4 (Epstein Barr virus); identical to SEQ ID NO: 545536

SEQ ID NO: 545540 - RNA, 64 nt, Human Herpes Virus 4 (Epstein Barr virus); identical to SEQ ID NO: 545537

SEQ ID NO: 545541 - RNA, 64 nt, Human Herpes Virus 4 (Epstein Barr virus); identical to SEQ ID NO: 545536

SEQ ID NO: 545542 - RNA, 64 nt, Human Herpes Virus 4 (Epstein Barr virus); identical to SEQ ID NO: 545537

SEQ ID NO: 545543 - RNA, 62 nt, Human Herpes Virus 2
caccggccgcgggucgcgcccccaggacccgggggcgcgaccgcagcagcuucgccaggcgu

SEQ ID NO: 545544 - RNA, 62 nt, Human Herpes Virus 2
ggguuuuuuaaccggccccacggcgccccggggggcgcgaucacggcggagcagaccaacgu

SEQ ID NO: 545545 - RNA, 62 nt, Human Herpes Virus 2
ccugcuggcgcgcgagaacgcggcgcugaccggggcgcgaacccccgacgacggcggcgacg

SEQ ID NO: 545546 - RNA, 62 nt, Human Herpes Virus 2
acacaccagacccaccacgccgcccgcgccccgggcgcgacgucggcgcccggcgcggccuc

SEQ ID NO: 545547 - RNA, 62 nt, Human Herpes Virus 2
gaacugcgcgucaagagccgcguguuguucgcgggcgcgagcgccaacgcguccgaggccgc

SEQ ID NO: 545548 - RNA, 62 nt, Human Herpes Virus 2
ggcgcgcgcgucaccaagcaggcccggcgggggggcgcgaggcgggaugagguggugcgcag

SEQ ID NO: 545549 - RNA, 62 nt, Human Herpes Virus 2
ugcuguacuggcccggggugcgcgcgcuccuggggcgcgacugucgcguggccgcccgcuac

SEQ ID NO: 545550 - RNA, 62 nt, Human Herpes Virus 2; identical to SEQ ID NO: 545535

SEQ ID NO: 545551 - RNA, 62 nt, Human Herpes Virus 2; identical to SEQ ID NO: 545545

SEQ ID NO: 545552 - RNA, 64 nt, Human Herpes Virus 2; identical to SEQ ID NO: 536841

SEQ ID NO: 545553 - RNA, 64 nt, Human Herpes Virus 2; identical to SEQ ID NO: 536842

SEQ ID NO: 545554 - RNA, 64 nt, Human Herpes Virus 2; identical to SEQ ID NO: 536843

SEQ ID NO: 545555 - RNA, 64 nt, Human Herpes Virus 2; identical to SEQ ID NO: 536844

SEQ ID NO: 545556 - RNA, 64 nt, Human Herpes Virus 2; identical to SEQ ID NO: 536845

SEQ ID NO: 545557 - RNA, 64 nt, Human Herpes Virus 2; identical to SEQ ID NO: 536847

SEQ ID NO: 545558 - RNA, 64 nt, Human Herpes Virus 2; identical to SEQ ID NO: 536848

SEQ ID NO: 545559 - RNA, 64 nt, Human Herpes Virus 2; identical to SEQ ID NO: 536849

SEQ ID NO: 545560 - RNA, 64 nt, Human Herpes Virus 2; identical to SEQ ID NO: 536850

SEQ ID NO: 545561 - RNA, 64 nt, Human Herpes Virus 2; identical to SEQ ID NO: 536851

SEQ ID NO: 545562 - RNA, 64 nt, Human Herpes Virus 2; identical to SEQ ID NO: 536852

SEQ ID NO: 545563 - RNA, 64 nt, Human Herpes Virus 2; identical to SEQ ID NO: 536854

SEQ ID NO: 545564 - RNA, 64 nt, Human Herpes Virus 4 (Epstein Barr virus); identical to SEQ ID NO: 545536

SEQ ID NO: 545565 - RNA, 64 nt, Human Herpes Virus 4 (Epstein Barr virus); identical to SEQ ID NO: 545537

SEQ ID NO: 545566 - RNA, 64 nt, Human Herpes Virus 4 (Epstein Barr virus); identical to SEQ ID NO: 545536

SEQ ID NO: 545567 - RNA, 64 nt, Human Herpes Virus 4 (Epstein Barr virus); identical to SEQ ID NO: 545537

SEQ ID NO: 545568 - RNA, 64 nt, Human Herpes Virus 2
ggucucgcacgaggguaacgugcuggccgucgugcggcgggaaauccacggguuccuggccauc

SEQ ID NO: 545569 - RNA, 64 nt, Human Herpes Virus 2
cagagggcguaucugguuaaccccuuucucuuugcggcgggauuuuuggaggacuugagucacu

SEQ ID NO: 545570 - RNA, 64 nt, Human Herpes Virus 2
cccagggacaggugggccgccgccuccgucgcggcggcgggagccgcggcccccagccgcgcga

SEQ ID NO: 545571 - RNA, 64 nt, Human Herpes Virus 2
ccgaggcgguccgggcccacaucacgaccaacuacggcgggacgcgggccggggcgcggcugga

SEQ ID NO: 545572 - RNA, 64 nt, Human Herpes Virus 2
cgugcgcggcggcccggcggagcugcgcgggccgcggcgggaguucugcgcgcgggcgcugcuc

SEQ ID NO: 545573 - RNA, 64 nt, Human Herpes Virus 2
gcgcgcaucggaccccccaucgcgucacaccagacggcgggaccccgacguggcccgcccuccu

SEQ ID NO: 545574 - RNA, 64 nt, Human Herpes Virus 2
aucuacucgccaacacggugcgguaccugcagcgcggcgggagguggcgggaggacuggggccg

SEQ ID NO: 545575 - RNA, 64 nt, Human Herpes Virus 2
cgguccugcagcaccucgcccccagacuagcgggcggcgggagcgacgcgcccccguaggcccg

SEQ ID NO: 545576 - RNA, 64 nt, Human Herpes Virus 4 (Epstein Barr virus); identical to SEQ ID NO: 545536

SEQ ID NO: 545577 - RNA, 64 nt, Human Herpes Virus 4 (Epstein Barr virus); identical to SEQ ID NO: 545537

SEQ ID NO: 545578 - RNA, 64 nt, Human Herpes Virus 4 (Epstein Barr virus)
auacaaugcgaccaccuaucuaccucccagcacuucuagcaaacugcggccccgcuggacuuuu

SEQ ID NO: 545579 - RNA, 64 nt, Human Herpes Virus 4 (Epstein Barr virus)
auggucgucaucuggcucuccugugugaccccucacuuuguacagacuuuuggcaaugggagca

SEQ ID NO: 545580 - RNA, 64 nt, Human Herpes Virus 4 (Epstein Barr virus)
augcgaguuugcaaugucccccgccucaucaacaacuuuguagcccgcaaguacguggugaaag

SEQ ID NO: 545581 - RNA, 64 nt, Human Herpes Virus 4 (Epstein Barr virus)
ccggucuuccucugccauuuugcagacaggcacuacuuuguaaugacagccgcugaccccuucu

SEQ ID NO: 545582 - RNA, 64 nt, Human Herpes Virus 4 (Epstein Barr virus)
acaaccuuugugcauuaugccaacuuucacaacuacuuuguacccaaccugaaggauauguuuu

SEQ ID NO: 545583 - RNA, 64 nt, Human Herpes Virus 4 (Epstein Barr virus)
uaugaguccuucaggcucacggggggcgucuaccacuuuguaaagaagcacgugcacgaguccu

SEQ ID NO: 545584 - RNA, 64 nt, Human Herpes Virus 4 (Epstein Barr virus)
ccuucugcuccagugccuccgccugagccgcuuacagcucgacagcgagagguaaugauuacgc

SEQ ID NO: 545585 - RNA, 64 nt, Human Herpes Virus 4 (Epstein Barr virus)
gugagaugaaggucugcaggguggcaaugccguccagcucgaugguuuuaaaguggugguaguc

SEQ ID NO: 545586 - RNA, 64 nt, Human Herpes Virus 4 (Epstein Barr virus)
uugaccuggaggcggcccgcccgccaccgaggaacagcucgaggggcggagaucaggaggcggg

SEQ ID NO: 545587 - RNA, 64 nt, Human Herpes Virus 2
guuuguacacgaguuuguuucguccgaacccaugcgccuccaucgagauaacgucaugcugucu

SEQ ID NO: 545588 - RNA, 64 nt, Human Herpes Virus 2
ccugcgaccuccccgagucccaccucagcgaucucgccuccaggggccugccggcccccgucgu

SEQ ID NO: 545589 - RNA, 64 nt, Human Herpes Virus 2
uguaugucacagagaaggcggacgggacgcuccccgccuccacccugguccgccuucucgucca

SEQ ID NO: 545590 - RNA, 64 nt, Human Herpes Virus 2
augccgguuucccaacuccacccgcacggaguuccgccuccagaucuggcguuaugccacggcg

SEQ ID NO: 545591 - RNA, 64 nt, Human Herpes Virus 2
agcucugggcccugcuucggcggggccugacgaccgccuccacgcugcgguggggcgcgcaggg

SEQ ID NO: 545592 - RNA, 64 nt, Human Herpes Virus 2
uguccgugcgcgggcaugccguacgccggaggcgcgccuccacccggucccaugccccguccgc

SEQ ID NO: 545593 - RNA, 64 nt, Human Herpes Virus 2
uuugucguuauugauaucgacacccccacggacucgccuccaccguacucugcagggacgucgc

SEQ ID NO: 545594 - RNA, 62 nt, Human immunodeficiency virus type 1 (BLAI)
gggggacaucaagcagccaugcaaauguuaaaagagaccaucaaugaggaagcugcagaaug

SEQ ID NO: 545595 - RNA, 61 nt, Human immunodeficiency virus type 1 (BLAI)
aaaggaaggacaccaaaugaaagauuguacugagagacaggcuaauuuuuuagggaagauc

SEQ ID NO: 545596 - RNA, 61 nt, Human immunodeficiency virus type 1 (BLAI)
ggcccgaaggaauagaagaagaagguggagagagagacagagacagauccauucgauuagu

SEQ ID NO: 545597 - RNA, 63 nt, Human immunodeficiency virus type 1 (BLAI)
uagcacccaccaaggcaaagagaagaguggugcagagagaaaaaagagcagugggaauaggag

SEQ ID NO: 545598 - RNA, 63 nt, Human immunodeficiency virus type 1 (BLAI)
acccugugagccugcauggaauggaugacccugagagagaaguguuagaguggagguuugaca

SEQ ID NO: 545599 - RNA, 64 nt, Human Herpes Virus 1; identical to SEQ ID NO: 538563

SEQ ID NO: 545600 - RNA, 64 nt, Human Herpes Virus 1; identical to SEQ ID NO: 538564

SEQ ID NO: 545601 - RNA, 64 nt, Human Herpes Virus 1; identical to SEQ ID NO: 538565

SEQ ID NO: 545602 - RNA, 64 nt, Human Herpes Virus 1; identical to SEQ ID NO: 538566

SEQ ID NO: 545603 - RNA, 64 nt, Human Herpes Virus 1; identical to SEQ ID NO: 538567

SEQ ID NO: 545604 - RNA, 64 nt, Human Herpes Virus 1; identical to SEQ ID NO: 538569

SEQ ID NO: 545605 - RNA, 64 nt, Human Herpes Virus 1; identical to SEQ ID NO: 538570

SEQ ID NO: 545606 - RNA, 64 nt, Human Herpes Virus 1; identical to SEQ ID NO: 538571

SEQ ID NO: 545607 - RNA, 64 nt, Human Herpes Virus 1; identical to SEQ ID NO: 538572

SEQ ID NO: 545608 - RNA, 64 nt, Human Herpes Virus 1; identical to SEQ ID NO: 538569

SEQ ID NO: 545609 - RNA, 64 nt, Human Herpes Virus 2
cggcguccggcccaccggggggccgcggcgcggucggcgggagcugccgggacaagauacaacg

SEQ ID NO: 545610 - RNA, 64 nt, Human Herpes Virus 2; identical to SEQ ID NO: 545572

SEQ ID NO: 545611 - RNA, 64 nt, Human Herpes Virus 1; identical to SEQ ID NO: 538575

SEQ ID NO: 545612 - RNA, 64 nt, Human Herpes Virus 1; identical to SEQ ID NO: 538576

SEQ ID NO: 545613 - RNA, 62 nt, Human Herpes Virus 2
uguggcgggcgcuguaugcgugcguucuggcggcccuggagcgccagacgggccggugggcc

SEQ ID NO: 545614 - RNA, 62 nt, Human Herpes Virus 2
ugugggacugcgacggccuuaugcgacacgcggcccuggaccgccaccgagacugccggauu

SEQ ID NO: 545615 - RNA, 62 nt, Human Herpes Virus 2
uggccauaggcgacaggcuggucuuccuggaggcccuggagagacgcaucuacgccgccacc

SEQ ID NO: 545616 - RNA, 62 nt, Human Herpes Virus 2
ccaccgaggccauugcccugcucacgggggaggcccuggacgggacgggcauuagccugcau

SEQ ID NO: 545617 - RNA, 62 nt, Human Herpes Virus 2
agcgcgggcauggcgaguggucgaccgacgcggcccuggagguggcccacgaggcggaggcc

SEQ ID NO: 545618 - RNA, 62 nt, Human Herpes Virus 2
ugagcgaggaaaugauggaguuuaccacccgcgcccuggagcgcgggcauggcgaguggucg

SEQ ID NO: 545619 - RNA, 62 nt, Human Herpes Virus 2
agcucggggcuggccgaacugcggucacccucgcccuggauagcggcgcucgcgcagcagcu

SEQ ID NO: 545620 - RNA, 62 nt, Human Herpes Virus 2
cgcgccgggccccugaccgugcgacucggcuggcccuggaggggcgccggcggcagggcccc

SEQ ID NO: 545621 - RNA, 62 nt, Human Herpes Virus 2
gacgaaaauucgcagaucggcaguaccgggaggcccuggaacguccuggucgccagggacgu

SEQ ID NO: 545622 - RNA, 62 nt, Human Herpes Virus 2
aucaacgcccugcggucgccgagcgcgcccacgcccuggagguuggagcucugcgucaucuu

SEQ ID NO: 545623 - RNA, 62 nt, Human Herpes Virus 2
ucacgcccgcgcacugcacccaguacauaucggcccuggagggguuuuugguggcgggggug

SEQ ID NO: 545624 - RNA, 62 nt, Human Herpes Virus 2
gucgccgccacgucauccacgacgccccggaggcccuggacuggcugcccgauccgaugacc

SEQ ID NO: 545625 - RNA, 62 nt, Human Herpes Virus 2
acggcgaggagguggauaugacgcccgccgacgcccuggacgacuucgacuuggagaugcug

SEQ ID NO: 545626 - RNA, 62 nt, Human Herpes Virus 2; identical to SEQ ID NO: 545526

SEQ ID NO: 545627 - RNA, 64 nt, Human Herpes Virus 1
gcuucgggccccccggguaggcgcgcccaucacgggcuccgaugucauccugggggaggaggag

SEQ ID NO: 545628 - RNA, 64 nt, Human Herpes Virus 1
ugggguugacgcuggggguccugguggcgucggcggcuccgaguucccccggcacgccuggggu

SEQ ID NO: 545629 - RNA, 64 nt, Human Herpes Virus 1
ggaggucaucaaggacaccauccucgcggucaccggcuccgacacgucccaugcgcuggauucc

SEQ ID NO: 545630 - RNA, 62 nt, Human Herpes Virus 2
ugcugcaggcccagcgcaccgcggccgcggcggcccuggagaacgccgcccuccaggccgcc

SEQ ID NO: 545631 - RNA, 62 nt, Human Herpes Virus 2
cgaucgagcagcaggugcaucacaucgccgacgcccuggaggcgcuggagaccgcggcggcc

SEQ ID NO: 545632 - RNA, 62 nt, Human Herpes Virus 2
cccuguacgacagcggggacccgggcgagcuggcccuggacccagacacggugcgugcggcc

SEQ ID NO: 545633 - RNA, 64 nt, Human Herpes Virus 1; identical to SEQ ID NO: 545627

SEQ ID NO: 545634 - RNA, 64 nt, Human Herpes Virus 1; identical to SEQ ID NO: 545628

SEQ ID NO: 545635 - RNA, 64 nt, Human Herpes Virus 1; identical to SEQ ID NO: 545629

SEQ ID NO: 545636 - RNA, 64 nt, Human Herpes Virus 2
ccccccggacggccagggugcgcugggccauauuggaccacaugcacggggcgacgcagggaca

SEQ ID NO: 545637 - RNA, 64 nt, Human Herpes Virus 2
acgccggcgugcugcucauggccccccagcaccuggaccacaccauccaaaauggcgaauacuu

SEQ ID NO: 545638 - RNA, 64 nt, Human Herpes Virus 4 (Epstein Barr virus)
uccuggcccaugggauaucguacagcaacacuacgcacauuaacucccgugccuaacaggguug

SEQ ID NO: 545639 - RNA, 62 nt, Human Herpes Virus 2
ucagcuuuuucgagaagaaggcgucgcgcaacgcccuggagcacuuugggcgacgcgagacc

SEQ ID NO: 545640 - RNA, 62 nt, Human Herpes Virus 2
ccguggucaacgagagucuggucaucuacggggcccuggagacggacagcggucuguacacc

SEQ ID NO: 545641 - RNA, 60 nt, Human Herpes Virus 4 (Epstein Barr virus)
cuguuggagacugacgguuuuacugaacgagccugugaaucuugccaauaaacguuuauu

SEQ ID NO: 545642 - RNA, 64 nt, Human Herpes Virus 4 (Epstein Barr virus)
uauggucacucaggcacggucgccccuccgagugaccagucaccuuccagacuaugcauacacu

SEQ ID NO: 545643 - RNA, 59 nt, Human Herpes Virus 4 (Epstein Barr virus)
guggacacccaccacacagcauggcaacgaccagucaugucgagcaugagcuccucucc

SEQ ID NO: 545644 - RNA, 64 nt, Human Herpes Virus 4 (Epstein Barr virus)
ggguaggccaugauucuuccaggcauagguuacaaccagucacugcuaucaagccuacucaguu

SEQ ID NO: 545645 - RNA, 64 nt, Human Herpes Virus 4 (Epstein Barr virus)
ggcaagucaucuguuggaggacccugaugaagaaaccagucaggccgugaaggcccuaagggag

SEQ ID NO: 545646 - RNA, 64 nt, Human Herpes Virus 4 (Epstein Barr virus)
agcccccaccacauuagucucccacaccacaagcaccagucacaggccccauaggcggccuguu

SEQ ID NO: 545647 - RNA, 64 nt, Human Herpes Virus 2
gacggugcgccugcagaccgacccggucgaguaucuguccgagcagcucaacaaccucaucgaa

SEQ ID NO: 545648 - RNA, 64 nt, Human Herpes Virus 2
cgacauugauaugcuaaucgaccuaggauuggaccuguccgacagcgagcucgaggaggacgcu

SEQ ID NO: 545649 - RNA, 64 nt, Human Herpes Virus 2
gcccccguacaccagcacccugcugccgccggagcuguccgacaccaccaacgccacgcaaccc

SEQ ID NO: 545650 - RNA, 64 nt, Human Herpes Virus 2
gcgucgacgcccugcggaggggcgccggggcaagcuguccgaaaugggacgaggucuggggucg

SEQ ID NO: 545651 - RNA, 64 nt, Human Herpes Virus 4 (Epstein Barr virus)
ugagccacaggcauugcuaauguaccucauagacacaccuaaauuuagcacgucccaaaccaug

SEQ ID NO: 545652 - RNA, 64 nt, Human Herpes Virus 4 (Epstein Barr virus)
ccgccaccacggugcagccuaccgccacgcgucagcaaaccagcuuuccuuuccgagucugcga

SEQ ID NO: 545653 - RNA, 64 nt, Human Herpes Virus 1
gaguucccucugcgcuugcgauucuagccucguggggcuggacguucgacacgccaaaccacga

SEQ ID NO: 545654 - RNA, 64 nt, Human Herpes Virus 1
caugcagggccugcacacggccugccugaagcuggggcuggaucuggagucugccgaauuucag

SEQ ID NO: 545655 - RNA, 64 nt, Human Herpes Virus 1
uuuucccgacgacgaccucgacguuauuuucgcggggcuggacgaacaacagcucgacguguuu

SEQ ID NO: 545656 - RNA, 64 nt, Human Herpes Virus 1
acaaccaccuuccguccccugccccccccaccccagacgacaucagcuguggacccgagcuccc

SEQ ID NO: 545657 - RNA, 64 nt, Human Herpes Virus 1
ucagcugcuccuccggggagaugggggggucggacgccccgacgaugggcgggucugcgggcgc

SEQ ID NO: 545658 - RNA, 64 nt, Human Herpes Virus 1
caccuuaauaugcgaaguggaccugggaccgcgccgccccgacugcaucugcguguucgaauuc

SEQ ID NO: 545659 - RNA, 64 nt, Human Herpes Virus 1
caucugcgccaccuacgcgauuccccacgccccccgccccgacaccgucagcgcugcgucccug

SEQ ID NO: 545660 - RNA, 64 nt, Human Herpes Virus 1
ugcagcgacacguuucuccggccgugaguccggucgccccgacccccuuguauguccccaaaau

SEQ ID NO: 545661 - RNA, 64 nt, Human Herpes Virus 1
agucccaucccccgaucccaacaacucccccgcgcgccccgagaccagucgcccgaagacaccc

SEQ ID NO: 545662 - RNA, 64 nt, Human Herpes Virus 1
agcagcacggacccgucaccuuccccaacgcgagcgccccgacggccaggugcgugacuguggu

SEQ ID NO: 545663 - RNA, 64 nt, Human Herpes Virus 1
agacgcugcuggaguuggugguuagcguguacgucgccccgagccugggcguacccgugacccg

SEQ ID NO: 545664 - RNA, 64 nt, Human Herpes Virus 1
ugaaacugacaucgcgauacccucgggcaucucgcgccccgaugcggcggcgcugcagcgcugc

SEQ ID NO: 545665 - RNA, 64 nt, Human Herpes Virus 1
gcgggcggccggucgacggggugcucgucaccaccgccccgaucaaacagcgccuccugcaguc

SEQ ID NO: 545666 - RNA, 64 nt, Human Herpes Virus 1
ucccggcuugccggucggcgggcccgcgggaggccgccccgaagagggggaccccggggcucag

SEQ ID NO: 545667 - RNA, 64 nt, Human Herpes Virus 1
cuggccuccacgcgccugaguucuucgccgaucacgccccgaucgccccucguccagcacgugc

SEQ ID NO: 545668 - RNA, 64 nt, Human Herpes Virus 1
cccgccacgcccauaagcuccucccgauaaaaagcgccccgauggcccuggacgcggcauaacu

SEQ ID NO: 545669 - RNA, 64 nt, Human Herpes Virus 1
uucucuucucggggcuauauguggcuggggagcgcgccccgaggaacaauaugagaugauccgc

SEQ ID NO: 545670 - RNA, 64 nt, Human Herpes Virus 2
uguuuucgcucggauccugcgaccuccccgagucccaccucagcgaucucgccuccaggggccu

SEQ ID NO: 545671 - RNA, 64 nt, Human Herpes Virus 2
cgccuaaacagcgcguacguagccaugucccgcaccaccucauccgaguuccugcacaugaauc

SEQ ID NO: 545672 - RNA, 64 nt, Human Herpes Virus 2
augucgagaauuuucucaagcagcugaacuacugccaccucaucacccccccgagcggcgccac

SEQ ID NO: 545673 - RNA, 64 nt, Human Herpes Virus 2; identical to SEQ ID NO: 545670

SEQ ID NO: 545674 - RNA, 64 nt, Human Herpes Virus 2; identical to SEQ ID NO: 545671

SEQ ID NO: 545675 - RNA, 64 nt, Human Herpes Virus 2; identical to SEQ ID NO: 545672

SEQ ID NO: 545676 - RNA, 64 nt, Human Herpes Virus 2
ccggcucauggaaccccggcccggcacgagcucccgggcggaccccggccccgagcggccgccg

SEQ ID NO: 545677 - RNA, 64 nt, Human Herpes Virus 2
augacagaacgcagaggcgccacccggcgcuggucgggcggaugacgcuuuccgcgccgucccg

SEQ ID NO: 545678 - RNA, 64 nt, Human Herpes Virus 2
gggccgcgcacguggggccgccugcugcagaucucgggcggaaccugggacgugcgccugcgaa

SEQ ID NO: 545679 - RNA, 64 nt, Human Herpes Virus 2
cgcgguggccguggagcuggcgcuguucgggcggcgggcggagcacuucgaucgcgcguucggg

SEQ ID NO: 545680 - RNA, 64 nt, Human Herpes Virus 2
cggacguggccgcccaccggucacggcggcgcugcgggcggaccgaaaauucgcagaucgggcg

SEQ ID NO: 545681 - RNA, 64 nt, Human Herpes Virus 2
gcgaguccgucaugcgggagcacgcguauagccgcgggcggaccagaaacaauuacggaucgac

SEQ ID NO: 545682 - RNA, 64 nt, Human Herpes Virus 2; identical to SEQ ID NO: 545676

SEQ ID NO: 545683 - RNA, 64 nt, Human Herpes Virus 2
agccgacguaucgcgguuuugcggucgucguccucacggccaacgaggaccacgugcacagccu

SEQ ID NO: 545684 - RNA, 64 nt, Human Herpes Virus 2
cgcaacucagggggcgugacuuugggggcgaccacacggccaagcuggaguuccuggcccccga

SEQ ID NO: 545685 - RNA, 64 nt, Human Herpes Virus 2
gcccccgaccgcccuggccgcccagaugcgccagcacggccagggcguacgcggugugaaagaa

SEQ ID NO: 545686 - RNA, 64 nt, Human Herpes Virus 2
cccccgagcuguacguguacguggacccggcguucacggccaacacgcgcgccuccggcaccgg

SEQ ID NO: 545687 - RNA, 64 nt, Human Herpes Virus 2
cgcgcugcuuaccguuugccuggcucgcgcccagcacggccagucugugugagauaucccaaua

SEQ ID NO: 545688 - RNA, 64 nt, Human Herpes Virus 2
agcuaaagacaugcaaaucgauuucuuccggggacacggccagcaaacgcgaacagcggaccac

SEQ ID NO: 545689 - RNA, 64 nt, Human Herpes Virus 2
auccaacccgcccucgagaugugccuuccaguuccacggccaggauggguccgacgaggccuuc

SEQ ID NO: 545690 - RNA, 64 nt, Human Herpes Virus 2
gaacuuuuugcugaucgauacgggcguguacgcccacggccacagccugcgcuugccguauuuc

SEQ ID NO: 545691 - RNA, 64 nt, Human Herpes Virus 2
cgcagcaacccacgcugaccauggaaaaguggaucacggccaacgccagucgcaucaccaacua

SEQ ID NO: 545692 - RNA, 64 nt, Human Herpes Virus 2
ccgccuuucgggaagcggucgcgcgguggcaccccacggccaccaccauccaacuacucgaccc

SEQ ID NO: 545693 - RNA, 64 nt, Human Herpes Virus 2
ccccccggggguuugggaugcccgccgcccugaccacggccaacuuucacacucugguggggca

SEQ ID NO: 545694 - RNA, 64 nt, Human Herpes Virus 2
ccccggaggagcagcucacggccccgggaggcgacacggccaccgcggaggacguguccaucac

SEQ ID NO: 545695 - RNA, 64 nt, Human Herpes Virus 2
agcgucucaucguggaaacgggaucggcgguauccacggccaccgcugccagcgacgugcaguu

SEQ ID NO: 545696 - RNA, 64 nt, Human Herpes Virus 2
gccccugcuucaaguucuucaccgcggccgacaucacggccaaacaucgcugccuggagcgucu

SEQ ID NO: 545697 - RNA, 64 nt, Human Herpes Virus 2
acggccagagcgacccggcgcggcccuucgcggccacggccaacccgugggcgucgcagcgguu

SEQ ID NO: 545698 - RNA, 64 nt, Human Herpes Virus 2
caaggagggggacgucauagcccucauguacgaccacggccagagcgacccggcgcggcccuuc

SEQ ID NO: 545699 - RNA, 64 nt, Human Herpes Virus 2
ucgacaagauuaacaccaagggggucugccgcuccacggccaaguacgugcggaacaacaugga

SEQ ID NO: 545700 - RNA, 64 nt, Human Herpes Virus 2
cugguccggaccggggucacucggccccgacggucacggccauggcuggucgcgugcgcggcgg

SEQ ID NO: 545701 - RNA, 64 nt, Human Herpes Virus 2; identical to SEQ ID NO: 544023

SEQ ID NO: 545702 - RNA, 64 nt, Human Herpes Virus 2
ucuccucgggcagaugggguacaccgagggucaggggguguacaacgucguccgguccagcgag

SEQ ID NO: 545703 - RNA, 64 nt, Human Herpes Virus 2
uaugcgaaggcgaacgccacggucgaggugcgcggggguguagccgucccccuccgguuggaca

SEQ ID NO: 545704 - RNA, 64 nt, Human Herpes Virus 4 (Epstein Barr virus)
gggcgauaccuugggcaucaugcagggugcacagacuagcgaggauaaucugggcagccagagc

SEQ ID NO: 545705 - RNA, 58 nt, Human Herpes Virus 4 (Epstein Barr virus)
gggggcccguuuauuaugguaaggcucuucgggcaagauggagaggcaaacauacagg

SEQ ID NO: 545706 - RNA, 58 nt, Human Herpes Virus 4 (Epstein Barr virus)
cggugacagcaguuccagcagcagugacucgggcaacagugacaccgagcagagcgag

SEQ ID NO: 545707 - RNA, 18 nt, Human Herpes Virus 4 (Epstein Barr virus)
aaggcucuucgggcaaga

SEQ ID NO: 545708 - RNA, 18 nt, Human Herpes Virus 4 (Epstein Barr virus)
gcagugacucgggcaaca

SEQ ID NO: 545709 - RNA, 64 nt, Human Herpes Virus 1
acccuccagccgcauacgacccccauggagccccgccccggagcgaguacccgccggccugagg

SEQ ID NO: 545710 - RNA, 64 nt, Human Herpes Virus 1
auucuuacccgccccccuuuuuuccccuuagcccgccccggaugucuggguguuucccugcgac

SEQ ID NO: 545711 - RNA, 64 nt, Human Herpes Virus 1
uguuuccgcgccggcgcgcggguauaagaacggggccccggaguccacggacauaccgcccggc

SEQ ID NO: 545712 - RNA, 64 nt, Human Herpes Virus 1
gauugcccccccgcccgcggacccccgcgccccggccccggagcgaaaggcgcccgccgccgac

SEQ ID NO: 545713 - RNA, 64 nt, Human Herpes Virus 1
gacagcgaccccccucaccaaccuguucuuacgggccccggacauaacccacguggcccccccu

SEQ ID NO: 545714 - RNA, 64 nt, Human Herpes Virus 1
cagcgcggaugccgcggacgaugucgacgaggacgccccggacgacguggccuauccggaggaa

SEQ ID NO: 545715 - RNA, 64 nt, Human Herpes Virus 1
guccgagacccccaacgccacgcagccagaacucgccccggaagaccccgaggauucggcccuc

SEQ ID NO: 545716 - RNA, 64 nt, Human Herpes Virus 1
ggacgaucccgacgcccgaccccgcggccucgccgccccggacccccgccuuucgagccgacga

SEQ ID NO: 545717 - RNA, 64 nt, Human Herpes Virus 1
gcgggaaucccucuggccgcccugaugcgcggccgccccggacucgggacggccgcaaacuucc

SEQ ID NO: 545718 - RNA, 64 nt, Human Herpes Virus 1
gcuuugugcgccaccgccagccgcgccccuccuugccccggaccgcggcggccgagcucuacgu

SEQ ID NO: 545719 - RNA, 64 nt, Human Herpes Virus 1
ggggagccucgaucggccacggguguggggacccgccccggagggagaacccgaccagauggaa

SEQ ID NO: 545720 - RNA, 64 nt, Human Herpes Virus 1; identical to SEQ ID NO: 545710

SEQ ID NO: 545721 - RNA, 60 nt, Human Herpes Virus 1
uccagccgcauacgacccccauggagccccgccccggagcgaguacccgccggccugagg

SEQ ID NO: 545722 - RNA, 64 nt, Human Herpes Virus 1; identical to SEQ ID NO: 545716

SEQ ID NO: 545723 - RNA, 64 nt, Human Herpes Virus 1
acguaaugacccuccuugaccagaacaacgcccugccccggacuuccgucgacgcaagcccggc

SEQ ID NO: 545724 - RNA, 64 nt, Human Herpes Virus 1; identical to SEQ ID NO: 543466

SEQ ID NO: 545725 - RNA, 64 nt, Human Herpes Virus 1; identical to SEQ ID NO: 543467

SEQ ID NO: 545726 - RNA, 64 nt, Human Herpes Virus 1; identical to SEQ ID NO: 543468

SEQ ID NO: 545727 - RNA, 64 nt, Human Herpes Virus 1; identical to SEQ ID NO: 543469

SEQ ID NO: 545728 - RNA, 64 nt, Human Herpes Virus 1
cccggucuccccgggagccccggucuccccgggagccccggaccccacgcaccccccgcgaacc

SEQ ID NO: 545729 - RNA, 64 nt, Human Herpes Virus 1
ggccuguaauauaccaacaugggcguuguugucgucaacguaaugacccuccuugaccagaaca

SEQ ID NO: 545730 - RNA, 62 nt, Human Herpes Virus 2
cccgagcccgggcccacgaagacggcggacccgcggaggaggaggaggcggcggcggcggcg

SEQ ID NO: 545731 - RNA, 62 nt, Human Herpes Virus 2
ccaagccccgcaagcugcugguguccgagcuggcggaggaucccggguacgccaucgcccgg

SEQ ID NO: 545732 - RNA, 62 nt, Human Herpes Virus 2
cgggguucgggccggcgggggccggcgcuacggcggaggaaacucgucgaauguugcauaga

SEQ ID NO: 545733 - RNA, 62 nt, Human Herpes Virus 2
cggccuucccggcgagcaccuuuuauacccccgcggaggaugcguaccuggcccccgggccc

SEQ ID NO: 545734 - RNA, 62 nt, Human Herpes Virus 2
acgaggacuaccccaucguggacgccgcgggugcggaggaggaagacgaggccgacgaugac

SEQ ID NO: 545735 - RNA, 62 nt, Human Herpes Virus 2
acagccgccccggccucuggggggcgcccgaggcggaggaggcgcgggcccgguucgaggcc

SEQ ID NO: 545736 - RNA, 62 nt, Human Herpes Virus 2
ugggguacacguacacccggguguucgcguucgcggaggagcugcggcggcggcacgcgacg

SEQ ID NO: 545737 - RNA, 62 nt, Human Herpes Virus 2
uggugacguuccucggcaggcaccgcgcgggcgcggaggagggcgugacguuccgccuggag

SEQ ID NO: 545738 - RNA, 62 nt, Human Herpes Virus 2
agcucacggccccgggaggcgacacggccaccgcggaggacguguccaucacgcaagagaac

SEQ ID NO: 545739 - RNA, 62 nt, Human Herpes Virus 2
ggggggccgaggaggaagagccccgggccgccgcggaggagggggggcggaggcguggcgcg

SEQ ID NO: 545740 - RNA, 62 nt, Human Herpes Virus 2
accugaaccucccgcuggugcgaagugcggcggcggaggaacccggggcgccccucacgacc

SEQ ID NO: 545741 - RNA, 62 nt, Human Herpes Virus 2; identical to SEQ ID NO: 545730

SEQ ID NO: 545742 - RNA, 62 nt, Human Herpes Virus 2; identical to SEQ ID NO: 545735

SEQ ID NO: 545743 - RNA, 62 nt, Human Herpes Virus 2
gcugucccccaaacaccacgacgggccuguuugcggaggacgacccccuggaaagcaucgag

SEQ ID NO: 545744 - RNA, 62 nt, Human Herpes Virus 1
aguugccauggcugggcgggaggggcgcacgcgccagcgaacuuuacgggacacaauccccg

SEQ ID NO: 545745 - RNA, 62 nt, Human Herpes Virus 1
ccggggccacacccgcccacaaggcucuacaggccagcgacaacccgggcccgucgcgacga

SEQ ID NO: 545746 - RNA, 62 nt, Human Herpes Virus 1
ggccccucucgcccacggccaccacguguacugccagcgagucaauggcgugauggugcuuu

SEQ ID NO: 545747 - RNA, 62 nt, Human Herpes Virus 1
agacggguucggcgguguccacggccaccgccgccagcgacguacaguuuaagcgccccccg

SEQ ID NO: 545748 - RNA, 64 nt, Human Herpes Virus 4 (Epstein Barr virus); identical to SEQ ID NO: 543781

SEQ ID NO: 545749 - RNA, 64 nt, Human Herpes Virus 4 (Epstein Barr virus)
aaguuuguaaaaaaauucauaaaaugucacuaauuccucuuaccuguuuaggguauugugcaau

SEQ ID NO: 545750 - RNA, 64 nt, Human Herpes Virus 4 (Epstein Barr virus)
gggcuauauguggggaugucuguggcuugucauuuccucuuagaagguaaucccccaucuuaac

SEQ ID NO: 545751 - RNA, 64 nt, Human Herpes Virus 4 (Epstein Barr virus)
ccgggcugccauuauucccuugaguguuauagcuuccucuuaacuuaagcaagagcuccaggau

SEQ ID NO: 545752 - RNA, 64 nt, Human Herpes Virus 4 (Epstein Barr virus)
cagggacgaggacgagaaggaggagacuggcaacuccucuuacaccagaggccacaaaaggcga

SEQ ID NO: 545753 - RNA, 64 nt, Human Herpes Virus 2
ccgacacgugacccggaaggcacggcgggucauccggccccaccagagagcgacccccccuccc

SEQ ID NO: 545754 - RNA, 64 nt, Human Herpes Virus 2
cggcguuucggugcuguuucagggguuuuuuaaccggccccacggcgccccggggggcgcgauc

SEQ ID NO: 545755 - RNA, 64 nt, Human Herpes Virus 2
gggacgagaccgccaaacccaccacguucgagcucggccccaacggcaaguuuuccguguuuaa

SEQ ID NO: 545756 - RNA, 64 nt, Human Herpes Virus 2
cggccgacguccccagcgugugugucaccgccaccggccccaacgcggugucggcgguguuucu

SEQ ID NO: 545757 - RNA, 64 nt, Human Herpes Virus 2
ggaguuauuuaguccgcgccuccugcucgaccagcggccccauccacuguuuuuucuuugcggu

SEQ ID NO: 545758 - RNA, 64 nt, Human Herpes Virus 2
gucuguuguggguagaggugggcggggagggccccggccccaccgcccccccacaggcggcgcg

SEQ ID NO: 545759 - RNA, 64 nt, Human Herpes Virus 2
ucgcccuauacagcuuaaaaaucgccggguggcacggccccaagcccccguacaccagcacccu

SEQ ID NO: 545760 - RNA, 64 nt, Human Herpes Virus 2
gccugugggucugcgccaccggccuggucguccgcggccccacggucagucuggucucagacuc

SEQ ID NO: 545761 - RNA, 64 nt, Human Herpes Virus 2
aaaacgcccccgcggugcuccccgggccuccggccggccccagguaucgcgucuuuguccuggg

SEQ ID NO: 545762 - RNA, 64 nt, Human Herpes Virus 2
guggccggcguuccggaacauccgacgacgccggcggccccacgccucguucgccagcacgagu

SEQ ID NO: 545763 - RNA, 64 nt, Human Herpes Virus 2
ucagcuguuguuucccgcggcccgcguagaccccgacgccuaucccuguuauuuuuucaaaagc

SEQ ID NO: 545764 - RNA, 64 nt, Human Herpes Virus 2
cucccccgcugacggccugguggaccagggcgcccuggcggagccccgaggcgacgccggaggc

SEQ ID NO: 545765 - RNA, 64 nt, Human Herpes Virus 2
cgcguccaagccccgcaagcugcugguguccgagcuggcggaggaucccggguacgccaucgcc

SEQ ID NO: 545766 - RNA, 64 nt, Human Herpes Virus 2
ggucgcagacucguccaccaaaaugaugggacgucuggcggaagcagaaaggcuccuagucccc

SEQ ID NO: 545767 - RNA, 64 nt, Human Herpes Virus 2
gugccuggccgccugccgcgggauccuggaggcgcuggcggagggcuucgacggcgaccuggcg

SEQ ID NO: 545768 - RNA, 64 nt, Human Herpes Virus 2
cgcggcgaacgcgucucuguggggggacggcgaccuggcggacggauggaugaguccgggcgac

SEQ ID NO: 545769 - RNA, 64 nt, Human Herpes Virus 2
caccgcgaaccaaggggcgaccaucgcccgccgccuggcggaccgcaucuguaaccacgucacc

SEQ ID NO: 545770 - RNA, 64 nt, Human Herpes Virus 2
cgcucgcggccaacgccgagcccuggggggccugcuggcggagugccuucgcguuuaaccccua

SEQ ID NO: 545771 - RNA, 64 nt, Human Herpes Virus 2
cccuggaggcgaugcucaacaggccguggggcgccuggcggacggcccacgacgcccgggagaa

SEQ ID NO: 545772 - RNA, 64 nt, Human Herpes Virus 2
ggauccaggcgcuggcccaggggcgcauggcgcccuggcggacggucgaggcggaggcccgcga

SEQ ID NO: 545773 - RNA, 64 nt, Human Herpes Virus 2
gccccugggccaugcggccgccacgcgcaugagccuggcggacgggcccccugggcauggggcu

SEQ ID NO: 545774 - RNA, 64 nt, Human Herpes Virus 2
gcguccgccagugugccguggaguggaucgaccgcuggcggaccgucacccagagcugccuggc

SEQ ID NO: 545775 - RNA, 64 nt, Human Herpes Virus 2
guuugcggggcgcguccuggacgugcuggcgguccuggcggagcagacgguccaguggcucucg

SEQ ID NO: 545776 - RNA, 64 nt, Human Herpes Virus 2
ggccguugcggcgcaucgggacaagaugcgccgccuggcggacacgugcauggccaccauccug

SEQ ID NO: 545777 - RNA, 64 nt, Human Herpes Virus 2; identical to SEQ ID NO: 545767

SEQ ID NO: 545778 - RNA, 64 nt, Human Herpes Virus 2
uucgggccaacagggaguccucgccgcuguggcccuggcggacggccgccaugaauuuuaucgc

SEQ ID NO: 545779 - RNA, 64 nt, Human Herpes Virus 4 (Epstein Barr virus)
ccaggucggagcggugggacaggugugcccaggugcucaaaaauaggcugcuccgcguggagcu

SEQ ID NO: 545780 - RNA, 64 nt, Human Herpes Virus 4 (Epstein Barr virus)
agcggcgcuacaacuccacgcugcguccaucggagcucaaaauccaccuggcugccuucagaua

SEQ ID NO: 545781 - RNA, 61 nt, Human immunodeficiency virus type 1 (BLAI); identical to SEQ ID NO: 545595

SEQ ID NO: 545782 - RNA, 61 nt, Human immunodeficiency virus type 1 (BLAI); identical to SEQ ID NO: 545596

SEQ ID NO: 545783 - RNA, 64 nt, Human Herpes Virus 4 (Epstein Barr virus)
ccacuaacaaucuuuguuggggaaaacacgggggugcccccaccacucccaccaccccccccac

SEQ ID NO: 545784 - RNA, 64 nt, Human Herpes Virus 4 (Epstein Barr virus)
gacgcuguccuacggccacaccggagucggauacugcccccagcagggccccugcuacacccac

SEQ ID NO: 545785 - RNA, 64 nt, Human Herpes Virus 4 (Epstein Barr virus)
guccaucuuugcacgccaggccccgcaaucccauugcccccaauccgaggccagggccgccaaa

SEQ ID NO: 545786 - RNA, 64 nt, Human Herpes Virus 4 (Epstein Barr virus)
cgccugaccgaccugcucucgccuuucuggacacugcccccaacaggaggaggagaacccgagg

SEQ ID NO: 545787 - RNA, 64 nt, Human Herpes Virus 4 (Epstein Barr virus)
uaugcgcacgacauccugcagaaucgggauccagugcccccacgguacacuugcgugcaucucu

SEQ ID NO: 545788 - RNA, 64 nt, Human Herpes Virus 4 (Epstein Barr virus)
uggcuucggguccgagauggagggggaacagacaugcccccaugcucagaggcacucugagucu

SEQ ID NO: 545789 - RNA, 62 nt, Human Herpes Virus 1; identical to SEQ ID NO: 545744

SEQ ID NO: 545790 - RNA, 62 nt, Human Herpes Virus 1
cgacgacguccgacggcgaggccguugagcuagccagcgagacgcugaugaagcgcgaacug

SEQ ID NO: 545791 - RNA, 62 nt, Human Herpes Virus 1
uuuuacggggaacucgcggacugggcgcggccgccagcgaccgccccgccggccaaucugua

SEQ ID NO: 545792 - RNA, 62 nt, Human Herpes Virus 1; identical to SEQ ID NO: 545745

SEQ ID NO: 545793 - RNA, 62 nt, Human Herpes Virus 1
acuacguaaaaacuuucaggcggguccagggcgccagcgagcacacgcacgggcggcucugc

SEQ ID NO: 545794 - RNA, 62 nt, Human Herpes Virus 1
cgguucccgagaguuugaucguggacgggcucgccagcgacccgcacuacgaguacauccgg

SEQ ID NO: 545795 - RNA, 62 nt, Human Herpes Virus 1
aguacuggagcguucgggugucccccuuugaggccagcgaccccuugccccccacugccuuc

SEQ ID NO: 545796 - RNA, 62 nt, Human Herpes Virus 1
gccuguuucaggaggccuacccgcucaccugcgccagcgaccccgcccuccuccgcagugcc

SEQ ID NO: 545797 - RNA, 62 nt, Human Herpes Virus 1; identical to SEQ ID NO: 545793

SEQ ID NO: 545798 - RNA, 62 nt, Human Herpes Virus 1; identical to SEQ ID NO: 545794

SEQ ID NO: 545799 - RNA, 62 nt, Human Herpes Virus 1; identical to SEQ ID NO: 545746

SEQ ID NO: 545800 - RNA, 62 nt, Human Herpes Virus 1; identical to SEQ ID NO: 545790

SEQ ID NO: 545801 - RNA, 62 nt, Human Herpes Virus 1; identical to SEQ ID NO: 545795

SEQ ID NO: 545802 - RNA, 64 nt, Human Herpes Virus 2
gaugggacgucuggcggaagcagaaaggcuccuagucccccacggcuggcccgcguucgcacca

SEQ ID NO: 545803 - RNA, 64 nt, Human Herpes Virus 2
uguuuucggggagcuucauuuugugggggcccaggucccccauacaaacuacuacgacggcauc

SEQ ID NO: 545804 - RNA, 64 nt, Human Herpes Virus 2
acccgaccgaucgugcgaacccgcuccugucgcugucccccaaacaccacgacgggccuguuug

SEQ ID NO: 545805 - RNA, 64 nt, Human Herpes Virus 1
cgcguaucauggguccggccgugccgacggaacaucuggcgagccugcggcgggcgcucguggg

SEQ ID NO: 545806 - RNA, 62 nt, Human Herpes Virus 1; identical to SEQ ID NO: 545796

SEQ ID NO: 545807 - RNA, 62 nt, Human Herpes Virus 1; identical to SEQ ID NO: 545747

SEQ ID NO: 545808 - RNA, 62 nt, Human Herpes Virus 1; identical to SEQ ID NO: 545791

SEQ ID NO: 545809 - RNA, 64 nt, Human Herpes Virus 4 (Epstein Barr virus); identical to SEQ ID NO: 545213

SEQ ID NO: 545810 - RNA, 64 nt, Human Herpes Virus 4 (Epstein Barr virus); identical to SEQ ID NO: 545214

SEQ ID NO: 545811 - RNA, 64 nt, Human Herpes Virus 4 (Epstein Barr virus); identical to SEQ ID NO: 545215

SEQ ID NO: 545812 - RNA, 64 nt, Human Herpes Virus 4 (Epstein Barr virus); identical to SEQ ID NO: 544460

SEQ ID NO: 545813 - RNA, 64 nt, Human Herpes Virus 4 (Epstein Barr virus); identical to SEQ ID NO: 544461

SEQ ID NO: 545814 - RNA, 64 nt, Human Herpes Virus 4 (Epstein Barr virus); identical to SEQ ID NO: 544462

SEQ ID NO: 545815 - RNA, 64 nt, Human Herpes Virus 4 (Epstein Barr virus); identical to SEQ ID NO: 544463

SEQ ID NO: 545816 - RNA, 64 nt, Human Herpes Virus 1; identical to SEQ ID NO: 541797

SEQ ID NO: 545817 - RNA, 64 nt, Human Herpes Virus 1; identical to SEQ ID NO: 541798

SEQ ID NO: 545818 - RNA, 64 nt, Human Herpes Virus 1; identical to SEQ ID NO: 541727

SEQ ID NO: 545819 - RNA, 64 nt, Human Herpes Virus 1; identical to SEQ ID NO: 541794

SEQ ID NO: 545820 - RNA, 64 nt, Human Herpes Virus 4 (Epstein Barr virus); identical to SEQ ID NO: 544460

SEQ ID NO: 545821 - RNA, 64 nt, Human Herpes Virus 4 (Epstein Barr virus); identical to SEQ ID NO: 544461

SEQ ID NO: 545822 - RNA, 64 nt, Human Herpes Virus 4 (Epstein Barr virus); identical to SEQ ID NO: 544462

SEQ ID NO: 545823 - RNA, 64 nt, Human Herpes Virus 4 (Epstein Barr virus); identical to SEQ ID NO: 544463

SEQ ID NO: 545824 - RNA, 64 nt, Human Herpes Virus 4 (Epstein Barr virus)
accagguggguggugugugcccgggggauuggaagugugcuauaaguaccgucagcucuucuca

SEQ ID NO: 545825 - RNA, 64 nt, Human Herpes Virus 4 (Epstein Barr virus)
cagggaugccuggacacaagagccaucaccucuugauagggauccgcuaggauaugacgucggg

SEQ ID NO: 545826 - RNA, 64 nt, Human Herpes Virus 4 (Epstein Barr virus)
ccucagacgccuccgugaggcguauagucaggaggauagggacccuggcuaggcgccgcgucca

SEQ ID NO: 545827 - RNA, 64 nt, Human Herpes Virus 4 (Epstein Barr virus)
cccugcaaacugacacacaggccuggcggguggagauagggaccagaggacuaauguucucuaa

SEQ ID NO: 545828 - RNA, 64 nt, Human Herpes Virus 2
gcucaacgacaugcaguggcucgccagcagcgacucggaggaggagaccgaggugggaaucucu

SEQ ID NO: 545829 - RNA, 64 nt, Human Herpes Virus 2
ucuggacgggaguuccgacgacgcguacguggcgucggaggauuacuuuaagcgcugcggggac

SEQ ID NO: 545830 - RNA, 64 nt, Human Herpes Virus 2
ggcggcacaggccuccgucagggccguggccagcucggaggacagccgcggggggcgggcgcgu

SEQ ID NO: 545831 - RNA, 64 nt, Human Herpes Virus 2
ucaucuucccggcggugcggccgccgccccccuuucggaggacgcgaucccgucgccgcgcgag

SEQ ID NO: 545832 - RNA, 64 nt, Human Herpes Virus 2
gggccacuguaacgugaccgacggccccuugcugucggaggacgcgguuaagcgcguggccgac

SEQ ID NO: 545833 - RNA, 64 nt, Human Herpes Virus 2; identical to SEQ ID NO: 545828

SEQ ID NO: 545834 - RNA, 64 nt, Human Herpes Virus 1
cacgagcacgagccacgaggcgcgacugcugaggcgacuggaccacccggcgauccugccccuc

SEQ ID NO: 545835 - RNA, 64 nt, Human Herpes Virus 1
ccgccggcacguaccugcggcucgugaagauaaacgacuggacggagauuacacaguuuauccu

SEQ ID NO: 545836 - RNA, 64 nt, Human Herpes Virus 1
uuauuauuuugggcguugcguggggucagguccacgacuggacugagcagacagacccaugguu

SEQ ID NO: 545837 - RNA, 64 nt, Human Herpes Virus 1
cucuccguccugacggacgcgccauucaccgcaucgacuggagccaagccacuggacgagcugg

SEQ ID NO: 545838 - RNA, 64 nt, Human Herpes Virus 1
uccugccaacacccaggaaacagaaacgcgcuuggcccuuuauaaagagauacgccaggcgcug

SEQ ID NO: 545839 - RNA, 62 nt, Human immunodeficiency virus type 1 (BLAI); identical to SEQ ID NO: 545594

SEQ ID NO: 545840 - RNA, 64 nt, Human Herpes Virus 4 (Epstein Barr virus)
gaggugcugcagacccugcgcuccaugaacauguacccggcaguccucggucgagugggcgagc

SEQ ID NO: 545841 - RNA, 64 nt, Human Herpes Virus 4 (Epstein Barr virus)
caauagccccucucaaccgacaggcggcauauccacccggcacauucgcggacaauaagauuua

SEQ ID NO: 545842 - RNA, 64 nt, Human Herpes Virus 4 (Epstein Barr virus)
cauaauggaacggcgcgugaccuucuccaccgagacccggcaggggguccugcggucgaaggug

SEQ ID NO: 545843 - RNA, 63 nt, Human immunodeficiency virus type 1 (BLAI); identical to SEQ ID NO: 545597

SEQ ID NO: 545844 - RNA, 63 nt, Human immunodeficiency virus type 1 (BLAI); identical to SEQ ID NO: 545598

SEQ ID NO: 545845 - RNA, 64 nt, Human Herpes Virus 4 (Epstein Barr virus)
ccgucuaccacaacuuucuggggccucacgauggccgaccgauggagaacccagaggccuuuuc

SEQ ID NO: 545846 - RNA, 64 nt, Human Herpes Virus 2; identical to SEQ ID NO: 540010

SEQ ID NO: 545847 - RNA, 64 nt, Human Herpes Virus 2; identical to SEQ ID NO: 540011

SEQ ID NO: 545848 - RNA, 64 nt, Human Herpes Virus 2; identical to SEQ ID NO: 540012

SEQ ID NO: 545849 - RNA, 64 nt, Human Herpes Virus 2; identical to SEQ ID NO: 540013

SEQ ID NO: 545850 - RNA, 64 nt, Human Herpes Virus 2; identical to SEQ ID NO: 540014

SEQ ID NO: 545851 - RNA, 64 nt, Human Herpes Virus 2; identical to SEQ ID NO: 540015

SEQ ID NO: 545852 - RNA, 64 nt, Human Herpes Virus 2; identical to SEQ ID NO: 540016

SEQ ID NO: 545853 - RNA, 64 nt, Human Herpes Virus 2; identical to SEQ ID NO: 540017

SEQ ID NO: 545854 - RNA, 64 nt, Human Herpes Virus 2; identical to SEQ ID NO: 540018

SEQ ID NO: 545855 - RNA, 64 nt, Human Herpes Virus 2; identical to SEQ ID NO: 540019

SEQ ID NO: 545856 - RNA, 64 nt, Human Herpes Virus 2; identical to SEQ ID NO: 540020

SEQ ID NO: 545857 - RNA, 64 nt, Human Herpes Virus 2; identical to SEQ ID NO: 540021

SEQ ID NO: 545858 - RNA, 64 nt, Human Herpes Virus 2; identical to SEQ ID NO: 540022

SEQ ID NO: 545859 - RNA, 62 nt, Human Herpes Virus 2; identical to SEQ ID NO: 540023

SEQ ID NO: 545860 - RNA, 64 nt, Human Herpes Virus 2; identical to SEQ ID NO: 540024

SEQ ID NO: 545861 - RNA, 64 nt, Human Herpes Virus 2; identical to SEQ ID NO: 540025

SEQ ID NO: 545862 - RNA, 64 nt, Human Herpes Virus 2; identical to SEQ ID NO: 540026

SEQ ID NO: 545863 - RNA, 64 nt, Human Herpes Virus 2; identical to SEQ ID NO: 540027

SEQ ID NO: 545864 - RNA, 64 nt, Human Herpes Virus 2; identical to SEQ ID NO: 540028

SEQ ID NO: 545865 - RNA, 64 nt, Human Herpes Virus 2; identical to SEQ ID NO: 540029

SEQ ID NO: 545866 - RNA, 64 nt, Human Herpes Virus 2; identical to SEQ ID NO: 540030

SEQ ID NO: 545867 - RNA, 64 nt, Human Herpes Virus 2; identical to SEQ ID NO: 540031

SEQ ID NO: 545868 - RNA, 64 nt, Human Herpes Virus 2; identical to SEQ ID NO: 540032

SEQ ID NO: 545869 - RNA, 64 nt, Human Herpes Virus 2; identical to SEQ ID NO: 540033

SEQ ID NO: 545870 - RNA, 64 nt, Human Herpes Virus 2; identical to SEQ ID NO: 540010

SEQ ID NO: 545871 - RNA, 64 nt, Human Herpes Virus 2; identical to SEQ ID NO: 540017

SEQ ID NO: 545872 - RNA, 64 nt, Human Herpes Virus 2
accgcgcgccccggucgcgcaugacccaggcucagaccgacacccaagcacagagucugggccg

SEQ ID NO: 545873 - RNA, 64 nt, Human Herpes Virus 2
ugccuguuuccccggugccgcccuccccgagaucgaccgacagacaaacacagccagacgcgag

SEQ ID NO: 545874 - RNA, 64 nt, Human Herpes Virus 2
ggagcuuggcgucccaggacucucgggccggcccgaccgacagccaggacuccuccuccgagcc

SEQ ID NO: 545875 - RNA, 64 nt, Human Herpes Virus 2
uggagaccaccgcguuucaccgggacgaccacgagaccgacauggagcucaagccggcgaaggu

SEQ ID NO: 545876 - RNA, 64 nt, Human Herpes Virus 2; identical to SEQ ID NO: 545872

SEQ ID NO: 545877 - RNA, 64 nt, Human Herpes Virus 2
ccccccucguucugcugcaccggcucuccuuguuucgccccacggaccuccgggacuucgagcu

SEQ ID NO: 545878 - RNA, 64 nt, Human Herpes Virus 2
caccaucgagcuguacaagcaggccuaccgccucucgccccaguggguggccgauuacgcguuc

SEQ ID NO: 545879 - RNA, 64 nt, Human Herpes Virus 2
ccuggccccggaccugcuucggagcggaaccccgucgccccacuacgaguccauccugcgccuc

SEQ ID NO: 545880 - RNA, 64 nt, Human Herpes Virus 1
uuauguaaucacggccguguuguuguuggccguggccguguaugccguggucggcgccgugacc

SEQ ID NO: 545881 - RNA, 64 nt, Human Herpes Virus 1
aacaacgacccacccggcccuuugucccccggaggccguguaucgccccccaccacacagcgcc

SEQ ID NO: 545882 - RNA, 64 nt, Human Herpes Virus 1
ccgcggggcucccccucuccuggacaacgcggcagccguguaccugcggaacgcggucguggcg

SEQ ID NO: 545883 - RNA, 64 nt, Human Herpes Virus 1
cuaccucgggggagaccuucccgaggagugcauggccguguaccgggaccugguggcgcacguc

SEQ ID NO: 545884 - RNA, 64 nt, Human Herpes Virus 1
ccugcuucagcuucucgggcggcgauccaaccucgccguguaccaggaccuggcccugagucag

SEQ ID NO: 545885 - RNA, 64 nt, Human Herpes Virus 1
ggacacaauccccgacugcgcgcugcggucccagacccuggagagucuagacgcgcgcuacguc

SEQ ID NO: 545886 - RNA, 64 nt, Human Herpes Virus 1
cgggaccccgcuacaaccggaccacaucgccgccacccuggacgcggaggccacguucgcgcug

SEQ ID NO: 545887 - RNA, 64 nt, Human Herpes Virus 1
cgcgaccgacagcacucacagccccgcauaucccacccuggagcucaaucuggcccaacagccg

SEQ ID NO: 545888 - RNA, 64 nt, Human Herpes Virus 1
ccaggccggggccuuucucaccccgcugucggucacccuggaguugcugcuagaguacgcgugg

SEQ ID NO: 545889 - RNA, 64 nt, Human Herpes Virus 1
ccguccuacaccugucggaacgcuuccgacggacacccuggagucgccaguacgugccguuuuu

SEQ ID NO: 545890 - RNA, 64 nt, Human Herpes Virus 1
caucgggccacacggcagcaguaacaccaacaccaccaccaacagcagcggcggcggcggcucc

SEQ ID NO: 545891 - RNA, 64 nt, Human Herpes Virus 1
gggggagcgguuucuguuguaccgccccucgaccaccaccaacagcggccucauggcccccgau

SEQ ID NO: 545892 - RNA, 64 nt, Human Herpes Virus 1
ggcggcgcccgacgcgggcgccaacaccgcguccaccaccaacaugcgcauauucgacggggcg

SEQ ID NO: 545893 - RNA, 64 nt, Human Herpes Virus 1
gcagagcaaccccaugaaggcccuguacccgcuaaccaccaaggagcucaagaaccccaccaac

SEQ ID NO: 545894 - RNA, 64 nt, Human Herpes Virus 1
ccgauucucuuccgacgccauauccaccaccuucaccaccaaccugaccgaguacccgcucucg

SEQ ID NO: 545895 - RNA, 64 nt, Human Herpes Virus 1
caagcaggucgacggcuucuacgcgcgcgaccucaccaccaaggcccgggccacggcgccgacc

SEQ ID NO: 545896 - RNA, 64 nt, Human Herpes Virus 1
accaaccggagggagagcaugcgcccugcaggacaccaccaacacgcgcgaccaccggcgcgcg

SEQ ID NO: 545897 - RNA, 64 nt, Human Herpes Virus 1; identical to SEQ ID NO: 545890

SEQ ID NO: 545898 - RNA, 64 nt, Human Herpes Virus 1; identical to SEQ ID NO: 544926

SEQ ID NO: 545899 - RNA, 64 nt, Human Herpes Virus 1; identical to SEQ ID NO: 544927

SEQ ID NO: 545900 - RNA, 64 nt, Human Herpes Virus 1; identical to SEQ ID NO: 544928

SEQ ID NO: 545901 - RNA, 64 nt, Human Herpes Virus 1; identical to SEQ ID NO: 544929

SEQ ID NO: 545902 - RNA, 64 nt, Human Herpes Virus 1; identical to SEQ ID NO: 544930

SEQ ID NO: 545903 - RNA, 50 nt, Human Herpes Virus 1; identical to SEQ ID NO: 544931

SEQ ID NO: 545904 - RNA, 64 nt, Human Herpes Virus 1; identical to SEQ ID NO: 544932

SEQ ID NO: 545905 - RNA, 64 nt, Human Herpes Virus 1; identical to SEQ ID NO: 544927

SEQ ID NO: 545906 - RNA, 64 nt, Human Herpes Virus 1; identical to SEQ ID NO: 544926

SEQ ID NO: 545907 - RNA, 64 nt, Human Herpes Virus 1
ccgggggcgccauguuagggggugcggaacccccugacccuauauauacagggaccggggucgc

SEQ ID NO: 545908 - RNA, 64 nt, Human Herpes Virus 1
cucucggacagccuuaacauccuucacaugcugcugacccuaaacugcauacgcgugcgcuucu

SEQ ID NO: 545909 - RNA, 64 nt, Human Herpes Virus 1; identical to SEQ ID NO: 545907

SEQ ID NO: 545910 - RNA, 64 nt, Human Herpes Virus 1
cgacccgccgcccccgaccgccccguccccccaggugugccaggacggccagggcauacgcggu

SEQ ID NO: 545911 - RNA, 64 nt, Human Herpes Virus 1
gcugcgccugucucuggaacacgcgaucgggaccgugugccacccuucgcugaugaacguugac

SEQ ID NO: 545912 - RNA, 62 nt, Human Herpes Virus 1
cuggugcccggggcccaggauuccgccccgcccggccccacgcuaagggagcuguggugggu

SEQ ID NO: 545913 - RNA, 62 nt, Human Herpes Virus 1
cacgauucacggcaccgaggacaugacgcccccggccccaaaccgaaaccccgacuuccccc

SEQ ID NO: 545914 - RNA, 62 nt, Human Herpes Virus 1
gcgcgggccccgguugggggacaggaggccggcggccccagcgcagccacccagggggaggc

SEQ ID NO: 545915 - RNA, 62 nt, Human Herpes Virus 1
ucccacgcucuccccugcugccauggauuccgcggccccagcccucucccccgcucugacgg

SEQ ID NO: 545916 - RNA, 62 nt, Human Herpes Virus 1
gagguugccuacuuugaccugugccacgaagucggccccacggcggaaccucgcgaaacgga

SEQ ID NO: 545917 - RNA, 62 nt, Human Herpes Virus 1
ccgggaaacgcagccccgggcccccaccccgucggccccaagcccaaaugcaaugcuacggc

SEQ ID NO: 545918 - RNA, 62 nt, Human Herpes Virus 1
guccacaacgcguccuuguucucggccccccgcggccccaaaaggggcccgugcgacaguca

SEQ ID NO: 545919 - RNA, 62 nt, Human Herpes Virus 1
uccggucccgcuggcgauggcguacgcccccccggccccaucugcgaccgggggucuacgaa

SEQ ID NO: 545920 - RNA, 62 nt, Human Herpes Virus 1
ccaaguggccucggugguccugguggugcaaccggccccaguuccgaccccacccccgaccc

SEQ ID NO: 545921 - RNA, 62 nt, Human Herpes Virus 1
aaagcgcguccccgcguccgcagcccuuggcccggccccacgcgggggcgcccgcagacccg

SEQ ID NO: 545922 - RNA, 62 nt, Human Herpes Virus 1
acccuccucgaaccggccgcccggggcggccucggccccacuaugcagauggccgacaacau

SEQ ID NO: 545923 - RNA, 62 nt, Human Herpes Virus 1
caccgcuacauuaaguacgucauaucgcuuaucggccccaaggagcgggggccguggacucu

SEQ ID NO: 545924 - RNA, 62 nt, Human Herpes Virus 1
cuggauccccgggacguuaccgggggccaccccggccccaggucguccuccucggagauacu

SEQ ID NO: 545925 - RNA, 62 nt, Human Herpes Virus 1
cguggcucucgagaugagccagacccaacccccggccccaguugggccgggcgacccagaug

SEQ ID NO: 545926 - RNA, 64 nt, Human Herpes Virus 1; identical to SEQ ID NO: 545910

SEQ ID NO: 545927 - RNA, 64 nt, Human Herpes Virus 1; identical to SEQ ID NO: 545911

SEQ ID NO: 545928 - RNA, 62 nt, Human Herpes Virus 1; identical to SEQ ID NO: 545912

SEQ ID NO: 545929 - RNA, 62 nt, Human Herpes Virus 1; identical to SEQ ID NO: 545913

SEQ ID NO: 545930 - RNA, 62 nt, Human Herpes Virus 1; identical to SEQ ID NO: 545914

SEQ ID NO: 545931 - RNA, 62 nt, Human Herpes Virus 1; identical to SEQ ID NO: 545915

SEQ ID NO: 545932 - RNA, 62 nt, Human Herpes Virus 1; identical to SEQ ID NO: 545916

SEQ ID NO: 545933 - RNA, 62 nt, Human Herpes Virus 1; identical to SEQ ID NO: 545917

SEQ ID NO: 545934 - RNA, 62 nt, Human Herpes Virus 1; identical to SEQ ID NO: 545918

SEQ ID NO: 545935 - RNA, 62 nt, Human Herpes Virus 1; identical to SEQ ID NO: 545919

SEQ ID NO: 545936 - RNA, 62 nt, Human Herpes Virus 1; identical to SEQ ID NO: 545920

SEQ ID NO: 545937 - RNA, 62 nt, Human Herpes Virus 1; identical to SEQ ID NO: 545921

SEQ ID NO: 545938 - RNA, 62 nt, Human Herpes Virus 1; identical to SEQ ID NO: 545922

SEQ ID NO: 545939 - RNA, 62 nt, Human Herpes Virus 1; identical to SEQ ID NO: 545923

SEQ ID NO: 545940 - RNA, 62 nt, Human Herpes Virus 1; identical to SEQ ID NO: 545924

SEQ ID NO: 545941 - RNA, 62 nt, Human Herpes Virus 1; identical to SEQ ID NO: 545925

SEQ ID NO: 545942 - RNA, 64 nt, Human Herpes Virus 4 (Epstein Barr virus)
ugcuuuucuccucagucuuugcaauuugccuaacauggaggauugaggacccaccuuuuaauuc

SEQ ID NO: 545943 - RNA, 64 nt, Human Herpes Virus 4 (Epstein Barr virus)
agagguggcacagaucgcgggcagaacuccaaagauggaggacuuugugcccuggaccguggac

SEQ ID NO: 545944 - RNA, 64 nt, Human Herpes Virus 4 (Epstein Barr virus)
ucagacagaaggaggugcagacuccauggauggcauggaggagcuuuaagcccgccaccgagga

SEQ ID NO: 545945 - RNA, 64 nt, Human Herpes Virus 4 (Epstein Barr virus)
ccaccuggcugccuucagauaugccaccccccagauggaggaggacaagggucccaucaaccac

SEQ ID NO: 545946 - RNA, 64 nt, Human Herpes Virus 4 (Epstein Barr virus)
aaugcucgguaaugagauagauauugaguguauuauggaggauggcgaaauuucacaaguucug

SEQ ID NO: 545947 - RNA, 64 nt, Human Herpes Virus 4 (Epstein Barr virus)
cccccacuucgggauaguguuucagguaaagcucauggaggaaagauuuuaauggucgggcauu

SEQ ID NO: 545948 - RNA, 64 nt, Human Herpes Virus 4 (Epstein Barr virus)
gcgcuuggccgccaugcugauggccacggucaagauggaggagcugggucaccugacuacugag

SEQ ID NO: 545949 - RNA, 64 nt, Human Herpes Virus 4 (Epstein Barr virus)
cuagaggacuuuaagggcuaccuuggaugccaggcccugucagaaaugauccaauucuaccugg

SEQ ID NO: 545950 - RNA, 64 nt, Human Herpes Virus 4 (Epstein Barr virus)
aagcccccaaaaguagaggcucaggccaugcgcgcccugucaccaggccugccaaagagccaga

SEQ ID NO: 545951 - RNA, 64 nt, Human Herpes Virus 4 (Epstein Barr virus); identical to SEQ ID NO: 545950

SEQ ID NO: 545952 - RNA, 64 nt, Human Herpes Virus 4 (Epstein Barr virus)
caggaccuggacggcuacucccgcgcgugucucucccugucaggcaucuuugcacgccaggccg

SEQ ID NO: 545953 - RNA, 64 nt, Human Herpes Virus 2
acaaggucgccauaugcuucacgcccggaaaccugcgccuaaacagcgcguacguagccauguc

SEQ ID NO: 545954 - RNA, 64 nt, Human Herpes Virus 2
cccucccgcgcggacccccaaaaugacgcgcggggcgccuaaggccuccgcgaccccggcgacc

SEQ ID NO: 545955 - RNA, 64 nt, Human Herpes Virus 2
cgagcggaccgugucguggaccccguuccccgcagcgccuaaucacccccuggaaaaucuccuu

SEQ ID NO: 545956 - RNA, 64 nt, Human Herpes Virus 2
gguuuccugggaaacccuggucgcucacggcccgagccucuaccgcacauucgcagccaacccg

SEQ ID NO: 545957 - RNA, 64 nt, Human Herpes Virus 4 (Epstein Barr virus)
caaggagcuguuuggcucggcuguggagcaggcuucccugcaauuuuacaagcggccacaaggg

SEQ ID NO: 545958 - RNA, 64 nt, Human Herpes Virus 4 (Epstein Barr virus)
ggauauucuggagauccccgugacugugcucucaucccugcaacugucucccaccaaguccauc

SEQ ID NO: 545959 - RNA, 64 nt, Human Herpes Virus 4 (Epstein Barr virus)
ggcugcguaccccacucuaccgccggggccgcauucccugcaucgucugcgugggcucucccac

SEQ ID NO: 545960 - RNA, 64 nt, Human Herpes Virus 4 (Epstein Barr virus)
caaugucguguugaccggcucacggaccgcucauucccugcauaccucgaggaggucauguaug

SEQ ID NO: 545961 - RNA, 64 nt, Human Herpes Virus 4 (Epstein Barr virus)
ggccccggccccgcgagacaggcgcgagaccuacucccugcaacacaggaggcccaaucacaug

SEQ ID NO: 545962 - RNA, 64 nt, Human Herpes Virus 2; identical to SEQ ID NO: 535987

SEQ ID NO: 545963 - RNA, 64 nt, Human Herpes Virus 2; identical to SEQ ID NO: 535988

SEQ ID NO: 545964 - RNA, 64 nt, Human Herpes Virus 2; identical to SEQ ID NO: 535987

SEQ ID NO: 545965 - RNA, 64 nt, Human Herpes Virus 2; identical to SEQ ID NO: 535988

SEQ ID NO: 545966 - RNA, 64 nt, Human Herpes Virus 2
agacgcccaucggcgcaucaccgacccggagagggacauccaggacuuuguccucaccgccgaa

SEQ ID NO: 545967 - RNA, 64 nt, Human Herpes Virus 2
cggcuccuucgcgcgcuucgcccugaccaucaacgacauccaccggcauuucuuucuccacugc

SEQ ID NO: 545968 - RNA, 64 nt, Human Herpes Virus 2; identical to SEQ ID NO: 540401

SEQ ID NO: 545969 - RNA, 64 nt, Human Herpes Virus 2; identical to SEQ ID NO: 540402

SEQ ID NO: 545970 - RNA, 64 nt, Human Herpes Virus 2; identical to SEQ ID NO: 540403

SEQ ID NO: 545971 - RNA, 64 nt, Human Herpes Virus 2; identical to SEQ ID NO: 540404

SEQ ID NO: 545972 - RNA, 64 nt, Human Herpes Virus 2; identical to SEQ ID NO: 540405

SEQ ID NO: 545973 - RNA, 64 nt, Human Herpes Virus 2; identical to SEQ ID NO: 540406

SEQ ID NO: 545974 - RNA, 64 nt, Human Herpes Virus 2; identical to SEQ ID NO: 540407

SEQ ID NO: 545975 - RNA, 64 nt, Human Herpes Virus 2; identical to SEQ ID NO: 540408

SEQ ID NO: 545976 - RNA, 64 nt, Human Herpes Virus 2; identical to SEQ ID NO: 540409

SEQ ID NO: 545977 - RNA, 64 nt, Human Herpes Virus 2; identical to SEQ ID NO: 540410

SEQ ID NO: 545978 - RNA, 64 nt, Human Herpes Virus 2; identical to SEQ ID NO: 540411

SEQ ID NO: 545979 - RNA, 64 nt, Human Herpes Virus 2; identical to SEQ ID NO: 540412

SEQ ID NO: 545980 - RNA, 64 nt, Human Herpes Virus 2; identical to SEQ ID NO: 540405

SEQ ID NO: 545981 - RNA, 64 nt, Human Herpes Virus 2; identical to SEQ ID NO: 540404

SEQ ID NO: 545982 - RNA, 64 nt, Human Herpes Virus 2; identical to SEQ ID NO: 540403

SEQ ID NO: 545983 - RNA, 64 nt, Human Herpes Virus 2; identical to SEQ ID NO: 540402

SEQ ID NO: 545984 - RNA, 62 nt, Human Hepatitis C Virus
ugaugggaagcuccuacggauuccaauacucaccaggacagcggguugaauuccucgugcaa

SEQ ID NO: 545985 - RNA, 64 nt, Human Herpes Virus 2
ccccgcacuacccgccuccucccgcccacccguacccggguaugcuguucgcgggccccagucc

SEQ ID NO: 545986 - RNA, 64 nt, Human Herpes Virus 2
ccgcaagcugcugguguccgagcuggcggaggaucccggguacgccaucgcccggggcguuccg

SEQ ID NO: 545987 - RNA, 64 nt, Human Herpes Virus 2
ggcgccccagaagaagaaggccucgagggccaggcccggguaccgcccgcguucccggaaccgc

SEQ ID NO: 545988 - RNA, 64 nt, Human Herpes Virus 2
caacccgcagcuggaccgcgagggccacguggugcccggguacgaggggcgccccacggcgccc

SEQ ID NO: 545989 - RNA, 64 nt, Human Herpes Virus 2
cccugcuucaaguucuucaccgcggccgacaucacggccaaacaucgcugccuggagcgucuca

SEQ ID NO: 545990 - RNA, 64 nt, Human Herpes Virus 2
gcgggcagcgcggacgagccggcguuucuguccgcggccaaacugcacgccgccacggcggcgu

SEQ ID NO: 545991 - RNA, 64 nt, Human Herpes Virus 2
caugcgccacgugggcgacaucaacgacacgguacgcgccuacuuggacgaggcgggggggcac

SEQ ID NO: 545992 - RNA, 64 nt, Human Herpes Virus 2
cuuugcccucgccauggccgugcuucggugcacgcgcgccuaccuguaucaccggcgacaccac

SEQ ID NO: 545993 - RNA, 64 nt, Human Herpes Virus 2
ggacguuguguuuuacgucacggcagacagaaaccgcgccuacuuugugugcgggggguccguu

SEQ ID NO: 545994 - RNA, 64 nt, Human Herpes Virus 2
uuucugggggccgcuaucuggugggcgguuggcgcgcgccuaugaaagggggcgagccaccguc

SEQ ID NO: 545995 - RNA, 64 nt, Human Herpes Virus 2
gcuggugcucuuucacaacaacgaccaggcgcgccgcgccuauguggcccgcaccaucaaccac

SEQ ID NO: 545996 - RNA, 64 nt, Human Herpes Virus 2
cgcgcagaagggcuuccugcugaccagccugcgccgcgccuacgcgccccugcuggcgcgcgag

SEQ ID NO: 545997 - RNA, 64 nt, Human Herpes Virus 2; identical to SEQ ID NO: 545996

SEQ ID NO: 545998 - RNA, 64 nt, Human Herpes Virus 2; identical to SEQ ID NO: 537941

SEQ ID NO: 545999 - RNA, 64 nt, Human Herpes Virus 2; identical to SEQ ID NO: 537942

SEQ ID NO: 546000 - RNA, 64 nt, Human Herpes Virus 2; identical to SEQ ID NO: 537943

SEQ ID NO: 546001 - RNA, 64 nt, Human Herpes Virus 2; identical to SEQ ID NO: 537944

SEQ ID NO: 546002 - RNA, 64 nt, Human Herpes Virus 2; identical to SEQ ID NO: 537945

SEQ ID NO: 546003 - RNA, 64 nt, Human Herpes Virus 2; identical to SEQ ID NO: 537946

SEQ ID NO: 546004 - RNA, 64 nt, Human Herpes Virus 2; identical to SEQ ID NO: 537947

SEQ ID NO: 546005 - RNA, 64 nt, Human Herpes Virus 2; identical to SEQ ID NO: 537941

SEQ ID NO: 546006 - RNA, 64 nt, Human Herpes Virus 4 (Epstein Barr virus); identical to SEQ ID NO: 545536

SEQ ID NO: 546007 - RNA, 64 nt, Human Herpes Virus 4 (Epstein Barr virus); identical to SEQ ID NO: 545537

SEQ ID NO: 546008 - RNA, 64 nt, Human Herpes Virus 2; identical to SEQ ID NO: 536759

SEQ ID NO: 546009 - RNA, 64 nt, Human Herpes Virus 2; identical to SEQ ID NO: 536760

SEQ ID NO: 546010 - RNA, 64 nt, Human Herpes Virus 2; identical to SEQ ID NO: 536761

SEQ ID NO: 546011 - RNA, 64 nt, Human Herpes Virus 2; identical to SEQ ID NO: 536762

SEQ ID NO: 546012 - RNA, 64 nt, Human Herpes Virus 2; identical to SEQ ID NO: 536763

SEQ ID NO: 546013 - RNA, 64 nt, Human Herpes Virus 2; identical to SEQ ID NO: 536764

SEQ ID NO: 546014 - RNA, 64 nt, Human Herpes Virus 2; identical to SEQ ID NO: 536765

SEQ ID NO: 546015 - RNA, 64 nt, Human Herpes Virus 2; identical to SEQ ID NO: 536766

SEQ ID NO: 546016 - RNA, 64 nt, Human Herpes Virus 2; identical to SEQ ID NO: 536767

SEQ ID NO: 546017 - RNA, 64 nt, Human Herpes Virus 2; identical to SEQ ID NO: 536768

SEQ ID NO: 546018 - RNA, 64 nt, Human Herpes Virus 2; identical to SEQ ID NO: 536769

SEQ ID NO: 546019 - RNA, 64 nt, Human Herpes Virus 2; identical to SEQ ID NO: 536761

SEQ ID NO: 546020 - RNA, 64 nt, Human Herpes Virus 2; identical to SEQ ID NO: 536760

SEQ ID NO: 546021 - RNA, 64 nt, Human Herpes Virus 2; identical to SEQ ID NO: 536759

SEQ ID NO: 546022 - RNA, 64 nt, Human Herpes Virus 4 (Epstein Barr virus)
cccucagcuugccuccccaccggguccaucaggccggccggagggaccccggcggcccgguguc

SEQ ID NO: 546023 - RNA, 64 nt, Human Herpes Virus 4 (Epstein Barr virus); identical to SEQ ID NO: 546022

SEQ ID NO: 546024 - RNA, 64 nt, Human Herpes Virus 4 (Epstein Barr virus); identical to SEQ ID NO: 546022

SEQ ID NO: 546025 - RNA, 64 nt, Human Herpes Virus 4 (Epstein Barr virus); identical to SEQ ID NO: 546022

SEQ ID NO: 546026 - RNA, 64 nt, Human Herpes Virus 4 (Epstein Barr virus); identical to SEQ ID NO: 546022

SEQ ID NO: 546027 - RNA, 64 nt, Human Herpes Virus 4 (Epstein Barr virus); identical to SEQ ID NO: 546022

SEQ ID NO: 546028 - RNA, 64 nt, Human Herpes Virus 4 (Epstein Barr virus); identical to SEQ ID NO: 546022

SEQ ID NO: 546029 - RNA, 64 nt, Human Herpes Virus 4 (Epstein Barr virus); identical to SEQ ID NO: 546022

SEQ ID NO: 546030 - RNA, 64 nt, Human Herpes Virus 4 (Epstein Barr virus)
caaaaccaggagcaaaagagagcagcucagagggcggccggacccucaguggccagcagagcau

SEQ ID NO: 546031 - RNA, 64 nt, Human Herpes Virus 4 (Epstein Barr virus)
cggcccagaggagggcgcggucccgggcccggggcggccggaggcagagggggcgaccagagcg

SEQ ID NO: 546032 - RNA, 64 nt, Human Herpes Virus 4 (Epstein Barr virus)
ucucaacuucaucgauaaggaggacgacgggcagcggccggacgacgagccccgcuacaccuac

SEQ ID NO: 546033 - RNA, 64 nt, Human Herpes Virus 1
ccccgcgucuggccccggcgagcguauaccaacccgccccuaaccaggccuccacccccucgac

SEQ ID NO: 546034 - RNA, 64 nt, Human Herpes Virus 2
ugccccaggcggacgacagcgacgacgcggacuacgccggcaacgacgacgcagagugggcgaa

SEQ ID NO: 546035 - RNA, 64 nt, Human Herpes Virus 2
ccccccacggcgggucuccccgacgcgaggucggcgccggcauacucgccuccgacgcaacuag

SEQ ID NO: 546036 - RNA, 64 nt, Human Herpes Virus 2
ggaugacgggggcuaggaucgcccccaccgcauccgccggcacguaggcggcaaacgccgaacg

SEQ ID NO: 546037 - RNA, 64 nt, Human Herpes Virus 2
ccggggagccacccagacggcaccgccgccuugccgccggcagaacuucuacaacccccaccuc

SEQ ID NO: 546038 - RNA, 64 nt, Human Herpes Virus 2
gccccggcgacucccccggaaaccccggccugggcgccggcaccgggccgggcuccgcgacgga

SEQ ID NO: 546039 - RNA, 64 nt, Human Herpes Virus 2
cgauucccaaaggucccccggcccgccccgaggacgccggcacccccgaagccucgacgccucg

SEQ ID NO: 546040 - RNA, 64 nt, Human Herpes Virus 2
ucgucgccugccccguggaccuggggcucacgcacgccggcaccgucaaucuccgcaacaccuc

SEQ ID NO: 546041 - RNA, 64 nt, Human Herpes Virus 2
ucccggucuuuggcugcgcccaggugccgcggcgcgccggcauggaccacgggcaggaugccgu

SEQ ID NO: 546042 - RNA, 64 nt, Human Herpes Virus 2
ggcauguauuacggguggaccggacgggcgguggcgccggcauguauuauagccgccguccucg

SEQ ID NO: 546043 - RNA, 64 nt, Human Herpes Virus 2
cgugggcguacgccgaccugauccugcugcugcucgccggcacccccgccgucugggagucggg

SEQ ID NO: 546044 - RNA, 64 nt, Human Herpes Virus 2
ggugagcguccucgggcgcacgagggguggcguccgccggcacuccgcgcuguggaccugcaug

SEQ ID NO: 546045 - RNA, 64 nt, Human Herpes Virus 2
ccaugucggacagcgcgcuccaggucccggcgcccgccggcaugacccccccguccgcuccacc

SEQ ID NO: 546046 - RNA, 64 nt, Human Herpes Virus 2; identical to SEQ ID NO: 546034

SEQ ID NO: 546047 - RNA, 64 nt, Human Herpes Virus 2; identical to SEQ ID NO: 546034

SEQ ID NO: 546048 - RNA, 64 nt, Human Herpes Virus 2; identical to SEQ ID NO: 546035

SEQ ID NO: 546049 - RNA, 64 nt, Human Herpes Virus 2; identical to SEQ ID NO: 546036

SEQ ID NO: 546050 - RNA, 64 nt, Human Herpes Virus 2; identical to SEQ ID NO: 546037

SEQ ID NO: 546051 - RNA, 64 nt, Human Herpes Virus 2; identical to SEQ ID NO: 546038

SEQ ID NO: 546052 - RNA, 64 nt, Human Herpes Virus 2; identical to SEQ ID NO: 546039

SEQ ID NO: 546053 - RNA, 64 nt, Human Herpes Virus 2; identical to SEQ ID NO: 546040

SEQ ID NO: 546054 - RNA, 64 nt, Human Herpes Virus 2; identical to SEQ ID NO: 546041

SEQ ID NO: 546055 - RNA, 64 nt, Human Herpes Virus 2; identical to SEQ ID NO: 546042

SEQ ID NO: 546056 - RNA, 64 nt, Human Herpes Virus 2; identical to SEQ ID NO: 546043

SEQ ID NO: 546057 - RNA, 64 nt, Human Herpes Virus 2; identical to SEQ ID NO: 546044

SEQ ID NO: 546058 - RNA, 64 nt, Human Herpes Virus 2; identical to SEQ ID NO: 546045

SEQ ID NO: 546059 - RNA, 64 nt, Human Herpes Virus 2; identical to SEQ ID NO: 546034

SEQ ID NO: 546060 - RNA, 64 nt, Human Herpes Virus 2
ugcugccccgcaaaacggcccccugcccgcgggguggaccgacccgcaugagccuggcggacgu

SEQ ID NO: 546061 - RNA, 64 nt, Human Herpes Virus 2
cgcggccccggucggccucgagacgcgcaucucguggaccgaaauucuggcccaacagaucgcg

SEQ ID NO: 546062 - RNA, 64 nt, Human Herpes Virus 2; identical to SEQ ID NO: 541175

SEQ ID NO: 546063 - RNA, 64 nt, Human Herpes Virus 2; identical to SEQ ID NO: 541176

SEQ ID NO: 546064 - RNA, 64 nt, Human Herpes Virus 2; identical to SEQ ID NO: 541177

SEQ ID NO: 546065 - RNA, 64 nt, Human Herpes Virus 2; identical to SEQ ID NO: 541178

SEQ ID NO: 546066 - RNA, 64 nt, Human Herpes Virus 2; identical to SEQ ID NO: 541179

SEQ ID NO: 546067 - RNA, 64 nt, Human Herpes Virus 2; identical to SEQ ID NO: 541180

SEQ ID NO: 546068 - RNA, 64 nt, Human Herpes Virus 2; identical to SEQ ID NO: 541181

SEQ ID NO: 546069 - RNA, 64 nt, Human Herpes Virus 2; identical to SEQ ID NO: 541182

SEQ ID NO: 546070 - RNA, 64 nt, Human Herpes Virus 2; identical to SEQ ID NO: 541183

SEQ ID NO: 546071 - RNA, 64 nt, Human Herpes Virus 2; identical to SEQ ID NO: 541184

SEQ ID NO: 546072 - RNA, 64 nt, Human Herpes Virus 2; identical to SEQ ID NO: 541180

SEQ ID NO: 546073 - RNA, 56 nt, Human Herpes Virus 2
cggcgcgacccaaggucccgauggccgccccgcaguuucaccgccccagcaccauu

SEQ ID NO: 546074 - RNA, 64 nt, Human Herpes Virus 2
acggcggggcugcuggagacacccugcgcaugcugccccgcaaacgccggccccugggccaugc

SEQ ID NO: 546075 - RNA, 64 nt, Human Herpes Virus 2
cuacggucccucguggcuccucacaacaaaccccgccccgcaucaucccgcccgcauccggcga

SEQ ID NO: 546076 - RNA, 63 nt, Human Herpes Virus 4 (Epstein Barr virus)
aguuuugcacccacaacauguaagggcccgcuaccccuacaacacaaaacaaacuaucucccc

SEQ ID NO: 546077 - RNA, 63 nt, Human Herpes Virus 4 (Epstein Barr virus)
ccauccaucaugcaccgcuaugcugugguccagccccuacauauagaggagcuaaccuucggg

SEQ ID NO: 546078 - RNA, 63 nt, Human Herpes Virus 4 (Epstein Barr virus)
aggagauggauacccgagccauccacccucagcccccuacaagcuugggccugguccacaacc

SEQ ID NO: 546079 - RNA, 64 nt, Human Herpes Virus 2
ccccccgagcgagggcggggggaaggcgccggaggccccgcacgccgcgccugccgccgccugc

SEQ ID NO: 546080 - RNA, 64 nt, Human Herpes Virus 2
aaaucccccccguugcuuugucaagcagcccgccgccccgcacgccugggggaugcucaacgac

SEQ ID NO: 546081 - RNA, 64 nt, Human Herpes Virus 2
accguauccggagcggccgccgcguuagccgagcgccccgcagaggaguggcuggcgcgacccc

SEQ ID NO: 546082 - RNA, 64 nt, Human Herpes Virus 2
cgucgcaugccgaccccccgggaggcgcguccaagccccgcaagcugcugguguccgagcuggc

SEQ ID NO: 546083 - RNA, 56 nt, Human Herpes Virus 2; identical to SEQ ID NO: 546073

SEQ ID NO: 546084 - RNA, 64 nt, Human Herpes Virus 2
ggaccucggggugacccacgccaacaacacguucgccccgcagccuauguucgcgggcgacgcc

SEQ ID NO: 546085 - RNA, 64 nt, Human Herpes Virus 2
cagguccagucgugcugcuguccgucaguccucggccccgcaguggcccgacggccccccaaga

SEQ ID NO: 546086 - RNA, 64 nt, Human Herpes Virus 2
ggcuuuuccauuggaucaccgccagccagcugcugccccgcacggauccccuccgcgcccguuc

SEQ ID NO: 546087 - RNA, 64 nt, Human Herpes Virus 2
cgcgccccgaccccgaggacggcgcggggucucugccccgcaucgaggacacgcuguuugcccu

SEQ ID NO: 546088 - RNA, 64 nt, Human Herpes Virus 2
ccguccccccagcgugcaggcggcggccgccugggccccgcagggcggcgcgggccuggaggcc

SEQ ID NO: 546089 - RNA, 64 nt, Human Herpes Virus 2; identical to SEQ ID NO: 546074

SEQ ID NO: 546090 - RNA, 64 nt, Human Herpes Virus 2
acacgcauauggccggggcgcccccgcgccucccgccccgcaaccccgcgccccccgagcagcg

SEQ ID NO: 546091 - RNA, 64 nt, Human Herpes Virus 2
gcccacaggcuccagcaguacauguucuuuaugcgccccgcagacccgagccggccgagcacgg

SEQ ID NO: 546092 - RNA, 64 nt, Human Herpes Virus 2; identical to SEQ ID NO: 546080

SEQ ID NO: 546093 - RNA, 64 nt, Human Herpes Virus 2; identical to SEQ ID NO: 546079

SEQ ID NO: 546094 - RNA, 64 nt, Human Herpes Virus 2; identical to SEQ ID NO: 546075

SEQ ID NO: 546095 - RNA, 64 nt, Human Herpes Virus 2; identical to SEQ ID NO: 546079

SEQ ID NO: 546096 - RNA, 64 nt, Human Herpes Virus 2; identical to SEQ ID NO: 546080

SEQ ID NO: 546097 - RNA, 64 nt, Human Herpes Virus 2; identical to SEQ ID NO: 546081

SEQ ID NO: 546098 - RNA, 64 nt, Human Herpes Virus 2; identical to SEQ ID NO: 546082

SEQ ID NO: 546099 - RNA, 56 nt, Human Herpes Virus 2; identical to SEQ ID NO: 546073

SEQ ID NO: 546100 - RNA, 64 nt, Human Herpes Virus 2; identical to SEQ ID NO: 546084

SEQ ID NO: 546101 - RNA, 64 nt, Human Herpes Virus 2; identical to SEQ ID NO: 546085

SEQ ID NO: 546102 - RNA, 64 nt, Human Herpes Virus 2; identical to SEQ ID NO: 546086

SEQ ID NO: 546103 - RNA, 64 nt, Human Herpes Virus 2; identical to SEQ ID NO: 546087

SEQ ID NO: 546104 - RNA, 64 nt, Human Herpes Virus 2; identical to SEQ ID NO: 546088

SEQ ID NO: 546105 - RNA, 64 nt, Human Herpes Virus 2; identical to SEQ ID NO: 546074

SEQ ID NO: 546106 - RNA, 64 nt, Human Herpes Virus 2; identical to SEQ ID NO: 546090

SEQ ID NO: 546107 - RNA, 64 nt, Human Herpes Virus 2; identical to SEQ ID NO: 546091

SEQ ID NO: 546108 - RNA, 64 nt, Human Herpes Virus 2; identical to SEQ ID NO: 546080

SEQ ID NO: 546109 - RNA, 64 nt, Human Herpes Virus 2; identical to SEQ ID NO: 546079

SEQ ID NO: 546110 - RNA, 64 nt, Human Herpes Virus 2; identical to SEQ ID NO: 546075

SEQ ID NO: 546111 - RNA, 64 nt, Human Herpes Virus 2
gcgggggcaagaugcucaucaagggcguggaucuggugcgcaaaaacaacugcgcguuuaucaa

SEQ ID NO: 546112 - RNA, 64 nt, Human Herpes Virus 2
aagggcacgcgcgggagauugagccgaagcggcuggugcgcaccgaaaaccggcgcgaccucgg

SEQ ID NO: 546113 - RNA, 64 nt, Human Herpes Virus 2
ggcacgcacggcuacaaccccugcgggaugagguggugcgcagggcaggcgcucgcggccaacg

SEQ ID NO: 546114 - RNA, 64 nt, Human Herpes Virus 1
agguccgaagacucauuuggauccggcgggagccacccgacaacagcccccggguuuucccacg

SEQ ID NO: 546115 - RNA, 64 nt, Human Herpes Virus 1
cccugcgggccucccugccgacgucgcauucgugacccgacagggccguucggggggcgccccc

SEQ ID NO: 546116 - RNA, 64 nt, Human Herpes Virus 1
ugcccccgcgccucccggcccguaacgucgcgggacccgacaggcgaccgccggcggcgacgug

SEQ ID NO: 546117 - RNA, 64 nt, Human Herpes Virus 1
cccuguuucuuccggaaaccaggcuuguggccccacccgacaucacaagggaccucuugucggg

SEQ ID NO: 546118 - RNA, 64 nt, Human Herpes Virus 2; identical to SEQ ID NO: 544999

SEQ ID NO: 546119 - RNA, 64 nt, Human Herpes Virus 2; identical to SEQ ID NO: 545005

SEQ ID NO: 546120 - RNA, 64 nt, Human Herpes Virus 2; identical to SEQ ID NO: 545034

SEQ ID NO: 546121 - RNA, 64 nt, Human Herpes Virus 1
cauggcgggccugaucgaaauccuagacacgcaccgccaggaguguucgagucgugucugcgag

SEQ ID NO: 546122 - RNA, 64 nt, Human Herpes Virus 1
cggcacccgcgcgaucaugguacggggccgggagcgccaggaccgccugccgcgcggaggcguu

SEQ ID NO: 546123 - RNA, 64 nt, Human Herpes Virus 1
ccuggagcgcugcgacggcgccgugaucgucgggcgccaggagauggacguguuucgauacguc

SEQ ID NO: 546124 - RNA, 64 nt, Human Herpes Virus 2; identical to SEQ ID NO: 545415

SEQ ID NO: 546125 - RNA, 64 nt, Human Herpes Virus 1; identical to SEQ ID NO: 546121

SEQ ID NO: 546126 - RNA, 64 nt, Human Herpes Virus 1; identical to SEQ ID NO: 546122

SEQ ID NO: 546127 - RNA, 64 nt, Human Herpes Virus 1; identical to SEQ ID NO: 546123

SEQ ID NO: 546128 - RNA, 64 nt, Human Herpes Virus 1
uccguguugugcguguaugggcaugcccgaggucccagacgagcaacccacaucgccgggccgu

SEQ ID NO: 546129 - RNA, 64 nt, Human Herpes Virus 2
cucauaugcaaagcccuuaccuuugacgcggcgcuccgcccaagcgccgcggaguugcugcgcc

SEQ ID NO: 546130 - RNA, 64 nt, Human Herpes Virus 2
cucgguggucgugggggcgcgccugcacccgcacuccgcccaccccgcguuugcggacguggag

SEQ ID NO: 546131 - RNA, 59 nt, Human Herpes Virus 1
cauacacgcacgauggccgugccgacgggcccacggagcaagacagguucgaagagagu

SEQ ID NO: 546132 - RNA, 64 nt, Human Herpes Virus 2
ggccgcggcucccggggggccuggcgucgccuggggacgccagagugcccgcugugccagguug

SEQ ID NO: 546133 - RNA, 64 nt, Human Herpes Virus 2
gcaugcgcgccgcccagcuccacgagcgauuuauggacgccaucacgcccgccgggaccgucau

SEQ ID NO: 546134 - RNA, 64 nt, Human Herpes Virus 2
cccccgccgaacuagagguuauauucccgaccacggacgccaagcugaacuaccucucgcggac

SEQ ID NO: 546135 - RNA, 64 nt, Human Herpes Virus 2
uggggucugucguucugucgcgcggcccguaugcggacgccaugucgggggcguucgugaucgg

SEQ ID NO: 546136 - RNA, 64 nt, Human Herpes Virus 2
cggcgggcggggcgccccccccggacgcccccccggacgccaccuucuucggggagcuggaggc

SEQ ID NO: 546137 - RNA, 64 nt, Human Herpes Virus 2
gccugcugcgcacgugcccgcggaucaucgccauggacgccaccgccaacgcgcagcuggugga

SEQ ID NO: 546138 - RNA, 64 nt, Human Herpes Virus 2
guaaccacgucacccaacaggcccaggugcggcuggacgccaacgagcugcgacgguaccugcc

SEQ ID NO: 546139 - RNA, 64 nt, Human Herpes Virus 2
ccccucccggacuuugugggcuccgcgaucgccuggacgccaucggcgacccugcgggccuccc

SEQ ID NO: 546140 - RNA, 64 nt, Human Herpes Virus 2
ccggcaagcgcagcggcggcacguacgggaucguggacgccaucgucucgaccgucgagguucu

SEQ ID NO: 546141 - RNA, 64 nt, Human Herpes Virus 2
aaaccagccccucccgcgcgauggguuuucugguggacgccaucgugcggguggcgaucaacgg

SEQ ID NO: 546142 - RNA, 64 nt, Human Herpes Virus 4 (Epstein Barr virus)
uggugccggggcccacgugaacauccugcguggcuggacggaggacgauagcccaggcacaucu

SEQ ID NO: 546143 - RNA, 64 nt, Human Herpes Virus 4 (Epstein Barr virus)
ccucucagaguuucaggacgauuuaccuggaugcuggacggagauuuacaugcaggcauugaag

SEQ ID NO: 546144 - RNA, 59 nt, Human Herpes Virus 1
ggccguuugucguuauugaucuggacacccccacggacccaccuccaccguacucugcu

SEQ ID NO: 546145 - RNA, 59 nt, Human Herpes Virus 1
aggccccgcuacgcggcgcguauccggaccccacggaccgccugucgccgcgcccgccg

SEQ ID NO: 546146 - RNA, 63 nt, Human Herpes Virus 4 (Epstein Barr virus)
cccgccccuguccacugccccgguccccccagaagcccccaaaaguagaggcucaggccaugc

SEQ ID NO: 546147 - RNA, 63 nt, Human Herpes Virus 4 (Epstein Barr virus)
cugcugcuaucuuuagaggggaaaagaggaauaagcccccagacaggggagugggcuuguuug

SEQ ID NO: 546148 - RNA, 63 nt, Human Herpes Virus 4 (Epstein Barr virus); identical to SEQ ID NO: 546146

SEQ ID NO: 546149 - RNA, 63 nt, Human Herpes Virus 4 (Epstein Barr virus); identical to SEQ ID NO: 546147

SEQ ID NO: 546150 - RNA, 63 nt, Human Herpes Virus 4 (Epstein Barr virus)
cucugcaccaucauggucaucuccccagccccgagcccccauacgccccauuccaacaagauu

SEQ ID NO: 546151 - RNA, 63 nt, Human Herpes Virus 4 (Epstein Barr virus)
uacccuucuccuggcccaccugcgcaaaaagacagcccccauccacugccgugaugcucaagu

SEQ ID NO: 546152 - RNA, 63 nt, Human Herpes Virus 4 (Epstein Barr virus)
cucccaccaaguccauccugaaaaaggcaccggagcccccaccuccggagccccaagccaccu

SEQ ID NO: 546153 - RNA, 63 nt, Human Herpes Virus 4 (Epstein Barr virus)
caccgaacgaugaggaacgugaaucuaaugaagagcccccaccgccuuaugaggacccauauu

SEQ ID NO: 546154 - RNA, 63 nt, Human Herpes Virus 4 (Epstein Barr virus)
ggugggagcagggagggggcgucccgggaccccagcccccagccggcaauccaggcguaccgg

SEQ ID NO: 546155 - RNA, 63 nt, Human Herpes Virus 4 (Epstein Barr virus)
gcucggcccuccgcauccuacgacugcagcagcagcccccaccccacugcaaguuuggccgcu

SEQ ID NO: 546156 - RNA, 63 nt, Human Herpes Virus 4 (Epstein Barr virus)
uaccuucacaagcaccaccucaccuccuucuacagcccccacagugacgcggggguccuuggc

SEQ ID NO: 546157 - RNA, 63 nt, Human Herpes Virus 4 (Epstein Barr virus)
agggcccuggucaggggaauugcucauauuuuuagcccccacgcucucuauguugucacauau

SEQ ID NO: 546158 - RNA, 63 nt, Human Herpes Virus 4 (Epstein Barr virus)
uaugcaucuuacuguuaucccagccacuaccauagcccccaccacauuagucucccacaccac

SEQ ID NO: 546159 - RNA, 64 nt, Human Herpes Virus 4 (Epstein Barr virus)
uggcggacuacgccuucguugcccacagucaggucuggaccaggcccgguggggcuccucccuu

SEQ ID NO: 546160 - RNA, 64 nt, Human Herpes Virus 4 (Epstein Barr virus)
ccauccaagccuaggggagaccgaagugaaggcccuggaccaacccggcccgggccccccggua

SEQ ID NO: 546161 - RNA, 64 nt, Human Herpes Virus 4 (Epstein Barr virus); identical to SEQ ID NO: 546160

SEQ ID NO: 546162 - RNA, 64 nt, Human Herpes Virus 4 (Epstein Barr virus); identical to SEQ ID NO: 546160

SEQ ID NO: 546163 - RNA, 64 nt, Human Herpes Virus 4 (Epstein Barr virus)
accuucucugccaccguguggacaccaccccaugcuggaccaagagagcaagaaagauacgcuc

SEQ ID NO: 546164 - RNA, 64 nt, Human Herpes Virus 4 (Epstein Barr virus)
ccuggaaauggccuaggagagaagggagacacaucuggaccagaaggcuccggcggcaguggac

SEQ ID NO: 546165 - RNA, 64 nt, Human Herpes Virus 4 (Epstein Barr virus)
cuuuuugguuuggcacgaagccuucuccuggacccuggaccaacuagcggcgagacccgaggca

SEQ ID NO: 546166 - RNA, 64 nt, Human Herpes Virus 4 (Epstein Barr virus)
caagcugcugagcauggccccccaggaggcaacgcuggaccaggcggccguuucaaaugcugug

SEQ ID NO: 546167 - RNA, 64 nt, Human Herpes Virus 1
gcuccgccuggccugcgaggugcgccaggucggcgaccgccagccgcgguuuaccgccaccagc

SEQ ID NO: 546168 - RNA, 64 nt, Human Herpes Virus 1
caaagagaagcggacacaggcuagcaucccccuggaccgccaggguacacugggccaucuuggc

SEQ ID NO: 546169 - RNA, 64 nt, Human Herpes Virus 1
gcagauagccgcguuggugggggccauagccgcggaccgccaggcgggcggucagccggccgcg

SEQ ID NO: 546170 - RNA, 64 nt, Human Herpes Virus 1
uaugcgugcaggcguuuaacgacuccggccccgggaccgccagcgucaugcccgcccucaaggu

SEQ ID NO: 546171 - RNA, 64 nt, Human Herpes Virus 1
aucgcacuuuugccggcaauccucgggccgcaucgaccgccaaggccaugcgcgacugcgugcu

SEQ ID NO: 546172 - RNA, 64 nt, Human Herpes Virus 1
ggacugugacgcccugaugcggcgcgcggcccuggaccgccaucgcgacugccggguuagcgcg

SEQ ID NO: 546173 - RNA, 64 nt, Human Herpes Virus 1
cuucccgccccgccagcuguuuuuuugggggaaggaccgccaggugcugcgccugucucuggaa

SEQ ID NO: 546174 - RNA, 64 nt, Human Herpes Virus 1
acaugccccgcccccggcccucacccucaucuucgaccgccaucccaucgccgcccuccugugc

SEQ ID NO: 546175 - RNA, 64 nt, Human Herpes Virus 1
ucgcgccuuccuggccuccuuggucguguuggccgaccgccacaacgccccccuccaggaccuc

SEQ ID NO: 546176 - RNA, 64 nt, Human Herpes Virus 1
cuucguggccgcguucgaguuuguguacgucauggaccgccacuuucugcgcaccaagaaggcg

SEQ ID NO: 546177 - RNA, 64 nt, Human Herpes Virus 1
gacacuacgaucucgaagccaucugaagccguccgaccgccaacaauccccaggacaccgcgug

SEQ ID NO: 546178 - RNA, 64 nt, Human Herpes Virus 2; identical to SEQ ID NO: 545008

SEQ ID NO: 546179 - RNA, 59 nt, Human Herpes Virus 1
uuccucgucggacgaggacauggaagacccccacggagaggacggaccggagccgauac

SEQ ID NO: 546180 - RNA, 59 nt, Human Herpes Virus 1; identical to SEQ ID NO: 546145

SEQ ID NO: 546181 - RNA, 59 nt, Human Herpes Virus 1
ugcucgugguccggcgcaacgcagagaaacccacggacgcggagauuccgaccgugucg

SEQ ID NO: 546182 - RNA, 59 nt, Human Herpes Virus 1
agaugaucccggaggacaccgucgcgccacccacggacuugccguuaacuaguuaccaa

SEQ ID NO: 546183 - RNA, 64 nt, Human Herpes Virus 2; identical to SEQ ID NO: 545003

SEQ ID NO: 546184 - RNA, 64 nt, Human Herpes Virus 2; identical to SEQ ID NO: 545004

SEQ ID NO: 546185 - RNA, 64 nt, Human Herpes Virus 2; identical to SEQ ID NO: 545000

SEQ ID NO: 546186 - RNA, 64 nt, Human Herpes Virus 2; identical to SEQ ID NO: 545001

SEQ ID NO: 546187 - RNA, 64 nt, Human Herpes Virus 2; identical to SEQ ID NO: 545002

SEQ ID NO: 546188 - RNA, 64 nt, Human Herpes Virus 2; identical to SEQ ID NO: 544996

SEQ ID NO: 546189 - RNA, 64 nt, Human Herpes Virus 2; identical to SEQ ID NO: 544997

SEQ ID NO: 546190 - RNA, 64 nt, Human Herpes Virus 2; identical to SEQ ID NO: 544998

SEQ ID NO: 546191 - RNA, 64 nt, Human Herpes Virus 2; identical to SEQ ID NO: 545006

SEQ ID NO: 546192 - RNA, 64 nt, Human Herpes Virus 2; identical to SEQ ID NO: 546080

SEQ ID NO: 546193 - RNA, 64 nt, Human Herpes Virus 2; identical to SEQ ID NO: 546081

SEQ ID NO: 546194 - RNA, 64 nt, Human Herpes Virus 2; identical to SEQ ID NO: 546082

SEQ ID NO: 546195 - RNA, 64 nt, Human Herpes Virus 2; identical to SEQ ID NO: 546088

SEQ ID NO: 546196 - RNA, 64 nt, Human Herpes Virus 2; identical to SEQ ID NO: 545007

SEQ ID NO: 546197 - RNA, 64 nt, Human Herpes Virus 2; identical to SEQ ID NO: 546079

SEQ ID NO: 546198 - RNA, 64 nt, Human Herpes Virus 2; identical to SEQ ID NO: 546084

SEQ ID NO: 546199 - RNA, 64 nt, Human Herpes Virus 2; identical to SEQ ID NO: 546085

SEQ ID NO: 546200 - RNA, 64 nt, Human Herpes Virus 2; identical to SEQ ID NO: 546086

SEQ ID NO: 546201 - RNA, 64 nt, Human Herpes Virus 2; identical to SEQ ID NO: 546087

SEQ ID NO: 546202 - RNA, 64 nt, Human Herpes Virus 2; identical to SEQ ID NO: 546090

SEQ ID NO: 546203 - RNA, 64 nt, Human Herpes Virus 2; identical to SEQ ID NO: 546091

SEQ ID NO: 546204 - RNA, 64 nt, Human Herpes Virus 2; identical to SEQ ID NO: 546080

SEQ ID NO: 546205 - RNA, 64 nt, Human Herpes Virus 2; identical to SEQ ID NO: 546079

SEQ ID NO: 546206 - RNA, 64 nt, Human Herpes Virus 2; identical to SEQ ID NO: 545035

SEQ ID NO: 546207 - RNA, 64 nt, Human Herpes Virus 4 (Epstein Barr virus)
ugugaggaagaucucguugucggugcccagcugucccucguaggucuuggugucguugauaaag

SEQ ID NO: 546208 - RNA, 62 nt, Human Herpes Virus 2
cccacaaccugugcuucaguacgcucucccugcggcccgaggccgucgcgcaccuggaggcg

SEQ ID NO: 546209 - RNA, 62 nt, Human Herpes Virus 2
accgggagcuuggcgucccaggacucucgggccggcccgaccgacagccaggacuccuccuc

SEQ ID NO: 546210 - RNA, 62 nt, Human Herpes Virus 2
gaucuccgcgggucugcggcgacggggccgcacggcccgaaaacaucuggguucccguggug

SEQ ID NO: 546211 - RNA, 62 nt, Human Herpes Virus 2
cccugacggagguucugggccgcuacgaugugcggcccgacgccggggagaccguggagggg

SEQ ID NO: 546212 - RNA, 64 nt, Human Herpes Virus 2; identical to SEQ ID NO: 545036

SEQ ID NO: 546213 - RNA, 64 nt, Human Herpes Virus 2; identical to SEQ ID NO: 544996

SEQ ID NO: 546214 - RNA, 62 nt, Human Herpes Virus 2
cgucggguuuccugggaaacccuggucgcucacggcccgagccucuaccgcacauucgcagc

SEQ ID NO: 546215 - RNA, 62 nt, Human Herpes Virus 2
ggcggugauguucgggcgggugaacgagccgacggcccgaaaccugcuguuucgcuacugcg

SEQ ID NO: 546216 - RNA, 62 nt, Human Herpes Virus 2
accgcgggugggaagcucuggccggcggcgaccggcccgacuggcuguggagccgucgcucc

SEQ ID NO: 546217 - RNA, 62 nt, Human Herpes Virus 2
cccggaagcggaaaaccaaaaagccgcccaagcggcccgaggcgaccccgccccccgacgcc

SEQ ID NO: 546218 - RNA, 62 nt, Human Herpes Virus 2
cgcgcccccggccgcgguuuccgagcccacugcggcccgacagaaacuguuggcccugcucg

SEQ ID NO: 546219 - RNA, 62 nt, Human Herpes Virus 2
gcccgcccccggaccaacgcgcuggccaacgacggcccgacgaacgucgccgcccucagcgc

SEQ ID NO: 546220 - RNA, 62 nt, Human Herpes Virus 2
uccuaugggccgcguacgccgagcagaugaugcggcccgaucuguucgacggccucugcugc

SEQ ID NO: 546221 - RNA, 64 nt, Human Herpes Virus 2
gcgcgguucuaggcguggcgggccgcccggagacccgggcuacgcggaaacccccuacgcgagc

SEQ ID NO: 546222 - RNA, 64 nt, Human Herpes Virus 2
ggccccgagccugggcguccccgugacccgcgucccgggcuaccaguacuuuaacaaccagcuc

SEQ ID NO: 546223 - RNA, 64 nt, Human Herpes Virus 4 (Epstein Barr virus)
gagugcccuggaggccucaggcaacaacuauguguaugccuacggaccagacuggauggcaagg

SEQ ID NO: 546224 - RNA, 64 nt, Human Herpes Virus 4 (Epstein Barr virus)
ugcggccuccuucucgcccaaccuucuugcccgcuaugccuacuaccugcaguuuugccaggga

SEQ ID NO: 546225 - RNA, 64 nt, Human Herpes Virus 1
ucgacgaggccaacuuuauucgcccggaugcgguccagacgauuaugggcuuucucaaccaggc

SEQ ID NO: 546226 - RNA, 64 nt, Human Herpes Virus 1
ugccaaguuuggucuggucguucgagggacaggcccagacgaccgcguggucgccaacuaugua

SEQ ID NO: 546227 - RNA, 64 nt, Human Herpes Virus 1
ugacaaccaccuuccguccccugccccccccaccccagacgacaucagcuguggacccgagcuc

SEQ ID NO: 546228 - RNA, 64 nt, Human Herpes Virus 1
cccgaaccaugaacgcgcacuuggccaacgagguccagacgaucucggccacggcccgggucgg

SEQ ID NO: 546229 - RNA, 64 nt, Human Herpes Virus 1
accggcagacgcuggacgagcucgagagcgccccccagacgacgcgcgugcgcgcggaucuggu

SEQ ID NO: 546230 - RNA, 64 nt, Human Herpes Virus 1
gggccuggggggacuacagccucggcccccugggccagacgaccgcgguuccggacuccgugga

SEQ ID NO: 546231 - RNA, 64 nt, Human Herpes Virus 1
uacucacacgcaucuagggggguggggaggagccgcccgccauauuugggggacgccgugggac

SEQ ID NO: 546232 - RNA, 64 nt, Human Herpes Virus 1
acacucuggggcgcgcgacccgcccgagucagcggcccgccaguuaccacccgccgaccaaacc

SEQ ID NO: 546233 - RNA, 64 nt, Human Herpes Virus 1
gucgacgcggcgggugguggauaugucaucgggggcccgccaggcggcgcuggugcgccucacc

SEQ ID NO: 546234 - RNA, 64 nt, Human Herpes Virus 1
aggcgcgccgcgcggggucgacucccggcgcgcggcccgccauucucccgggaccaacgagacc

SEQ ID NO: 546235 - RNA, 64 nt, Human Herpes Virus 1
caugcccccacucccccguaugccccagcugccugcccgccaggcccgccaccgcccccauguc

SEQ ID NO: 546236 - RNA, 64 nt, Human Herpes Virus 1
acucccccguaugccccagcugccugcccgccaggcccgccaccgcccccauguccuuccaccc

SEQ ID NO: 546237 - RNA, 64 nt, Human Herpes Virus 1
agcuccuggucccccgcggguggcccgcguuugcgcccgccagucccggggaggacacggcggg

SEQ ID NO: 546238 - RNA, 64 nt, Human Herpes Virus 1
cgccucccccgcggggggcgacgaccccgacgccgcccgccacgccgacgccgacgacgacgcc

SEQ ID NO: 546239 - RNA, 64 nt, Human Herpes Virus 1
accuggcggccgucccggggcuggccggggcccggcccgccagccccccgcggccggagggacc

SEQ ID NO: 546240 - RNA, 64 nt, Human Herpes Virus 1
cgaccuggggucgcucuguccaccgggaagcagggcccgccaucugggauggcuccuggccagg

SEQ ID NO: 546241 - RNA, 64 nt, Human Herpes Virus 1
ccauguuucacaacgggcgcgugguaguggacgggcccgccaugcucacgcugcaggugcuggc

SEQ ID NO: 546242 - RNA, 64 nt, Human Herpes Virus 1
cccgcccccgccguugagccccucgcccguccucgcccgccaucgagccaacgcccugaccaac

SEQ ID NO: 546243 - RNA, 64 nt, Human Herpes Virus 1
cacgugucggggaggcgcgcgaccgggcugggaggcccgccacgcccauaagcuccucccgaua

SEQ ID NO: 546244 - RNA, 64 nt, Human Herpes Virus 1; identical to SEQ ID NO: 546231

SEQ ID NO: 546245 - RNA, 64 nt, Human Herpes Virus 1; identical to SEQ ID NO: 546239

SEQ ID NO: 546246 - RNA, 64 nt, Human Herpes Virus 1; identical to SEQ ID NO: 546238

SEQ ID NO: 546247 - RNA, 64 nt, Human Herpes Virus 2
ugugggggugggcccgugggugaggaggaagcggaagcgggaggggggggcgacgugugugccg

SEQ ID NO: 546248 - RNA, 64 nt, Human Herpes Virus 2
gcacagacagcuguacgcgcugcugauggcccauaagcgggaguuugcgggcgcgcgcuucaag

SEQ ID NO: 546249 - RNA, 64 nt, Human Herpes Virus 2; identical to SEQ ID NO: 546247

SEQ ID NO: 546250 - RNA, 64 nt, Human Herpes Virus 1
gcgaggcgcgccggaccagggcgggggcaucgggcaccgggauggccgccgcgacggccgacga

SEQ ID NO: 546251 - RNA, 64 nt, Human Herpes Virus 1
ccaacugcaagauuaucuucgugucguccaccaacaccgggaaggccaguacgagcuuuuugua

SEQ ID NO: 546252 - RNA, 64 nt, Human Herpes Virus 1
agccgagauuuacaaggaccagacccugcagcugcaccgggagggcgucagcacccaagauccu

SEQ ID NO: 546253 - RNA, 64 nt, Human Herpes Virus 1
ugggccauggacagcgaccuggggucgcucuguccaccgggaagcagggcccgccaucugggau

SEQ ID NO: 546254 - RNA, 64 nt, Human Herpes Virus 1
guacgugcgcaacaaccuggagaccaccgcguuucaccgggacgaccacgagaccgacauggag

SEQ ID NO: 546255 - RNA, 64 nt, Human Herpes Virus 2; identical to SEQ ID NO: 545318

SEQ ID NO: 546256 - RNA, 64 nt, Human Herpes Virus 2; identical to SEQ ID NO: 545414

SEQ ID NO: 546257 - RNA, 64 nt, Human Herpes Virus 2; identical to SEQ ID NO: 545416

SEQ ID NO: 546258 - RNA, 64 nt, Human Herpes Virus 2; identical to SEQ ID NO: 545417

SEQ ID NO: 546259 - RNA, 64 nt, Human Herpes Virus 2; identical to SEQ ID NO: 545418

SEQ ID NO: 546260 - RNA, 64 nt, Human Herpes Virus 4 (Epstein Barr virus); identical to SEQ ID NO: 544829

SEQ ID NO: 546261 - RNA, 64 nt, Human Herpes Virus 4 (Epstein Barr virus); identical to SEQ ID NO: 544830

SEQ ID NO: 546262 - RNA, 64 nt, Human Herpes Virus 4 (Epstein Barr virus); identical to SEQ ID NO: 544831

SEQ ID NO: 546263 - RNA, 64 nt, Human Herpes Virus 2; identical to SEQ ID NO: 545419

SEQ ID NO: 546264 - RNA, 64 nt, Human Herpes Virus 2; identical to SEQ ID NO: 545319

SEQ ID NO: 546265 - RNA, 64 nt, Human Herpes Virus 4 (Epstein Barr virus); identical to SEQ ID NO: 544832

SEQ ID NO: 546266 - RNA, 64 nt, Human Herpes Virus 4 (Epstein Barr virus); identical to SEQ ID NO: 544833

SEQ ID NO: 546267 - RNA, 64 nt, Human Herpes Virus 2
agguggugaacgccgucggggacgagaccgccaaacccaccacguucgagcucggccccaacgg

SEQ ID NO: 546268 - RNA, 64 nt, Human Herpes Virus 2
gaccuuuuguuuauuggggacggaagugggcgugacccaccacccgaaagggcgcacccggccc

SEQ ID NO: 546269 - RNA, 64 nt, Human Herpes Virus 2
cgagacgaugaacgucgccaccugcacacaccagacccaccacgccgcccgcgccccgggcgcg

SEQ ID NO: 546270 - RNA, 64 nt, Human Herpes Virus 2
caacgcccugauccgcgccuucgucccggaggccacccaccaguguagcggcccgucgcacaac

SEQ ID NO: 546271 - RNA, 64 nt, Human Herpes Virus 2
ccggcccccggccgagcgccagggcagccccacgcccgccgacgcgcagggauccugugggggu

SEQ ID NO: 546272 - RNA, 64 nt, Human Herpes Virus 2
gcacgcggcucugccccggccccccuccccaacccccgccgauuuccgggcgagcgcguccccg

SEQ ID NO: 546273 - RNA, 64 nt, Human Herpes Virus 2
uggggcgucgaacgcagggauggccgaccccacgcccgccgaugagggaacggccgccgccauc

SEQ ID NO: 546274 - RNA, 64 nt, Human Herpes Virus 2
accguguuguguccccgagcgucucuuccgcccccccgccgagcgcccccgacgcgagucugcc

SEQ ID NO: 546275 - RNA, 64 nt, Human Herpes Virus 2
gggggacgcggccgucugguucgaggacaugacccccgccgaacuagagguuauauucccgacc

SEQ ID NO: 546276 - RNA, 64 nt, Human Herpes Virus 2
gagggguuccggacgcgaccgccaccccccgagacccgccgauuuugguguuuacgaacgaguu

SEQ ID NO: 546277 - RNA, 64 nt, Human Herpes Virus 2
ggaugaagauaaaccagacgcuguuguuucugggcccgccgaccgccccccccggcggggcaug

SEQ ID NO: 546278 - RNA, 62 nt, Human Herpes Virus 2; identical to SEQ ID NO: 537665

SEQ ID NO: 546279 - RNA, 64 nt, Human Herpes Virus 2
cccauggccagccugucgccgcgacccccggcgccccgccgacaccaccaccaccaccaccacc

SEQ ID NO: 546280 - RNA, 64 nt, Human Herpes Virus 2
cggccgccccucccgcgggggccgcgccccccgccccgccgacgccgccgccgcggccgccgcg

SEQ ID NO: 546281 - RNA, 64 nt, Human Herpes Virus 2
gcggccgccgcgccccgcggcgcugacccgccggcccgccgagggccccgacccgcagggcggc

SEQ ID NO: 546282 - RNA, 64 nt, Human Herpes Virus 2
caucgucgucaacgccgugcgcgccgcggacuggcccgccgacgggcccguggucucgcggcag

SEQ ID NO: 546283 - RNA, 64 nt, Human Herpes Virus 2
cagguaucgcgucuuuguccugggggccccgacgcccgccgacaacggcucggcgcuggacgcc

SEQ ID NO: 546284 - RNA, 64 nt, Human Herpes Virus 2
cgagcuccccgaggcggggcccacgucccguccccccgccgaggugacccagcucaagggacug

SEQ ID NO: 546285 - RNA, 64 nt, Human Herpes Virus 2
cgcggcgggcggcggggccagggccggcccgccgcccgccgauagcucuucuguccgcgaggag

SEQ ID NO: 546286 - RNA, 64 nt, Human Herpes Virus 2; identical to SEQ ID NO: 540868

SEQ ID NO: 546287 - RNA, 64 nt, Human Herpes Virus 2
ggcguucgacgaaaaccacgagggcgcggcccuccccgccgacauuacguucacggccuucgag

SEQ ID NO: 546288 - RNA, 64 nt, Human Herpes Virus 2
cguccgacgacgccggcggcaaccgcacuugccccccgccgacgcuucuucccccccccgccac

SEQ ID NO: 546289 - RNA, 64 nt, Human Herpes Virus 2
ccccccacgcccucuaccgaccaucccgccuccgcccgccgaagcuggccgccgcgacccaccg

SEQ ID NO: 546290 - RNA, 64 nt, Human Herpes Virus 2
gacggcggacaaguacgugugucgccgccugggccccgccgaucgccgguucguggcgcucagc

SEQ ID NO: 546291 - RNA, 64 nt, Human Herpes Virus 2
acuccgccuggacggcgaggagguggauaugacgcccgccgacgcccuggacgacuucgacuug

SEQ ID NO: 546292 - RNA, 64 nt, Human Herpes Virus 2; identical to SEQ ID NO: 546271

SEQ ID NO: 546293 - RNA, 64 nt, Human Herpes Virus 2; identical to SEQ ID NO: 546282

SEQ ID NO: 546294 - RNA, 64 nt, Human Herpes Virus 2; identical to SEQ ID NO: 546281

SEQ ID NO: 546295 - RNA, 64 nt, Human Herpes Virus 2; identical to SEQ ID NO: 546280

SEQ ID NO: 546296 - RNA, 64 nt, Human Herpes Virus 2; identical to SEQ ID NO: 546279

SEQ ID NO: 546297 - RNA, 64 nt, Human Herpes Virus 4 (Epstein Barr virus)
gccuggccaauaacuacauaaguagggaugagcugcuccacacccgcgcugccucccuguuaua

SEQ ID NO: 546298 - RNA, 62 nt, Human Herpes Virus 2
aggacggcgcauuccgggccuaccccagagggguuccggacgcgaccgccaccccccgagac

SEQ ID NO: 546299 - RNA, 62 nt, Human Herpes Virus 2
ccgacaccaccaacgccacgcaacccgaacucguuccggaagaccccgaggacucggcccuc

SEQ ID NO: 546300 - RNA, 62 nt, Human Herpes Virus 2
guggccaagacgcucgaccacugguggccggcguuccggaacgccgaccaggucgagguucu

SEQ ID NO: 546301 - RNA, 62 nt, Human Herpes Virus 2
acagccuggggccccugggucagccgacggugguuccggacuccguggaccugucuccccag

SEQ ID NO: 546302 - RNA, 64 nt, Human Herpes Virus 2
ccgccgaugagggaacggccgccgccauccucaaacaggccaucgccggggaccgcagucuggu

SEQ ID NO: 546303 - RNA, 64 nt, Human Herpes Virus 4 (Epstein Barr virus)
gcuucccaccguuccagaugagaggcagccaucuuuaucuuacggucuuccucucuggacacug

SEQ ID NO: 546304 - RNA, 64 nt, Human Herpes Virus 4 (Epstein Barr virus)
gcuguucucggcccuguacccggccccgugcaucucgggcuacgcgcgccccccgggccccagu

SEQ ID NO: 546305 - RNA, 64 nt, Human Herpes Virus 4 (Epstein Barr virus)
cggcccugggcagggaggccaccuuuuacgcgugucgggcuaugcgucggcuucuacucggcgu

SEQ ID NO: 546306 - RNA, 64 nt, Human Herpes Virus 1; identical to SEQ ID NO: 545481

SEQ ID NO: 546307 - RNA, 64 nt, Human Herpes Virus 1; identical to SEQ ID NO: 545482

SEQ ID NO: 546308 - RNA, 64 nt, Human Herpes Virus 1; identical to SEQ ID NO: 545483

SEQ ID NO: 546309 - RNA, 64 nt, Human Herpes Virus 1
cgcccaucgggccacacggcagcaguaacaccaacaccaccaccaacagcagcggcggcggcgg

SEQ ID NO: 546310 - RNA, 64 nt, Human Herpes Virus 1
ccaucgggccacacggcagcaguaacaccaacaccaccaccaacagcagcggcggcggcggcuc

SEQ ID NO: 546311 - RNA, 64 nt, Human Herpes Virus 1
cgggggagcgguuucuguuguaccgccccucgaccaccaccaacagcggccucauggcccccga

SEQ ID NO: 546312 - RNA, 64 nt, Human Herpes Virus 1
uuacgucgccgcccgcgauggagcuuagcuacgccaccaccaugcacuaccgggacguuguguu

SEQ ID NO: 546313 - RNA, 64 nt, Human Herpes Virus 1
ccgauucgggcccggucgcucgcuaccggugcgccaccaccagaggccauauccgacaccccag

SEQ ID NO: 546314 - RNA, 64 nt, Human Herpes Virus 1
cuccgcgugggugaugucggguccaaacucccgacaccaccagcuggcaugguauaaaucaccg

SEQ ID NO: 546315 - RNA, 64 nt, Human Herpes Virus 1
cggcggcgcccgacgcgggcgccaacaccgcguccaccaccaacaugcgcauauucgacggggc

SEQ ID NO: 546316 - RNA, 64 nt, Human Herpes Virus 1
uuuauauagacgguccccacgggauggggaaaaccaccaccacgcaacugcugguggcccuggg

SEQ ID NO: 546317 - RNA, 64 nt, Human Herpes Virus 1
uccgauucucuuccgacgccauauccaccaccuucaccaccaaccugaccgaguacccgcucuc

SEQ ID NO: 546318 - RNA, 64 nt, Human Herpes Virus 1
ucaagcaggucgacggcuucuacgcgcgcgaccucaccaccaaggcccgggccacggcgccgac

SEQ ID NO: 546319 - RNA, 64 nt, Human Herpes Virus 1
aaccaaccggagggagagcacgcgcccugcaggacaccaccaacgcgcgcgaccaccggcgcgc

SEQ ID NO: 546320 - RNA, 64 nt, Human Herpes Virus 1
gcacagacgaagaccucaacgaacuccuuggcaucaccaccauccgcgugacggucugcgaggg

SEQ ID NO: 546321 - RNA, 64 nt, Human Herpes Virus 1; identical to SEQ ID NO: 546310

SEQ ID NO: 546322 - RNA, 64 nt, Human Herpes Virus 1; identical to SEQ ID NO: 546309

SEQ ID NO: 546323 - RNA, 64 nt, Human Herpes Virus 1
ucgugcgcacuagguccugucgcugccccccaaacaccaccacgggccuguuugcggaggacag

SEQ ID NO: 546324 - RNA, 64 nt, Human Herpes Virus 1
uguggcccuggcggacggcggccauuaacuuuaucaccaccauggccccccgcguccaaaccca

SEQ ID NO: 546325 - RNA, 64 nt, Human Hepatitis C Virus (HCV-N)
ucccuuacaucgaacagggaaugcaacucgccgagcaauucaagcagaaggcgcucggguuguu

SEQ ID NO: 546326 - RNA, 64 nt, Human Herpes Virus 4 (Epstein Barr virus)
cgaccggcuccagcaguuggcuccggaucccccuccucucuaucaaaaggggagcacuacugcu

SEQ ID NO: 546327 - RNA, 62 nt, Human Herpes Virus 2
cccaaauggucccugcguacgacucgggaaccgcggucgagagcgcgccggccgcguccucg

SEQ ID NO: 546328 - RNA, 62 nt, Human Herpes Virus 2
ugcaccccggggcguuucgcagcguucgcguggcggucgagggcaacagcagccaggacucg

SEQ ID NO: 546329 - RNA, 62 nt, Human Herpes Virus 2
guccccgccaccgccgcuuuugcgucgucuccgcggucgagucucccccgccccgauacgcc

SEQ ID NO: 546330 - RNA, 62 nt, Human Herpes Virus 2
gggcgguucugcgauccauauccgagcgcgcggcggucgagcgcaucagcgaaagcuuugga

SEQ ID NO: 546331 - RNA, 62 nt, Human Herpes Virus 2
acaaccgcccccugaagcacgacgucgggcuggcggucgaucucuacgcccuggggcagacg

SEQ ID NO: 546332 - RNA, 62 nt, Human Herpes Virus 2; identical to SEQ ID NO: 546327

SEQ ID NO: 546333 - RNA, 64 nt, Human Herpes Virus 1
uaacucucaguuuaucauggauaacaaccacccgcacccccagggcacccaaggggccgugcgg

SEQ ID NO: 546334 - RNA, 64 nt, Human Herpes Virus 1
gagggcgcuuggucgggaggccgcaucgaacgcacacccccauccggugguccguguggagguc

SEQ ID NO: 546335 - RNA, 64 nt, Human Herpes Virus 1
cggggucccccgggucagccgccagcccggaggucacccccacaucgaccccaaaccccaacaa

SEQ ID NO: 546336 - RNA, 64 nt, Human Herpes Virus 1
ccccaaaccccaacaaugucacacaaaacaaaaccacccccaccgagccggccagccccccaac

SEQ ID NO: 546337 - RNA, 64 nt, Human Herpes Virus 1
ggagggcggggacgaccccgaccacgaccccgaccacccccacgaccucgacgacgcccggcgg

SEQ ID NO: 546338 - RNA, 64 nt, Human Herpes Virus 1
cgcgugcggcggcggcgacgacgacgauaacccccacccccacggggccgccgggggccgccuc

SEQ ID NO: 546339 - RNA, 64 nt, Human Herpes Virus 1
accgccugccgcgcggaggcguuguuauccagcacacccccauugggcuguuggugauuaucga

SEQ ID NO: 546340 - RNA, 64 nt, Human Herpes Virus 1
ggaucgacguguauggucagacccacugggacaucacccccaccaccccggccacgccgcuguc

SEQ ID NO: 546341 - RNA, 64 nt, Human Herpes Virus 1
agcgccggggccuuggggccccggccggguacuucacccccauugccguggaccuguggaacgu

SEQ ID NO: 546342 - RNA, 64 nt, Human Herpes Virus 1
ggggauuggggugaccgaggcgcccuccuuggggcacccccacacgccgcccccggagguuacg

SEQ ID NO: 546343 - RNA, 64 nt, Human Herpes Virus 1
ggaacgaggggccguuugucguuauugaucuggacacccccacggacccaccuccaccguacuc

SEQ ID NO: 546344 - RNA, 64 nt, Human Herpes Virus 1; identical to SEQ ID NO: 546338

SEQ ID NO: 546345 - RNA, 64 nt, Human Herpes Virus 1; identical to SEQ ID NO: 546337

SEQ ID NO: 546346 - RNA, 62 nt, Human Herpes Virus 4 (Epstein Barr virus)
uggagacccgagucucugcuuucgcgcagagcccggccuacgagcgcaucgucuccagcggc

SEQ ID NO: 546347 - RNA, 62 nt, Human Herpes Virus 4 (Epstein Barr virus)
gccuagccuccucccucuacguguacguugauccggccuauaccaacaacacauccgcauca

SEQ ID NO: 546348 - RNA, 62 nt, Human Herpes Virus 4 (Epstein Barr virus)
cucacaccuaccacccccacccacaccccccuccggccuacuuuggcuugccgggccucuuu

SEQ ID NO: 546349 - RNA, 62 nt, Human Herpes Virus 4 (Epstein Barr virus)
cuccuccaggccacgggggagucggcacacauccggccuacggaggccgaggcggccgaggu

SEQ ID NO: 546350 - RNA, 62 nt, Human Herpes Virus 4 (Epstein Barr virus)
aucgagaccggcccucuggcgacccccuuaacccggccuacgacccccgcggcuaccgccaa

SEQ ID NO: 546351 - RNA, 62 nt, Human Herpes Virus 4 (Epstein Barr virus)
cccugagggccggccaaacggcgcgcgcggauccggccuauguccacagccccuucuucccg

SEQ ID NO: 546352 - RNA, 62 nt, Human Herpes Virus 4 (Epstein Barr virus)
agggggcgagaaagacggagauggccgaggacccggccuacgccgagcggcacggcguuccc

SEQ ID NO: 546353 - RNA, 64 nt, Human Herpes Virus 1
aggcgcccuggaggcgcuggagacggcggcggccgccgccgaagaggcggaugccgcgcgcggg

SEQ ID NO: 546354 - RNA, 64 nt, Human Herpes Virus 1
gugucucuaccugcuguaccgaaacacgcacggggccgccgacgauagcgaccgcgcuccgguc

SEQ ID NO: 546355 - RNA, 64 nt, Human Herpes Virus 1
gucgccggcgucucgcgagggggcgcggcgacuggccgccgaggccgagcucgcgcuguccggg

SEQ ID NO: 546356 - RNA, 64 nt, Human Herpes Virus 1
cagcgcagcacacguggacguugacacggcccgcgccgccgauuuguucgucucucagaugaug

SEQ ID NO: 546357 - RNA, 64 nt, Human Herpes Virus 1
agaugccggacggacgagacggauccugugccgcgccgccgagcaggcuauuacccgucgccgc

SEQ ID NO: 546358 - RNA, 64 nt, Human Herpes Virus 1
cugugccgcgccgccgagcaggcuauuacccgucgccgccgaacccggcggucccgggaggcgu

SEQ ID NO: 546359 - RNA, 64 nt, Human Herpes Virus 1
ggcggcgugugccgccucguacgacgcgcgcgacgccgccgaugcgguacgggcccacgucacg

SEQ ID NO: 546360 - RNA, 64 nt, Human Herpes Virus 1
cagcuuuuaccgcuuccucuucgcuuuccugucggccgccgacgaccugguuacggaaaaccug

SEQ ID NO: 546361 - RNA, 64 nt, Human Herpes Virus 1
cccccgcgccccggccccggagcgaaaggcgcccgccgccgacaccaucgacgccaccacgcgg

SEQ ID NO: 546362 - RNA, 64 nt, Human Herpes Virus 1
aaacgccagccuguuuguccuggggauggccauagccgccgaagggacucuggcguacaacggc

SEQ ID NO: 546363 - RNA, 64 nt, Human Herpes Virus 1
ggccuggcgcacgcggcggccgccguggccaugagccgccgauacgaccgcgcgcagaagggcu

SEQ ID NO: 546364 - RNA, 64 nt, Human Herpes Virus 1
cccccugcuggcggcggcggccagcgcaccggacgccgccgacgcgcuggcggccgccgccgcc

SEQ ID NO: 546365 - RNA, 64 nt, Human Herpes Virus 1
gugccgggaucccgaggcgucgcugccggcccaggccgccgagacggaggaggugggucuuuuc

SEQ ID NO: 546366 - RNA, 64 nt, Human Herpes Virus 1
ccgagcuccugcaggcugcccugcgcccgcccgggccgccgagcggcccgucuccggacgccuc

SEQ ID NO: 546367 - RNA, 64 nt, Human Herpes Virus 1
ccacccgcgccccguccugccgcccuuugacaucgccgccgaggucgccuuuaccgcgcgcaua

SEQ ID NO: 546368 - RNA, 64 nt, Human Herpes Virus 1
ccgggaggggucgcacaccgaacacaccagcuacgccgccgaccgcuucaagcaggucgacggc

SEQ ID NO: 546369 - RNA, 64 nt, Human Herpes Virus 1
ccgcggugucugggaauagagcagaaacgcacgcgccgccgacucccggcuugccggucggcgg

SEQ ID NO: 546370 - RNA, 64 nt, Human Herpes Virus 1
ugugccgcccgucgguacgcucgacgaggacgucgccgccgacguggucaccgcccccucaagg

SEQ ID NO: 546371 - RNA, 64 nt, Human Herpes Virus 1
aggcaaugcucgagggagcgacgacccggcggcggccgccgagcgacgcccgggagaaguucuu

SEQ ID NO: 546372 - RNA, 64 nt, Human Herpes Virus 1
gggccguauacagcgccaaggccacgagcgcugggccgccgacggaccgccgguuucacguggc

SEQ ID NO: 546373 - RNA, 64 nt, Human Herpes Virus 1
ccccgacgcacccagaaccgccuuagggucggcugccgccgaccgccaaauuugcccguggcga

SEQ ID NO: 546374 - RNA, 64 nt, Human Herpes Virus 1; identical to SEQ ID NO: 546364

SEQ ID NO: 546375 - RNA, 64 nt, Human Herpes Virus 1; identical to SEQ ID NO: 546363

SEQ ID NO: 546376 - RNA, 63 nt, Human Herpes Virus 1
aaguugccauggcugggcgggaggggcgcacgcgccagcgaacuuuacgggacacaauccccg

SEQ ID NO: 546377 - RNA, 63 nt, Human Herpes Virus 1
gggccccucucgcccacggccaccacguguacugccagcgagucaauggcgugauggugcuuu

SEQ ID NO: 546378 - RNA, 63 nt, Human Herpes Virus 1
acgacgacguccgacggcgaggccguugagcuagccagcgagacgcugaugaagcgcgaacug

SEQ ID NO: 546379 - RNA, 63 nt, Human Herpes Virus 1
gaguacuggagcguucgggugucccccuuugaggccagcgaccccuugccccccacugccuuc

SEQ ID NO: 546380 - RNA, 63 nt, Human Herpes Virus 1
ggccuguuucaggaggccuacccgcucaccugcgccagcgaccccgcccuccuccgcagugcc

SEQ ID NO: 546381 - RNA, 63 nt, Human Herpes Virus 1
gagacggguucggcgguguccacggccaccgccgccagcgacguacaguuuaagcgccccccg

SEQ ID NO: 546382 - RNA, 63 nt, Human Herpes Virus 1
cuuuuacggggaacucgcggccugggcgcggccgccagcgaccgccccgccggccaaucugua

SEQ ID NO: 546383 - RNA, 63 nt, Human Herpes Virus 1
cccggggccacacccgcccacaaggcucuacaggccagcgacaacccgggcccgucgcgacga

SEQ ID NO: 546384 - RNA, 63 nt, Human Herpes Virus 1
aacuacguaaaaacuuucaggcggguccagggcgccagcgagcacacgcacgggcggcucugc

SEQ ID NO: 546385 - RNA, 63 nt, Human Herpes Virus 1
acgguucccgagaguuugaucguggacgggcucgccagcgacccgcacuacgaguacauccgg

SEQ ID NO: 546386 - RNA, 64 nt, Human Herpes Virus 1; identical to SEQ ID NO: 546353

SEQ ID NO: 546387 - RNA, 64 nt, Human Herpes Virus 1; identical to SEQ ID NO: 546354

SEQ ID NO: 546388 - RNA, 64 nt, Human Herpes Virus 1; identical to SEQ ID NO: 546355

SEQ ID NO: 546389 - RNA, 64 nt, Human Herpes Virus 1; identical to SEQ ID NO: 546356

SEQ ID NO: 546390 - RNA, 64 nt, Human Herpes Virus 1; identical to SEQ ID NO: 546357

SEQ ID NO: 546391 - RNA, 64 nt, Human Herpes Virus 1; identical to SEQ ID NO: 546358

SEQ ID NO: 546392 - RNA, 64 nt, Human Herpes Virus 1; identical to SEQ ID NO: 546359

SEQ ID NO: 546393 - RNA, 64 nt, Human Herpes Virus 1; identical to SEQ ID NO: 546360

SEQ ID NO: 546394 - RNA, 64 nt, Human Herpes Virus 1; identical to SEQ ID NO: 546361

SEQ ID NO: 546395 - RNA, 64 nt, Human Herpes Virus 1; identical to SEQ ID NO: 546362

SEQ ID NO: 546396 - RNA, 64 nt, Human Herpes Virus 1; identical to SEQ ID NO: 546363

SEQ ID NO: 546397 - RNA, 64 nt, Human Herpes Virus 1; identical to SEQ ID NO: 546364

SEQ ID NO: 546398 - RNA, 64 nt, Human Herpes Virus 1; identical to SEQ ID NO: 546365

SEQ ID NO: 546399 - RNA, 64 nt, Human Herpes Virus 1; identical to SEQ ID NO: 546366

SEQ ID NO: 546400 - RNA, 64 nt, Human Herpes Virus 1; identical to SEQ ID NO: 546367

SEQ ID NO: 546401 - RNA, 64 nt, Human Herpes Virus 1; identical to SEQ ID NO: 546368

SEQ ID NO: 546402 - RNA, 64 nt, Human Herpes Virus 1; identical to SEQ ID NO: 546369

SEQ ID NO: 546403 - RNA, 64 nt, Human Herpes Virus 1; identical to SEQ ID NO: 546370

SEQ ID NO: 546404 - RNA, 64 nt, Human Herpes Virus 1; identical to SEQ ID NO: 546371

SEQ ID NO: 546405 - RNA, 64 nt, Human Herpes Virus 1; identical to SEQ ID NO: 546372

SEQ ID NO: 546406 - RNA, 64 nt, Human Herpes Virus 1; identical to SEQ ID NO: 546373

SEQ ID NO: 546407 - RNA, 64 nt, Human Herpes Virus 1; identical to SEQ ID NO: 546364

SEQ ID NO: 546408 - RNA, 64 nt, Human Herpes Virus 1; identical to SEQ ID NO: 546363

SEQ ID NO: 546409 - RNA, 63 nt, Human Herpes Virus 1; identical to SEQ ID NO: 546376

SEQ ID NO: 546410 - RNA, 63 nt, Human Herpes Virus 1; identical to SEQ ID NO: 546377

SEQ ID NO: 546411 - RNA, 63 nt, Human Herpes Virus 1; identical to SEQ ID NO: 546378

SEQ ID NO: 546412 - RNA, 63 nt, Human Herpes Virus 1; identical to SEQ ID NO: 546379

SEQ ID NO: 546413 - RNA, 63 nt, Human Herpes Virus 1; identical to SEQ ID NO: 546380

SEQ ID NO: 546414 - RNA, 63 nt, Human Herpes Virus 1; identical to SEQ ID NO: 546381

SEQ ID NO: 546415 - RNA, 63 nt, Human Herpes Virus 1; identical to SEQ ID NO: 546382

SEQ ID NO: 546416 - RNA, 63 nt, Human Herpes Virus 1; identical to SEQ ID NO: 546383

SEQ ID NO: 546417 - RNA, 63 nt, Human Herpes Virus 1; identical to SEQ ID NO: 546384

SEQ ID NO: 546418 - RNA, 63 nt, Human Herpes Virus 1; identical to SEQ ID NO: 546385

SEQ ID NO: 546419 - RNA, 64 nt, Human Herpes Virus 1
agauuaucuucgugucguccaccaacaccgggaaggccaguacgagcuuuuuguacaaccuccg

SEQ ID NO: 546420 - RNA, 64 nt, Human Herpes Virus 2
gccgccuggcgauauauucgcgagcucauuaucgccaccacacucuuugcgucggucuaccggu

SEQ ID NO: 546421 - RNA, 64 nt, Human Herpes Virus 4 (Epstein Barr virus); identical to SEQ ID NO: 544460

SEQ ID NO: 546422 - RNA, 64 nt, Human Herpes Virus 4 (Epstein Barr virus); identical to SEQ ID NO: 544461

SEQ ID NO: 546423 - RNA, 64 nt, Human Herpes Virus 4 (Epstein Barr virus); identical to SEQ ID NO: 544462

SEQ ID NO: 546424 - RNA, 64 nt, Human Herpes Virus 4 (Epstein Barr virus); identical to SEQ ID NO: 544463

SEQ ID NO: 546425 - RNA, 64 nt, Human Herpes Virus 2
aacaccagcagcgccuccgcagcgaaaacgccccccaccacaccagcccccacgacccccccgc

SEQ ID NO: 546426 - RNA, 64 nt, Human Herpes Virus 2
acgaccggccgcaccggccggccgacuggaccguccaccacaaaaucuacuauuacgugcuggu

SEQ ID NO: 546427 - RNA, 64 nt, Human Herpes Virus 2
cggucuguauguccugcgcguaugggucggcagcgcgacgaacgccagccgguuuguuuugggg

SEQ ID NO: 546428 - RNA, 64 nt, Human Herpes Virus 4 (Epstein Barr virus); identical to SEQ ID NO: 544460

SEQ ID NO: 546429 - RNA, 64 nt, Human Herpes Virus 4 (Epstein Barr virus); identical to SEQ ID NO: 544461

SEQ ID NO: 546430 - RNA, 64 nt, Human Herpes Virus 4 (Epstein Barr virus); identical to SEQ ID NO: 544462

SEQ ID NO: 546431 - RNA, 64 nt, Human Herpes Virus 4 (Epstein Barr virus); identical to SEQ ID NO: 544463

SEQ ID NO: 546432 - RNA, 64 nt, Human Herpes Virus 1; identical to SEQ ID NO: 540130

SEQ ID NO: 546433 - RNA, 64 nt, Human Herpes Virus 1; identical to SEQ ID NO: 540068

SEQ ID NO: 546434 - RNA, 64 nt, Human Herpes Virus 1; identical to SEQ ID NO: 540125

SEQ ID NO: 546435 - RNA, 64 nt, Human Herpes Virus 1; identical to SEQ ID NO: 540126

SEQ ID NO: 546436 - RNA, 64 nt, Human Herpes Virus 1; identical to SEQ ID NO: 540127

SEQ ID NO: 546437 - RNA, 64 nt, Human Herpes Virus 1; identical to SEQ ID NO: 540124

SEQ ID NO: 546438 - RNA, 64 nt, Human Herpes Virus 1; identical to SEQ ID NO: 540069

SEQ ID NO: 546439 - RNA, 64 nt, Human Herpes Virus 1; identical to SEQ ID NO: 540128

SEQ ID NO: 546440 - RNA, 64 nt, Human Herpes Virus 1; identical to SEQ ID NO: 540129

SEQ ID NO: 546441 - RNA, 51 nt, Human Herpes Virus 1
acgcucccaucgcgggcgccauggcgggacugggcaagcccuacaccggcc

SEQ ID NO: 546442 - RNA, 64 nt, Human Herpes Virus 1
ggguuucuucucgguguuuguguuguaucgugcuuggcgggaacgcccaaaacguccuggagac

SEQ ID NO: 546443 - RNA, 64 nt, Human Herpes Virus 1
cugcgcgagauugaguugguguuuaccggggugcuggcgggaguauggggcgagggggggaagu

SEQ ID NO: 546444 - RNA, 64 nt, Human Herpes Virus 1
aacgcggcagccguguaccugcggaacgcggucguggcgggaaaccgccuggggccggcccagc

SEQ ID NO: 546445 - RNA, 64 nt, Human Herpes Virus 1
caauacggugcgguaucugcagggcggcgggucguggcgggaggauuggggacagcuuucgggg

SEQ ID NO: 546446 - RNA, 64 nt, Human Herpes Virus 1
guccguaucaccaacgggucaggcuggauacguauggcgggaccguccauauggagcuguguuu

SEQ ID NO: 546447 - RNA, 64 nt, Human Herpes Virus 4 (Epstein Barr virus)
ccggugucaguccccccugcagccgcccagucucugccuccaggcaagggcgccagcuuuucuc

SEQ ID NO: 546448 - RNA, 64 nt, Human Herpes Virus 4 (Epstein Barr virus); identical to SEQ ID NO: 546447

SEQ ID NO: 546449 - RNA, 64 nt, Human Herpes Virus 4 (Epstein Barr virus)
ccauagacucccauguaagccugccucgaguaggugccuccagagccccuuuugccccccuggc

SEQ ID NO: 546450 - RNA, 64 nt, Human Herpes Virus 4 (Epstein Barr virus); identical to SEQ ID NO: 546447

SEQ ID NO: 546451 - RNA, 64 nt, Human Herpes Virus 4 (Epstein Barr virus); identical to SEQ ID NO: 546449

SEQ ID NO: 546452 - RNA, 64 nt, Human Herpes Virus 4 (Epstein Barr virus); identical to SEQ ID NO: 546447

SEQ ID NO: 546453 - RNA, 64 nt, Human Herpes Virus 4 (Epstein Barr virus); identical to SEQ ID NO: 546447

SEQ ID NO: 546454 - RNA, 64 nt, Human Herpes Virus 4 (Epstein Barr virus); identical to SEQ ID NO: 546447

SEQ ID NO: 546455 - RNA, 64 nt, Human Herpes Virus 4 (Epstein Barr virus); identical to SEQ ID NO: 546447

SEQ ID NO: 546456 - RNA, 64 nt, Human Herpes Virus 4 (Epstein Barr virus); identical to SEQ ID NO: 546447

SEQ ID NO: 546457 - RNA, 64 nt, Human Herpes Virus 4 (Epstein Barr virus)
augcggacacauucucgccuucuuugaccagcuuugccuccaucugggcacuucugacgcuugu

SEQ ID NO: 546458 - RNA, 64 nt, Human Herpes Virus 4 (Epstein Barr virus)
cuuuuagacacggaagacaaugugccgccaugguugccuccacacgacaucacaccauauaccg

SEQ ID NO: 546459 - RNA, 64 nt, Human Herpes Virus 4 (Epstein Barr virus)
ggaagguaaucgcggaugucugccgcaguggcuaugccuccaugcccuccaugacggccacgca

SEQ ID NO: 546460 - RNA, 64 nt, Human Herpes Virus 4 (Epstein Barr virus)
gaauuuggacgcagcuacuugaccuuugcccccgugccuccagcgcugauaagugcugcgucca

SEQ ID NO: 546461 - RNA, 64 nt, Human Herpes Virus 4 (Epstein Barr virus)
aacggcgggggcuggcaagagcaccagcguuagcugccuccaccacacgauggacugccugguc

SEQ ID NO: 546462 - RNA, 64 nt, Human Herpes Virus 4 (Epstein Barr virus)
ccucccuggagcuguacucacgggacgaacagcgugccuccaacgucuuugaccuggagggcau

SEQ ID NO: 546463 - RNA, 64 nt, Human Herpes Virus 4 (Epstein Barr virus)
uggcggacagcguccuagaaacccuggcgaccauugccuccagcgggauagaguggacggcgga

SEQ ID NO: 546464 - RNA, 64 nt, Human Herpes Virus 4 (Epstein Barr virus)
ggauguugaccuaccaaagaacuccaucauuaugcugggccaggaugacuucauuaaguucaaa

SEQ ID NO: 546465 - RNA, 64 nt, Human Herpes Virus 4 (Epstein Barr virus)
ugucggagguggagaggcccgggggccuuguccgcugggccaggucacagaccagccccucauc

SEQ ID NO: 546466 - RNA, 64 nt, Human Herpes Virus 4 (Epstein Barr virus)
ucucuguggggcgauggccuccggggggcuguaccugggccauuccagcaucauugcauguguc

SEQ ID NO: 546467 - RNA, 64 nt, Human Herpes Virus 4 (Epstein Barr virus)
gaacucucugcggccagugaggaugauccucaaucugggccaguggaagagaauuuagaugccg

SEQ ID NO: 546468 - RNA, 64 nt, Human Herpes Virus 4 (Epstein Barr virus)
aucccugagaacgcuccagguagaguuuccagcccugggccaaaagacccuccccaccuccacc

SEQ ID NO: 546469 - RNA, 64 nt, Human Herpes Virus 4 (Epstein Barr virus)
cuggcggaggccgcccgaacgaggcgaaugaggccugggccagagguagaugaggaggacgucc

SEQ ID NO: 546470 - RNA, 64 nt, Human Herpes Virus 4 (Epstein Barr virus)
caacugcagacggagacacgaugaaguugaauuccugggccacuacaucaagaauuacaacccu

SEQ ID NO: 546471 - RNA, 64 nt, Human Herpes Virus 4 (Epstein Barr virus)
ugcugcuacuacugccuuacacuggaaagugaggagcgcccaccgaccccauaucgcaacacug

SEQ ID NO: 546472 - RNA, 64 nt, Human Herpes Virus 4 (Epstein Barr virus)
agugggcacccgccaccaugcagacaccaccgagagcgcccacucccaugucaccaccugaggu

SEQ ID NO: 546473 - RNA, 64 nt, Human Herpes Virus 4 (Epstein Barr virus)
auggcaagcgccgacaccugcccccgggagcaagagcgcccagagccccaagggcccccagggu

SEQ ID NO: 546474 - RNA, 64 nt, Human Herpes Virus 4 (Epstein Barr virus)
cacggggggcgucuaccacuuuguaaagaagcacgugcacgaguccuucuuggcuagucuguug

SEQ ID NO: 546475 - RNA, 63 nt, Human Herpes Virus 4 (Epstein Barr virus)
ugcugaagaugauggacccaaacucgacuucugaagauguaaaauuuacaccugacccauacc

SEQ ID NO: 546476 - RNA, 63 nt, Human Herpes Virus 4 (Epstein Barr virus)
ggcaaccacgcgguggccguggaaagccugcaaaagauguacaaugacacucaguccccauac

SEQ ID NO: 546477 - RNA, 63 nt, Human Herpes Virus 4 (Epstein Barr virus)
cccuucagugucuggcggccgcugcgcccuguaaagauguaaagaucuaccccagcugcaucu

SEQ ID NO: 546478 - RNA, 64 nt, Human Herpes Virus 1
ccucuucggccagcgccuuguagaagcgcguauggcuucguaccccugccaucaacacgcgucu

SEQ ID NO: 546479 - RNA, 64 nt, Human Herpes Virus 4 (Epstein Barr virus)
agaauggcaguuugguggacaagguuggucgagccggauggagcccucucagccugaaaugggc

SEQ ID NO: 546480 - RNA, 64 nt, Human Herpes Virus 4 (Epstein Barr virus)
gauggaguguaaggccagcgcggcucugucggugccgcgggaggaacagaaugagcggaguccc

SEQ ID NO: 546481 - RNA, 64 nt, Human Herpes Virus 4 (Epstein Barr virus)
ggccgacacuuaucuggcccggugggacgccuucccgcgggaggggcugucauucuacgcuuuu

SEQ ID NO: 546482 - RNA, 64 nt, Human Herpes Virus 4 (Epstein Barr virus)
ccagcaguccaucgcccccagccccauccgcggcccgcgggagcacccccgccgccguucugag

SEQ ID NO: 546483 - RNA, 64 nt, Human Herpes Virus 2
ccgaggcgggcggcgaggucgccgccggggccggggucgauacggccccggcggcgccgacucc

SEQ ID NO: 546484 - RNA, 64 nt, Human Herpes Virus 4 (Epstein Barr virus); identical to SEQ ID NO: 546297

SEQ ID NO: 546485 - RNA, 62 nt, Human Herpes Virus 1
gguaccgcggaaccguuauggccguggucguagcgccuaaaaggacgcgggaauuugccccc

SEQ ID NO: 546486 - RNA, 64 nt, Human Herpes Virus 1
ucgacagcacgcuacaacccacgccccagugcacccgcggcaacgacaaccugcgguccauggg

SEQ ID NO: 546487 - RNA, 64 nt, Human Herpes Virus 2
uggccaagacgcucgaccagugguggccggcguuccggaacacagaccaggucgagguucuguu

SEQ ID NO: 546488 - RNA, 64 nt, Human Herpes Virus 4 (Epstein Barr virus); identical to SEQ ID NO: 540834

SEQ ID NO: 546489 - RNA, 64 nt, Human Herpes Virus 4 (Epstein Barr virus); identical to SEQ ID NO: 540835

SEQ ID NO: 546490 - RNA, 64 nt, Human Herpes Virus 2
ggccuacgugguccucguggaccagacggggaacguggcggaccugcugcgggccgcggccccc

SEQ ID NO: 546491 - RNA, 64 nt, Human Herpes Virus 2
gcagacguaccugacagacgucgcggcccuguucguggcggacguacagcacgcggcucugccc

SEQ ID NO: 546492 - RNA, 64 nt, Human Herpes Virus 2
acaggccaucgccggggaccgcagucuggucgagguggcggaggggaucagcaaccaggcgcug

SEQ ID NO: 546493 - RNA, 64 nt, Human Herpes Virus 2
ccgggccucggcgacgggccccacuuacauucgcguggcggacagcgagcuguacgcggacugg

SEQ ID NO: 546494 - RNA, 64 nt, Human Herpes Virus 2
cgauuccgccaacgcgcuguggcgcgcccccgccguggcggaggccugucccugcgucgccccg

SEQ ID NO: 546495 - RNA, 64 nt, Human Herpes Virus 2
ccucgccccuguccuuccucaccaggcgcgcucgguggcggagaggguauguaaaggcgacucg

SEQ ID NO: 546496 - RNA, 64 nt, Human Herpes Virus 2; identical to SEQ ID NO: 546490

SEQ ID NO: 546497 - RNA, 62 nt, Human Herpes Virus 2
ggcgugguguggcgcgcggcgggguggcgggccugcgcgugaucgucuauugacgacggccg

SEQ ID NO: 546498 - RNA, 64 nt, Human Herpes Virus 2
guuuaccgugccggccgccgccgccgccgagucggcgcgugaccuggugcggggcgccgcggcc

SEQ ID NO: 546499 - RNA, 64 nt, Human Herpes Virus 2
gggccggcucagcgccauacguacuacagcgagugcgacgaauuucgauuuaucgccccgcguu

SEQ ID NO: 546500 - RNA, 64 nt, Human Herpes Virus 2
ccgaaccacacccacgcccccccaaccccgcaaggcgacgaaaaguaaggccuccaccgccaaa

SEQ ID NO: 546501 - RNA, 64 nt, Human Herpes Virus 2
cgccugggacccucgagcguauacacccccggagccucccgacccaccccuccacggacaacga

SEQ ID NO: 546502 - RNA, 64 nt, Human Herpes Virus 2
cgcuguggaccugcauguuuccgcuuccgcgcguccucccgaccagcuucgacgcccuccuggc

SEQ ID NO: 546503 - RNA, 64 nt, Human Herpes Virus 2
gcugcggcccgcgguccagcugccucccccccagccucccgaggugggcagcagccugcugcug

SEQ ID NO: 546504 - RNA, 64 nt, Human Herpes Virus 1
aacgcgcuuggcccuuuauaaagagauacgccaggcgcuggacagucgcaagcaggccgccagc

SEQ ID NO: 546505 - RNA, 64 nt, Human Herpes Virus 1
acacaccacgggcagggagacgaacaaccccccggcgcuggacgcacgcggaaggaggccaggg

SEQ ID NO: 546506 - RNA, 64 nt, Human Herpes Virus 1
ggagcugugguggguguuuuaugccgcagaccgggcgcuggaggagccccgcgccgacucuggc

SEQ ID NO: 546507 - RNA, 64 nt, Human Herpes Virus 1
acggaacgugcacgagaucgcaggcgcccuggaggcgcuggagacggcggcggccgccgccgaa

SEQ ID NO: 546508 - RNA, 64 nt, Human Herpes Virus 1
gcgccguauugcggccgacguccgcgagaccagugcgcuggagaaguucauaacccacgaucgc

SEQ ID NO: 546509 - RNA, 64 nt, Human Herpes Virus 1
ugugagcuucuuugaaaggaaggcgucccgcaacgcgcuggaacacuuugggcgacgcgagacc

SEQ ID NO: 546510 - RNA, 64 nt, Human Herpes Virus 1
gcuccagaacccgcgcgugguccccggggacguggcgcuggaccaggccugcuuccggaucucg

SEQ ID NO: 546511 - RNA, 64 nt, Human Herpes Virus 1
guccccgcgcgaguaccgccgggccgugcugccggcgcuggacggccgggcggcggccucgggg

SEQ ID NO: 546512 - RNA, 64 nt, Human Herpes Virus 1
ccuagggucccugacgcgggccgacaacggcuccgcgcuggacgcccuccgccgcgugggcggc

SEQ ID NO: 546513 - RNA, 64 nt, Human Herpes Virus 1
gcauuucgaucgcgcguucgggagccaccuggcggcgcuggauaugguggacgcccuaauaauc

SEQ ID NO: 546514 - RNA, 64 nt, Human Herpes Virus 1
ccaccucaucacccccucgcgcggcgccaccgccgcgcuggagcgcguucgggaguuuauggug

SEQ ID NO: 546515 - RNA, 64 nt, Human Herpes Virus 1
cgggcccuuuuccgcggcggccaucgacaccuucgcgcuggaccggcccugucuggucugccgc

SEQ ID NO: 546516 - RNA, 64 nt, Human Herpes Virus 1
uccaggggguccugcgccccuggcgugcguggcggcgcuggagcgccuguccggccguccuggc

SEQ ID NO: 546517 - RNA, 64 nt, Human Herpes Virus 1
ugacggcagagcucgccccccgaucggaagcguggcgcuggacccgcgcgcgcucccuggaggc

SEQ ID NO: 546518 - RNA, 64 nt, Human Herpes Virus 1
cauccucgcggucaccggcuccgacacgucccaugcgcuggauuccgccggccugcgcaccgcg

SEQ ID NO: 546519 - RNA, 64 nt, Human Herpes Virus 1; identical to SEQ ID NO: 546511

SEQ ID NO: 546520 - RNA, 64 nt, Human Herpes Virus 1; identical to SEQ ID NO: 546510

SEQ ID NO: 546521 - RNA, 64 nt, Human Herpes Virus 1
ccuggcgcacgcggcggccgccguggccaugagccgccgauacgaccgcgcgcagaagggcuuc

SEQ ID NO: 546522 - RNA, 64 nt, Human Herpes Virus 1
gaacgucauguacacguugguggucaaauaucagcgccgauaccccaguuacgaccgcgaggcc

SEQ ID NO: 546523 - RNA, 64 nt, Human Herpes Virus 1; identical to SEQ ID NO: 546521

SEQ ID NO: 546524 - RNA, 64 nt, Human Herpes Virus 2
gcucgggcccgagcccgagcccgggcccacgaagacggcggacccgcggaggaggaggaggcgg

SEQ ID NO: 546525 - RNA, 64 nt, Human Herpes Virus 2
guucggaaccucgagcgacgucgaguuuaacugcacggcggacaaccuggccgucgagggggcc

SEQ ID NO: 546526 - RNA, 64 nt, Human Herpes Virus 2
ggccgcgggguucgggccggcgggggccggcgcuacggcggaggaaacucgucgaauguugcau

SEQ ID NO: 546527 - RNA, 64 nt, Human Herpes Virus 2
uaaccggccccacggcgccccggggggcgcgaucacggcggagcagaccaacgugauucugcac

SEQ ID NO: 546528 - RNA, 64 nt, Human Herpes Virus 2
cuggccaagaugcuguuuuaccuggagcgcugcgacggcggagucaucgucgggcgccaggaga

SEQ ID NO: 546529 - RNA, 64 nt, Human Herpes Virus 2
cggcgcgcgaugccgcccugaggcggccaagaugacggcggagccagcucaccaucaacgcccu

SEQ ID NO: 546530 - RNA, 64 nt, Human Herpes Virus 2
cguguuguaccauugggccucguggaugcuguggacggcggacaaguacgugugucgccgccug

SEQ ID NO: 546531 - RNA, 64 nt, Human Herpes Virus 2; identical to SEQ ID NO: 546524

SEQ ID NO: 546532 - RNA, 64 nt, Human Herpes Virus 2
gcccgcggacgcgccgcgcgggaagguacgccuccccuccgacccccugacgccccuccgaccc

SEQ ID NO: 546533 - RNA, 64 nt, Human Herpes Virus 2
gggaagguacgccuccccuccgacccccugacgccccuccgacccccugacgccccuccgaccc

SEQ ID NO: 546534 - RNA, 64 nt, Human Herpes Virus 2
ccgacccccugacgccccuccgacccccugacgccccuccgacccccugacgccccuccgaccc

SEQ ID NO: 546535 - RNA, 64 nt, Human Herpes Virus 2; identical to SEQ ID NO: 546534

SEQ ID NO: 546536 - RNA, 64 nt, Human Herpes Virus 2; identical to SEQ ID NO: 546534

SEQ ID NO: 546537 - RNA, 64 nt, Human Herpes Virus 2; identical to SEQ ID NO: 546534

SEQ ID NO: 546538 - RNA, 64 nt, Human Herpes Virus 2
ccgacccccugacgccccuccgacccccugacgccccuccgacccccgugucuccccgcccgca

SEQ ID NO: 546539 - RNA, 64 nt, Human Herpes Virus 2
cuaccgcggcuucuucgccgcccucgcccagacgcccuccgaggagaucgccaucgugcgcucg

SEQ ID NO: 546540 - RNA, 64 nt, Human Herpes Virus 2
cgccuggccggccgaaagccacgccccccgcgcccccuccgaggacgcagauuccauuuacgag

SEQ ID NO: 546541 - RNA, 64 nt, Human Herpes Virus 2; identical to SEQ ID NO: 546538

SEQ ID NO: 546542 - RNA, 64 nt, Human Herpes Virus 2; identical to SEQ ID NO: 546534

SEQ ID NO: 546543 - RNA, 64 nt, Human Herpes Virus 2; identical to SEQ ID NO: 546534

SEQ ID NO: 546544 - RNA, 64 nt, Human Herpes Virus 2; identical to SEQ ID NO: 546534

SEQ ID NO: 546545 - RNA, 64 nt, Human Herpes Virus 2; identical to SEQ ID NO: 546534

SEQ ID NO: 546546 - RNA, 64 nt, Human Herpes Virus 2; identical to SEQ ID NO: 546533

SEQ ID NO: 546547 - RNA, 64 nt, Human Herpes Virus 2; identical to SEQ ID NO: 546532

SEQ ID NO: 546548 - RNA, 64 nt, Human Herpes Virus 2
cgacggcuccacagccagucgggccggucgccgccggccagagcuucccacccgcgguccagcc

SEQ ID NO: 546549 - RNA, 64 nt, Human Herpes Virus 2
ugaacggccgggguguguuccgcgugugggacaucggccagagccacuuucagaagcgcagcaa

SEQ ID NO: 546550 - RNA, 64 nt, Human Herpes Virus 2
gcgcucgcgaccgccgggggggcgguggcccugccggccagacggcgcgggggaucgcuggucu

SEQ ID NO: 546551 - RNA, 64 nt, Human Herpes Virus 2
uccauagaugccagcgccgauacaggcgcccccgcggccagauuuacaaccccgggggcguuuc

SEQ ID NO: 546552 - RNA, 64 nt, Human Herpes Virus 2
aggagggggacgucauagcccucauguacgaccacggccagagcgacccggcgcggcccuucgc

SEQ ID NO: 546553 - RNA, 64 nt, Human Herpes Virus 2
agggggcggcuaucugcgcccccagccuaacggccggccagacggcccccgccgagagcagcuu

SEQ ID NO: 546554 - RNA, 64 nt, Human Herpes Virus 2
cucggcuggagcgcggcguuuacgccagggccggcggccagacgcgacauguuucgggucgacg

SEQ ID NO: 546555 - RNA, 64 nt, Human Herpes Virus 2
ugcgcgagacggcgcucaucuggcucgacguguacggccagacccacugggaccugacccccac

SEQ ID NO: 546556 - RNA, 64 nt, Human Herpes Virus 2
gagauccauaaaagggaacgggaggaccgagaggcggccagaacugcggugaccgacccggagc

SEQ ID NO: 546557 - RNA, 64 nt, Human Herpes Virus 2; identical to SEQ ID NO: 546532

SEQ ID NO: 546558 - RNA, 64 nt, Human Herpes Virus 2; identical to SEQ ID NO: 546533

SEQ ID NO: 546559 - RNA, 64 nt, Human Herpes Virus 2; identical to SEQ ID NO: 546534

SEQ ID NO: 546560 - RNA, 64 nt, Human Herpes Virus 2; identical to SEQ ID NO: 546534

SEQ ID NO: 546561 - RNA, 64 nt, Human Herpes Virus 2; identical to SEQ ID NO: 546534

SEQ ID NO: 546562 - RNA, 64 nt, Human Herpes Virus 2; identical to SEQ ID NO: 546534

SEQ ID NO: 546563 - RNA, 64 nt, Human Herpes Virus 2; identical to SEQ ID NO: 546538

SEQ ID NO: 546564 - RNA, 64 nt, Human Herpes Virus 2; identical to SEQ ID NO: 546539

SEQ ID NO: 546565 - RNA, 64 nt, Human Herpes Virus 2; identical to SEQ ID NO: 546540

SEQ ID NO: 546566 - RNA, 64 nt, Human Herpes Virus 2; identical to SEQ ID NO: 546538

SEQ ID NO: 546567 - RNA, 64 nt, Human Herpes Virus 2; identical to SEQ ID NO: 546534

SEQ ID NO: 546568 - RNA, 64 nt, Human Herpes Virus 2; identical to SEQ ID NO: 546534

SEQ ID NO: 546569 - RNA, 64 nt, Human Herpes Virus 2; identical to SEQ ID NO: 546534

SEQ ID NO: 546570 - RNA, 64 nt, Human Herpes Virus 2; identical to SEQ ID NO: 546534

SEQ ID NO: 546571 - RNA, 64 nt, Human Herpes Virus 2; identical to SEQ ID NO: 546533

SEQ ID NO: 546572 - RNA, 64 nt, Human Herpes Virus 2; identical to SEQ ID NO: 546532

SEQ ID NO: 546573 - RNA, 64 nt, Human Herpes Virus 2; identical to SEQ ID NO: 546548

SEQ ID NO: 546574 - RNA, 64 nt, Human Herpes Virus 2; identical to SEQ ID NO: 546549

SEQ ID NO: 546575 - RNA, 64 nt, Human Herpes Virus 2; identical to SEQ ID NO: 546550

SEQ ID NO: 546576 - RNA, 64 nt, Human Herpes Virus 2; identical to SEQ ID NO: 546551

SEQ ID NO: 546577 - RNA, 64 nt, Human Herpes Virus 2; identical to SEQ ID NO: 546552

SEQ ID NO: 546578 - RNA, 64 nt, Human Herpes Virus 2; identical to SEQ ID NO: 546553

SEQ ID NO: 546579 - RNA, 64 nt, Human Herpes Virus 2; identical to SEQ ID NO: 546554

SEQ ID NO: 546580 - RNA, 64 nt, Human Herpes Virus 2; identical to SEQ ID NO: 546555

SEQ ID NO: 546581 - RNA, 64 nt, Human Herpes Virus 2; identical to SEQ ID NO: 546556

SEQ ID NO: 546582 - RNA, 64 nt, Human Herpes Virus 2
agggggggagacgaggggucggaauccaaaggacgcagaccaccuuugguuacggaccccuuuc

SEQ ID NO: 546583 - RNA, 64 nt, Human Herpes Virus 2
cccacggcgccccggggggcgcgaucacggcggagcagaccaacgugauucugcacuccaccga

SEQ ID NO: 546584 - RNA, 64 nt, Human Herpes Virus 2
ccccccggcgcgggcggcgccgcgcccgcgugccgcagaccaccucgcggcggcucccccgcgg

SEQ ID NO: 546585 - RNA, 64 nt, Human Herpes Virus 2
cgacgacgacgccgcccgcgcccccgccagcgccgcagaccacgccgcgggcgggacccucggc

SEQ ID NO: 546586 - RNA, 64 nt, Human Herpes Virus 2; identical to SEQ ID NO: 546582

SEQ ID NO: 546587 - RNA, 64 nt, Human Herpes Virus 2; identical to SEQ ID NO: 546585

SEQ ID NO: 546588 - RNA, 64 nt, Human Herpes Virus 1; identical to SEQ ID NO: 539527

SEQ ID NO: 546589 - RNA, 64 nt, Human Herpes Virus 1; identical to SEQ ID NO: 539528

SEQ ID NO: 546590 - RNA, 64 nt, Human Herpes Virus 1; identical to SEQ ID NO: 539529

SEQ ID NO: 546591 - RNA, 64 nt, Human Herpes Virus 1; identical to SEQ ID NO: 539530

SEQ ID NO: 546592 - RNA, 64 nt, Human Herpes Virus 1; identical to SEQ ID NO: 539531

SEQ ID NO: 546593 - RNA, 64 nt, Human Herpes Virus 1; identical to SEQ ID NO: 539532

SEQ ID NO: 546594 - RNA, 64 nt, Human Herpes Virus 1; identical to SEQ ID NO: 539533

SEQ ID NO: 546595 - RNA, 64 nt, Human Herpes Virus 1; identical to SEQ ID NO: 539534

SEQ ID NO: 546596 - RNA, 64 nt, Human Herpes Virus 1; identical to SEQ ID NO: 539535

SEQ ID NO: 546597 - RNA, 64 nt, Human Herpes Virus 1; identical to SEQ ID NO: 539527

SEQ ID NO: 546598 - RNA, 64 nt, Human Herpes Virus 1; identical to SEQ ID NO: 539529

SEQ ID NO: 546599 - RNA, 64 nt, Human Herpes Virus 1
cccugcugcugucugcacugggguugucggugugggcguguaugaccuguuggcgcaggcgugc

SEQ ID NO: 546600 - RNA, 64 nt, Human Herpes Virus 1
ccaccaugacgacgacuccgccuccgaggcggacagcacggacacggaacuguucgagacgggg

SEQ ID NO: 546601 - RNA, 64 nt, Human Herpes Virus 1
guguguaacucgguguacggguucacgggagugcagcacggacuccugccgugccugcacguug

SEQ ID NO: 546602 - RNA, 64 nt, Human Herpes Virus 1
ggccgugacgacccacgaccccaaccccgcggccagcacggagcagcccucgccccugggcagg

SEQ ID NO: 546603 - RNA, 64 nt, Human Herpes Virus 1
cggguucacccgaaaacaacgaucgagcggcagcagcacggacccgucaccuuccccaacgcga

SEQ ID NO: 546604 - RNA, 64 nt, Human Herpes Virus 1; identical to SEQ ID NO: 546600

SEQ ID NO: 546605 - RNA, 64 nt, Human Herpes Virus 1; identical to SEQ ID NO: 546599

SEQ ID NO: 546606 - RNA, 64 nt, Human Herpes Virus 1; identical to SEQ ID NO: 546600

SEQ ID NO: 546607 - RNA, 64 nt, Human Herpes Virus 1; identical to SEQ ID NO: 546601

SEQ ID NO: 546608 - RNA, 64 nt, Human Herpes Virus 1; identical to SEQ ID NO: 546602

SEQ ID NO: 546609 - RNA, 64 nt, Human Herpes Virus 1; identical to SEQ ID NO: 546603

SEQ ID NO: 546610 - RNA, 64 nt, Human Herpes Virus 1; identical to SEQ ID NO: 546600

SEQ ID NO: 546611 - RNA, 64 nt, Human Herpes Virus 2
cuucuaaaaagacugcccaucuaucaggaccuccgcgacgaagauuuagcgcgcuccaucguga

SEQ ID NO: 546612 - RNA, 64 nt, Human Herpes Virus 4 (Epstein Barr virus)
aacgcuaacuuuuuaacgagguguaagcaucagguuaaucuaagacagucaccuauuuuccuga

SEQ ID NO: 546613 - RNA, 64 nt, Human Herpes Virus 2
gcccagggcccgcagacacgcgaucuggaugcgcgcgacgaaggccaccucggccgcgauguca

SEQ ID NO: 546614 - RNA, 64 nt, Human Herpes Virus 2; identical to SEQ ID NO: 541175

SEQ ID NO: 546615 - RNA, 64 nt, Human Herpes Virus 2; identical to SEQ ID NO: 541176

SEQ ID NO: 546616 - RNA, 64 nt, Human Herpes Virus 2; identical to SEQ ID NO: 541177

SEQ ID NO: 546617 - RNA, 64 nt, Human Herpes Virus 2; identical to SEQ ID NO: 541178

SEQ ID NO: 546618 - RNA, 64 nt, Human Herpes Virus 2; identical to SEQ ID NO: 541179

SEQ ID NO: 546619 - RNA, 64 nt, Human Herpes Virus 2; identical to SEQ ID NO: 541180

SEQ ID NO: 546620 - RNA, 64 nt, Human Herpes Virus 2; identical to SEQ ID NO: 541181

SEQ ID NO: 546621 - RNA, 64 nt, Human Herpes Virus 2; identical to SEQ ID NO: 541182

SEQ ID NO: 546622 - RNA, 64 nt, Human Herpes Virus 2; identical to SEQ ID NO: 541183

SEQ ID NO: 546623 - RNA, 64 nt, Human Herpes Virus 2; identical to SEQ ID NO: 541184

SEQ ID NO: 546624 - RNA, 64 nt, Human Herpes Virus 2; identical to SEQ ID NO: 541180

SEQ ID NO: 546625 - RNA, 64 nt, Human Herpes Virus 1
gacgagaucugacguacuacugggaggugauuuuggaccucacgaagcgcgcccuggccgccuc

SEQ ID NO: 546626 - RNA, 64 nt, Human Herpes Virus 1
cgaucgcccgggggcaguuuugccuccaggagccggaccucaaguccccccggauguuuggcau

SEQ ID NO: 546627 - RNA, 64 nt, Human Herpes Virus 1
agggccaagcgacggacgugcgccuggauucgcuggaccucacguugcgguuucccguuccgcu

SEQ ID NO: 546628 - RNA, 64 nt, Human Herpes Virus 1
gccaccgccgggaggccgucgaggccuggcucguggaccucaccacggccacgcagcccuccgu

SEQ ID NO: 546629 - RNA, 59 nt, Human Herpes Virus 4 (Epstein Barr virus)
gccuuugagaggcucaucuacgcagugaacacggccagccuuucugccagucaggucac

SEQ ID NO: 546630 - RNA, 59 nt, Human Herpes Virus 4 (Epstein Barr virus)
auuguagaauuuaagacggccaugagcaacacggccaacccgcaaagcguuacucgcaa

SEQ ID NO: 546631 - RNA, 59 nt, Human Herpes Virus 4 (Epstein Barr virus)
gccgccaggugggcccuggccacggccgacacggccacccucagaaggcgccuccuggu

SEQ ID NO: 546632 - RNA, 59 nt, Human Herpes Virus 4 (Epstein Barr virus)
cuaauguuaauggagcuccaggacucugccacggccagcaggccaccugugagauuauc

SEQ ID NO: 546633 - RNA, 59 nt, Human Herpes Virus 4 (Epstein Barr virus)
aucgagugucugggggaggagggcuuccccacggccaccaacgaggcugaccugauccu

SEQ ID NO: 546634 - RNA, 59 nt, Human Herpes Virus 4 (Epstein Barr virus)
aggagccuggccaucgacaaggggguccucacggccaaggaggccaagguggugcaugg

SEQ ID NO: 546635 - RNA, 64 nt, Human Herpes Virus 1
uaucaccgcagucgugcggaugcuccagagccuguccacguauacgguccccauugagccuagg

SEQ ID NO: 546636 - RNA, 64 nt, Human Herpes Virus 2; identical to SEQ ID NO: 535901

SEQ ID NO: 546637 - RNA, 64 nt, Human Herpes Virus 2; identical to SEQ ID NO: 535902

SEQ ID NO: 546638 - RNA, 64 nt, Human Herpes Virus 2; identical to SEQ ID NO: 535903

SEQ ID NO: 546639 - RNA, 64 nt, Human Herpes Virus 2; identical to SEQ ID NO: 535904

SEQ ID NO: 546640 - RNA, 64 nt, Human Herpes Virus 2; identical to SEQ ID NO: 535905

SEQ ID NO: 546641 - RNA, 64 nt, Human Herpes Virus 2; identical to SEQ ID NO: 535906

SEQ ID NO: 546642 - RNA, 64 nt, Human Herpes Virus 2; identical to SEQ ID NO: 535907

SEQ ID NO: 546643 - RNA, 64 nt, Human Herpes Virus 2; identical to SEQ ID NO: 535908

SEQ ID NO: 546644 - RNA, 64 nt, Human Herpes Virus 2; identical to SEQ ID NO: 535909

SEQ ID NO: 546645 - RNA, 64 nt, Human Herpes Virus 2; identical to SEQ ID NO: 535910

SEQ ID NO: 546646 - RNA, 64 nt, Human Herpes Virus 2; identical to SEQ ID NO: 535911

SEQ ID NO: 546647 - RNA, 64 nt, Human Herpes Virus 2; identical to SEQ ID NO: 535912

SEQ ID NO: 546648 - RNA, 64 nt, Human Herpes Virus 2; identical to SEQ ID NO: 535913

SEQ ID NO: 546649 - RNA, 64 nt, Human Herpes Virus 2; identical to SEQ ID NO: 535914

SEQ ID NO: 546650 - RNA, 64 nt, Human Herpes Virus 2; identical to SEQ ID NO: 535915

SEQ ID NO: 546651 - RNA, 64 nt, Human Herpes Virus 2; identical to SEQ ID NO: 535916

SEQ ID NO: 546652 - RNA, 64 nt, Human Herpes Virus 2; identical to SEQ ID NO: 535917

SEQ ID NO: 546653 - RNA, 64 nt, Human Herpes Virus 2; identical to SEQ ID NO: 535918

SEQ ID NO: 546654 - RNA, 64 nt, Human Herpes Virus 2; identical to SEQ ID NO: 535919

SEQ ID NO: 546655 - RNA, 64 nt, Human Herpes Virus 2; identical to SEQ ID NO: 535920

SEQ ID NO: 546656 - RNA, 64 nt, Human Herpes Virus 2; identical to SEQ ID NO: 535921

SEQ ID NO: 546657 - RNA, 64 nt, Human Herpes Virus 2; identical to SEQ ID NO: 535922

SEQ ID NO: 546658 - RNA, 64 nt, Human Herpes Virus 2; identical to SEQ ID NO: 535923

SEQ ID NO: 546659 - RNA, 64 nt, Human Herpes Virus 2; identical to SEQ ID NO: 535924

SEQ ID NO: 546660 - RNA, 64 nt, Human Herpes Virus 2
cggccgaguuccgggaccugaacacacacaucgccgaggugaugcugcucgcggccaugaagac

SEQ ID NO: 546661 - RNA, 64 nt, Human Herpes Virus 2
uccccgaggcggggcccacgucccguccccccgccgaggugacccagcucaagggacugucgca

SEQ ID NO: 546662 - RNA, 64 nt, Human Herpes Virus 1
gacgcggggcguuccagcgcggcacgcgggcgccgcgcagcaacaaaagccuccagauguuugu

SEQ ID NO: 546663 - RNA, 64 nt, Human Herpes Virus 1
gcuggggaggugccaccaggcccccgggcccaaggcgcagcacgcgcccggcuccggggggguc

SEQ ID NO: 546664 - RNA, 64 nt, Human Herpes Virus 1
ggcgauccaauacgaacaggggcuuggccugcuggcgcagcaggcacgcauuggcuugggcucc

SEQ ID NO: 546665 - RNA, 64 nt, Human Herpes Virus 1
aacgcggaggccggggcccuugucaacgccagcagcgcagcacacguggacguugacacggccc

SEQ ID NO: 546666 - RNA, 64 nt, Human Herpes Virus 1
gacgcgaauaaaccgggccgccggccggggcgccgcgcagcagcucgccgcccggauccgccag

SEQ ID NO: 546667 - RNA, 64 nt, Human Herpes Virus 1
gcgugugggacauaggccagagccacuuccagaagcgcagcaagauaaaggugaacggcauggu

SEQ ID NO: 546668 - RNA, 64 nt, Human Herpes Virus 1
gcguucgcggggcccgucccuucaaccacuuuaagcgcagcauguaucgcgccggccgcuuuca

SEQ ID NO: 546669 - RNA, 64 nt, Human Herpes Virus 1
ggcggccgugugggcgcccgagcugggcgacgccgcgcagcaguacgcccugaucacgcggcug

SEQ ID NO: 546670 - RNA, 64 nt, Human Herpes Virus 1
gacaugcggguccuggagaucuggacgagcuggcgcgcagcaucccgggcacgcuacucggccg

SEQ ID NO: 546671 - RNA, 64 nt, Human Herpes Virus 1; identical to SEQ ID NO: 546669

SEQ ID NO: 546672 - RNA, 62 nt, Human Herpes Virus 1
cgcucggcccccccugccaagcgcccggcgcgucgcccuaccaaaggcaaaacccccgucgg

SEQ ID NO: 546673 - RNA, 64 nt, Human Herpes Virus 1
gcgcuaccgcucccgcgcggccgggaacaaucgcccgccguacacccgaccggccuggacccgc

SEQ ID NO: 546674 - RNA, 63 nt, Human Herpes Virus 1
ucaaaggcucuaugcaacauucgacgaguuuccuccgccguagcgccggcacccaccgccccg

SEQ ID NO: 546675 - RNA, 61 nt, Human Herpes Virus 1
auacguguacgcucgcgcguguccguccgaaggcaucgagcuucuggcguuacugucggca

SEQ ID NO: 546676 - RNA, 64 nt, Human Herpes Virus 2; identical to SEQ ID NO: 540276

SEQ ID NO: 546677 - RNA, 64 nt, Human Herpes Virus 2; identical to SEQ ID NO: 540277

SEQ ID NO: 546678 - RNA, 64 nt, Human Herpes Virus 2; identical to SEQ ID NO: 540278

SEQ ID NO: 546679 - RNA, 64 nt, Human Herpes Virus 2; identical to SEQ ID NO: 540279

SEQ ID NO: 546680 - RNA, 64 nt, Human Herpes Virus 2; identical to SEQ ID NO: 540280

SEQ ID NO: 546681 - RNA, 64 nt, Human Herpes Virus 2; identical to SEQ ID NO: 540281

SEQ ID NO: 546682 - RNA, 64 nt, Human Herpes Virus 2; identical to SEQ ID NO: 540282

SEQ ID NO: 546683 - RNA, 64 nt, Human Herpes Virus 2; identical to SEQ ID NO: 540283

SEQ ID NO: 546684 - RNA, 64 nt, Human Herpes Virus 2; identical to SEQ ID NO: 540284

SEQ ID NO: 546685 - RNA, 64 nt, Human Herpes Virus 2; identical to SEQ ID NO: 540285

SEQ ID NO: 546686 - RNA, 64 nt, Human Herpes Virus 2; identical to SEQ ID NO: 540286

SEQ ID NO: 546687 - RNA, 64 nt, Human Herpes Virus 2; identical to SEQ ID NO: 540287

SEQ ID NO: 546688 - RNA, 64 nt, Human Herpes Virus 2; identical to SEQ ID NO: 540288

SEQ ID NO: 546689 - RNA, 64 nt, Human Herpes Virus 2; identical to SEQ ID NO: 540289

SEQ ID NO: 546690 - RNA, 64 nt, Human Herpes Virus 2; identical to SEQ ID NO: 540290

SEQ ID NO: 546691 - RNA, 64 nt, Human Herpes Virus 2; identical to SEQ ID NO: 540291

SEQ ID NO: 546692 - RNA, 64 nt, Human Herpes Virus 2; identical to SEQ ID NO: 540292

SEQ ID NO: 546693 - RNA, 64 nt, Human Herpes Virus 2; identical to SEQ ID NO: 540293

SEQ ID NO: 546694 - RNA, 64 nt, Human Herpes Virus 2; identical to SEQ ID NO: 540294

SEQ ID NO: 546695 - RNA, 64 nt, Human Herpes Virus 2; identical to SEQ ID NO: 540295

SEQ ID NO: 546696 - RNA, 64 nt, Human Herpes Virus 2; identical to SEQ ID NO: 540296

SEQ ID NO: 546697 - RNA, 64 nt, Human Herpes Virus 2; identical to SEQ ID NO: 540277

SEQ ID NO: 546698 - RNA, 64 nt, Human Herpes Virus 2; identical to SEQ ID NO: 540276

SEQ ID NO: 546699 - RNA, 64 nt, Human Herpes Virus 2; identical to SEQ ID NO: 544751

SEQ ID NO: 546700 - RNA, 62 nt, Human Herpes Virus 1; identical to SEQ ID NO: 546485

SEQ ID NO: 546701 - RNA, 62 nt, Human Herpes Virus 1
gccgagcagggcccgcgccccccucucuucuggcgccuaacggggcugcucgcgacgucggg

SEQ ID NO: 546702 - RNA, 62 nt, Human Herpes Virus 1; identical to SEQ ID NO: 546701

SEQ ID NO: 546703 - RNA, 64 nt, Human Herpes Virus 1
cuaaggcccccgcggccccggcggcggagaccacccgcggcaggaaaucggcccagccagaauc

SEQ ID NO: 546704 - RNA, 63 nt, Human Herpes Virus 1
ccgcgagcggcuucgcgcgggacuaucccgauggcgaaugagccgcucgucucaucgccgcgc

SEQ ID NO: 546705 - RNA, 61 nt, Human Herpes Virus 1
ccgcgagcggcuucgcgcgggacuaucccgauggcgaaugagccgcucgucucaucgccgc

SEQ ID NO: 546706 - RNA, 64 nt, Human Herpes Virus 1
ccaaaccgacguauuguacgccaagauacaacacccgcggcaccugcccgacgacgaucccauc

SEQ ID NO: 546707 - RNA, 64 nt, Human Herpes Virus 1
ccgcggcccugcgcgaguccccgggcgcgucguuccgcggcaucuccgcggaccacuucgaggc

SEQ ID NO: 546708 - RNA, 64 nt, Human Herpes Virus 1
gacguggugcgcgggcgcccccaggacccgggggccgcggcaucccccgcucccuucguugcgg

SEQ ID NO: 546709 - RNA, 64 nt, Human Herpes Virus 1
ucggcggaggagaucgcggacuggcagacuggcgccgcggcaaggacggagaaggcgcgcgagc

SEQ ID NO: 546710 - RNA, 64 nt, Human Herpes Virus 4 (Epstein Barr virus)
ucacgcccccuugggagguggcggcauaugcaaaggauagcacucccacucuacuacuggguau

SEQ ID NO: 546711 - RNA, 64 nt, Human Herpes Virus 4 (Epstein Barr virus)
uacuggguaucauaugcugacuguauaugcaugaggauagcauaugcuacccggauacagauua

SEQ ID NO: 546712 - RNA, 64 nt, Human Herpes Virus 4 (Epstein Barr virus)
augaggauagcauaugcuacccggauacagauuaggauagcauauacuacccagauauagauua

SEQ ID NO: 546713 - RNA, 64 nt, Human Herpes Virus 4 (Epstein Barr virus)
auuaggauagcauauacuacccagauauagauuaggauagcauaugcuacccagauauagauua

SEQ ID NO: 546714 - RNA, 64 nt, Human Herpes Virus 4 (Epstein Barr virus)
auuaggauagccuaugcuacccagauauaaauuaggauagcauauacuacccagauauagauua

SEQ ID NO: 546715 - RNA, 64 nt, Human Herpes Virus 4 (Epstein Barr virus); identical to SEQ ID NO: 546713

SEQ ID NO: 546716 - RNA, 64 nt, Human Herpes Virus 4 (Epstein Barr virus)
auuaggauagccuaugcuacccagauauagauuaggauagcauaugcuacccagauauagauua

SEQ ID NO: 546717 - RNA, 64 nt, Human Herpes Virus 4 (Epstein Barr virus)
auuaggauagcauaugcuacccagauauagauuaggauagcauaugcuauccagauauuugggu

SEQ ID NO: 546718 - RNA, 64 nt, Human Herpes Virus 4 (Epstein Barr virus)
auuuggguaguauaugcuacccagauauaaauuaggauagcauauacuacccuaaucucuauua

SEQ ID NO: 546719 - RNA, 64 nt, Human Herpes Virus 4 (Epstein Barr virus)
auuaggauagcauauacuacccuaaucucuauuaggauagcauaugcuacccggauacagauua

SEQ ID NO: 546720 - RNA, 64 nt, Human Herpes Virus 4 (Epstein Barr virus)
auuaggauagcauaugcuacccggauacagauuaggauagcauauacuacccagauauagauua

SEQ ID NO: 546721 - RNA, 64 nt, Human Herpes Virus 4 (Epstein Barr virus); identical to SEQ ID NO: 546713

SEQ ID NO: 546722 - RNA, 64 nt, Human Herpes Virus 4 (Epstein Barr virus); identical to SEQ ID NO: 546714

SEQ ID NO: 546723 - RNA, 64 nt, Human Herpes Virus 4 (Epstein Barr virus); identical to SEQ ID NO: 546713

SEQ ID NO: 546724 - RNA, 64 nt, Human Herpes Virus 4 (Epstein Barr virus)
auuaggauagccuaugcuacccagauauagauuaggauagcauaugcuauccagauauuugggu

SEQ ID NO: 546725 - RNA, 64 nt, Human Herpes Virus 4 (Epstein Barr virus)
cugccggacgugcaguucuaaugccaaaauguaaggauagcaugauggccgaccgauguacuca

SEQ ID NO: 546726 - RNA, 64 nt, Human Herpes Virus 4 (Epstein Barr virus)
uguccuuccaacgcggcggaaccugaacagccuuggauagcagcgguccaccaagagagcgaug

SEQ ID NO: 546727 - RNA, 64 nt, Human Herpes Virus 2
gcgggaugugucgcggggacagccccggggucgcgggcgggagcggcgaacacugccucggagg

SEQ ID NO: 546728 - RNA, 64 nt, Human Herpes Virus 2
cccgcgcccccgccagcgccgcagaccacgccgcgggcgggacccucggcgcggacgacgagga

SEQ ID NO: 546729 - RNA, 64 nt, Human Herpes Virus 2
uguuuacggggguucuggaaggcguguggggcgagggcgggagcuuuguguacccuuucgauga

SEQ ID NO: 546730 - RNA, 64 nt, Human Herpes Virus 2
aggccgugugcaucagcaacaccuuccugcaucugggcgggauggacaagguaaccaucgggga

SEQ ID NO: 546731 - RNA, 64 nt, Human Herpes Virus 2; identical to SEQ ID NO: 546728

SEQ ID NO: 546732 - RNA, 64 nt, Human Herpes Virus 4 (Epstein Barr virus)
cgacgaaagugaggaaauugaagcugaaagcgacgaggaggaagacaagaguggaauggaaucu

SEQ ID NO: 546733 - RNA, 64 nt, Human Herpes Virus 4 (Epstein Barr virus)
ccgacgccugcggacucaggccaccgucuacccagaggaggacaugugcauggccugggcccgc

SEQ ID NO: 546734 - RNA, 64 nt, Human Herpes Virus 4 (Epstein Barr virus)
ccggucuugcagggaccggcgccucuugucggacgaggaggaagagacuucacagagcagcagc

SEQ ID NO: 546735 - RNA, 64 nt, Human Herpes Virus 4 (Epstein Barr virus)
cacucuggggucucaggccucccagucuauccaggaggaggacgugagugacacugaugagucu

SEQ ID NO: 546736 - RNA, 64 nt, Human Herpes Virus 4 (Epstein Barr virus)
cgucuccuccguuuuaccgaugacgacggacagcgaggaggagaucuuccccuaaugcaauaaa

SEQ ID NO: 546737 - RNA, 64 nt, Human Herpes Virus 4 (Epstein Barr virus)
ucccucgcgauccaacaagcggaaaagagaccccgaggaggaugaagaaggcggggggcuauuc

SEQ ID NO: 546738 - RNA, 64 nt, Human Herpes Virus 4 (Epstein Barr virus)
gugguaccuggaggucauucuauugggauaacgagaggaggaggggcuagaggcccgcgagauu

SEQ ID NO: 546739 - RNA, 64 nt, Human Herpes Virus 4 (Epstein Barr virus)
caggcccugcaguccccggacaggaugaccaagagaggaggagaggaucuggaggcccccuacg

SEQ ID NO: 546740 - RNA, 64 nt, Human Herpes Virus 4 (Epstein Barr virus)
ggacuaucgcgagcuccucuuaccgccaaagaaggaggaggaggugagcgguauccccuggccc

SEQ ID NO: 546741 - RNA, 64 nt, Human Herpes Virus 4 (Epstein Barr virus)
agcagccccugccaucagcucccuggagcgaguugaggaggacgcagcucccaccaucagccac

SEQ ID NO: 546742 - RNA, 64 nt, Human Herpes Virus 4 (Epstein Barr virus)
uaauccccaucccucaccaaaggcugggguagaugaggaggacgcaccccgcgccagucucaac

SEQ ID NO: 546743 - RNA, 64 nt, Human Herpes Virus 4 (Epstein Barr virus)
auugggcaaagauagcccccggaggcgggggaaggaggaggagagccucccucuguccuccacc

SEQ ID NO: 546744 - RNA, 64 nt, Human Herpes Virus 4 (Epstein Barr virus)
ggaggggaggcagaucucaggggcgugccgggaggaggaggagaaggagcauacgaggaagaca

SEQ ID NO: 546745 - RNA, 64 nt, Human Herpes Virus 4 (Epstein Barr virus)
gagggaggggaggcagaucucaggggcgugccgggaggaggaggagaaggagcauacgaggaag

SEQ ID NO: 546746 - RNA, 64 nt, Human Herpes Virus 4 (Epstein Barr virus)
cgggagggugcagaucccucuggcgacggaagaggaggaggaggcggugguagcggugaaggaa

SEQ ID NO: 546747 - RNA, 64 nt, Human Herpes Virus 4 (Epstein Barr virus)
gaccgggagggugcagaucccucuggcgacggaagaggaggaggaggcggugguagcggugaag

SEQ ID NO: 546748 - RNA, 64 nt, Human Herpes Virus 4 (Epstein Barr virus)
acacuccacagauggagagauuucauccucagaggaggaggaugaagauccaacuccggcccac

SEQ ID NO: 546749 - RNA, 64 nt, Human Herpes Virus 4 (Epstein Barr virus)
agaacacuccacagauggagagauuucauccucagaggaggaggaugaagauccaacuccggcc

SEQ ID NO: 546750 - RNA, 64 nt, Human Herpes Virus 4 (Epstein Barr virus)
ccuggcugccuucagauaugccaccccccagauggaggaggacaagggucccaucaaccacccc

SEQ ID NO: 546751 - RNA, 64 nt, Human Herpes Virus 4 (Epstein Barr virus)
cuacuccuggcauacuuuuugccacccaggguaagaggaggagggcggguggcagccgcggcca

SEQ ID NO: 546752 - RNA, 64 nt, Human Herpes Virus 4 (Epstein Barr virus)
ugcaucugcgaaacuugcagagggccacaguccagaggaggaccugguuaaagaacccgcgcca

SEQ ID NO: 546753 - RNA, 64 nt, Human Herpes Virus 4 (Epstein Barr virus)
gcucaaccgagccaugcagcgguugggccgaggcgaggaggaggcgucccgggagagcccggag

SEQ ID NO: 546754 - RNA, 59 nt, Human Herpes Virus 4 (Epstein Barr virus)
gccagccggagggaccccggcagcccgggcggccccagaggccgguuccucgccccuuc

SEQ ID NO: 546755 - RNA, 59 nt, Human Herpes Virus 4 (Epstein Barr virus); identical to SEQ ID NO: 546754

SEQ ID NO: 546756 - RNA, 59 nt, Human Herpes Virus 4 (Epstein Barr virus); identical to SEQ ID NO: 546754

SEQ ID NO: 546757 - RNA, 59 nt, Human Herpes Virus 4 (Epstein Barr virus); identical to SEQ ID NO: 546754

SEQ ID NO: 546758 - RNA, 59 nt, Human Herpes Virus 4 (Epstein Barr virus); identical to SEQ ID NO: 546754

SEQ ID NO: 546759 - RNA, 59 nt, Human Herpes Virus 4 (Epstein Barr virus); identical to SEQ ID NO: 546754

SEQ ID NO: 546760 - RNA, 59 nt, Human Herpes Virus 4 (Epstein Barr virus); identical to SEQ ID NO: 546754

SEQ ID NO: 546761 - RNA, 59 nt, Human Herpes Virus 4 (Epstein Barr virus); identical to SEQ ID NO: 546754

SEQ ID NO: 546762 - RNA, 59 nt, Human Herpes Virus 4 (Epstein Barr virus)
uccucguccucgguuuucggcccugccuccggccccaucccgcgagccccagcagacau

SEQ ID NO: 546763 - RNA, 59 nt, Human Herpes Virus 4 (Epstein Barr virus)
uuggggaugaugcaucugggguguggccucggccccaggaccugucugaccuagaggag

SEQ ID NO: 546764 - RNA, 59 nt, Human Herpes Virus 4 (Epstein Barr virus)
ccagcagcugaaaauccgcauggagcccccggccccauacacgugggaccccgaccccg

SEQ ID NO: 546765 - RNA, 59 nt, Human Herpes Virus 4 (Epstein Barr virus)
ccacucccuuggaugugggcccucuucuacggccccaggucccacugcgaagagcguca

SEQ ID NO: 546766 - RNA, 59 nt, Human Herpes Virus 4 (Epstein Barr virus)
ggagaggguggaagucuuuuauaaggcuccggccccacgaccucgggagggacgggccu

SEQ ID NO: 546767 - RNA, 59 nt, Human Herpes Virus 4 (Epstein Barr virus)
uacaacugcgggcacaaaccgcugcacaucggccccagcaccagacuuggacuugcgcu

SEQ ID NO: 546768 - RNA, 64 nt, Human Herpes Virus 4 (Epstein Barr virus)
ggggccccuccgaugccuggggaguccccccaggcggucggacugcgcccccucaacuuagagg

SEQ ID NO: 546769 - RNA, 64 nt, Human Herpes Virus 4 (Epstein Barr virus)
uuggcucccacccccacaggaccuguccaugaaccggucggaucccuaacgccagccccggugc

SEQ ID NO: 546770 - RNA, 64 nt, Human Herpes Virus 4 (Epstein Barr virus); identical to SEQ ID NO: 546768

SEQ ID NO: 546771 - RNA, 64 nt, Human Herpes Virus 4 (Epstein Barr virus); identical to SEQ ID NO: 546769

SEQ ID NO: 546772 - RNA, 64 nt, Human Herpes Virus 2; identical to SEQ ID NO: 546727

SEQ ID NO: 546773 - RNA, 64 nt, Human Herpes Virus 2; identical to SEQ ID NO: 546728

SEQ ID NO: 546774 - RNA, 64 nt, Human Herpes Virus 2; identical to SEQ ID NO: 546729

SEQ ID NO: 546775 - RNA, 64 nt, Human Herpes Virus 2; identical to SEQ ID NO: 546730

SEQ ID NO: 546776 - RNA, 64 nt, Human Herpes Virus 2; identical to SEQ ID NO: 546728

SEQ ID NO: 546777 - RNA, 64 nt, Human Herpes Virus 4 (Epstein Barr virus); identical to SEQ ID NO: 537382

SEQ ID NO: 546778 - RNA, 64 nt, Human Herpes Virus 4 (Epstein Barr virus); identical to SEQ ID NO: 537383

SEQ ID NO: 546779 - RNA, 55 nt, Human Herpes Virus 4 (Epstein Barr virus); identical to SEQ ID NO: 537384

SEQ ID NO: 546780 - RNA, 64 nt, Human Herpes Virus 4 (Epstein Barr virus); identical to SEQ ID NO: 537385

SEQ ID NO: 546781 - RNA, 64 nt, Human Herpes Virus 1
gaggccagcaggggggcaggacuuugugaggcgggggggggagagggggaacucgugggugcug

SEQ ID NO: 546782 - RNA, 64 nt, Human Herpes Virus 1
uggggccgcagggcguggaugggggggcggucucgggggggagccccccccgcgaggaagaccc

SEQ ID NO: 546783 - RNA, 64 nt, Human Herpes Virus 1
gcggcaaggacccugggggaggaggaggaggagggggggggagggaggaauaggcgggcgggcg

SEQ ID NO: 546784 - RNA, 64 nt, Human Herpes Virus 1
ugaugcgcgugcugucggccgcguagcgcguguugggggggacgagcucgucguaacuaaacag

SEQ ID NO: 546785 - RNA, 64 nt, Human Herpes Virus 1
cggucaccucaagcgcgcccccaagguguacugcgggggggacgagcgcgacguccuccgcguc

SEQ ID NO: 546786 - RNA, 64 nt, Human Herpes Virus 1
caagcucaugugcuucgauaucgaaugcaaggcggggggggaggacgagcuggccuuuccggug

SEQ ID NO: 546787 - RNA, 64 nt, Human Herpes Virus 1
ucugccggacacccaggggcgauuuaggggcgccgggggggaggcgcccaagcguccggccgca

SEQ ID NO: 546788 - RNA, 64 nt, Human Herpes Virus 1
cugucgcgacacacggcgccgcucugcgguauucgggggggagggggauccagucggccccgcg

SEQ ID NO: 546789 - RNA, 64 nt, Human Herpes Virus 1
agguccugggucgguacaacguacagccggaugcgggggggaccgucgagggguucgcaucgga

SEQ ID NO: 546790 - RNA, 64 nt, Human Herpes Virus 1
uguuuaccggggugcuggcgggaguauggggcgagggggggaaguuuguguaucccuuugacga

SEQ ID NO: 546791 - RNA, 64 nt, Human Herpes Virus 1
gucuuugccuuucuggggcccgaguuugagguccgggggggacccgucccguacuuugccgucc

SEQ ID NO: 546792 - RNA, 64 nt, Human Herpes Virus 1
cacgucgagcguaucgcuagcgcggauguuguacgggggggauuuggccgaaugggugccccgg

SEQ ID NO: 546793 - RNA, 64 nt, Human Herpes Virus 1
cuucuuuguggggguggccgacguggagcugccggggggggacguucccccggccggcccgggg

SEQ ID NO: 546794 - RNA, 64 nt, Human Herpes Virus 1
gguggaucgagaucuggucgacgaggccgccuucgggggggaggagggagaacugccgcuggag

SEQ ID NO: 546795 - RNA, 64 nt, Human Herpes Virus 1
ugccgugaccgacgccguucuggcuccucauaucgggggggaggcugggagcucacaugccccg

SEQ ID NO: 546796 - RNA, 64 nt, Human Herpes Virus 1
ccguacauugaggcggaaaauccccuguacgacugggggggauccgcccuauuuucccccccgg

SEQ ID NO: 546797 - RNA, 64 nt, Human Herpes Virus 1
ucuccgccuucgggguugccgggggaacccggucgggggggauuggggugaccgaggcgcccuc

SEQ ID NO: 546798 - RNA, 64 nt, Human Herpes Virus 1; identical to SEQ ID NO: 546783

SEQ ID NO: 546799 - RNA, 64 nt, Human Herpes Virus 1; identical to SEQ ID NO: 546782

SEQ ID NO: 546800 - RNA, 64 nt, Human Herpes Virus 1; identical to SEQ ID NO: 546781

SEQ ID NO: 546801 - RNA, 64 nt, Human Herpes Virus 2; identical to SEQ ID NO: 541181

SEQ ID NO: 546802 - RNA, 64 nt, Human Herpes Virus 4 (Epstein Barr virus)
gucccgcggccacugucagaucaugaauaucuuaagaauuuauuacucaccauccaucaugcac

SEQ ID NO: 546803 - RNA, 64 nt, Human Herpes Virus 4 (Epstein Barr virus)
agugaggaugauccucaaucugggccaguggaagagaauuuagaugccgcugcaagagaggaag

SEQ ID NO: 546804 - RNA, 64 nt, Human Herpes Virus 4 (Epstein Barr virus)
gcaguuuauuccuugagcaaaaccugaacaucgaagaauuuauauggaugugcaugaccgugcg

SEQ ID NO: 546805 - RNA, 64 nt, Human Herpes Virus 4 (Epstein Barr virus)
uagcucugcagccuuauccccgguguuauauuguagaauuuaagacggccaugagcaacacggc

SEQ ID NO: 546806 - RNA, 64 nt, Human Herpes Virus 4 (Epstein Barr virus)
ucucuuuccagcacagguggucugccaaagcugcucgggggaugaugggcgggaccaacaaccc

SEQ ID NO: 546807 - RNA, 64 nt, Human Herpes Virus 2
acgacaugcaguggcucgccagcagcgacucggaggaggagaccgaggugggaaucucugacga

SEQ ID NO: 546808 - RNA, 64 nt, Human Herpes Virus 2
ccgcgcggcccggguucggguggcacggugggccggaggagaacgaagacgaggccgacgacgc

SEQ ID NO: 546809 - RNA, 64 nt, Human Herpes Virus 2
gucguggcauggaagcccccggcaucguuuggguggaggagagcgucagcgccauuacccuaua

SEQ ID NO: 546810 - RNA, 64 nt, Human Herpes Virus 2
uggcgcaguuuuuccgcggugagcugcgggcgcgggaggagagcuaccggaccguguuggcaaa

SEQ ID NO: 546811 - RNA, 64 nt, Human Herpes Virus 2; identical to SEQ ID NO: 546807

SEQ ID NO: 546812 - RNA, 64 nt, Human Herpes Virus 2; identical to SEQ ID NO: 546808

SEQ ID NO: 546813 - RNA, 64 nt, Human Herpes Virus 2; identical to SEQ ID NO: 541175

SEQ ID NO: 546814 - RNA, 64 nt, Human Herpes Virus 2; identical to SEQ ID NO: 541176

SEQ ID NO: 546815 - RNA, 64 nt, Human Herpes Virus 2; identical to SEQ ID NO: 541177

SEQ ID NO: 546816 - RNA, 64 nt, Human Herpes Virus 2; identical to SEQ ID NO: 541178

SEQ ID NO: 546817 - RNA, 64 nt, Human Herpes Virus 2; identical to SEQ ID NO: 541179

SEQ ID NO: 546818 - RNA, 64 nt, Human Herpes Virus 2; identical to SEQ ID NO: 541180

SEQ ID NO: 546819 - RNA, 64 nt, Human Herpes Virus 2; identical to SEQ ID NO: 541182

SEQ ID NO: 546820 - RNA, 64 nt, Human Herpes Virus 2; identical to SEQ ID NO: 541183

SEQ ID NO: 546821 - RNA, 64 nt, Human Herpes Virus 2; identical to SEQ ID NO: 541184

SEQ ID NO: 546822 - RNA, 64 nt, Human Herpes Virus 2; identical to SEQ ID NO: 541180

SEQ ID NO: 546823 - RNA, 64 nt, Human Herpes Virus 2; identical to SEQ ID NO: 540542

SEQ ID NO: 546824 - RNA, 64 nt, Human Herpes Virus 2; identical to SEQ ID NO: 540543

SEQ ID NO: 546825 - RNA, 64 nt, Human Herpes Virus 2; identical to SEQ ID NO: 540544

SEQ ID NO: 546826 - RNA, 64 nt, Human Herpes Virus 2; identical to SEQ ID NO: 540545

SEQ ID NO: 546827 - RNA, 64 nt, Human Herpes Virus 2; identical to SEQ ID NO: 540546

SEQ ID NO: 546828 - RNA, 64 nt, Human Herpes Virus 2
uccccaggcgccacggaaagaccugguuuuuggugccccucaucgcgcugucgcucgcguccuu

SEQ ID NO: 546829 - RNA, 64 nt, Human Herpes Virus 2
ugaacgaagggcgugugcaguucgagguccaccagccccucaucgcccgcgacggcccgcaccc

SEQ ID NO: 546830 - RNA, 64 nt, Human Herpes Virus 2
cggcgcgcagcggcgacgcggacgucgccgucgcgccccucaucgucggccugaccguggagag

SEQ ID NO: 546831 - RNA, 64 nt, Human Herpes Virus 2
uccuacacgcuccugaccauguggccgcccaccggccccucaucccgggacggcgacacggccu

SEQ ID NO: 546832 - RNA, 64 nt, Human Herpes Virus 2
uggugcgaagugcggcggcggaggaacccggggcgccccucacgaccccgcccguccugcaggg

SEQ ID NO: 546833 - RNA, 64 nt, Human Herpes Virus 2
gaggggcgagguucgcuuucuccauuaugacgaggcuggguaugcccucuaccgggacucgucu

SEQ ID NO: 546834 - RNA, 64 nt, Human Herpes Virus 4 (Epstein Barr virus)
acaaaucuggcccccgacccgaaaggagauuaacccucgccacguuugcacgcgggaaggcggc

SEQ ID NO: 546835 - RNA, 64 nt, Human Herpes Virus 4 (Epstein Barr virus)
cccgcggggggaggggggcacggaugagcccaauccucgccaccugugcucguauaguaagcug

SEQ ID NO: 546836 - RNA, 59 nt, Human Herpes Virus 4 (Epstein Barr virus)
gaggacuuugugcccuggaccguggacaaucugaaaagccaguucgaggcagucggccu

SEQ ID NO: 546837 - RNA, 59 nt, Human Herpes Virus 4 (Epstein Barr virus)
uuuguccgcagguggcugcugccaaaucaucugaaaaugacaggcugcgccuccuguug

SEQ ID NO: 546838 - RNA, 59 nt, Human Herpes Virus 4 (Epstein Barr virus)
auuuuugacaccagcuuauuuuagacacuucugaaaacugccuccuccucuuuuagaaa

SEQ ID NO: 546839 - RNA, 59 nt, Human Herpes Virus 4 (Epstein Barr virus)
ugaccguggucaggaccgaugagauccucucugaaaacauauuguuuagcuccagggcc

SEQ ID NO: 546840 - RNA, 59 nt, Human Herpes Virus 4 (Epstein Barr virus)
aacccuuuccuaagaccuaauaaaggccuucugaaaaagccugacaaggaguaccugcg

SEQ ID NO: 546841 - RNA, 64 nt, Human Herpes Virus 2
agccggcggcucgggcggcgucuggguuuuuugccccccacaacccccggggagccacccagac

SEQ ID NO: 546842 - RNA, 64 nt, Human Herpes Virus 2
agaggugggcggggagggccccggccccaccgcccccccacaggcggcgcgugcggagggcggc

SEQ ID NO: 546843 - RNA, 64 nt, Human Herpes Virus 2
guuucguggccugcguuuccgggagcgcugucugcccccacagacgcccgccgcccccagcgac

SEQ ID NO: 546844 - RNA, 64 nt, Human Herpes Virus 2
gccgcgcucagauggcccccaagcgccuacgucucccccacauccgggaugacgacgcgccccc

SEQ ID NO: 546845 - RNA, 64 nt, Human Herpes Virus 2
ggagggcucgcgggacguccgggcaccagguccgcccccacagcagcccggggccagacccgcc

SEQ ID NO: 546846 - RNA, 64 nt, Human Herpes Virus 2
ggccaaucuguacgcacgcccuuuuccgaucacgcccccacaaucgcgcgcccacccgaacacc

SEQ ID NO: 546847 - RNA, 64 nt, Human Herpes Virus 2; identical to SEQ ID NO: 536841

SEQ ID NO: 546848 - RNA, 64 nt, Human Herpes Virus 2; identical to SEQ ID NO: 536842

SEQ ID NO: 546849 - RNA, 64 nt, Human Herpes Virus 2; identical to SEQ ID NO: 536843

SEQ ID NO: 546850 - RNA, 64 nt, Human Herpes Virus 2; identical to SEQ ID NO: 536844

SEQ ID NO: 546851 - RNA, 64 nt, Human Herpes Virus 2; identical to SEQ ID NO: 536845

SEQ ID NO: 546852 - RNA, 64 nt, Human Herpes Virus 2; identical to SEQ ID NO: 536846

SEQ ID NO: 546853 - RNA, 64 nt, Human Herpes Virus 2; identical to SEQ ID NO: 536847

SEQ ID NO: 546854 - RNA, 64 nt, Human Herpes Virus 2; identical to SEQ ID NO: 536848

SEQ ID NO: 546855 - RNA, 64 nt, Human Herpes Virus 2; identical to SEQ ID NO: 536849

SEQ ID NO: 546856 - RNA, 64 nt, Human Herpes Virus 2; identical to SEQ ID NO: 536850

SEQ ID NO: 546857 - RNA, 64 nt, Human Herpes Virus 2; identical to SEQ ID NO: 536851

SEQ ID NO: 546858 - RNA, 64 nt, Human Herpes Virus 2; identical to SEQ ID NO: 536852

SEQ ID NO: 546859 - RNA, 64 nt, Human Herpes Virus 2; identical to SEQ ID NO: 536853

SEQ ID NO: 546860 - RNA, 64 nt, Human Herpes Virus 2; identical to SEQ ID NO: 536854

SEQ ID NO: 546861 - RNA, 64 nt, Human Herpes Virus 2
ccccccagccucccgaggugggcagcagccugcugcugaucagcauguacgcccuggcggcccg

SEQ ID NO: 546862 - RNA, 64 nt, Human Herpes Virus 2
ccaccgucgaggggcaccgcacaaaauugggcgcgcugaucacccuccucgaaccggccacccg

SEQ ID NO: 546863 - RNA, 64 nt, Human Herpes Virus 2
ucucguacccccucgguccucguggggacucucgccgugcgacagcggcuggcaggaauucaac

SEQ ID NO: 546864 - RNA, 64 nt, Human Herpes Virus 2
cuuguucucggccccgcgcgaccccgaaaggcggccgugcgacaaccagaucgcgcgcaucauc

SEQ ID NO: 546865 - RNA, 64 nt, Human Herpes Virus 2
cccaagaccgggcccccgaagacauccucggagcccgugcgaugcaaccgccacgacccgcugg

SEQ ID NO: 546866 - RNA, 63 nt, Human Herpes Virus 2
gcagagcucugcguugcaguugcccgggcccgucccccgcacggacuguguggccuauaaccc

SEQ ID NO: 546867 - RNA, 63 nt, Human Herpes Virus 2
cccccggucccgcucccccgcuacaucagcccucccccgcacacgcccaccccccuccgccgc

SEQ ID NO: 546868 - RNA, 63 nt, Human Herpes Virus 2
gcccccccuccgcugauggcgcugucccugacccccccgcacgcggacggccgcgccccgguc

SEQ ID NO: 546869 - RNA, 63 nt, Human Herpes Virus 2
ugaugcgucagacggcugguugguugacacacccccccgcaaauccaagcgaccccgaaucaa

SEQ ID NO: 546870 - RNA, 63 nt, Human Herpes Virus 2
cacccucagucgacccaagcgcggaaccgaccgcccccgcaaccacuacuccccccgacgaga

SEQ ID NO: 546871 - RNA, 63 nt, Human Herpes Virus 2
cuggugcugcgcgacgacgcggacgcgggcccgcccccgcagauacgcugggcgucggccgcg

SEQ ID NO: 546872 - RNA, 63 nt, Human Herpes Virus 2
cagcguguuuguggcgaccgucaagagccugggcccccgcacccagcagcugcagaucgagga

SEQ ID NO: 546873 - RNA, 63 nt, Human Herpes Virus 2
cgcgaguuugggugucgcuggaccccgcugccccccccgcacggagcggcggcgccgcguccg

SEQ ID NO: 546874 - RNA, 61 nt, Human Herpes Virus 2; identical to SEQ ID NO: 542456

SEQ ID NO: 546875 - RNA, 63 nt, Human Herpes Virus 2
aggugcaggcgccaccgcgaggaccuccccgagcccccgcacgucgacgcggccgaccggggu

SEQ ID NO: 546876 - RNA, 63 nt, Human Herpes Virus 2
gccgcgcaugucguuucucuccgcgggacaacgcccccgcagacuguccaccaccgcccccau

SEQ ID NO: 546877 - RNA, 63 nt, Human Herpes Virus 2; identical to SEQ ID NO: 546871

SEQ ID NO: 546878 - RNA, 63 nt, Human Herpes Virus 2
acgcuugaagggcacucgcuuccgaccgacgggcccccgcaccggggcggcgaccaugauccg

SEQ ID NO: 546879 - RNA, 64 nt, Human Herpes Virus 1
acccucgcagcggcauacgcccccuccgcgucccgcacccgagaccccggcccggcugcccuca

SEQ ID NO: 546880 - RNA, 64 nt, Human Herpes Virus 1
caccgcccccccgaccgccgguuggggcccggcggcacccgacgacggagcuggacaucacgca

SEQ ID NO: 546881 - RNA, 64 nt, Human Herpes Virus 1
cucgccuuucucaucgagaacgagaugcccuggagcacccgacucgggguggccggcccggccg

SEQ ID NO: 546882 - RNA, 64 nt, Human Herpes Virus 1
cgacguccagcaguaccuggagcgccucgagaaacagaggcaacuuaaggugggcgcggacgag

SEQ ID NO: 546883 - RNA, 64 nt, Human Herpes Virus 4 (Epstein Barr virus)
caucugcgaggccgugcgggccaaaguacggcccgcgcccgagcuagcugggggcgcgggugcc

SEQ ID NO: 546884 - RNA, 64 nt, Human Herpes Virus 4 (Epstein Barr virus)
ggcucaccuuggucaacaagaccaccauccugcugcgcccgaugaagaccacaacuguggaccu

SEQ ID NO: 546885 - RNA, 64 nt, Human Herpes Virus 1
cccgccccacgccacggaguucucguaggagacgacgacgaagcgcugcuugguuccguagugg

SEQ ID NO: 546886 - RNA, 64 nt, Human Herpes Virus 1
gcauccgguguaccagcgcgccuguaugucucugacgacgaagaucccaaacccgacccccggc

SEQ ID NO: 546887 - RNA, 64 nt, Human Herpes Virus 1
gauuaugcccucuacgggggcucgucauccgaagacgacgaacacccggaggucccccggacgc

SEQ ID NO: 546888 - RNA, 64 nt, Human Herpes Virus 2; identical to SEQ ID NO: 537989

SEQ ID NO: 546889 - RNA, 64 nt, Human Herpes Virus 2; identical to SEQ ID NO: 537990

SEQ ID NO: 546890 - RNA, 64 nt, Human Herpes Virus 2; identical to SEQ ID NO: 537991

SEQ ID NO: 546891 - RNA, 64 nt, Human Herpes Virus 2; identical to SEQ ID NO: 537992

SEQ ID NO: 546892 - RNA, 64 nt, Human Herpes Virus 2; identical to SEQ ID NO: 537993

SEQ ID NO: 546893 - RNA, 60 nt, Human immunodeficiency virus type 1 (BLAI); identical to SEQ ID NO: 544601

SEQ ID NO: 546894 - RNA, 60 nt, Human immunodeficiency virus type 1; identical to SEQ ID NO: 544601

SEQ ID NO: 546895 - RNA, 64 nt, Human Herpes Virus 2; identical to SEQ ID NO: 545753

SEQ ID NO: 546896 - RNA, 64 nt, Human Herpes Virus 2; identical to SEQ ID NO: 545754

SEQ ID NO: 546897 - RNA, 64 nt, Human Herpes Virus 2; identical to SEQ ID NO: 545755

SEQ ID NO: 546898 - RNA, 64 nt, Human Herpes Virus 2; identical to SEQ ID NO: 545756

SEQ ID NO: 546899 - RNA, 64 nt, Human Herpes Virus 2; identical to SEQ ID NO: 545757

SEQ ID NO: 546900 - RNA, 64 nt, Human Herpes Virus 2; identical to SEQ ID NO: 545758

SEQ ID NO: 546901 - RNA, 64 nt, Human Herpes Virus 2; identical to SEQ ID NO: 545759

SEQ ID NO: 546902 - RNA, 64 nt, Human Herpes Virus 2; identical to SEQ ID NO: 545760

SEQ ID NO: 546903 - RNA, 64 nt, Human Herpes Virus 2; identical to SEQ ID NO: 545761

SEQ ID NO: 546904 - RNA, 64 nt, Human Herpes Virus 2; identical to SEQ ID NO: 545762

SEQ ID NO: 546905 - RNA, 64 nt, Human Herpes Virus 1; identical to SEQ ID NO: 538485

SEQ ID NO: 546906 - RNA, 64 nt, Human Herpes Virus 1; identical to SEQ ID NO: 538486

SEQ ID NO: 546907 - RNA, 64 nt, Human Herpes Virus 1; identical to SEQ ID NO: 538487

SEQ ID NO: 546908 - RNA, 64 nt, Human Herpes Virus 1; identical to SEQ ID NO: 538488

SEQ ID NO: 546909 - RNA, 64 nt, Human Herpes Virus 1; identical to SEQ ID NO: 538489

SEQ ID NO: 546910 - RNA, 64 nt, Human Herpes Virus 1; identical to SEQ ID NO: 538490

SEQ ID NO: 546911 - RNA, 64 nt, Human Herpes Virus 1; identical to SEQ ID NO: 538491

SEQ ID NO: 546912 - RNA, 64 nt, Human Herpes Virus 1; identical to SEQ ID NO: 538492

SEQ ID NO: 546913 - RNA, 64 nt, Human Herpes Virus 1; identical to SEQ ID NO: 538493

SEQ ID NO: 546914 - RNA, 64 nt, Human Herpes Virus 1; identical to SEQ ID NO: 538494

SEQ ID NO: 546915 - RNA, 64 nt, Human Herpes Virus 1; identical to SEQ ID NO: 538495

SEQ ID NO: 546916 - RNA, 64 nt, Human Herpes Virus 1; identical to SEQ ID NO: 538496

SEQ ID NO: 546917 - RNA, 64 nt, Human Herpes Virus 1; identical to SEQ ID NO: 538497

SEQ ID NO: 546918 - RNA, 64 nt, Human Herpes Virus 1; identical to SEQ ID NO: 538498

SEQ ID NO: 546919 - RNA, 64 nt, Human Herpes Virus 1; identical to SEQ ID NO: 538499

SEQ ID NO: 546920 - RNA, 64 nt, Human Herpes Virus 1; identical to SEQ ID NO: 538500

SEQ ID NO: 546921 - RNA, 64 nt, Human Herpes Virus 1; identical to SEQ ID NO: 538501

SEQ ID NO: 546922 - RNA, 64 nt, Human Herpes Virus 1; identical to SEQ ID NO: 538502

SEQ ID NO: 546923 - RNA, 64 nt, Human Herpes Virus 1; identical to SEQ ID NO: 538503

SEQ ID NO: 546924 - RNA, 64 nt, Human Herpes Virus 1; identical to SEQ ID NO: 538493

SEQ ID NO: 546925 - RNA, 62 nt, Human Herpes Virus 1; identical to SEQ ID NO: 545791

SEQ ID NO: 546926 - RNA, 64 nt, Human Herpes Virus 1
gguggcacgggucauccagcaggcggugcuguuggaccgagauuuuguggaggccaucgggagc

SEQ ID NO: 546927 - RNA, 62 nt, Human Herpes Virus 1; identical to SEQ ID NO: 545793

SEQ ID NO: 546928 - RNA, 62 nt, Human Herpes Virus 1; identical to SEQ ID NO: 545794

SEQ ID NO: 546929 - RNA, 64 nt, Human Herpes Virus 4 (Epstein Barr virus)
gugggauggaucugcaggacauggccaggaucaggucucccaguucccacaucugcaaucggag

SEQ ID NO: 546930 - RNA, 64 nt, Human Herpes Virus 4 (Epstein Barr virus)
agauccccgugacugugcucucaucccugcaacugucucccaccaaguccauccugaaaaaggc

SEQ ID NO: 546931 - RNA, 64 nt, Human Herpes Virus 4 (Epstein Barr virus)
gccucuucugcuccaggcaccaggcccgcgcaaggucucccagcaugcgguugaucuggcggcg

SEQ ID NO: 546932 - RNA, 64 nt, Human Herpes Virus 4 (Epstein Barr virus)
uaucccagccacuaccauagcccccaccacauuagucucccacaccacaagcaccagucacagg

SEQ ID NO: 546933 - RNA, 64 nt, Human Herpes Virus 4 (Epstein Barr virus)
gguggcggccaagcgccugggggaugucaucucagucucccagugcgugcccguuaaccaggcc

SEQ ID NO: 546934 - RNA, 62 nt, Human Herpes Virus 1; identical to SEQ ID NO: 545744

SEQ ID NO: 546935 - RNA, 62 nt, Human Herpes Virus 1; identical to SEQ ID NO: 545746

SEQ ID NO: 546936 - RNA, 62 nt, Human Herpes Virus 1; identical to SEQ ID NO: 545790

SEQ ID NO: 546937 - RNA, 62 nt, Human Herpes Virus 1; identical to SEQ ID NO: 545795

SEQ ID NO: 546938 - RNA, 62 nt, Human Herpes Virus 1; identical to SEQ ID NO: 545796

SEQ ID NO: 546939 - RNA, 62 nt, Human Herpes Virus 1; identical to SEQ ID NO: 545747

SEQ ID NO: 546940 - RNA, 62 nt, Human Herpes Virus 1; identical to SEQ ID NO: 545745

SEQ ID NO: 546941 - RNA, 64 nt, Human Herpes Virus 1
gccggggcgccgcgcagcagcucgccgcccggauccgccagacaaacaaggcccuugcacaugc

SEQ ID NO: 546942 - RNA, 64 nt, Human Herpes Virus 1
cgaccuucgagcaccagaaacugcgguguuccguccgccagagcgagaacgugcucacguaccu

SEQ ID NO: 546943 - RNA, 64 nt, Human Herpes Virus 4 (Epstein Barr virus)
ugggucucuuuuacgcccuggccugcaaccgcagcccacccacacuucccgaggaugcuacccu

SEQ ID NO: 546944 - RNA, 64 nt, Human Herpes Virus 4 (Epstein Barr virus)
uauacgucugcggcuucguggagcgcccggacgccccacccaaggacgccugccuucaccugga

SEQ ID NO: 546945 - RNA, 64 nt, Human Herpes Virus 4 (Epstein Barr virus)
gccuucuuggcgauggacgcucacaccuaccacccccacccacaccccccuccggccuacuuug

SEQ ID NO: 546946 - RNA, 64 nt, Human Herpes Virus 4 (Epstein Barr virus)
gcggcuacccccaggguggggccagcggaccgcacccacccaggucggacuagcggaugcagca

SEQ ID NO: 546947 - RNA, 64 nt, Human Herpes Virus 4 (Epstein Barr virus)
ucacgaauccgagcgugcuguuuggucagauuuacccacccagcuuccaggccuuuaaggcagc

SEQ ID NO: 546948 - RNA, 64 nt, Human Herpes Virus 4 (Epstein Barr virus)
cgccucaugcgccgccuggguccaguguccagggcccacccagucuauuuuuucaaaucagcuu

SEQ ID NO: 546949 - RNA, 64 nt, Human Herpes Virus 4 (Epstein Barr virus)
gccggggccaguggaaucccaaggaacaauuccucccacccaccguccuucgaagggugcagcg

SEQ ID NO: 546950 - RNA, 64 nt, Human Herpes Virus 4 (Epstein Barr virus)
gggccgcauucccugcaucgucugcgugggcucucccacccagacagacgccuuucaguccucc

SEQ ID NO: 546951 - RNA, 64 nt, Human Herpes Virus 4 (Epstein Barr virus)
aggaugcccccuuuguggugggacugagauuuaacccacccaaaaugcacccggacaugucacg

SEQ ID NO: 546952 - RNA, 64 nt, Human Herpes Virus 4 (Epstein Barr virus)
aggugaggaagaugacgacggccucuaccaggugcccacccacuggccccccuugauggcuccg

SEQ ID NO: 546953 - RNA, 64 nt, Human Herpes Virus 4 (Epstein Barr virus)
cggggccccuggcggaggagagcgggcucuuucccccacccagcaacguggcccuggcucgcug

SEQ ID NO: 546954 - RNA, 64 nt, Human Herpes Virus 4 (Epstein Barr virus)
gccucuaaggcccucgggucccccuggaccccggccucagcaacccugcugcuccccuccugcc

SEQ ID NO: 546955 - RNA, 64 nt, Human Herpes Virus 4 (Epstein Barr virus); identical to SEQ ID NO: 546954

SEQ ID NO: 546956 - RNA, 64 nt, Human Herpes Virus 4 (Epstein Barr virus); identical to SEQ ID NO: 546954

SEQ ID NO: 546957 - RNA, 64 nt, Human Herpes Virus 4 (Epstein Barr virus)
aggccgccggcucccgcgccggucaggggacgggccucagcaccucccaggccaccagccccag

SEQ ID NO: 546958 - RNA, 64 nt, Human Herpes Virus 4 (Epstein Barr virus)
agccgggaacucuggaccccgggaggacaccaacccucagcagcccaccaccgagggccaccac

SEQ ID NO: 546959 - RNA, 64 nt, Human Herpes Virus 4 (Epstein Barr virus)
gcuaaaccacgaguggcagcaggccuaagaagcuccucagcaacauggagaccucgaagggaaa

SEQ ID NO: 546960 - RNA, 64 nt, Human Herpes Virus 4 (Epstein Barr virus)
cccucaugcgccagagcggccuucuccucuuccuccucagcagccaguugacggacgugcccag

SEQ ID NO: 546961 - RNA, 64 nt, Human Herpes Virus 4 (Epstein Barr virus)
ccucccgcccugagcuggaccuucuccacuucuuccucagcagccuggaugcccucaugcgcca

SEQ ID NO: 546962 - RNA, 64 nt, Human Herpes Virus 4 (Epstein Barr virus)
gcaacugcguccucuaccugcuucuccacuucuuccucagcagcccccugaccucccgcccuga

SEQ ID NO: 546963 - RNA, 64 nt, Human Herpes Virus 4 (Epstein Barr virus)
ggcuuccgcaggggggagcagacaccccaccuccccucagcauggacgacauccuguaucuagg

SEQ ID NO: 546964 - RNA, 64 nt, Human Herpes Virus 4 (Epstein Barr virus)
gccaccagccccaccuugggaaaaacaagccccaccucagcagugacuaccccaaccccaaaug

SEQ ID NO: 546965 - RNA, 64 nt, Human Herpes Virus 4 (Epstein Barr virus); identical to SEQ ID NO: 546964

SEQ ID NO: 546966 - RNA, 64 nt, Human Herpes Virus 4 (Epstein Barr virus)
gccaccagccccaccuugggaaaaacaaguccuaccucagcagugacuaccccaaccccaaaug

SEQ ID NO: 546967 - RNA, 64 nt, Human Herpes Virus 4 (Epstein Barr virus)
gcaccaggauguugccaccuuuguuaugcgcaauccucagcagcgggccguggaagccuucaac

SEQ ID NO: 546968 - RNA, 64 nt, Human Herpes Virus 1
gaugucgcccgucuuuaaccucccccgggagacggcggcggagcagguggucguccuacaggcc

SEQ ID NO: 546969 - RNA, 64 nt, Human Herpes Virus 1
uccagucccccuggacacggaggacgacuccgaugcggcggacgggacggcggcccgucccgcc

SEQ ID NO: 546970 - RNA, 64 nt, Human Herpes Virus 1
cuccaacccccaccgaccaaagcccagccugcccgcggcggacgccgugggcgucgcagggguc

SEQ ID NO: 546971 - RNA, 64 nt, Human Herpes Virus 1
agccugcgcggccggggccucgauguggguggcggcggcggacagcuuugccgccucugccaau

SEQ ID NO: 546972 - RNA, 64 nt, Human Herpes Virus 1
gcgucgcgugcuggcgcgcaugggggcggggggcgcggcggacgcgcccaagggcggcgcgggc

SEQ ID NO: 546973 - RNA, 64 nt, Human Herpes Virus 1
cgggccggguuugugugcgcggccucaagccucggcggcggagcgcacgaaagcucgcugugcg

SEQ ID NO: 546974 - RNA, 64 nt, Human Herpes Virus 1
ccagcggguggcgacuaaggcccccgcggccccggcggcggagaccacccgcggcaggaaaucg

SEQ ID NO: 546975 - RNA, 64 nt, Human Herpes Virus 1
ccccccucgccucuaccacuugugggugguaggcgcggcggaucugugugugccguuucucgaa

SEQ ID NO: 546976 - RNA, 64 nt, Human Herpes Virus 1
ccgcgagauucuccacgggcagcugggguauaccgagggccaggggguguacaacgucguccgg

SEQ ID NO: 546977 - RNA, 64 nt, Human Herpes Virus 1
cggggaccccaucagccucgucccgcccguguucgagggccaagcgacggacgugcgccuggau

SEQ ID NO: 546978 - RNA, 64 nt, Human Herpes Virus 1
gccgcccaccgacaucuccgcguggccgcuguucgagggccaggacacggccgcggcccgcgcc

SEQ ID NO: 546979 - RNA, 64 nt, Human Herpes Virus 1
ccgggacuuugggcugggcuaucuccccacgguugagggccaucgcaccaaacugggcgcgcug

SEQ ID NO: 546980 - RNA, 64 nt, Human Herpes Virus 1
ccuacguucuggcccugguggucggggacgcgcugagggccacguguagcgcggccuaccuucc

SEQ ID NO: 546981 - RNA, 64 nt, Human Herpes Virus 4 (Epstein Barr virus)
cugagaaugccggcaacgacgcauguuccaucgcgugcccuauagugaugcgcuacguguuaga

SEQ ID NO: 546982 - RNA, 64 nt, Human Herpes Virus 2; identical to SEQ ID NO: 543783

SEQ ID NO: 546983 - RNA, 64 nt, Human Herpes Virus 2; identical to SEQ ID NO: 543784

SEQ ID NO: 546984 - RNA, 64 nt, Human Herpes Virus 2; identical to SEQ ID NO: 543785

SEQ ID NO: 546985 - RNA, 64 nt, Human Herpes Virus 2; identical to SEQ ID NO: 543786

SEQ ID NO: 546986 - RNA, 64 nt, Human Herpes Virus 2; identical to SEQ ID NO: 543787

SEQ ID NO: 546987 - RNA, 64 nt, Human Herpes Virus 2; identical to SEQ ID NO: 543788

SEQ ID NO: 546988 - RNA, 64 nt, Human Herpes Virus 2; identical to SEQ ID NO: 543789

SEQ ID NO: 546989 - RNA, 64 nt, Human Herpes Virus 2; identical to SEQ ID NO: 543790

SEQ ID NO: 546990 - RNA, 64 nt, Human Herpes Virus 2; identical to SEQ ID NO: 543791

SEQ ID NO: 546991 - RNA, 64 nt, Human Herpes Virus 2; identical to SEQ ID NO: 543792

SEQ ID NO: 546992 - RNA, 64 nt, Human Herpes Virus 2; identical to SEQ ID NO: 543793

SEQ ID NO: 546993 - RNA, 64 nt, Human Herpes Virus 2; identical to SEQ ID NO: 543794

SEQ ID NO: 546994 - RNA, 64 nt, Human Herpes Virus 2; identical to SEQ ID NO: 543795

SEQ ID NO: 546995 - RNA, 64 nt, Human Herpes Virus 2; identical to SEQ ID NO: 543796

SEQ ID NO: 546996 - RNA, 64 nt, Human Herpes Virus 2; identical to SEQ ID NO: 543797

SEQ ID NO: 546997 - RNA, 64 nt, Human Herpes Virus 2; identical to SEQ ID NO: 543798

SEQ ID NO: 546998 - RNA, 64 nt, Human Herpes Virus 2; identical to SEQ ID NO: 543799

SEQ ID NO: 546999 - RNA, 64 nt, Human Herpes Virus 2; identical to SEQ ID NO: 543800

SEQ ID NO: 547000 - RNA, 64 nt, Human Herpes Virus 2; identical to SEQ ID NO: 543801

SEQ ID NO: 547001 - RNA, 64 nt, Human Herpes Virus 2
caucaccaccgacggcggggaggucgucucgcugaccgcccacgaauuugacgucguggacauc

SEQ ID NO: 547002 - RNA, 64 nt, Human Herpes Virus 1; identical to SEQ ID NO: 546941

SEQ ID NO: 547003 - RNA, 64 nt, Human Herpes Virus 1; identical to SEQ ID NO: 546942

SEQ ID NO: 547004 - RNA, 62 nt, Human Herpes Virus 1; identical to SEQ ID NO: 545744

SEQ ID NO: 547005 - RNA, 62 nt, Human Herpes Virus 1; identical to SEQ ID NO: 545746

SEQ ID NO: 547006 - RNA, 62 nt, Human Herpes Virus 1; identical to SEQ ID NO: 545790

SEQ ID NO: 547007 - RNA, 62 nt, Human Herpes Virus 1; identical to SEQ ID NO: 545795

SEQ ID NO: 547008 - RNA, 62 nt, Human Herpes Virus 1; identical to SEQ ID NO: 545796

SEQ ID NO: 547009 - RNA, 62 nt, Human Herpes Virus 1; identical to SEQ ID NO: 545747

SEQ ID NO: 547010 - RNA, 62 nt, Human Herpes Virus 1; identical to SEQ ID NO: 545791

SEQ ID NO: 547011 - RNA, 62 nt, Human Herpes Virus 1; identical to SEQ ID NO: 545745

SEQ ID NO: 547012 - RNA, 62 nt, Human Herpes Virus 1; identical to SEQ ID NO: 545793

SEQ ID NO: 547013 - RNA, 62 nt, Human Herpes Virus 1; identical to SEQ ID NO: 545794

SEQ ID NO: 547014 - RNA, 64 nt, Human Herpes Virus 1
ccgacuccgcgccccccacgaaaggcaugaccggggcgcggacggcguggugggucuggugugu

SEQ ID NO: 547015 - RNA, 64 nt, Human Herpes Virus 1
ggagcgccucgagaaacagaggcaacuuaaggugggcgcggacgaggcgucggcgggccucacc

SEQ ID NO: 547016 - RNA, 64 nt, Human Herpes Virus 1
ccccuggaacacucgcaauucagucgguaucgcuggcgcggacccacggcggcguuccugucuc

SEQ ID NO: 547017 - RNA, 64 nt, Human Herpes Virus 1
ugcgcuuuaagcacggccgggcgagucgcgccacggcgcggacauucgucgcgcugagcgucgg

SEQ ID NO: 547018 - RNA, 64 nt, Human Herpes Virus 1
gaacgcggugguggaacagccccucccacagcgcggcgcggauuuggccgagcccacccacccg

SEQ ID NO: 547019 - RNA, 64 nt, Human Herpes Virus 1
cccagaccgcgacgagcggggggcccucggguggggcgcggagacggaggagggcggggacgac

SEQ ID NO: 547020 - RNA, 64 nt, Human Herpes Virus 1
cggcggcccgcgacccccgaagacgaagaagagcggcgcggacgcccccggcucggacgcccgc

SEQ ID NO: 547021 - RNA, 64 nt, Human Herpes Virus 1
cgccguccgcgccccggucaugccuuucguggggggcgcggagucgggagauccucugggggcc

SEQ ID NO: 547022 - RNA, 64 nt, Human Herpes Virus 1
ggaccgucugcaagaggucgucgggggacggugcggcgcggacaacauccccccgaccagcgcc

SEQ ID NO: 547023 - RNA, 64 nt, Human Herpes Virus 1
cgcgggggggcgggcgacggaggggguucgggcgggcgcggaggaccccgcaacccgcccccgg

SEQ ID NO: 547024 - RNA, 64 nt, Human Herpes Virus 1; identical to SEQ ID NO: 547020

SEQ ID NO: 547025 - RNA, 64 nt, Human Herpes Virus 1; identical to SEQ ID NO: 547019

SEQ ID NO: 547026 - RNA, 64 nt, Human Herpes Virus 1
cgcacacauucgcuccuaucacacgcgucucgugagcgcccaauaaacacacccagguaugcua

SEQ ID NO: 547027 - RNA, 64 nt, Human Herpes Virus 1
gauaucggccggggacgcggcggugguaaugacaagcgcccagauaacaaugggcaugccuuau

SEQ ID NO: 547028 - RNA, 64 nt, Human Hepatitis C Virus (M1LE)
cggaugugcugcuccucaacaacacgcggccuccgcaaggcaauugguucggcuguacguggau

SEQ ID NO: 547029 - RNA, 63 nt, Human Herpes Virus 1
cacaaaaagcagacgccgacgaccccacucccggcgccucuaacgaugccucgacggaaaccc

SEQ ID NO: 547030 - RNA, 64 nt, Human Herpes Virus 1
cacaaaaagcagacgccgacgaccccacucccggcgccucuaacgaugccucgacggaaacccg

SEQ ID NO: 547031 - RNA, 64 nt, Human Herpes Virus 1
gucguggugggaaauguucaaguucuuuuuccaccgccucuacgaccaccagaucguaccgucg

SEQ ID NO: 547032 - RNA, 64 nt, Human Herpes Virus 1
ccgacugcugcaccgagaccaacccagccccccucgccucuaccacuugugggugguaggcgcg

SEQ ID NO: 547033 - RNA, 64 nt, Human Herpes Virus 2
guacgcaauuacgucuacgcuguugcuggcggcggccguguacgccgcggugggcgcggugacc

SEQ ID NO: 547034 - RNA, 64 nt, Human Herpes Virus 2
ccgcggggcccccccgcugcuagacaacgcggccgccguguaccugcgcaacgcggucguggcg

SEQ ID NO: 547035 - RNA, 64 nt, Human Herpes Virus 2
cuaccucgggggcgaccuccccgaggagugcauggccguguaucgggaccugguggcccacguc

SEQ ID NO: 547036 - RNA, 64 nt, Human Herpes Virus 2
ccugcugcagcuccucgcgcggcgguccaaccucgccguguaccaggaccuggcccugagccag

SEQ ID NO: 547037 - RNA, 64 nt, Human Herpes Virus 2
cgccaccagcgggcugaacgccgugcugggcgcggccguguacgcgcugcacacggcccuggcg

SEQ ID NO: 547038 - RNA, 53 nt, Human Herpes Virus 1
gucgcccgcaggguggcggaauggaccgagaugccgcccacgcggcccugcgc

SEQ ID NO: 547039 - RNA, 64 nt, Human Herpes Virus 1
cggcuguaucggcccccggucggucguggucuacgaccgagacguuuucucgauccucuacucg

SEQ ID NO: 547040 - RNA, 64 nt, Human Herpes Virus 1
uuagcccgccccggaugucuggguguuucccugcgaccgagaccugccggacagcagcgacucu

SEQ ID NO: 547041 - RNA, 64 nt, Human Herpes Virus 2
gcggcccgucgcacaacgcggagccccggauccucgugcccaucacccacaacgccagcuacgu

SEQ ID NO: 547042 - RNA, 64 nt, Human Herpes Virus 2
cgcccccgggcgaacucaaccugacuacggcauccgugcccaugcuucggugguacgccgagcg

SEQ ID NO: 547043 - RNA, 64 nt, Human Herpes Virus 2
gccccgcccccgcagacaccgccucggccgcggucgugcccaugcgaggaccugcggguccugg

SEQ ID NO: 547044 - RNA, 64 nt, Human Herpes Virus 2
uccuagcgcaguacuggaaguaccuccagacggucgugcccagcggccuggacauccccgacga

SEQ ID NO: 547045 - RNA, 64 nt, Human Herpes Virus 1; identical to SEQ ID NO: 543535

SEQ ID NO: 547046 - RNA, 64 nt, Human Herpes Virus 1; identical to SEQ ID NO: 543536

SEQ ID NO: 547047 - RNA, 64 nt, Human Herpes Virus 1; identical to SEQ ID NO: 543537

SEQ ID NO: 547048 - RNA, 64 nt, Human Herpes Virus 1; identical to SEQ ID NO: 547040

SEQ ID NO: 547049 - RNA, 64 nt, Human Herpes Virus 2
cgccccccgcgagacagccccgcgcggcccaggagccccccauagucaucagcgacucuccccc

SEQ ID NO: 547050 - RNA, 64 nt, Human Herpes Virus 2
cggggucccccgcggcaccaacacccccggugccgccccccacgccgcggagggggcggcggcc

SEQ ID NO: 547051 - RNA, 64 nt, Human Herpes Virus 2
cgccucuuccuccgccgccccgcgcucgccccucgccccccagggggugggggccaagagggcg

SEQ ID NO: 547052 - RNA, 64 nt, Human Herpes Virus 2
gaagccggcggcucgggcggcgucuggguuuuuugccccccacaacccccggggagccacccag

SEQ ID NO: 547053 - RNA, 64 nt, Human Herpes Virus 2
cgaaaaguaaggccuccaccgccaaaccggccccgccccccaagaccgggcccccgaagacauc

SEQ ID NO: 547054 - RNA, 64 nt, Human Herpes Virus 2
aacccccggggacgacgcggggggcggcacugccgccccccagaccugcggaaucgucaagcgc

SEQ ID NO: 547055 - RNA, 64 nt, Human Herpes Virus 2
acacgaacaccagcagcgccuccgcagcgaaaacgccccccaccacaccagcccccacgacccc

SEQ ID NO: 547056 - RNA, 64 nt, Human Herpes Virus 2
accacauucagccgagccuggaggacccguuccagccccccagcaucccgaucacuguguacua

SEQ ID NO: 547057 - RNA, 64 nt, Human Herpes Virus 2
cugccgcagcgugcuccuacaugccccaucggaggccccccagaucgugcgcggggcuucggac

SEQ ID NO: 547058 - RNA, 64 nt, Human Herpes Virus 2
guccgucaguccucggccccgcaguggcccgacggccccccaagaggucuagguccaagcgggc

SEQ ID NO: 547059 - RNA, 64 nt, Human Herpes Virus 2
cgagcccgucgagcccacccgcccgcacgugagagccccccaucccgcgcccuccgcgcgcggc

SEQ ID NO: 547060 - RNA, 64 nt, Human Herpes Virus 2
gugccccagggacccucacggcuaccuggcccccgccccccagaccccccuggccuucuacgag

SEQ ID NO: 547061 - RNA, 64 nt, Human Herpes Virus 2
ucaccgggggccccggguucccauuggccccagagccccccacgugggcaacccgacggcgggg

SEQ ID NO: 547062 - RNA, 64 nt, Human Herpes Virus 2
cgacggggcgcugcacgccggcgugcugcucauggccccccagcaccuggaccacaccauccaa

SEQ ID NO: 547063 - RNA, 64 nt, Human Herpes Virus 2
ggcgaaccgggagacgcuggaugaacucgaaagcgccccccagacaacgcgcgugcgcgcggau

SEQ ID NO: 547064 - RNA, 64 nt, Human Herpes Virus 2
cccuguucgaccacuccacccacagcuucgcccagccccccaacaccgcgcuguacuacagcgu

SEQ ID NO: 547065 - RNA, 64 nt, Human Herpes Virus 2
cgagcgcccucucgccgacgcccgguugcccgccgccccccaccacaucuccaugaccccgguc

SEQ ID NO: 547066 - RNA, 64 nt, Human Herpes Virus 2
ccgcccugugcgcccggcugcgucccuccccgaggccccccacgcccugggagaugaacuuuga

SEQ ID NO: 547067 - RNA, 64 nt, Human Herpes Virus 2
uucaggaggugauggcccacgcgaccgaggacgcgccccccagcccggccgcagaccucgucgu

SEQ ID NO: 547068 - RNA, 64 nt, Human Herpes Virus 2
aucuguuugcggacgcggacgggguuucgccaccgccccccaggccagccgggggucccaagaa

SEQ ID NO: 547069 - RNA, 64 nt, Human Herpes Virus 2; identical to SEQ ID NO: 547051

SEQ ID NO: 547070 - RNA, 64 nt, Human Herpes Virus 2; identical to SEQ ID NO: 547050

SEQ ID NO: 547071 - RNA, 64 nt, Human Herpes Virus 2; identical to SEQ ID NO: 547049

SEQ ID NO: 547072 - RNA, 64 nt, Human Herpes Virus 2
gcggcucaugaacgacugggccgaugugcccugcaaccccuaccugcgcgugcagaacaccggc

SEQ ID NO: 547073 - RNA, 64 nt, Human Herpes Virus 2
cgaggcccagcuaaugauccuggcccaggcccugaaccccuacgacugucugauccacagcacc

SEQ ID NO: 547074 - RNA, 64 nt, Human Herpes Virus 2
agcgcuucgacgcccucgaccggccuucgcguuuaaccccuacaagcgacgcggccuucguccc

SEQ ID NO: 547075 - RNA, 64 nt, Human Herpes Virus 4 (Epstein Barr virus)
cuccgggcucucccgggacgccuccuccucgccucggcccaaccgcugcauggcucgguugagc

SEQ ID NO: 547076 - RNA, 64 nt, Human Herpes Virus 1
cacgguggagguucugucgaucguccaucaccacgcccaguauaucaucaacgcgacccucacc

SEQ ID NO: 547077 - RNA, 64 nt, Human Herpes Virus 4 (Epstein Barr virus)
aauacguggcggagcuuggugcugugccccugcccgggcguacgugggauccggaggugacugc

SEQ ID NO: 547078 - RNA, 64 nt, Human Herpes Virus 1; identical to SEQ ID NO: 546941

SEQ ID NO: 547079 - RNA, 64 nt, Human Herpes Virus 1; identical to SEQ ID NO: 546942

SEQ ID NO: 547080 - RNA, 64 nt, Human Herpes Virus 4 (Epstein Barr virus)
gcccauagaaaguucacacuugaguuccaugucgcccacacagccgauaucgcacgaagaacaa

SEQ ID NO: 547081 - RNA, 64 nt, Human Herpes Virus 4 (Epstein Barr virus)
aggguugccgugguugggcagaaccaucagcucgcccacacagcgccagcagggcacagaggug

SEQ ID NO: 547082 - RNA, 64 nt, Human Herpes Virus 4 (Epstein Barr virus)
cacgaccuccgccgccaucaaaaugcuggacaaccccacacagcagcuaccgguggaggcaugg

SEQ ID NO: 547083 - RNA, 64 nt, Human Herpes Virus 1
ucgggcccccgaguugcuggcccccaacggcgaccuguauaacguguuugccugggcuuuggac

SEQ ID NO: 547084 - RNA, 64 nt, Human Herpes Virus 4 (Epstein Barr virus)
uccaggucacgcgacgaagccccucaaccacccgcggcagcaacgcuucccuccccgcccaaag

SEQ ID NO: 547085 - RNA, 64 nt, Human Herpes Virus 4 (Epstein Barr virus)
cucagugccccccuuuguccuacggacucagccgcggcagcagcaugcggcccugcacgugcgc

SEQ ID NO: 547086 - RNA, 62 nt, Human Herpes Virus 2
gcgcacacgacgcugaugcggcugcgggcccgccaccccaaguucgcgagcgccgcccgggg

SEQ ID NO: 547087 - RNA, 62 nt, Human Herpes Virus 2
ccucucgccgacgggcccccgcccgccgccccccaccccaguuccaugaccccggucgcggu

SEQ ID NO: 547088 - RNA, 62 nt, Human Herpes Virus 2
cgcgcagcagcuggacagcgcgagaaccagcgccaccccaugcggccccgcgccguacgucg

SEQ ID NO: 547089 - RNA, 62 nt, Human Herpes Virus 2
gguaucgugcaugcgcucgugcuguucgagguccaccccaauuuucgacguggggccccgcg

SEQ ID NO: 547090 - RNA, 62 nt, Human Herpes Virus 2
accaagauccgcuucccggcccuggagggcauccaccccaacguccucgccgacccgggguu

SEQ ID NO: 547091 - RNA, 62 nt, Human Herpes Virus 2
cgccccgcaucaucccgcccgcauccggcgacccaccccacgcagcgcccguguuuuacgug

SEQ ID NO: 547092 - RNA, 64 nt, Human Herpes Virus 1
aaacuggcacauaccgucgauccaggacgccgcgacgccuuaccaucccccggccaccccgaac

SEQ ID NO: 547093 - RNA, 64 nt, Human Herpes Virus 1
acaggcucgggugucccggaccgucgcaccaaccacgccuuaguuaggccgauccgcaguuaca

SEQ ID NO: 547094 - RNA, 64 nt, Human Herpes Virus 4 (Epstein Barr virus); identical to SEQ ID NO: 544460

SEQ ID NO: 547095 - RNA, 64 nt, Human Herpes Virus 4 (Epstein Barr virus); identical to SEQ ID NO: 544461

SEQ ID NO: 547096 - RNA, 64 nt, Human Herpes Virus 4 (Epstein Barr virus); identical to SEQ ID NO: 544462

SEQ ID NO: 547097 - RNA, 64 nt, Human Herpes Virus 4 (Epstein Barr virus); identical to SEQ ID NO: 544463

SEQ ID NO: 547098 - RNA, 64 nt, Human Herpes Virus 1; identical to SEQ ID NO: 545880

SEQ ID NO: 547099 - RNA, 64 nt, Human Herpes Virus 1; identical to SEQ ID NO: 545881

SEQ ID NO: 547100 - RNA, 64 nt, Human Herpes Virus 1; identical to SEQ ID NO: 545882

SEQ ID NO: 547101 - RNA, 64 nt, Human Herpes Virus 1; identical to SEQ ID NO: 545883

SEQ ID NO: 547102 - RNA, 64 nt, Human Herpes Virus 1; identical to SEQ ID NO: 545884

SEQ ID NO: 547103 - RNA, 64 nt, Human Herpes Virus 4 (Epstein Barr virus)
caacaauuacaucaucuacccucggggccaccaugguggccacccaucugcgaccccccgcaac

SEQ ID NO: 547104 - RNA, 64 nt, Human Herpes Virus 4 (Epstein Barr virus)
ucccugagagcugucguggggugguggaggcccagguggccaagcuugaggccgugcgcucagu

SEQ ID NO: 547105 - RNA, 64 nt, Human Herpes Virus 4 (Epstein Barr virus)
cuggcgacagccuggcccugauggagauggagaagguggccacggcgcucaagauggacgagac

SEQ ID NO: 547106 - RNA, 64 nt, Human Herpes Virus 4 (Epstein Barr virus)
ccaucaauguggccaucauaccuauccugugcucgguggccaugcucaucaggauaugccggau

SEQ ID NO: 547107 - RNA, 64 nt, Human Herpes Virus 4 (Epstein Barr virus)
uagccguggagggcaacagcagucaggacucugcgguggccauugccucaaucauuggggaauc

SEQ ID NO: 547108 - RNA, 64 nt, Human Herpes Virus 4 (Epstein Barr virus)
aagucggagugguaagcuccgucagguucuugacgguggccaacgagcgcggggucagagguag

SEQ ID NO: 547109 - RNA, 64 nt, Human Herpes Virus 4 (Epstein Barr virus)
gcgccaggcaggacugcagcuuggccagacccucgguggccaccuggcgcagguacugcuccuu

SEQ ID NO: 547110 - RNA, 64 nt, Human Herpes Virus 4 (Epstein Barr virus)
gccgggcauccuucucuccagccgccaucgagcagguggccacgguucugcucucggccgggcu

SEQ ID NO: 547111 - RNA, 64 nt, Human Herpes Virus 4 (Epstein Barr virus)
ugcaggcgauccagaacgcggggcucugcacccugguggccaugcuagaagagaccaucuuuug

SEQ ID NO: 547112 - RNA, 64 nt, Human Herpes Virus 4 (Epstein Barr virus)
auauugcccaggccaagcucaagauccacccagggguggccaugaccguggucaggaccgauga

SEQ ID NO: 547113 - RNA, 64 nt, Human Herpes Virus 4 (Epstein Barr virus)
ccaccauggcccccggguccaccguggggacccugguggccaacaugacuuccgucaaugcaac

SEQ ID NO: 547114 - RNA, 64 nt, Human Herpes Virus 4 (Epstein Barr virus)
agugcacgugcaacgccgucuacggcuucaccgggguggccaacggccucuuucccugccucuc

SEQ ID NO: 547115 - RNA, 64 nt, Human Herpes Virus 4 (Epstein Barr virus)
acgcgcucaagcgcaaggagcaguaccugcgccagguggccaccgagggucuggccaagcugca

SEQ ID NO: 547116 - RNA, 64 nt, Human Herpes Virus 4 (Epstein Barr virus)
ugcuggagaagcagagccugcaggaccaggccaagguggccaagguggccccccucaaggaguu

SEQ ID NO: 547117 - RNA, 64 nt, Human Herpes Virus 4 (Epstein Barr virus)
aggccuucaaggagcgacucuacagcggaaaccugguggccauuccaucguuaaaacaggaggu

SEQ ID NO: 547118 - RNA, 64 nt, Human Herpes Virus 4 (Epstein Barr virus)
acuuuuacccccuggccaccuacccucuuagggagguggccacacuggggaccggcuacgcggg

SEQ ID NO: 547119 - RNA, 64 nt, Human Herpes Virus 4 (Epstein Barr virus)
cugcaaauuuuagaucagauggcauagagacaaggacaccgaagacccccagagcccucaucgc

SEQ ID NO: 547120 - RNA, 64 nt, Human Herpes Virus 4 (Epstein Barr virus)
cagcaguuccagcagcagugacucgggcaacagugacaccgagcagagcgagcgggaagaggcc

SEQ ID NO: 547121 - RNA, 64 nt, Human Herpes Virus 1
ucugcgccaccuacgcgauuccccacgccccccgccccgacaccgucagcgcugcgucccugac

SEQ ID NO: 547122 - RNA, 64 nt, Human Herpes Virus 1
cgagcuaaucgcgauuuccgacgaacgcggacccccccgacaugaccgcccgccccucgccacg

SEQ ID NO: 547123 - RNA, 64 nt, Human Herpes Virus 1
ggcgcggcacacggggugggcgccgcgccuccacccccgacaaccgccugccccgggacggccg

SEQ ID NO: 547124 - RNA, 64 nt, Human Herpes Virus 1
gucccugggcccuggccgaggacaccccucguggccccgacagcccccccaagcgcccccgccc

SEQ ID NO: 547125 - RNA, 64 nt, Human Herpes Virus 1
cguuccacggggaugacccguuuggggaggggccccccgacaaaaagggagaccugacguugga

SEQ ID NO: 547126 - RNA, 64 nt, Human Herpes Virus 1
cagcgccugaccccgcaucccggccgccugcccuccccgacacgagcguuuucggccggaggcc

SEQ ID NO: 547127 - RNA, 64 nt, Human Herpes Virus 1
gguuaucgcgcgugggggucaugcacuucgccucccccgacaaccccgcgguguuuuuccgcca

SEQ ID NO: 547128 - RNA, 64 nt, Human Herpes Virus 4 (Epstein Barr virus)
auuaccccccucacaauugccaccaccagcagcaccagcacagccaccuccaggggucaucaac

SEQ ID NO: 547129 - RNA, 64 nt, Human Herpes Virus 4 (Epstein Barr virus)
ggaugagcagggccucaucuuccagccucucuuuccagcacagguggucugccaaagcugcucg

SEQ ID NO: 547130 - RNA, 64 nt, Human Herpes Virus 4 (Epstein Barr virus)
caacuucaugaccgugguggccucugucuccgccccaggggaauucucggguccucugaucacg

SEQ ID NO: 547131 - RNA, 64 nt, Human Herpes Virus 4 (Epstein Barr virus)
gcguuauggcacgccggcugcccaagcccacccuccaggggaggcuggaggcggauuuuccaga

SEQ ID NO: 547132 - RNA, 64 nt, Human Herpes Virus 4 (Epstein Barr virus)
gguugcggggccgguugacaucaugagcaagggcccaggggagggaccagguggguggugugug

SEQ ID NO: 547133 - RNA, 64 nt, Human Herpes Virus 4 (Epstein Barr virus)
uacgcccugggggagggaucggcggggcugggguccaggggaccacgcccccacccugcauucc

SEQ ID NO: 547134 - RNA, 64 nt, Human Herpes Virus 4 (Epstein Barr virus)
uggacccagaaccugcaaagauucccaggaugucccaggggacgucggcaggggccuguacacc

SEQ ID NO: 547135 - RNA, 64 nt, Human Herpes Virus 4 (Epstein Barr virus)
gguagccggcacacaucgugccccuuuacccugcccaggggagcccagccaccagcacccgcac

SEQ ID NO: 547136 - RNA, 64 nt, Human Herpes Virus 4 (Epstein Barr virus); identical to SEQ ID NO: 547128

SEQ ID NO: 547137 - RNA, 64 nt, Human Herpes Virus 4 (Epstein Barr virus); identical to SEQ ID NO: 547129

SEQ ID NO: 547138 - RNA, 64 nt, Human Herpes Virus 4 (Epstein Barr virus); identical to SEQ ID NO: 547130

SEQ ID NO: 547139 - RNA, 64 nt, Human Herpes Virus 4 (Epstein Barr virus); identical to SEQ ID NO: 547131

SEQ ID NO: 547140 - RNA, 64 nt, Human Herpes Virus 4 (Epstein Barr virus); identical to SEQ ID NO: 547132

SEQ ID NO: 547141 - RNA, 64 nt, Human Herpes Virus 4 (Epstein Barr virus); identical to SEQ ID NO: 547133

SEQ ID NO: 547142 - RNA, 64 nt, Human Herpes Virus 4 (Epstein Barr virus); identical to SEQ ID NO: 547134

SEQ ID NO: 547143 - RNA, 64 nt, Human Herpes Virus 4 (Epstein Barr virus); identical to SEQ ID NO: 547135

SEQ ID NO: 547144 - RNA, 64 nt, Human Herpes Virus 1
guuuucccccggggagacguucagcacgaacgucuccauccaugccaucgcccacgacgaccag

SEQ ID NO: 547145 - RNA, 64 nt, Human Herpes Virus 1; identical to SEQ ID NO: 547144

SEQ ID NO: 547146 - RNA, 64 nt, Human Herpes Virus 2
guacuacuggguguggggccggacggaccgcccguccgcguacgggaccugggugcgcguucgc

SEQ ID NO: 547147 - RNA, 64 nt, Human Herpes Virus 2
ccggccaacggcgccacggucauacagccgucccuccgcguauugcgcgcggccgacggaccag

SEQ ID NO: 547148 - RNA, 64 nt, Human Herpes Virus 2
guucgaccccgcggaccccggcgcccccgcggccuccgcguacgaggaccugauggcgcggcga

SEQ ID NO: 547149 - RNA, 64 nt, Human Herpes Virus 4 (Epstein Barr virus)
cuucacauuuaaccuguuuuaucaagauucuuuauugaccaagcauuuccagugccagaccguc

SEQ ID NO: 547150 - RNA, 64 nt, Human Herpes Virus 4 (Epstein Barr virus)
caguagccagaaacacggacucguuaagcaucccuugaccaacacuugccgcuaugcuauuggg

SEQ ID NO: 547151 - RNA, 64 nt, Human Herpes Virus 4 (Epstein Barr virus)
ccugacccauaccaggugccuuuuguacaagcuuuugaccaagcuaccagagucuaucaggacc

SEQ ID NO: 547152 - RNA, 64 nt, Human Herpes Virus 1
agcgccggccuccccguacauugaggcggaaaauccccuguacgacugggggggauccgcccua

SEQ ID NO: 547153 - RNA, 64 nt, Human Herpes Virus 1
ccugcgcuacgcgugcguccuccgagcgacccagccccuguacgcgcgcaccacccccgccaag

SEQ ID NO: 547154 - RNA, 64 nt, Human Herpes Virus 2
guuaugccacggcgacggacgccgagaucggaacggcgccuagcuuagaggaggugaugguaaa

SEQ ID NO: 547155 - RNA, 64 nt, Human Herpes Virus 2
gcucgcggacgagcccguggcccacgagcucgacggcgccuaccugguacccacggacacggcc

SEQ ID NO: 547156 - RNA, 64 nt, Human Herpes Virus 2
ccccucccgcgcggacccccaaaaugacgcgcggggcgccuaaggccuccgcgaccccggcgac

SEQ ID NO: 547157 - RNA, 64 nt, Human Herpes Virus 1
aaccuuuuguuuauuggggacggaagugggugggacccaccaggcccgcgggcgaacccgaccc

SEQ ID NO: 547158 - RNA, 64 nt, Human Herpes Virus 1
aauccacugcuuuuucuuugcgguauacaaggacacccaccacaccccuccgcugauuaccgag

SEQ ID NO: 547159 - RNA, 64 nt, Human Herpes Virus 1
acgucagacgagcgcgcuuguccccgaacaaacgacccaccaauaaaauuaugguauccuaugc

SEQ ID NO: 547160 - RNA, 64 nt, Human Herpes Virus 1
cgccacccgcuggguccggaggggccggacgcacacccaccaccgccccccgggccccccgaac

SEQ ID NO: 547161 - RNA, 64 nt, Human Herpes Virus 1
cuccaacuccacgaucgcccgggggcaguuuugccuccaggagccggaccucaaguccccccgg

SEQ ID NO: 547162 - RNA, 64 nt, Human Herpes Virus 1
ccacggggccuccgggcgccccagcggccccucucuccaggacgccgccgucucccgcuccucc

SEQ ID NO: 547163 - RNA, 64 nt, Human Herpes Virus 1
cuuggucguguuggccgaccgccacaacgccccccuccaggaccucuuggccgggauucuuggc

SEQ ID NO: 547164 - RNA, 61 nt, Human Herpes Virus 1
uggggucuuuuucuuuuuugggggguagcggacauccgauaacccgcgucuaucgccacca

SEQ ID NO: 547165 - RNA, 61 nt, Human Herpes Virus 4 (Epstein Barr virus)
cuacaaauuggaguuucugaaauccauccucaccggccaguccccggccaacuucugcuuc

SEQ ID NO: 547166 - RNA, 61 nt, Human Herpes Virus 4 (Epstein Barr virus)
uccaacgaggaucccgcagguaagaagcuacaccggccaguggccggggccguggagccgg

SEQ ID NO: 547167 - RNA, 61 nt, Human Herpes Virus 4 (Epstein Barr virus)
aauccucagcagcgggccguggaagccuucaaccggccagagcagcucuuugcagaguacc

SEQ ID NO: 547168 - RNA, 61 nt, Human Herpes Virus 4 (Epstein Barr virus)
gaacauuuccaacaaccccauaacgaucgugaccggccagagcauggcccaggccuuuuuc

SEQ ID NO: 547169 - RNA, 61 nt, Human Herpes Virus 4 (Epstein Barr virus); identical to SEQ ID NO: 547165

SEQ ID NO: 547170 - RNA, 61 nt, Human Herpes Virus 4 (Epstein Barr virus); identical to SEQ ID NO: 547166

SEQ ID NO: 547171 - RNA, 61 nt, Human Herpes Virus 4 (Epstein Barr virus); identical to SEQ ID NO: 547167

SEQ ID NO: 547172 - RNA, 61 nt, Human Herpes Virus 4 (Epstein Barr virus); identical to SEQ ID NO: 547168

SEQ ID NO: 547173 - RNA, 64 nt, Human Herpes Virus 2; identical to SEQ ID NO: 544351

SEQ ID NO: 547174 - RNA, 64 nt, Human Herpes Virus 2; identical to SEQ ID NO: 544352

SEQ ID NO: 547175 - RNA, 64 nt, Human Herpes Virus 2; identical to SEQ ID NO: 544353

SEQ ID NO: 547176 - RNA, 64 nt, Human Herpes Virus 2; identical to SEQ ID NO: 544354

SEQ ID NO: 547177 - RNA, 64 nt, Human Herpes Virus 2; identical to SEQ ID NO: 544355

SEQ ID NO: 547178 - RNA, 64 nt, Human Herpes Virus 2; identical to SEQ ID NO: 544353

SEQ ID NO: 547179 - RNA, 64 nt, Human Herpes Virus 4 (Epstein Barr virus); identical to SEQ ID NO: 544460

SEQ ID NO: 547180 - RNA, 64 nt, Human Herpes Virus 4 (Epstein Barr virus); identical to SEQ ID NO: 544461

SEQ ID NO: 547181 - RNA, 64 nt, Human Herpes Virus 4 (Epstein Barr virus); identical to SEQ ID NO: 544462

SEQ ID NO: 547182 - RNA, 64 nt, Human Herpes Virus 4 (Epstein Barr virus); identical to SEQ ID NO: 544463

SEQ ID NO: 547183 - RNA, 64 nt, Human Herpes Virus 4 (Epstein Barr virus); identical to SEQ ID NO: 544460

SEQ ID NO: 547184 - RNA, 64 nt, Human Herpes Virus 4 (Epstein Barr virus); identical to SEQ ID NO: 544461

SEQ ID NO: 547185 - RNA, 64 nt, Human Herpes Virus 4 (Epstein Barr virus); identical to SEQ ID NO: 544462

SEQ ID NO: 547186 - RNA, 64 nt, Human Herpes Virus 4 (Epstein Barr virus); identical to SEQ ID NO: 544463

SEQ ID NO: 547187 - RNA, 64 nt, Human Herpes Virus 4 (Epstein Barr virus)
auuuuuugguugugcggucuguuuuccccgcguuuuccgauagaauagcugccuggaucugcga

SEQ ID NO: 547188 - RNA, 64 nt, Human Herpes Virus 2
gucgcaugccgaccccccgggaggcgcguccaagccccgcaagcugcugguguccgagcuggcg

SEQ ID NO: 547189 - RNA, 64 nt, Human Herpes Virus 2
auccgccccccgaaccacacccacgcccccccaaccccgcaaggcgacgaaaaguaaggccucc

SEQ ID NO: 547190 - RNA, 64 nt, Human Herpes Virus 2
ugaugcgucagacggcugguugguugacacacccccccgcaaauccaagcgaccccgaaucaac

SEQ ID NO: 547191 - RNA, 64 nt, Human Herpes Virus 2
cacccucagucgacccaagcgcggaaccgaccgcccccgcaaccacuacuccccccgacgagau

SEQ ID NO: 547192 - RNA, 64 nt, Human Herpes Virus 2
cggcggggcugcuggagacgcccugcgcaugcugccccgcaaaagccggccccugggccaugcg

SEQ ID NO: 547193 - RNA, 64 nt, Human Herpes Virus 2
cacgcauauggccggggcgcccccgcgccucccgccccgcaaccccgcgccccccgagcagcgg

SEQ ID NO: 547194 - RNA, 64 nt, Human Herpes Virus 2
uggguucggcaagggcggcaccggccgcgggucgcgcccccaggacccgggggcgcgaccgcag

SEQ ID NO: 547195 - RNA, 64 nt, Human Herpes Virus 2
gguccgggugcgccgggaugacgggggcuaggaucgcccccaccgcauccgccggcacguaggc

SEQ ID NO: 547196 - RNA, 64 nt, Human Herpes Virus 2
accggcgcacggaugucgugaucacgggcacccgcgcccccagaccgauggccgggaccggggc

SEQ ID NO: 547197 - RNA, 64 nt, Human Herpes Virus 2
acgccaccaagcgcccgaagacgggcgugcccgccgcccccacgcgagccgagucgcccccccu

SEQ ID NO: 547198 - RNA, 64 nt, Human Herpes Virus 2
cggccccgcccgggggccaacugguguaugacagcgcccccaaccgaacggacccgcacgugau

SEQ ID NO: 547199 - RNA, 64 nt, Human Herpes Virus 2
gugcaagaugugcauucaccacaaucugccgcuccgcccccaggacccuaucaucggaacggcg

SEQ ID NO: 547200 - RNA, 64 nt, Human Herpes Virus 2
gcccguggcgcucggugcccccgguaugguauuccgcccccaaccccggguuucguggccugcg

SEQ ID NO: 547201 - RNA, 64 nt, Human Herpes Virus 2
uccgggagcgcugucugcccccacagacgcccgccgcccccagcgaccuaccacgcgucgcuuu

SEQ ID NO: 547202 - RNA, 64 nt, Human Herpes Virus 2
gccccacgcucccgccaggaauucuugggccgcucgcccccaacacgccucgcccccccgccca

SEQ ID NO: 547203 - RNA, 64 nt, Human Herpes Virus 2
cgauccaggacgucgcgccgcaccacgcccccgccgcccccagcaacccgggccugaucaucgg

SEQ ID NO: 547204 - RNA, 64 nt, Human Herpes Virus 2
ggggagggcucgcgggacguccgggcaccagguccgcccccacagcagcccggggccagacccg

SEQ ID NO: 547205 - RNA, 64 nt, Human Herpes Virus 2
gaccccgacguggcccgcccuccugccacgcucacgcccccacucucugauagcgaauaaagac

SEQ ID NO: 547206 - RNA, 64 nt, Human Herpes Virus 2
ccugacggaggccugugccgccgagcgcgucgugcgcccccaccagcugucccccgcggcccag

SEQ ID NO: 547207 - RNA, 64 nt, Human Herpes Virus 2
uuuuuuccauccucuacucgguccugcagcaccucgcccccagacuagcgggcggcgggagcga

SEQ ID NO: 547208 - RNA, 64 nt, Human Herpes Virus 2; identical to SEQ ID NO: 538902

SEQ ID NO: 547209 - RNA, 64 nt, Human Herpes Virus 2
ucccgaggaccccgcugcccucacgucgacuccgcgcccccaccggguccucgcccccacucuc

SEQ ID NO: 547210 - RNA, 64 nt, Human Herpes Virus 2
gcgggggggcgcgaggcguccgcggggccuuucccgcccccacgcuaccgacccacgggccagc

SEQ ID NO: 547211 - RNA, 64 nt, Human Herpes Virus 2
ggcugggcguccggagcggcgacccggggguccucgcccccacuccgggggucccagcgccacu

SEQ ID NO: 547212 - RNA, 64 nt, Human Herpes Virus 2
ccggccaaucuguacgcacguucuuuuccgaucacgcccccacacucgcgcgcccacccgaaca

SEQ ID NO: 547213 - RNA, 64 nt, Human Herpes Virus 2
gcgcgacaacgcacccccgccgcucccccgggcucgcccccacucgacccccgcggccccucgg

SEQ ID NO: 547214 - RNA, 64 nt, Human Herpes Virus 2
ccgcgggacaacgcccccgcagacuguccaccaccgcccccauuaccgacgucagccugggaga

SEQ ID NO: 547215 - RNA, 64 nt, Human Herpes Virus 2
cggacccuacaccggacccacgucaucgcacguccgcccccaaacgccaggccucgucgaccga

SEQ ID NO: 547216 - RNA, 64 nt, Human Herpes Virus 2
aggaggcccuggcgguggucaaugcgcuuuugcccgcccccaucacgcucgacgacgcccuaga

SEQ ID NO: 547217 - RNA, 64 nt, Human Herpes Virus 2
agggaugacggagaugauagcgugauugacgccccgcccccauacgagaguguggccggcgcga

SEQ ID NO: 547218 - RNA, 57 nt, Human Herpes Virus 2; identical to SEQ ID NO: 544925

SEQ ID NO: 547219 - RNA, 64 nt, Human Herpes Virus 4 (Epstein Barr virus)
uaggguuccauuauccuggagguauccuaagcuccgccccuauauaccagguggguggagcuag

SEQ ID NO: 547220 - RNA, 64 nt, Human Herpes Virus 4 (Epstein Barr virus)
gcacaaaccagucuacgaccuugaccacgacuagcgccccuauaaccacaacugcuauucugag

SEQ ID NO: 547221 - RNA, 64 nt, Human Herpes Virus 2; identical to SEQ ID NO: 538849

SEQ ID NO: 547222 - RNA, 64 nt, Human Herpes Virus 2; identical to SEQ ID NO: 538850

SEQ ID NO: 547223 - RNA, 64 nt, Human Herpes Virus 2; identical to SEQ ID NO: 538851

SEQ ID NO: 547224 - RNA, 64 nt, Human Herpes Virus 2; identical to SEQ ID NO: 538852

SEQ ID NO: 547225 - RNA, 64 nt, Human Herpes Virus 2; identical to SEQ ID NO: 538853

SEQ ID NO: 547226 - RNA, 64 nt, Human Herpes Virus 2; identical to SEQ ID NO: 538854

SEQ ID NO: 547227 - RNA, 64 nt, Human Herpes Virus 2; identical to SEQ ID NO: 538855

SEQ ID NO: 547228 - RNA, 64 nt, Human Herpes Virus 2; identical to SEQ ID NO: 538856

SEQ ID NO: 547229 - RNA, 64 nt, Human Herpes Virus 2; identical to SEQ ID NO: 538857

SEQ ID NO: 547230 - RNA, 64 nt, Human Herpes Virus 2; identical to SEQ ID NO: 538858

SEQ ID NO: 547231 - RNA, 64 nt, Human Herpes Virus 2; identical to SEQ ID NO: 538852

SEQ ID NO: 547232 - RNA, 64 nt, Human Herpes Virus 4 (Epstein Barr virus)
cgcuguggagcaccuggucuaugcggccuccuucucgcccaaccuucuugcccgcuaugccuac

SEQ ID NO: 547233 - RNA, 64 nt, Human Herpes Virus 2
gccgccugccccuaucccugcggccacacauuucuccggccaugagcgcgggacccccagcccg

SEQ ID NO: 547234 - RNA, 64 nt, Human Herpes Virus 4 (Epstein Barr virus)
gcaacgagagcaauacacaauuaggcuaaaagcagccaccuaucaauaaacuguuuaaacuaac

SEQ ID NO: 547235 - RNA, 64 nt, Human Herpes Virus 4 (Epstein Barr virus)
ggguccgugcggcuacaucuacuuuuacccccuggccaccuacccucuuagggagguggccaca

SEQ ID NO: 547236 - RNA, 64 nt, Human Herpes Virus 2; identical to SEQ ID NO: 537989

SEQ ID NO: 547237 - RNA, 64 nt, Human Herpes Virus 2; identical to SEQ ID NO: 537990

SEQ ID NO: 547238 - RNA, 64 nt, Human Herpes Virus 2; identical to SEQ ID NO: 537991

SEQ ID NO: 547239 - RNA, 64 nt, Human Herpes Virus 2; identical to SEQ ID NO: 537992

SEQ ID NO: 547240 - RNA, 64 nt, Human Herpes Virus 2; identical to SEQ ID NO: 537993

SEQ ID NO: 547241 - RNA, 61 nt, Human Herpes Virus 2
gcggggguguagccgucccccuccgguuggacacgcagagccugcuggccacguacgcaau

SEQ ID NO: 547242 - RNA, 61 nt, Human Herpes Virus 2
guauccgccgguggggcccuaccaccacccccacgcagacacggagacccccgcccaacca

SEQ ID NO: 547243 - RNA, 61 nt, Human Herpes Virus 2
gucgccggguguucgauccggcccagauacacacgcagacgcaggagaaccccgacggcuu

SEQ ID NO: 547244 - RNA, 61 nt, Human Herpes Virus 2
gcgaacuguucggggugcagcuggccaagagcacgcagacguuucccggggcggggcgcgu

SEQ ID NO: 547245 - RNA, 64 nt, Human Herpes Virus 1
guuuguggcgggcggcgaggcccggcuuccgcgucuuccacaaaacgaggaccccuuccucgcg

SEQ ID NO: 547246 - RNA, 64 nt, Human Herpes Virus 1; identical to SEQ ID NO: 547245

SEQ ID NO: 547247 - RNA, 64 nt, Human Herpes Virus 2
ggcccucgcccgucgccgccgguccaggcggucccaggaugacuacggggcgguggugguggcg

SEQ ID NO: 547248 - RNA, 64 nt, Human Herpes Virus 1
ggucggccgccucgcgccucgugcggcuuaucaucaacaugaagggcaugcgccacguaggcga

SEQ ID NO: 547249 - RNA, 64 nt, Human Herpes Virus 1
cgcugacccacacgcugcuuuccaccgccguuaacaacaugaugcugcgggaccgcuggagccu

SEQ ID NO: 547250 - RNA, 64 nt, Human Herpes Virus 1
uccagaccaccggucgucccucgcaugaagcccccaacaugacccagaccggcaccaccgacuc

SEQ ID NO: 547251 - RNA, 64 nt, Human Herpes Virus 1
ggaggauguguuuucguggacucguuauugcacccccgacgaggugcgcgugguuaucaucggc

SEQ ID NO: 547252 - RNA, 64 nt, Human Herpes Virus 1
cgccccccguucucucggcccuguucugugccaccccgacgagcuccucauuccggcugccggg

SEQ ID NO: 547253 - RNA, 64 nt, Human Herpes Virus 1
auuguacgccaagauacaacacccgcggcaccugcccgacgacgaucccaucuaugacaccguu

SEQ ID NO: 547254 - RNA, 64 nt, Human Herpes Virus 1
uggucggggggauguuguccgcgccgcaccgucccccgacgaccucuugcagacgguccgugau

SEQ ID NO: 547255 - RNA, 64 nt, Human Herpes Virus 1
gcugcuccuccggggagaugggggggucggacgccccgacgaugggcgggucugcgggcgcccc

SEQ ID NO: 547256 - RNA, 64 nt, Human Herpes Virus 1
guacacacagcgccacggccuguacgucccucggcccgacgacccagucuuggccgaugccauc

SEQ ID NO: 547257 - RNA, 64 nt, Human Herpes Virus 1
cucccuccugacguacgccgggccuauaaaagcgcccgacgacgccgccgccccgcagaccccg

SEQ ID NO: 547258 - RNA, 64 nt, Human Herpes Virus 1
ggggacggaaacggaugcgucggugucggacgaccccgacgacacguccgacuggucuuaugac

SEQ ID NO: 547259 - RNA, 64 nt, Human Herpes Virus 1
gcggagggacuuuugcgcccgcgcccugcuggagcccgacgacgacgcccccccgcuggugcug

SEQ ID NO: 547260 - RNA, 64 nt, Human Herpes Virus 1
acuggggccgcgggacgggggcccggacgauuuucccgacgacgaccucgacguuauuuucgcg

SEQ ID NO: 547261 - RNA, 64 nt, Human Herpes Virus 1
cgcccccccgaccgccgguuggggcccggcggcacccgacgacggagcuggacaucacgcaccu

SEQ ID NO: 547262 - RNA, 64 nt, Human Herpes Virus 1
gggcgcggcggacgcgcccaagggcggcgcgggccccgacgacgacggggaccgugucgccgua

SEQ ID NO: 547263 - RNA, 64 nt, Human Herpes Virus 1
ggacgcccuaauaaucggcggucaggccacgucacccgacgaucagaucgaggcgcucauccgc

SEQ ID NO: 547264 - RNA, 64 nt, Human Herpes Virus 1
cuggguucuguucggccauccccccgccacccaucccgacgagcugcugcuccacaaggccaag

SEQ ID NO: 547265 - RNA, 64 nt, Human Herpes Virus 1
cacugcaguacgcgcucugcuguaccagcgcgcccccgacgaccggcgcgcugcugaugugucc

SEQ ID NO: 547266 - RNA, 64 nt, Human Herpes Virus 1
cccccccugccaaaaccaaggcgcgucgcccuaccccgacgacgacccccgucggggccgcggu

SEQ ID NO: 547267 - RNA, 64 nt, Human Herpes Virus 1
ccgcccgugcgccgucgacgggaaggcccgcgagcccgacgacggcgcgcgucggaagccccgc

SEQ ID NO: 547268 - RNA, 64 nt, Human Herpes Virus 1
ucguucgaccgaacagccguccggggcuuuggcgcccgacgaccagcgacgaacgcaaaacucg

SEQ ID NO: 547269 - RNA, 64 nt, Human Herpes Virus 1; identical to SEQ ID NO: 547259

SEQ ID NO: 547270 - RNA, 60 nt, Human Herpes Virus 1
acgcggcggucgggggccuuaaccgcgaccccgucgaagccgccaauccguacggggcgu

SEQ ID NO: 547271 - RNA, 64 nt, Human Herpes Virus 4 (Epstein Barr virus)
gaccccagggucuccaggcaggguccggcaucuucaggggcagcaggcucaccaccacaggccc

SEQ ID NO: 547272 - RNA, 64 nt, Human Herpes Virus 4 (Epstein Barr virus)
cacccucggggcccaggccccagaguccagaggucaggggcaccucagggugccuccccggguc

SEQ ID NO: 547273 - RNA, 64 nt, Human Herpes Virus 4 (Epstein Barr virus); identical to SEQ ID NO: 547271

SEQ ID NO: 547274 - RNA, 64 nt, Human Herpes Virus 4 (Epstein Barr virus); identical to SEQ ID NO: 547272

SEQ ID NO: 547275 - RNA, 64 nt, Human Herpes Virus 4 (Epstein Barr virus); identical to SEQ ID NO: 547271

SEQ ID NO: 547276 - RNA, 64 nt, Human Herpes Virus 4 (Epstein Barr virus); identical to SEQ ID NO: 547272

SEQ ID NO: 547277 - RNA, 64 nt, Human Herpes Virus 4 (Epstein Barr virus); identical to SEQ ID NO: 547271

SEQ ID NO: 547278 - RNA, 64 nt, Human Herpes Virus 4 (Epstein Barr virus); identical to SEQ ID NO: 547272

SEQ ID NO: 547279 - RNA, 64 nt, Human Herpes Virus 4 (Epstein Barr virus); identical to SEQ ID NO: 547271

SEQ ID NO: 547280 - RNA, 64 nt, Human Herpes Virus 4 (Epstein Barr virus); identical to SEQ ID NO: 547272

SEQ ID NO: 547281 - RNA, 64 nt, Human Herpes Virus 4 (Epstein Barr virus); identical to SEQ ID NO: 547271

SEQ ID NO: 547282 - RNA, 64 nt, Human Herpes Virus 4 (Epstein Barr virus); identical to SEQ ID NO: 547272

SEQ ID NO: 547283 - RNA, 64 nt, Human Herpes Virus 4 (Epstein Barr virus); identical to SEQ ID NO: 547271

SEQ ID NO: 547284 - RNA, 64 nt, Human Herpes Virus 4 (Epstein Barr virus); identical to SEQ ID NO: 547272

SEQ ID NO: 547285 - RNA, 64 nt, Human Herpes Virus 4 (Epstein Barr virus); identical to SEQ ID NO: 547271

SEQ ID NO: 547286 - RNA, 64 nt, Human Herpes Virus 4 (Epstein Barr virus); identical to SEQ ID NO: 547272

SEQ ID NO: 547287 - RNA, 64 nt, Human Herpes Virus 4 (Epstein Barr virus)
aaggccagagccggggacagagcagggggaggggcaggggcaggggcaggggcaggggcaaggg

SEQ ID NO: 547288 - RNA, 64 nt, Human Herpes Virus 4 (Epstein Barr virus)
agagccggggacagagcagggggaggggcaggggcaggggcaggggcaggggcaagggcaaguc

SEQ ID NO: 547289 - RNA, 64 nt, Human Herpes Virus 4 (Epstein Barr virus)
ggggacagagcagggggaggggcaggggcaggggcaggggcaggggcaagggcaaguccaggga

SEQ ID NO: 547290 - RNA, 64 nt, Human Herpes Virus 4 (Epstein Barr virus)
agagcagggggaggggcaggggcaggggcaggggcaggggcaagggcaaguccagggacaagca

SEQ ID NO: 547291 - RNA, 64 nt, Human Herpes Virus 4 (Epstein Barr virus)
aaguggagagaugcuccggggcgcauguguucuccaggggcagcucccaaccccucugcaccgu

SEQ ID NO: 547292 - RNA, 64 nt, Human Herpes Virus 4 (Epstein Barr virus)
gcacucucccgucguuaucuuggagaaugucggccaggggcaacagcagacucuggagugcgga

SEQ ID NO: 547293 - RNA, 64 nt, Human Herpes Virus 4 (Epstein Barr virus)
uggccccgccuuugagguccugagagacaugcaccaggggcagcuauggaccaccaaugugauc

SEQ ID NO: 547294 - RNA, 64 nt, Human Herpes Virus 4 (Epstein Barr virus)
ccguuaaagacauccgucaaggguccuaacuggucaggggcagcuggaggcaugaaacggaagc

SEQ ID NO: 547295 - RNA, 64 nt, Human Herpes Virus 4 (Epstein Barr virus)
gcccccucaguucuuaccccaaccgguagugacucaggggcaggugaggaagaugacgacggcc

SEQ ID NO: 547296 - RNA, 64 nt, Human Herpes Virus 1
ccgcaaacuuccaggucgaaauccagacucgggcucaugccaccggcgacuguaccccguggug

SEQ ID NO: 547297 - RNA, 64 nt, Human Herpes Virus 2
ccggcacgugcgcgcccagcugaacauccgcgaguacguaaagcaaaacgucacccccagggaa

SEQ ID NO: 547298 - RNA, 64 nt, Human Herpes Virus 2; identical to SEQ ID NO: 547049

SEQ ID NO: 547299 - RNA, 64 nt, Human Herpes Virus 2; identical to SEQ ID NO: 547050

SEQ ID NO: 547300 - RNA, 64 nt, Human Herpes Virus 2; identical to SEQ ID NO: 547051

SEQ ID NO: 547301 - RNA, 64 nt, Human Herpes Virus 2; identical to SEQ ID NO: 547052

SEQ ID NO: 547302 - RNA, 64 nt, Human Herpes Virus 2; identical to SEQ ID NO: 547053

SEQ ID NO: 547303 - RNA, 64 nt, Human Herpes Virus 2; identical to SEQ ID NO: 547054

SEQ ID NO: 547304 - RNA, 64 nt, Human Herpes Virus 2; identical to SEQ ID NO: 547055

SEQ ID NO: 547305 - RNA, 64 nt, Human Herpes Virus 2; identical to SEQ ID NO: 547056

SEQ ID NO: 547306 - RNA, 64 nt, Human Herpes Virus 2; identical to SEQ ID NO: 547057

SEQ ID NO: 547307 - RNA, 64 nt, Human Herpes Virus 2; identical to SEQ ID NO: 547058

SEQ ID NO: 547308 - RNA, 64 nt, Human Herpes Virus 2; identical to SEQ ID NO: 547059

SEQ ID NO: 547309 - RNA, 64 nt, Human Herpes Virus 2; identical to SEQ ID NO: 547060

SEQ ID NO: 547310 - RNA, 64 nt, Human Herpes Virus 2; identical to SEQ ID NO: 547061

SEQ ID NO: 547311 - RNA, 64 nt, Human Herpes Virus 2; identical to SEQ ID NO: 547062

SEQ ID NO: 547312 - RNA, 64 nt, Human Herpes Virus 2; identical to SEQ ID NO: 547063

SEQ ID NO: 547313 - RNA, 64 nt, Human Herpes Virus 2; identical to SEQ ID NO: 547064

SEQ ID NO: 547314 - RNA, 64 nt, Human Herpes Virus 2; identical to SEQ ID NO: 547065

SEQ ID NO: 547315 - RNA, 64 nt, Human Herpes Virus 2; identical to SEQ ID NO: 547066

SEQ ID NO: 547316 - RNA, 64 nt, Human Herpes Virus 2; identical to SEQ ID NO: 547067

SEQ ID NO: 547317 - RNA, 64 nt, Human Herpes Virus 2; identical to SEQ ID NO: 547068

SEQ ID NO: 547318 - RNA, 64 nt, Human Herpes Virus 2; identical to SEQ ID NO: 547051

SEQ ID NO: 547319 - RNA, 64 nt, Human Herpes Virus 2; identical to SEQ ID NO: 547050

SEQ ID NO: 547320 - RNA, 64 nt, Human Herpes Virus 2; identical to SEQ ID NO: 547049

SEQ ID NO: 547321 - RNA, 60 nt, Human Herpes Virus 1
uagagccuuugauacucuagcaugagccccccgucgaagcugaugucccucauuuuacaa

SEQ ID NO: 547322 - RNA, 60 nt, Human Herpes Virus 1
aaauggccagccgcccagccgcauccucucccgucgaagcgcgggccccgguugggggac

SEQ ID NO: 547323 - RNA, 60 nt, Human Herpes Virus 2
cuuucuggccucccuggucgugcuggccgaccgccacagcaccccccuccaggaccuccu

SEQ ID NO: 547324 - RNA, 64 nt, Human Herpes Virus 1
agaagcggacacaggcuagcaucccccuggaccgccaggguacacugggccaucuuggcccaca

SEQ ID NO: 547325 - RNA, 64 nt, Human Herpes Virus 1
ccgccgacauuacguucacggccuucgaagccagccaggguaagaccccgcggggcgggcgcga

SEQ ID NO: 547326 - RNA, 64 nt, Human Herpes Virus 1
agggaacccagaguaccgcgagcucccagagaccccaggguaccgcgugaccccagggauccac

SEQ ID NO: 547327 - RNA, 64 nt, Human Herpes Virus 4 (Epstein Barr virus)
gagcaagagcgcccagagccccaagggcccccagggugccuagagcaccgaggucuccaagagc

SEQ ID NO: 547328 - RNA, 64 nt, Human Herpes Virus 4 (Epstein Barr virus)
agacacauucgggugaaggcucgacgcgggcccgggugccuacugauggccaucuuucaggggg

SEQ ID NO: 547329 - RNA, 64 nt, Human Herpes Virus 4 (Epstein Barr virus)
accaggugacagucaccgccagauacuucagaagggugccuagccaguccaccugagugcgagg

SEQ ID NO: 547330 - RNA, 60 nt, Human Herpes Virus 1
cggcgcuugccguccccccaaaguuucgaaccgucgaaccaugccaccgccccccgcccc

SEQ ID NO: 547331 - RNA, 64 nt, Human Herpes Virus 1
caagaucggacugcgggugugcaugcccguccccgccccguacgucguccacgguucucuaacg

SEQ ID NO: 547332 - RNA, 64 nt, Human Herpes Virus 1
ggagggcaucgcgguggucuucaaggagaacaucgccccguacaaguucaaggccaccauguac

SEQ ID NO: 547333 - RNA, 64 nt, Human Herpes Virus 2; identical to SEQ ID NO: 545953

SEQ ID NO: 547334 - RNA, 64 nt, Human Herpes Virus 2; identical to SEQ ID NO: 545954

SEQ ID NO: 547335 - RNA, 64 nt, Human Herpes Virus 2; identical to SEQ ID NO: 545955

SEQ ID NO: 547336 - RNA, 64 nt, Human Herpes Virus 4 (Epstein Barr virus)
auaggcuuuuuuugugaaaacccggggaucggacuagccuuagaguaacucaaggccaagcauu

SEQ ID NO: 547337 - RNA, 64 nt, Human Herpes Virus 4 (Epstein Barr virus)
acggaacucauauaacuaacggggguuacaauuauagccuuacccuagaauggguaaaugacuc

SEQ ID NO: 547338 - RNA, 62 nt, Human Herpes Virus 4 (Epstein Barr virus)
gggaggaggcguccgccccgaugcggaggacugcauccaacgcuuccacccccuggagccag

SEQ ID NO: 547339 - RNA, 63 nt, Human Herpes Virus 1
gccgaggacagcagcggagggcgggcgcgucgcccgccccacgccacggaguucucguaggag

SEQ ID NO: 547340 - RNA, 63 nt, Human Herpes Virus 1
aggcccuggugagcggccuguuugacggcauccccgccccacgccagccacuugacgcccaca

SEQ ID NO: 547341 - RNA, 63 nt, Human Herpes Virus 1
cgcggcuggccgcccuccgcgagcuagacgccgccgccccaggggacgagcccgccccccccg

SEQ ID NO: 547342 - RNA, 63 nt, Human Herpes Virus 1
accuccggucccgauggccgucccgcaauuucaccgccccagcaccguuaccaccgauagcgu

SEQ ID NO: 547343 - RNA, 63 nt, Human Herpes Virus 1
uguugggccuuauccacaugaagccacuguuuuccgccccaccccccgacgccagcuuuccgc

SEQ ID NO: 547344 - RNA, 63 nt, Human Herpes Virus 1
acccaagaacaacaccacccccgccaagucgggccgccccacuaaaccccccgggcccgugug

SEQ ID NO: 547345 - RNA, 63 nt, Human Herpes Virus 1
cucccgaccuagaggagguccugacgaacaucaccgccccacccgggggacuccugguguacg

SEQ ID NO: 547346 - RNA, 63 nt, Human Herpes Virus 1
aaccacccggggggcugcgaguccugcgccccgccgccccacaucgauuccgccaacgcacug

SEQ ID NO: 547347 - RNA, 63 nt, Human Herpes Virus 1
gauuuuuuugucaguucggcauacucgcgucuuccgccccauacccagccggucuuuucaaag

SEQ ID NO: 547348 - RNA, 63 nt, Human Herpes Virus 1
gaggauuggggacagcuuucgggggcggccgugccgccccagggugccgagccccagagcaac

SEQ ID NO: 547349 - RNA, 63 nt, Human Herpes Virus 1
gcgcgcccgucgucguggcggcccgguuucccgccgccccacuccgcgagucggagcuggagc

SEQ ID NO: 547350 - RNA, 63 nt, Human Herpes Virus 1
aacgccaaggcggugacccucgcgcccgggcguccgccccaccuuaacccauacacccccgag

SEQ ID NO: 547351 - RNA, 63 nt, Human Herpes Virus 1
guacauguucuuuaugcgcccggcggacccaagccgccccagcaccgacaccgcacugcggcu

SEQ ID NO: 547352 - RNA, 63 nt, Human Herpes Virus 1; identical to SEQ ID NO: 547339

SEQ ID NO: 547353 - RNA, 63 nt, Human Herpes Virus 1; identical to SEQ ID NO: 547340

SEQ ID NO: 547354 - RNA, 63 nt, Human Herpes Virus 1; identical to SEQ ID NO: 547341

SEQ ID NO: 547355 - RNA, 63 nt, Human Herpes Virus 1; identical to SEQ ID NO: 547342

SEQ ID NO: 547356 - RNA, 63 nt, Human Herpes Virus 1; identical to SEQ ID NO: 547343

SEQ ID NO: 547357 - RNA, 63 nt, Human Herpes Virus 1; identical to SEQ ID NO: 547344

SEQ ID NO: 547358 - RNA, 63 nt, Human Herpes Virus 1; identical to SEQ ID NO: 547345

SEQ ID NO: 547359 - RNA, 63 nt, Human Herpes Virus 1; identical to SEQ ID NO: 547346

SEQ ID NO: 547360 - RNA, 63 nt, Human Herpes Virus 1; identical to SEQ ID NO: 547347

SEQ ID NO: 547361 - RNA, 63 nt, Human Herpes Virus 1; identical to SEQ ID NO: 547348

SEQ ID NO: 547362 - RNA, 63 nt, Human Herpes Virus 1; identical to SEQ ID NO: 547349

SEQ ID NO: 547363 - RNA, 63 nt, Human Herpes Virus 1; identical to SEQ ID NO: 547350

SEQ ID NO: 547364 - RNA, 63 nt, Human Herpes Virus 1; identical to SEQ ID NO: 547351

SEQ ID NO: 547365 - RNA, 64 nt, Human Herpes Virus 2
ccuguuuccccggugccgcccuccccgagaucgaccgacagacaaacacagccagacgcgagug

SEQ ID NO: 547366 - RNA, 64 nt, Human Herpes Virus 2
cgcccccggccgcgguuuccgagcccacugcggcccgacagaaacuguuggcccugcucgggca

SEQ ID NO: 547367 - RNA, 64 nt, Human Herpes Virus 4 (Epstein Barr virus); identical to SEQ ID NO: 544316

SEQ ID NO: 547368 - RNA, 64 nt, Human Herpes Virus 4 (Epstein Barr virus); identical to SEQ ID NO: 544317

SEQ ID NO: 547369 - RNA, 65 nt, Human Herpes Virus 4 (Epstein Barr virus)
agauguuuuacacgaggaucucuuaaauuucuaacucccguuauugaaaccacgccugcuucacg

SEQ ID NO: 547370 - RNA, 65 nt, Human Herpes Virus 4 (Epstein Barr virus)
auauucccccaccccucaaagcccaccuuucuuccucccguuaaaaggaagaagggccucaggga

SEQ ID NO: 547371 - RNA, 65 nt, Human Herpes Virus 4 (Epstein Barr virus)
agcgcggcccccgggguuugcccaacucuuauucuucccguuaacaggaagaaugaugguggggg

SEQ ID NO: 547372 - RNA, 65 nt, Human Herpes Virus 4 (Epstein Barr virus)
ccaccugugcucguauaguaagcuggaguuccaucucccguuaccugagagcauggccuccgugu

SEQ ID NO: 547373 - DNA, 335 bp, Human immunodeficiency virus type 1
ggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagag

SEQ ID NO: 547374 - DNA, 163 bp, Human immunodeficiency virus type 1
acagggctgctattaacaagagatggtggtaatagcaacaatgagtccgagatcttcagacctggaggaggagatatgagggacaattggagaagtgaattatataaatataaagtagtaaaaattgaaccattaggagtagcacccaccaaggcaaagagaa

SEQ ID NO: 547375 - DNA, 200 bp, Human immunodeficiency virus type 1
tgggaagccctcaaatattggtggaatctcctacagtattggagtcaggaactaaagaatagtgctgttagcttgctcaatgccacagccatagcagtagctgaggggacagatagggttatagaagtagtacaaggagcttgtagagctattcgccacatacctagaagaataagacagggcttggaaaggattttgct

SEQ ID NO: 547376 - DNA, 24 bp, Human immunodeficiency virus type 1
tgagtccgagatcttcagacctgg

SEQ ID NO: 547377 - DNA, 24 bp, Human immunodeficiency virus type 1
tgaggggacagatagggttataga

SEQ ID NO: 547378 - DNA, 179 bp, Homo sapiens
gtcatgaagtgtagttggtgagaaggtcacagatcctgaaaggtaaaaagaagtgcaaagggaataggagagagaagatggagatgctgcagggttacatcggttctcttcccagtattccctttctgtgtccctaatcttccagcctctgtaatcttggcagttctctaccttcagat

SEQ ID NO: 547379 - DNA, 179 bp, Homo sapiens
gaggatgactatcacatgcttagtacatatactatgtcaggtattgtgctgatattatatgcacatgaattttgttcatctgcatgtaatattgaatattgaatctagttcatgtgtatataatattagcataatgcctgacataatgtatgtactaagcatatgacagtgattaactc

SEQ ID NO: 547380 - DNA, 179 bp, Homo sapiens
ggctatccctggagcataggagtaggattttatcccccagcttcggcctccccaggcagcacttcctttctgtgctttgactccaatttggatggtgctcaggcgggaagtaggctggggtgggaggagtttaggggaatatttgtcttctctcctgttttgccctagagattctggcc

SEQ ID NO: 547381 - DNA, 179 bp, Homo sapiens
tttgacttcccatctgacttgggtgcgttgttgaagctctcagcacctccagctcaccatctgcaggatagatcatcagaatgtaacagaccatttattctgatgaccttgttttattgatgtagaaattgaggccctgaaagtaaagcaatgttcccaaggtcacagcatgagttaga

SEQ ID NO: 547382 - DNA, 178 bp, Homo sapiens
tccccttggtggtctgtgtgctgtcctgcatggggtcggcagctctgctcagcgctgtaacaaatttaaaaaaaactaaagtttgaattaattagttttttttcaacttgttacagcagcgaatggagctgccgtggttcggtgtagactgcagcacagtgaaggagcgccgaggaga

SEQ ID NO: 547383 - DNA, 178 bp, Homo sapiens
ttcttcccttggacactcccttctaggaacagggtgagctggagagaggcaacagagcaggagcagggagcactgagggtggctccgcctgagggtacagcacacgtccagggctgtctgcacactatttctccctctcttctcactcccaatttagaacaagtgcccaggggaagaa

SEQ ID NO: 547384 - DNA, 178 bp, Homo sapiens
tgaatcctgtggctctgtgatggctttacaccatttaattgtcacagcagccctgtgaggtgtttctgttttatagctgagaatactggaatcagagaggttcaggaatatctcatagggctgttgtgacagttgaacggtgtaaagctctcagcacagtgtctctaataggggctca

SEQ ID NO: 547385 - DNA, 177 bp, Homo sapiens
tggtttcagctggccctgcgggggactgccccatctccccagggaggaaagagggtctggagatagccccgggtgggggaggtcaacctgcagatcccggcttggggacagctccagatgacacctcgtgagccgcctggggtggaggggcccccagtgcagggctgcgtggcccca

SEQ ID NO: 547386 - DNA, 177 bp, Homo sapiens
gttctgctagaggctggctgagagacctgggacagtcccttgcccatagtcctgaccagtgcccttctctgaggttcttgtgatgcaccaatgagatgagacacctgagatgaaggcatttggcaaggtgggcagggggtctgtgaggcctctgggtcagccacaggctggcaggat

SEQ ID NO: 547387 - DNA, 176 bp, Homo sapiens
ggtttagtccggttgtgactggccacagccagtttacactggtttagacaagctgcaaccagatttgaatggttttgactagccatgactgacttaggctttgactggtttgaaccattcttggttggatgcaacttgtttagaccagttttggctggccacaactggattagact

SEQ ID NO: 547388 - DNA, 176 bp, Homo sapiens
gcacttcctccgttttgctggttgtagaatgagtgctctcattttacttaaaatgagttaattttttaatgatgtgtgcttcttctatctttggggaatgtacatcatgataaattaagtagtttaaaataaatttgtgagtactcatcccacgaccgctagtttggggttggtgt

SEQ ID NO: 547389 - DNA, 176 bp, Homo sapiens
ttccgtagccagctggagaaggagaaatgcagagtgaaaaggagaaagaagaactggacaaaattaaaatgctcttctgtcattgtaatagttcatatgggcactgacaggagagcattttgactttgtcaagtgtgtctgctactcatttattccatctcctgcttgttaccgaa

SEQ ID NO: 547390 - DNA, 176 bp, Homo sapiens
attcacgtatagacactgaaagttctgcgtccactcagttctcttccctataggcaatgatgctattaatttttataaaatatctttggaagaataaacaaaaagtaaatagcatcattacctgtagggaagagaactaagtggatataaaaattttccattttttttatgtggat

SEQ ID NO: 547391 - DNA, 176 bp, Homo sapiens
aaacaggtgtatccatgaggtaatgaaatgcaggttgctcctctgctacagtggtgtggagggtcatgttcaggatcacaggtagaaactgtctctgtgcagaatgatcctttccacccagtggtacaattgcagctgtgggttgagagaaagccgcatggtttgagcacttgttt

SEQ ID NO: 547392 - DNA, 175 bp, Homo sapiens
gcaggatgaggggtagggagggacgaagtgcaagccttggcggagcgcaaggtgcggccaagcagggagtcagagcccctagccccgagagggctcccgtgccctccccagctcactccccgctccgtgcctagctctgcgctcccgcggcgcccccagaccgccccttacctgt

SEQ ID NO: 547393 - DNA, 175 bp, Homo sapiens
cctcacaccctcccccttgctcgctctgcttcagccacaccaactcatctctgtttctcaaatacaccaggcatggcctagctattaaatgcacggtccagcctggtgcatttgaagaacacggatgaattggtgtggctggaacagagtgagtgagggggagagcgggaggagg

SEQ ID NO: 547394 - DNA, 175 bp, Homo sapiens
tttttctctgtgctggactgctctgaccttttcaatattctataatttgactggctggccatttcagttctctcctttttacagccttattaacttgtgggaaagaggtgacatgaacaaccaatcagaatacataatattgcaaaggtcagcgtagtcctgtacagtatcataa

SEQ ID NO: 547395 - DNA, 174 bp, Homo sapiens
cagggcagatgcctcaggtttaaagtcacatcaaaccgagtgtgaaccttctgtaactcgcaactgtgctaacttttggaggtttcttgaaaaattctagtcagtttgggttaaagaatggtttcagtaatgtcacactcagggtcatgactgctcaactggtcattagccctg

SEQ ID NO: 547396 - DNA, 174 bp, Homo sapiens
gccccgcagccaatcagcagcggccggggcggtgcaatgacctcaccggttctactctcttacccctcccccacgtggttgttgctgccggtagacggagtagggaagtttggattgggggaggggaggagaaccagtgatgtcacctttccccttgttgattggctgccgggt

SEQ ID NO: 547397 - DNA, 174 bp, Homo sapiens
agggtggctgtgctgatgaaaggcagagatggccgcggatgtctgcatgaatcacacagggctgtgcagcagccaaaagtctcttcaatctctgtgattcatgcagatgccaatggccattctttgtccctctctattcattttattcatccaataagcatttgtcaacgccct

SEQ ID NO: 547398 - DNA, 174 bp, Homo sapiens
ttgtaggaaatgcatgaaaaattattagtgataggaaaaaagacctctgggaccttatatgtcagttataaaagacagattgttaaaactataaatttatctctcgtggaactgacatccaaggttccagagcctttttcccttcactgaggattttttacgtaattcctacag

SEQ ID NO: 547399 - DNA, 174 bp, Homo sapiens
ggcccctcgcgcccggcccctcggtttcccggctccttggccccccggttccccagctccccggcgcgccttcccgcgggtgaggcttgggctccgacgcgggccaggcggcccgggagcattgccggggagggcctgggggccgtgggctggaggggcgggcgggaaggggcc

SEQ ID NO: 547400 - DNA, 173 bp, Homo sapiens
ctgaacatacaatgggctgtgacactggataaatcatttgtttccacttgttattgatgacatttcataactcatttggggctctgctttgccccgtcactcgtgagttatgaggttatcaatcatgactgggaataaatgatttatgtaagttgccctattgtatattttag

SEQ ID NO: 547401 - DNA, 172 bp, Homo sapiens
cctcccgctctccccctcactcactctgttccagccacaccaattcatccgtgttcttcaaatgcaccaggctggaccgtgcatttaatagctaggccatgcctggtgtatttgagaaacagagatgagttggtgtggctgaagcagagcgagcaagggggagggtgtgagg

SEQ ID NO: 547402 - DNA, 172 bp, Homo sapiens
ttgcttagtgaatttctgccatctaactaaaaaaaattctgtttatcaccagatcctagaaccctatcaatattgtctctgctgtgtaaatagttctgagtagtgcaatattgcttatagggttttggtgtttggaaagaacaatgggcaggctgcagaaagtatgtagcag

SEQ ID NO: 547403 - DNA, 171 bp, Homo sapiens
aggatcactttaatatcatccagatgcaaataacttatttcattagccacatcctcctgaacaaactgtgcaataagtctagacttttgtataaagcattgcagagtttgttcgggagaatatggttactgaaagaagttatatgcatctggatgatgttaaagttatcct

SEQ ID NO: 547404 - DNA, 171 bp, Homo sapiens
gtggatggcccactgcccatctggacacccttcctatgccagctgatcccctaagccctaggcttccatcatatcactgaccaaagcatagggcagtttgagtgggggtcagaggcctggggggtctctggctggaaggacttggtagtcttttctaaggtgggtctacac

SEQ ID NO: 547405 - DNA, 171 bp, Homo sapiens
tgacaaaagcaaggaaattcacagttaaaggggaaacgtgccatatgttcttcaatacctaagagcaacggggtgcatttggaaagtcattaaagcggcacccagttgtgcctaggtattggagaacatatggaatcttttcctccgcgagtgtaattttccctgctctca

SEQ ID NO: 547406 - DNA, 171 bp, Homo sapiens
tttctataatggtgctttagcaataatgatggaggtgcaggcatttcctgaggattaatgaccagctgggaggaaccagtggcccttggctctgcctcccagccagccattaattctaaggaaatgtcttttgctgaggtcgttactgctattataagcttaaaatggaaa

SEQ ID NO: 547407 - DNA, 171 bp, Homo sapiens
cataggtgcttcccacctaaacatcagttatgaggactttttctctgcccttcatcaacatgcagcctgtgaacagtgtctgggaaagtagtggtcattggttgcgtaatttgattttaggcttatggagaaaaggacccaagtgactctgatgtttacaaagcacctatg

SEQ ID NO: 547408 - DNA, 171 bp, Homo sapiens
tttataatgaacagaacaaaaacgttccaacacacatgttcattactattttctgaaggcataatgtcaaagtaaaaatttttctgttacactgaattttattttggcattatgccatcaaaatataataaagaacatgtgttggaaactccttgctttactcattataaa

SEQ ID NO: 547409 - DNA, 171 bp, Homo sapiens
gcacaggagcagggctttccaaacggcacggatgacgggatctttggatgactgtgccgtgtgatttattctgggatttactagctggcttgtaaatcccaggaagagtagacaggctttcttaagtctaacttaatcccagtgcatgaaagccactgtgagctcctgtgt

SEQ ID NO: 547410 - DNA, 169 bp, Homo sapiens
gcagcagctccagccccacaaatagatgccagtacagtagcccctcggatcacaggaggtatttttggtgctggaagccagccacactttggcaggctttcagcatcaagtctgttccctttagaggcggggggtggcaagctatcagtgtttagcatgggaatgctgc

SEQ ID NO: 547411 - DNA, 169 bp, Homo sapiens
ggctgagggacgggtgtcttcagggaaatactacattttaaagggaagatttttttttttacttttcagagaatttcaaatcttggcactaaagagggggaaaaaggtatgtcttttctttgaaatactggcttttttttttctgaaaagaccaccctctccccaagcc

SEQ ID NO: 547412 - DNA, 169 bp, Homo sapiens
ggataactttaacatcatccagatgcatataacttctttcagtaaccatattctcccgaacaaactctgcaatgctttatacaaaagtctagacttattgcacagtttgttcaggaggatgtggctaatgaaataagttatttgcatctggatgatattaaagtgatcc

SEQ ID NO: 547413 - DNA, 169 bp, Homo sapiens
gagccagggcaggccttgagttgaaaatgtttcctgcctctccccggtggctctgtacctggtagaaggagggaagaggctgcaggttccccattccctgttttctcctttcctgccctctggcagctgccaaactcggggtgggcggggaggcctttgccctgcgctc

SEQ ID NO: 547414 - DNA, 168 bp, Homo sapiens
ggccctgagggctggctttggctgagacaggtgcagggaaggtgagaagcaggctgaggagcacagagagggagtctgtgtcttgatttcctttcttgtttacttcttttgtgtcctttcccaccctcgtcaccctggcctcagtcttcattgagtcttccctgggcc

SEQ ID NO: 547415 - DNA, 168 bp, Homo sapiens
ggaggctataaaatcccctgagaatgcaagggtaagcttctacctcctggccgaattctcacccacagaagtagacactgctgctgttgaatctacttctgtgagtgagaattcagccaggagaatccaaagtgctcttcgtatgaactttgggagacccatgcctcc

SEQ ID NO: 547416 - DNA, 168 bp, Homo sapiens
ttttaatattacacatacaatcattttacagtgtggaggttaattccgctcacaaaagtgcatgaaaggaattaaaggaaacaatttgaacattttaattcttttcatatatttcaaggggaggaattaggcaccaaaacacaaaacaattatatgtgtaatttaaaa

SEQ ID NO: 547417 - DNA, 168 bp, Homo sapiens
attattagcatcttgcagtttgtgagccaactgaggcattagaagtcaagtaacttgctcaaggtttcatgtaatagcaaatactgtcatagctatgtgagaccttgagcaagtcacttgatctctaatgcctcaactgacacattgctaatataagatactaataat

SEQ ID NO: 547418 - DNA, 168 bp, Homo sapiens
ctgggatttcaggcgtgagccaccatgcctggccttaacttcttcctttctgatttggatgccttttatttctttgtcctgcctaattgctctgacaagaggaagggaaggcggccaataagagtccatgaccaggccagacatgatggctcacacctgtaatcccag

SEQ ID NO: 547419 - DNA, 168 bp, Homo sapiens
tggtgtttctggtgtctgtcatgacgaagtgggctgggagatgggacatcctacatatgcaaccagccagccccctcttatatgaaatagggatttcctggcagcactatgcaggatgttcaacctcccggcccatgcgaagatgaactgctgcaccatgaagttcca

SEQ ID NO: 547420 - DNA, 167 bp, Homo sapiens
gggtgacagagctgtctccatggcctggcactggttttcatcctggtattagaaatgcatcagtgctccctggggaaggggccagtttcaccagctcctgccccatgagctgtgaaaatgcacattctaagaaggagccaggcagggcctgagtccctctgtgaccc

SEQ ID NO: 547421 - DNA, 167 bp, Homo sapiens
agcatgaccaagtttaaacacagggacaagggcgctaaacatacttcactgcacaagacatcctgctgctgttgctccaggctcttgggagttgctaggggtgggcttgtctggaggatgaggggcacattatagtgtcctgtcctctgtgggtgcttgtgtcagct

SEQ ID NO: 547422 - DNA, 167 bp, Homo sapiens
tttgtaatattaatcttccccagcctccactgtcctagcttctacctcctgtcttgtaggtaaatacccaagggaactggttatttacaacacctaaggaaatttacctacaagagaggaggtagatgctaggacagtagaggctgggggagagtagtgttaacaag

SEQ ID NO: 547423 - DNA, 167 bp, Homo sapiens
gccctttcagctacattcacgtgcatagaaaataacattgtcagacgtgtcatccccagatacaatggacaatatgctattataatcgtatggcattgtccttgctgtttggagataatactgctgactttattcctctcatacatgtgaatgtggctgtagggagc

SEQ ID NO: 547424 - DNA, 167 bp, Homo sapiens
cagcaatctgtcacattttagtttctgtttccagatagaaatgggggataatactggaaatagtaatgcataagtggacagggtctgaccattaaaatgtttaccatttccagaatgatgcctgcagatgttacaaaattgaaactggataggtgttagaattgctg

SEQ ID NO: 547425 - DNA, 166 bp, Homo sapiens
gtccccttgtgtgtgtccgtccccctcccgtctgtctgtgattctccctttgttttccctccgcctctggccgcgctttctgcctccccccagcgtgtgcttctggctcagggcctcagtttccccatcgggacaacgcagaaggtaacgggccgtccaggaggac

SEQ ID NO: 547426 - DNA, 165 bp, Homo sapiens
gctcagtggtgtggtggccaggggatgggcagtggttgggtaaggccgggcctggagggagggaggaagggccttattggactgaatctgaaggcccctcctcctgggccctcccaggcatgcgctccactgtacagctggcgcacagagaaggagccactgagc

SEQ ID NO: 547427 - DNA, 165 bp, Homo sapiens
aatgagaaatcagataaatttatttaagagcatggaaagtagaagtaaataggctttgaataattatctgaaataaacataagaataagctgtttcaggtatttattcaaagtctatttacttccactttccatgcccttaaataagtttatctgatttcccatt

SEQ ID NO: 547428 - DNA, 165 bp, Homo sapiens
tgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagca

SEQ ID NO: 547429 - DNA, 165 bp, Homo sapiens
tcactgttgtgaacacttgctttcacttgctatgcacctgatgacgaggggtccacagccatgcccgtgttcatgaaaggtcaccacgttctgcttctcatcatgggcatgtgtcgtatccccgaggctgaggcaagaagagagaaggaaagtaagtggcagtga

SEQ ID NO: 547430 - DNA, 164 bp, Homo sapiens
ctgtaatataattctgaaatagctggaccattaattcaacctaatatatgtaatttcttatattccagaggccacttaccatcttccatgagtagtctgcagaatgtaagagattccatattttgtatcaaattaatggtccaaccatttcagaatttaaaaag

SEQ ID NO: 547431 - DNA, 164 bp, Homo sapiens
tttctagaagtttgtcagtgcatgatagaaaagtagtgtttttttgggagcagcaaaaaattaacatctcttcaccttcccaggtgaacagaagatgaaagttgcttttctgctttcaactttaagcatgcttcttgccatgattgtgtaaaaacatctaggaa

SEQ ID NO: 547432 - DNA, 163 bp, Homo sapiens
cttcatggctcattctcacttagataactatactgtttctcttcccttctgtcctcccatgccagaggaaaaacacatctgctgatatcagagtccctcctcctctggagggaggaaggcaaagagagggacagccgagcaactaggagaaatggctttggag

SEQ ID NO: 547433 - DNA, 163 bp, Homo sapiens
ggccctgggatgggcaaccacagtaacttccacggaggtttcagcagtggcatctggggctggggtcgcggccgtggacagcaccggagccgggaccaaggccacggagcttgcagaggcaaggccgaggataaggagtggatgcccatcaccaagctgggcc

SEQ ID NO: 547434 - DNA, 163 bp, Homo sapiens
gtgttgctctttgaaatcatgctaagaggaagttgtgatgcaaaagactatatgtgggtgttataaggcacccaccagatgatttatgaggcacccacatatagccttttgcttcacaacttcctcctagcatgatttcacagtccctcagttacagcagcac

SEQ ID NO: 547435 - DNA, 163 bp, Homo sapiens
ttttttccagattttaagaatttccagattattccaaattttatgggcgaaattctgccctcaattatgcacatgcaactaattgcacacacataactgagggtagagtttggcttttggagctgaaaatctctaaagttctgaatttttttcttggaaaaaa

SEQ ID NO: 547436 - DNA, 162 bp, Homo sapiens
ggagtgaaatttaggagggcagaacaaagcagtcaaatccaagtgatgagagctgtcaatagatctgccatgggataaaattggcaggttctgcttggctctagtcacaggtggaacataatttgatggctttatctatacctctcctgagcatttttttcc

SEQ ID NO: 547437 - DNA, 162 bp, Homo sapiens
ctgggaatgagattcaagctgtgttttttctgcttcttatagtccatcatcaccagtaataaagagcctgcaaatttgtcagccaagtcctgacagtaaaatctttattgctggtgatgatgtaagaggctaaagggacacagcttgagttgtagatcccag

SEQ ID NO: 547438 - DNA, 162 bp, Homo sapiens
gaccagggccttacccgcaagccacagggaccttgacttcacggctctgactctgagaggccactctaactacttgcctgttctgagcagtggagctaggcctcatcagctgacagaaagcctgctgttaagttaatgtgttttaaattaaggccattggtt

SEQ ID NO: 547439 - DNA, 162 bp, Homo sapiens
cagcatgttccctctcaagagaaggaagagatgtccgcatgtctccatccatgctctactgtcaaatcagtcacttttccccgaggctagagtgaggcagtggagggtggctgggagtgttatgttaatgggtcttcacttggaagggaacgtcaagagttg

SEQ ID NO: 547440 - DNA, 161 bp, Homo sapiens
ctgctgagacccattaaagcaatggggggctgccaagtactcacatcccagactcatcaacttgtttttttgctgaccactcagtcagtcagcaagagcaatgtgataagtcctggatgataaacatggttctgttgcagagacaaaatggatcacagcag

SEQ ID NO: 547441 - DNA, 161 bp, Homo sapiens
gctcccttgaagcaagaaagaaggtcccagggctgcaaaactggaagcacagcctctaggatggggagggaaagatggtactatatccagttcctgctctctgctcatgggtggctgtgacaaccctggcctcacttgatttcttgccaccccctgggagt

SEQ ID NO: 547442 - DNA, 161 bp, Homo sapiens
tgacggctgccaagcccaacagccatccctggttacaagctagaggaaaagtccctgagcatatctgttgtttcctgtgtgtaaagatgctaaatgccaggtgctttcctctagagtggaagggccggggcggggcagtgcctgcagaggcagcaaggtca

SEQ ID NO: 547443 - DNA, 160 bp, Homo sapiens
atactcaatatatggagaatatatgaaggaataggtcttttatgacatttctttttatgagtgagaagagacctaataaattactttattaaatctcttctcacaagtgaagataaatgtcatcaagggcttaaggtctcatgtattacatataatgtat

SEQ ID NO: 547444 - DNA, 160 bp, Homo sapiens
tcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaaga

SEQ ID NO: 547445 - DNA, 160 bp, Homo sapiens
ggcattaattaagtaataacgatcaaggtatggggcatttcctggggattaatgaccagctgggggagttgatagcccacagtgcagccaagggccattaaccccagctggtcatcaattcctgggccctgtgttatagtcattattgctatcataagcc

SEQ ID NO: 547446 - DNA, 160 bp, Homo sapiens
cgaaggaacatttatcacactaacacgcctgtaaagtggagagggttcatccacatgctctctgcagcttctattagaacgttaattgttcatactgaagaaaaggagacataaggaatggcttttaccatcacgtgttaagtttatttttgttcctctg

SEQ ID NO: 547447 - DNA, 160 bp, Homo sapiens
gatattgccttcaacagtgggcatgaccttgagctagatggctcttttcaacttcagatatttaatatattaaatgcaattcaacttaagatatatgaaatatcttaagtttaaaagagccatctagttcaaggtcatgctggctgtccagggcagtttc

SEQ ID NO: 547448 - DNA, 160 bp, Homo sapiens
ggggtctgtagaggttggcaaagtcattgtgttgatttgctaagactgtccttaagtttaatttaaagaaaacttactttaagcatactggtttctttaaactagacttaaggtcaaccttagcaaatcagcaaaatgacttcgccaacctgtacacccc

SEQ ID NO: 547449 - DNA, 159 bp, Homo sapiens
cagtgaaattcctaaggatccaaaagaatcagaaggatggctcaggcctgcctacatgttacagtggtgagttctttagaaacttgccccactgtgatttctaggtacaacccgcctgtgttcctggggttgctctctccatagtggggatttctgctg

SEQ ID NO: 547450 - DNA, 159 bp, Homo sapiens
gtgatcatcgatgtgttttagcagtggtcctttctataatggagttgggtggggttttctctgcatttggtgtattatattttactaggctgacagggactacacctacatcaataacttcacacaaagtagggccttttgtaagcatgagatgctcac

SEQ ID NO: 547451 - DNA, 159 bp, Homo sapiens
caccacagacatcagcggatgttacaaatcaggcttctttttccccgtgaatcagcctcctgtaccactccggcccctccctggtgcaggagcagtgcagtgagctgattcatgcggagaaagattggtctggcctgccccgtgaacggtctgtgtgtg

SEQ ID NO: 547452 - DNA, 159 bp, Homo sapiens
gcaaagtacctagcccatgtcctagtatgtaacgggagctcaataaacagcaggtcttgacaggtgtagcactgaaggtctacagaggtgctgctctggccaggaactgctgattattgagctcctattgtatgccaggacatgagctaggggctttgc

SEQ ID NO: 547453 - DNA, 159 bp, Homo sapiens
aactttctccccaccatgtcttttcatttctctctgggctcttgtctcagtcttagccctgaacctctcacttaaaggatgagctagagaggtgggggaagagatgagattttcaaaggatgcaggagaaaatggggctggctggtgaagggggaggtt

SEQ ID NO: 547454 - DNA, 158 bp, Homo sapiens
tggaataagtagctattgacatctgctgaagtcagtataaagatttatttacctgagtgtagatattgaccaatagggagcctggctcaatgtttacattgaaggacaataaattgccgtattgactgggctgagacatcaatatttgcattgttgta

SEQ ID NO: 547455 - DNA, 158 bp, Homo sapiens
tataacatgtaagcacggaataatacctttacaatttagaagcacaagactgaaatcaagatgcaagagttgctttttattcggacttgctcttgcattttgattttggtcttctgcttctacactgtaaacgtattattctgtgcttacatgatata

SEQ ID NO: 547456 - DNA, 158 bp, Homo sapiens
tgactactttttctatctcttcttttctgtgcttagctccctcggggctgttcaatcaagactcaataaaaattgttgaactgttcagatttttattgagagccttgatgctatagccccacaggagcccactgaagaagggattatccttgttatca

SEQ ID NO: 547457 - DNA, 158 bp, Homo sapiens
tctctgggaagacacaggcccttctggaggctgcaataactgagtaagaccactggggtaccatttggtaaactgcagcttcagtgcactcaatagtaccttagtggcctgaaagagttaatgcagcatctagtggtacatgacttaattccttggga

SEQ ID NO: 547458 - DNA, 157 bp, Homo sapiens
gcactggtgtctgagtaatactccattcaaacacctcaccctgatgtattgcattaatagatcatcagaagcagttgtcattccagtgatatattagtgcaatacatgagaatgagactcactgatgatgtatttagtactcacaagatggcagtgt

SEQ ID NO: 547459 - DNA, 157 bp, Homo sapiens
acctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggt

SEQ ID NO: 547460 - DNA, 156 bp, Homo sapiens
atttactgacaattcatgctattttatagtccatgtcttttggaatggatgggagtttgttattcagtggtttataaaatcttccagactgaatgatgagctcacatctgttacaattggtatggaaagtaaaactggcgtgagttgtccataaat

SEQ ID NO: 547461 - DNA, 156 bp, Homo sapiens
ggaatggggaagccagtgttggggaagttgagaatgtggggacccgaggggccagcagggattttctagtctcccagcaaggttttccggagactgaagatggctctattggacccatctctccccaccttttccatcactgggttcccccacccc

SEQ ID NO: 547462 - DNA, 156 bp, Homo sapiens
ccctgccacctcccccctttcctttcgtctggccgtgctggcggggctggctctgggcctcagacactctggaatcgccaaggtctgagctcagggcctggcccccttcccaggctaacagccgggaggacgggggcgctgtccgagggcccaggg

SEQ ID NO: 547463 - DNA, 156 bp, Homo sapiens
cccttacagagatgtatttgctccccttatcttccttccgtctttcttgattaaaagctatgtgtgatatttgtagttatcaaacatcaatatttggcatggattggcgaaatggatatggggggaagaaaggagtctgaccatttctgtaaaggg

SEQ ID NO: 547464 - DNA, 155 bp, Homo sapiens
ttgcccagtctcctgcggagccactcctcttggggtccccctcttgaaaagacccctgcccaaagctccagccctgggatgctgatagcagccgtgctgagattgaggctggggtagaggggccatctagagcagtcgctcccactacctggcaa

SEQ ID NO: 547465 - DNA, 155 bp, Homo sapiens
cagcagagagcaccatcaggtctgtggggaccgattagcgaggtggctctctgtgtcctatatactatatgccacttcagtggttacagtaacacataggacatggagaagtgaaaactttgattcataaaaggaccccatgtgactctctgctg

SEQ ID NO: 547466 - DNA, 155 bp, Homo sapiens
gtccttggcactaagtcttaggttccttgtcactgaacagccttctttccacttggcttctcttggccagcatcctggcacaccatcagaggagaaaataatgagaaagaagtgtcttacagggatggggagcactggtggcttaccatatgggc

SEQ ID NO: 547467 - DNA, 155 bp, Homo sapiens
gaggtcagaattttgaggagatgaagaggttccagcagggattcttaaatgtttgtgccatttatccctctaggctttaccgggcaactagatggatgcatcacacaaaacatttaagaaaccctgatggattgttcttcaagagttctagtctc

SEQ ID NO: 547468 - DNA, 154 bp, Homo sapiens
gcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgt

SEQ ID NO: 547469 - DNA, 154 bp, Homo sapiens
ggaggagagggagagcagcgtcagggaggcagaggggtctcctagcaacagcatgggctcctccttcttgaaaagctttcgggatggggggctggtgctccgacgaggacggctggacctctgaaaaagaccctcccgtcttttcttctcctcc

SEQ ID NO: 547470 - DNA, 153 bp, Homo sapiens
gggttggggagttgggggaagggtggaggcagggctgtttttgtttctcctaagccaggaagttgtgtggatgagtcaaggttgaatggagagccctaggcagtgttgtcccgcccgccctgactcacctgtcccccaaatcccctgatgccc

SEQ ID NO: 547471 - DNA, 153 bp, Homo sapiens
ccagtgggagggaaaaggggtggggaaacctggcccagagacctgggagggagctgggagagtttggagtgtgttctctctctcctttgctttctcttgctctctctttctgggtcagcatgctaggccaccgaccatcccctctccccctgg

SEQ ID NO: 547472 - DNA, 153 bp, Homo sapiens
agtgatggaaatagtcttgtgtcgatttccaaggcgcaatgtgggaggcactgtgtgtgcacaaatcccgttatttgttaataggatttgtccacataccctctgcccaatctgtccaatgctttgaaatattgcagctgcttttcatttcct

SEQ ID NO: 547473 - DNA, 153 bp, Homo sapiens
tgctgaaggtggagcctgcccctgacaataccccaagcctacatctctctggttttgtggtcgtttttgtggagggtgattttcttatacatcttcctaatggatgcctacaaaggcaggctgaacctgggagcagtgcccattattctagca

SEQ ID NO: 547474 - DNA, 153 bp, Homo sapiens
gctgctttacaaacttcacggaatgctgtgagagtctggctggggttgacagggcaggcctgtgcttgtgggccctggggccccaagcacagctgaggttctgggaccatgtgccagggtcctaagtcagtgaagttgacaactagagtgagc

SEQ ID NO: 547475 - DNA, 152 bp, Homo sapiens
atgtctctgcaaagtctctatatggggtggcctattgaagaaagaccccatttaacttgaaaccgagcttgttatttggctttcaagttaagtggggcctgcttaaatgggctatcacatatagagaacaacatctcatcactcagacacat

SEQ ID NO: 547476 - DNA, 152 bp, Homo sapiens
gcagaggccaggcttcaggtttgaaatgaatgtctgcatgagttgctaatatagaccaaggagagcatgagcactcctactgctgtggtaatgatgcaggccaagagacacaccaggaaaatgttcacccgtgaccacagcctgttctttgc

SEQ ID NO: 547477 - DNA, 152 bp, Homo sapiens
gctccaccttcccaagaatgtctaattgtcattggaacagccagtgtctggcagcttcgctcgggctgatgtggcatctgacccttggtgggttgccagacattccttcctgtttccgccatgggaagttgacactgggaatggtatggagc

SEQ ID NO: 547478 - DNA, 152 bp, Homo sapiens
gtgttgcaggcaaaatacaagagctaacatgcacatgagtaacacatgcacatcatcagctgtgtctgcaacacaaagtgccacatgtcaggcacagttgattatgtgcatgtgtttactcatttagtccttacctcaggccgaggtcacac

SEQ ID NO: 547479 - DNA, 152 bp, Homo sapiens
gcgttaacctgcagaggggttggcagcagctgcttatttctgatttgcttgtctttgaatgggggtaattgctgggagctgccagtgttccaggttgttccctggaagagggggaagaagaaatggctgtcatgggctctgcggagtgctgc

SEQ ID NO: 547480 - DNA, 151 bp, Homo sapiens
ggcttggaggcagaagagaagcagggcgttcgaggctggggattagagttgggggaactctggcactggggaagccagagtttccagagtcacccctaactcttactcactgtgtggccttggggagcttggggttacttctctctaagcc

SEQ ID NO: 547481 - DNA, 151 bp, Homo sapiens
gagttcatctgctcctgctgtttattctccacctgaagttctaatcctctgtttgtgacaacataatcatttccacagcaaccaattgtgaagttgcaaagcaaggattagacttcaggtggggaataagcaacaaggggctgatgaactc

SEQ ID NO: 547482 - DNA, 151 bp, Homo sapiens
agggaggcaaagttccttccatcccccggggcgctgtccctgtgagctcccggtgtcctgcacacgtgggcccctgagtcactgggtctgtgtgtgtgggatggggctccgtggccagcctgtcctcctggggttcactttctgctttcct

SEQ ID NO: 547483 - DNA, 151 bp, Homo sapiens
taaataacatgagatatagtgtaagcatatattctttttggtgctaggttgatgcaaaagtaagtgtggtgtttgccattgctccgcattactagtgcgccagcctagcaccaaagagagtatatacttatactgtatctcatattattta

SEQ ID NO: 547484 - DNA, 151 bp, Homo sapiens
tgggcagcacccactgcgtgcccagctctgtgcccaggtcctgagggctgctgttggttgtaacgtttcatggaaagaacagggcttgctgctgtacagcagctcagatgacgctgggccaaagaccccacgtttgtgtgggtgaggtcca

SEQ ID NO: 547485 - DNA, 150 bp, Homo sapiens
gcctgcggggtgcaccggcgctttcgggcggaaggcggggcctcccggccagtgaccccgccccgaggcgcctcccgggcggggaagggcggggctcgcgctgggaaactccccttccaaggccgaggcgccgctgcgcgtcctccaggc

SEQ ID NO: 547486 - DNA, 150 bp, Homo sapiens
taatttgagagtaacaagaaaaatagattggtaagatgatacaccacaagccagttgtcgtgtatgaaactacataaatatatatgcacactacaactggcttgtgatgtatcatctttccaaggcattcttcttgttaatattaaatta

SEQ ID NO: 547487 - DNA, 150 bp, Homo sapiens
gcttcccacagcaactataacttagcctcatctggcgtgtgtagtattttgtgttagtgtggatggtgttatatgttaagacattaaagttaacaccataagcagagcacaaaatgcttgagggggctgagttatgatgactgtgtgagc

SEQ ID NO: 547488 - DNA, 150 bp, Homo sapiens
tcacattttgaggctttaagtggaaaatatcagctcatgatacccttgggcctaagcttgtgtctacaaatagcttctttttgtggcaacaaattagttctggggtttattttattctgcattatttccgatgtctgcctcgctgcctga

SEQ ID NO: 547489 - DNA, 149 bp, Homo sapiens
gtgtcatctccgcttggcagacaggaaagtagaggctcagagaggctcagggatttggccaaagtcagactgccactaccttgatgtctgactttggcaagttcttcaaactctctgcctctgcatccttgcttataaaatggagacac

SEQ ID NO: 547490 - DNA, 149 bp, Homo sapiens
cttcttctgagatacagtagtaccaaaaataggcaaaaattccctcatggagcttgcatctagtaaggggaaattgacaactgaatacaagctccacgagggagcacatcgtatttttttgctagaacatggtaatgctatggaagaag

SEQ ID NO: 547491 - DNA, 149 bp, Homo sapiens
gtgcaaggtcaagggcatggctgtcagagcactcatttaaaactaagtaccttgaagggatctccattcccaatgcttctctcttcaaggcaatttgttttaaatggccactttagcgctacaatcaagtcatgtcctgctgacagtac

SEQ ID NO: 547492 - DNA, 149 bp, Homo sapiens
gcacagcaatggggccaagagactggggtgggatccatgtggtatctggtatctgtcatcttctgcagcacttacattcttcctgtggagatggcagaagccagcatttttgtgtctcatttaatccatctggcctctccatgttgtgt

SEQ ID NO: 547493 - DNA, 149 bp, Homo sapiens
accatacggagataacacatgcggaaatgcttgacacttagtaggcatttggaaaaggtgaattgactctgaatcatgaaaactgtcaaatcacatttttcaagcctaccacgtgccaagcgtttccacgtgagttatctacgtgtggt

SEQ ID NO: 547494 - DNA, 149 bp, Homo sapiens
gggggtggccctccctgcagtcagcggcaggccggagccagctctggccttggcagggcggacacggtgagagtcagctccacctgtgccgtgtcaaggccgggagcgggcttgtggctgccgttcagctcactggggccttggcctct

SEQ ID NO: 547495 - DNA, 149 bp, Homo sapiens
gtctgactcacttctaaattgaagtgcatatataaaaaaaattgaatcactccaatgattttaaatcactcttcaatgtgcagagcaatttaaaattactggagtgcttccaatttttattagtccttgaatttggaagtgatctaggc

SEQ ID NO: 547496 - DNA, 148 bp, Homo sapiens
ccttgctggccggtctccctggagctgaagtgcctgaggcctgctctggcccagagcgcatgtgagtgaggcctctgctgtgggctctgggccggaggcgtcctctctctgtcagtcctcgggaggtggatcctggctttgagcgagg

SEQ ID NO: 547497 - DNA, 148 bp, Homo sapiens
gtcacatgattccttttaaagtcaggctctggctggtgctgcttttcctacccactgcccatctgccagctcaaaagacaacctgagtgctgggtggggtgggggaaccgccacagtgagtgctcaagtaagaacagaaatatttgac

SEQ ID NO: 547498 - DNA, 148 bp, Homo sapiens
tctcacccatgcagctgctggtttttgtggtataaactactctacacagagcacattgtgttcatggggcctagaggatccttgaggaatgaacagatgtgctctgaagctgacatgtgaccaacagaacccagctgtgcaattgaga

SEQ ID NO: 547499 - DNA, 148 bp, Homo sapiens
tctcaattgcacagctgggttctgttggtcacatgtcagcttcagagcacatctgttcattcctcaaggatcctctaggccccatgaacacaatgtgctctgtgtagagtagtttataccacaaaaaccagcagctgcatgggtgaga

SEQ ID NO: 547500 - DNA, 148 bp, Homo sapiens
catgaaatataacattttgagtggaagaaacatctcaaatcatgctgacagcattttcactattagcggcaaacaaatcaactataattaaaatgctgtcaaagtgatttgagatttttctcacactttcaaagttccatatttcatg

SEQ ID NO: 547501 - DNA, 148 bp, Homo sapiens
catgaaatatggaactttgaaagtgtgagaaaaatctcaaatcactttgacagcattttaattatagttgatttgtttgccgctaatagtgaaaatgctgtcagcatgatttgagatgtttcttccactcaaaatgttatatttcatg

SEQ ID NO: 547502 - DNA, 148 bp, Homo sapiens
ggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctct

SEQ ID NO: 547503 - DNA, 148 bp, Homo sapiens
aattctgaaatggttggaccattaatttgatacaaaatatggaatctcttacattctgcagactactcatggaagatggtaagtggcctctggaatataagaaattacatatattaggttgaattaatggtccagctatttcagaatt

SEQ ID NO: 547504 - DNA, 148 bp, Homo sapiens
gggagctcttgcaaatgacagtttttcacccctttctaccactgttcaataggtggaataagtaattcttctcactcctcattgcctcttttctgcctcttgggtagtggtagaaacgggtgaaaaactatcacttccaagagctgcc

SEQ ID NO: 547505 - DNA, 148 bp, Homo sapiens
ggctgatcagtgacaaggaggctgcaggtcacgggggggatgctaggtggcctggagctttgtggttaactgccattgtgggaggctgccatggccttgggccgcctggagcccccctcgctgtggcgtctcctcagtggctgcagct

SEQ ID NO: 547506 - DNA, 147 bp, Homo sapiens
ctggggcctaggcatttccctcgctttatgtttttggttttttttcttccttcaatctctttgattaggccgtacgtggctgtggcaaggagttggggaaaaaaattataaaaacaggaaagagagaaagcacagccagagccccgg

SEQ ID NO: 547507 - DNA, 147 bp, Homo sapiens
ttgtggtgatatggtcatggtttacgaaaacaataatccgtaagaaataggtcattaacagtagttaacgtttacttgtgatctatggtaatgactgatttctttgggattactgcagttataaaccataattacagattattacag

SEQ ID NO: 547508 - DNA, 147 bp, Homo sapiens
ttcaccatggctagttaagaaggacagtctgtctttactgcctgttgatgtgcatgtctgcctaccctgagcctacggacaagcaacattagcagtagtggtaactgaaagaaaagagactgaagctttgccataggccatgatgaa

SEQ ID NO: 547509 - DNA, 147 bp, Homo sapiens
cctgctgttgaaagagaccctcttcatatatacaacattcaggtaattgcttctaagcttacttgaaaggaagcttatccctattttaaatgagattagaagtcctgcctgagtgttattttggtctcagtgcctttcaaacaaagg

SEQ ID NO: 547510 - DNA, 147 bp, Homo sapiens
ctggggcctaggcatttccctcgctttatgtttttggttttttttcttccttcaatctctttgattaggccgtacgtggctgtggcaaggagttggggaaaaaaattataaaaacaggaaagagagaaagaacagccagagccccgg

SEQ ID NO: 547511 - DNA, 147 bp, Homo sapiens
tttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaa

SEQ ID NO: 547512 - DNA, 147 bp, Homo sapiens
ttgtttgtaggaagctacaaagctcactcttacccaaagtcagcaaccctttttacatgctttttcaggtacccggcaaagcaaatgggttggtgactttgggcaagagagagctttttagcttccttgtttcaaagtagcagacaa

SEQ ID NO: 547513 - DNA, 147 bp, Homo sapiens
gcaaagttttcggctagccctcactatctctcaaccccccttcctccacttccctgctgttctttcttggcacacaaaatataggccaatgagcagtgggtgggtgaggaggatgtgagagaaaatttgagaagtaaaaaaaggagc

SEQ ID NO: 547514 - DNA, 146 bp, Homo sapiens
ctgtgctgcagtctacaccgaaccacggcagctccattcgctgctgtaacaagttgaaaaaaaactaattaattcaaactttagttttttttaaatttgttacagcgctgagcagagctgccgaccccatgcaggacagcacacag

SEQ ID NO: 547515 - DNA, 146 bp, Homo sapiens
ggactacgctgacctttgcaatattatgtattctgattggttgttcatgtcacctctttcccacaagttaataaggctgtaaaaaggagagaactgaaatggccagccagtcaaattatagaatattgaaaaggtcagagcagtcc

SEQ ID NO: 547516 - DNA, 146 bp, Homo sapiens
actgtacaagagctgggggagaaaatataatgtaaggaatgatttgaaatcaggggcaggagaaggcagaggaatgaactggctgaccccaaatgtcttttccatctctaactcctatgattctttgacctccaattttgtgctgt

SEQ ID NO: 547517 - DNA, 146 bp, Homo sapiens
ggctgggcattgggagtgagctgcagggaggcagaggggcggcctcgggtgatggtgggagggcgcctggatccagctgtgcctgatgcctgcgcttttacttataggccctccccagccactgccgctgttcccagttctcagcc

SEQ ID NO: 547518 - DNA, 146 bp, Homo sapiens
ggctggggcagggctgggacaagtggcagagctgttcccagagtctgtttcttctgatgattggaaactccctggcagccaagaggaagaggcagtcctcggagcccaagctgccagtcctggctctgcttcctggacagccagcc

SEQ ID NO: 547519 - DNA, 146 bp, Homo sapiens
gtcttgtgagaggaaaggccatcagcaggtatacagcagttctgtgtatacatgctctgtgtggacttgggtattattctgcacctgcttgtgtagtgcactctactctgtgtatctgcctcctctgtacacactcctcaccagat

SEQ ID NO: 547520 - DNA, 146 bp, Homo sapiens
agtaataatatcaaggctctcttttttgctcagcagtaatctgattctctagctgtgataaactgctctgcctttggccttctagtttagccatttaggaattggattattgtctcataaaacagaggggcaatgatatcattgct

SEQ ID NO: 547521 - DNA, 146 bp, Homo sapiens
aggcagagagcagcatttgagtcattttggcacagcctgcagtgtggcttctgctcaggaatgacagtgggaatgcagcattatccagtaggaccagactgcaggctctgggctagatgacctggattcaaatcctggctctgctt

SEQ ID NO: 547522 - DNA, 146 bp, Homo sapiens
agccagcggcgggagcatcatttcataacgtaagtaaaatagagagggagtgaaatggaatagagagagaataaaactcccattactctgtggctatttgattctctatgtattttattcacataatgaatgatgtacttctggct

SEQ ID NO: 547523 - DNA, 146 bp, Homo sapiens
gaagcaggaacagctatggggctcttagttctcctggtgagtgggaagcggagctggggagactggaacccaggctctgggctcctttcccagtgctccttcctgccaccaacattctacctgccccaccttttctatgatgcatc

SEQ ID NO: 547524 - DNA, 146 bp, Homo sapiens
cccctctctccccctttctccagctccgtgtcatttcctccttgcgctcgctcgctgcctgagcgtctccagccgggagagtaggcggagcagggcggtgcggggtggcgtagagctggagggcgatggtggcggagctgctgggg

SEQ ID NO: 547525 - DNA, 146 bp, Homo sapiens
cggggaattgccagcgatggaaagcagtctgaggctccatttggctccgcggctccgagggtgcccggggccctccaaggcccccgccccaggggctgcagggaagccgggcctggggccccctcccaccgcaggctgagcccccg

SEQ ID NO: 547526 - DNA, 146 bp, Homo sapiens
gcaggactttggcacttttctagttaacttgctaaatatacgtggccaaaccagatcattcaggccagtggtgatttttgaacctaaatattctggtttggctgttttcatttgtaaaattaacctgatacttgccaaatcactgc

SEQ ID NO: 547527 - DNA, 145 bp, Homo sapiens
attgcagtagggctctaatcccacagctatttgagctgtcagccagggccagtcctgagggttcccctcacctagaccccaggtactccgggcctggtcctcagctcacttccatgatgggggtgggtaggtgcactgctgcaat

SEQ ID NO: 547528 - DNA, 145 bp, Homo sapiens
gggaatgaagaggaagagatggatttgagaaatatcagaaaatagtgcaattgttgcttttagttgcagtgcagaagcacccaacagaaaagtggcatattgcagaactgataagtctcttactccaactgctttttagaaaccc

SEQ ID NO: 547529 - DNA, 145 bp, Homo sapiens
ttttgcatggtaccttgttaactgaaaaccaggcatattggaaccatgtccttgctttgatttaattttagttacacagaaccatgcaaaatgagaacatagttctgatacatatgagtttcagttaacatggtactatacaaaa

SEQ ID NO: 547530 - DNA, 145 bp, Homo sapiens
tctgtaattatggtttataactgcagtaatcccaaagaaatcagtcattaccatagatcacaagtaaacgttaactactgttaatgacctatttcttacggattattgttttcgtaaaccatgaccatatcaccacaaatacaga

SEQ ID NO: 547531 - DNA, 145 bp, Homo sapiens
aaattgctttattcttctttcattcttgtaaactaatttctgttcatgttacaaagcattcagcatgatgctataccctaccatgctgaaatgctttgtaatatgaacaaaattagagaggggaaagagaagaaacctgcaattt

SEQ ID NO: 547532 - DNA, 144 bp, Homo sapiens
tattgctaataacacacatccaaaaaggcatcttttttcagtgaccggatgtttattcaaatattcaatacctaccattatttgagtaaacatccagtcactgaaaaaggatgcctttttggcatccttgttctattggcaata

SEQ ID NO: 547533 - DNA, 144 bp, Homo sapiens
gccgcgtgcaactgttttcgaaaacctgggatgatcatttaaatgtttaaaatatgcacatggtaattcaaaactaattaccctgagcacatttgaaacatttatgccatcgtctctggatcctgcctactgattgtgcgcggc

SEQ ID NO: 547534 - DNA, 144 bp, Homo sapiens
gccacatgggcttctcaggagcctcagtctccatacctggaaaatgggaacaccaccacctggctcagtggggtccgagccaagcggtgctgttctcattgttcaggtgtggagtggcatgggataaagggaagcacatgaggt

SEQ ID NO: 547535 - DNA, 144 bp, Homo sapiens
tgagagagagcaaacgtgagacgaacataagcatgtactatgagagcctatattcattaaagaaagattctggggctgtttgttgtcccaggataatgagtaataggtgatagatacagagctgtcatccttttctctctttta

SEQ ID NO: 547536 - DNA, 144 bp, Homo sapiens
ctccctccctccctcgctggctctccttctctccccacccttcccagcgccagccctccccactggtttgcatcatcacgcagggaggggctgcgtgctgaggtaagggggggaaacgggtgggcggctggggaatggggggag

SEQ ID NO: 547537 - DNA, 144 bp, Homo sapiens
aggtagtgtgaggtaggatttagaaagtgtctttgaagggccatcaaatttggagcttataaaagggagatgatcccaattagccaagttttgtggcttttctcaaatcatcaggatcatagctagatgcttccagtattacct

SEQ ID NO: 547538 - DNA, 144 bp, Homo sapiens
gatgtcaaaggtgccgagacctcctccacacgtgcctggcttgccttctccctgaatgctgtgggcacttgattcagtctgcgtattcaggcaggaagacagagatgggctgcgcgagggggttgatctgggagcctttgaatc

SEQ ID NO: 547539 - DNA, 144 bp, Homo sapiens
ccagggctgggctggggttgaggccccgcgagggcagccacggccaaggagaaggggggtgtctctccatctgcatgcttgccccccttccccagggccctagcacaatgccaaaggtcggcctcccatccccaccagccctgg

SEQ ID NO: 547540 - DNA, 144 bp, Homo sapiens
gtctttccacctagcctttgccatgtcgtagatttataaaatcagggatcctacttaacttctcacaggaacaaatatagagaagttaagtagcatccctgattttacaaatctactatatggcaaaaggctaggtagaaagat

SEQ ID NO: 547541 - DNA, 143 bp, Homo sapiens
ggaattcttcataaccgaagtgtgttttccccgaggagttatgctaccatttgatttaatttttaatttttacattttaatcaaaaatagatcaaatggtggtggtctctccggggaaacacacttcagataggaagccggcc

SEQ ID NO: 547542 - DNA, 143 bp, Homo sapiens
cacctaaggcctggagttaatctggggcctgatggtcaccagggacccaggtgtccacctagggcctagtgaccaactagggcctgatgtccacctggagtctagtatccgccttggccctgatgctacttgaggcctgggtg

SEQ ID NO: 547543 - DNA, 143 bp, Homo sapiens
agggaacattttttggacttcttatcccaggctgctgaaccttaggagtccaggggttgcatctggagcaaagagatgtcccaacagccttgccctgaggttgagagaggatgggctgggataggggtccatggggtttccct

SEQ ID NO: 547544 - DNA, 143 bp, Homo sapiens
cgtccttcgcattcctgggctggaggaataaggatccaattgtggtttctgcgctggttatcttggtgccgccgagggggccaccggggaaaatctgctgaattcttccttttctattttctgcctcggcgaggaggagggcg

SEQ ID NO: 547545 - DNA, 143 bp, Homo sapiens
gggtctcacatgctgctactgccagaaccggcctctcagcatttgtggaatcagcacaagggtggcgtatgctcaggattggcctacggctggttctgcaagtgctgagggtctctggtgcccatgtggtagttggaaggccc

SEQ ID NO: 547546 - DNA, 143 bp, Homo sapiens
tccatgccagcacagctgcttcccccctggggtttctgacactctcaggatgtgggttttcacactgtgtctctcgcacagtaatacacagccatgtcctcagatctcaggctgctcagctccatgtaggctgtgctcgcgga

SEQ ID NO: 547547 - DNA, 142 bp, Homo sapiens
tgtggatgtcactcagcttcccctcagctcttgatttgagagaagggccagggatcatgcttaggaccaaactggctccacagcacccctctctttacttaagggactgagggggagaacaacacctgtcagaaaaatccca

SEQ ID NO: 547548 - DNA, 142 bp, Homo sapiens
gtgtattgggggtggtggggtcccccctgctggccgcaggtgctctgacgaggttgcactactgtgctctgagaagcagtgcaatgatattgtcaaagcatctgggaccagccttggggatctccctccctataaccctcac

SEQ ID NO: 547549 - DNA, 142 bp, Homo sapiens
tctccagaaatcctgcccaattttctcggttaaaggtacgtgtagtaggcattgctttttctctttggggacaaaactcaggaggattgccccttgatgaacaaggctaacctgctgattctttgaagcaaggaactggaga

SEQ ID NO: 547550 - DNA, 142 bp, Homo sapiens
tcctttgtcttctcaccctttgtggcaaattgagacgggggaaaactattaggttggggcgaaagtaatttctgtttctgccattacttttgccccaacctaatacctcccagcaaaatgcaggggttgcggagagaaaggg

SEQ ID NO: 547551 - DNA, 142 bp, Homo sapiens
tctttgatcaggtttatgcagtaggaagttatgtttcagtggctgtgattgggcccagggcatagctaagtctataattactagctggttaaatcagagctcttctggaatttagcagccatttgtgtaaactgcctcaata

SEQ ID NO: 547552 - DNA, 142 bp, Homo sapiens
cttctgcagctggcacctcatcccccgctgcactaaatcgacacttctggaagtagcagcttcggagtgactgacgagagccattgcttgcccaagtgtcaatttagtgcagcaggggatggagtagcagctgcagcaaaag

SEQ ID NO: 547553 - DNA, 142 bp, Homo sapiens
gggctccccgagatgggcacactggggtcaggctctgccagcatcctgccgtggcgctctcagtcgtgtgcacttactgagagcctattgtaggcacatggcaggcactcgggggccctcaggatgttccttggggtcgcct

SEQ ID NO: 547554 - DNA, 142 bp, Homo sapiens
gggaggacacagaggcacaggggcatgaggaccctgccctgggtggtggcagagctgggatttgaacccgggtttgcatgactcccagccctgttcctgtcctctcaggggctgcaccctccccctgccccttcctcctccc

SEQ ID NO: 547555 - DNA, 142 bp, Homo sapiens
ctgtctcccccaacccttagtagcccccatagcctgcagcccagtggcgaggtgggttggcacagaatcctcaatggaaaggaggcaccctctctccctggggtgcagaaggtggaggcggcgggggtcggggggtatgcag

SEQ ID NO: 547556 - DNA, 142 bp, Homo sapiens
tacgtgtttaagagaaattttactctttgaaccacttttgttaagttttgactagctcataattgcttcacaaaaccttttgttttgagttagtcaaaactttagagtggtttaaagagtaaaatttcagattaaatatgtg

SEQ ID NO: 547557 - DNA, 141 bp, Homo sapiens
ctgatgaacataaaaatccctctcccatgttgcctttctgtagagattatcaggcctctttctaccttccaaggctcagaaggtagaatgaggcctgacatatctgcaggaaaaaaaaggagagagatttatgtttgtaag

SEQ ID NO: 547558 - DNA, 141 bp, Homo sapiens
gggcagggggttatggggggcattggggcatggtctgcctgggaaggggaaggtcctctccagcccccaggcctcagtggagtagtcggctccctcctttctgcagccatgcctcagattctagtgtcccttgccccgccc

SEQ ID NO: 547559 - DNA, 141 bp, Homo sapiens
taaacatcagttatgaggactttttctctgcccttcgtcaatatgcagcctgtgaacagcgtctgggaaagtagtggtcattggttgcgtaatttgatttgaggcttgtggaggaaaggacccaagtgactctgatgttta

SEQ ID NO: 547560 - DNA, 141 bp, Homo sapiens
gtgctttcactcttcccagagtcctccctcaccacgtcaccacccccagaacagctttaagacactgaatgccagcgctaagcctttgtccagaactgttctgggggtgggctttggagagggtgggtcagggtcatgcac

SEQ ID NO: 547561 - DNA, 141 bp, Homo sapiens
tcctttgcgaatacagcttcagttcctaaccaaaaacacatccctgctattgtcttgtctggatccagatgcaaacatgattaattaagtttctggtgaggagtgggacgagggcagtgggaactgatggcttgctgagga

SEQ ID NO: 547562 - DNA, 141 bp, Homo sapiens
gctatgatagagacaggtcttaagagagcagagagtggatgcaatcgaggaagacttcctggtcttcatagccccacctctaggaagtcttccttggttgcacccactctgtgctccgttaagacctgtctctggagtagc

SEQ ID NO: 547563 - DNA, 141 bp, Homo sapiens
gggggtgacttcgcatgtgtctgtcattgaattctcatggcatctttgagcaaggtgtaattcttcaattttatagaagagagaaaggaagctcagagagtcaagtattttttggagatcacatagctaggaagtgccttc

SEQ ID NO: 547564 - DNA, 141 bp, Homo sapiens
gcaactggggttagcaagacagtgaggcactttatcctttatcacttgctgtgaatgaaattgactaggatcatacacagcaggggtcaagggtaaagtgcttccttgctggcgttcaacttgtgctacctctcctcttgc

SEQ ID NO: 547565 - DNA, 141 bp, Homo sapiens
taaacatcagttatggggactttttctctgcccttcgtcattatgcagcctgtgaacagcgtctgggaaagtggtggtcattggttgcataatttgatctgaggcttatggaggaaaggacccaagtgactctgatgttta

SEQ ID NO: 547566 - DNA, 140 bp, Homo sapiens
ccttcagctcctatgttctacacctcctgctgcccctatcctttgccaccagtgttctcaggtcctgctggggggacagagaagatcagaggtgaagggtagagatggcagaaagtggggttggagcagtgggctggagg

SEQ ID NO: 547567 - DNA, 140 bp, Homo sapiens
ggtttatatgctcatttttagcttatttcttgtaccttgcagcacactctacgcactcagcccttaaggggtttactttacaaactgtgtgcctgtaagatgtattagcaataagatagaaaattgagcaagtttatacc

SEQ ID NO: 547568 - DNA, 140 bp, Homo sapiens
ggagaactctgtggaggtgcgtcgggcatggacactcacctgtcttttttgtgggatccacaggataatcccatgatcctagaagaaggcagacatgagccagtctgaagaaaagccaagcacagccccagaaatagacc

SEQ ID NO: 547569 - DNA, 140 bp, Homo sapiens
tctcaggcttccccacacacaccagcagcagagactaggaagcccgggtgctgaggtcaaggggactcatggagatgttggcgtgcgaggcctcctgggagctcatgctgggtgcaggtgctgtgggggagcagaggaga

SEQ ID NO: 547570 - DNA, 140 bp, Homo sapiens
ttcagaactttagagattttcagctccaaaagccaaactctaccctcagttatgtgtgtgcaattagttgcatgtgcataattgagggcagaatttcgcccataaaatttggaataatctggaaattcttaaaatctgga

SEQ ID NO: 547571 - DNA, 140 bp, Homo sapiens
gtctcttccagaaacatttccaaagcagcatttgatactgaaaacatggattttcctctatgattaaccaggaatcacgtaaacatagaaggaatatccacgttttaaataccaaagaaggactgggctctggaaaggac

SEQ ID NO: 547572 - DNA, 140 bp, Homo sapiens
gtgccttcactagagccaaaagtagattaaaaatcagtcactcattaatactttgcctagctactaaattggaggtgcctaaacaagatactaatgaggtgactgagtcttaacctggttttggcctccactaaaggtat

SEQ ID NO: 547573 - DNA, 140 bp, Homo sapiens
gggcctgggtgccgaggcctggggaggaggaggagctgaagcttggtcacttccgactgtttctgaaggaaagaggccctgggcccacggcttcagccctgctcagaccaacacaaacaagcctcacgcacctcaggccc

SEQ ID NO: 547574 - DNA, 139 bp, Homo sapiens
agcagttaaacttggaacagaggttgaggattcatggatgattagatgtggggtctgagggaaagcaggaacgcaaggatgactcccagatcttcagcatgaacaactcagcacactctggtttgaggtggagaaagct

SEQ ID NO: 547575 - DNA, 139 bp, Homo sapiens
tcaacatgtcaggatgttaaaagtgtggtaatttggggtgctttcagtttcttttgaaaacaatgagagattattttctatggaaactaaaagcctaccatgtgtttaaagttgctacacttgaaaattgatatgttga

SEQ ID NO: 547576 - DNA, 139 bp, Homo sapiens
gttccctaggtttccaaggtccaaggccccaggaaatataaagagaccatggcttctcaaacattaaagtttagaggagaagccactggtctatttatatttcctctgccacttaggccttaggatcattgtagggggc

SEQ ID NO: 547577 - DNA, 139 bp, Homo sapiens
aatgtacagtttctagaatgagaactcttaccctggcttcggaacttctaggaggcatggaaacaggtatgtatagggtctccatttctcctggaaggcttgaggccagcaaaactccttactctagaaaccggacatt

SEQ ID NO: 547578 - DNA, 139 bp, Homo sapiens
cctgatgccaggaaccctatctctccagctctgacccagatctccagtgtccaggagaattcattttacaaagcagggaattctcctgggcactggagagctgggtcagaggtggggaggtagggttcctggtatcagg

SEQ ID NO: 547579 - DNA, 139 bp, Homo sapiens
gttcagtggtattgcaaagaggacagatggttttagggaggccttgtgaaggaggctgttttgcagatggagacactgttggtggctgcagaggttttccagatcctgtttggcttactggttttgtagattgctgagc

SEQ ID NO: 547580 - DNA, 139 bp, Homo sapiens
ttctcctagttgctcggctgtccctctctttgccttcctccctccagaggaggagggactctgatatcagcagatgtgtttttcctctggcatgggaggacagaagggaagagaaacagtatagttatctaagtgagaa

SEQ ID NO: 547581 - DNA, 139 bp, Homo sapiens
ggcaggaagacattggagccaggaggaggcaggaaagctgctgtggtaagctctacacttcaatgtgctggtatgtgtggtgggagacgctggagcagtgccaaagtcatccatctgacctttaatgttgtgaaatgtc

SEQ ID NO: 547582 - DNA, 139 bp, Homo sapiens
gtccaagatgtctgagcctagctgaacctgcactgtaccccattgtgacggagcacttttacattttgcggaaaacaatgatatgttctttcacagatggggagaaagttgcagccagtctaagccaaacatctttgac

SEQ ID NO: 547583 - DNA, 139 bp, Homo sapiens
aatgtccggtttctagagtaaggagttttgctggcctcaagccttccaggagaaatggagaccctatacatacctgtttccatgcctcctagaagttccgaagccagggtaagagttctcattctagaaactgtacatt

SEQ ID NO: 547584 - DNA, 139 bp, Homo sapiens
tagggcctcacggtatgcccaacactgcctggcaagcatcgggtgttcagtaaatgtaagttatatgccaccatagcacgcacttattggacatgcgttttatgccaggcagcacaggtaacatggagtcttggcccta

SEQ ID NO: 547585 - DNA, 139 bp, Homo sapiens
gactttatggacacattttaaactaatagtcactttttaaaagccagcattatgtttaattaaaacacactgggaacacattaaatatgatgctagcttttagatggtgactattagcttaaaatgggtttatgttgtt

SEQ ID NO: 547586 - DNA, 138 bp, Homo sapiens
gcattgagaacctattatatggccggcattgttatgctagaggccaatgacagtcagaggtgggcggttgaaagtaatgctgctgattgtcgttgtcatctggtagagtcatgcccatcacgtaacagctgccaatgc

SEQ ID NO: 547587 - DNA, 138 bp, Homo sapiens
tgatttctacggttagattgaaggtgagggcggatgtggctcagaggcaatgtcaggaaagaggaagcatagtacacacctcctctttcctcaagttggtgttggaatctgtcccactttgaactcaagtggaattca

SEQ ID NO: 547588 - DNA, 138 bp, Homo sapiens
ggctgtgggtcagtaccttaaaaaagtagctgaggtcagaggaggctggggcacaggaaatggttgtacaatgatctgctacttataaatgccccacctcccactcactgtggcattttagaggttctgccccacacc

SEQ ID NO: 547589 - DNA, 138 bp, Homo sapiens
gtagccttggctgaatgcgctggaccgggagggccgaggcctcctctccccgtctccatggccacgggcgtgcgcctgaccctggagccggctggggcggaaccctcggactaccttcccgccttcagcaaactctac

SEQ ID NO: 547590 - DNA, 138 bp, Homo sapiens
ctgctcacgtgggcacttggcatgttcaggcaggttgacgtctccactctgctccgtccgcccagcatgtcactgagtgtgggtggggtgcagagatgggggtgcagggtgcacctgagcactggccaccctgggcag

SEQ ID NO: 547591 - DNA, 138 bp, Homo sapiens
ggaggtaacgggactggtggtgggaggttagagcctgaactggaagtctttggaagtgggtcaatttttagagcgctgtttccagagcaacccttagaccatggcctttagacttcccactgtcggtttctggcctct

SEQ ID NO: 547592 - DNA, 138 bp, Homo sapiens
cattaaatataggagactttttgttatgtggcagatggataataaaggaatgctgaatgcagctccattccaagttatgggaatctggacacttcatcagcattcacttaatcctctgccatagctccgcctttgatg

SEQ ID NO: 547593 - DNA, 138 bp, Homo sapiens
cattcaaagtgtcctttcagcttgctctgctggagcaagagcaggagcaggagtcctcatggaggcaaacagtggggctcactggttttctcttatttagcagaagcacttggagcttctgaaggactactgggaatg

SEQ ID NO: 547594 - DNA, 138 bp, Homo sapiens
ggtgggtgctggaataacaaatgctacaaatggcactgggggtgttggccaggctctgggggcacaggagctctgcccatgcccacagttggcctgtgctgacctccctccgtcaagctgagtggcaccagcccttcc

SEQ ID NO: 547595 - DNA, 138 bp, Homo sapiens
ggaggacatgtgttaagatgggtccccaggggtccagggctgatttgctggggttgctgggtctgctctgcagattgcaggctgattgcagcagattagctgggacctaaaaggggccttgtcacagcccatgaatcc

SEQ ID NO: 547596 - DNA, 138 bp, Homo sapiens
ccccaccccggactccttgcgccctcccgttcccctggcaacggccggtgacctcaccggggttgtaagccgagcccagagtgaagtcaccgctgttgctatggggactcagtggtcgccaaggagttcggggtgggg

SEQ ID NO: 547597 - DNA, 138 bp, Homo sapiens
gtaaattgctcatttttgaaggtgcattaactcttccaggcccctagggtatcatttagttcactggaatagtaatttactaaactgtaccttaggggcctgaaaatgttaatgcacctccaaaagtttctaatttac

SEQ ID NO: 547598 - DNA, 138 bp, Homo sapiens
gtccctctagaagctgtgggccactcagcggttgtgtgtgtgtgtccgtccccccagagtcagaggcttttgagggagcgtgtgcatgtgcacgtgtgcgctggcaacatgaatgtggcccggcactgctttggggat

SEQ ID NO: 547599 - DNA, 138 bp, Homo sapiens
ggaaaaattgcacaatgttaaagcaacaataattggttcctcctggcttttcccattgaaggaaattgaaattcaattgactttcaatggaatagccatggagttccaattgtcattgctccgactttgtgcttgtct

SEQ ID NO: 547600 - DNA, 137 bp, Homo sapiens
agttgagtttggtgcatgtaaaattttcccagcaaaatacttctggaggtaaatcttaggttgaaaatcttggatctaaaaaggcttacctccagcagaactttgctgggaacattttacatgcactaaactcaatt

SEQ ID NO: 547601 - DNA, 137 bp, Homo sapiens
cctgaacagattaagcattgtctgctgaatgatatgtttgcttttcatgcagtgaagttcttttgtgacaacagaacagctgcatgaaaacaactttttcataatttccacacgaatgcatcataatgtcaatcagg

SEQ ID NO: 547602 - DNA, 137 bp, Homo sapiens
ggtagaggagggcccagggaggttgtgaaatgaaggagaaaggaaggaacaggggtccgggaagagtaactgtcttgttctcatctttcttcttttccttgcagcaaacagtttgtggatttgaccttcttcgtgcc

SEQ ID NO: 547603 - DNA, 137 bp, Homo sapiens
atacataatttaaatgtatccactgtgtttcatgtgtttcttacataattggaagggatctataattgcaagagatctataagagataacaatgtaagagacatgtgaaacacagtggacatgtctaaattatgtat

SEQ ID NO: 547604 - DNA, 137 bp, Homo sapiens
agggtggaacatatgcagttgaactttgagagataaatgaggaagctagaaatgaagaaaccttcctttaagttatgttctttatgtctgagtttcttggttttcagaccaaatagtttccctgtttgtgccactct

SEQ ID NO: 547605 - DNA, 137 bp, Homo sapiens
gccgccttcaggccgctacgagaggcttgcaacgcttcacgacagcgcgctttctgcctcgctggtttccaatgtgacctcacggcaaccagccaagaaagtggctgtcggggtgcagctgcgaggccgccagcggc

SEQ ID NO: 547606 - DNA, 136 bp, Homo sapiens
ctctcaatgatacttgtggcagacaatgttgatactgtgcccataaatatgagcacagtatcgacatttttcaaggcagtgcaatgataaatatgggcacagtgccaacattgtccaccctgagtatcattgagag

SEQ ID NO: 547607 - DNA, 136 bp, Homo sapiens
cgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcg

SEQ ID NO: 547608 - DNA, 136 bp, Homo sapiens
aagtgctcagataacacctccaggaagccatctctggcctccataacccatgtatggctttgtcctcatcacaaaaccatacatgggttctgcaggtcagagatggcttgctgtttttgtcacttacatagcactt

SEQ ID NO: 547609 - DNA, 136 bp, Homo sapiens
gcctggtgagggaggcagcacaaggctacgggagtcacaggtttgagtgcagggtgtaggaggacctgggaggcttcagggcccttgactcaagtgcctgtgttcctgccctattccctgctgtcctgacccaggt

SEQ ID NO: 547610 - DNA, 136 bp, Homo sapiens
tgataagagccaaggagtttagatttttaagactgacacccccctttttaactcatgttgttttatttattttccccaattgcatgaattaaagatggggtgttatctcagctttgaattccttagcttgatgtca

SEQ ID NO: 547611 - DNA, 136 bp, Homo sapiens
atggttctggtgataattgctgaatttccgaattaataggaaaactggcacaatactagataatatcagagtttgttatttgtgaagtgccaattttatgtaattagggaaaattgctaattatcactggaactat

SEQ ID NO: 547612 - DNA, 136 bp, Homo sapiens
aggaccatgcacacacatgtcatcccccacagaacataggctgcagaccccaatcttcttggcacaggcacaggcccaagaaggtcaggggtctgcaacctatgtcctgtggtgggtgacaggtgtgtgcgtgcct

SEQ ID NO: 547613 - DNA, 136 bp, Homo sapiens
taggacacaacctgggcgctgcatgtgagactctctgggtgtggagtgtgactgtgttgtgtgggggtgcgggatgtggtatatacgcacacacgcagggagcggggtatgtgtggttggagagggttgcgttgtg

SEQ ID NO: 547614 - DNA, 136 bp, Homo sapiens
atttccaaaaggaccgcctccggaagacggcatttccaggagtgacgctaaggcttcctaggcgcggtttctcgggcactgcctgcaatgtcattcccagaagtactaccttcaggaggcgggtcctggtgggaat

SEQ ID NO: 547615 - DNA, 136 bp, Homo sapiens
aataatggtggcagaaaggaggtgtttgttgcactgaactaaatagcaatgtttcctgagcccctaatagttggtgctcagcaaacattactatttaattcagtacaacaaataccttctttctgccagcgttatt

SEQ ID NO: 547616 - DNA, 136 bp, Homo sapiens
cgtttaaaagtaactggcagttgagcaagcaagagacatagggaatagtcttaaaagaatagcggaaggaaaaagcatgttgcttttatgattatttccatgagtcctgcttgttcaaatcagttatttttaaatg

SEQ ID NO: 547617 - DNA, 136 bp, Homo sapiens
gtccctcctctttctctctgtctggattccttgggactgacatcatagacatggaggagtctctgactttttaaagtttttgacagtcttgaatgttgtggttttccagtgagttatgggaagagttggagaggac

SEQ ID NO: 547618 - DNA, 136 bp, Homo sapiens
cattaccgtgtaatcggactttttggaaaagtatagcaggctctaaactaaatggctgcagaccactcactggtagttacttagttcagagcctgtaatacttttgtttctagagaacagttctggcagggtagtg

SEQ ID NO: 547619 - DNA, 136 bp, Homo sapiens
gaaagcccttataattccgagggatcccatggtcagcatttttagccagtagcttttctatttttttcagtcccaaatagaaaagctagttgctaaaaatactgatcatgggatccccagaatcataagggctttc

SEQ ID NO: 547620 - DNA, 136 bp, Homo sapiens
gcagctgatgagtcatcaaatgggagaaatctgagagccatgtgttccacaggcctctggtccttgttcaggcagcagggcactgtgacatgtggctccttggccccttccagccaccaccttgattgcatgctgc

SEQ ID NO: 547621 - DNA, 136 bp, Homo sapiens
gaaagcccttatgattctggggatcccatgatcagtatttttagcaactagcttttctgtttgggactgaaaaaaatagaaaagctactggctaaaaatgctgaccgtgggatccctcggaattataaggactttc

SEQ ID NO: 547622 - DNA, 136 bp, Homo sapiens
ggagaaagcagggtcgcatgggcttcccagggcctctctcttggtccccatcctgtcacctgcacagtgagtgatgagggtgaggaagagaggggaccaggccatgctggagattgtcctgagtcctgtcttctct

SEQ ID NO: 547623 - DNA, 136 bp, Homo sapiens
tgaatcaaaatctgcaacttatcaagctgcccaggcgattgctaatgtgcataggaattctgaatctgaagaatatgattcctgtgcacattagggatcacctggggagcttgatcaattgcagattttgtgttcg

SEQ ID NO: 547624 - DNA, 136 bp, Homo sapiens
tctcccaccagtgacctgttttgtgattcctccgagtttttcagtctcagtattattgacatttggactagatatgtgaatagtgttgagattgagaagctcagagaaataataaaacagagtgggtggtgggaga

SEQ ID NO: 547625 - DNA, 136 bp, Homo sapiens
ggtccttctgtggcttcagacttttaattccagtcttaactcacccttctgctgcatctcctgcttcatttcctgaatgtagtgtgaccaggggagagcagaaggaagcagggattggatctgaaatcagtagacc

SEQ ID NO: 547626 - DNA, 135 bp, Homo sapiens
ccctgtcttaccctgtaatctcagcacttagtatggggccttgtacaggaataaaaggaataaggatttccatcctactatttctttattactgactttactctttgccggtgtttccattacaggagaagaggg

SEQ ID NO: 547627 - DNA, 135 bp, Homo sapiens
gcaagccttgcagaaggacctccaaggtgcagagaggtgggctcggggctccgagtggccctcaaacaagtacctttggaccattcaagctctgacccacttactgtttccagagttctgtccctgcaaacttgt

SEQ ID NO: 547628 - DNA, 135 bp, Homo sapiens
ttcttctttgcatgctgctcacttcttatacccagacatttatgactatgtcattcataaatttgtccaaaccttttgtgaattccttctgtcatatccttctggtttaagagatgtgagtcatgcaagaaagaa

SEQ ID NO: 547629 - DNA, 135 bp, Homo sapiens
ggcaaagacaatccatactgtttgtgctttgtgtcttgtggtcagtagagtgctcctcaaatttcagaaagctgctggggagttccttgttgaccagaagcctagcagttgtaaaccctatggaccctgtctgcc

SEQ ID NO: 547630 - DNA, 135 bp, Homo sapiens
gggactcaagacaggcctaacagcgtcctttctgttcatgggaggcactgctggagcttgctgacattggacaatttgctcctggtagtgtgcccatggggagcagagctcagacatgtatggtgtgtctgtccc

SEQ ID NO: 547631 - DNA, 135 bp, Homo sapiens
gagatcccatggaaggatgcatgatggcagagctcttgtatgacattcatcttcatgagtgagctgttccatctcctctcacgagcggagataaatgtcagaagagatcagccgttgtgtattacatggccactc

SEQ ID NO: 547632 - DNA, 135 bp, Homo sapiens
gtaataagcaggtattgacttctgttgagatcaatatcaagatttgttgacccaaagaagttaaaattgactgaagagtgagacaataaatcttgttattgactagaaagcagaagtcaatatatgtattattat

SEQ ID NO: 547633 - DNA, 135 bp, Homo sapiens
tcacttccaaattcaaggactaataaaaattggaagcactccagtaattttaaattgctctgcacattgaagagtgatttaaaatcattggagtgattcaattttttttatatatgcacttcaatttagaagtga

SEQ ID NO: 547634 - DNA, 135 bp, Homo sapiens
gctgaatgaatggctgtattattatcaaggtaattcaaaacaaatttcaagctgtgacaataaaatggttcttgtagtaggttggggtttgtgctgaaattgccagttggaatgagaacagttatgttttcaagc

SEQ ID NO: 547635 - DNA, 135 bp, Homo sapiens
gtttgacatgaagtctttgtatctgaggatgtcagccattgaactatgcaggctaactctcatcttcacaaagagagtctgtctgcacagcagtggcttgcaacttaatattttgcataaaaattcatgaggagc

SEQ ID NO: 547636 - DNA, 135 bp, Homo sapiens
ggggggggctggcgtagtttgcctgtgtgggccagttcagtgagccatctgtgctcagtccagagaccattgggagaggggcactatgggctctctggacattgcatctgggaagcttagaaccagccccatccc

SEQ ID NO: 547637 - DNA, 135 bp, Homo sapiens
ttgacagcagggcagccccttgatttcttccgcagactgcacctccagcggctggtgagcaatgagagccagaggcgccagctggtggggaagctgcaggtccttgtggaggaggcctttggttgccagctgcaa

SEQ ID NO: 547638 - DNA, 135 bp, Homo sapiens
gcatggttgtgtgctgtggctcagctagtcaggaggcagggcctggagggctgctgggaggggaagggcctgccctgtccccagcagcctttgcccccatccccaggctggagaagctacgccaccagctcatgc

SEQ ID NO: 547639 - DNA, 134 bp, Homo sapiens
ttgaggcattttacttcttatcccaggagagctggtgtggatgggggttggggtctctttatgaagagcaccttcctccacccacaactagtttcttttagcaccttcttgggaagagagaagcaataccacaa

SEQ ID NO: 547640 - DNA, 134 bp, Homo sapiens
ttactgcttaggatcatggaactggctctttctttggttctgttccacctcaaataagctggggagaggtgtgtggctgtcattgggtgtggcaaagccaaagaaggagctaattcatgattctaagcatgtga

SEQ ID NO: 547641 - DNA, 134 bp, Homo sapiens
gctgccttcatggggcccagcctagatgaacacagctgtcctcattgggccctggccaggttttagagtgaatacctgggctgggccctattaggacatctgtgatcatgtgggctgggtacaatgagggcagc

SEQ ID NO: 547642 - DNA, 134 bp, Homo sapiens
ggtgtgctcagaagaccaccctgcaagtttctgcctctgtggtcacagcttcatgccgtgggcgtaaaggtgggtgtgcagccagaggcaggatgtgcaggcaagatccaatgtggttaaaatttgggatcact

SEQ ID NO: 547643 - DNA, 134 bp, Homo sapiens
cttatttgatcaatccccctgtaattaatccatcacctccttcaggttcttccctttcttctctgaaaaatattagggaagaaccagagggaggtaatggattagttaattgcagggggattagtgtaattaag

SEQ ID NO: 547644 - DNA, 134 bp, Homo sapiens
ctgctcctgctgcttgtttctcagttgaaggcataatcctttgtttgtgactatgaaattggcttatgtagagatgattatgatgtacattcagagaattgtgacttcaggtgagaaataagcagcaggaacag

SEQ ID NO: 547645 - DNA, 134 bp, Homo sapiens
gtttattttgttcatgtgactaactcttcaatccatttgacaaagtgtgcctgtcattttcagattcctgaagtaaggacaggtgacatgttcttcaaaggaaatttagggaaaacaaaggaaaacaaaaagac

SEQ ID NO: 547646 - DNA, 134 bp, Homo sapiens
tctgaatttgtcacttatattctctgtgccccagttttcccattagcaaaatgaggacaatattacttcttataagtgtgatgggaatgaattggcattggcaaagtgttttgaagttcttcgataaaagcaga

SEQ ID NO: 547647 - DNA, 134 bp, Homo sapiens
aaaatagaaccttatcaatatctttgaaattctgtttatgcccctccctggtggcatcctgaaggaaggggaaggggatgaaaccagggaagggcataaccagaactttaaagatataggtaaggttctatttt

SEQ ID NO: 547648 - DNA, 134 bp, Homo sapiens
cctttagtggaggccaaaaccaggttaagactcagtcacctcattagtatcttgtttaggcacctccaatttagtagctaggcaaagtattaatgagtgactgatttttaatctacttttggctctagtgaagg

SEQ ID NO: 547649 - DNA, 133 bp, Homo sapiens
attctgacttacatttctcccagtggacaccggccagatgcagaaaccaaagagcttggtgccggtactgcctcttccttcttttatagtttgtgcatttggatgtgtttagcatgatctgcgagtgcagggt

SEQ ID NO: 547650 - DNA, 133 bp, Homo sapiens
gggatagaaactaacgccacaacaacaggatgtcatggtcactgctgagtagaaatcttttgacaagtacaaacagacctctgctatagcactgtcacattgcattatagttatttgtttacttttctgtctt

SEQ ID NO: 547651 - DNA, 133 bp, Homo sapiens
atcagttcattttctgcctttagtcaaagcctaatcaaatgaggctgggagaggcaatactttacatttctctactgcctcttctagcctcgtttgattaggttttgcctaatggcagaaaaatgaacttgat

SEQ ID NO: 547652 - DNA, 133 bp, Homo sapiens
gcttcttgtccatgtccgaccgggcccctgtgctcaccccccgcgccaggcccaggcagtgcggcgctgcttccggtctgggccaggcgagccgagggcgggagcggggcccgcgaggcccctctcgagaagc

SEQ ID NO: 547653 - DNA, 133 bp, Homo sapiens
gggtttctgatgagaatggtatgtgtattcatgtatgtgtcatgtcctgacttgtttctgcctctgcatgtacctgcaagtcagcgtgtgtgtgcatgcgtgtgtctcacacatccctctggcatagagatcc

SEQ ID NO: 547654 - DNA, 133 bp, Homo sapiens
gctcttcatcacggcttcaaggggttaggggcttgctaggaagtgccaggttgataagtactggccaaaggggagccagggccatgagcctggcatatcccaggcaatgtccaagctaggagcattgaggagt

SEQ ID NO: 547655 - DNA, 133 bp, Homo sapiens
ctgcagctgctactccatcccctgctgcactaaattgacacttgggcaagcaatggctctcgtcagtcactccgaagctgctacttccagaagtgtcgatttagtgcagcgggggatgaggtgccagctgcag

SEQ ID NO: 547656 - DNA, 133 bp, Homo sapiens
ttgagtttagtgcatgtaaaatgttcccagcaaagttctgctggaggtaagcctttttagatccaagattttcaacctaagatttacctccagaagtattttgctgggaaaattttacatgcaccaaactcaa

SEQ ID NO: 547657 - DNA, 133 bp, Homo sapiens
gtggggatgctggggtctcacaaggccttgatgtgagtccccgctctagtgattacacagccagtatacatagtaagcactacagcagggcctcacaactaggtcttgtgatcccagagctcatcttcctcac

SEQ ID NO: 547658 - DNA, 133 bp, Homo sapiens
gtgtatgtatcttgagtcacagacaagggaacagaggcctgaagaagtcatagcttaagtcatggccaactcctgtgacttcttcagtcctctgttccctcacttgtaagatttaagtaacagtcaattacac

SEQ ID NO: 547659 - DNA, 133 bp, Homo sapiens
cttggactgtggatgcagaagacctgggttcaaatcctgcctggctcacttcccaggcggtggctccagacaagtcacttggggagcaccgttgggaggtgagggcgagcccacaaacatgcatagcttcagg

SEQ ID NO: 547660 - DNA, 133 bp, Homo sapiens
tagccggtgacaaatgtatgtgaatgaccagctcacaggaagtggccttcaatagtccgatagcttcctgtatcctgacattgtgaaggcccacttcctgtgctgtctctgaaaatacagcaagtcaaagctg

SEQ ID NO: 547661 - DNA, 133 bp, Homo sapiens
aaagggaagagagagatgaaactcacatctttaatattggtcctagtttgttattgtaggaggctgcaatcacttgttacaatgaaacttttggctggattatcagtgaattttatttatctcttttcccttt

SEQ ID NO: 547662 - DNA, 133 bp, Homo sapiens
gacactatgttaatggaaactcatgcatatctgagctatgttcttgattttcaggttttcttgcagcgatcagggaactatgaaacacaaagaccgagttctaatatgtacaagtttcagttaatataatgtt

SEQ ID NO: 547663 - DNA, 133 bp, Homo sapiens
atcaagttcatttttctgccattaggcaaaacctaatcaaacgaggctagaagaggcagtagagaaatgtaaagtattgcctctcccagcctcatttgattaggctttgactaaaggcagaaaatgaactgat

SEQ ID NO: 547664 - DNA, 133 bp, Homo sapiens
ggaaaacagaactatctggtgggtcaaaggcgcataccagggggccgtgggtgcctgtcaaaccggaatggttatctggtctggcagagcccagcatcttgggtggccaaacaaacctcagatacagtgttcc

SEQ ID NO: 547665 - DNA, 133 bp, Homo sapiens
agtggtagtgacctcaggagtctgtgtgtggcccatttgatgtggtttgggcctaaggaaaagctaaaggctaaatgtattttaagtgggctaaaaccaagataaacacatccctgaggtcattatttccatt

SEQ ID NO: 547666 - DNA, 132 bp, Homo sapiens
ttggctagtggagatgttaatctgggaggtggctgggtcctgaaagcatgcacgggaaggaatcgttcctccatcaggaagtaagctaatcaggactccagtcttaatggaaatgaatcttccgcaagcagg

SEQ ID NO: 547667 - DNA, 132 bp, Homo sapiens
gcaacctgaatgaaaattatttcctgacttttactagcctaatactgtgctttcaattaaagaataccgaaggcacagcattaggctagtaatagtaaaagtgaggaagtaattttcctcctatttctttgc

SEQ ID NO: 547668 - DNA, 132 bp, Homo sapiens
tctgaacttagagctgagacagaggagagggcctcaatgactcagtcccacctccgccaccagccagggagctggtcatgaaggctctctgccttctgtttccacatctgaaaaaggctctaaggccacaga

SEQ ID NO: 547669 - DNA, 132 bp, Homo sapiens
catttatgttagaggttaacatttgtgttatttcctcttattgcctggctttacagaatgttatgccccactgcttttattaaatccaggtaatagaggaaataacagtgttattaacctctaacactgatg

SEQ ID NO: 547670 - DNA, 132 bp, Homo sapiens
gaggtggaggggttttgttccaagtcacagaggaaatgaatgttttagaggccagaaagagctcctgagttctgtgaagcattcctggctctgggaccttcagttctcctttgggccaaacttctctccctc

SEQ ID NO: 547671 - DNA, 132 bp, Homo sapiens
gggatcctgccctgcgatagtccagtgcttgagtccgcagtaaggcaatggtcctccaatgctggagttcacggcgttgtggggtcggggtcctttggtgacttagtccagggcgtaccagggcgggggtcc

SEQ ID NO: 547672 - DNA, 132 bp, Homo sapiens
tcctgctggggagggcatggagtatttcagagtaggaaagaatgagggagaggatagtcagataaatcaaagtttcattcttttcctcctctttcttagctcgtcaaatcctacactttctctccagctgga

SEQ ID NO: 547673 - DNA, 132 bp, Homo sapiens
tcagcaaactaacagaaagtcacttcaatgatcaaataaccacattgtttataagtataaagtttatactccttatttatacttataaataatgtggttgtttgactaaatcgctttctgttaggggactga

SEQ ID NO: 547674 - DNA, 132 bp, Homo sapiens
gatgctctgttctcctggcaacgctccttactggcttgcaggtgcccgtgagcagggcttggctggccatcctgccaagcttgctcatggagacagcaagatctcatggaggagcatttcagatcagacatc

SEQ ID NO: 547675 - DNA, 132 bp, Homo sapiens
tgttccctgagttcctgggtgctgaggaattaattaccctccccgctcagccggccctgctgaggtcaggggtgcaggcctgtgtgggtcagggtgagattatccgggacaggtctaaggagcaaggggaca

SEQ ID NO: 547676 - DNA, 132 bp, Homo sapiens
ctcccttggtaaaaatgagcttgcagctataatacctctggtggtcaagagtgtcaagtgtgcaacggtactgtcagacattttgcgcagatgcactctgaccactcctggcatggtgggacttcatgggag

SEQ ID NO: 547677 - DNA, 132 bp, Homo sapiens
acctgtcccctgacttgctctttccacttcacagtcttaatcatgaggcaagacagtgtgctcagaaggcactgtgcagttctgctgcctgatgattccaaacttagagtgaaaagtgaagatgggccaggt

SEQ ID NO: 547678 - DNA, 132 bp, Homo sapiens
gtaggggtaatatggttacctccacacacatctgcgttttcaggagatgtggttatactaccctgttctttctctatgtagccacatcttctgaaaattcaagtgtgtgtggagtaagcatattacctctat

SEQ ID NO: 547679 - DNA, 132 bp, Homo sapiens
gaatggggaaagaccaagctctgcagcgggtgggcccccctttcatatgcccagatctgtgcagcccagacacgcctaggctgggtaatgaaggcacacttcctcctgctgcagaacaccaactcttcattc

SEQ ID NO: 547680 - DNA, 132 bp, Homo sapiens
cttttctgtcacccctgggctgagccgtcctgttcgctgctggcccttctcttcctgggagcgctcatcattgcccagctgccagaagaggaggggttagcattggtggagggaagcagggggagggaggag

SEQ ID NO: 547681 - DNA, 132 bp, Homo sapiens
gggatcctgccctgcgatagtccagtgcttgagtccgcagtaaggcaatggtcctccaatgctggagttcacggcgttgtggggtcggggtccttcggtgacttagtccagggcgtaccagggcgggggtcc

SEQ ID NO: 547682 - DNA, 131 bp, Homo sapiens
ggatcccggcccatggtgctcacaggcccccgccccgggtagctgggaagggcgtgcgggctgcgtggcctcccctccaagctgcccagggacagggacggccagaggagagcagcccagggccaggatcc

SEQ ID NO: 547683 - DNA, 131 bp, Homo sapiens
gtatggtcccagctgaatagtaagagggtgatttattcccaaggttctgtttccatttttgctgtttatgatagcatatcaagctagctttttgattgaattaccaccttgtattcaggctgggaccatgc

SEQ ID NO: 547684 - DNA, 131 bp, Homo sapiens
ctgcttgatgattattcaatggaattgatattgattcacccagtctaagctaccttggctcttttttaagtatctatggtaagactgagtgaatcaatatcaacttctccagtgaagccttcctcaggtag

SEQ ID NO: 547685 - DNA, 131 bp, Homo sapiens
cctctttgtattcacgtttcccatctgtaaaattgggcactgcctgtggcacccataccactgtcgggagaattcaagcactgggaccccgggaagtgctcagtatccatggaggacggatgtaccagagg

SEQ ID NO: 547686 - DNA, 131 bp, Homo sapiens
gggatcctgccctgcgatagtccagtgactgagtccgcagtaaggcagtggtcctccaatgctggagttcacggcgtggtggggtcacggtccttcagtgtcttagtccatgggtaccagggcgggggtcc

SEQ ID NO: 547687 - DNA, 131 bp, Homo sapiens
gcctcataccagagagctgcttccaagggagcagcatccttcacttgacccacgcatccaggagactttgctcctgtcacccagagtccagggaggacgctgccccaggtgtgagctcactgggctattgc

SEQ ID NO: 547688 - DNA, 131 bp, Homo sapiens
gtttgattgggagaaggcacctagggagggaggatggtgcatcacttaatattaaattgcctccctacactatgtggctgagtgtcatggaccttcctccctctctgcgcctttgaactcccactgttagc

SEQ ID NO: 547689 - DNA, 131 bp, Homo sapiens
agtggaatgcgtttgcagtagggctttgggaatggggctgtgtcactgtgggtatagcatacaccattagtacaatatcctcacagtgacacgagcccccacaaaatcctcctgtccctgcgggtgtcact

SEQ ID NO: 547690 - DNA, 131 bp, Homo sapiens
tttcccaagctcttcatgcagcctccctgcccccaccctctcagtgttgttttccctttctcaaggggaagactgtcctaggaggggctgcggggcagagacagactgcaggaggaagaggaaaggggaga

SEQ ID NO: 547691 - DNA, 131 bp, Homo sapiens
agggaagaaagagagttggggtctcaggatggtggggagaaggagctgtggtggggcccagtgtagaaagaggaggcctatagctattttctccctctgttagggcagatctcagctcacttattttcctt

SEQ ID NO: 547692 - DNA, 131 bp, Homo sapiens
agtagagtgaggtgcaacataattttatctctggcagaaaaatgttgaggtttcaagctatgagaagattttgaaacatgactcttttttctggcaacacttaagagttgatgcttaaacctcactttatt

SEQ ID NO: 547693 - DNA, 131 bp, Homo sapiens
cctccctgttggcccacagctgctaaaaaacaaggtgagtggtgcttaagttcaggcttgataaaccacaactgagctggactttgcaccacttcaccctctacagcagtcactgaattcctgctgggagg

SEQ ID NO: 547694 - DNA, 131 bp, Homo sapiens
ggtctcctacactgcccccaccccagtgcaacaggactgaaaggcaaaggcagccacatcactggccttccttctgtggcttcctattgccttgagaaccttaagcactgcctctggggccctgaggagct

SEQ ID NO: 547695 - DNA, 130 bp, Homo sapiens
agggccattgtagacttagtgggtcaccttgaagaaattatccccaggcagagagctcagggcagagagtaagggctctctgcctgggaataatttcctcatggtgacccactaagcttacctgagttct

SEQ ID NO: 547696 - DNA, 130 bp, Homo sapiens
ggaagatgaaaaaggagatattaacatgactatctattgtcttcttcatgaaaatgatggtgacacaattgagcgtgaagaagtaataggtggtgatgtcaaacgtaccattcataatttattgtcttcc

SEQ ID NO: 547697 - DNA, 130 bp, Homo sapiens
aaaaagaatgtaaaccaataacgtaatcccttttctgtaggactgtgtgcctgcacatatatatctctaggcatgtgcagacacacatatctatagaacagggattatgttattgggttacttgcttttt

SEQ ID NO: 547698 - DNA, 130 bp, Homo sapiens
tagaggtaatatgcttactccacacacacttgaattttcagaagatgtggctacatagagaaagaacagggtagtataaccacatctcctgaaaacgcagatgtgtgtggaggtaaccatattaccccta

SEQ ID NO: 547699 - DNA, 130 bp, Homo sapiens
ggggagcgggatcccgggccccgggcgggcgggagggacgggacgcggtgcagtgttgttttttcccccgccaatattgcactcgtcccggcctccggcccccccggccccccggcctccccgctacccc

SEQ ID NO: 547700 - DNA, 130 bp, Homo sapiens
cagtaagcaggatatgcagacatgtaggaggtctaaccggctgctgaaaacttggaccctcagggcctgactacagaggctggatggacttgcctactgtgtgcaggtccaactcctgcttggcttactg

SEQ ID NO: 547701 - DNA, 130 bp, Homo sapiens
ggggccctgcccatcttccccccgttctcctagggctacagcccccattgtcaccatgccttttcccctcacgggacagtgagggccatagctctaggggcatgggggagaacaggggcaggtgggccct

SEQ ID NO: 547702 - DNA, 130 bp, Homo sapiens
tgagtcttaagctctaaacataatcagttccctaagcatgggcaggcttgggacctgccattggcaatctcagcattggcaggcctgggacctgctctttgtctgcctgtgttttctcaatggaggctca

SEQ ID NO: 547703 - DNA, 130 bp, Homo sapiens
gagctggtttctcatcttccccatgctttctgtggagctgatccaagcacagagtctacttgagtactgaaatagcctctgcacttggatcttctccatgagggttcaaagtaagatgaaacactggttc

SEQ ID NO: 547704 - DNA, 130 bp, Homo sapiens
ggatatctccctgaggtcactgtcttgtcacatttttctatatgaactctatttaaaaatagtttcaataaaggtgaaatggcgttcttatagaagaatgtgataaaacagtgacctcaaggagatatcc

SEQ ID NO: 547705 - DNA, 130 bp, Homo sapiens
gtgtctctgtgtttgcaggtgtccagtgtgaggtgcagctggtggagtctgggggaggcttggtacagcctgggggatccctgagactctcctgtgcagcctctggattcaccttcagtaacagtgacat

SEQ ID NO: 547706 - DNA, 129 bp, Homo sapiens
cttttcatgtggaaagatcaatacacaataataaagtgattgaaaggacgtttagagtatacacaagccccaattagacatcctctcaattgcttttactattgtatataaatcttttgacactaaaag

SEQ ID NO: 547707 - DNA, 129 bp, Homo sapiens
agtgctgccgggagacagggtggctgggctctgggatgctggctgagggacacaggctccctcctgtcctccggggccagtggaccctggggcagcccccatgcctgctgtcctgtccccacacagcct

SEQ ID NO: 547708 - DNA, 129 bp, Homo sapiens
gtttcatcctttgaggccacatattgggtctcctgcattctatctgtttactctctataagatttaaaacagagagagtaaatagacagaaggcagaggacccaactatgtggcctcaaaagatgtggc

SEQ ID NO: 547709 - DNA, 129 bp, Homo sapiens
gggatgccacattcagccattcagcgtacagtgcctttcacagggaggtgtcatttatgtgaactaaaatataaatttcacctttctgagaagggtaatgtacagcatgcactgcatatgtggtgtccc

SEQ ID NO: 547710 - DNA, 129 bp, Homo sapiens
gtgagtgcttagctttgaacttgctcatggagtttagctcaatgggttattttcaggacttgattcttttcctgtgcattttccatttgagtcccatccaattatgcagattcagtgctgtgcacccac

SEQ ID NO: 547711 - DNA, 129 bp, Homo sapiens
tcctcccatcccaatacgaggcactgagttaagtgttctacacagataatctgttattaatgagagaatagaatagacaatctgtgtagagtgcttaacctggtgcccagtgttttcattcctagagga

SEQ ID NO: 547712 - DNA, 129 bp, Homo sapiens
ttctgttttgctccctgatgtagccccaaaacctagaatacagtttgatacataatagggtcccattccaggactgctatgtgccagcctgtgttctaggatacaggaatacataggttcaaagcagaa

SEQ ID NO: 547713 - DNA, 129 bp, Homo sapiens
ggctcctcggtagctgcctgaaagtctggactctgggggctgggctgggctgggtggggagattgctgttggtcccactgtgcctgttgtaatccccaggttcatgaaagaggtgcctgccttagagcc

SEQ ID NO: 547714 - DNA, 129 bp, Homo sapiens
agggaggaggaggccttgatggtgcgcattcgagctgatcttttctgattccagtgggacctctctctgccaacctccactaggagtctcaaaaagactcagccctgcttcatccagactcccctccct

SEQ ID NO: 547715 - DNA, 129 bp, Homo sapiens
gattgtcttcattaaggacattaatattcatagggagtagaaaatctgacacaagagaggactcactaaccttttctcgtattagatttttacttcttaacacaattacagtccggcaatgacttaatt

SEQ ID NO: 547716 - DNA, 129 bp, Homo sapiens
aacataaatctctctccttttttttcctgcagatatgtcaggcctcattctaccttctgagccttggaaggtagaaagaggcctgataatctctacagaaaggcaacatgggagagggatttttatgtt

SEQ ID NO: 547717 - DNA, 129 bp, Homo sapiens
ccccaggcctgtgggcagagctggcctgggaggacacgggcctgagggctgagcaatccctgagtgagaacaggtagctgaggctggagcctgtgtcccccaggcagctgctaaggcccgggcctgggg

SEQ ID NO: 547718 - DNA, 129 bp, Homo sapiens
gagtctgccagtcaggacctagggcttcagagctggttctttaggtgctgagccttctaaagtctccgttctagggttcagcaccccgaaagtgtcttcctgccctgggattattcatttggcagactc

SEQ ID NO: 547719 - DNA, 129 bp, Homo sapiens
acttttttatgccaccagggattaggcagtgagttactgtgctcagtgctatttaatgtacaagacagaaatttattaaatggcaatgaagtagtaattactaaacagttccctagtggctcaaaaagt

SEQ ID NO: 547720 - DNA, 129 bp, Homo sapiens
cctcccctaggccacagccgaggtcacaatcaacattcattgttgtcggtgggttgtgaggactgaggccagacccaccgggggatgaatgtcactgtggctgggccagacacggcttaaggggaatgg

SEQ ID NO: 547721 - DNA, 129 bp, Homo sapiens
aaaataggaatagtatgcatctcaaatacttgtgaggattaaatgttctaaataaactcatatatatcacttagaacattttatcttcaccacaaccatttgagatccatactattattattctatttt

SEQ ID NO: 547722 - DNA, 128 bp, Homo sapiens
tcagcacaatgcttggcaaccaactaagtattcaatacacattgaccatattattactatgaaagttctcagcatgtgaatggtcaacatgtattgagcacttagttggatgctaagcaagttgctga

SEQ ID NO: 547723 - DNA, 128 bp, Homo sapiens
tgagcagggaggtccccggcccagctcccatcccagaacccagctcacctaccttgagaggctcggctacctcagtgtggaaggtgggcagttctggaatggtgccaggggcagagggggcaatgccg

SEQ ID NO: 547724 - DNA, 128 bp, Homo sapiens
taatgaccagagtccagggcactgcctggaattaatggctggctgggaaaatggcccgggacacagtaaggaccattaagcccagccagttattaatccccagtaagagcttgatgccaaggtcatta

SEQ ID NO: 547725 - DNA, 128 bp, Homo sapiens
gaggcctgcagaagagactccatgtttggggtaggtggaagggaattttgagaaggggcagccttggggtattgagttctccatttcctcccaccctccctgggccctgggcttctactgaggctctt

SEQ ID NO: 547726 - DNA, 128 bp, Homo sapiens
gtccttcacggtggggttctgggggcacaggtgggttggtgggcaagggcacagcagctccttctccagctgctgcccagcccccaacccagagccagatgaacactgacccgctgaggtgagcggat

SEQ ID NO: 547727 - DNA, 128 bp, Homo sapiens
ggtgggcaggcactatgggggaagaggaaggggcagcagggatgggtgggagctcaggcaagctggcaaagcatcctcccagctctgctcccagttattcctcttccctctcactgtgctggcccgct

SEQ ID NO: 547728 - DNA, 128 bp, Homo sapiens
tcccttcttcagtgggctcctgtggggctatagcatcaaggctctcaataaaaatctgaacagttcaacaatttttattgagtcttgattgaacagccccgagggagctaagcacagaaaagaagaga

SEQ ID NO: 547729 - DNA, 128 bp, Homo sapiens
tgggtaataagcataggatgaggaatttgcaaattgatgtgtaaatgtgaatatcaacgaacaaaaaatagtagcctgtgcatatttactatcaaaatgcaaatacctcactctacacatattaccca

SEQ ID NO: 547730 - DNA, 128 bp, Homo sapiens
gtgtcccctattgactccctggggctggtcactcagtttttggcctctgctgcatccctcatactgttccaagtgtggcagggggaattgagaggcccctcctcaagccttggtcatgataggggtac

SEQ ID NO: 547731 - DNA, 128 bp, Homo sapiens
tcggctgcggcaagtgcttctacatccctgctccaacaaggaaagacaggaggccaggcgtgtgtgtggctcacacctcttgtccttccttgttggggcaggggtacagaagcattttggggggctga

SEQ ID NO: 547732 - DNA, 128 bp, Homo sapiens
ccatgggctcttgtctcctgttccctgtcccatttctttccatttctcccactacccagcatggtctgggccctccagcctgctaccggggtgggggagaggggggcggagcacggggaagcccctgg

SEQ ID NO: 547733 - DNA, 128 bp, Homo sapiens
gggaagaaatgggaaaatcactagatccatgtctttgagcaggtgagagggtataagttctaatgcataagcactggctttattagttcatctgttttaacaggatcaagatttatctttgttttcct

SEQ ID NO: 547734 - DNA, 128 bp, Homo sapiens
taggcaggcattctgggcaaagacaagtccaagctggagattaactgggcatccctctgccaaaaggagatggctagataggttgtcagctttggattctcaggtctttttttttagatgcatgcctg

SEQ ID NO: 547735 - DNA, 128 bp, Homo sapiens
gctgggctgccgctggaggtggctgcgctgcgggagcggtgggcgcgcacctgcctcctgcatggcgaggcctgggggcggggcgcggagcttgacccgcagctggcgccgctgcagcgcggcctggc

SEQ ID NO: 547736 - DNA, 128 bp, Homo sapiens
ttgggggcttcccaatttctggaaacctggagttaaaaggaagaggcatcccagatagaaatgatttcctcgagctggagtgccttttccttctatttccaggtttccagaagctggggagcctctga

SEQ ID NO: 547737 - DNA, 128 bp, Homo sapiens
attttggatgcccccgtcgggactgtgtgtcactgtactggaactcgagtgaacacttagctcaaaatctattgctgttctctagaatccagcccaattctcatggttaaatataaggtatgtatagt

SEQ ID NO: 547738 - DNA, 128 bp, Homo sapiens
tggaggccttgctggtttggaaagttcattgttcgacaccatggatctccaggtgggtcaagtttagagatgcaccaacctggaggactccatgctgttgagctgttcacaagcagcggacacttcca

SEQ ID NO: 547739 - DNA, 128 bp, Homo sapiens
ccaaatctaactctttctcttcctttgtaactcctctgtgtcttccttccctgaggcaatgtactgtcgtaagcagactcaatgagggaaggacagaggagcatagggaaatatggaggtgggcttgg

SEQ ID NO: 547740 - DNA, 128 bp, Homo sapiens
tcctgccggccggccccctcctcaggcccctccttctcagccccagctcccgctcacccctgccacgtcaaaggaggcagaaggggagttgggagcagagaggggaccacgggctggctggtctgggg

SEQ ID NO: 547741 - DNA, 128 bp, Homo sapiens
tggaaatataacattttgtatgaatgggaaggataagcctggttgcatgctaatgagggagacaaagtagcctcactcttatttgcaactggctcagacctttccattagcaaattaaaatctgttca

SEQ ID NO: 547742 - DNA, 127 bp, Homo sapiens
tttattgctattgagtgttacagcataaatatcttaaacttgtaactaaccagttactttgattttagggtatatcaaagtaactgcttagttacaagttcaagatatttaaacactcacaaataga

SEQ ID NO: 547743 - DNA, 127 bp, Homo sapiens
tcccagctgtctgggactgtctgctggagcaagtgacatcacagtgaccagaaaccacctcccctttgtctggagcagttatgatgtcattccctctggcagcgaagcaggatgttggcagctggga

SEQ ID NO: 547744 - DNA, 127 bp, Homo sapiens
ttggaggccaggcccagcctgctcctggctgtgggttccttatctgttcacaatcccgagacgaaagacaatattaggagcagataatggacccacaaccaggagcaggctgagtgatgccgcccaa

SEQ ID NO: 547745 - DNA, 127 bp, Homo sapiens
tagtggggtcactcattggggccacaagttggaagagtgattttcagggggtcgcagatggggtaattggtttgggagtccctgagggaattattagttaggaagtcattgatgggtggaattacta

SEQ ID NO: 547746 - DNA, 127 bp, Homo sapiens
ggctcagagaggggacacagcccgccctgcccttggggtctggagtggtgggggtcagagagagagtgggggacaccgccaggccaggccctgagggcagaggtgatgtctgagtttctgcgtggcc

SEQ ID NO: 547747 - DNA, 127 bp, Homo sapiens
gctcacccattttgcatttggcttcagaatctgttgtggagacttctaggaaatcagcaatgagtgattctaattgcttgttcttggaaatttcctaaaataacttggccaaatgagggtggggagc

SEQ ID NO: 547748 - DNA, 127 bp, Homo sapiens
acataaatctctctccttttttttcctgcagatatgtcaggcctcattctaccttctgagccttggaaggtagaaagaggcctgataatctctacagaaaggcaacatgggagagggatttttatgt

SEQ ID NO: 547749 - DNA, 127 bp, Homo sapiens
gcaggttttatttccgtagcctcacagccttgatgggagagagaaaatgtgtgtgtgttttccatccctgaatatacacattttatctctcctcttgaggctgtgaggctagggaaataaaacctgc

SEQ ID NO: 547750 - DNA, 127 bp, Homo sapiens
ccggaggattccagcgactcgggaggggcgggaggggggtccccggtgctcggatctcgagggtgcttattgttcggtccgagcctgggtctccctcttccccccaaccccccctcagcccctccgg

SEQ ID NO: 547751 - DNA, 127 bp, Homo sapiens
gtggcagtgggtagggaatcaaacatcagatgaccttcttcctctctggtttctccccaccgctgtatcagaccaggaaggtgaaagagggtcatgctgactctcctaactcccatccctctgccac

SEQ ID NO: 547752 - DNA, 127 bp, Homo sapiens
acagagtggccccttctctgtacctatggatcttggactcccaagacctttccctgaatgtggtaagaatttaataagaaaggttcttgggagttcacagaccagggacagagtgaaccttctctgt

SEQ ID NO: 547753 - DNA, 127 bp, Homo sapiens
gtccattccccactccaggcctcagtttccccatcagggatcaagaacttcagggacccttgctctaacatcctagggctccctggacttctcagattcctatgagcccatgtgggtggggaaggac

SEQ ID NO: 547754 - DNA, 127 bp, Homo sapiens
aggtttggaagcattctttcaaattaacccatctcaggccatctgcagagaagaaaggtggtacctaaatttttcttgtcagcatttggtaggggtgttttattgaccaaatatgttcccacaacct

SEQ ID NO: 547755 - DNA, 127 bp, Homo sapiens
gattttgctggaggctgttgcttttgaaaatcactgttcttcttcaaagtctttcctttacaaagaaattgaggctggaagaggagaagggacctttcaaagttagtgacattaccaaagcaggatc

SEQ ID NO: 547756 - DNA, 127 bp, Homo sapiens
cagagacagaaggcccaggggttgaagagagagtgagcctggggtgggggcagagagatggacgctgggtgcgtgtttctgcagagctggcctgggcgtggccccgtgaaggcctatggtacctctg

SEQ ID NO: 547757 - DNA, 127 bp, Homo sapiens
ccagggctgcagggagctttacacacgggccctgggaagttgattggaagctagcagttcatctctgcactgccagctctcaacggccctttggcctgttgaaaagcgcccagaatggcaaccctgg

SEQ ID NO: 547758 - DNA, 127 bp, Homo sapiens
ggatgccacattcagccattcagtgtgcagtgcctttcacagggaggtgtcatttatgtgaactaaaatataaatttcacctttctgagaagggtaatgtacagcatgcactgcatatgtggtgtcc

SEQ ID NO: 547759 - DNA, 127 bp, Homo sapiens
ggaactaggcactgatgaaaaaggattgttaacagacagaagggagggagagtgccaacccccgccacacacacattctctctcccttccgtctgttaataatccactttcatcagtgcccagttct

SEQ ID NO: 547760 - DNA, 126 bp, Homo sapiens
ggtaagttgaataaataagtaaatgaatgaatgaattgctgttcacttgaatgaggacaacctatttggacctcagtcaagtggacagaaatacatttttttatttgctcaatcactgtcactacc

SEQ ID NO: 547761 - DNA, 126 bp, Homo sapiens
cttacctctgaatccccacaaagccctcagcacaatgcctggcacatagcaggcactcaacaaatatttactgagtgcttgctaggtgccaagcactgatctgggtgctgcagatacagaggtgag

SEQ ID NO: 547762 - DNA, 126 bp, Homo sapiens
tgtcttctttgagcaggcaataacttggacccaagttgcaaaccatctccttagctgcatgatatcttttgctaaggagacagtttgcaacttgagtccaagttaattgcctgctcaaacaagaca

SEQ ID NO: 547763 - DNA, 126 bp, Homo sapiens
acatgtttcaacaacaaaaaattaactgattccttctaaaagttgaagggtcaatatccactgccaaggagccttcagcttttagaaggaatcggttaattcccatttttgttgttgttgacgtgt

SEQ ID NO: 547764 - DNA, 126 bp, Homo sapiens
gactcatgctagtactggaattctttttgccttgagaaatggaaaggtctctccccacattttgacttttccatttctacaccctaggcagccttttccattgagttcttccatctggcgtctgtt

SEQ ID NO: 547765 - DNA, 126 bp, Homo sapiens
ggttcccgctaataggcaaacaccaggaacgtgcagcccctcccctccgcctcgcgctctttctgggaggagcctgggggggggagggtcctgcccacgggccccgccctgcactaggcggaagcc

SEQ ID NO: 547766 - DNA, 126 bp, Homo sapiens
ggggacggggcagccagtctgctgcatggcaggttgcagggcccaggtgtccgggtcctgcctacagtggcccggtgacactcagggcccggccaccccagccccaggcaggacccctccctcccc

SEQ ID NO: 547767 - DNA, 126 bp, Homo sapiens
gcacagctaatgccatgcaaattggcacagaggcaatcagcctgactctaaaagctgccccactggccgcaggctggctcattgtcttttctgtcaatttgcatctcattacccagaaggctgtgc

SEQ ID NO: 547768 - DNA, 126 bp, Homo sapiens
gacctgtataaatacttgtaagttgtactctacataaaatttctataactgttatactcttcactaggatcaccaagttattgaaattttgatgtagatgaaaatacagtgagtattatacaggtc

SEQ ID NO: 547769 - DNA, 126 bp, Homo sapiens
ggagggtgggtgctctgcccagttgagtggtaggagctggtgtgttgctgtattctcaggagctgtgtggaggagagtcagtattctagctcttgctgatggatgtgggcaggcgtgaagccttcc

SEQ ID NO: 547770 - DNA, 126 bp, Homo sapiens
ctcttctaaaggtaaggaaatatgggggtgtgagggaggagcaggcagaggcagtgacaggccaaacaggaagctggctctgaagcttcttccttatcaactggcccctaatgttaatgccaagag

SEQ ID NO: 547771 - DNA, 126 bp, Homo sapiens
tcattttgattaaataagactctggaggattaagactggagagcaatcagttgttctgaaagatagctctggagaatttattgtactgtggtcttagtcattcagagttgtgtttaatcaaagtga

SEQ ID NO: 547772 - DNA, 126 bp, Homo sapiens
tcccgggataactacttccttgtgtgcaatctcagcaaatggacaggtctgtgaggagtctccttgggtctcctgactcctcaggatgctgccatgtgctggatcaccattatcctgcttccggga

SEQ ID NO: 547773 - DNA, 126 bp, Homo sapiens
tgagggagaagaggaggcgctcatgtgcagcgatgcttccctgggtcctatccctggcgccatccctgggtactgatagggcctgaggtaagctgccacttacctggtgctctaacattctcccca

SEQ ID NO: 547774 - DNA, 126 bp, Homo sapiens
gagagatatgtttcctcagtgagtgtcctactaactgatacttttagtgttagagtctgccctgttgactcccaacactaatttattaaatagttgctgacgtcattgttttaacatttatttctc

SEQ ID NO: 547775 - DNA, 126 bp, Homo sapiens
gaccttttcaatattctgttattagatgggctggccatttcaacttcctcctgaacaaagtatcttcaacatgtgctgaagagggagaatggccagttaatcagaacaccgaatgctgaaaaggtc

SEQ ID NO: 547776 - DNA, 126 bp, Homo sapiens
tatgacaggcaaaatgtgggagcagggtattgtaaataattctcagccaattctaaaaatggcttgcagccattctaaatattgcctaggaattatttataatgcctgatataacattctgtgata

SEQ ID NO: 547777 - DNA, 126 bp, Homo sapiens
tcggtatacaaagaatttcctgtagattaatatgaagctggaaggagttgatagatttcagcagtgatttgggctattaatccaagccagtcattcattaaccctcaggaagttttctgtgccaaa

SEQ ID NO: 547778 - DNA, 126 bp, Homo sapiens
ggcagtcacttcctcgctgggctcttctcaggaagcagagcaaagtcctgggcacttctcagatactcagcctgcctgggatttctgctacctgatcaaggaagccagctccaggatcctgactcc

SEQ ID NO: 547779 - DNA, 126 bp, Homo sapiens
ctgggaaggttgcttggtctgcctagagccccggctggcaggcagtgccctgggcaagctcttcagcctgcacctgcccctgggcgctcacttcagctggagtgtggtggacagagtcctgcccag

SEQ ID NO: 547780 - DNA, 126 bp, Homo sapiens
tgtcttgtttgagcaggcaattaacttggactcaagttgcaaactgtctccttagcaaaagatatcatgcagctaaggagatggtttgcaacttgggtccaagttattgcctgctcaaagaagaca

SEQ ID NO: 547781 - DNA, 125 bp, Homo sapiens
gggcacttctggaagctgcgttaactctttcaggccaccggggtgctgtttgatgcacagagccaatcatttactaaatggtaccatggggaccccaaagagttaaggcagcttccaaaaggccc

SEQ ID NO: 547782 - DNA, 125 bp, Homo sapiens
caaaatctgcaattgatcaagctccccaggtgatccctaatgtgcacaggaatcatattcttcagattcagaattcctatgcacattagcaatcgcctgggcagcttgataagttgcagattttg

SEQ ID NO: 547783 - DNA, 125 bp, Homo sapiens
cggaccctgagctctggccacggcatctgtttgcaatgtttgactcggtagttttatttctgcttggcggtataatataaactatcttgttacacggcaggcaggctgggcgcagagccgggacg

SEQ ID NO: 547784 - DNA, 125 bp, Homo sapiens
ttagacaccagttctgctcattctgaagtcataattcatgtcattgaatgaaaatctcatttaatgtcatgaaattagcatttaatgacatgcattatgactacagaatgagtagaattgtttaa

SEQ ID NO: 547785 - DNA, 125 bp, Homo sapiens
agaaatagactgaagtcatttttgcccttaggaattatagtgccatttgttttcattttgaaaataaaaacaaatgacagtacgatttcctccgagggaaagtactttagttgtaaagtatttct

SEQ ID NO: 547786 - DNA, 125 bp, Homo sapiens
gtgattcttgctccatttgtactaaattggcccttctgaagagttgagcatcctggatgtccagatgtttgtctatatagaagtggttgttgagtatataatgaagcaccacaaaaaagtatcac

SEQ ID NO: 547787 - DNA, 125 bp, Homo sapiens
ctgtgtccctttagcctcttacatcatcaccagcaataaagattttactgtcaggacttggctgacaaatttgcaggctctttattactggtgatgatggactataagaagcagaaaaaacacag

SEQ ID NO: 547788 - DNA, 125 bp, Homo sapiens
ttctctcgatctcccaccccttccccagtgccactcatctgtcagcctcactggtagcacccatgaggtagttgctaccaatgaggctgacagatgggggcaggtttgtgtggcgccttagagaa

SEQ ID NO: 547789 - DNA, 125 bp, Homo sapiens
gataagagatgtactgagatacagccatagacacagttcacaaaaccttggccttgtgactagctgttccactggccagaattttgtgaacagttgtgatggcgctatcccagtgcctctctttc

SEQ ID NO: 547790 - DNA, 125 bp, Homo sapiens
gtcctgatgaacaactaacaatcgtccgcccccacagagaagcacagggcccagccatacccacctctccgctctgccctggtgctcttctgtccacctggagagccacagcctgatctcaggac

SEQ ID NO: 547791 - DNA, 125 bp, Homo sapiens
caggcttctcttgcatgtgtagctgcttctgccacctggtttcatttccagcacattattcctgtttatgtgggtgctgggaagtgggaaaaggggcctcactgctggacaaaacactctgcttg

SEQ ID NO: 547792 - DNA, 125 bp, Homo sapiens
ggggtgtatgaaggaagcctggttagtggggagagtgggattagggaacagctgcttaacctggcttgtttcaagtccccctttctccctttttgccctcaaaaagttcccctcattttttcccc

SEQ ID NO: 547793 - DNA, 125 bp, Homo sapiens
agcactgagacaattgtccatatcattcaagccaaagaaacactttgatttgaaattctgtatctaaatgattggggccagagtgctcctttggtttgagtgatttggataattgtttcagttct

SEQ ID NO: 547794 - DNA, 125 bp, Homo sapiens
tggtacaagacaacatgaattaatctatatatctgagttgagttctgaactttccattttggatatatggaaagttgttaactttacttaggtgtgtgtggtaatttaatgtacatccaaggcca

SEQ ID NO: 547795 - DNA, 125 bp, Homo sapiens
agttatttgtcttaaccatgtgctgtcatgttttgcttcttaactttatcaaacaaaaccagcctttgggagagtgtttggtcagggttatagcttagctcagcatgggtgcagacagattttct

SEQ ID NO: 547796 - DNA, 125 bp, Homo sapiens
tgcatctctgcttttctctccatatttcttttctccactcgcttcctctctcccagctgcagggattcgtcctctaaaagagtggaggtgggagggaacaagaaatggaagcaaagcagggagca

SEQ ID NO: 547797 - DNA, 125 bp, Homo sapiens
cctagaatagcctagaatagttcctggcacagagcaggtgtgcagtaaatatttgttgatgaataaagttccacaaatgtctattgagcacccactctatgccagcccctgtgctgggcactagg

SEQ ID NO: 547798 - DNA, 125 bp, Homo sapiens
tgtgtagatgactgaatctatgcagtggagtatatatatatgtgtgtgtgtgtatacatataatatgtatatagatttaaatacgtatgtatttatgcgccagcatgggcaacatgtctctacca

SEQ ID NO: 547799 - DNA, 125 bp, Homo sapiens
acggtttgtttcagcagtagatggctacaggtgacgcaggtatccagaaatcctgccctccaaatgatcaaagcaggcctagtcctggatgcctgtgacatctgagtgtatctgaaaccatctgt

SEQ ID NO: 547800 - DNA, 125 bp, Homo sapiens
cccccggtgcaccacatgttagctggatgtctgctccaggacaggggccccaggcagagggtaccccaaagaaacatgggccccagcccctggggacagacagaatgacagggtgaggtggaggg

SEQ ID NO: 547801 - DNA, 124 bp, Homo sapiens
gtgattaaacatcgaggctttgatgttttatacggcattcttccccacaattaacttcattagtgcagttaattagtggggaagaatatcgtataaacatcaaagcctcagtgtttagtgtcac

SEQ ID NO: 547802 - DNA, 124 bp, Homo sapiens
ccccatctgccgggcaggtgagtcccttccctccccaggcctcgcttccccagccttctgaaagaaggaggtttaggggatcgagggctggcggggagaagcagacaccctcccagcagagggg

SEQ ID NO: 547803 - DNA, 124 bp, Homo sapiens
actgttaaggaggttaatctctgttctccttgcttaccctccctgcagtaaggttggtgccccctctccttacttcaggggaggtttgtgagagggctgacagcagaagccttctggagccagt

SEQ ID NO: 547804 - DNA, 124 bp, Homo sapiens
ggatttcacaggccacgtgattagtcgcacaagttggatggagttgggggattttatgcacacaggttcccaaccataaaatctcccaactctggccgggtgcagtggctcacgcctgtaatcc

SEQ ID NO: 547805 - DNA, 124 bp, Homo sapiens
ggggaaggtgggtccagatgaggtgagccagtggagagcttaagggactgacaactccttctccagtcctcttccttctgagttcctccattggtcacactgtaccctaattaatgctttccct

SEQ ID NO: 547806 - DNA, 124 bp, Homo sapiens
gagagctgcagccctcttgtctggctgatcaggaagctactgccagcagcctgcagccctgggggcgcacaggtctgctgcagagcatggctttcctcggcccagacggctgttcctgctcctc

SEQ ID NO: 547807 - DNA, 124 bp, Homo sapiens
tattattcgataaaactgtaaaactattgtgtagtcagctcataaattataagcaaatggatactgctaaaatagattttatgggctgattacacaagagtcttaaaacttgtcgaatagtttg

SEQ ID NO: 547808 - DNA, 124 bp, Homo sapiens
aaccctccttgggaagtgaagctcaggctgtgatttcaagccagggggcgtttttctataactggatgaaaagcacctccagagcttgaagctcacagtttgagagcaatcgtctaaggaagtt

SEQ ID NO: 547809 - DNA, 124 bp, Homo sapiens
ccttctgggacaggaacacatccacatcagcttctttcatacccccaaatacttagggcaatgcctgttctgtttgtgggttaatgaatgagtcagtggacaagattttctgactgcctgaggg

SEQ ID NO: 547810 - DNA, 124 bp, Homo sapiens
aagtcacagagaaggtataatcataagtatgggtatttctaccatatgtttaggcatatggtagaaataatgcaaacatatggtggaaataatcatacttatgattgtacctcctctgtgactt

SEQ ID NO: 547811 - DNA, 124 bp, Homo sapiens
tcaccttttggaggtaaacggtctctttccagggcaccaggggatcatttagcactctggaagaagtaatttgctctatggttctctggtgtcctgaaaagtgtaatccacctccaaaaggtga

SEQ ID NO: 547812 - DNA, 124 bp, Homo sapiens
gttccttaaaggattctgatttttctcacatccctcacgtccttcctgataggcagggtttctttctgtgtctgtttgggaagggtgttcagggggccttctctccaagtctccatcctggaac

SEQ ID NO: 547813 - DNA, 124 bp, Homo sapiens
tgcattgtgctcacattcccttaaatgttgtttccaaaggtgctcagcctctagcccagctggaatctccgggaagaggcagagacagtttggggaaaaagacacaggggaggagcgggaggca

SEQ ID NO: 547814 - DNA, 124 bp, Homo sapiens
tttttccttgtagagaggaaagttttagataaacaacagagaatcagtaaataattcagcctatgaccttgatgcttattgattcctgcagctgtttatctttctctaggctacccaggaaaga

SEQ ID NO: 547815 - DNA, 124 bp, Homo sapiens
ggaatgcagttggccctagacagacctggagccagaagatggggtagagtcaggcccccaggctgtgtgcctagccatctgcctctgcctcactttgcagaccagctctgtctgccactcgtct

SEQ ID NO: 547816 - DNA, 124 bp, Homo sapiens
gcttctaagtgggcagtgctgccccgtgcccctccagacttctcttcccagcagggcagcagtgcatggcaccctgggatagaaggcctgcaggggcagaggggaggctgaacatgctgggggc

SEQ ID NO: 547817 - DNA, 124 bp, Homo sapiens
ggtgtctcagtctctctgagcctcagtctataaaggggtcacagactcctggtagccagtgaacagggtggttgtttttgggggtgggtggcccctagggctgtgcagggaggcctggggtacc

SEQ ID NO: 547818 - DNA, 124 bp, Homo sapiens
gccaccaccatcagccatactatgtgtagtgccttattcaggaaggtgttacttaatagattaatatttgtaaggcacccttctgagtagagtaatgtgcaacatggacaacatttgtggtggc

SEQ ID NO: 547819 - DNA, 124 bp, Homo sapiens
ttacaacatccattaaaagttagtaacattaatttaacagggagaaaatctaatagagttcttagagtgatactggcatttttccattaaattaatgttacaaacttttaacaggatgtcttaa

SEQ ID NO: 547820 - DNA, 124 bp, Homo sapiens
tttgagaaccactgtccttaaggaatacgtagatttgttgcctttcctggaggcaacaaatctcatgctcctggagagaaggaaacaaatctatgtactcgttaaggacagtggttacattaga

SEQ ID NO: 547821 - DNA, 124 bp, Homo sapiens
acattctgtacctatctcttttctgattagagaggtggcatggagcctggctcattaggcagaagtaatgagccagtctatacgccatctctaattagagaaaagatacagtaggtacgactgt

SEQ ID NO: 547822 - DNA, 123 bp, Homo sapiens
caaaactcctccttttggtttatttgccaacagacttcagcttcttgagcaaagttactgatgagggttttgcccaagaagccaaagtctgttggcaaacaaaccaaaaggagaagatttttg

SEQ ID NO: 547823 - DNA, 123 bp, Homo sapiens
ggtgggcgccggagcctccagacccggggtcggcctcgcccatgcccagcggctggtgtggacccccagctgtctcaggtggggtggggtggcccctgggtggcggcgtttctgcagcccacc

SEQ ID NO: 547824 - DNA, 123 bp, Homo sapiens
cacctggctggattcttcagtttttaaatgcatatttatgttattctgataatgacagatctcctaaactatcattctgagaataacataaatgcacatttgaaaactggagaattctgggtg

SEQ ID NO: 547825 - DNA, 123 bp, Homo sapiens
gcagggtttattccacatctggccaaaattgttaactgcacattttatgcaattcatttgagttgcatttagaatgtgtgtaataattctagctagtgactgtatttgtgggatgagaactgt

SEQ ID NO: 547826 - DNA, 123 bp, Homo sapiens
acccaagaggaactgtttcctgctttctgttagaacagtctgcaatgacctatagtaacactgctgaggcagaggttactatcgggcattagatgctgctatcaggaagtcagtcactcgggt

SEQ ID NO: 547827 - DNA, 123 bp, Homo sapiens
tccttcacagctacacaaggacaggcattcagtctctgagataataaggaattcacagcaaccaggctttcctccttcatggactgaaatgactgttttatgtgcatttggctgaaataagga

SEQ ID NO: 547828 - DNA, 123 bp, Homo sapiens
tgatagccctgccctttcccaggcttctgtgcagggacctttgctgcctgcaaacagtagggacacctgttttctgagcagggaaggccagcatctgaaatcttaggaatggggctgctatta

SEQ ID NO: 547829 - DNA, 123 bp, Homo sapiens
tctatgaagcacatcatttggaatttggggaatgatgaagcagaaaccttgacagtactctctagaagcgagatttctacttaaatattgtttccccagtttccagattctgtgctttagaga

SEQ ID NO: 547830 - DNA, 123 bp, Homo sapiens
gcacaaagtcggagcaatgacaattggaactccatggctattccattgaaagtcaattgaatttcaatttccttcaatgggaaaagccaggaggaaccaattattgttgctttaacattgtgc

SEQ ID NO: 547831 - DNA, 123 bp, Homo sapiens
ccggagtcccagagtgaatgaatggctggggagatcccgggatcaaatcgggtgctttctaatagtgtccacctgatttgattctgggatctcctgagccattcattcactttgggaatttgg

SEQ ID NO: 547832 - DNA, 123 bp, Homo sapiens
ccaggcagccctgggagatctcttcttcaaggctgaggcccagagagaggccacattcctcaggttgccttttgtgggcctcagtttctgccatctgacaattgtctcctcaaagctgtctgg

SEQ ID NO: 547833 - DNA, 123 bp, Homo sapiens
acaatgaatcctattcacatcctgtgtaactccaaggggatgctatggggaaagtttccatatatggtaattttccccatagactccccacagtttatacaggatatgaatctggtccattgt

SEQ ID NO: 547834 - DNA, 123 bp, Homo sapiens
gggagatgctcttcaccccccattttgtgttctcatttgtgtccttccagggaagtcactgaaacaacctgaggacttctccaggaggatttacaaagaggacacaaggggagggcattgctt

SEQ ID NO: 547835 - DNA, 123 bp, Homo sapiens
caaaaatcttctccttttggtttgtttgccaacagactttggcttcttgggcaaaaccctcatcagtaactttgctcaagaagctgaagtctgttggcaaataaaccaaaaggaggagttttg

SEQ ID NO: 547836 - DNA, 123 bp, Homo sapiens
ctggctacattaaacaagtaaatttgtagcttagcacggtttacttaacaagcccagttatgacagagctggagaggagagaaagctgtgttggagaggcaggaaggtgtgatgttcagccag

SEQ ID NO: 547837 - DNA, 123 bp, Homo sapiens
gggccttgattccagaagaaggagctctctgaatatgggtttactagttggtggtgaattcatgagtcgccaactattaggcctttatgtccagatattatcctaatttatggagtaaggtcc

SEQ ID NO: 547838 - DNA, 123 bp, Homo sapiens
ttaggtaagggaaatacatgctcaggtttgcattccagatgtgtatttttagtgcctgtttggtgctggcactgaaaagacacatctgaaatgcaaacctgaacatatgtttcccttacttaa

SEQ ID NO: 547839 - DNA, 123 bp, Homo sapiens
gggttctagttttcagcagcatcttccgcctttggcaatggatggtcatctagtgcaatgtttggcacacagtaggtgccatgtatatgtcaaatggataactgagtgaaatagcatgaaccc

SEQ ID NO: 547840 - DNA, 123 bp, Homo sapiens
gctggccttcaggagggccttggctgggtgggcatgtgggcagggtgctgacaggacaacagccttcctgtccagcctgcccacacccactcctctttgccctcagggctctgccgagccagc

SEQ ID NO: 547841 - DNA, 122 bp, Homo sapiens
ggtggctcccgctggctcccccaccactcctggtgatgttctccccacgactgtcttataataggacctgtggcagtcctggggaaacaccaaaatgacggtggggagctttgtggaacatc

SEQ ID NO: 547842 - DNA, 122 bp, Homo sapiens
tgacctggcatgtcttgggcactcagggcatgactatttgtagtcttttctccctttcaccaaggggatcactcctgctgctcctggtaccatgtcctgtcccgtgaagatcctgccagtca

SEQ ID NO: 547843 - DNA, 122 bp, Homo sapiens
tcttctttcacattctcaatgtcagaggagggtatcaggtgaggttggaggagatgttggaggctggcaggggaaacaaaaaatgtctgatactcctggaggagaggagaatgaatagaaga

SEQ ID NO: 547844 - DNA, 122 bp, Homo sapiens
tcttcacacctccagtagcccagaggatgcagaggttttggtaaccattgcacaaggtccaggtccttgtggaagttatggtgacctctgtagaaccaccttgctatataagaggaggagga

SEQ ID NO: 547845 - DNA, 122 bp, Homo sapiens
gctgctgcctgcaacactgaccgagtgacaatctgggcttgttgactgggctggatagtggctgtactggttgggtctagttggagcccccaggaggtcaccactgtggctaggatagcagt

SEQ ID NO: 547846 - DNA, 122 bp, Homo sapiens
ggccgctatgtgggtggtatatggtgggctgttgggtggagcggggcgggtcgttactgatctatctggaatacccgctttatctctacccagcaaactgctacccatccaagacccaggcc

SEQ ID NO: 547847 - DNA, 122 bp, Homo sapiens
ggagctagattctttgtctagctctagaatctctttgtgcaaaaatccctgtgagtaccacacagagggatttttgcacagattctagagctgaacaaaggatctttaagtctattttctcc

SEQ ID NO: 547848 - DNA, 122 bp, Homo sapiens
tcttagtgtggtggttttgattgttgagctttcttttggtggagaaggagaaaggatttttaggccatgatttttattctcatcaaaaggcatatattgagaccacttcatacccgctagga

SEQ ID NO: 547849 - DNA, 122 bp, Homo sapiens
cgtttaactttaatgctaggtttcaaattgttgtatggacaggaaagtaacattagaaaaattactctactgttgctttcttttctatacagtggtttgaactcaagcaataaagttaaatg

SEQ ID NO: 547850 - DNA, 122 bp, Homo sapiens
gtgttagaggttaataacactgttatttcctctattacctggatttaataaaagcagtggggcataacattctgtaaagccaggcaataagaggaaataacacaaatgttaacctctaacat

SEQ ID NO: 547851 - DNA, 122 bp, Homo sapiens
atgtattgatattatcattcttgctgacatattctggaagctttcagccccaccaacactgccccacccaggacttctgcagctgagagttcctgtgtcagtagggtctgatatttgtacat

SEQ ID NO: 547852 - DNA, 122 bp, Homo sapiens
ggaaaacaatcccccaagaccttggccttctccctgtggaggaccccttacccaccttgtcatggacgtcagggacccctctgagtggaggagtcagatagggcttggggggtgtcagggcc

SEQ ID NO: 547853 - DNA, 122 bp, Homo sapiens
ctgccaaaaaaatcacagtaaagtccttttgaaaaaacccttcaccgagtgtggtggctcacgcctgtagccacctcactcggctaaggattttttcaaaaggattttactgtccttgggag

SEQ ID NO: 547854 - DNA, 122 bp, Homo sapiens
gccctgtcccctgtgccttgggcgggcggctgttaagacttgcagtgatgtttaactcctctccacgtgaacatcacagcaagtctgtgctgcttcccgtccctacgctgcctgggcagggt

SEQ ID NO: 547855 - DNA, 122 bp, Homo sapiens
actgaatgcctgacccctcagaatggccattctcttgcctgcctctccagctctctgtagtgacatctgagcatgccgtggggaggcaggaggggaggcttgctggatctcttggtggaagt

SEQ ID NO: 547856 - DNA, 122 bp, Homo sapiens
ttctgcaattcaaaaatgactgaagctgtgaacttcaaatttggcaagattgtagtcctcattaaggaagggaatggaagccaattttgaagaaaaatggtttcctatttttgagtgtagaa

SEQ ID NO: 547857 - DNA, 122 bp, Homo sapiens
gcctgggagccatgcagcacaatcagtctggcttctcccatccagctctgccctgaccagcagagctgtgtggtgggaggcgagggctgctgctaatcatgctttctgaacacgccacaggc

SEQ ID NO: 547858 - DNA, 122 bp, Homo sapiens
tgctcatttttagcttatttcttgtaccttgcagcacactctacgcactcagcccttaaggggtttactttacaaactgtgtgcctgtaagatgtattagcaataagatagaaaattgagca

SEQ ID NO: 547859 - DNA, 122 bp, Homo sapiens
atgagggaaatagcagtcatattgagagttgcatggcttgttgaatacttggctggaatcctataaaaggagaaatcattaagtgtcagttaatccctgtagctctttgttattgttctcat

SEQ ID NO: 547860 - DNA, 122 bp, Homo sapiens
ggcgaggcacgcagcgcccctaagcctggctctatcctgaaagggcacctaagcgtgaacagagccggtgcctgcaaaacctccaggaagagctgggtgcgagtgggcgtttgatacacgct

SEQ ID NO: 547861 - DNA, 122 bp, Homo sapiens
tgtgtcagttgaggcattagagatcaagtgacttgctcaaggtctcacatagctatgacagtatttgctattacatgaaaccttgagcaagttacttgacttctaatgcctcagttggctca

SEQ ID NO: 547862 - DNA, 122 bp, Homo sapiens
tctcgaggctctatcgggcgcgcatgctcagcgcgccgctcgtggccccactagcctcactgcgcgcttccgcggcagccgcggcggccgagctgagtgtgcgggccaggagagccaagaga

SEQ ID NO: 547863 - DNA, 122 bp, Homo sapiens
gaaaacttgcatatatcccttacccccatacattctgggagcacaggctgaactcatcgccaccagcttagtttagtctttgctcccagaatttatggtggtaatggatatatgcgtgtttc

SEQ ID NO: 547864 - DNA, 122 bp, Homo sapiens
tatccacaatatcccaaagggtctgacttctggagggagatataaactccctccagagcattttatagaggtaatgtttatatttcccttcagaagttgaacctattgggatattgtgttta

SEQ ID NO: 547865 - DNA, 122 bp, Homo sapiens
agccagtagctgcactgcagcccatagattctgaggattctacaaagcaatgtgtagaatgagatgcctttgacctgaattctcgggattttaaaatctgctgacagtagcagtttctggct

SEQ ID NO: 547866 - DNA, 121 bp, Homo sapiens
gggaagagaaacaggatggctgggtggatgggtgtgtattcggggatcaatgggtgggcctctgaaaataggcctgtccccgaatcccagcctgttttttccagttaacacttctcttcct

SEQ ID NO: 547867 - DNA, 121 bp, Homo sapiens
agtggatggagccaggatgagaccaggagtgacagagtgacattttctgatgtgagctggccctatattgctgctagaggatggctctggtcttctctagttctttctggctctatgtggt

SEQ ID NO: 547868 - DNA, 121 bp, Homo sapiens
gtcagatggtacaattatagttattttgcagagtcaattttctgttacataatcacatagacttgtatctaatgcaacagaaaattgcctgggtggaataactttcaggtgttggtttgac

SEQ ID NO: 547869 - DNA, 121 bp, Homo sapiens
agctaaggaattcaaagctgagataacaccccatctttaattcatgcaattggggaaaataaataaaacaacatgagttaaaaaggggggtgtcagtcttaaaaatctaaactccttggct

SEQ ID NO: 547870 - DNA, 121 bp, Homo sapiens
cattaaggcactcccgggtacattttattggtccattaatatagggcccgagtggttgaatacacctaaggcatgtactgtattaatgaaccaataaaacatgccctggagtgtcttaatg

SEQ ID NO: 547871 - DNA, 121 bp, Homo sapiens
catcttttgaggccacatagttgggtcctctgccttctgtctatttactctctctgttttaaatcttatagagagtaaacagatagaatgcaggagacccaatatgtggcctcaaaggatg

SEQ ID NO: 547872 - DNA, 121 bp, Homo sapiens
gtccgtccagcttgcattttcctcttttccaggtaccagagtcttggttttgcttcaggaaacctcattcttggtgtctgcagttgaggtaagattgatcccctctgttccatggatgggc

SEQ ID NO: 547873 - DNA, 121 bp, Homo sapiens
cattaagacactccagggcatgttttattggttcattaatacagtacatgccttaggtgtattcaaccactcgggccctatattaatggaccaataaaatgtacccgggagtgccttaatg

SEQ ID NO: 547874 - DNA, 121 bp, Homo sapiens
cattataagcaaatatatggaagcatattcttaaactacaaaactctttcgagtggcattttgtgagaattattcagagatttgagtttaagaaatatgttcctatatgttgtttacaatg

SEQ ID NO: 547875 - DNA, 121 bp, Homo sapiens
gtgtgtgtggaggggaggtgggaggtcatacctgagcagtctgggggactcttgctcaggggacaggaagagtgttctagaaactgctcttgttatacccccgctccaccaaaatacatac

SEQ ID NO: 547876 - DNA, 121 bp, Homo sapiens
gtgtatcgtactgcctagctttgcctgcaggagcaggtgggacccccagagcctgcatggacagtggtggggtgccagcctgccctgctagcatggagttgggtgcagcgggatggtacat

SEQ ID NO: 547877 - DNA, 121 bp, Homo sapiens
ggaattctcactgcccctcttcctaatgtgtgttctaacacaaattcacctgtgactgcattacagaggcgaatttatgttagaacacatgtcagggagaagggtgtgataggggaattcc

SEQ ID NO: 547878 - DNA, 121 bp, Homo sapiens
ccagcgagggcatgggctgctggggtggcccaccttccccggtgtacatactgtgtctgtgtaacattttgtatattccagagggtagggctgcccctgtatcatacctagcagaggttgg

SEQ ID NO: 547879 - DNA, 121 bp, Homo sapiens
gaactaattgttctgtgattgattgatagtttccctcttgttgctacatacagcccaatgacatgcattgtacacacaacaggaggtaagagagtcaatcaattagggaaacaattagttc

SEQ ID NO: 547880 - DNA, 121 bp, Homo sapiens
tagttgaagacagcgtaagtctgtgttttggtatcacagcttggtatcaccagcttaaggtatccccccttaagctgggatgttgatgttgtactacagagatcttgcagcgttacaacta

SEQ ID NO: 547881 - DNA, 121 bp, Homo sapiens
gcttcttagtgatttcctgcatttcttcttttgtgcctatttgaacctacaactgtcaccagttgttccagtgatcagaaaggcacaggcgctgtgtgggtgaaattctgtgactgtgagc

SEQ ID NO: 547882 - DNA, 121 bp, Homo sapiens
ggcgactgagagagggccaggggaaaggaggcctgattggggggcccctggagagttgtccatgagagagccatgccccccggtcaggttcagccagcttctgcgtactctctcagccgcc

SEQ ID NO: 547883 - DNA, 121 bp, Homo sapiens
gctaggatagtttgggtttttaatatttagctttctgtggccagtcactggagaggtgagaaggcagggctagttgactggccatggtaagctaaaccttaaacacccaaagcatcaaagt

SEQ ID NO: 547884 - DNA, 121 bp, Homo sapiens
ctggggtgggctggtaaggatctgtgccaaccttgcgggtgggggagaagggagggggcaggtgcctagcagattcccttccccctttccctcaacctgggctccccgccagctgccccag

SEQ ID NO: 547885 - DNA, 121 bp, Homo sapiens
gaacacagtgaatgtgggagctgtgtggagccgggaagggggagggttggagcccccagaaactggctcttccagctgtctcagtgtcctgcccaccgcagaacccccacctcactggttc

SEQ ID NO: 547886 - DNA, 120 bp, Homo sapiens
gcagaagaatgaactgctccttctcccatacccattgcatatcggagttgtgaattctcaaaacacctcctgtgtgcatggattacaggagggtgagccttgtcatcgtgaatcttctgc

SEQ ID NO: 547887 - DNA, 120 bp, Homo sapiens
cattatgttgaggaagtaacagacctggagtcaagaggtgtgccttagtcactaaccagatgtgtgacctagagcaagtcacttgacctctctgggcttcaaattcttccttatgtaatg

SEQ ID NO: 547888 - DNA, 120 bp, Homo sapiens
aagcctgttacctatatcctctgtttctttttgttgagcagctgcatgaaagtagcccataactttgaggctggtgcagatgctaaattaaagagaaactgatctgggtaatgtgtgctt

SEQ ID NO: 547889 - DNA, 120 bp, Homo sapiens
gctgttttgtttccaactcccagtcataatcctttgttcatgacattataatcatcaccacaagtggctaattgtgatgtcacaaatggaggattatgactcaaatgaggaataaacagc

SEQ ID NO: 547890 - DNA, 120 bp, Homo sapiens
agctcagaggaaggaagggcttgtattccgaggatttggggggctggagaggggtcctagtgggctctgctgtagcctgcaaggtcctacaagcccaggtccttcctgccctctctggct

SEQ ID NO: 547891 - DNA, 120 bp, Homo sapiens
ccgggggcccagctgctcgctcagcacgtccaggaagcggtcagtatcgcggcttcgcacagggtgggagaaggtgaagagcttcctgcggctgggcgggcgggtggggtccgggcttgg

SEQ ID NO: 547892 - DNA, 120 bp, Homo sapiens
ggagtttcaatgtcttcctcccaaaaacctctaagctgattccactctttccacagacctgctgtagtgcggtgtgggtggagggagggatcagaaggtacagaaaaaaaagactgctcc

SEQ ID NO: 547893 - DNA, 120 bp, Homo sapiens
gtgtcagcctccctgccccctacccacatttctgcccccagtgtccctgcttcaggatggacaggatgcagggagttgggaggtggcaagctgggtggggtggagcggcgggctagaggc

SEQ ID NO: 547894 - DNA, 120 bp, Homo sapiens
ggctaagccaatttcattgatgcatttttaaacattattaaacaggttcagaaacaatgtttccaaagttgcatttgaaattgtttaacaatgtttacatcagtgaaattagtttaggcc

SEQ ID NO: 547895 - DNA, 120 bp, Homo sapiens
aggggaaaaaggtgggagacttggcaagaagccatgaatcaggagaggtctgctcaggccaacttgatcttctccttgatccctttggcttcttgcttctcctctttccttttctcctct

SEQ ID NO: 547896 - DNA, 120 bp, Homo sapiens
ttgcaatagaaattctttctggttaggaaaaataaaaggcagtgataggccactgaacattctgggaacagtcatgcctctgccttttgtccctgacagagaagataaagtcacgtgtag

SEQ ID NO: 547897 - DNA, 120 bp, Homo sapiens
caagattatgtgatgattttaaagtgtgttataggttaaatgctaagtatttttattaatttaggaagtactttggcatatggcctttaaaattacattattatattatcgtaaatcttg

SEQ ID NO: 547898 - DNA, 120 bp, Homo sapiens
ggaaatattgttcattagctgtaatctgcggaattgcttgagtgaacttcctttggaggctgctttaaacggttcactcaagtaaagcagtttgtatggtaattaagggagcatttttct

SEQ ID NO: 547899 - DNA, 120 bp, Homo sapiens
ttcctgacagatggctttccaggggtaggtgtgagagacccagaagtagggctctgtaattagtctcccttcacccttagccctgtcctcagccacctctggacaagataatgttaggga

SEQ ID NO: 547900 - DNA, 120 bp, Homo sapiens
tccttgaaaaattaattggtcaggttttgctataatggataacaacctacgttagagataccgcatatgaacaaattattagtctttatagcatacattgactaattaattttccaggga

SEQ ID NO: 547901 - DNA, 120 bp, Homo sapiens
ggcaggagtggttaaccggcttttaataactcattttgctgaatgatttctggtgaggagagaaaaccttaatcccagagataaagcacagagtggggggtggttgaagtcagccctgct

SEQ ID NO: 547902 - DNA, 120 bp, Homo sapiens
tttccagagcccagtccttctttggtatttaaaacgtggatattccttctatgtttacgtgattcctggttaatcatagaggaaaatccatgttttcagtatcaaatgctgctttggaaa

SEQ ID NO: 547903 - DNA, 120 bp, Homo sapiens
ccattggttttctttgtgtttctgttttgtattatagtgtacgatggctccctggcctctctgggtctctcagggaaccaagcgtccactgtgcccaagaaggaaaaaggaaaaaagtgg

SEQ ID NO: 547904 - DNA, 120 bp, Homo sapiens
gtggggtagtcctctggcttctctgggcctggtttcccctttttttgtgtactaagggagctacatggaagaggggaggctcaggaatggagtagagggtcagggccttagctgccccat

SEQ ID NO: 547905 - DNA, 120 bp, Homo sapiens
gcttcttttatctaatctctacgttaacaaatggacgctgcagccagtgtctatcctgtggctgaggcatggacgctggctgtagcaaccatttgttaggtgtagacggttctctgaagc

SEQ ID NO: 547906 - DNA, 120 bp, Homo sapiens
tccagagcccagcctggcacattagtaggcctcagtaaatgtttattagatgaataaatgaatgactcatcagcaaacatttattgtgtgcctgctaaagtgagctccacaggctctgga

SEQ ID NO: 547907 - DNA, 120 bp, Homo sapiens
gtttcttgttctcctctatataccctcagagctgatatgagtgtggagattccattcacttcaaaggaagcttcacgcttggatcttctccacaggggtgcttagactaagacaagaaat

SEQ ID NO: 547908 - DNA, 120 bp, Homo sapiens
tccagagcctgtggagctcactttagcaggcacacaataaatgtttgctgatgagtcattcatttattcatctaataaacatttactgaggcctactaatgtgccaggctgggctctgga

SEQ ID NO: 547909 - DNA, 120 bp, Homo sapiens
ttccttcttactagctctgtgactttggccaagtcccctcatctttctgatgtcaaacagaaatggaagtttagaaaaatgaagggacttgcctaaggtcacaactagcaagagagggaa

SEQ ID NO: 547910 - DNA, 120 bp, Homo sapiens
ctggttgtgaaattttagaagaggttaagtttagaagaagcaagtttcctttgttgcaggttgctgaaaaggaaatttacctcttctaaactttacctgttctaaaatttcagcctccag

SEQ ID NO: 547911 - DNA, 120 bp, Homo sapiens
aagagaggcactgggatagcgccatcacaactgttcacaaaattctggccagtggaacagctagtcacaaggccaaggttttgtgaactgtgtctatggctgtatctcagtacatctctt

SEQ ID NO: 547912 - DNA, 119 bp, Homo sapiens
gtcccagctattaaatcaggcagttggaaagtacataaattctttcaaaccctaagtggttccctggtagtctgaaaggatttatatacttccctacatgcctagcttactagagggac

SEQ ID NO: 547913 - DNA, 119 bp, Homo sapiens
aggcactggcccacctctctagggacccctgcagctcccactcactctgggctgggaccgcggtctggatgccagggagtggaaaggagctgaaggaactctcgcaggcgggcaggcct

SEQ ID NO: 547914 - DNA, 119 bp, Homo sapiens
acaactgagggaggaagggactattttttcaaaggcttttagaggatgttgttaaaagaatatatagtgacatcatttaaaagccttttaaataatagtcctctttccctcccaattgt

SEQ ID NO: 547915 - DNA, 119 bp, Homo sapiens
ggaagactctgcccacttcaaatccctgcctggggaaggacacatgggaatggggccgggggaaaaggcgggccacctcgggccttcgtcacctgtgtcagctcctagggattgtctcc

SEQ ID NO: 547916 - DNA, 119 bp, Homo sapiens
aaggctgccttatagcaagaacagatcatgttttttccaatagtgaatatgccactaaaattcactggcatattcaccactggacaaatcattagcagtacttgctataaggcaggctt

SEQ ID NO: 547917 - DNA, 119 bp, Homo sapiens
gacctttgctctttattatatcggacaggtcagtttgcaagtttgttgggttggggcaacttttctgaatcagactcatgtactgataaattctgcacttggtggaggaggcaaaggtt

SEQ ID NO: 547918 - DNA, 119 bp, Homo sapiens
gctctgctgcctgttctgttgtgtgcactggaatattgatttttcagtgtgtgtgcgccggctctgtaaaaatcaatatttcagtagctcgagcacagcgcagggcagtgtaatggagc

SEQ ID NO: 547919 - DNA, 119 bp, Homo sapiens
ggctgcggcggatcatgcccatggtgtagccgccaagcggaggcatggctgccggaaggttactgctctacactggcctctcgctagcgctctgcgccctcggcatgctggccgtggcc

SEQ ID NO: 547920 - DNA, 119 bp, Homo sapiens
actgttctactccttggataatatattcatatcccaaatataggtaacaggctgtactaactggcacactctacagactgttacctaaatttgggatattaatgaaggagtagatcagt

SEQ ID NO: 547921 - DNA, 119 bp, Homo sapiens
ggatgataacagatgtctgaaaaatttttctctccttgatttcgtggctagccatttcaaaaagctagtgaaattaaagaggaaaatcttttcaaggcaaatttgggaatttatcatcc

SEQ ID NO: 547922 - DNA, 119 bp, Homo sapiens
gcattagttctgctgagtaatctttaacttgctgctttataatgattataatgagatatcactgggtattatggtctttgggtagcagcagggtagggatttccaggctgggactaagc

SEQ ID NO: 547923 - DNA, 119 bp, Homo sapiens
ggagccctcctgtcccagagaaggtaggattgagcggcaccgccagaaaccctggctgcttttttccggattgggttgtgtgtggtgtgtttatcctgagatggtataggcagggcttt

SEQ ID NO: 547924 - DNA, 119 bp, Homo sapiens
tgtctattacagcacttagcatagggtggagtgggggaaggagtgttatttagcagagtggaccaagcacagcttgcattccagtccccactgtgtcctaagctgtgtgattttggaca

SEQ ID NO: 547925 - DNA, 119 bp, Homo sapiens
tactctgttatttaaataccaatgcacaacatttcccaaagaaacctttctttatgaattctggaagaaaactttctttgggaaaggttgtgcattgttttattttaagttccagggta

SEQ ID NO: 547926 - DNA, 119 bp, Homo sapiens
ggaagaaatatctagttggcactggcttacttctcctgacccccctggggttgttatgctatccgcatctcaggatcaggtgggtagggagcaccagcctccaacttctgtcctcttct

SEQ ID NO: 547927 - DNA, 119 bp, Homo sapiens
gttgctaagctgctgttgtttaaattaatggggcaacagggctgagtgggaagggctaaacttgacaggcgggcttatctagctcaattcctgagtgcctcatttagtagcttagggac

SEQ ID NO: 547928 - DNA, 119 bp, Homo sapiens
cgtatacaaaccgtaagagagtcttaaagatacatcagggtaggtgggatactataacaacatttagcatattgttatactattccacccaccttaatgaggatcctttaggtgttgcg

SEQ ID NO: 547929 - DNA, 119 bp, Homo sapiens
ggaacagctgcgtcgtgagaagtgaggaggcccaagggggatggtggtggtgaggaagccgagaggacttggccattcaccagctcctcagggaaagcactgctcaccacgcaaggtcc

SEQ ID NO: 547930 - DNA, 119 bp, Homo sapiens
gagaagggctatctgaggagctgggagagagaatgcagtccccgctcttgcctcacaatccctattgtaagggctccttccccactctctctcctgcttcatcagttttccattttctc

SEQ ID NO: 547931 - DNA, 119 bp, Homo sapiens
gacatcatcttttctctttccatcccattctcttgccagcttctgccactgggtggggattcaggataaggtaggagttgggggtgaaaaagggatggaatgaagtgggcatgggggtt

SEQ ID NO: 547932 - DNA, 119 bp, Homo sapiens
gagagagagattttgtgagttagctggtcagttcctctgctggttttttcagagctaatttatgtagaagtattcagctggaggagctgatgggctacagggtccaagatgtctctctc

SEQ ID NO: 547933 - DNA, 119 bp, Homo sapiens
gtccctctagtaagctaggcatgtagggaagtatataaatcctttcagactaccagggaaccacttagggtttgaaagaatttatgtactttccaactgcctgatttaatagctgggac

SEQ ID NO: 547934 - DNA, 119 bp, Homo sapiens
gtgtccaggatggaaagaaagcccctagcgctctggggactcaaggatggatcttaaggatggcactggggagtctatcttattgtcctttagaaagaggggcttgtatcctgagacac

SEQ ID NO: 547935 - DNA, 119 bp, Homo sapiens
gagtgttgttttgggtagagattaatcaagcccggtgttcagacttccctcggtgttgctgattttagaagagtctgatgatatcttgcttgattttatcatgaccttaaaacaatctc

SEQ ID NO: 547936 - DNA, 119 bp, Homo sapiens
actgatctactccttcattaatatcccaaatttaggtaacagtctgtagagtgtgccagttagtacagcctgttacctatatttgggatatgaatatattatccaaggagtagaacagt

SEQ ID NO: 547937 - DNA, 119 bp, Homo sapiens
ggacctgcttttgtgagggcagtgaagagaggggaaggagtggtgtcttcatattgagatattttgagattcctgctttctccactcacttcaactgcccaaataggttctgcaggttc

SEQ ID NO: 547938 - DNA, 119 bp, Homo sapiens
gctcagaaaagtcacctaggtggcggcagggcagggcagtgccagacggggccatgtggaaccagccttatgctggtagatgccctgctctgtatgagccttagaatggaaagttgagc

SEQ ID NO: 547939 - DNA, 119 bp, Homo sapiens
ggggggggggcccggggctatcggaggtgaccctgtgcaggctagatggggaccagctgttgggatcgccaaatgcagcctgaccggggtccccctccagccctctgagcccgcttccc

SEQ ID NO: 547940 - DNA, 118 bp, Homo sapiens
tgatgtggagagaggtcttccgagctaaagtcagtgcacatggtctacaccacgtgtagtgcggtgtggtgtagacaatgtgcacggaccttggctcagaagacctccctccacatca

SEQ ID NO: 547941 - DNA, 118 bp, Homo sapiens
tcttagggctccaaatctgccttgggttcaaaggaaggttgcagttggatgtgactcctttcacaaaagaagcgaggactctctgcagcccttcctgtcctcagaatgggctctgaga

SEQ ID NO: 547942 - DNA, 118 bp, Homo sapiens
cttactcagtagacttgatgccataccccggctcttttagttgtccatgtctgtgctggcagcctcagtcagggactagctagagactggaaatcatggtttcaggactactggttag

SEQ ID NO: 547943 - DNA, 118 bp, Homo sapiens
gaagaaggggaatggggagaatggcggccaggagaagacatatgacattccccagggtcaatggtgcggcccgtgtgtctatctactggccctccactcctcctgcgccactttcttc

SEQ ID NO: 547944 - DNA, 118 bp, Homo sapiens
ttcctgaagctagggggtgggagtgttattcacggaaaattgaaggcttgttgagtcaataatcttctttcacacagtaacaattttccgctaaaatttcttgacccaaacaaaggaa

SEQ ID NO: 547945 - DNA, 118 bp, Homo sapiens
ctagctcataaactccgacttaaaagccagtctcagttactctccctggtacttggaggtcccagtgccagagagagtgactgaggctagcttataagtcggagtttctccaggctgg

SEQ ID NO: 547946 - DNA, 118 bp, Homo sapiens
ggcagaaagaaggtatttgttgtactgaattaaatagtaatgtttgctgagcaccaactattaggggctcaggaaacattgctatttagttcagtgcaacaaacacctcctttctgcc

SEQ ID NO: 547947 - DNA, 118 bp, Homo sapiens
agtttgcaattcatttgaggatcctttacatatggcctgaagtatatgtggcatttaattgaaaaaccaccaaataaaggcttttgggccatgtaaaggggccatgtgggtgccaact

SEQ ID NO: 547948 - DNA, 118 bp, Homo sapiens
gcctcccgtgctgcccgtatctcgcatggcctccatcccctccatgatcggggagaagctgcccaccgccaaggggttggaggccgggctggacacacccaaggtagccaccaaaggc

SEQ ID NO: 547949 - DNA, 118 bp, Homo sapiens
ccctggaaaattaattagtcaatgtatgctataaagactaataatttgttcatatgcggtatctctaacgtaggttgttatccattatagcaaaacctgaccaattaatttttcaagg

SEQ ID NO: 547950 - DNA, 118 bp, Homo sapiens
actcattactccgtcaaggatttggcatttcaatcgatgggaaatgatgtgtgatcattctaatttattatacatcatttcccatcaatcgacgaactaaagccttgacgtaataagt

SEQ ID NO: 547951 - DNA, 118 bp, Homo sapiens
agacttagccacctgtcctttcttctatcctcctgtactcatcagattgagcaccatgtgggtccagtccctgagatgagtgcttgatagatagaggtgaacgatgggggcttggtct

SEQ ID NO: 547952 - DNA, 118 bp, Homo sapiens
ccatatagtgagttcgtttccataaataaaaacgacttctccccttgaagaagcagactaagaagacactgctttttgagggaagggaggaggcatgtggctgggactggcagtgtgg

SEQ ID NO: 547953 - DNA, 118 bp, Homo sapiens
tcaataggctctggcagagggaggagatgggcactgagttagaatttggggcatgcagaatggcctccaaaatgtctcaggttttctcaggccacatcttcttccctgtgcctgttgg

SEQ ID NO: 547954 - DNA, 118 bp, Homo sapiens
gttctaatttatgctgcctttcatagcagaaaattgggaggctggagcctgtggataaagaacccaggtcttgcctttgattgttgattgtgatggtaaatgtatggatgatgagaac

SEQ ID NO: 547955 - DNA, 117 bp, Homo sapiens
gctggaatgtttctttggggtccgaggtgacatgatctcttgggtggtatccaggccccagggacttgaaagcactccactcaagatttctgtctgccgaggagaggagaccccagc

SEQ ID NO: 547956 - DNA, 117 bp, Homo sapiens
agtcaaactgttaattggaatagaatccatctcaatttattcctagaaacagttctgcttttctgaggcattaggaataaattgaggtggatcctgttccaattagaatttatgatt

SEQ ID NO: 547957 - DNA, 117 bp, Homo sapiens
tctcctactccccttggccaatcctcacttgtctatcggcccccatcacttgtaaggtaaacaaacagcaagtgatgggggctgatagacaggtgaggattgaagcggactgggaga

SEQ ID NO: 547958 - DNA, 117 bp, Homo sapiens
tgatcttttcagtattctgtgacttgattggttgtccattctatttcagttctcacttatctggggaatggaggagggatggattgttaattaatatgcagaatactgaaaaggcca

SEQ ID NO: 547959 - DNA, 117 bp, Homo sapiens
cccaccagctttcccttcctttctctccctttcacttaactagcccagcctaatagaggcagtgaaggacaggcaggtgaggggcagacaggacaaggaaggtggaggctggcaggg

SEQ ID NO: 547960 - DNA, 117 bp, Homo sapiens
agaatgacttggggcgttggcgggggaaggtggagatgagaggcttctgtagctgatgctgtcaaggagtgccttttccctactgcctcccacccgcctgctatgaactgagattct

SEQ ID NO: 547961 - DNA, 117 bp, Homo sapiens
agtgtgagaatttggactctactcaccaaggaggctgttgtggagagggccagaagagcaaaatggcccagagtcacgtggttttttgaagggtggggagagtctctctttggcatt

SEQ ID NO: 547962 - DNA, 117 bp, Homo sapiens
atttatgcctgtatcgtggaatgttgggatttatattttctttataagaaagtttcttatttattgtttcttataaagaaatgataaatcccaactttccaggatacaaggataaat

SEQ ID NO: 547963 - DNA, 117 bp, Homo sapiens
tatgtacccagagccaaaagtgattggaggtgggtggggttaatgaatagacaagtgttaaaactaaaagtcatgcctatctctccttcctcctcagttttggcttgatttttcatg

SEQ ID NO: 547964 - DNA, 117 bp, Homo sapiens
atttatccttgtatcctggaaagttgggatttatcatttctttataagaaacaataaataagaaactttcttataaagaaaatataaatcccaacattccacgatacaggcataaat

SEQ ID NO: 547965 - DNA, 117 bp, Homo sapiens
ggtgtgtggcctcctcctcttcctcgagggcctctgggagggagccgcgtgtgcctcatgggtgtttggctccttcccagttttgctctggggacctgcattccctggccctgcacc

SEQ ID NO: 547966 - DNA, 117 bp, Homo sapiens
gggaagcgacagagctgcaggtaggactaaggtatgggggatgtcaggcaggcccttgttctgcgtggccatcctgactcatgtcccctgcattttagccagctttgtctgctgccc

SEQ ID NO: 547967 - DNA, 117 bp, Homo sapiens
gcagccccctgggtccctctggctccgctgtcaggggcggccttgccgccaagatctccggctttcggaggcgctaggctgcgtctgaaagcgggctggcgaccccagggaggccgc

SEQ ID NO: 547968 - DNA, 117 bp, Homo sapiens
ctcatcaggattttaagatggtgaatctatagtgcccggaatgtgatgatgattgtggtcattgttccaggtgctgtggattcactatcctgaaatccttacaacaacctttttgag

SEQ ID NO: 547969 - DNA, 117 bp, Homo sapiens
ggctggaagtgaggggcggaagcactggggagagacaggtgtgagcttcccacgtggtgatcagctcacacctgtcttgtgttcttggtattcacagactctcagaatgtcacagcc

SEQ ID NO: 547970 - DNA, 117 bp, Homo sapiens
cactgactcaaagaataacttgcataggaaggggacagtgagtgtgcttggggcccatagattttgggtgagagaaccactgcttccttccaactgaaagacgtaatgagtttagtg

SEQ ID NO: 547971 - DNA, 117 bp, Homo sapiens
aaagctattctatagctgttccttttttataactgccccatcttatccctcctggagatgccgacccagcagggggtgaggtaatggccagttatggagatcagaatggattgcttt

SEQ ID NO: 547972 - DNA, 117 bp, Homo sapiens
gagttctctgatatgtcctttgagcttcccttagacgctcttagactactgtattgggagaatgcagtagtggctaagagcctgggccgtggagttggactgactaggtttgaactt

SEQ ID NO: 547973 - DNA, 117 bp, Homo sapiens
gctctccctgctggaggaccgccatccttattgaatgtatttccaagaaagcagttgacgggcttggctgtgctatttctggaaatgttcaataggccatcttctggcagggaccgc

SEQ ID NO: 547974 - DNA, 117 bp, Homo sapiens
gctactgttgctgtggttgtattttatttgttgaacaatcctgtactttgaaatgattcatttaagagccatgaaacattcaaagcaggatgtgtgactcacatagcaaacagtagc

SEQ ID NO: 547975 - DNA, 117 bp, Homo sapiens
cagagccctggccagggccagtacactgcccaactccagaggaccctgtcccctccttgtgaacggcattccctggagttgggcaatcttgtgggcctgctccttccctaccctctg

SEQ ID NO: 547976 - DNA, 117 bp, Homo sapiens
gagcactgctgtgttccccatcttgagttatacttcatcccttccagtctctgtggggcccctcactgatccacagtgactggaggtcaatgaagttttgagataaagcatttgctc

SEQ ID NO: 547977 - DNA, 117 bp, Homo sapiens
agactgattcagcatcatcatcacctaccacccaggtccgtcattattcaataatagctatcttttaccaagcattattaaatagctcattgacctaggtgatgatgataccagtct

SEQ ID NO: 547978 - DNA, 117 bp, Homo sapiens
gctggacgcgccgcccccagcagcctcccctcccagccccaccccacccatgccctccccaaccagcagctgaaactggagctggggctggaggggggccagggggcggcccccagc

SEQ ID NO: 547979 - DNA, 117 bp, Homo sapiens
gtatggtgtgtgctaagttttgcatttctttgcatgttgggctcatcctctccaaaaagatactttggggaagatggcccacatgtagttgcagcttatgttgtgcttacacctcac

SEQ ID NO: 547980 - DNA, 116 bp, Homo sapiens
cagtgggctattttactgctttcctgtttttctcctgctctatttattcaggttgggtccatgcttgggagatgagggtgggaggaaattcagagccatgtggtggggcctcagtg

SEQ ID NO: 547981 - DNA, 116 bp, Homo sapiens
gggtgtgaactttagggaggcctgtgagcccccacctggaatttgcacacaaaatgtcatgcatgtgtacatttttctgggtgggaatgcagagtgtttcaaaggagttcacatcc

SEQ ID NO: 547982 - DNA, 116 bp, Homo sapiens
aaccagttattggacttgtccacacttttcaagtacatgttgttcaaaagccacatgttctcgtctatgaggtcaagagcagcatgagctatgaactggtgcagacagtgacggtt

SEQ ID NO: 547983 - DNA, 116 bp, Homo sapiens
tgtaggtgaaaagcttagcacaggtcctggctgataaacaatagtactttataatcaccattgaggagtttattttattgtttatttccgggattatcagggtttggccacttgca

SEQ ID NO: 547984 - DNA, 116 bp, Homo sapiens
caactacagccactactacaggaccatcgaggacctgcgggacaagattcttggtgccaccattgagaacgccaggattgtcctgcagatcaacaatgctcaactggctgcagatg

SEQ ID NO: 547985 - DNA, 116 bp, Homo sapiens
ggttgcaacttatgtctgatgttagtaccctgtggctggaagtggtcaaagctacgcattgatctcctctacttccaggccaagaagggtaaatgcaatgactgacaaatgcaacc

SEQ ID NO: 547986 - DNA, 116 bp, Homo sapiens
tattcgacaagttttaagactcttgtgtaatcagcccataaaatctattttagcagtatccatttgcttataatttatgagctgactacacaatagttttacagttttatcgaata

SEQ ID NO: 547987 - DNA, 116 bp, Homo sapiens
tccacttagttctcttccctacaggtaatgatgctatttactttttgtttattcttccaaagatattttataaaaattaatagcatcattgcctatagggaagagaactgagtgga

SEQ ID NO: 547988 - DNA, 116 bp, Homo sapiens
aattaattgtacttacaaatgcctccttgagggcataattagtcaccagcaactcattctaaaggcgccagaggctaattgtacccccaagtgagaagtttcaggtgtaattaatt

SEQ ID NO: 547989 - DNA, 116 bp, Homo sapiens
ggcatcactcagcctgctcctggttgtgggtccattatctgctcctaatattgtctttcgtctcgggattgtgaacagataaggaacccacagccaggagcaggctgggcctggcc

SEQ ID NO: 547990 - DNA, 116 bp, Homo sapiens
tgaatgcactgtggatctttgtgtgtaagcagaatgttaataagctgtgtatcttatgttctacggcatcagtttattaacgctatgtttacacatgaagatccagagttgcatca

SEQ ID NO: 547991 - DNA, 116 bp, Homo sapiens
cctgcagtgctgactgccatgcttgggagagggaagggatttcttcacctgtatctgggactggatctcttcctcctacccccaagctcctgcttctcagcactaattcctgcagg

SEQ ID NO: 547992 - DNA, 116 bp, Homo sapiens
tggtggggggagctgggggcgcgggcagacaggcagcaggagggagtcgcaaagccgtgcctggtctcgtttcctcgctcgcctttcccctgcgccccctccctgcaccccctcca

SEQ ID NO: 547993 - DNA, 116 bp, Homo sapiens
gtgttgttgttgatttggttgttttaaagatttccccccgcccccattttcttaaaatagagtgttgtggtggggaggggggcaggtccagtttgtagattaaatccactcggcac

SEQ ID NO: 547994 - DNA, 116 bp, Homo sapiens
gtgaaaagagatttggctcaagtggttatggtgcctctttaaatgtcagagtccctgctgactggcgttttgggggcatcatcagacccctgcccccaagcctgatctttatttgc

SEQ ID NO: 547995 - DNA, 116 bp, Homo sapiens
tgctggggctgggcagggcactggagcaggtctgcgagctctgctgggtggccttgggcaagctggtaccttctcagagctgtagccttggccctgggccctcccagcgcctggca

SEQ ID NO: 547996 - DNA, 116 bp, Homo sapiens
gctgtgccgggagacccagagaaatggccccagctgaggtcccagcaggccagtccctgttttcctcctctaccctcacactgggcccactttgctcagggaatcccatgcacagt

SEQ ID NO: 547997 - DNA, 116 bp, Homo sapiens
tttcctatgagtattttgtgtaaacttgtaaaaggccccagaaaagcatcggggttctcagtccagtgtgtttttctggtgctttttacaagtttacatgaaatattgatgggaaa

SEQ ID NO: 547998 - DNA, 116 bp, Homo sapiens
tggagctaagcttctccatggcagcagcacctccattgtttttagtccattccaggagcaagcccatgatgtagatgctgaaacatggaggcgtgttgtacgaggagctgtttcca

SEQ ID NO: 547999 - DNA, 116 bp, Homo sapiens
cctgttccacagggactgctctggcctggactttgggtcctgtggcctagaagtaaagggaccagatcttagtcaggcctcaggacagaagccgagccagtcaaatctggaggagg

SEQ ID NO: 548000 - DNA, 116 bp, Homo sapiens
caagccattacaacatttccagtaaggcgaagtgtatggtgtagctggtgtaccatgcacttaaacttaccagttataacgtacactatgccttattggcaatgctgtatggcttg

SEQ ID NO: 548001 - DNA, 116 bp, Homo sapiens
gccaaagcgtgtgtccctccctggagtcatgggggaatggtggggccctctctttggcataggaaggagacaggagggcctgactactcccccaggaggtgtgaaagccctttggt

SEQ ID NO: 548002 - DNA, 116 bp, Homo sapiens
tttcttcctgtggtgttaagtactattgttcagtttattactccctccctaccctcctttgtacctttggtttagggtagaagctaaacaatagtacttgacatcccaggaagaaa

SEQ ID NO: 548003 - DNA, 116 bp, Homo sapiens
gtgttgctataggaagagagagtcaccatgaaggatggcctgtatggaaagaggcacactgcgggtgccctggtgggtcgtcctggctgtgggctactctttcctggagctgacac

SEQ ID NO: 548004 - DNA, 116 bp, Homo sapiens
tgttcttggccaagggcctccgctgagcctggcacagcctcggcttggccctcaccagcgagtgagggcttggctggggcccagccagggcggtggacatgattgaagctagaaca

SEQ ID NO: 548005 - DNA, 116 bp, Homo sapiens
ggaagcaggggaggtgggcatgagattggggtgaggggtaatgttgagaatccgcatgtggaacgagcaagtctattctttactatgtttcaaagctaaaatagtctcctgctttt

SEQ ID NO: 548006 - DNA, 116 bp, Homo sapiens
gggagtaagtgaactgactggtttttattttgttttactgcttttaacattacagtaactgttacaggttccagcaggctaactgggtggaaatgagtttggtttcacttagtctc

SEQ ID NO: 548007 - DNA, 116 bp, Homo sapiens
gagaccatcaccgcctgccgggtgctgaaatatgttatcattaggctcaacatgctatttagttaattaaatgtcatgcttttgatggcattaattagacccgctgccgattcctc

SEQ ID NO: 548008 - DNA, 116 bp, Homo sapiens
gacttctggattccagaagatagggggagccattttaaggttggaagcagaggactggtgtgatctgatctggcctttaagaggatcttcctggctgctgtcgggaaaccagagtc

SEQ ID NO: 548009 - DNA, 116 bp, Homo sapiens
gctctggatacctgtgtgtgatgagctggcagtgtattgttagctggttgaatatgtgaatggcatcggctaacatgcaactgctgtcttattgcatatacaatgaacatcagagt

SEQ ID NO: 548010 - DNA, 116 bp, Homo sapiens
gcccactcccttcaccataacaaccattcttttggagttgcttaagactttaatatcatttcattaagtcagcaagttcagagaaggttgggggcacaaagagactgggggtgggc

SEQ ID NO: 548011 - DNA, 116 bp, Homo sapiens
acacttgctcaaattaatgaccaaaatgtcagatgtgtccacagctaattattcattagatgcttaattagtgtgggatgatcatgacattttaatgttattaatttttatactgt

SEQ ID NO: 548012 - DNA, 116 bp, Homo sapiens
cctagttttcttcccagtgattccagtcctggttcctgcacgtctcaggttgttgaggaatctttgtctatttgagagatgccaactaggggtggtactggggtgtatgagctggg

SEQ ID NO: 548013 - DNA, 115 bp, Homo sapiens
tgggggcaggggtgaaggtgcccattgcttccttatcactgggcctcactttttccatctgccactggttgggctccagtcctaaggaaagggctatctgtcttgcctgccccca

SEQ ID NO: 548014 - DNA, 115 bp, Homo sapiens
cctactgggtgactaattacaaaggctgggctggagcttcagaggctgcttgttaaacacttcattaagcggcactctgaaagctgccacctgcgcattctgggagctcagaggg

SEQ ID NO: 548015 - DNA, 115 bp, Homo sapiens
aagagctaacatgcacatgagtaacacatgcacatcatcaactgtgcctgcaacccaaagtgctacatgtcacacacagttgatgagtgtgcgtatgtttactcatttagtcctt

SEQ ID NO: 548016 - DNA, 115 bp, Homo sapiens
tttctcacacctgtcaggccctagcaatgccactctgcttcctttatcccatccgtacccaatcccgtgaaggaggcagaccagggattgcctctcccattttgcagatgaggaa

SEQ ID NO: 548017 - DNA, 115 bp, Homo sapiens
gacaaatgtttattaaacacacagttgtgatagacactggttctaggtgcttcattcattcatttgcacctagaaccatgtctgacgcataatgggagctcaataaatatttgtt

SEQ ID NO: 548018 - DNA, 115 bp, Homo sapiens
cttgttggcactggagcggggcctggtgtggtgggggtgggcagtggtgagggggcaggggctggcacagacattgctggccccagaatgctgaggcccattctttgccaggggg

SEQ ID NO: 548019 - DNA, 115 bp, Homo sapiens
tgagctccttcctctttttcccagagatgagactaacaatcgttggtatgagggtttaaccacatgactgttgtctgtctttaggataaaggaagcaaagagaacaaggagctta

SEQ ID NO: 548020 - DNA, 115 bp, Homo sapiens
aggtgtgggccaaggcgggcagcctggggtgtgtcctggtctcagggcatctcaccagggaaaagggccccgagctgggcaggcctgggctgcctccttgactctgcctgtgcct

SEQ ID NO: 548021 - DNA, 115 bp, Homo sapiens
agaaccatctcttgcttcttctgtcagcatcttcttcctgtaccatctataatgctgttgcataggaccaggggagatgctggcctgaagcaggggcagaggtcactgtggttct

SEQ ID NO: 548022 - DNA, 115 bp, Homo sapiens
caaatacattaagtagcagtagagtgcttagaagagctttggcaccaggccactctgtaacaggaacttgcttggcaaagagctgctttaagcacatttgctgtgtatgtatttg

SEQ ID NO: 548023 - DNA, 115 bp, Homo sapiens
gcaatttcagtggatgtggttatcatgggataatcacactcctggggtacagccttgtgcctgtaatctctcaggagtgtaattatttcatgataaccacaccccctggtgttgc

SEQ ID NO: 548024 - DNA, 115 bp, Homo sapiens
agagtgtgaagacagggaggcattggtatgcagaacacacagtcacccttatataggtcactgctggaggactgtgctgtgcatgtacttaagccccgcttctgtttcaagccct

SEQ ID NO: 548025 - DNA, 115 bp, Homo sapiens
caggaatatcaatgctggctcttggggattcagtgccagagtgggaggatcctgagaaatctgagatctcacccacctttggcatgatttctttcctggcttgtgaaaattcctg

SEQ ID NO: 548026 - DNA, 115 bp, Homo sapiens
ccaccttcagctgagtgtagtgccctactccagagggcgtcactcatgtaaactaaaacatgattgtagccttttggagtagagtaatacacatcacgtaacgcatatttggtgg

SEQ ID NO: 548027 - DNA, 115 bp, Homo sapiens
gggctgcagggttggggtgcagggacgccgaggagctgaagagtagcatttaaaaagtttgaatttttcagcttccttccctccctgcacattcccaaactccacttgccagccc

SEQ ID NO: 548028 - DNA, 115 bp, Homo sapiens
gagtccctttctcacagaagcctctgactccccacactagtccgggtcccacagcatgggacagtaggacccagacaagtatggggaatcggaggcttctacaaggaagaggctc

SEQ ID NO: 548029 - DNA, 115 bp, Homo sapiens
gccagtgttgtctttcctgcagctcgaagctaacaagaccctgaactgctgcttctctaggacctcagagcttagtgttttgtcagcttcaagctgttttggagaaagtgttggc

SEQ ID NO: 548030 - DNA, 115 bp, Homo sapiens
catacttggtcacttgttaatgaagaaaattaatcactgtttttatgtaatcagtgcttcaaaagtacttgagggtacttgaaagcagttgattttcttaggtagattatttatg

SEQ ID NO: 548031 - DNA, 115 bp, Homo sapiens
gggaaggacaaagcgggtgaatgtccatggattttgtgtagaaacacagcctgggtgttttcgggaggcagttctaccaacagctattgatatcatttcacgttggtttcttctt

SEQ ID NO: 548032 - DNA, 115 bp, Homo sapiens
gaagtaagatatacatgatgaaggagcatcagcacagacagccaacgttcaggcatgggggagagtaaggacgtgagtgtctgatggtggtggtcacttgtcagtgttctgcttc

SEQ ID NO: 548033 - DNA, 115 bp, Homo sapiens
tgcgtttagtcttgtgttaaactgtgttactgttctcaggtttcatgccagcttcctgcggaagactggccaaggctgaggacagcacaacaggagtccccttaaggtgaaggca

SEQ ID NO: 548034 - DNA, 114 bp, Homo sapiens
ggcacatagttgatgctcagagaatatttgttgagtaaatgaatcaaataaccaatgccttgcttcattaattcattcattcatcaaatattcattgtgcacctactacgtgcc

SEQ ID NO: 548035 - DNA, 114 bp, Homo sapiens
gcggatgactctcgcccaactcaccctcgctggattccgacaaagggaaatgtattttggtttttcctttatttggacctggtgcggggagacattgggttctgtgacagctgc

SEQ ID NO: 548036 - DNA, 114 bp, Homo sapiens
cctcatgccctgtccatgcccgctctgacctgtgccctccaccagggaaaaccgcgggtttttccctgcacagggggctgcaggccaggccgggctccacagggcagattgagg

SEQ ID NO: 548037 - DNA, 114 bp, Homo sapiens
tctagaaatctgaacaggcacggataggacagagggctcctctaactattggggtgtggggcagttcaaaggatagggaggcctctcagaggccttgaagttgggttttgtaga

SEQ ID NO: 548038 - DNA, 114 bp, Homo sapiens
ggtactctgacatgaaacagcatgaatattatgcacacttgaataatgtataagttaaataaattatattatttaagtgtgcacaatagtcatgctgtttcatatcacagtacc

SEQ ID NO: 548039 - DNA, 114 bp, Homo sapiens
tgattataatgtccacagctgaaggcactatttcacaattgagattactactttccagatgaaaaaaaattctgagctgtggaataatgccttcagctacacacactgtaatca

SEQ ID NO: 548040 - DNA, 114 bp, Homo sapiens
tgggagcagagggcaaattggacatcaaagagttgctaaaggcttttcggctgtggaaggccgaggagctgatgattctttgatctccacttccccctacacacactgctccca

SEQ ID NO: 548041 - DNA, 114 bp, Homo sapiens
tgacgcacactgtcccacctaattcgcccagcccagcccgctgggaggtgggtgccgtggttcccttcccacgggtcaggggctgaggctcagagaggtgaaatgacttgctca

SEQ ID NO: 548042 - DNA, 114 bp, Homo sapiens
ttgaagaggttatctcaagtcctgttttgtcactgtcaacatcatccagctctgggtggactgctgttggaatggaaaatgacaaaaaggaaaatgaaggttcagccaagtcaa

SEQ ID NO: 548043 - DNA, 114 bp, Homo sapiens
gagcggagtgtttatgtcaactacatattcccctagatacgaatttgtgaccacaaaattccttacacaaattcggatctacagggtatatacagaagacagacagatcttctt

SEQ ID NO: 548044 - DNA, 114 bp, Homo sapiens
ggtagctcgctggggaaataaagtgtctgagctggatgtgcaaactgacctggatcgttttagttttgcattcacgtttgcactttgtaaatatttgcctggcaccctgctgct

SEQ ID NO: 548045 - DNA, 114 bp, Homo sapiens
ggcccttgcctttctgagtgcctggtttgacctcttgatccctccaggggagaacgtcacagtcaaaggaggggtgcaagaggccagtggcacacagagaggtctgtgtgggcc

SEQ ID NO: 548046 - DNA, 114 bp, Homo sapiens
gtgactctctccattcagagcaccccttagacagattctgagttgagtagggctccccttaggtctgccctgcttgttgtggactgtctaaagggcactgctgtaaagagttac

SEQ ID NO: 548047 - DNA, 114 bp, Homo sapiens
gctctctctaggctccccttctgttctctcgtttttttcgcccgcaggaacactccaagttccacagttaaagaggaccgggagggcaggaatgggtggggcctggaaatcagc

SEQ ID NO: 548048 - DNA, 114 bp, Homo sapiens
gggggcagtgttaaaggaggtaaggagtggctgaaggtagagtccacgatgttgctaagggttggacttgaccttaagcacacttgttctattagctccactggaactgccctc

SEQ ID NO: 548049 - DNA, 114 bp, Homo sapiens
tctgcaagtccacggccaggctgatggagccagttttgaggcagcttaagattttccctttccatggccagatctgttttaaattgaatcttccagctggtcccgatttgcaga

SEQ ID NO: 548050 - DNA, 114 bp, Homo sapiens
gaattaaacacagcgggccaaattctgcccctggatatgcatgcacaatttccattgacttcaatgggggttttgttgtgtgtatccaagggcagaatccagcttaattaattt

SEQ ID NO: 548051 - DNA, 114 bp, Homo sapiens
tctgtaacagtgcatagagagcatcattattcctagtgcttacgacagagcctggcacatagtacacactcagtaagtactggatgaatgaatgaatgcattctattttacaga

SEQ ID NO: 548052 - DNA, 114 bp, Homo sapiens
tgcctttgatactcattcatggattagaagggattataatttgataataataatggcattttacatgttatatgttatggtcccttctaatccagaaacaatgaatactaggca

SEQ ID NO: 548053 - DNA, 114 bp, Homo sapiens
agggggcagataggacaaaagaccccatcttctaggcagagggacagcggaacatgaacagtgacccaagcattctctgcctagaagtggcatcagcccagcccatcactccct

SEQ ID NO: 548054 - DNA, 114 bp, Homo sapiens
ctgctgatgcctcttggaatattaaatgcttagaaagctgtcgtcgggatcacattctggaatcttgaccatgtagtcatctgagtgggtgtgacaggaagtatacaccagcag

SEQ ID NO: 548055 - DNA, 114 bp, Homo sapiens
ggagcccttcctttgtgccaggctggaagctgtgtgcagatgatctcatctcatctttagtaccctcttgcgaggtaaggttactgtcacacagtggttaagcacaagggctct

SEQ ID NO: 548056 - DNA, 114 bp, Homo sapiens
taggcttgttgttttacagtgttagtgatccattccctttgacgatccctaggtggagatggggcatgaggatcctccaggggaaaagctcactaccactgggcaacaacccta

SEQ ID NO: 548057 - DNA, 114 bp, Homo sapiens
agagcactcctatgtataaagcacattgttaaggacctggaaaaaaaagctaaataagactgagatattttattccaggtgcttagcaatgtgttttgtgtccaggagtattct

SEQ ID NO: 548058 - DNA, 114 bp, Homo sapiens
agttgactagccctaaaaggtatcttattctccagtcaagtttgcatgaactttatggatagtgctaacttgactggagaaataggagatctttcaggcttatgttagttaact

SEQ ID NO: 548059 - DNA, 114 bp, Homo sapiens
gcttaagttctgggacctcagccaaactttcagagaggagccctttcttctttgtttataataggatatgtgtcctgcaagggagaaaggctctctcctgcccaggacccttgc

SEQ ID NO: 548060 - DNA, 114 bp, Homo sapiens
ccccactggcttggttcacatagtccaaatagttgaaatgttttgcttgctctttttaatatttgaaggatgtcagcatgcattttggcatagttggaaatggcctgcaagggg

SEQ ID NO: 548061 - DNA, 114 bp, Homo sapiens
acttctggatatagagctttccttggatactgtgtctcttgggataatccagcttctacccagaggcttttatgttatcccccagagaatcacagtagaaactctccctgaagt

SEQ ID NO: 548062 - DNA, 114 bp, Homo sapiens
agggccgggcagtggcgcagtgaggtggtcttggctacggggtctccctcaggcagggagcctccaccagaccctgaggcccaaccagcagcaatgcacccactcaccctccct

SEQ ID NO: 548063 - DNA, 114 bp, Homo sapiens
tctggaccagggctgtcccctgggccgtgagtgccgggcgtggagagctggtgtagatgacatttgtagctccacatgccctggcctgggcgccaaggacagccgcagagaaga

SEQ ID NO: 548064 - DNA, 114 bp, Homo sapiens
gcccaggtcccctgggggaggggccgtccctgtccccgctgtcccccagccctggccagggctgtcctcagggtggggaaggcaggcccccgccaccctctcagggcctcaggc

SEQ ID NO: 548065 - DNA, 114 bp, Homo sapiens
tcaacaacaacaaaaatgggaattaaccgattccttctaaaagctgaaggctccttggcagtggatattgacccttcaacttttagaaggaatcagttaattttttgttgttga

SEQ ID NO: 548066 - DNA, 114 bp, Homo sapiens
gagccaaaacgtggattttgagtgcattcaagatgctggctgggtttggaagggaactgagtcttccaggacccaataggtagagagacgcagtcaagagaaatgttttggctc

SEQ ID NO: 548067 - DNA, 114 bp, Homo sapiens
cagtacaagctggcacctcttctcaaagcaacattgacaaatggcaatggctttctatttgagcccacatttgttaatgctgcttttaacaagaagtgccagcatgctatactg

SEQ ID NO: 548068 - DNA, 114 bp, Homo sapiens
agaacaaactgaatatatcagatctctgtgaaagggagtgtgatactagaatataattgtgacctcttgtcttctccttttctcttgagttctgagatgacttcggctgtctct

SEQ ID NO: 548069 - DNA, 114 bp, Homo sapiens
agggaattggaaatagtatgcggttttggtgactcattagcagtctgtaaaggaggcatcttccgttacttactgctacctgacttgtcagtatgaatgtggctcctattccct

SEQ ID NO: 548070 - DNA, 114 bp, Homo sapiens
gtggatagaaatccctattctctgttaggaaatgctaagttatttatagaacttttaagaaagttgctacaaatagcttagcatctcaacagaggaagagggacaactctccat

SEQ ID NO: 548071 - DNA, 114 bp, Homo sapiens
ggagtaagtgaactgactggtttttattttgttttactgcttttaacattacagtaactgttacaggttccagcaggctaactgggtggaaatgagtttggtttcacttagtct

SEQ ID NO: 548072 - DNA, 113 bp, Homo sapiens
gactagatgatcttaaagttccttcccattctaacattctgtgattcttggatgttataaattcccagaatcataaaatttagagttgaaggaacttcagaagtcatctattc

SEQ ID NO: 548073 - DNA, 113 bp, Homo sapiens
gcgctgtgggacacttacttggccctctcctgctgggcgatttccacttgttttcgggcgatgcagggcctggtgagagaggtgcccaggaggtagtggtcctcatacagtgc

SEQ ID NO: 548074 - DNA, 113 bp, Homo sapiens
ctacctaacactgagagctcaataatattttgttcccttgctccttcactcttattccttctggaaagaagagtaaggaagagggagagaaacagtttggtatttttaggtag

SEQ ID NO: 548075 - DNA, 113 bp, Homo sapiens
tgggagaaaggaaaggagagaggagtgaggggcagaatgtgatcagggtcttctgagtaccctgaccctggtttgtactcccccacctgctcttgatgctttatctcatccca

SEQ ID NO: 548076 - DNA, 113 bp, Homo sapiens
tgaatctttttttttaagtctagaaagtgacccagtgttgtgggagaaatgtgaaaggcaggcaccatcgctttcacggcacttggggtcatagtctggatgaccaagattca

SEQ ID NO: 548077 - DNA, 113 bp, Homo sapiens
ccgaggccacgatgtagaagtaggggaagttcatgcgcagccgccaggccaggtcgaagaaggtgagcagcgtgcgcgtgagccccttgcagaaggcgccgtatgagcctcgg

SEQ ID NO: 548078 - DNA, 113 bp, Homo sapiens
ggcatggggatgcttcagcagctgatgtggtgggggagaggtgtcaatgcccacagacaaggagggccctcttccctgcagccacggccagtctgcagcctccccagagggtc

SEQ ID NO: 548079 - DNA, 113 bp, Homo sapiens
ttttttctctttccatttcagtggcttcatttctgccagaatttaacattgacagggtgatgttgcctcttttctggggggaaaaagaagctctctgttgtcaagaaaaaaaa

SEQ ID NO: 548080 - DNA, 113 bp, Homo sapiens
ctgtggtcgtggctgagcagtacctgactctgaccaacctctgcctctaattagttacaacacaatttagaacccgggatggttggcgtttgggacttgcagccacggcccag

SEQ ID NO: 548081 - DNA, 113 bp, Homo sapiens
ctcctacaggctgcagtgccttctgtctgctttagggtgtggcatctgccattggggaggaaaaactggcatgtgtcgccttttatagcagactgatttcattgtgctggggg

SEQ ID NO: 548082 - DNA, 113 bp, Homo sapiens
ccaaaactgcattccattgtttaatttcaggccttttctaacacggaagctgcatttaagagccttagggatgaagtgcccttttgtggaggaggctcactgagcagtgttgg

SEQ ID NO: 548083 - DNA, 113 bp, Homo sapiens
taatttacatatggtgaaatttgctgttttaatgtatggttctgcaaaatatatcaaatttgtcaaattttgtagaaccaaacaaaacaataaatgtcaccatatgtaagtta

SEQ ID NO: 548084 - DNA, 113 bp, Homo sapiens
tattttacagactacaaataaccttgtaattaaactgaaaacaaataattgccaagaaacaattatcatttaattaaagagtaattacatggttattcgtgccctgtaaaata

SEQ ID NO: 548085 - DNA, 113 bp, Homo sapiens
gtgattagagtcttaaatattttgtcctgtctggatcagtgggtgcttggttccttaacaaatcagctgcctcagtgattgggaaggcaggatggtaagagcttttagatcac

SEQ ID NO: 548086 - DNA, 113 bp, Homo sapiens
ggcgctcggcaggggtgcggcgtggcggggagggagctgtggctttgatttcagctgatctgagccccagcctccctcccccagcagagccgcttggcccagccccatatgcc

SEQ ID NO: 548087 - DNA, 113 bp, Homo sapiens
ggcaggggaagcgctggtggtgggcccagccctgactgtcatggaagctaggaaggtgttttcagcttctggggtgggagccagggcgggcattcagcggccctttctctgtt

SEQ ID NO: 548088 - DNA, 113 bp, Homo sapiens
agcaacgattgattggatttgagggttacaattgtgggagcactgctgttgtcaagtgccgctgagcagctctgctccatcagttgcctcagagcaagaactcggtagttgct

SEQ ID NO: 548089 - DNA, 113 bp, Homo sapiens
gccaacagagtgtaacactgagggccttttggggtaagggtctagggttttaatgaggttctactgaccctagaccctcaccccaaaggccctcagtgctacactctattggc

SEQ ID NO: 548090 - DNA, 113 bp, Homo sapiens
gattatcatgtagcctgctgggtgtaccgggctctgggagtggagctaagaggcacctaattcccccagcgctccccagagcctcctgagccccagcagataacttcatagtc

SEQ ID NO: 548091 - DNA, 113 bp, Homo sapiens
ggctgaaattttagaacaggtaaagtttagaagaggtaaatttccttttcagcaacctgcaacaaaggaaacttgcttcttctaaacttaacctcttctaaaatttcacaacc

SEQ ID NO: 548092 - DNA, 113 bp, Homo sapiens
tgactaatttttcatccaaggcttgtgcctacatttcaatttccagggatcaaacaaacagacttaatgggaaactgaaattcaggtataatcccaaggtgaaaaatgagcca

SEQ ID NO: 548093 - DNA, 113 bp, Homo sapiens
gctgggcgtttttaatacaacggtgggtggctggtactgacggaggggatttgggatctccaccccttccgtttccctcactattccaggccctgttttggaaatgcttcagc

SEQ ID NO: 548094 - DNA, 113 bp, Homo sapiens
cagcagatcccttcagggtggtggaaatggagttctgcaaagtactgctgctgttgctgctgcagactttgcatgaatctcatttaccctggatcctggggcccatgctgctg

SEQ ID NO: 548095 - DNA, 113 bp, Homo sapiens
ttttagggatacagtcagtctgtgaggccaccagggtactattcactgctttgcagcagcaatttaccaaatggtaccctggtgacttagagagtgaatgcacatctgtaaag

SEQ ID NO: 548096 - DNA, 113 bp, Homo sapiens
agttcttagacttttgctcattacactgctgcatttgcagtcctttaacccacaggattgagggtgaaaagattgggaatgcagcagtataatgaacaaaagtaatgaaaact

SEQ ID NO: 548097 - DNA, 113 bp, Homo sapiens
gccttccaattctatcaattccattgtgtttctctggtaaccttcccagttccctgtcaaagtgactagtttgaggcatcatggccaaattacattgttgatgaggtgaaggc

SEQ ID NO: 548098 - DNA, 113 bp, Homo sapiens
ggatgagcaggctgcatatataatcttctgctacattctgcctagaactaaagttctgcctaaagttctaggcaaaacatagcagaaggatcatatttgcagcccaatcatct

SEQ ID NO: 548099 - DNA, 113 bp, Homo sapiens
tgcagtttgacctgatctggcttgcggatgcggtataaagacagtgccacaacatgggcacaataaaatatgtccttgtttccacagctgcaggtcactgaggtaatcttgca

SEQ ID NO: 548100 - DNA, 113 bp, Homo sapiens
gaaggctggagtcacttaaggtagttgataaagggctctctcagttctcaggtctagaaacaggaggcaaagggagatcttaatcagtaatcttgccaccctctacagtcttc

SEQ ID NO: 548101 - DNA, 113 bp, Homo sapiens
ttgggagagtggccatagtgcttccttgctggtgtccaaccttggcccacagctcaccattgctgcacagacgttgtgacagaagcaatgattccactggccatatcctccaa

SEQ ID NO: 548102 - DNA, 113 bp, Homo sapiens
gcttagattcagctgaaactcatcggaaatcagatctgatggtggcctcagttctgatgactacactaacttcatccgatcagatttccagtgagtcaggctggttgctgagc

SEQ ID NO: 548103 - DNA, 112 bp, Homo sapiens
taaacactgaggctttgatgtttatacgatattcttccccactaattaactgcactaatgaagttaattgtggggaagaatgccgtataaaacatcaaagcctcgatgttta

SEQ ID NO: 548104 - DNA, 112 bp, Homo sapiens
tcatttttgactactgtcatccagcaggactcagttggtcataaactccagtgactggtcgctagggtccatgatccactaagacctggtggacgatggcaatcgaatatga

SEQ ID NO: 548105 - DNA, 112 bp, Homo sapiens
agtttttaaaaagaattttcttatctgtattagaaatataagaatgtgggttttcatgaaaactcacattttcatatgacggtatagatgtatttaataatttctaaaaatt

SEQ ID NO: 548106 - DNA, 112 bp, Homo sapiens
ttttggaggtgcattaacattttcaggcccctaaggtacagtttagtaaattactattccagtgaactaaatgataccctaggggcctggaagagttaatgcaccttcaaaa

SEQ ID NO: 548107 - DNA, 112 bp, Homo sapiens
gtcatgtaatagtgctgttttttctctgctcacacttcctccccctgtgatttaacactaagtactcggggaggagctgaacacgggaaaaaccaagctattactgcatgac

SEQ ID NO: 548108 - DNA, 112 bp, Homo sapiens
gctaacaaaggccaagcgccctgccaagcggtgtcctggattggggtgggcgtgggggttcgcctcaggtccaggctccgggatgtcgtgcaggacagggcgcggctgcggc

SEQ ID NO: 548109 - DNA, 112 bp, Homo sapiens
ggaggtaaggggttcggggacccgggctgggctccaggagtggcctggacacctccttcggggccccagttcactcctggccgagttgcatccttgagcccacgtcaccccc

SEQ ID NO: 548110 - DNA, 112 bp, Homo sapiens
tgcactgttgtgacaagccctagtagatggtgtcaatcatattgctttatgttacattaagtgacatattgtaatgcgattgatacaacatgggatgacacatcataatgcg

SEQ ID NO: 548111 - DNA, 112 bp, Homo sapiens
agcaaggacatgggaacattttcggcttgaggcagtactggcattccaagaggcagttcctggctctgtcagtgctgttcttcagctggaagctctgtttctctgcttagct

SEQ ID NO: 548112 - DNA, 112 bp, Homo sapiens
tcagtttctcatctttttcctgccgagcccattcaagcacgaagcttccttttgaagacagagggagctttgtgcttgaattcgttccgcagggaaacagtcagagaactga

SEQ ID NO: 548113 - DNA, 112 bp, Homo sapiens
attttcttgcaaacataaagccatgggttctgaaatgtcttcaagtcagagattgagttcactaacttcgggacatttttagaatctatggctctattgtttacagggaaat

SEQ ID NO: 548114 - DNA, 112 bp, Homo sapiens
ccaccccggtcctgctcccgccccagcagcacactgtggtttgtacggcactgtggccacgtccaaaccacactgtggtgttagagcgagggtgggggaggcaccgccgagg

SEQ ID NO: 548115 - DNA, 112 bp, Homo sapiens
gacagccacccaagttctacggcagatacctggtgttttcagacccagaaaataaatgcccagcttgggtcatgataacacctggaatggctgagaggctttggttgctgtt

SEQ ID NO: 548116 - DNA, 112 bp, Homo sapiens
ttcacttttacctgcccagatgttgcagccagagcttgagggcaaacttggttccagtgctgactctctctttgtcctctgccatggttgggatcatccgcaggagggtgga

SEQ ID NO: 548117 - DNA, 112 bp, Homo sapiens
ggagaaaggcaggggacttggcaagaagccagagctggagaggtctgctcaggccaacctgacctcctccttgacccctttggcttctggcttctcctccttggttttctcc

SEQ ID NO: 548118 - DNA, 112 bp, Homo sapiens
tccgggccaaatcccctaaggtggtaggaaggcgggtaagggctggaccttcgggagggtgttgccagcccagtggctccgccttcacaccccttacttctcccggcccggg

SEQ ID NO: 548119 - DNA, 112 bp, Homo sapiens
gggtatagccaagctattatagcaacactcactgggaccagccaaggtgttcactgccatcatcatctgggctgtctcaggtgttcaaagctgtcctcacagggccaagccc

SEQ ID NO: 548120 - DNA, 112 bp, Homo sapiens
aaataaatgaagtgttatagaatacatttaagatccaaatgagataaagagacatacccgtagacttatatctcatttggatcctaaatatattctataacattttttattt

SEQ ID NO: 548121 - DNA, 112 bp, Homo sapiens
gctccctgagtgacagtgttttccttcatatgggactggtgaattgcaagtgtagggacatagtctttggtttcttagttttgctgtctgatatgttaggtactcagggagt

SEQ ID NO: 548122 - DNA, 112 bp, Homo sapiens
ttcatcagtcttctccctgtcattcattccctatggaatcccttctacctgagacaaataggactgattactttagggaaattgagtgaacaggagggaaaactcaaatgag

SEQ ID NO: 548123 - DNA, 112 bp, Homo sapiens
tcatattcgattgccatcgtccaccaggtcttagtggatcatggaccctagcgaccagtcactggagtttatgaccaactgagtcctgctggatgacagtagtcaaaaatga

SEQ ID NO: 548124 - DNA, 112 bp, Homo sapiens
gccatttactcattaagctgatgatgatggagtttttaaaacctgctctttgtaatggacagtagaccttaaaaatctgtcataaattgctcaattgaggaaatcaaatggc

SEQ ID NO: 548125 - DNA, 112 bp, Homo sapiens
gctgtcctcattatttttttttctgccagatggcttgctaatttaaagtccctgaagtgataggtgttttattatagacaatccacttggctgggaaaagtaagactgcagc

SEQ ID NO: 548126 - DNA, 112 bp, Homo sapiens
gggtctagtgatgggaggaaggcctgatttgggaagcaggttcttcaggatgaaaagcttaaccctttccattccctgacagcctctttcaaaacagtctttcctcagaccc

SEQ ID NO: 548127 - DNA, 112 bp, Homo sapiens
gctctcatctggctgcattcatgtcattcttgcatctctggggtccttttaaccatggccttcccagagggtgcaggggaggcaaatgtcagcatcccagaccaaggagagc

SEQ ID NO: 548128 - DNA, 112 bp, Homo sapiens
ccctgagagaggagagcacattttaaagtgagttagcccaggcccgccctgaaccccagatgcgcgggtctgatgttggccttagaaatgggctcttccaactaattcaggg

SEQ ID NO: 548129 - DNA, 112 bp, Homo sapiens
gggggacagtgatgccactatgctcctaaaatgcctctcacagagaacaggagtcggtttcctacccctgttcgtctgctagaggtctttgacggcagtgccactatctccc

SEQ ID NO: 548130 - DNA, 112 bp, Homo sapiens
tcttaacaatgtttctgtgaatgactttgaagattttgctctgctggagcatttctcaggagatgttcaggggaaatcctcagagtcaaccacaccacggataaagttgaga

SEQ ID NO: 548131 - DNA, 112 bp, Homo sapiens
ggctggtggggtttctggttgcagggctaggtggttccccacgggggcagggggtgagtttctgtttccctgggtctggagtgcccggttctgcctctctgtttcagcggcc

SEQ ID NO: 548132 - DNA, 112 bp, Homo sapiens
gtactgattaattattaaaaacacattttgtgtggtttgacagctatgccagagcagtctgtctcatagtgattaaacctccataaatgtggttccaataatgagctggtac

SEQ ID NO: 548133 - DNA, 112 bp, Homo sapiens
gcactacccaaccccagctcccaggacaggcccagggcggggccaaggtcagggaggccccaaatgaccccccgccccggtgcattctgggaaattcgccgggggtgggggc

SEQ ID NO: 548134 - DNA, 112 bp, Homo sapiens
gtggctgctgctgggggctgttgaatctgagggccaggcttctcatttctctcaccaggccctgcctccaagcctagtcccagggagacagccctcaggaacccaaggccac

SEQ ID NO: 548135 - DNA, 112 bp, Homo sapiens
gcattgtctgctaatctggagatctgaatttctgttgttttcctcctttccaccagtagatgagttgacagggattcagtgattcctaagaaagacagatttaaaaaaatgc

SEQ ID NO: 548136 - DNA, 112 bp, Homo sapiens
ggagcgagcactccagggcagaggtggtgggactggggggttgggggactagagagctgtgcctttccctctctcccccgccctcagtccctgccctgcccagtgtgtgccc

SEQ ID NO: 548137 - DNA, 111 bp, Homo sapiens
ttttccttttgcttgtattttcattttgttgatctcaagatttactcccatctcaagatatgttgagatgggagaatttgaagttaaaatgtagaaatataaattggaaaa

SEQ ID NO: 548138 - DNA, 111 bp, Homo sapiens
gcaagatggattttcaacttcaaggaaattggcaagaagagcagagggaacccttacatttttctttctcattctgggtctctttccagtcagctgaaaaatctattttgc

SEQ ID NO: 548139 - DNA, 111 bp, Homo sapiens
ccagttcagtttcaccacttatattttctctttcccaacttactttactctgaatagtataggtaggaggagggaagttgggtagggtggttgggggtgggagtgggttgg

SEQ ID NO: 548140 - DNA, 111 bp, Homo sapiens
cagattctcatcctatataactctctgagaattcccacagggaaatctgtgaaagaattcagaaactttccttgcggaaattctcatagagagacataggacaagaatctg

SEQ ID NO: 548141 - DNA, 111 bp, Homo sapiens
ggggtggtagtggtggccagtaggagcagggctgggcagcctccctaacccacgttcatgagacttgaagctggctggtttcctgtcccctggcctcccttgcccattccc

SEQ ID NO: 548142 - DNA, 111 bp, Homo sapiens
tctaaaccacatcagtgagttagtgaaagggttgagaatagacttcacagtttgtgacatctggtctagttcttagacttcttgtctactgtctcactgtgtgttcttgga

SEQ ID NO: 548143 - DNA, 111 bp, Homo sapiens
ggagggggaggcgaaaggagatcatacatggaagcagatctgagaaatcccctaccccagcctctgggtgctcttaggccttcttccctgttgctcctcgctttcccttcc

SEQ ID NO: 548144 - DNA, 111 bp, Homo sapiens
ccagccccagcctgatttcccagggtctgtccttgcccgatgtccctccctcaaagtccatgtgggatgggagcggggtgggggcagccctaatcaagggatggctgctgg

SEQ ID NO: 548145 - DNA, 111 bp, Homo sapiens
gcagatatgtgacagagccaggcatgctatactgccatggtgactctaggtcagtttgaatctcagagtcaccatgacagtatagcttgcctggctctgctacatatctgt

SEQ ID NO: 548146 - DNA, 111 bp, Homo sapiens
gatgcccttagcagtggggctcctgggctcagggcaggggaaatgtaccctgaagggggaagtttcccttctaagagctgacggagccacttaaccacggcaaggaacatc

SEQ ID NO: 548147 - DNA, 111 bp, Homo sapiens
ttcactcacaaagttattgacaagcatttttcacagcaacagctcttctctgtgaccctcgtgagctgtttacatgaaaaatgctcttccttgtagattaatgagagtgga

SEQ ID NO: 548148 - DNA, 111 bp, Homo sapiens
gcaggcagggcacagtccatattcacacaagctctgtgagctgctggaccccctgccccgttacagggactgggggcacagcagtgagcagaaaagaccgggtcctgccgc

SEQ ID NO: 548149 - DNA, 111 bp, Homo sapiens
gggtctaaggattctagatatatgagggttggaggcctgcgtgtcccaggaatctatgaatttggggtctgagggtcccaggcttctgtgagttgagagtctaagagactc

SEQ ID NO: 548150 - DNA, 111 bp, Homo sapiens
ggctaccagtaagcacagtccctcctagagaggccggtgggagatgccttggtcatgcccgtcagcatctccttcccacttcttaggagctgagtggcttcctgggcggcc

SEQ ID NO: 548151 - DNA, 111 bp, Homo sapiens
ttaggctaactggcaaacactattgctttccaattctactgtgaattagcttacaagtctatttaaatcatggtgtaattgaaggacaacggtgttggccaattagcctaa

SEQ ID NO: 548152 - DNA, 111 bp, Homo sapiens
ggagggggaggcgaaaggaggtcatacatggaagcagatctgagaaatcccctaccccagcctctgggtgctcttaggccttcttccctgttgctcctcgctttcccttcc

SEQ ID NO: 548153 - DNA, 111 bp, Homo sapiens
gatccagatagatgatatgtttctactagtggttgatggcctctttcagctccatcgctatggaggcgaggttcatcaataactcagagaaacttgtgtccagagttggtc

SEQ ID NO: 548154 - DNA, 111 bp, Homo sapiens
tgtaaagcataaagtggaagaagagatcagagcttgggaagataactatgcccccacctggacctagttatcatctctggctctgatctcttgttctactttatacttaca

SEQ ID NO: 548155 - DNA, 111 bp, Homo sapiens
ctttgggactattttgagcaagggcatttgttggaagtagaagaaggaaaagtctgaggaattttaacttctccttggacaggtgcccttgcttttagaattggctcttag

SEQ ID NO: 548156 - DNA, 111 bp, Homo sapiens
tcatatttgattgccgtcatccaccaggtcttggttgatcatggactctagcgactgtcactggagtttatgaccaactgaggccagttggatgatggtagtcaaaaatga

SEQ ID NO: 548157 - DNA, 111 bp, Homo sapiens
tcccctggaggtgggagtgggggcgaggggcactgggcaaagacacactgtgattattttgatcattttgctaaggctcctcctgtcttcctcttccccaaacaaagggga

SEQ ID NO: 548158 - DNA, 111 bp, Homo sapiens
gtagagagtgcattctgcaggatgagtgaaaaggcatttatgattcttgggggcagatgttctacagttgcctgtgctagttcatgtctttctgcagatcacattcttaac

SEQ ID NO: 548159 - DNA, 111 bp, Homo sapiens
acagctggttccacccctgattctacaatggatttgctctgtgaccttgggcattttattaaagctctttggcactgagcagcatctgtaaaattggggcagtatcaatgt

SEQ ID NO: 548160 - DNA, 111 bp, Homo sapiens
ggagggggaggcaaaaggaggtcatacatggaagcagttctgagaaatcccctaccccagactctgggcgctcttaggccttcttccctgttgctcctagcttctccttcc

SEQ ID NO: 548161 - DNA, 111 bp, Homo sapiens
actaaaaataaatattgagcactagttaatgatatacatgcttaagtatttataggttgttaacgtttcagcatgcatatcattaactagaatttaatatttgtttactgt

SEQ ID NO: 548162 - DNA, 111 bp, Homo sapiens
gctccctcatgtattccctgcaaatgaccactgaaaatttgacattgtttaagatcagcaagcccaaaataatgtcttatcccagtgtgttgcacggaataggtgttgagt

SEQ ID NO: 548163 - DNA, 111 bp, Homo sapiens
gggtggggtgggtgtgggggacaggtttggagagtgtagagagagaggtttggatttactctactttcctctttctaacacttttctgatatccaacacagttcctcttcc

SEQ ID NO: 548164 - DNA, 111 bp, Homo sapiens
ccagcaggcctggataaaatgtttctgttcatttgcctcggctctgagccaccagcctcagagtggaaggaaaaagagcagattctgggggtgttttgtctggcttgctgg

SEQ ID NO: 548165 - DNA, 111 bp, Homo sapiens
gattattgtacaatcacactgttttatgaggtaataatccagttcctgagtggataaatgagaaaaccaagttattgcctcataaagcagcatggtggtatggttattgtc

SEQ ID NO: 548166 - DNA, 111 bp, Homo sapiens
ccttcctatgccagctgatcccctaggccctaggcttccatcatatcactgagcaaagcacagggcagtttgagtgggggtcagaggcctggggggtctttggctggaagg

SEQ ID NO: 548167 - DNA, 111 bp, Homo sapiens
gtttgttgatagattgagtttgtttaggactggtgttgggtctgcagaaagtctatattggccagatcagatattctatactagtttctagcattctcactttcaacagat

SEQ ID NO: 548168 - DNA, 111 bp, Homo sapiens
agttcaaggttggtatatctgtataaatagctactgtatttggaggaggctcataatccgaaagtccttcatctatagtagctattcatattaatatactagctttgaact

SEQ ID NO: 548169 - DNA, 111 bp, Homo sapiens
ccgcaatcgggagcccagggctgggtgtaggggccccccggggttggaggaacctagtccccccagccctggggtgccccctcgcgcccgacggagggagcccgattgcgg

SEQ ID NO: 548170 - DNA, 111 bp, Homo sapiens
gtacctactgtatcttttctctaattagagatggcgtatagactggctcattacttctgcctaatgagccaggctccatgccacctctctaatcagaaaagagataggtac

SEQ ID NO: 548171 - DNA, 111 bp, Homo sapiens
tcagtttgatggaatgagcactggaccaagagtcagaagaactagggactcagatcacctctccctttgatttcttctgtgaccttgggccagttaggtgatcatctctga

SEQ ID NO: 548172 - DNA, 111 bp, Homo sapiens
tagggttgaggtgccagatagagctgtaggtaatatggagctggaggactggaaactgaaactaaatattccactagccctatagctgtgtcactgtggcatctaactcta

SEQ ID NO: 548173 - DNA, 111 bp, Homo sapiens
ctttgaaacaggactaatgcacatctcatatggaaatattgacagcattctctatcattcttagcatggtcatcattttcatatgagatgtgtattaatcctgtttcaaag

SEQ ID NO: 548174 - DNA, 111 bp, Homo sapiens
ctgaaatgcaccatatgcgctctgatacctatgcacaatagggtgcaggtttaatgactttcttattgtgcccctgttgtaattaggtattaaaggacatatggtatgctg

SEQ ID NO: 548175 - DNA, 111 bp, Homo sapiens
cggcaccggcggtggcaaagctgggggccgcccgggagggggcgtgggctgcgcttacccgcccgaagcccccggcccggcggcggctcccaggtcgcggagccggagccg

SEQ ID NO: 548176 - DNA, 111 bp, Homo sapiens
gctggggttgcctgctcccaaagatgatgccgctgggagctcagagggcccaaggcccaagtcctgtgtcctccagcagtggtacagcctatggcagcgtggcatcccggc

SEQ ID NO: 548177 - DNA, 111 bp, Homo sapiens
aggaatgtattcagcctagggaatggatagaaacaggcaggactgggagagctggcaaagtgctttttctgttctgttcatctgttcactcttggagctctgtgcaaacct

SEQ ID NO: 548178 - DNA, 111 bp, Homo sapiens
ctggtgagcacccctgggacccgagcagcatcctcaggagccagtgccggagccatctggcatccagcagtgctctagagcgtgcctcctgcggtctcagctgccccccag

SEQ ID NO: 548179 - DNA, 111 bp, Homo sapiens
tcccaaagtgaatgaatggctcaggagatcccagaatcaaatcaggtggacactattagaaagcacccgatttgatcccgggatctccccagccattcattcactctggga

SEQ ID NO: 548180 - DNA, 111 bp, Homo sapiens
tgggacgtaggacagacatgttttgacagggcaaggggcccagcaggtgatcctaaattttaactgttcagcctctttccttgccagtccctaatgctgcctttgtctcca

SEQ ID NO: 548181 - DNA, 111 bp, Homo sapiens
ttgaagctggcatgcgggcatcagcctcctgcaagctctgaggctttgtgacaccaggaattgttccatcttatagcttaggaggctggggctctgtgcctctgccttcag

SEQ ID NO: 548182 - DNA, 111 bp, Homo sapiens
gatgattgggctgcaaatatgatccttctgctatgttttgcctagaactttaggcagaactttagttctaggcagaatgtagcagaagattatatatgcagcctgctcatc

SEQ ID NO: 548183 - DNA, 111 bp, Homo sapiens
agctttcttcaaaacatatttttgtaaaccctaagtgaaaaatatgctaagaagaaaagagattcttagcgtgtttttcacatagggtttataaaaatcctggggtttgtt

SEQ ID NO: 548184 - DNA, 110 bp, Homo sapiens
taattgctgatttttctatatttatggaaaactggcatttcataaatatcaaattgtgatatcatctacttgtatgctggttttctatgaatatataaattttgtaatta

SEQ ID NO: 548185 - DNA, 110 bp, Homo sapiens
ccctggatcactcagattctaaatgcctcccaatgattgctcctggtgcatacaacaacctgatagaggcaatggttggggacatttggcaagtttccagtggttcaggg

SEQ ID NO: 548186 - DNA, 110 bp, Homo sapiens
tactacttcaccctcctcatagtatgattaaaagctgctttgaatccactattgcctcaagggatttgaggctagaatttaacaaactgctgagaaggcttaagtcagta

SEQ ID NO: 548187 - DNA, 110 bp, Homo sapiens
aaaatactttttggtatctctcctcttcccaggatgctgagtgaaaccagatgagagggagtttagtcggcctggggcagttgagtcgtagcaaaatcaggaagtgtttt

SEQ ID NO: 548188 - DNA, 110 bp, Homo sapiens
ctgcttctcctgctgtgaaacaactgccatattttttaaagtgttgtctgtgttttcttagaggcattcctgctcgaaaagatgtggtaatttcattccataagtagcag

SEQ ID NO: 548189 - DNA, 110 bp, Homo sapiens
tcatcgagccccgcggtggccacacagggtgcgggctcaggacaggccgggcctcgggagaaggccctgtcctgggcgctgggccaccccgtggggccactggatgatga

SEQ ID NO: 548190 - DNA, 110 bp, Homo sapiens
gttctatacgtggtgatcgggttcccagacctgtctataaaagtgaatacactgtgggctggattcacttttatagataggtctgggaacccaatcaccatttacagaat

SEQ ID NO: 548191 - DNA, 110 bp, Homo sapiens
agcagggctgaggatgcctgacagtaaaagtacagacctttcttgataagccccatggtttccttcttggagaagggattgtgctctgtacagatgcattcagtcttctt

SEQ ID NO: 548192 - DNA, 110 bp, Homo sapiens
gaggcagagaaggagagtggttagaacatgctcaagagccaaactgcacatgctgactgctgatgccagctctgtgggcctgggctagctgcctatcctctctgtgcctc

SEQ ID NO: 548193 - DNA, 110 bp, Homo sapiens
caggttctaaattacaaacttactgatttcagctgcaaataacactacctggctacaaaaaaccaggcagtgttatttgtagcccaaatcagtagtctgatattttcctg

SEQ ID NO: 548194 - DNA, 110 bp, Homo sapiens
gggggtgtctgctgcgggtcgagaggggtggaggatgggtgaggaccaggaacgagggccttctctcaggactccatccttctgaaaatgtgcacctgcagtaagccccc

SEQ ID NO: 548195 - DNA, 110 bp, Homo sapiens
agcatatcaataggaagctgggcagggtcagaaatcctgctgtcagaactactggttttgtgaagatgacttcaggatttctgaacttgtaaaacttcctattggttgct

SEQ ID NO: 548196 - DNA, 110 bp, Homo sapiens
gtccccggcccagctcccatcccagaacccagctcacctaccttgagaggctcggctacctcagtgtggaaggtgggcagttctggaatggtgccaggggcagagggggc

SEQ ID NO: 548197 - DNA, 110 bp, Homo sapiens
caggccctgtgtgctgttttccttcctgtcctgccctggctgagagcgggcttaatgaatggggctcagtttagggtgggaggaaggtcggcagcaggagccagggcttg

SEQ ID NO: 548198 - DNA, 110 bp, Homo sapiens
gcttttccctttgcatcggcctggggccctggggcctgatttgcagcatcaacagcttttccactgctgtgtgtcagcccaagggccttgtcactgtgagagggtaacgt

SEQ ID NO: 548199 - DNA, 110 bp, Homo sapiens
tgtgctgggcattcttctagggggtggagatatagcagtgaggacaatgtcttacgaagctttatttattcattgttgaatcctcagttcccagaatagtgcctggcaca

SEQ ID NO: 548200 - DNA, 110 bp, Homo sapiens
cgcctcagagccgcccgccgttcctttttcctatgcatatacttctttgaggatctggcctaaagaggtatagggcatgggaaaacggggcggtcgggtcctccccagcg

SEQ ID NO: 548201 - DNA, 110 bp, Homo sapiens
ctactgagttcccgagttctcttgattatggtcaaaaggcataggtggctttccagagtgccacctgtgcttttaaattgtaatcaagagtgatctattataatctttag

SEQ ID NO: 548202 - DNA, 110 bp, Homo sapiens
gccatgggcgtggaagctgggtacatcgtcatctatgatttccatcttcttcccggtgaagttggggttttcatagaggatgatcttgtgctcttggctgtcctattggc

SEQ ID NO: 548203 - DNA, 110 bp, Homo sapiens
tcccaggaggacacatttcttactacagggcaaccctttcctgtccaatgatcttaggatctattatcttcgaagggtagaccatgtggtagtaacatattttccaggga

SEQ ID NO: 548204 - DNA, 110 bp, Homo sapiens
ttgcatcagcttggtaaagacgaggtagagtttgtagtgttggggtctctgagggtgagtcaggtccccgtcacacaaactgtaaagtcaacgacaaaccagcttagcag

SEQ ID NO: 548205 - DNA, 110 bp, Homo sapiens
ggcagtgtgtgatgtgagtaaggaggaacattgtgtgattcagtcagtgttgcctcacctggctgaacacatttctgtcactactggcatgcatcagaattcatcctgct

SEQ ID NO: 548206 - DNA, 110 bp, Homo sapiens
ggggagagctactggatgcaaagctctggttttggaggaaggatgcctcaaaagctagtcttggcactcttccccttaccagaatctctgtctatgtagcagccttcccc

SEQ ID NO: 548207 - DNA, 110 bp, Homo sapiens
tggctgctgcagtgtggggaagggagggaaatcagatcagtgccgtcctcctcctggaccagctgcaactcatctgtttccttctctctttatcttcatattttgggcca

SEQ ID NO: 548208 - DNA, 110 bp, Homo sapiens
caatctgctaacaataacagtacaaatgactgggtaacagtattagagatattgcggtacacctctaatacctatacccagtcatttgcacagtcattgctagcagattg

SEQ ID NO: 548209 - DNA, 110 bp, Homo sapiens
tgcaggatccagaggagcttgtgttccatgctgtgcatcttgatgacccaagcctgaaggtcacaagggtggcacagtgggggagggcttaagcacctggaaaaactgta

SEQ ID NO: 548210 - DNA, 110 bp, Homo sapiens
gatgtcagcggaaccatggggctaaagttttagtgctggaaggttgtctatgtagtttttttcagacatcctccagtggtgcaactcagccccatggttcctctgacatc

SEQ ID NO: 548211 - DNA, 110 bp, Homo sapiens
gtaggccctgttcattcctctatcttatcgtaataagccaggtcacctctgaactgaactgaaatcacgactgttcagtgttgcctgctttatgggtctggatggcctac

SEQ ID NO: 548212 - DNA, 110 bp, Homo sapiens
gggtgacagcatgaacaaaaatgccaggaagtgactgtatctacaagactcaactttgagaaattgtagatagcccatgaacttcctgcaattagtgtatcagttcagct

SEQ ID NO: 548213 - DNA, 110 bp, Homo sapiens
gaataagattcactgatgagctgctgagagtggcttggctgcactacagggctagccagttgccatgtggcctgtggtcaagtcagagggagcagctgtgaatcctattt

SEQ ID NO: 548214 - DNA, 110 bp, Homo sapiens
ctctgctcctaccatatgtttatggttacttcctgggcatctacacaagggccagtcactgtgtggggctggggatatgacaacaatgagaacaacatccaggtccagag

SEQ ID NO: 548215 - DNA, 110 bp, Homo sapiens
ggcacacagtggccattcagtgaatatctgtggatggatgaattcttgtcatcatagtttgtagttctgtttatttgtttacctgattattgctggggtcagtgtctgcc

SEQ ID NO: 548216 - DNA, 110 bp, Homo sapiens
aggaactaagtcttctaagcctcctaccctttctcttgcctttctcagaaggcagaggtattcagaaaagggcaagagagagggcaagaggcccaggagacttagttcct

SEQ ID NO: 548217 - DNA, 110 bp, Homo sapiens
gtccctggcccagacccttctcttccacccaatctcattgcctttagccacaataaatatcacagggcctgggacagggtggaacactgacagggttgctggccggagat

SEQ ID NO: 548218 - DNA, 109 bp, Homo sapiens
attgtatgtattatcggacatgtccgtatattttggggacaactgaacttatcccatgacacccaggccttccccaaaatacatggacgtgtcccatcatacatataat

SEQ ID NO: 548219 - DNA, 109 bp, Homo sapiens
gactagtgggagagccacattttctggtgatcaaagactctgaggctttcatctgcaagtgcctgggagaatgttgaacatcttggaatttgtcatatcgcctttggtt

SEQ ID NO: 548220 - DNA, 109 bp, Homo sapiens
ttttccccaagatttccattactgctataaatttttcagcgtggcttttatgtaaatgcagcaagaaaggcaagacagaaaaatttatttgtaagctttagggggaaaa

SEQ ID NO: 548221 - DNA, 109 bp, Homo sapiens
cagggtggggagcttgaaagggtcttgcaggcagagcgtgggtgactgactcctcaggtaggcctgacctgcactctgctgcagaccctcggcagcgcagcccactctg

SEQ ID NO: 548222 - DNA, 109 bp, Homo sapiens
tgctgttgttttgccaaatgtaactgtcactttttattgaaacatcagaatcagacatttaattctcacagttttgatgcttaatgaaaagtgaaagttaaacacagca

SEQ ID NO: 548223 - DNA, 109 bp, Homo sapiens
aacaccttgtttcctccttttctcccatcatttctccttctacttcatccccacgataacgcagaggaacagtgagagaagtggggtgagaagaggaggaagcagtgtt

SEQ ID NO: 548224 - DNA, 109 bp, Homo sapiens
tgggtccctggacacgacctcgtctcctgctctcactccattctctagtggcagcagccactctgggactgagggcatgggggatgagttgaaagaacagtgggaccca

SEQ ID NO: 548225 - DNA, 109 bp, Homo sapiens
gagcagtaatgaggagaattactctggcagtttctggcatcagctttgcagtgtcattcccgaagctggcaggaaactttccaattgtaactttctagcattgctgttt

SEQ ID NO: 548226 - DNA, 109 bp, Homo sapiens
gctctcatgttgctaaaaattatttgtcttataggaggaagagaattcctcaaatcccacaaaggcaactcttcttcctgaagacagcagctttgccagtaatgagggc

SEQ ID NO: 548227 - DNA, 109 bp, Homo sapiens
tgccattgacagcaggagaaaagcagaaatctgaaggcatgatttcaacagcagattaaatagagctgaaggcatcatgttttggatcatgtttgtggtgttcatggta

SEQ ID NO: 548228 - DNA, 109 bp, Homo sapiens
ccatagagggtgcactgagggccgggcggtgcggggatgaggcacctccagagggactcggtcttgatggttcccgcatccccttgggccatcagtacagccaggaaag

SEQ ID NO: 548229 - DNA, 109 bp, Homo sapiens
tagagttcatatttacaaagtgtgtgcatgcctatgtgtatcactaatatgtagtatatgcatactaaatatgcacatgggtatttcaaactctgttggcttgactcta

SEQ ID NO: 548230 - DNA, 109 bp, Homo sapiens
ttttgtttctgtaggatctgtgactctgtataatcttaatttgctttccctcctgtttcttgaagacaaaataggaatatatggagtcacaggtcctatggaaacaaaa

SEQ ID NO: 548231 - DNA, 109 bp, Homo sapiens
ctgttgcgctgtccttcctctggggagcaggctccgggggacagggaaaagcacacaaggaacttgtcctctagggcctgcagtctcatgggagagtgacatgcaccag

SEQ ID NO: 548232 - DNA, 109 bp, Homo sapiens
tagctcctccttgaaattcgtgcttgcatatttaaggtggggctcagaaaataccttttctcctcctgtcccacctggaagctgtgaggcaaacattctggtggtgcta

SEQ ID NO: 548233 - DNA, 109 bp, Homo sapiens
gagtcagagaaattctgtttccccagtaggccattggtaataatggtgtattctaattcagttgatattattaataccaatagcccactagggaaacagaggagggctc

SEQ ID NO: 548234 - DNA, 109 bp, Homo sapiens
gcgtttcctgaatcgtggcctggtgaaacagcttagcttctgcagagctcgagagaaagaacggatttggttttgcagaggttaaggctgaggcggcagcaggagatgt

SEQ ID NO: 548235 - DNA, 109 bp, Homo sapiens
aaagatacagaggaaattcaacccagattaggtggcagaagataatacagtttgctcatttttattctgctgctcaaactggagttgaattcattttcactttatcttt

SEQ ID NO: 548236 - DNA, 109 bp, Homo sapiens
gaaaaatgagtgggagttgtatacagaaaaatgtctgcatggctgtctgctacagtgttagttatgcagataatctatgcagcatttttttactcctaatcatctcctc

SEQ ID NO: 548237 - DNA, 109 bp, Homo sapiens
gagacgttttcctttgtcatctctagctcccatatctcgtttccaccaaggcatatgcatctcggtggaaacaaaatattggagctagagatactggcactttggtttc

SEQ ID NO: 548238 - DNA, 109 bp, Homo sapiens
ctgggtctgaaggtccctgaggtcccaagagaaccctgcctctcctgcttcttatttaggttgctagtgagagtccttggggttctttggaagaagactccaggcccag

SEQ ID NO: 548239 - DNA, 109 bp, Homo sapiens
cttatgaatatactccaactatagactacttttctttctacattcatgtacttcattattcagtttgtacagaaagaaaggtagcctatggttggaatatattcataag

SEQ ID NO: 548240 - DNA, 109 bp, Homo sapiens
catctcattgggtgaccttggcaattccttttcttaacacctccattgtctgcctgtcaatgatgtgttgggtgaagagctctccaaggcttgatctaactctgagatg

SEQ ID NO: 548241 - DNA, 109 bp, Homo sapiens
aggcgggggcggggcacgctgcaggggtcctccccacgctggtcggcaggagtgacgcctgaagctacagctggggtggactcctgcctactgcccacctgtccctcct

SEQ ID NO: 548242 - DNA, 109 bp, Homo sapiens
ggctgcacctgaacttgttggtatggtgggaagagcttggactttcaagtcagtcatctggatttgaatcctggctttaccacttaccagctttgtgatcttggcagtc

SEQ ID NO: 548243 - DNA, 109 bp, Homo sapiens
tgggttatttcaacatctaattcccatttaactcttcttgttttcacttgtctggggacaggcatgaatttgaacagagttgaatacgaaatgatgtggaaatggtcta

SEQ ID NO: 548244 - DNA, 109 bp, Homo sapiens
actttttgcctgcatgtggctttgagcctgggaagagttgaggggagggaatgtgctgaagttttccctttcttcttcagccctggggagccacaggcaggtgctgagt

SEQ ID NO: 548245 - DNA, 109 bp, Homo sapiens
acaatatttgcaatttaccttaatctcagagaaaggatagaagggcaccaagaacaggaagatgtacatctatcttttctctgagagcaaggtaaagtacaagcattgt

SEQ ID NO: 548246 - DNA, 109 bp, Homo sapiens
gatggattaccaagctctgcatcaatcaatagggcttttatggttatatttgtggtggtttgtaataagatcaggccctgaagattgatgtggaagtttgtaatccatc

SEQ ID NO: 548247 - DNA, 109 bp, Homo sapiens
tcccagcagtggaaacccaggaaagttcctgaggttttctgtgcctcagcttcctcctaggtgaacacagagaataacaggacttacctcaaagggctgttgctaggga

SEQ ID NO: 548248 - DNA, 109 bp, Homo sapiens
agccctcaaacctgctgggtgtgatctcaagggagggtgcaggcctccccctcctctcaccttgcttgcttccctcctgtgagatctgcagctcccacccaggagggct

SEQ ID NO: 548249 - DNA, 109 bp, Homo sapiens
gacaatcaagattgtgagttggtagtttggagccagatgtaacagatgctcaattggcccacagcgtgctggtttcagattgtcgtgtacagttgtcttggattttgtt

SEQ ID NO: 548250 - DNA, 109 bp, Homo sapiens
taaattctaattggaacaggatccacctcaatttattcctaatgcctcagaaaagcagaactgtttctaggaataaattgagatggattctattccaattaacagtttg

SEQ ID NO: 548251 - DNA, 109 bp, Homo sapiens
ttttattaatatagttttaagtggattttttgggtctgtttgattgcttttgggcagaagcagtttaacaggggactagaaaaactactatctgaactagttaatgaaa

SEQ ID NO: 548252 - DNA, 109 bp, Homo sapiens
ggcttccagttggggggccatatgctgtctttaatctgcctgtgcaattctcaccgatgtcaataggcgcgggcgggtgggtggttcaaatggcccgagagctgggact

SEQ ID NO: 548253 - DNA, 109 bp, Homo sapiens
cctggcccctcccatcttttaaaatcacctgtgaccatcctcactgagctgaggccctcaacccttagctggcttggtgagcaggacatgggtgaggaggatggtcagg

SEQ ID NO: 548254 - DNA, 108 bp, Homo sapiens
atatcattgtgagaattaagttatttaatacatataaaaaggcacttacaacagtgtctggcagtgtctttttatatgtatgaaatcacttaattctcataatgatat

SEQ ID NO: 548255 - DNA, 108 bp, Homo sapiens
gatgacacgaattttgaagggcaaacaaagaagctgaagggagagagacatgactccttagaagcttggtcctcctctcccccagcttctcttgtcttccctgtcatc

SEQ ID NO: 548256 - DNA, 108 bp, Homo sapiens
gatgacagggaagacaagagaagctgggggagaggaggaccaagcttctaaggagtcatgtctctctcccttcagcttctttgtttgcccttcaaaattcgtgtcatc

SEQ ID NO: 548257 - DNA, 108 bp, Homo sapiens
ttgtacctgctactgtgactcttttccatgtctgtttccacattggtgtagcaaaggaaaatgaggagacgcatttggataaatgtcgagtcatagaatttggtgcaa

SEQ ID NO: 548258 - DNA, 108 bp, Homo sapiens
tcgccgataggctcagcgactacaactcccagcaggccacgcgccgcggcccgccgtgtactcttggcgcagggccttctgggagctgtagtgccccggccgcggcgg

SEQ ID NO: 548259 - DNA, 108 bp, Homo sapiens
taattctttttctattggctgtttttatggaaggtgtggggagcattggtcaattctgctccctacagcctccataaaaacaaactgatagccaatagaaaaaaatta

SEQ ID NO: 548260 - DNA, 108 bp, Homo sapiens
tcatctccagaaggcagtgcttccaggaatggttgcacactgtcagctcatttgtgttgtcagtgctgccacctcgttcccagaagagcatctgtggatttggggaga

SEQ ID NO: 548261 - DNA, 108 bp, Homo sapiens
gtcccagcagtgtctaatgacctggagagaccgcatgctaagttgggcccccactttccagcctagggtgtgacatagcagagtggtttaaggttatgagcatgggat

SEQ ID NO: 548262 - DNA, 108 bp, Homo sapiens
aaatgaaaagtctcagcaattggaaaaccaggattttgttttgcctccttccatataggaaacatttgtaagatagaattctggcagttatttgttgaagggtcattt

SEQ ID NO: 548263 - DNA, 108 bp, Homo sapiens
gagatgaaaggctgtagcccacagtttgttgctttggatgaagatagtttgagaagttaaaactcagtctcaccagtaacagcctcagtgggaggcagtagaaagctc

SEQ ID NO: 548264 - DNA, 108 bp, Homo sapiens
gtaacgcttttccctgctctgcttgtctgcaggcagtgaagtgaaatctgcaagagtcctgctcgctcaaggcctgcatacaggaaagaagcaggggaaaagcgttac

SEQ ID NO: 548265 - DNA, 108 bp, Homo sapiens
tgacatcattattcttcgcttggactgtctttgtttaagagccacttaaaatttttggctgctggtgaatagagaagcctgttagctgaggaaaacatgttgatgtca

SEQ ID NO: 548266 - DNA, 108 bp, Homo sapiens
ggaaggaatatgaatgtggtgccggctctaccatggggccttgaggcctcgtccaagccatccagggaccttatgaaagtggaacggaactcttttcatgtatattcc

SEQ ID NO: 548267 - DNA, 108 bp, Homo sapiens
gtagattgaagccagttgattagggtgcttagctgttaactaagtgtttgtgggtttaagtcccattggtctagtaagggcttagcttaattaaagtggctgatttgc

SEQ ID NO: 548268 - DNA, 108 bp, Homo sapiens
tggggctgggggaggggaaagccttgcccaaggcccctgggctagcaactcaatagagctgggcctaacccaggggtctgcaggatgtctccttccacccccacccca

SEQ ID NO: 548269 - DNA, 108 bp, Homo sapiens
ctctgctctgcaacctctccaaggagctgatcgagagagccgtcttgaagtaacttggaaatagcttagagtttgggtcagctctatagagaggatgaacagaaagag

SEQ ID NO: 548270 - DNA, 108 bp, Homo sapiens
ttgcaaaccttcagggtcccagaatggggagagtgcagtgctttctcacttgtcaaagttccttccttgtacttttcctagtttcaggatgaccttggggtgcggcaa

SEQ ID NO: 548271 - DNA, 108 bp, Homo sapiens
atgatgttctggatcacattcctgtatgttctggttcagtatattaaagataactcaaagatagatgtactgaaccagaatatatgaaaacgtgatccagaaaattat

SEQ ID NO: 548272 - DNA, 108 bp, Homo sapiens
ggaaagtatatgagcctataactggcttttacagatgattaaatgctcaggttgaagccgaggcttttgataactgctagagccatttatgacctcatatactactcc

SEQ ID NO: 548273 - DNA, 108 bp, Homo sapiens
tgcagcactcagtcagatccctcatctctgttacagaggtgctttgcgaaatgactggtggcatttcatcactgtaatgagggagaagggaagggactttctgctgca

SEQ ID NO: 548274 - DNA, 108 bp, Homo sapiens
agttgtagaatatggtttggaattcaaaatgtggtcaagtattgttcctgaacatgccttaacaacacttgaccacatcctgagtcccaaaccataggtcgattagct

SEQ ID NO: 548275 - DNA, 108 bp, Homo sapiens
gaaaagaaactcccagttaattcagagttgcttatgtcaggtgagaggggtagacaccaattctctctcacctggcataagcaattcacaattaactgagttcttttt

SEQ ID NO: 548276 - DNA, 108 bp, Homo sapiens
gccgctcacaggtatcttaatcggaactttgcagcggagacttctcaggaacaaatacttagaaagtctccgtggtcaggtgatgtctatggaactccagtgagtggt

SEQ ID NO: 548277 - DNA, 108 bp, Homo sapiens
gtacagggcaaatagcagtgcggggtgaaaataaagactgactaccactggcaacccttggtcactcttcatttattcatccaacattgctgaatatttgccctgtgc

SEQ ID NO: 548278 - DNA, 108 bp, Homo sapiens
aatccccagagatgtgtgggggaagggggggcagtgcatgtgtgtgcacgtgtgtgttcatgcgtgcacgtgggtgtctccttgcccgacgagagattccttgggatt

SEQ ID NO: 548279 - DNA, 108 bp, Homo sapiens
ttctgtaaatggtgattgggttcccagacctatctataaaagtgaatccagcccacagtgtattcacttttatagacaggtctgggaacccgatcaccacgtatagaa

SEQ ID NO: 548280 - DNA, 108 bp, Homo sapiens
ggcatcctttaatgtcaatgtcacttgttctgatttgtgctgggcaaggaaagacactgtcctttccaccccagcacatttgacaagcactgacactctgggcatgct

SEQ ID NO: 548281 - DNA, 108 bp, Homo sapiens
gccacgctgtttctccagaactgagccggccttgtgtctgttgggaagaaagacatgaaaatgagggctggagcggacgcagggccccgattccaggagaaacagggc

SEQ ID NO: 548282 - DNA, 108 bp, Homo sapiens
gaatgccaaagatgtgttgtgtccctgcaagtgtgctgaactgtactgaactgaccaaagcactgcagttcagtgggcttgctgaggacccaaagctcaatgtcattc

SEQ ID NO: 548283 - DNA, 108 bp, Homo sapiens
gctctcctgctctgttcagaccagggtgaggaatgtaaggtggatcatagggaacttcttttcccatgttgcattcctgctcaggtggcggagctgaacaaggagggc

SEQ ID NO: 548284 - DNA, 108 bp, Homo sapiens
gctaatggtgagaagaaattgtaaaaagaggcaatagaagatgctaagttgtttctcttcagcatcttctagtatctctttttaattcataatttgcttaaaattggc

SEQ ID NO: 548285 - DNA, 108 bp, Homo sapiens
gtaatgcttttccctgcactgcttgtctgcaggaggtgaagtgaaatctgcaagagtcctgctcgctcaaggcctgcatacaggaaagaagcaggggaaaagcgttac

SEQ ID NO: 548286 - DNA, 108 bp, Homo sapiens
catgcagtaatagcttggtttttcccgtgttcagctcctccccgagtacttagtgttaaatcacagggggaggaagtgtgagcagagaaaaaacagcactattacatg

SEQ ID NO: 548287 - DNA, 108 bp, Homo sapiens
tcttctaaggtcctgctatccttctgtggggaatgtgtccggaacccagtctcctaacacccaggatacaacctccaggaggcaaaagcggggaaaaaccttggaaga

SEQ ID NO: 548288 - DNA, 108 bp, Homo sapiens
ggttctcagctgaggctgttctgatgggggttggggcgatggcttctaagagctgagcttcttccatggccctccctgaattcctagagaagcagccagctgtaagcc

SEQ ID NO: 548289 - DNA, 108 bp, Homo sapiens
aggaagcctgtgtcctgcccctctgacctgtctaggcccagcttttgtctttgtaacttaaactcccaaaggcaggcctggacaccctgtgttggcttctggcttcct

SEQ ID NO: 548290 - DNA, 108 bp, Homo sapiens
ttaggtttctatcctgctttgaggaaagatttcagtcagctgtgatgtatatggaatagcagagtggaacttgtctctttttcagagcatggggcttagggaacctga

SEQ ID NO: 548291 - DNA, 108 bp, Homo sapiens
tgatttaaggctcttttagaaagagagactgagggctaccccggggcaaacactgcatgactctggcagtagatccagtctctctgcttcagacatgggccttaatca

SEQ ID NO: 548292 - DNA, 108 bp, Homo sapiens
gtaacgcttttcccctgcttctttcctgtatgcaggccttgagcgagcaggactcttgcagatttcacttcactgcctgcagacaagcagagcagggaaaagcgttac

SEQ ID NO: 548293 - DNA, 107 bp, Homo sapiens
tgtgtccttccagaatttgccagcccagggaggcccagggttggaccagagtctgggtccatcctccctgggcctctctggcctcactgttctgggcttccctcaca

SEQ ID NO: 548294 - DNA, 107 bp, Homo sapiens
ggcccagagggagagagacatacagggaggctgcagtggagcagggcaacctcacacttctgcttccagctctctgtaaggtctgacttcacttctctcgttgggtc

SEQ ID NO: 548295 - DNA, 107 bp, Homo sapiens
gacgcatctacttcccagcagtgttgaggcctaatttcatttgattgaaaagcctttgggctttttccatgatcagctgtatttggtttcagaagttcagaactgtc

SEQ ID NO: 548296 - DNA, 107 bp, Homo sapiens
gtctgagacaataaaaaatatgtagggagagagttttgagtcttgggattgaacttttctcaaaactttgggcttttctttggtgttcttgtggtgtagtctcaggc

SEQ ID NO: 548297 - DNA, 107 bp, Homo sapiens
gctaccaccactagaacgttaattctgggagtgatgttacagcactaatgattcagtctttcctgggctgtaatgcgatcccagaattactgtcttatggtgtcagt

SEQ ID NO: 548298 - DNA, 107 bp, Homo sapiens
cagacaggcttacagacctctccatctgtcaaatatcatgctctttggtttggaacatattccttggtttggagcattatgtttgaacagatggagtggcctgtttg

SEQ ID NO: 548299 - DNA, 107 bp, Homo sapiens
ctgagtgatagaaataaggctcccgtccattactggagactctgggttttatactaccagtgtctccagtagtagacagaagccttatttctcaagttcgttctcag

SEQ ID NO: 548300 - DNA, 107 bp, Homo sapiens
cgcccccaggggttagagatcccaggagacaggcataggacaataatagcaaacgcctttcctaggcctttcttctgtggatctgtgtgcacccagaaccaggggtg

SEQ ID NO: 548301 - DNA, 107 bp, Homo sapiens
ttccaggtgggaagaggcccagtctggggatcttagtttgagaaaccagtgttgggatctataactgggacctcagaatgggcttagtatgaaggttcagtttggag

SEQ ID NO: 548302 - DNA, 107 bp, Homo sapiens
cgggatcctgagtcccactgctttctgctgcttgttgcgtgtctcagaggcaaagagaagcaaccttggaaatgcgacaagctgtggatgtggagtcagagattctg

SEQ ID NO: 548303 - DNA, 107 bp, Homo sapiens
ctcggtgtccatgatggggcagccggggggctgtacgcttcctctgtctctgtctctgggcagaccatagtccagcgtgctgcccctactgccctggaaaagccgag

SEQ ID NO: 548304 - DNA, 107 bp, Homo sapiens
tgagcccaggagtatcaagggggaggggtggggaagcaactgcttaagactagtctgtccgcatctgctgtctctgctcttcacctgcaaagctcttctgtgctaca

SEQ ID NO: 548305 - DNA, 107 bp, Homo sapiens
ggagagaaccttatgtacagtcacatattcaatcactaagtaaatttaccaggtaaatactgtagtatttactaagtggtaaatatgtgtggtattaggttcccttc

SEQ ID NO: 548306 - DNA, 107 bp, Homo sapiens
tctaaaaacatctgttgctctccccagtccaagatgaggatattttggtccagagaagtaagaagtttcctcatctttggactgcggagagtaacaaatgttttaga

SEQ ID NO: 548307 - DNA, 107 bp, Homo sapiens
agtcttaatcttattaagttatatatatgatgtcatttatctcagaaaggcaaggcaaggcatttctgagatggatgacatgtatctatgacttaataggagtgact

SEQ ID NO: 548308 - DNA, 107 bp, Homo sapiens
cattttttattggatagaaaagggtcatatgactctggaaaactgtgtgcctgaaaaaggaaagcaggattgtcataatggctcatttctgccctgaataaaatatg

SEQ ID NO: 548309 - DNA, 107 bp, Homo sapiens
tgcttgcctcttttccatctcctctggaggttctcacatctccaccaaacattttaaaaactgggtggagaagtatgagccttcacaggagatgaaacagagtaaca

SEQ ID NO: 548310 - DNA, 107 bp, Homo sapiens
ttcgagtttgggttacatgtgtggcattgtgtttttgaatggagctttctggaatggcaacactccatcaaaaacacaatagcacacctgtactccaaatggctgaa

SEQ ID NO: 548311 - DNA, 107 bp, Homo sapiens
tgtgtgtcactgggaagcttactgtctctgatcaaatgcatgtggtgctgacacaaggtccccactgtgcaggtgatatgggacagtccgcctatacattgcacgca

SEQ ID NO: 548312 - DNA, 107 bp, Homo sapiens
cttttcttttctttccctgtcccttttctcttacattttttgccacttgagacttagtgaaaggaggaatgaagaagtgaaggggtggtgagagagaagagtaaaag

SEQ ID NO: 548313 - DNA, 107 bp, Homo sapiens
acggccctatggcttggtttccagatatctggagaaaagtgtgctttctcttcttccatgaaatcacaaatttctctagatatttggaaaccaagtcacagggttgt

SEQ ID NO: 548314 - DNA, 107 bp, Homo sapiens
tgggggggtgggtgggagcgagggacagatagttgctcgggggtcgaggcgggggacgcctcgacttttcgagataacaggtttgtccgattccccccacgccccca

SEQ ID NO: 548315 - DNA, 107 bp, Homo sapiens
agaaaggaaccagtccaaagcaaagcagtgtttgccagaaccgggacagaaacctgctctctctggcgctggcaaatgctggggtgctgctggagtgggccctttct

SEQ ID NO: 548316 - DNA, 107 bp, Homo sapiens
ggctcctgtaaatgtgggtcaggaatcaccagggaggtaatgacttggtctgctctgtgttctctggccctccttggtccttccatgaaagccctctgtcaggagcc

SEQ ID NO: 548317 - DNA, 107 bp, Homo sapiens
accttttggctttgctgtccttatttctcttcttctgatccctcatctgctccttcctttgctgatcattagaacaggaagagggataaggggcagctgcctaaggt

SEQ ID NO: 548318 - DNA, 107 bp, Homo sapiens
gcaacagcaacagcagtgaataaacaagttatcaccacagcccttgttcttaccccttacagctgggagcagaggctgggagatcgatgctgcttgtcagctgttgt

SEQ ID NO: 548319 - DNA, 107 bp, Homo sapiens
ttcttatttaattacagctatattgaagatacaatatgggtgtgtgtggattcatttattcacaaacatatatatttgcatctacaatgtgttgtacatagtaagaa

SEQ ID NO: 548320 - DNA, 107 bp, Homo sapiens
acaaaacagcaattcagaatagactctcttttaatatagtaatgtggataggctttcctgggctagcggtattaggaatgagggctaattagtaatggctgttttgt

SEQ ID NO: 548321 - DNA, 107 bp, Homo sapiens
cactggggtgatgttaccataataattatggaattatggcttaaaatcaaatcactattgtggacatttaagtcatgattctgtgttactaggaaaccaaactagtg

SEQ ID NO: 548322 - DNA, 107 bp, Homo sapiens
tggagtttcatcagccatggacttccacctgtcttctctatggtatcaaggggattgtcccatgaccctaagagagggcagatgtgtgtcagcctgaagaaacatca

SEQ ID NO: 548323 - DNA, 107 bp, Homo sapiens
ttacctgtctacagcaccacttgcaggggagggggaggaggcagttctttaggaagggtagtgcaatgcttcctcctcttctgcaagcagtgctggagattctgtag

SEQ ID NO: 548324 - DNA, 107 bp, Homo sapiens
cggccatggtttctcagtcacccctcaaggagttgacactttggggcccatgaagttttttagccctaaaacatgttgactctttaaatggctgtggaatctggctg

SEQ ID NO: 548325 - DNA, 107 bp, Homo sapiens
gcaggtcttgagtctggcagccagggagggagcacagccgcctctcatgaaacaatggcaccctgctgtgcttcttcaagctggtctgtcactcactccctccctgc

SEQ ID NO: 548326 - DNA, 107 bp, Homo sapiens
gctgtgacccatgaggcttctcttctgcctctgacctggaggggttctggccacggaagtaccctgaaggaggggcaggaggtgagaagatgggaaaaaagaacagt

SEQ ID NO: 548327 - DNA, 107 bp, Homo sapiens
atcctaattgggcattaaagacatgttcatagaagttacagtgtggtcaagatatctgcatattctgtagaatgttctgtgaacagtctagtgacttacatttggat

SEQ ID NO: 548328 - DNA, 107 bp, Homo sapiens
gcatatatccattaccaccataaattctgggagcaaagactaaactaagctggtggcgatgagttcagcctgtgctcccagaatgtatgggggtaagggatatatgc

SEQ ID NO: 548329 - DNA, 107 bp, Homo sapiens
gaagtctatgaaagccaacatttgtggtgagcagggaacgtcagttaatcacatattagggatgattcctttgttcattgtgcaaaagtggtttctagcagacattc

SEQ ID NO: 548330 - DNA, 107 bp, Homo sapiens
gatggtgctaactgtggcatttgctaaaacactgacaaatctgttaaaagcgttgagctttgttgaaatggatttagtcggcttttagtgagtgtcataataacctc

SEQ ID NO: 548331 - DNA, 106 bp, Homo sapiens
gaatagaatgatataacaaggcaatatttctgaaagctgagatcaacagactgtgattaaagtcagcttgcagttatattggctgagaatgtcatgccagctgctc

SEQ ID NO: 548332 - DNA, 106 bp, Homo sapiens
cccgcccccgccaaacctcccaccccccgccaccttcttttccctgggtcctgggagctgaggcaggaggagaagtggggggatgggagtggagagggagggcggg

SEQ ID NO: 548333 - DNA, 106 bp, Homo sapiens
ccattacttagcctctctgttcctcagcattctctgtaaaacgatgagagctatagcaaccctcttaacatgggagtgcttgaggatgaaatgaggtaagtggtgg

SEQ ID NO: 548334 - DNA, 106 bp, Homo sapiens
tagtctttcaatcatgaatgctcactaacagtccaacgggaatggctctatgggaacagttaagtaaaccttggactgcagtgtgcattcagttagtggaggatta

SEQ ID NO: 548335 - DNA, 106 bp, Homo sapiens
attattaagctttgagagaaatgataaggcagatagagaattaaatattaaaactttcaagtttgattctctatctcccctatcatttcttttaaagcctaataat

SEQ ID NO: 548336 - DNA, 106 bp, Homo sapiens
taattctataagtccacatggtaattacctaattacaagctgtcagcatatgattgctgacacttgtaatattttgtaattacataatttggcatgattacaatta

SEQ ID NO: 548337 - DNA, 106 bp, Homo sapiens
tgggccgggaggttgaacatcctgcatagtgctgccaggaaatccctatttcatataagagggggctggctggttgcatatgtaggatgtcccatctcccagccca

SEQ ID NO: 548338 - DNA, 106 bp, Homo sapiens
ggttagctagtgtgaggtcacagagctagtaggtagtagagttgggaattaaacccaggtttttctgtctacctgtaaagtctgtgttcttgaccactatttaccc

SEQ ID NO: 548339 - DNA, 106 bp, Homo sapiens
cctgcagctttctcctcaactttcttcctcccccactagataactgctattgaacctgcttgtgtaaaagtgggaggaggtaggaaagctaaggagatagggcagg

SEQ ID NO: 548340 - DNA, 106 bp, Homo sapiens
ggtcaaatttagtttcagcaaagtgttcttgcactgcctgccaagaagatggggttaattggtaggaaagtgtgggaggaaactgatgttagtggaacatttaact

SEQ ID NO: 548341 - DNA, 106 bp, Homo sapiens
tcctctattcacatccatcagggagaggagtaggctgatggtgccagctaaggacctcggcactcctagacctattcctgaaccattaatggctctgaatttggga

SEQ ID NO: 548342 - DNA, 106 bp, Homo sapiens
gtgcaattaagatggttgggtttggattgttgtacttttttttttgttcgttgcatttttaggaacaaaaaaaaaagcccaacccttcacaccacttcatccgcat

SEQ ID NO: 548343 - DNA, 106 bp, Homo sapiens
tggaaatacttctggctgaagcattgctcagtaaattgctgataaatgacttccatctggaatatacttggtcagcaatttaggaagccatgcagatttattttca

SEQ ID NO: 548344 - DNA, 106 bp, Homo sapiens
atttttaaaaagaacagcacagttagcattactatttataaagaagacataaggatgtgtattcataaatagataaaattaactagtgctattctgatgtgagaat

SEQ ID NO: 548345 - DNA, 106 bp, Homo sapiens
ccaaaatatgctcactcatagctttttctctgacctccttcccagccttcttagatgggaggaaggagggaggggaggggagagctgtgcatcagtcagggtaggg

SEQ ID NO: 548346 - DNA, 106 bp, Homo sapiens
gggggtggcccagcctaaggagtcctgccctggatggtccagagctagcagcaggagaggtggcactggattatttggggtccactaccaggggtgggatactcct

SEQ ID NO: 548347 - DNA, 106 bp, Homo sapiens
gggaggtgaaggaagggtttgggttcagtaaggggatgttgtcattctggaaagttccaagatttgctctccttcctctgcccaagctatataaataacctggccc

SEQ ID NO: 548348 - DNA, 106 bp, Homo sapiens
tggaaatttctctagtagtctactccttctgtcctgtggtagaagtacatcatgagagagttgccacaagacagaacaagctgaattgctggaggtaaatgctcca

SEQ ID NO: 548349 - DNA, 106 bp, Homo sapiens
accacactcagccttcttcctcccttatcctggacctcttcaactgcctccagcaaatattcagtaagatccagggaaaaggaggaggaaggaggaagcctgtggt

SEQ ID NO: 548350 - DNA, 106 bp, Homo sapiens
aagtgttatcagtttaatgaactacttatgaagtgttaaatgcatgcaagtgtaaactgcaacatctgggtttgtgttttatttgtagacttcaaactgggcgctt

SEQ ID NO: 548351 - DNA, 106 bp, Homo sapiens
gcagtcatgttggccaactctcattttaggtgtaaggtatatcagcctccttcagtctcaggtgcagtccttatacctaaaattgagggctggccaagatgactgc

SEQ ID NO: 548352 - DNA, 106 bp, Homo sapiens
cagtgtcctgggtaggccttgaagggtgatcttcacgtaagcctgtggccagagcaagaaagctgcacacgggcagcggaggaaccagcaggagcccagtccactg

SEQ ID NO: 548353 - DNA, 106 bp, Homo sapiens
tcctgcacagagtccttgaaatcttggctgtcctctgtcccttcgagcacatgctgaatgggctgagaggtggccggtgtggtgttctgggattagggatgcagga

SEQ ID NO: 548354 - DNA, 106 bp, Homo sapiens
gcaatccaggatgtattttatagggctattaatatatgcctcgagtggtcaaaggctttgccactcacttgaggcaaatagtaatggccaataaaacttgccttgt

SEQ ID NO: 548355 - DNA, 106 bp, Homo sapiens
gccttccagcccctccacagaatccagaattgctgaggtgccagttaattcttcattctgcacctcccctcaccaatctggttttctgggagggctctggcagggc

SEQ ID NO: 548356 - DNA, 106 bp, Homo sapiens
ggggtctcagcccttagatcacatgatttataaggcaggagggagtcccctggatgatggaaccccctcccttgtataaatcatttgatttaagggctgaaacccc

SEQ ID NO: 548357 - DNA, 106 bp, Homo sapiens
ttcatctgttgtatggtgcttctcttctctgccaagtggtctgagagcctaatcgtatcactattagcccacttgggagaggagagaagcactgcacaacagggaa

SEQ ID NO: 548358 - DNA, 106 bp, Homo sapiens
ttcctccctccctccgagttgatctcccttgagctttgacacacggtacctaatgaaggtggggtgtgtgtgggtggggagggtgatgtgggggtgtagggaggag

SEQ ID NO: 548359 - DNA, 106 bp, Homo sapiens
caccgagtcccctccaacccaggactctagacattcaggacagggctgcttgtaccactctgctgcttctgaactggggtcctgggtttgtgccagcgactgggtg

SEQ ID NO: 548360 - DNA, 106 bp, Homo sapiens
gttttaagcaatcctttatacacaattatagatagatgccattgtaccagctggctctgggtacaatgccatctatctttaagtgttcaaaattttagctcaagac

SEQ ID NO: 548361 - DNA, 106 bp, Homo sapiens
gctactcagtttagtcctccaatgtgctccctttgttttagattccatgaatatcctggaccctgaggatgaggaggagcacactcaggaagaggacagcagtggc

SEQ ID NO: 548362 - DNA, 106 bp, Homo sapiens
caccatgcccgtgttgagtcaggcctcggtctcctcacctatgtgatggcctttggccctcaaccctcaggagacggaggcctgacttacccaagggcgcatggtg

SEQ ID NO: 548363 - DNA, 106 bp, Homo sapiens
gtgcaaatgaaagtgggcaaaaagcctgtccctaagtccctcccagccttccagagttggtgccaggaaggatttagggacaggctttgtgcccacttttggctac

SEQ ID NO: 548364 - DNA, 106 bp, Homo sapiens
gtattcacagtgcacaaaattctaggtatatagtgtaaaacctttttacgaactttttacaaagtttttgcactatatacctataattttgggcactgttctttac

SEQ ID NO: 548365 - DNA, 106 bp, Homo sapiens
ctctgtggttaagcccattaaatctcttgtgctttcatagcagcttggctaaaggttattactatgaaggctggagggagagtgggagataacttcgaccagagag

SEQ ID NO: 548366 - DNA, 106 bp, Homo sapiens
taggtgccggctggagctggttaggatctttccgtctgacttacagggcaactgacgccctctgtgtaatcagacgtgatgaccggactagaaccagccctacctg

SEQ ID NO: 548367 - DNA, 106 bp, Homo sapiens
gggtgctctgaattaatggtgggggaaggtaatccctttgtgcctgtggggagcttcagatctgtccacagggcacacaggtgagaaacagccccaagatgtatcc

SEQ ID NO: 548368 - DNA, 106 bp, Homo sapiens
ggttgtgtaggcacagttcaggaatcagaggaatgtgtcaagtttctcattcaaacggaagcatgactttgttgatttctgaggtggcagacgtgccaacgcaacc

SEQ ID NO: 548369 - DNA, 106 bp, Homo sapiens
gcagtgagtggataaatgagccgggagttgagatgtgagcaccctcctatggagagttatctcagattactcttggcttccagaagtaacatttagccatcaaggc

SEQ ID NO: 548370 - DNA, 106 bp, Homo sapiens
tgcacaggtcagttgcaaataatctgatgctgtttttgggaaactgcaggctaaaaatagccatggttttcctggatgaggcattagtttgatgttggcctttgta

SEQ ID NO: 548371 - DNA, 106 bp, Homo sapiens
ggagacattctgggaggggttggaggaggctctggggctgccggagggggcctggctgggagcctccagtatcctcctctggcctctcacgggatgtgccagctcc

SEQ ID NO: 548372 - DNA, 106 bp, Homo sapiens
gtggcggcgccgggagacggcgggaagtgggaccgggggccagggagggtgaaggttggagtctcctcggccgagcccggtcctcaaaccgtcccggcagccccgc

SEQ ID NO: 548373 - DNA, 106 bp, Homo sapiens
tgtggctgacattcagtccttcttccttctcagggctttgttttaccttttcccatttgagccacaaaacagccctgaaaggctggagtaggagtcagcagcccca

SEQ ID NO: 548374 - DNA, 106 bp, Homo sapiens
tggcaattctcagattcatcccatggcatggatcggcctgcatctcaatagtgtgtgtacacattcaaggtgggaagggctaatttatagttggggtcttgagcca

SEQ ID NO: 548375 - DNA, 106 bp, Homo sapiens
ggtcatttaacactccatttagtcacccttgataatgttcttctttccagaggtgtagtgagagaagcagctttcaaggtgatttctctgcatggaggttatgtcc

SEQ ID NO: 548376 - DNA, 105 bp, Homo sapiens
catgccagctgctgtgggtgtgtggggccttcgggtcctgtgggatggcgagtgtgtgtgctgagcaggacctgtagggcctgcatcccaggtgagtgggccatg

SEQ ID NO: 548377 - DNA, 105 bp, Homo sapiens
gtggggagctccaagcaggtgggcaggacccaggggcctggtgaccaggacagacccccactgtccatcacctttcctggccctgtcctctgctaaacttcccac

SEQ ID NO: 548378 - DNA, 105 bp, Homo sapiens
ttattttaccttcttgtataagcactgtgctaaaattgcagacactaggaccatgtcttggtttttgcaataatgctagcagagtacacacaagaagaaaagtaa

SEQ ID NO: 548379 - DNA, 105 bp, Homo sapiens
ggggccttgctaaatgtggagggtatcctcatgaggggaaataggatcaaaacatgaaggaactgggcccatatgaggctgcccttgaatgcagaggaaggccct

SEQ ID NO: 548380 - DNA, 105 bp, Homo sapiens
agatcactaaggtttctacagccccgagttttcaggacttcagggtccttagactctaggatttcgaagttttaaaatttggaggctctagaattcttagcttct

SEQ ID NO: 548381 - DNA, 105 bp, Homo sapiens
tgggcaccctgtttgaggaggctggtctatcatttgggtggggaaacatttagggaactgagggggtcccaatctgaggagactggtctactattgaggggccca

SEQ ID NO: 548382 - DNA, 105 bp, Homo sapiens
gcccctctggtggtcccccgctgagtctttggtaaagtctgctgcatctgccaattcttttgtgagcagatttgttctaggggtgtgggggactaagaaaggggt

SEQ ID NO: 548383 - DNA, 105 bp, Homo sapiens
ggcaccatcctgcttcactcacccagtcttccactgtcccgcctccacgctggggacaggcaggcttgggacgagctggaggaaggggaggggaggaaaaatgct

SEQ ID NO: 548384 - DNA, 105 bp, Homo sapiens
ttgctttaacaaatatattattccttcagtttttatttttcagaatatgattcaatttcttggtgaatcaaaactgagaggagaataacttatttgttaaggtaa

SEQ ID NO: 548385 - DNA, 105 bp, Homo sapiens
gtggggagctccaagcaggcgggcaggacccaggggcctggtgaccaggacagacccccactgtccatcacctttcctggccctgtcctcagctaaacttcccac

SEQ ID NO: 548386 - DNA, 105 bp, Homo sapiens
ggtttttatgctgagagagcaatcttgaaggagtgatatttgttgttgattcagaaaatttaaccacaaacatgtccctttgagaacattctcaacatgaaaacc

SEQ ID NO: 548387 - DNA, 105 bp, Homo sapiens
acagatagaagctgaccttcacctctgtcttacctggtactgtttaggacgtagctgaactaggtccctggtaggtatggaaaaggaggttgagctctcttttgt

SEQ ID NO: 548388 - DNA, 105 bp, Homo sapiens
agatgtctgttcacttccttttgcatccaccctctccctctcctgtaaaacacaaagtgagagtctagggaaagtatggagtgctggagggaatggcacacattt

SEQ ID NO: 548389 - DNA, 105 bp, Homo sapiens
agcaccactcagcgccatctcacctccctgagccatgctgccatcacccttcgcctccatgtgaagtgtggctcagggagatgagatgaggctgagagtggtgct

SEQ ID NO: 548390 - DNA, 105 bp, Homo sapiens
ttggcgcaaacagagcctcttgctggtctcagaaatggggaaagtgagaactaaccaccaaccccaatgagaccagtgcaggaaggattttgaagtttggactag

SEQ ID NO: 548391 - DNA, 105 bp, Homo sapiens
aaagatttatatacaatagtaaaagcaattgagaggatgtctaattggggcttgtgtatactctaaacgtcctttcaatcactttattattgtgtattgatcttt

SEQ ID NO: 548392 - DNA, 105 bp, Homo sapiens
gtggggagctccaagcaggtgggcaggacccaggggcctggtgaccaggacagacccccactgtccatcacctttcctggccctgtcctcagctaaacttcccac

SEQ ID NO: 548393 - DNA, 105 bp, Homo sapiens
gtggggagctccaagcaggtgggcaggacccaggggtctggtgaccaggacagacccccactgtccatcacctttcctggccctgtcctcagttaaacttcccac

SEQ ID NO: 548394 - DNA, 105 bp, Homo sapiens
cttggggccttggcctctgctggctggctgtaacctgagaagctgtgtcacttctttcttcagattctcaggggacaggctgaccaggaggacaggagccccagg

SEQ ID NO: 548395 - DNA, 105 bp, Homo sapiens
tgcctccccacttctccacactacttctccaggagccacttactggacaccaactggctgacggtgggggtctctgagcaggtaattgggataggagcagaggca

SEQ ID NO: 548396 - DNA, 105 bp, Homo sapiens
gccctggacttctgacccagtcactgtgtagtgtgcttcttgtctgaagaagccacagaaatcagacaagaaagtagatacacgcaggatgggatgtactagggc

SEQ ID NO: 548397 - DNA, 105 bp, Homo sapiens
aaatgcactctaaattctttgcacatctgggaggtggtatgagtaatttttctaacttgctgcatcctatctcctgtgtgttgtatgaagtgaaagactgcattt

SEQ ID NO: 548398 - DNA, 105 bp, Homo sapiens
gtggggagctccaagcaggtgggcaggacccaggggtctggtgaccaggacagacccccactgtccatcacctttcctggccctgtcctcagctgaacttcccac

SEQ ID NO: 548399 - DNA, 105 bp, Homo sapiens
tgccagatgtgctctcctggcccatgaaatcaagcgtgggtgagacctggtgcagaacgggaaggcgacccatacttggtttcagaggctgtgagaataactgca

SEQ ID NO: 548400 - DNA, 105 bp, Homo sapiens
tccagatctcgccacaccctctgcaggccacccccacccttccttcccttccaggtgtggtcagtcggggagggtggtggccgggggtgaggggcatggtctgga

SEQ ID NO: 548401 - DNA, 105 bp, Homo sapiens
ggccgactacatgagttaatatttgaaaggtgcttagaacattgcctggtcaacagtaaggctatgtaagcacttgtttaatttattaattttctttccctggcc

SEQ ID NO: 548402 - DNA, 105 bp, Homo sapiens
agtattcacacttccaaataaacagagtgactcactactgaatttatgaagaaacttgggtagtggtgagttgctttgtttacttgggataaatgtgaatgtact

SEQ ID NO: 548403 - DNA, 105 bp, Homo sapiens
cttggggcgtagcacatgacctggtgctcaataagtgctcagtgggtgaaaacatagccccaagagctgcacttattgagcgccaactctgtgccaagccctggg

SEQ ID NO: 548404 - DNA, 105 bp, Homo sapiens
tcaccctggattcctgtaaatgtatgccatctgtaggtgttatgtggaaactatgtattgctatatttcacctatagatgtatgcaactaattatgtccaggtga

SEQ ID NO: 548405 - DNA, 105 bp, Homo sapiens
gtggggagctccaagcaggtgggcaggacccaggggtctggtgaccaggacagacccccactgtctatcacctttcctggccctgtcctcagctaaacttcccac

SEQ ID NO: 548406 - DNA, 105 bp, Homo sapiens
tattagaagcatgttcaaggagcagcctctggggttaatagagtttaatttgcaagacaaatgaaagcttattttctcctaggctctctgctcataattctagta

SEQ ID NO: 548407 - DNA, 105 bp, Homo sapiens
accaacagcttgttctaatttaggaaaggcagggtgggaggggagtaaggggtccccacagggaccttattttcttctatcttgatttccctcaagctacttggt

SEQ ID NO: 548408 - DNA, 105 bp, Homo sapiens
tgcacaatacaaccttcagggtatatgtttgttggctaataaaatatcaaaggcatgcatgtattggcagacaagcccataccctggagtgtgttattgcttgca

SEQ ID NO: 548409 - DNA, 105 bp, Homo sapiens
ctggggcaaggacacattaaactggtccctgtgggtcaggtctgagtgggggaggacctcccctccccactgcctcccacaggggcttgtgatgcagggtttcag

SEQ ID NO: 548410 - DNA, 105 bp, Homo sapiens
tgagaggtggctttttcctgtggtgccaggcttttgtaatctttgctcttgaccttcgccgggagggggtgcagaagtttggagcaccatggatgtaacctttca

SEQ ID NO: 548411 - DNA, 105 bp, Homo sapiens
tcttaattgcttttggacattcaaattctgaagtgggaaaacctcaagcgatttagtgttggcttagttttctcatttctacaatgaatgtcttgggctagaaga

SEQ ID NO: 548412 - DNA, 105 bp, Homo sapiens
cccacgcactgtggaggtgcgagagaggttgctccgtgcggtgctattcgaggcagatgcagagagcgccctggagtaagctctccaatcctagagctgcgcggg

SEQ ID NO: 548413 - DNA, 105 bp, Homo sapiens
agcctgtggtgttaggtgttgatcagggctctgccacaggggctgtgcacttactgcctgcccttgtcagtaggaaccctgatcctcggcctagattcagaggct

SEQ ID NO: 548414 - DNA, 105 bp, Homo sapiens
gagaagcagccaccgagaaggggcaagtgagcggcaaggccgtggttccacattcccaaaccacgctttgtccttcctggggtccccgtaggtggggctcttctc

SEQ ID NO: 548415 - DNA, 105 bp, Homo sapiens
gctcaaagaggtgaggtaactctcccagggttccacgcctggctgtgtgcatgacctgctacaaccagcatgaaaccttgagcaggttacttcacttctctgagc

SEQ ID NO: 548416 - DNA, 105 bp, Homo sapiens
gcatgcccaaggcagtggtcaggatgcatcagactgtcagcattatgtaaggtaaacctgaaggttcatgatgtgatcctgatgcctggtttgggacactattgc

SEQ ID NO: 548417 - DNA, 105 bp, Homo sapiens
attgcatggtgggtatccttttgttcagtgtcttggttggctgtggctagtcagtgagaagtcagctgggactctaaaccagatagggcacttaccatctgcaat

SEQ ID NO: 548418 - DNA, 105 bp, Homo sapiens
ctaatttcactgatgtaaacattgttaaacaatttcaaatgcaactttggaaacattgtttctgaacctgtttaataatgtttaaaaatgcatcaatgaaattgg

SEQ ID NO: 548419 - DNA, 105 bp, Homo sapiens
gctggtggggcggggagccgcttcttccaggagagagagaggggtgattttctgatgactcacttttttcccactcttggaggattaagttctggccccagtggc

SEQ ID NO: 548420 - DNA, 105 bp, Homo sapiens
agcctctgaatctaggccgaggatcagggttcctactgacaagggcaggcagtaagtgcacagcccctgtggcagagccctgatcaacacctaacaccacaggct

SEQ ID NO: 548421 - DNA, 105 bp, Homo sapiens
gcctgatcagaattaaaattgctgttggaatttcctgtcaaagcaactcatttattctctgagctctgcactttgattggacattgccttcagcaatagtcaggt

SEQ ID NO: 548422 - DNA, 105 bp, Homo sapiens
gtggggagctccaagcaggtgggcaggacccaggggcctggtgaccaggacagacccccactgtccatcacctttcctggccctgtcctctgctaaacttcccgc

SEQ ID NO: 548423 - DNA, 105 bp, Homo sapiens
gatcattaaagaatgttcctgtttacttccctccccataacccagtcacagtggcatacaattcagggatatggggagaggagtgaacaggaatagagaatgttc

SEQ ID NO: 548424 - DNA, 105 bp, Homo sapiens
gcccccattctttctctttccctctgcagcccaaaatatcaccctagtatggtagcaccttctagatttttggggtgacagagatggggagcaaggagagggggc

SEQ ID NO: 548425 - DNA, 105 bp, Homo sapiens
gccctcttcccatcatctgactgccctgccttccagctctggggagggttggagccctcttgggggcaggagggacaggggtccaactgaggaagggaagagggc

SEQ ID NO: 548426 - DNA, 105 bp, Homo sapiens
ggggctttgggttgagccccagatgacatggctgccgcaggcaggtggcctcgaggcccctggagcctccgggtgtggccatgttgggggcaccggccctgcccc

SEQ ID NO: 548427 - DNA, 105 bp, Homo sapiens
tgtaattattttctccaatcaggatgtagtttcaagggtggccaacactgtcaatcaccctctgcccttctttgaaactcgctgattatgggaaagtgctttgca

SEQ ID NO: 548428 - DNA, 105 bp, Homo sapiens
gctttcattgcaatcgttaattcagcatcattgttctctcaggctgttacgtgacccaacaggctgggggaacaatattgctgaatataattggcatatgtcagc

SEQ ID NO: 548429 - DNA, 105 bp, Homo sapiens
actgtgagggggcagaaatcctgtccgatacaggcagtggtctgcaaacctggtctgtggggaccactggcttatgggacattctaagatgtttccccttgcagt

SEQ ID NO: 548430 - DNA, 104 bp, Homo sapiens
tgggaaaaaggtgctttgagggcatagatcaatttatctcttgtccagtgctatgaccaggacaggagataaattgatctgtgccctcatttacttgacaacca

SEQ ID NO: 548431 - DNA, 104 bp, Homo sapiens
tgcacacctcccagggctaaggtgctgtggagaatacaggtgctatgtggaggacataaggtgctacgtatcctccatagcacctcagccataggaggtgtgta

SEQ ID NO: 548432 - DNA, 104 bp, Homo sapiens
tggcagtttatgtttttgaggctcactctacacagatagaatggggactgctggcagtgcctcaggttattggtgggggtaagaaagggcatttctctctgcca

SEQ ID NO: 548433 - DNA, 104 bp, Homo sapiens
acagcggagatccttagcgggcttcacttatctcatccttccttcatactggagttaaggcatgggaagagaagtctattgaccactccaggatctagccctgt

SEQ ID NO: 548434 - DNA, 104 bp, Homo sapiens
ggccccatactgtttcctctcggttgcttctaaggctcctgaaactgcagccagtgagcctttcaggaaccttgggagtaactgacagggaacagcaaggggcc

SEQ ID NO: 548435 - DNA, 104 bp, Homo sapiens
gcccccaggcctgctaagggtagctttgcatggacaggcacagagggagacacgtcaccctccctgtgtcttctgtgcaagggcccaggttgccaggcctgagc

SEQ ID NO: 548436 - DNA, 104 bp, Homo sapiens
cataatagctatttgattgggggtgagatattttgcatattggcttggcgctgatagcggaatttcatcaactcccttttttcatgctttaaaactgaattatg

SEQ ID NO: 548437 - DNA, 104 bp, Homo sapiens
aaggagaggaaaaggctgatgtggatggctgggaagaggttcgatggttaccttggcaactgagcttccttcctcatccccatccctccctagtccttgttctt

SEQ ID NO: 548438 - DNA, 104 bp, Homo sapiens
gtgacagaagcccagagagaactgaagctaaatggatattgtgagactggtaatcaacaaaaatcacagtgtctgggtttcagggcctaactctgggctgttat

SEQ ID NO: 548439 - DNA, 104 bp, Homo sapiens
aggatagctgagtcacctaagagcacagcacggctgcagagggcataaagcggaccagatctctgcagctgttgctgtgcctggagagtcacccgtgctgttct

SEQ ID NO: 548440 - DNA, 104 bp, Homo sapiens
ggtcattactagcagttaatgattggtttgttagttaatggcccaaggcaaagctgagggcggttaagactctaacaaacgagttgtgaattgtagcaatggct

SEQ ID NO: 548441 - DNA, 104 bp, Homo sapiens
cacttggtagttagttctctctcccttcttccaagagtctgtggctgaagcgagtccagatctggaagctgggaggttctgcaggactggcccttggctgagtg

SEQ ID NO: 548442 - DNA, 104 bp, Homo sapiens
agttacagcaatggggccttgtagagacaggacctgaggaagctggcgctgcctccttagacctgtttctctgccagaaatgcctccatttccagctgtcaact

SEQ ID NO: 548443 - DNA, 104 bp, Homo sapiens
gggtttatctcatagggaattgatgtcggtgtggctttttatttgttgctttgtgaatggaggaacaaattagagcctatcttatcagtttgttggagatgccc

SEQ ID NO: 548444 - DNA, 104 bp, Homo sapiens
gcagagatagagccacatgctcactcagatatattagggttacagagcagtttatcacagtatgtaattatatgtttgtgtgattgtttgagtcatgtctctgt

SEQ ID NO: 548445 - DNA, 104 bp, Homo sapiens
cgtcctgtatgtaaaccctattaccacggaaagagcatttttgtggcatatcgactaagaaaataaccaggctgctctttcttgtggtattggagctgaggacg

SEQ ID NO: 548446 - DNA, 104 bp, Homo sapiens
tctggattgtagagaaaaaaatttggtcattcattctgatgttttgtctgcgtagtaccaaacatctggaagttgggtgacagactgaatttttcacatccaga

SEQ ID NO: 548447 - DNA, 104 bp, Homo sapiens
ggtgcaaaatttaaggaggcacctactcccagggtcatgcaaaagccaactttgcatttgcacaatcctgtgagtgagtccctccttaaatttgaggctgtact

SEQ ID NO: 548448 - DNA, 104 bp, Homo sapiens
agagccagcatattatcttcccattattactctgttttaatatctaactgacagatgcatgtcactaaaacaaggcaatcatgggcagaaaatgcccctgctct

SEQ ID NO: 548449 - DNA, 104 bp, Homo sapiens
tcatcagacataggctatccagcgtttacatgggtactggccatcttgccctttttgggcatctgtgtagattctgtaaatcctggatgacaggtttctgatga

SEQ ID NO: 548450 - DNA, 104 bp, Homo sapiens
gtgggggaggaagctgatatttattcagagactggttatcattcactgcctacgtgacctcgggcggtaatgaaccatctctgagcctcagtttcttcctttgc

SEQ ID NO: 548451 - DNA, 104 bp, Homo sapiens
cgctgccgcaggtgttgtgggcttggtaggtgtgggtgctgccccttgggtgcagctcggacgcccagtactgggccaggcctaccgtatgcctgcaggcggtg

SEQ ID NO: 548452 - DNA, 104 bp, Homo sapiens
ggttcctaaggaagaagtacaggtagtaggttgcgtagtttgaggacagggattttatccacaaggaggtaattatatgacctgctgctacctttcttagggcc

SEQ ID NO: 548453 - DNA, 104 bp, Homo sapiens
tgtgacaggagtcttgatcatgtcgggcaagagtagcaaaacagttgtggaaaatcctcgactttagaagactgctcttgattattcaaggtctgattatcaca

SEQ ID NO: 548454 - DNA, 104 bp, Homo sapiens
tcatgtccctcatttgtgaagtggacgttgttggggtgctctccatcagaatcggggatggtgggggagcattccctgctcctgattcaggatgaggggtctga

SEQ ID NO: 548455 - DNA, 104 bp, Homo sapiens
tccgagctaatgacaaagcagatgtgtgggcaaggcagccagctttgtctttcaggtggagagggctgccttgtcagtaaatcaaatcagttcttggatttggg

SEQ ID NO: 548456 - DNA, 104 bp, Homo sapiens
tagtattaatgataatctttaattatagaatgaggacatagctttttgtttcatttatttaaaaggctgtgtcctcattttatatcatgatttgccattttctg

SEQ ID NO: 548457 - DNA, 104 bp, Homo sapiens
aaactcagcttattggtgtgcaggtggcacctagctgctatttgttgggagaagtgagcagcaaacagcaggtgccacctggcatatctgtacttggcaggttt

SEQ ID NO: 548458 - DNA, 104 bp, Homo sapiens
aagaaggagggtcctctgagtagtggtccccagcccgtttttctgccctaacactattgaatgggaggttggcgatcactacttagatgagggctttttttttt

SEQ ID NO: 548459 - DNA, 104 bp, Homo sapiens
gctgcccaacagctgttccctgggttattttggtctagtgggagtctgtcaattctagggcatttggaccaaaatagccaacagcgggacaatctcttggtagc

SEQ ID NO: 548460 - DNA, 104 bp, Homo sapiens
gtaaggggaacaaatgagatcgtgtaggcgatgccactttgcacattctgaagcactaaatgaatgtgcaatggtgtcaccacatggtcttttgcctcttttgc

SEQ ID NO: 548461 - DNA, 104 bp, Homo sapiens
actagtgatacggtattccctttggtatggtcaaagcctgtgtaatacttaagcatgtctcatacacggcttgaccattttgattgaattcacaattcactggt

SEQ ID NO: 548462 - DNA, 104 bp, Homo sapiens
ggagagaaagaggaataggaatagttcctttccctgctccaaagttttaaacgttctaacttactagtagagaaaggaaaatagttctgttcttccgtctctcc

SEQ ID NO: 548463 - DNA, 104 bp, Homo sapiens
tcaggcagcctttctgacccatgtagggtcacagaccccagcccacactgggcatggcctatgggagggggctgtgtgcacctgcaggaaaggatacagcctgg

SEQ ID NO: 548464 - DNA, 104 bp, Homo sapiens
tttttgactgccatcatgattcaggcctcagtgtcatggactctagagaccggtcactggaggttatgaccaactgaggcctgattgacgatggccgtcaaagg

SEQ ID NO: 548465 - DNA, 104 bp, Homo sapiens
gggagagcggggcagagtgggggtgagcatgcacgatggggctcgagttccagccacctagggcaagagcctcggcgtcctcgcctcttggcccctggcctccc

SEQ ID NO: 548466 - DNA, 104 bp, Homo sapiens
gttgatggcctcaccaagtttagtcatagatacccaaggtcagggagggccattaccctgtgaaactttggggatctacggctggaccacgtggggccatgagc

SEQ ID NO: 548467 - DNA, 104 bp, Homo sapiens
cctccagtttggagttggcacagtccaagactgaaatcaaggtcaagccctagggactggaccttgatttcacacttgggctatgtatgtgcccagtggggagg

SEQ ID NO: 548468 - DNA, 104 bp, Homo sapiens
ttagtgctagcaggtctcccaatatgcagatgctgccttgttgagtcaaagaacattccaagtagaagcatttgcattctggggactagcttctatgcttctaa

SEQ ID NO: 548469 - DNA, 104 bp, Homo sapiens
gcctaatccggtgcacattgtaggcctcattaaatgtttgttgaatgaaaaaatgaatcatcaacagacattaattgggcgcctgctctgtgatctccatgggc

SEQ ID NO: 548470 - DNA, 104 bp, Homo sapiens
agctataaaagccactgtttctgggagataatgaattgttggatcaaggcagaagtgatttcagcaatttgttccattcccagaagtcagagcttttaaaagct

SEQ ID NO: 548471 - DNA, 104 bp, Homo sapiens
accaaggtaagttaactgcattttcagtgggtgcagatttatcatcagaggcatgataatcatgcaaccactagaaaaagcaatgtgttttccatggccttggt

SEQ ID NO: 548472 - DNA, 104 bp, Homo sapiens
agctgaggtagttctggtcaaccaagtcaggtgctgagatgttcctggggggccctgggagttcctctagtgcctgaggggataggaccattgctgccttggct

SEQ ID NO: 548473 - DNA, 104 bp, Homo sapiens
tgtaaggtcaaagctgcttagagacagggaaggcctgagggctggtgacgctcccatggcctttgggatccccagctctctcctccctctcacagccccttgca

SEQ ID NO: 548474 - DNA, 104 bp, Homo sapiens
gatggaaagtatggaacaaacaggccctgctgacgttttggctctgctaagccttcctccgagctaaagcatctgcagcatcttcctgttctagaccctttatc

SEQ ID NO: 548475 - DNA, 104 bp, Homo sapiens
cttcctcaactctccttatcatagggctgtccttagtaaaggggccaatcttagcaaatatccaggctccccagagatagcccagggataaggggtgagtggag

SEQ ID NO: 548476 - DNA, 104 bp, Homo sapiens
gatttatgttcctaggctgttcccatcttacattgaacaaaggttagcccacagagcccaaactttgatcaatgcaagatgggaagagcctcggaacataaatt

SEQ ID NO: 548477 - DNA, 104 bp, Homo sapiens
ctttcttttaacctaatgagacactccacaggagactaacatttctttcgctgaattccaagtgtaggtttcctgggttgtccatttaattgttaaagtgagag

SEQ ID NO: 548478 - DNA, 104 bp, Homo sapiens
agaaagctttaatactatctcaaactaaaggatatagaaggttttccctttctcttgccctgaaaccttctgtatcctttattttgagatagtattagaattct

SEQ ID NO: 548479 - DNA, 104 bp, Homo sapiens
gtgactggcacgtattttgagcttaagaaacacttcctgggtaaaaagagcaccagagtggtgcattccaagaggtgtcctaggagctttagggtgccagtcat

SEQ ID NO: 548480 - DNA, 104 bp, Homo sapiens
acctggagagcatttaacaaatactaatgcctgggtccttcctcagaccaactgtgtctgtctctggaggagagactcaggcattttttgtttgtttgtttggt

SEQ ID NO: 548481 - DNA, 104 bp, Homo sapiens
ttcattttcacaaacctgcctgtgggtttaccacttataagcactgtgatactcagagcctggctttaggtggttgcacaggcagggatttggagggaaatgaa

SEQ ID NO: 548482 - DNA, 103 bp, Homo sapiens
ccacttggcaatgttgacatactcttagagactggggtccaggaaatggcctggctggcccagctctttcagggagtgtcagcagggcccatagaactagtgg

SEQ ID NO: 548483 - DNA, 103 bp, Homo sapiens
agcaaaagacatttccttagaattaatggctggctgggaggcagagccaagggccactggttcctcccagctggtcattaatcctcaggaaatgcctgcacct

SEQ ID NO: 548484 - DNA, 103 bp, Homo sapiens
ggggtaaatttcctaagcagtgtgtgagaggtgtacgcagaaatcctgttgacaaaatattttgtgcaagtgcctcccacacacagctttaaaatgttacccc

SEQ ID NO: 548485 - DNA, 103 bp, Homo sapiens
tcagtcctgaggcagaatttcccgtggcatctgatacacagcctggatttggagcactcactaggattagatgccatgggaatattgtgtttaggaactctga

SEQ ID NO: 548486 - DNA, 103 bp, Homo sapiens
ctgaaccctctaagccctctgcccccgcctcctgccagggtcccaccgcttgaggacttcaaggtgctggatggggtggaggatgcagagggcgaggaggaag

SEQ ID NO: 548487 - DNA, 103 bp, Homo sapiens
ggaggagggtcccatacccagccatcatgcctctggagctgaacactcagggtgcaggcactcgtgggtccccagttcctgagcagcacccggagcctcctcc

SEQ ID NO: 548488 - DNA, 103 bp, Homo sapiens
gtgtttgaagaggtaagttattaatgcagggatcatggtatctggtacactgcaagcccttgatacatgttccttgctattattcttcatcttttcctcacac

SEQ ID NO: 548489 - DNA, 103 bp, Homo sapiens
agaaaatgtcattcagcagtaaagctcctgctgtcataaacacttagctttcagggctcactgtttatggaacaggaggagtttattgccttatacattgtct

SEQ ID NO: 548490 - DNA, 103 bp, Homo sapiens
ttagaatgttgatgaaattggaatgtgtcttgggatatatggtgaatattcattcttccaagaaaaactcatctaatctccatctaataattcagcattctaa

SEQ ID NO: 548491 - DNA, 103 bp, Homo sapiens
ccctgaaaatctttctttgctggggaggcagtctgggccctgcccacgttgccctgcacatggatagagctgggtctgtctgccctgccaaggaagagcaggg

SEQ ID NO: 548492 - DNA, 103 bp, Homo sapiens
tgcttttttccaatctgctcctctaattgatacggttctggataagaataatccattaatagccacgagtatcgtattaaaggaagtagacctgccgaaagca

SEQ ID NO: 548493 - DNA, 103 bp, Homo sapiens
cacctctctgcttcacctttcttttagcaaagatgaggatttctaccttcaacatacattgttggtcttgtcttctgtttttgttaggagggacagcagtgtg

SEQ ID NO: 548494 - DNA, 103 bp, Homo sapiens
ttcttaaggctcataacatcattcattttctctgagggacagagtggtttttattaatggagcaacatctgttctttcagaagtaaatgagttccctgaagga

SEQ ID NO: 548495 - DNA, 103 bp, Homo sapiens
agagtgcattctgcaggatgagtgaaaaggcatttatgattcttgggggcagatgttctacagtagcctgtgctagttcatgtctttctgcagatcacattct

SEQ ID NO: 548496 - DNA, 103 bp, Homo sapiens
gctgggatggggtgaggcctctgaggagctgcgtgagacccactctccatcattgtggatgcacagtcaggccccttagggagccaggaccccaaaacccagc

SEQ ID NO: 548497 - DNA, 103 bp, Homo sapiens
cgtgcggcggcgggtccgctcggtccatttctgggcgctgcaagatcagcagaaacctgagaaagcgcctggaataccgagcagcgattggcccacccgggcg

SEQ ID NO: 548498 - DNA, 103 bp, Homo sapiens
tttatcaagttgtgtgggcttttatatttcttctttggcagttctatgacttcctaaaataattgctgaaaaagaaatataaaaggccattcaacttgataaa

SEQ ID NO: 548499 - DNA, 103 bp, Homo sapiens
ggctatatacaatttgacaaggccttgcctgggttcaaatcctggctctgtcactttccagctgggtgacctcaggtaagtcctttagtcactctgtatctcc

SEQ ID NO: 548500 - DNA, 103 bp, Homo sapiens
cttggtgtgcctgagaaagtgcaaagaggagtgggagaagaaaaatgccaaaaaatttttgcattccggcctcctctttctagattccataggcaacacaaag

SEQ ID NO: 548501 - DNA, 103 bp, Homo sapiens
cctccgtgacccatggcccgtgataaaggtgttggaacaatcgtgccaatatggccacaggaagcatgattgttctctccttgcgcattgcaggggctggagg

SEQ ID NO: 548502 - DNA, 103 bp, Homo sapiens
gggatggattttaagctggtttctcctatttctgtcttggccaggggtaggaatttcccttgagtaagacaggaatagaggaaaccagcttagactccaaccc

SEQ ID NO: 548503 - DNA, 103 bp, Homo sapiens
gcctgacccagaacacaattcccagagggctaggcgccgctcggagcctgcagtcctcacgcgcgcttagactcttgggagttgtagtacgaatccgtcaggc

SEQ ID NO: 548504 - DNA, 103 bp, Homo sapiens
cctgtaaaatatgtcctcacacatgcaagtgagtcattttacttgcaaattattgtttcgcatatgcaattacttgcttgcatctggatatacattttgtggg

SEQ ID NO: 548505 - DNA, 103 bp, Homo sapiens
ataagcaataggtgttacaagcagtaaaggctttgaagttttgcaccaacctaacatatagagaacctcaaagcccttactgcttccaacacctatttcttgt

SEQ ID NO: 548506 - DNA, 103 bp, Homo sapiens
ctcaccccagtgccattccacgcaggaaaccacttcagtccctggacacggtggggctctggggactgaagtgctttcctcaatggaatggtattggggtggg

SEQ ID NO: 548507 - DNA, 103 bp, Homo sapiens
agactgaggcccaaagagggtgtgcagggaagggcatgctattggcaaagcgatgaagatggtgatgcttttctgatttgtgcctccctctttgggcccatct

SEQ ID NO: 548508 - DNA, 103 bp, Homo sapiens
gcacctgctgccttctgctttaaccctttcccagtgagcctgggctcgggaccctcagggttctgggtctagagtttgaagagagggtggagttggcgggagc

SEQ ID NO: 548509 - DNA, 103 bp, Homo sapiens
tgatatatttgcctattggatttgtttaatgaaatatggatttataccataaatattggagtcgtgtagtccatatttcaattaatggatcatttatatgtca

SEQ ID NO: 548510 - DNA, 103 bp, Homo sapiens
aaagggaagttaaaacaagagtcttttcaaactagcaacacctcagtttttttctaagggaggtgctgctagtttgaaagggctcttgttttaccttaccttt

SEQ ID NO: 548511 - DNA, 103 bp, Homo sapiens
agtcaccaataccagattgctgttttcataggttttttcccccatttagtggtttatttgacggatgggggaaggagagcctgtgtgggaatttgaactgact

SEQ ID NO: 548512 - DNA, 103 bp, Homo sapiens
tgtgttttcccaccgaaggacccagctgttctttctgtttttgcttcctgtggaagccctatggttgggagcgttgggtcaataaacagctggggagagcaca

SEQ ID NO: 548513 - DNA, 103 bp, Homo sapiens
cgaccttctattcctctgggtataactctgatccgctgtgaggaatattattatattatttctggcagtgggccacagtggtacaccatttgggatgtggttg

SEQ ID NO: 548514 - DNA, 103 bp, Homo sapiens
gtgttctgctaccttccaggtggggcgggctgggaggcctcttctagaggggccctcaggctgctccaagccctggaatgcagccctggtggcctcagaacac

SEQ ID NO: 548515 - DNA, 103 bp, Homo sapiens
agcctctttcttacacgcaatgaattttgcccacaatgggctaattgccaaagcagttcgccacctgtgggagtaattagtcacgtgtcagtcttctgaggtt

SEQ ID NO: 548516 - DNA, 103 bp, Homo sapiens
tacagaggttaagtgtacagctttggggtcagacagactggtttgaatgctggctgttaatttctcagctgtgtgacttcaggcaaagtacttaatctgtgtg

SEQ ID NO: 548517 - DNA, 103 bp, Homo sapiens
ccaaaaaggcatcctttttcagtgactggatgtttactcaaataatggtaggtattgaatatttgaataaacatccggtcactgaaaaaagatgcctttttgg

SEQ ID NO: 548518 - DNA, 103 bp, Homo sapiens
ccctgccccttggcccttctgtttgttttgctttgcactgacctgaaatggataccttcacgggtccctgcagcggggcagacagtggttgggacatgtaggg

SEQ ID NO: 548519 - DNA, 103 bp, Homo sapiens
gccatgtgttagtaaagggaattttcagcattgctaatccacatagcaacaggttggccatgtggattaacaatgacggaaattaccttcatgaacacatggc

SEQ ID NO: 548520 - DNA, 103 bp, Homo sapiens
tgctatcatttccttttctcagtttggaaagaatgcaaagaattactcaaagtagataacttcatattttccacttgtggaaagaggagaacagctgatggca

SEQ ID NO: 548521 - DNA, 103 bp, Homo sapiens
ttgaggcacaaggaagttgggccacttgcccagggaagttagaagttgggagtggacgccagcactggaccctgggcaggctggctccagagtcctgcctcga

SEQ ID NO: 548522 - DNA, 103 bp, Homo sapiens
cattgatttgtgaatgagcagcttctccatgctggtgctcatgcctcagagtgctcctgggtgagcagcagctgggaaattgcttatttaaccatgattaatg

SEQ ID NO: 548523 - DNA, 103 bp, Homo sapiens
gggcattttctgaggattgatgaccagctaggaggagttgatggtccttggctgaaacttgggccattaactctagccagtcattaattgcctggaaatgtcc

SEQ ID NO: 548524 - DNA, 103 bp, Homo sapiens
ggggtaacattttaaagctgtgtgtgggaggcacttgcacaaaatattttgtcaacaggatttctgcgtacacctctcacacactgcttaggaaatttacccc

SEQ ID NO: 548525 - DNA, 103 bp, Homo sapiens
ttcctcagaaagttctaatgaaggatgataggatagggaagggatgagtgttagtattcattacttttcatttattactttttcaatagaattgactgaagaa

SEQ ID NO: 548526 - DNA, 103 bp, Homo sapiens
gagtgtgaaccttctgtaactcgcagctgtgctaacttttggaggtttcttgaaaaattctagtcagtttgggttaaagaatggtttcagtaatgtcacactc

SEQ ID NO: 548527 - DNA, 102 bp, Homo sapiens
gccaaagaagacacaggaaaggcaagagtggagtctgttcagatgggtgccacacacatggcagatgcaggactttgccttgcttttcctggtctctggggt

SEQ ID NO: 548528 - DNA, 102 bp, Homo sapiens
gggcttgtcccagttacatgaattaattctgtcttggggttctgatggcagcataaaccaaagagcccagaatcccatgatgaaattatatcgttaaagccc

SEQ ID NO: 548529 - DNA, 102 bp, Homo sapiens
ggcccagctaggatgctcccagcccagctcctacccgccgggtctttcccgtttgtcaggcaggccggcaggctgggctggtgactcatgactggctgggcc

SEQ ID NO: 548530 - DNA, 102 bp, Homo sapiens
gttcattccacatgcagattctcgggactccctccaggaaattaaattgagattcccggatttaaccccctggaaggggtcccaagaattcacgtgttgaac

SEQ ID NO: 548531 - DNA, 102 bp, Homo sapiens
tttgtgggaacatgtacctaggaaagctctgcacacttgtggacacacagttgtacatgtatgtgcacacaagtgtgtgttatccatatttcccctcacaaa

SEQ ID NO: 548532 - DNA, 102 bp, Homo sapiens
cttagtgggtcaccatgaggaaattattcccaggcagagagcccttactctctgccctgagctctctgcctggggataatttcttcaaggtgacccactaag

SEQ ID NO: 548533 - DNA, 102 bp, Homo sapiens
ttttataaccattatccttagtttctcatttcataatgagatgaaacccatcataagccattctcataacgaaatgagagactgagggtaatggtcataaaa

SEQ ID NO: 548534 - DNA, 102 bp, Homo sapiens
gtgctgctgctctgcctgaacaattccaccactgtggacgtatctttgtatcgagtgcccacgtaggatggaattgtctagataatgcagtcatactggcac

SEQ ID NO: 548535 - DNA, 102 bp, Homo sapiens
tcaggggctctggagagtcaccatctccccacctgctccctcagcttctggaagggtgcagggaggaggcgggtggaggtggttcttgcacagggtccctgg

SEQ ID NO: 548536 - DNA, 102 bp, Homo sapiens
aacatttcttctaatttgaagatttgtgcatgttgaattaatcatgtcgatttaattattaattcaacgtgcacaaattgtcaaattacaagaataaatgtt

SEQ ID NO: 548537 - DNA, 102 bp, Homo sapiens
tggtacttccgccctcaggtgattttatctaataaatctgataagtacagtagactctgatactcggatattagatgaatagctcatgctgtggggagacca

SEQ ID NO: 548538 - DNA, 102 bp, Homo sapiens
tttatttagtaaacattctttgagtctacactatgtacagatgtgctgctatgtagtagcaaagattcaggatgtgccctcaaggaatgtctgtcaagtaag

SEQ ID NO: 548539 - DNA, 102 bp, Homo sapiens
tggaatgcttacttactcctgtcaatttccatccacaactgcttgactctgaaggtgagtggtgagccctcttgggaatgttggcaggagaagatgactcca

SEQ ID NO: 548540 - DNA, 102 bp, Homo sapiens
ctcggggtgcagggcatgggggcagggagggcaggctggcctcagcctctccccggggactgggcccagccttcctgcccctgctgttcccaccaccctgag

SEQ ID NO: 548541 - DNA, 102 bp, Homo sapiens
aataggatttaattaacctggaaattgctgttgtgccgcagtcagggctaccctagagattgagtgcacagatagcaataagctggttaactctacactgtt

SEQ ID NO: 548542 - DNA, 102 bp, Homo sapiens
agaaagaatagggaagagggttgtccttgcagattcatcacttcttgaagctttccagaagtggtgatggatttgcaataagccatctgctttttttttttt

SEQ ID NO: 548543 - DNA, 102 bp, Homo sapiens
ggtaggtccgtggaggaattctaagcatccatctcttcttcacctttcagtgagggtggaaagatgaagatgtttaaggattggaggtttgcagagcctacc

SEQ ID NO: 548544 - DNA, 102 bp, Homo sapiens
gctcatctttgggcaggctcacggctgtgatggaaggaattagtcaattggttcactccctcattcctccatttagccgtgtggcctgtcagtgacctgggc

SEQ ID NO: 548545 - DNA, 102 bp, Homo sapiens
agggtagatggctgcctggagtcggggacttgcacctgcagcggcatctgcacgactcaaagcaagggcaagctctgctccgttggaggctgacgtctccct

SEQ ID NO: 548546 - DNA, 102 bp, Homo sapiens
tttagtcgaggagcctgcttatgcccagagacactctctgaagcagaagtaaagcacaggaagtgtttctttggcatatagtaggtttctctttctgctaga

SEQ ID NO: 548547 - DNA, 102 bp, Homo sapiens
ggggatcgtcatctggggaagggatccttacggtgtaatgggggtggccgtgtcaccacctatgcgctaatacgggtcccctccactcaaatgagggtctcc

SEQ ID NO: 548548 - DNA, 102 bp, Homo sapiens
tggtcctgggactacagttcccagaagaccctaggactccctcctctgctcttctaggggactcgagccccagggtctgatgggaattatagttcctatcta

SEQ ID NO: 548549 - DNA, 102 bp, Homo sapiens
gcctggggagccgggcgttctggccacccgcggtgcagcaggcaccaggccctggcagaagcaggctgggctgggggtggcaggcagccctggcccacaggc

SEQ ID NO: 548550 - DNA, 102 bp, Homo sapiens
gtgaggtcctcagaaggacagtgtgtttgttgggtgagtagaggcaggactggagacaaagttgcctaccacaaatgcgtctgtcctggctgagaccatcat

SEQ ID NO: 548551 - DNA, 102 bp, Homo sapiens
gggatgaaaaggaagggtggacgtgtcaatgaggaaccagtagcagctgcatctgctgctggttacagttattggcatccaaatacctttttatgtcatccc

SEQ ID NO: 548552 - DNA, 102 bp, Homo sapiens
cccttttattcctccttcttctgtgatattgggagtgtatagttgtcattgtgacaaaccctttgctgtcagtatctatagtggatggggagaaaaggaggg

SEQ ID NO: 548553 - DNA, 102 bp, Homo sapiens
aaaactacaaaaccaagttctcccactttaatagatgatacatttgtttgttttcccattatgtgactcatctattagagtgggagaaaggtttttggtttt

SEQ ID NO: 548554 - DNA, 102 bp, Homo sapiens
ttctgtccttgcggtaggtggttattttgttgaggttcatgagtttctttatttcttgtgggtctgttctaaacaagaaactgcacacacgcaaggacagag

SEQ ID NO: 548555 - DNA, 102 bp, Homo sapiens
ggcattcagtgattttccccaagcattgcctaggtaccggcagaccctcaattctaaccaaggtctgactggtgcttacttcagtacttttaatcacaggcc

SEQ ID NO: 548556 - DNA, 102 bp, Homo sapiens
tgttcattcagtcccaccatggtgggggaaagggacttgcctgtttgggggaacccatggtaacaggacaagcttttgccattgcagttgggactgatgaca

SEQ ID NO: 548557 - DNA, 102 bp, Homo sapiens
tcccctttcgccccatttttccatcactgtctttcttgggccacattttgatttcataatagtagttgcttgaaggcagtgggggaagtgggggaattggga

SEQ ID NO: 548558 - DNA, 102 bp, Homo sapiens
ggctaggctcgctgttgctacctctcctcgcagatgcaacgaggtaaggcttgtttgcggtgccagctgaaggtggggaggggggagcgaagcagtgtggcc

SEQ ID NO: 548559 - DNA, 102 bp, Homo sapiens
aaatcctttctaacagtgcctatattgatttcagacccagttttgttttaaaattcaaggacagaatttggtcctgtgtttagaggtccttaataaggattt

SEQ ID NO: 548560 - DNA, 102 bp, Homo sapiens
tagggactaagagtttgttgaccacatttccacttcataaacagagttatccaaccaagacttgtttagaaactagaaatgtagtcaaacacactgtccctg

SEQ ID NO: 548561 - DNA, 102 bp, Homo sapiens
ctccagtgtatcttgtgggtctagtgcattttgttttctggaagaattgcctactgatggggatgccaaacaaagtgccgacccactgagaaatagtgtgag

SEQ ID NO: 548562 - DNA, 102 bp, Homo sapiens
acagaaagcttcaagtctctgtaggcagctcacgtgtaggggctgctggggaaggtctgttgctcttgatgttgctgcccataaggagatgatgctttctgt

SEQ ID NO: 548563 - DNA, 102 bp, Homo sapiens
tttgtgatttcaaattatgttacaattctataatttgacaatttttaataattccatagttttggcaaattatagaattgcagcataatttgaattcacaaa

SEQ ID NO: 548564 - DNA, 102 bp, Homo sapiens
tgtgtgtgtatattctggtgcctcctctagcttgtagcattcttatcacaatcaaacagatgttgggctgagagttgggggaggataagaagctgccacaca

SEQ ID NO: 548565 - DNA, 102 bp, Homo sapiens
gtgattgtttgtacagatggatttacttaggatgaaggatgttcttttaatcccatttggataggttttatcctatgtatatctatctgtaacattatttgc

SEQ ID NO: 548566 - DNA, 102 bp, Homo sapiens
ggaatatgagtgagtgtggagggaggaggggaaatgaaaggatattatatatttttttgtatctgtcatttccctgctatctcccatatgacttcttaatcc

SEQ ID NO: 548567 - DNA, 102 bp, Homo sapiens
ctctgggggaatgtggtcccccttttactgcctttttcagcccactccccccagttgaatttttctgagaggcagtggaagggaaagtatatacccccatag

SEQ ID NO: 548568 - DNA, 102 bp, Homo sapiens
ccctagagcacagtaaggattaaacattaaactgcagatattcgtcattgagattagcgttattaccatggtttaatatttaattctcactgttctctaggg

SEQ ID NO: 548569 - DNA, 102 bp, Homo sapiens
cctgggagggctggtgctttgtggggtctcctgctagagacaccagaggcagggtagggcagagaaagcagagactccagaaacagtatcagtcttccaagg

SEQ ID NO: 548570 - DNA, 102 bp, Homo sapiens
gttcaacacgtgaattcttgggaccccttccagggggttaaatccgggaatctcaatttaatttcctggagggagtcccgagaatctgcatgtggaatgaac

SEQ ID NO: 548571 - DNA, 102 bp, Homo sapiens
ttgctttaacaaatatattgtttcttcagttttgattcttgaggatacgattcaattcactggtgaatcaaaactgagagaataacatatttgttaaggtaa

SEQ ID NO: 548572 - DNA, 102 bp, Homo sapiens
gaagatagaaagcaagtgtgcttactttacgggatcatagacttcaagatagaaaaaggaatcagtgatcctataaagtgagcacacctgctttctaccttc

SEQ ID NO: 548573 - DNA, 102 bp, Homo sapiens
catgccataattcagtctctgtgtcctgttgttgttcataaaccaacaagctttggtggtttatgtcatcagcagaaaacctgaaagtgaattatagccttg

SEQ ID NO: 548574 - DNA, 102 bp, Homo sapiens
ttgtgccagttctgggcttcttttgcataatcatttatctgaaaggacaagaaataatttgcaatttcagagtgtgatgcaaaagagacagatattgctcaa

SEQ ID NO: 548575 - DNA, 102 bp, Homo sapiens
gggcatgggctgctggggtggcccaccttccccggtgtacatactgtgtctgtgtaacattttgtatattccagagggtagggctgcccctgtatcatacct

SEQ ID NO: 548576 - DNA, 102 bp, Homo sapiens
cccaagtcaggtactcgaatggaggttgtccatggtgtgttcattttatttatgatgagtattacatggccaatctcctttcggtactcaattcttcttggg

SEQ ID NO: 548577 - DNA, 101 bp, Homo sapiens
aacacaggaagaaggggatttgagaaaaagtggaaagaagggacatcacacaaaggtccctttatattgcattctttcttctttctctttcttcaattgtt

SEQ ID NO: 548578 - DNA, 101 bp, Homo sapiens
ggggagctccaagcaggtgggcaggacccaggggcctggtgaccaggacagacccccactgtccatcacctttcctggccctgtcctcagctaaacttccc

SEQ ID NO: 548579 - DNA, 101 bp, Homo sapiens
gcagcaagaattgatatgggtaccacctcactgaattccacattcaatgttgatgcctcagtagggtggtatgccagatctggtactgctttctttgctgc

SEQ ID NO: 548580 - DNA, 101 bp, Homo sapiens
aaaacaaaaagtattcccttggcccctggattcttagaactcttagcagaccagaaaggagggtctgggagacagatggggttgaggggaaacttgagagt

SEQ ID NO: 548581 - DNA, 101 bp, Homo sapiens
ctgtgcaccacccatctgggggtggaggggagggtctaagtctggattcctaacctagaaacctctcactctcctcctcccactgccagacaggtgaccag

SEQ ID NO: 548582 - DNA, 101 bp, Homo sapiens
atccaggaattgacaagtcatactgaaacaaattaaagcctctttaaaatttgaatatagaggctttcctttgtgttattgtgactttccaattcttggat

SEQ ID NO: 548583 - DNA, 101 bp, Homo sapiens
tggattcaagagatcaccatcatcagactggctcagtttctcagtgcctcaattgcagatgcctgagaaagagggtttgatggtctttggtctggagtcca

SEQ ID NO: 548584 - DNA, 101 bp, Homo sapiens
ctggcttcatctgataagggtttatttttgatccagacctccttggaatgtttatcttagggggaagttggggaggaatgagctcagtagaattgggccag

SEQ ID NO: 548585 - DNA, 101 bp, Homo sapiens
gcattttcaaggaaaacaggaggccagcacaaaggcagtgctaattacctctaattacccagaagaggaaagcactgttttttgtgatgtactcctaatgt

SEQ ID NO: 548586 - DNA, 101 bp, Homo sapiens
tggaaagactgcccaggtttgaatttcaatgcttcctcttatgaatggtattaagctcacaagaggaagaactgaaattcaaaccagagcagtcttgacca

SEQ ID NO: 548587 - DNA, 101 bp, Homo sapiens
gcagtgtccctggggcagacatagagggtggtgaggctcccctcctgcctactggcccagcttcatttccctcttggcttctataccccagtgacttctgt

SEQ ID NO: 548588 - DNA, 101 bp, Homo sapiens
gagtggcattgtgagaatgagtaagaggaaatatcacttagtattaacagatgataataagtagtgtttcctactaattgattatttaccatatgctagtc

SEQ ID NO: 548589 - DNA, 101 bp, Homo sapiens
aaggtaaggtaaaacaagagccctttcaaactagcagcacctcccttagaaaaaaactgaggtgttgctagtttgaaaagactcttgttttaacttccctt

SEQ ID NO: 548590 - DNA, 101 bp, Homo sapiens
gcctgcaggtgccctccacagggcacacaggtgcaccccgccccgacgtagaagcccaggtgcacctgtgtgctaaggtcagggggtgcatgcctgctggc

SEQ ID NO: 548591 - DNA, 101 bp, Homo sapiens
ccccagccagagccccgcccgccacattcctgcctccccggagatggccgtggccagggccgtcgccagggggccgggaatgcagcgctcaatggcttggg

SEQ ID NO: 548592 - DNA, 101 bp, Homo sapiens
acgcttcccctggctcccttcgttcccccccaccccacttggcctgcgtgctggagggtgtgcgagggagtgggaggacgtcggggggtggggggaggcgt

SEQ ID NO: 548593 - DNA, 101 bp, Homo sapiens
gaggccctgccaatatccgcacatcactggcatgatagaccataacagcttcttctgagctgttccggtctatcgtgtcaatgcgtactcggggagtcctc

SEQ ID NO: 548594 - DNA, 101 bp, Homo sapiens
gaaatatttgctagggaagctggggtcgggggacactggggcaagaggaaaactcgttccttgctccagtgtcttgctacggaagcttctgcaagttcttc

SEQ ID NO: 548595 - DNA, 101 bp, Homo sapiens
gcccctgttttgtccccttcccatctccctgggaatgatgaccttgcctttgtcaggagggaggcgtcactcccagttgcttgggctggggtatctggggc

SEQ ID NO: 548596 - DNA, 101 bp, Homo sapiens
gctgtttggagctctgcggtgggtggaacatgtttcatgctggggtgacggggcattttcagcaaagcgtgtctccccactttgtgttgagttcctacggc

SEQ ID NO: 548597 - DNA, 101 bp, Homo sapiens
tccatgggtcagctatgtggactctagctgccaaaggcgcttctccttctgaacagagcgctttgctcagccagtgtagacatggcctgataaacaatgga

SEQ ID NO: 548598 - DNA, 101 bp, Homo sapiens
ggcgcatctcctctccacctcctgttgccaagacaacctgccggcagctcaggcccggctcagccgcggcagcagggagggggggaggaggaagctgtgcc

SEQ ID NO: 548599 - DNA, 101 bp, Homo sapiens
ggcgtgtctccgccccgccccctccaccgggctgaccggcctgggattcctgccttctaggcctaggcccggtgagagactccacacagcggagaactgcc

SEQ ID NO: 548600 - DNA, 101 bp, Homo sapiens
atgtggagaagctagataatgatgaagatgacagtgaggtgcccagcctgctcctgggactgacaggagcttttgaggatacttcatttgcttctctatgt

SEQ ID NO: 548601 - DNA, 101 bp, Homo sapiens
ttgtgaggctgggggaggatgttgggggctgtgaccagccacaggggtcccatgcagcctccggtgctgggcacccccagggttcctccctcaccccagga

SEQ ID NO: 548602 - DNA, 101 bp, Homo sapiens
caagtttttggtctaattccagctgaggatttaatgggactcattctgacaagatataggatattgtcccaatagatgctcatttggaaatgggccacttg

SEQ ID NO: 548603 - DNA, 101 bp, Homo sapiens
gcacttcccgcccgcgcacctggtggtctacggctggtctgttggcggcttcacggccacctgggccaccatgacctacccggagctgggtgcactggtgc

SEQ ID NO: 548604 - DNA, 101 bp, Homo sapiens
tctgattgatgggccatcagttgcacagttgttgggcagtgattgattttccaacccagctgctccagctgtgctgcagatgcgccttgtctgaagtcaga

SEQ ID NO: 548605 - DNA, 101 bp, Homo sapiens
agcggtgggtgtggcccttgggtgcagagtgggcagctggttccagagattttgcagccccgctggttgatcacctgtaccctataaaaatgtctaccgct

SEQ ID NO: 548606 - DNA, 101 bp, Homo sapiens
gcccggtacttgctgaaggggatgggggttctggatccaggtgcacccctctcaggatgcccctgatgggcctcgggactctcagccctcaagtatggggt

SEQ ID NO: 548607 - DNA, 101 bp, Homo sapiens
taggctgtaacatatgcagtatgaactcatgcgtttgagttgagttaattatatgagttaacacaagtgtatgagctcatactatacatgtaaaatgctta

SEQ ID NO: 548608 - DNA, 101 bp, Homo sapiens
aaagacaaagtcatatctgaatctatttaattcaacctctatatataaccagatctaactagaggttgaattagatagattcaggtatgttctttttcttt

SEQ ID NO: 548609 - DNA, 101 bp, Homo sapiens
cctcacttgacagaggaaactgaagtccagaaaggggacgggattagaatgtccaacagaagtacctttcaggcctcagtttcctcctttgtcacatgagg

SEQ ID NO: 548610 - DNA, 101 bp, Homo sapiens
tcccttccttactggtgtgtgcacatgtgtatgcatgcatgcatgtgtaatagcacatgcatttatgtgtgtacattgcatgtgtggtgtggtggagggca

SEQ ID NO: 548611 - DNA, 101 bp, Homo sapiens
cttgcttcctgccccttcccgcactcagcagcccttcgcaggaacttggggcacttccccatgcccgaggggctgctgggcagctcccaggcaggggcaag

SEQ ID NO: 548612 - DNA, 101 bp, Homo sapiens
gagtggcatagtgagaatgagtaagaggaaatatcacttagtattaacagatgataataagtagtgtttcctactaattgattatttaccatatgctagtc

SEQ ID NO: 548613 - DNA, 101 bp, Homo sapiens
tcaagactatttattctacggtttcaagatctgtccagaccattaaccacaatggcattaaaatggtctggacagacctggaacccctgtagtattcttga

SEQ ID NO: 548614 - DNA, 101 bp, Homo sapiens
tgccattttgaaaacagaaaaatgcggcctatgaatagagctatcattttaaggcagaatactccattcgtgggctgcattttccttttttcaaaatggta

SEQ ID NO: 548615 - DNA, 101 bp, Homo sapiens
ccactgcatgaagagagttaaaagtgggccatgcttggcttagcagagtccttttgcaaaagaggtgtgctatgccactaagcatgagccccttgcagagg

SEQ ID NO: 548616 - DNA, 101 bp, Homo sapiens
gagcacaaacctgagccaggcactgcaggcatcctgagcaggagttgggtccccaaggcggctgtgcgggggctctgtgatgcctggggaaggttctgctt

SEQ ID NO: 548617 - DNA, 101 bp, Homo sapiens
cttggctgccaggaccctagaccaacctgtgttaggctcagccaagggccactcaaaccttgagcctaagcacaggttggtcttgtgtcctggcagccaag

SEQ ID NO: 548618 - DNA, 101 bp, Homo sapiens
ccccggcccgcccgccggggagtgggagggcgatggcgccccgcctccggctcttacggagagcgcgcctccccctcaactccggcggcggggagccgggg

SEQ ID NO: 548619 - DNA, 101 bp, Homo sapiens
ttgcaggcttccatccagcttaacgttattgtaccagggctgacagcctgctgggtgcaaagccctgttttggatacggaggagctggggaagctctgcag

SEQ ID NO: 548620 - DNA, 101 bp, Homo sapiens
tttaaggatatatcgtattcaggattttttagttctgagttggctctcttaaagtagattacaatcacactagaaaatcctggataagatatatccttgga

SEQ ID NO: 548621 - DNA, 101 bp, Homo sapiens
gccctaactcatctttcaagtttgaaatttaaatgtatgtttctttgttctgagtgactgaaacatacacatgaagacaactttggtggatgcaggtgggc

SEQ ID NO: 548622 - DNA, 101 bp, Homo sapiens
ggtccctgcactgtagaagcatgatccagtgggctctcctgaatggacttggtccaaaaagctgaagggaggggccactggatggtgttatgcagggaacc

SEQ ID NO: 548623 - DNA, 101 bp, Homo sapiens
ctactctactttttctccaaactcctctccactcttgtttagatggtcttttttctattctggataggggtggagtagaaggaaaaaaatgttcccagtag

SEQ ID NO: 548624 - DNA, 101 bp, Homo sapiens
ctaactcccaagaggacatgcttatggcctgcactgactagggcagattttcaaaccagtcctagctctagcaaggctggcctggggttctgtggggttgg

SEQ ID NO: 548625 - DNA, 101 bp, Homo sapiens
ccttccttttctctgccttccttcccagcactgctaagcaaagctgtcactccctgtgtcttgcttagcagtgctaggaaggaaaggaggaaaaggactgg

SEQ ID NO: 548626 - DNA, 101 bp, Homo sapiens
gtaacacacgggggcgccaggacgtgcgcggacgcgggcaaggcagcacaaggtggttttcgtccgtgtgagtgtgtccgtgggcgtctttgtgtgtctgc

SEQ ID NO: 548627 - DNA, 101 bp, Homo sapiens
accaggacccaagaaaactattctctttagtatctctgtgtcttctataattgatggccatgtattatagagaataggagttctacaaggctgtccatggt

SEQ ID NO: 548628 - DNA, 101 bp, Homo sapiens
ggggctgggatgcaaacacaggtgtctttctgactccaaagtgatgttattagctttttaacatataattagaaagatatttggtctttgctcctggttcc

SEQ ID NO: 548629 - DNA, 101 bp, Homo sapiens
tgcacgtatctacttttaaagtggttgtaatttgtgttcagagtaagaggactatcttttctagactccaaattgcagacttttaagtataaattcgtgca

SEQ ID NO: 548630 - DNA, 101 bp, Homo sapiens
tcttcctcagtctggcattttctagattctaggatagttgcttgatatctgaagttgggcaatttgttttagacacagtagaattccagaaagagatgaga

SEQ ID NO: 548631 - DNA, 101 bp, Homo sapiens
gagaggagcccagcactgggattccgaggtgtttccattcagtgatctgcactgaacacagaggactcgccatggagtttgggctgagctgggttttcctt

SEQ ID NO: 548632 - DNA, 101 bp, Homo sapiens
aggtaagagccatccatcacacgcctcccgttcccccacccagagaaattaaagctgtgctggggggtggggggatgtgtttgttttttaatgttttgcct

SEQ ID NO: 548633 - DNA, 101 bp, Homo sapiens
ccgttcctgctgtggagaaggaggcgaagtcagagagctcttccaagctttccccaggaagagctctctggctttgccttaaagctccccagaggttttgg

SEQ ID NO: 548634 - DNA, 101 bp, Homo sapiens
gggaagaggacataagctgggggcagaggaaactggggtcaacaggatattcaaagccggccactcccccgccccctctgcttccgctcccccctccaccc

SEQ ID NO: 548635 - DNA, 101 bp, Homo sapiens
gcgagaagatctcatgctgtgactctctggagggaagcactttctgttgtctgaaagaaaacaaagcgcttctctttagagtgttacggtttgagaaaagc

SEQ ID NO: 548636 - DNA, 100 bp, Homo sapiens
tttgactgccatcatgattcaggcctcagtgtcatggactctagcgaccggtcactggaggttatgaccaactgaggcctgattgacgatggccgtcaaa

SEQ ID NO: 548637 - DNA, 100 bp, Homo sapiens
gccacagtttctaaattgagtgtctagcatttataatcaactgcttcatttaattcaggtcgattttaaatgctagccattcatttggtggactgtgagc

SEQ ID NO: 548638 - DNA, 100 bp, Homo sapiens
cgtggcagcagcttactatggcccaggctgatgtagactggcagcttctccccatcactggtagctggtatgcaggcagcctgcctcggctgttgccatg

SEQ ID NO: 548639 - DNA, 100 bp, Homo sapiens
gacttccctttctttctccattctcttcctcacactgcagtgtctcaaagggtgaaaatgtctgtgtgtgggagagggtggtggtggtagggcagtggtc

SEQ ID NO: 548640 - DNA, 100 bp, Homo sapiens
ggctctgccttggaggatgctccggaaggaccacataagcagtgccctcgtttggattggtcctgcctgagcattgtccccaagcagggcagtttcagcc

SEQ ID NO: 548641 - DNA, 100 bp, Homo sapiens
ccagagaaaggaaggagggggctgaattcgcaggcccaaggtgttcacacttgtccagacctgggccttgagaatcatgtttcttccctcttcactctgg

SEQ ID NO: 548642 - DNA, 100 bp, Homo sapiens
ccactccctgacctgtgtccccctttaccacctcgtaggttcatggcctctttcttcagaggcatggggtggggaggtatggtgagcaggttagggaggg

SEQ ID NO: 548643 - DNA, 100 bp, Homo sapiens
tacatatggaaattcgacagatgtacagaaatgctacacaggacgggatgtttctttatggcatttccttgtgcatctcattggagaaaagaaatgtgta

SEQ ID NO: 548644 - DNA, 100 bp, Homo sapiens
taccttcaatgtcagaaatgatttttctgacgatgtctaaatgtggtagattacacgttattccaaattatcagaaaaatcatctctgacatttaaggta

SEQ ID NO: 548645 - DNA, 100 bp, Homo sapiens
gtgattgccgggccaatcaaagctttcttttgtttctcttccccttccccttggagccaagaaggacacaaggatggctcggtggccttgggcaaatgac

SEQ ID NO: 548646 - DNA, 100 bp, Homo sapiens
agggacagtgtgtttgactacatttctagtttctaaacaagtcttggttggataactctgtttatgaagtggaaatgtggtcaacaaactcttagtccct

SEQ ID NO: 548647 - DNA, 100 bp, Homo sapiens
ggagcccagctgctgctgagctgctccttcccttcccagtgagctccaggcagatgtggggcacacgggatgggcagggagacggcaggcaagctgctcc

SEQ ID NO: 548648 - DNA, 100 bp, Homo sapiens
cttaataaataaattacacagccaatgtattatacataatttgtgtcctcgtggatttgagtgatatataatgcatggtccaagtcatttatttattaag

SEQ ID NO: 548649 - DNA, 100 bp, Homo sapiens
atgcttcccctggctcccttcgttccccccaccccacttggcctgcatgcgggagtgtgtgcgagggagtgggaggacgtcggggggtgagggaaggcat

SEQ ID NO: 548650 - DNA, 100 bp, Homo sapiens
gctgagaaaaaaagagttgcaataagagttgaggttgaactgggtcagagcaaggacactgcctggttcatatccatctttgtgctaggtcttttccagc

SEQ ID NO: 548651 - DNA, 100 bp, Homo sapiens
agggcgtgcacgtgggcgtgtgctgagattgcgttccttacacacacagagtctgtgtgtgtacgagtacatcctcatcatagccttggtggcatgccct

SEQ ID NO: 548652 - DNA, 100 bp, Homo sapiens
ctaggcctgtgggagggcggcgctgtgggtcctgcctgccgtcagttttctctctcctgggggtcagggagacttggagctctgtcccttcttggcttag

SEQ ID NO: 548653 - DNA, 100 bp, Homo sapiens
gaggagttaagagttcattcggctgtccagatgtatccaagtaccctgtgttatttggcaataaatacatctgggcaactgactgaacttttcacttttc

SEQ ID NO: 548654 - DNA, 100 bp, Homo sapiens
gtatggtgcactgcagcctggtccctgtcctcctggacctctgaacaggatgcaagaggagcaggagcgtggaccaacgctgccctacctgctcccatgc

SEQ ID NO: 548655 - DNA, 100 bp, Homo sapiens
ccaaagaaagatgctaaactatttttgcgatgtgttcctaatatgtaatataaatgtattggggacattttgcattcatagttttgtatcaataatatgg

SEQ ID NO: 548656 - DNA, 100 bp, Homo sapiens
aacctcagccctagcctttggaggcctccagctggactgtaggaggagcccaaggcagctggagttctccaaaggacttgaggggctctggacagaggtt

SEQ ID NO: 548657 - DNA, 100 bp, Homo sapiens
tcattccaacagctgctaaagatctggtgagccggttgctggtggtagaccccaaaaagcgctacacagctcatcaggttcttcagcacccctggatcga

SEQ ID NO: 548658 - DNA, 100 bp, Homo sapiens
ccatacttacattttacccggcagtcaatattttcacttggattctgtggaccaagcatccaagtgaaaatgttgactgccaggtagattgcaagtgtgg

SEQ ID NO: 548659 - DNA, 100 bp, Homo sapiens
gtgaggtaaggaagaagacatttcagaatttcttttttcttcactcttgattcatcaagtacaggcctgagagattctgaagaacttcatcaaacctgac

SEQ ID NO: 548660 - DNA, 100 bp, Homo sapiens
tgccacctcagatggtctatgcctggttattcctcaggctaagagggagaaagctgttgcactgaggaagtactgaaggctgactaggaagagggaggca

SEQ ID NO: 548661 - DNA, 100 bp, Homo sapiens
tttgactgccatcatgattcaggcctcagtgtcatggactctagcgaccggtcactggaggttatgaccagctgaggcctgattgaaaatggcagtcaaa

SEQ ID NO: 548662 - DNA, 100 bp, Homo sapiens
gctcacagtccaccaaatgaatggctagcatttaaaatcgacctgaattaaatgaagcagttgattataaatgctagacactcaatttagaaactgtggc

SEQ ID NO: 548663 - DNA, 100 bp, Homo sapiens
tggtttcaggtgaattggatatgaactgtaaaatctgatttcttgtcttcagacagttagtcatgttttattgtaaatgtccttgatctctttaaagcca

SEQ ID NO: 548664 - DNA, 100 bp, Homo sapiens
tagaagaaatcatgtggttaggaagactgataacatatatggagacttggaatggcctactgtatatgcagtgagtctttctatcatgtggcttctactg

SEQ ID NO: 548665 - DNA, 100 bp, Homo sapiens
gtctttagaacagtgcctggcatatagtaggtgctctgtgtttgataaatttattcaacatttattgagcacctactggatgccagatgcggttcttagc

SEQ ID NO: 548666 - DNA, 100 bp, Homo sapiens
gtgccttgtgtgtgagtatgggctgggagatcactctggtggtgctgggcttaagggacaccagtgtgattttctggccagtagttcttaaggaaggcat

SEQ ID NO: 548667 - DNA, 100 bp, Homo sapiens
ggcagttctcgggagtgcttctgcgtgtgtgatatgcctctgcacacatgtcttgtgcatgtgggagtgtcacatgctgcacgaggctcacctgtctgcc

SEQ ID NO: 548668 - DNA, 100 bp, Homo sapiens
gtgataggatcatcaagcagtgataggagggtaggaggcaaacccggacatgaactcaatgcctcctaccctcccatcaccgctgctctcctcttgtcac

SEQ ID NO: 548669 - DNA, 100 bp, Homo sapiens
gatgcataactgtgggttagtgaatttgaggcgtgggggtggtgtggggaaccgatatctccagacatcccagcttctatttattggggtcagaagcatc

SEQ ID NO: 548670 - DNA, 100 bp, Homo sapiens
ggacaggtgcgccagagaggtgggggcgatggggttaacactgccacaaaaggaaaagctccagctcactcccctctcttccagctcatcctaacagtcc

SEQ ID NO: 548671 - DNA, 100 bp, Homo sapiens
gagactctaaaaacatgtggctgtaaaggcaacaagaaagagtcaaaactttctccctcctgtttttgttgcctttctggccgcatgttatcagagtctc

SEQ ID NO: 548672 - DNA, 100 bp, Homo sapiens
agctatcaggtctcatgggtacataggattttgcacttagtccagggggacagataagctctggttttagtgcagaatctctgggcccattattgaagct

SEQ ID NO: 548673 - DNA, 100 bp, Homo sapiens
gaaggtagttcagtttctccagattaccacagaagacagctctgtggatcctcctcagatgagatgatttaatgtggtattggggaaatgagaagccgtc

SEQ ID NO: 548674 - DNA, 100 bp, Homo sapiens
ttctagttatgtaactagatctgtgataccatcaataccaagagatggcatcacaaaagatggattgatgctttcacagatccagttacataactatgga

SEQ ID NO: 548675 - DNA, 100 bp, Homo sapiens
ccctaccccaaccacacatggatatgcacatgtacacatgcatgtaggctcacacacccatgtatgcatgtgcacgtgcatgtgggcacatgcgggaggg

SEQ ID NO: 548676 - DNA, 100 bp, Homo sapiens
aatactgggccagattagctcgccatgtgtctccctgtgtgcacagaactttcactgacttcaacgggtggaatgtggtgggagaatctggctcattatt

SEQ ID NO: 548677 - DNA, 100 bp, Homo sapiens
tatctcacagggaattgatgtgggtgaggcattttatttgttgcatttgtggatgcagggacaaattagagcctcccattttatcaccttaatggagata

SEQ ID NO: 548678 - DNA, 100 bp, Homo sapiens
gatgtcctgatgtcacatttgccttgcctttagtgcctctgaggacagatggagaactgggtcaggggagggcagaaaggaggaaagcattgggaaaatc

SEQ ID NO: 548679 - DNA, 100 bp, Homo sapiens
ggtgggcaggcagcgcgtgggtctgtctctggcagggcagagggcggcaggagcagactttctccaggctcaagacacaggcccagcgccgctacccgcc

SEQ ID NO: 548680 - DNA, 100 bp, Homo sapiens
ggcaaatattaggaaagtaacttctctgtttcggccatgtgtgaggggctgtgagtacacacatggccaaaacagagaagatactctcctaatgtttgct

SEQ ID NO: 548681 - DNA, 100 bp, Homo sapiens
agagaaacttgggagcttttagtgttcctttttcctgattaaatgcagatcacataagggctcttaatgggagaaagggagtacagctcccagtacatct

SEQ ID NO: 548682 - DNA, 99 bp, Homo sapiens
gctgtcctgtgaaatacaaatctctcacccatggcctgaatatgtttgcaaactaagcagatcatgggaaggagaatgtgttggcgtcgctgggatggt

SEQ ID NO: 548683 - DNA, 99 bp, Homo sapiens
cctgccctcagagccctaccaccagtgttgggcattggggctaggctggagctgggctctgagcccagagctggtggtggtttccaggcctgtgggagg

SEQ ID NO: 548684 - DNA, 99 bp, Homo sapiens
ggcattcaaaagaagcagcttaggaggtgaaggtcagtgttctggtggcctcctgacttactggctttgcagcttgtctagtctgcttcttgcattgcc

SEQ ID NO: 548685 - DNA, 99 bp, Homo sapiens
ggtgaacatcaagatctattgacctgagaggtaaatattgaccgaggtgaagtcaaggtcaatatttgcctcaaagaataggaaatcttaatgctcacc

SEQ ID NO: 548686 - DNA, 99 bp, Homo sapiens
ggcggggaggggcaggtgtgtggggagggcctggggagcgcctccccagccgggcagcgcttccccagccaggccccgcagctggaccccggctccgtc

SEQ ID NO: 548687 - DNA, 99 bp, Homo sapiens
ctgcggaagaggtgagtgcagcgggaaccgggagggagcgggcaggcggccgggccaccccgcgacccctctgggacccgcggcactgcaactccgcag

SEQ ID NO: 548688 - DNA, 99 bp, Homo sapiens
ggtccttaaacactgaaagagctgaaagggcaaaagactgaagactgaacatcctgctgtagcagtcttttgcccttccagctctttaggtgtgtcacc

SEQ ID NO: 548689 - DNA, 99 bp, Homo sapiens
gatgatcttgggcttccaggcatactcctgggtggaccagatagttcccactttgctgtctgagtccactaggatttggcactggagacttaactcatc

SEQ ID NO: 548690 - DNA, 99 bp, Homo sapiens
ggagggctgaatttgcctggtgaaggataacagcattgagtcgtgaggctttagttgacttatttgttgttataataaaccattattcattcattctcc

SEQ ID NO: 548691 - DNA, 99 bp, Homo sapiens
ctcccctggtggtagggggctgggaaatggagatagggtgcatagtttgaaaattaaaaagcctcctatttcagattctcacagatttctactggggag

SEQ ID NO: 548692 - DNA, 99 bp, Homo sapiens
cattctttgcagccagtattcatttctgcttgttctgaaatctatcccatcacttaggatttggaaactagcagacatgaagattggctacaaagaatg

SEQ ID NO: 548693 - DNA, 99 bp, Homo sapiens
gttcttattgttgttgtcattagctgtttaagcgtatgcatatgacttatcacatctaagatgcttgaatagttttggatagcatatattcataagaac

SEQ ID NO: 548694 - DNA, 99 bp, Homo sapiens
ggaatgcaatagctagaattgtttttctctgacctgaagttcaaccaactccttcctgctttggtccagagagacagctagttgtgaattatgcattcc

SEQ ID NO: 548695 - DNA, 99 bp, Homo sapiens
gttgtactggggcttcagggaggtggaggggagcaggatttggaaatgtatgaaaacaactaagtccctgtccctgaccttgagaggttcccagactac

SEQ ID NO: 548696 - DNA, 99 bp, Homo sapiens
ttagagtcaatgggtggtagtggaggaagcatggaatttggagtctgaaaggcctgggttcgaatccctgcttcttcactgctagcccaaggagtttgg

SEQ ID NO: 548697 - DNA, 99 bp, Homo sapiens
tccctcagcctggctgccaagcttcccgggcagctgggcagatttagccactctctccccagctgtctgtgaacgctggcagccagttcaagtgacgga

SEQ ID NO: 548698 - DNA, 99 bp, Homo sapiens
agctgtgtctgcagaagaggccagaagaggagggtgagggtgggatacagctcagccgtactctttgaggcttctggcctctgttttcaggcatggact

SEQ ID NO: 548699 - DNA, 99 bp, Homo sapiens
ccagccctgccacatctttaacagaaagttcttctcctgctaatccttctgaatccaaagggattagcagaagaggaactgtcagggtggctgggctgg

SEQ ID NO: 548700 - DNA, 99 bp, Homo sapiens
aaaagagtgtaattccatcttggggcttctggtgagttgagcttgtggttctgtggtttatgatgtcaccagaacccctggatggaattacagcctttt

SEQ ID NO: 548701 - DNA, 99 bp, Homo sapiens
gctccccaaagtaatgtagctgtttatgcactcctgcctctgaattccttttaactggggcctgaggagaagtgcataagcaacattacttcagcaagc

SEQ ID NO: 548702 - DNA, 99 bp, Homo sapiens
gagtttgaggaaggaacagcaggtctttcttcagagcttggactcaaagaacttcagtttaagccctgaagaaagagctgctgctccttcctcaaactc

SEQ ID NO: 548703 - DNA, 99 bp, Homo sapiens
gcttgctgaagtaatgttgcttatgcacttctcctcaggccccagttaaaaggaattcagaggcaggagtgcataaacagctacattactttggggagc

SEQ ID NO: 548704 - DNA, 99 bp, Homo sapiens
ttgctgggagcaacctttggtccttccattggtcctagggctgatctaggctgctagatcagggcatgggaaggacccaaggttggtactcctcaggaa

SEQ ID NO: 548705 - DNA, 99 bp, Homo sapiens
ggagaagagatggtaatttatgttgcatgtttagtgacacaatccagacacaggtgggattgtatcactaaacatgtgacataatcaccctattactcc

SEQ ID NO: 548706 - DNA, 99 bp, Homo sapiens
tgttcccaggtcaggccctgtgctgtgtcctggggtaaaagggatgagtaagaaccagccccagagtacagcatagtactctatgggagcctggggata

SEQ ID NO: 548707 - DNA, 99 bp, Homo sapiens
gtgtgtgttgtcccagagtagcaggatctggcagaaggaaatttccttctaaccctcaaacaattcacataaatcttgttacatttgggattttaccat

SEQ ID NO: 548708 - DNA, 99 bp, Homo sapiens
ccaagaagttaaataacttgcttaagatcacagagctaatgagtggcagaacaattattctagctctgattttaagggatttacttaacttttacttgg

SEQ ID NO: 548709 - DNA, 99 bp, Homo sapiens
tctactttgccctggtcctgtctgccattagcccagtccaggccatcagcttctcttccctggactaggccagtggcaaacaggactggaagaaaggga

SEQ ID NO: 548710 - DNA, 99 bp, Homo sapiens
aggtcatctttctgaaatccctactttttgtccacttctgattagttaattctcaggcctgtttgcagaaggtgggtgtttcagcgagtctattgattt

SEQ ID NO: 548711 - DNA, 99 bp, Homo sapiens
tttctggaatcctgaagcttaatttttgctacaggctatcctctcttaaaaggaacttggaaagaaaataagcagaaattggctctcacattccagaaa

SEQ ID NO: 548712 - DNA, 99 bp, Homo sapiens
gcaagcaatttgtgcggtgtttcccatctatcttctaccttgaaaaggtgattagcactttggtggggagaggggagggaatgtctcacaaattgcttc

SEQ ID NO: 548713 - DNA, 99 bp, Homo sapiens
gtcacttagctaggaattgatggagatgggtttcacactccttcagggaaactcctgaagctaagctttgagacccgcttcatcttctagcttagagat

SEQ ID NO: 548714 - DNA, 99 bp, Homo sapiens
agatcctttgttcagctctagaatctgtgcaaaaatccctctgtgtggtactcacagggatttttgcacaaagagattctagagctagacaaagaatct

SEQ ID NO: 548715 - DNA, 99 bp, Homo sapiens
attctgagccttgcagattacatgataattatacttaagggctgccaaggaacttcaggaataattatcatatgatttgcaggttttcaagctcatgat

SEQ ID NO: 548716 - DNA, 99 bp, Homo sapiens
accttataccaaggctttgacagtgtctatcttattggttatggtatccatggctcctaggatggtgcctggcactgagtgttggtgtctatgaatggt

SEQ ID NO: 548717 - DNA, 99 bp, Homo sapiens
ggcacatgagtgcagtctgacaccttactcccaggtgttcgtgccccatgcctcccatgagtcatctgtggacacaggtgtcctgcacactcatgtgct

SEQ ID NO: 548718 - DNA, 99 bp, Homo sapiens
tttctttgttctccagataagtgaactgagatacagagttattaagcaagttctttaatagctttgtacctcagttcccttatctgtagaacaaaggaa

SEQ ID NO: 548719 - DNA, 99 bp, Homo sapiens
agctgtgcgtctctgtctacccagggcaggcaggccagcggctgggcgtcattggagcagcagtccctgccctgtgccctgggatcagcctgcaaagct

SEQ ID NO: 548720 - DNA, 99 bp, Homo sapiens
gctaactgcactaaccaggagagctggctggttggggagaagacactaaccctgtgagtctgacctcagccagctaacctgccctggggtgccaccagc

SEQ ID NO: 548721 - DNA, 99 bp, Homo sapiens
aggagctcagggcctttttcttaccctccttaccagcagttttcttgtttagtgttttgtgggttggggaaggaggagattagggctgacttagctctt

SEQ ID NO: 548722 - DNA, 99 bp, Homo sapiens
cattaacaaaagcaccaaaaggaatgttttccagacctagatggtttgagaagcatctaggtttggaagatagagtccttcctttagctgtagttgatg

SEQ ID NO: 548723 - DNA, 99 bp, Homo sapiens
caggggctggcacacagtaggtgcctactaaacagtagctcgcctttatgcatccagtaagcaggtgtttagtgagcacctgctgcatgccaggccctg

SEQ ID NO: 548724 - DNA, 99 bp, Homo sapiens
ggggccaggccaggcaaagggcagggggcctggctgggaaaggggcctgaggctcctcctcctctgctaagccgcctgcatagccgtggccaccgcctc

SEQ ID NO: 548725 - DNA, 99 bp, Homo sapiens
ggctagggcttccagggattccagggagttaggctctgtggcaggggatcaggtgttgcggaggagaacttcccagagtcccaaggccaagccctagtt

SEQ ID NO: 548726 - DNA, 98 bp, Homo sapiens
tctcattcctcctgttcctccgtgcttccctcctgcctctgtgaagccttcaaggctgggagggaggtcagaatggagcccatcctggcaaaatgaga

SEQ ID NO: 548727 - DNA, 98 bp, Homo sapiens
ctgttattgctgatgttgcctcctgttagtcatggatgttgccactatcactgtcttgaggcatcaagtatgactagtgggacagcccagtaatggag

SEQ ID NO: 548728 - DNA, 98 bp, Homo sapiens
ttagaatgagattcatgtgtcagtggggccagggccatgttccaggctaactggaatttgtgtgtgtgctggtttcacttttattgtttcccagctaa

SEQ ID NO: 548729 - DNA, 98 bp, Homo sapiens
ggtgtgttaagtgtttcaaatcactggggtaccattttatgagccaaaagaactcatttaccaaatgggtccccagggcctggaataacaaatgcacc

SEQ ID NO: 548730 - DNA, 98 bp, Homo sapiens
gttgtaggagtgacgttagagcagaagaatgcggactgaagaatctgtttctcccacaggtttttcccccgcttcctcctatcccatcttcctataac

SEQ ID NO: 548731 - DNA, 98 bp, Homo sapiens
gttgttttccagccccatctgcccagacacagccctgtgaagagagggccgaatgcagagccagggctgtgttgactgcagaagggacggaagaaaat

SEQ ID NO: 548732 - DNA, 98 bp, Homo sapiens
gggccacaatagggaagacagaagaatgatgttgggctgcccagaatcaagtggacaagggtggcaccaaaattttctggttttctctggagttgccc

SEQ ID NO: 548733 - DNA, 98 bp, Homo sapiens
gtgtgggagactggggggagacagagggtgcaggaaagaattgcattagcagcctccctccttggcctgccctttgtttgctcctttaagcaccatat

SEQ ID NO: 548734 - DNA, 98 bp, Homo sapiens
gaaccaggatctgtttaaccccaaggatgattctaaaggaggacttattttcttcagctctttcagaatcatccttgaggttaaatagatgctggttt

SEQ ID NO: 548735 - DNA, 98 bp, Homo sapiens
tgggttttctttagctcccagcttagtattatttttatcactccaaatgttagtcaaaatagaaataatgctgaatggtgagctaaaggacatgccca

SEQ ID NO: 548736 - DNA, 98 bp, Homo sapiens
gcctgtcacctgcggggtccggtgcagctcatacagactcagttcccacgttttgctggcattctgggcattcgccggcgtcgtcatggtgaccgggc

SEQ ID NO: 548737 - DNA, 98 bp, Homo sapiens
tgagcaaagaaattggcttttaaagttgtttccaggctctgttcatcactcattcctgggtgagatgccaggaaataactttcatggttttttcctca

SEQ ID NO: 548738 - DNA, 98 bp, Homo sapiens
gaaactggtggcacagaaggtaagggctgcaggttctctgtccccaggctcctggccaggtggcctcacccttccagttctgacccccactacgtttc

SEQ ID NO: 548739 - DNA, 98 bp, Homo sapiens
ccctagtgttccagagggaactgtccttcctggaggtgtacagggttaatctcttatgtctcctgggaggagaggcctgtgctggttattcactgggg

SEQ ID NO: 548740 - DNA, 98 bp, Homo sapiens
ttctctgtgaaaaactcctctcatgaaggcgcattgaggggagtcctccccatggcctccccttgctgtgccttttcacatatgttttttaaagtgga

SEQ ID NO: 548741 - DNA, 98 bp, Homo sapiens
gttaccgagggtagaattagacctcggggcccaatttcctgccacattacaaggcggtaattaactcagctcagaggtcccgttcctccctcggtaac

SEQ ID NO: 548742 - DNA, 98 bp, Homo sapiens
ctcctgccacctacctgggaactgatgctccccagcatctcctgcacctctgcaaggccctagctgctggtgggcacagtgggtgggtgcggtggggg

SEQ ID NO: 548743 - DNA, 98 bp, Homo sapiens
actctgatgctcacctttctcctcatttctacagtcgctgcttttgtgtaacgttggctcagcagccctgtaggagttagggggattggctttggagt

SEQ ID NO: 548744 - DNA, 98 bp, Homo sapiens
tatacatagattcctatatccctattaaaatgtgtgtgtatgtatttcattggatatagggatcaatacacattttaataggatacaggatatgtata

SEQ ID NO: 548745 - DNA, 98 bp, Homo sapiens
accttaaatgtcagagatgatttttctgataatttggaataacgtgtaatctaccacatttagacatcgtcagaaaaatcatttctgacattgaaggt

SEQ ID NO: 548746 - DNA, 98 bp, Homo sapiens
gtcttctcactgtcacaccctggctggagtgtaggtgctggatcagcagtgagccgttaccatgcccctgccctccagcatgtgtgtgagagtgtgac

SEQ ID NO: 548747 - DNA, 98 bp, Homo sapiens
gggcattatggtggtgataagtggatgaggaaagcttcccaataaccagaaaatttgggaagatgttccagtctctttgcccactcccagttcagcct

SEQ ID NO: 548748 - DNA, 98 bp, Homo sapiens
aactaccaaaggaaataaaaactataaaatgtagagagcgattttctcttttaaaaattgctttacatattttaactcttgtatttcccttgggggtt

SEQ ID NO: 548749 - DNA, 98 bp, Homo sapiens
gccacacctgggtaggaagaaaaggtatatggtgggtggaatgaggagccaccctgtccctccactccttccctacctttttttttaaccctactggc

SEQ ID NO: 548750 - DNA, 98 bp, Homo sapiens
ggtacttctcagtctgtggcactcagccttgagggcactttctggtgccagaatgaaagtgctgtcatagctgaggtccaatgactgaggcgagcacc

SEQ ID NO: 548751 - DNA, 98 bp, Homo sapiens
cacagtgaagctttggaggaaatctttcttccttttctcttcttttcccatcacgggttgagaaattggagggaggggcattgctggggcttcctgtg

SEQ ID NO: 548752 - DNA, 98 bp, Homo sapiens
tgtgcttccagagacagttcacactaccaagctctatggcaccacaacttttaaggtgagagggccctacagtactgtggaactgcttctggtgtaca

SEQ ID NO: 548753 - DNA, 98 bp, Homo sapiens
gaagcattctggaaacatctgttatttcaatgataccaccaaatcttcctctaggacttagtagtatcattgaaatgacagatgtcttcagatgtttc

SEQ ID NO: 548754 - DNA, 98 bp, Homo sapiens
gcaaacattaggagagtatcttctctgttttggccatgtgtgtactcacagcccctcacacatggccgaaacagagaagttactttcctaatatttgc

SEQ ID NO: 548755 - DNA, 98 bp, Homo sapiens
gtgtaataaagtttctgaagaacaaataaaatgattatgtgtgagacaaacctcaatcacaaaactattttctttgcttttttgaaactttattatac

SEQ ID NO: 548756 - DNA, 98 bp, Homo sapiens
gggtgagtggggagggctttcatgctctggggctgaggccggggtgtctgatcctcctgctccagccctggggttgggagctcaacagccacttcctc

SEQ ID NO: 548757 - DNA, 98 bp, Homo sapiens
cggggctggctgtcttctactttctcatgcctgggtttccagcccttgctatggtggctcaggaacccaggtgagggtggggcaaggcagcagcgctg

SEQ ID NO: 548758 - DNA, 98 bp, Homo sapiens
atactctgaaccccaagaagtgtccttttgggggaccttgattttccctctggtataactaagaccctcaaaaggactctccttgggattcagagtat

SEQ ID NO: 548759 - DNA, 98 bp, Homo sapiens
acattatatctcttttagggtcaggtcttcatttgacttactgaccattatgactcagtaagtcaagtgaagacctgactcttaaagggatataatgt

SEQ ID NO: 548760 - DNA, 98 bp, Homo sapiens
tgagacccagttgcggggagaggaagaaggtctggcctttctactcagtaaggctctgtttaggttaacccttcttttcctcttgctgctggctctca

SEQ ID NO: 548761 - DNA, 98 bp, Homo sapiens
tcatcagagaacactcctccactgtattgagatttcattgtgggtcagagagtgtgagcagcaataaggtcagatggggtgaggatacaatctggtga

SEQ ID NO: 548762 - DNA, 98 bp, Homo sapiens
cctcctctatataacttttctggggattttctatttcttttttcctgtacctactatggaggattagaagatgacccagaaaagctatgataaggggg

SEQ ID NO: 548763 - DNA, 98 bp, Homo sapiens
ttgacggccatcgtcaatcaggcctcagttggtcataacctccagtgaccggtcgctagagtccatgacactgaggcctgaatcatgatggcagtcaa

SEQ ID NO: 548764 - DNA, 98 bp, Homo sapiens
gactgacttaccggtgcctcctagcctttgttctgcctctcacgctgacatcagggaagcagtgatgtagaataaagcaggggtgggctaggttagtc

SEQ ID NO: 548765 - DNA, 98 bp, Homo sapiens
gctgggggctggggtctctgaccagaggatctgtctccttgtgtcctcagtggacgggtggcttctggtcacagcccccaactctgcagcctccatgt

SEQ ID NO: 548766 - DNA, 98 bp, Homo sapiens
agacaggtaagataaccaaagaaggaaaataagcttttcaaataattagcaatccttagacaaaacttgttttcctttcttggttatgttacctattt

SEQ ID NO: 548767 - DNA, 98 bp, Homo sapiens
tctgtgtgcgtggaggtaagagagcgtcagaaggtcaggctgtccatagaatgctaaggacatcctagcaccgtctgacatcagttgcagcacacagg

SEQ ID NO: 548768 - DNA, 98 bp, Homo sapiens
gtgcttctagatggagttgggggaacattgtgtgctgaatccctttctgaggacttggtgttcacttttcatacatgtgccttaacttcatttttcac

SEQ ID NO: 548769 - DNA, 98 bp, Homo sapiens
agaaattatgccacttttaatttcagctactacctctattaggatttgggagttatactaatagaggtaatagttgaaattaagagtggatgagttct

SEQ ID NO: 548770 - DNA, 98 bp, Homo sapiens
ctgatctttggctgttaaagtgcaaagaagaagggaaaggagatcggacttagattttctgcctttcctttcttgttgccatgacagcttgagggcag

SEQ ID NO: 548771 - DNA, 98 bp, Homo sapiens
gagttctcactctgttctgcttcctaaatcacctccctccaggagattctgcactgtaggagggaggtggtttaggcagaagaacagagtgaggactc

SEQ ID NO: 548772 - DNA, 98 bp, Homo sapiens
taaacttatttatttacaggttcattcaactaacaaatatttattataggagatataaatatgtgttggttgaacgaacctataaataaatgagttta

SEQ ID NO: 548773 - DNA, 98 bp, Homo sapiens
gtggctctacgttccctttctcctccagtgtggaaaaaaaatccctgcgtgacacacatttttttccatattggaagagaaagggaatgcagacccat

SEQ ID NO: 548774 - DNA, 98 bp, Homo sapiens
cagtgtttgctgttactggtgctgctgtcatcactgctaatgctgttaattattttgctcggcagtgatgtatacagcaggggttatgtcaggcactg

SEQ ID NO: 548775 - DNA, 98 bp, Homo sapiens
tgatcttgtccacagttttcaagtacatgttgctcaacagccacatgttctcatctatgaggttgacagcagcatgaactacgaactcgttcagatca

SEQ ID NO: 548776 - DNA, 98 bp, Homo sapiens
ggggcagggctgctaggattcacagcagtccatagaggctgctttcatccacttcagcccactctgatggcctgctgggagtcagccttctctgccct

SEQ ID NO: 548777 - DNA, 98 bp, Homo sapiens
gagtaacaagaactcttacacctaggtaaagccttgggaagggagcaaactgctcaggctgctaaggtgtaagaggatgtatgtgaaggggagtgctc

SEQ ID NO: 548778 - DNA, 98 bp, Homo sapiens
aggtgaatgatggatgaataaaatgaggttgcaggggaagggctgtgggaaagctggcctcccccctgcaaaacgttgctgtctacactcatccacct

SEQ ID NO: 548779 - DNA, 98 bp, Homo sapiens
ggcaaagagtcacagtgagaatgggaagggagagcccttggctgtgtcacacacagggatccagtgtccttcctttccatggaagtggcttttgagcc

SEQ ID NO: 548780 - DNA, 98 bp, Homo sapiens
aactgaagaactgcctgaggcctaaaagacatacagccagtccccgaaaggagtgttgaggactgaagtcttgccgggtctcagcgcagtgaaaggtt

SEQ ID NO: 548781 - DNA, 98 bp, Homo sapiens
gcctcttttcaagcattccctgcctggccctgtgcaggtgtttgactctgagattctgcatctgcatggttgggctttctggtgcatggacaagatgt

SEQ ID NO: 548782 - DNA, 97 bp, Homo sapiens
gatttgacacattttgatttctgcttaggaaaatatctgttaatcctattagatagagtaggagagggtcctgagcaggaatgcaaaagatcaaatc

SEQ ID NO: 548783 - DNA, 97 bp, Homo sapiens
ggtgactcttgagtgatgaattcaaggtattcacaccttgaccacctctctttaaagaacattgtgagtatcttgaattcatctctcaagagtcact

SEQ ID NO: 548784 - DNA, 97 bp, Homo sapiens
taatactaacttcacagggctgctgtgagttaatatttgtaatgcctttaggatggcgtttggcacacagtaagccctaagtgaatgttggctgtta

SEQ ID NO: 548785 - DNA, 97 bp, Homo sapiens
gcactccactagccctcaccgctactcctttcatttctccagcctgggaaaggtagtgttccgagaggtaaagatggggagggctaggaggaggtgc

SEQ ID NO: 548786 - DNA, 97 bp, Homo sapiens
ggacaaatgtataatcaggagaagagagtgtaaaccatccatttggtatctgcctgccatctatatcacacattctcctttcctgagaacaatgtct

SEQ ID NO: 548787 - DNA, 97 bp, Homo sapiens
ccattttgaaaaaaggaaaatgcagcccacgaatggagtattctgccttaaaatgatagctctattcataggccgcatttttctgttttcaaaatgg

SEQ ID NO: 548788 - DNA, 97 bp, Homo sapiens
tccttggtgttattactgagggctgaggctcctagagattggcattctggacatatgaaggtcaaattttagagcttaagccttttggtaccaggga

SEQ ID NO: 548789 - DNA, 97 bp, Homo sapiens
ctctctggaaatattatctttctgtgggcgggtacaaacacatgtttatgagaacatcatctgtagctgtctgtggaggggggagtgtgaggtagag

SEQ ID NO: 548790 - DNA, 97 bp, Homo sapiens
gcggaggagggatggcagcaactgtgaactcctcacatttattacagaaaatattattggagtttacagtcgtgggtgccatgcactcctccagtgc

SEQ ID NO: 548791 - DNA, 97 bp, Homo sapiens
tatggaggggcaacaaggctgtcctagagacatcagatgttctatgttagaatgggtttcatgtttctattggatggatgggagatgccactccata

SEQ ID NO: 548792 - DNA, 97 bp, Homo sapiens
ctgcactcactctttctgatcactggagtaccatttagcaaattgctgctgcagtaggctcaatgataccccagtgttctgaggaagttaattgcag

SEQ ID NO: 548793 - DNA, 97 bp, Homo sapiens
aggtatgtgggattgagaactgagtttatgtgaagagagggtttctatatgagatattttccttcagaaagttcaagtcctcaattccttttaacct

SEQ ID NO: 548794 - DNA, 97 bp, Homo sapiens
ctcctggttgcagagaagggtttgttttcgccttctgcaagatgggcaggtttgtgggctggagggcaggaggcgaagacacagcctggatgagggg

SEQ ID NO: 548795 - DNA, 97 bp, Homo sapiens
gcaaatgctcattctctctgttccataggaaaggcacttgggttccacctgggtctatgtgtgtgctttgctgtggggcagtgggagtggccactgc

SEQ ID NO: 548796 - DNA, 97 bp, Homo sapiens
gggcctgagtgagctcatttctaggggctccaggcaggggaccaggaatgtcatggtgactgcctggatgtggcccctagtgaggctctcctggccc

SEQ ID NO: 548797 - DNA, 97 bp, Homo sapiens
ggagagagtgtctgtgcggaagacaatgtgtctttttggtctcatttaattttttataaacattgtctctgacaaggacactcaaaaatacatctcc

SEQ ID NO: 548798 - DNA, 97 bp, Homo sapiens
aggcctggctcagggctgaagggctggggctagctctgaccagttcttgctgctctacctgccagagctggccaggtccttccaacttcccaggctt

SEQ ID NO: 548799 - DNA, 97 bp, Homo sapiens
gagatggggaaactgaggtacacagaggaacactgacttgctcaagggtgtggctgtgacaagtcactgttcttcaatgacctctccccgccccctc

SEQ ID NO: 548800 - DNA, 97 bp, Homo sapiens
aaagggaccttgagaacggaaattttcaagtgtgttttgtaacccttagcaaaaggagagcaaacacctttatgaaattctggcatgtggtcctttt

SEQ ID NO: 548801 - DNA, 97 bp, Homo sapiens
ggtgattagccatatcatggcactgagggaatttctgtgcgttagtctttggcaattaaaccttatgctgttccccagtgctgtgagtggcattgcc

SEQ ID NO: 548802 - DNA, 97 bp, Homo sapiens
cttacctgaaggcttaatcttctgttggtgacatgataatcagttctccagcaagcaattatgatgtcacaaagaggtaattatcacttcaggtgag

SEQ ID NO: 548803 - DNA, 97 bp, Homo sapiens
ctgtgcttgtcattgcggcttctattttctgcttctaaactatagtctgtagctatagtttgagcaggaattcgaagccaacagcaggacagtgtgg

SEQ ID NO: 548804 - DNA, 97 bp, Homo sapiens
tccccttgcctgacctcaatgtcctcatctgcccagtgggattcagatttttgtgttacccagggatgtgggaggatgaagtgagggcgcgaggaga

SEQ ID NO: 548805 - DNA, 97 bp, Homo sapiens
gtcatttccctagatgccagcctttctttgtgaagacggaaatactgtgtcggtgtctgtctaaacctacaagaggaaggaggccaataaggaagac

SEQ ID NO: 548806 - DNA, 97 bp, Homo sapiens
tcttatattcattgggacttgtacctttgctttgtaaatatgtaaaaagcatattttttccttgtggtggagagtgcttcttctagtgggtatagga

SEQ ID NO: 548807 - DNA, 97 bp, Homo sapiens
ggagctgcaggaaaatacacagggccggatcttgccagaggaggctgaagatggggaggacatggggagaaatgagccttggtggaatgcaggagcc

SEQ ID NO: 548808 - DNA, 97 bp, Homo sapiens
gcacactggtagctgagtacaggggagctgatggccagcctggagctgtggggcagctgaggagctggccagcctcctgggatacagggccagtggc

SEQ ID NO: 548809 - DNA, 97 bp, Homo sapiens
tcactgttctttctcttgagaaaggagagcttaatgtgtctgattccaggagctgagaattaagctgtcctttctcagaggaggtagaatacagtgg

SEQ ID NO: 548810 - DNA, 97 bp, Homo sapiens
tctaaattattatcatgtgctcttttctcaatgtggtaatgttaggtctctaacatacgtgccatagagaaaagaagttaagattgtactatttggg

SEQ ID NO: 548811 - DNA, 97 bp, Homo sapiens
aagggtctcaggcctgtcagtctgaaagctcagaaaagatctccttgaaaagctcttccaatctggctacttcaggctggcagttcctgggtctctt

SEQ ID NO: 548812 - DNA, 97 bp, Homo sapiens
aggcctgtaggactccatgcagggacaactccattcgtagagccagaactcccagtgagagttctagaatgggggctccttccgagtcccagagcct

SEQ ID NO: 548813 - DNA, 97 bp, Homo sapiens
cctgaatggggcccaccctgttgagcaactggccatcccagtggcacatattgagcctggtggggggtggtgcagtttcaatggggttgggtcaagg

SEQ ID NO: 548814 - DNA, 97 bp, Homo sapiens
gggggaggttggctggaggaggagaaaggggcgggcatctgggagggtctcagccactctcagaggcttattcatctcatcctcctttccctccccc

SEQ ID NO: 548815 - DNA, 97 bp, Homo sapiens
gcctcttcctccttctcagtactgtcaatcttacttgggttcaacatttgaccaagataggagagggcagtgcttggtatataaaaggaacagaggc

SEQ ID NO: 548816 - DNA, 97 bp, Homo sapiens
agactcagtgcatgagaagtcctgctggtcaatcacagccccggagagtctgaccagggctatggttgaccagcaggatttctcatggagtgagtct

SEQ ID NO: 548817 - DNA, 97 bp, Homo sapiens
cgtgagtgggcagaggtgaggggctggggacctggatcctttggcaggaagctcactctccctgtcccgccccacccctcctgtgttccagctcacg

SEQ ID NO: 548818 - DNA, 97 bp, Homo sapiens
gaaattcattgttactgcagttaatggccagtttattagagcgttaaccatccttggcaatgggctgagtcgtttaatgtgggtaacgaccaatttc

SEQ ID NO: 548819 - DNA, 97 bp, Homo sapiens
ctttctccaaaacagcttgaagctgacaaaacactaagctctgaggtcctagagaagcagcagttcagggtcttgttagcttcgagctgcaggaaag

SEQ ID NO: 548820 - DNA, 97 bp, Homo sapiens
tttaacaaatgtattggtctttcagttttaattcttccggatatgattcaatttcctgatgaatctgaactgagaggagaataacttatttgttaaa

SEQ ID NO: 548821 - DNA, 97 bp, Homo sapiens
tttcccagggagatgctaggagtgtgcttccatggaatatgtgagcccatggaagagcaagcccagggaagcacaatcctagtatcccactgggaaa

SEQ ID NO: 548822 - DNA, 97 bp, Homo sapiens
gagctgtgagcaatttcattttgcttgactacatcagtgaggtgacaaaagtggcaagcaagatagagtggagtgaaatgggagggctttgaaggtc

SEQ ID NO: 548823 - DNA, 97 bp, Homo sapiens
ggggctgaggaggctggtgtcaggccttggtaaatcctctccagtaagggtaaggcaccgaggggaggccaaggcctgggtgccagtcctctgcccc

SEQ ID NO: 548824 - DNA, 97 bp, Homo sapiens
tttctgcagcaacagtaaaatactctgatcttactgcttattggccaaagagttgcagcaataagatgagaatagagatgattatgggctgcagagg

SEQ ID NO: 548825 - DNA, 97 bp, Homo sapiens
ttataaactgtagcctaataccttctttctctttctccattctccttttctatttgagtggagggagagaaggcaaggattgggctctgttttataa

SEQ ID NO: 548826 - DNA, 97 bp, Homo sapiens
ggacatttctaggggattaatggccagctgggagagttgatggcccagaggagggactcattaacctcagcgggccattaattccttaggcactgcc

SEQ ID NO: 548827 - DNA, 97 bp, Homo sapiens
agcagggccagtccccgggcaggactggacacggagacacagggacaaaccagggtgcttcctgctccatcctgacctggaggggcctgtccatgct

SEQ ID NO: 548828 - DNA, 97 bp, Homo sapiens
aagaataacacagagaactccctatatcccagattaaccaattttcaatgttatttttgtcatatttggggtatggggagatctttttgttgttttt

SEQ ID NO: 548829 - DNA, 97 bp, Homo sapiens
ggaactgaggtagacgggctgttcagagtcagatcctagctttgtcacttgctaaagggctctgacgttcggacagcaagttttgagcctcagtttt

SEQ ID NO: 548830 - DNA, 97 bp, Homo sapiens
tggaccaactatgtccccctcagtgcttcagtaaccttagaagttaagcaaacacagaaatgctgactcacttcagaggggggcattgtgaagccca

SEQ ID NO: 548831 - DNA, 97 bp, Homo sapiens
atgtttttcattggaaaggtactaccctacctactaccaaaggtactatgctacctaccctttggtaataggtatagtaccttaccaatgaactcat

SEQ ID NO: 548832 - DNA, 97 bp, Homo sapiens
aactttgcactgagtgtcctcgcccttcctttagctaatcctatacattacagagaattcctaggacagggctggcgacaattcatgtgtaaatgtt

SEQ ID NO: 548833 - DNA, 97 bp, Homo sapiens
aggaaatacttgtaagtggtgcttttctgggaggaccagaaagtggttcttcttccttctggtcctcccaaaaagaagccacttacaagaatctcct

SEQ ID NO: 548834 - DNA, 97 bp, Homo sapiens
gccctgcaaagcttttagtttccctgtcagtttcccctctgctgagcaggtgattcagtgagggctgaggccaggggagagaggagcagagatgggc

SEQ ID NO: 548835 - DNA, 97 bp, Homo sapiens
ggaccaaaggaacttttctggtctattgggtaaatatgtattaaagtaatttttaaaatacttacatacttaataggctggaagtggtcaatggttt

SEQ ID NO: 548836 - DNA, 97 bp, Homo sapiens
agcagtacaggatctcagatacactcctgactcctaatggtgctctgttcttcccacctgccccttctctcaggatgcctctggatccccacctgct

SEQ ID NO: 548837 - DNA, 97 bp, Homo sapiens
tggagtgggtggctcagtttgccttgttacagctgcctcttccttctgagaaatggaagatggtatttgtaggaatgcgtttgtgtgaccggctcta

SEQ ID NO: 548838 - DNA, 97 bp, Homo sapiens
cccagtgacccccctctcatgtggcctcatgagcctggccagtgatgaatggcactttcatgggcatgagactccacgtgagtgggactcagctggg

SEQ ID NO: 548839 - DNA, 97 bp, Homo sapiens
taattgccagatatggagggtttttatatggccagggtgataaaacaggctggttattaacctggcaggtagagagaaaacccattgatggtaattg

SEQ ID NO: 548840 - DNA, 96 bp, Homo sapiens
ggccagtgggaacaggctgctgtaagccttgcaattaggacttttttctatgggcagtggggggtattgaaggctgaagcagcgtgtggcatggtc

SEQ ID NO: 548841 - DNA, 96 bp, Homo sapiens
ccctccccgcccccgccccctgggagctctcaacccgaatcggctttcaattaagctgcggcggccagagctcccggggaggaaacaggcgagcgg

SEQ ID NO: 548842 - DNA, 96 bp, Homo sapiens
ctgagaactcaagaagacaaaaggcagaaccagggcatcttctcattaggcagcagaagccttggctctgctttgctgtcaagaacagagttccag

SEQ ID NO: 548843 - DNA, 96 bp, Homo sapiens
gcccaggcggggcagggctggtctgaggggatgtttttgacggagcggagctccagatgctgcacattcctgatcgggtcaggcctgccctgcggc

SEQ ID NO: 548844 - DNA, 96 bp, Homo sapiens
tgctgctggtaatgagaaagacaggggtggagacagggctcatgatgtcctcttcttccctttgtctttccccctgttttctttctatgagcatca

SEQ ID NO: 548845 - DNA, 96 bp, Homo sapiens
ccctctacacagactggccagtgtctgcttggctccagggcagtgaggagctgccttgggactaacagaaaattggccagcttgtttttctttggg

SEQ ID NO: 548846 - DNA, 96 bp, Homo sapiens
actgggcaccaggttaagcactctacacagattgtctattctattctctcattaataacagattatctgtgtagaacacttaactcagtgcctcgt

SEQ ID NO: 548847 - DNA, 96 bp, Homo sapiens
gtccatctctctcttcttcttgagtaacatcagattcttcatcagtgccaactgaagtcccactctgattcaacttggcaggagacttagatagac

SEQ ID NO: 548848 - DNA, 96 bp, Homo sapiens
gcagctggatttgtgggcaggattttagtaattgaaactgggaggtcattttattttcacttattgactccctgtcacattttctcaaatagctgc

SEQ ID NO: 548849 - DNA, 73 bp, Homo sapiens
cagtggcaggtgatggacagtgtagccatagagagcacatcagctctgtgctcattcccgtctcccgtctctg

SEQ ID NO: 548850 - DNA, 73 bp, Homo sapiens
gagagaagcgggaatggaaggcagggatgaggactggtaacagaccctctgcctccttccttcctcttccctc

SEQ ID NO: 548851 - DNA, 73 bp, Homo sapiens
aatatgatgatgtatataagacatctagtgtagtactgctgcatagctggtatcatatatgtgtcattatatt

SEQ ID NO: 548852 - DNA, 73 bp, Homo sapiens
tcacatctaaggatgaagactaatgacagatacttcctgctttaagagtggaagtcttcagattagatagtga

SEQ ID NO: 548853 - DNA, 73 bp, Homo sapiens
aaccagtcattcttctcaccctccaatctcaaaaggggaaaagacggagggagagatggagttagattaggtt

SEQ ID NO: 548854 - DNA, 73 bp, Homo sapiens
tccgccgcctccccacctcaccctgctcggctagtttaaacagatccagcggtgggcagaggggaggcgggga

SEQ ID NO: 548855 - DNA, 73 bp, Homo sapiens
atgaactatgtggttttgaatcggatgtagaccattagtactactacttgagctaaacttctgcatggttcat

SEQ ID NO: 548856 - DNA, 73 bp, Homo sapiens
gcatgtttggtcatgaatgtcagtgtgacatttcagtcatttaaatcattgacgatcatgtacttttatgtgc

SEQ ID NO: 548857 - DNA, 73 bp, Homo sapiens
gtcatggactcttgcttttccctgtgcaagcaggaggctgtgcaagtacagggtaggggccaggaattctgac

SEQ ID NO: 548858 - DNA, 73 bp, Homo sapiens
cagggcttcctggagcaggtgtgggctcttccagcacagagcatgggctgcaccagcttcggggtgcaccgcg

SEQ ID NO: 548859 - DNA, 73 bp, Homo sapiens
ggagccaggcgtaggacagggcccatcactcagcactaagccacccccagctctgcctgccgcttgcagctcc

SEQ ID NO: 548860 - DNA, 73 bp, Homo sapiens
ggaggaggtttttgtattatttttggcttgggcattcatatcctgccagtgagtgacagcagagactgcctcc

SEQ ID NO: 548861 - DNA, 73 bp, Homo sapiens
aggggaaaatgggctgtattccaaaaattcaattttaaattgactgtttggaatgcagaacacattttccctt

SEQ ID NO: 548862 - DNA, 73 bp, Homo sapiens
gacagtctcctgctcttcaggttctcccagttgggttctagattggtatggagcctgggggcagggatatgtc

SEQ ID NO: 548863 - DNA, 73 bp, Homo sapiens
aatcctgtggccatgtgtggtcatttcagtttctttgtttccagcttggccacacccaatggatcatagggtt

SEQ ID NO: 548864 - DNA, 73 bp, Homo sapiens
tttttggctctgagaataaagtgagggaggagagtttttgtgccttttcaccctcattttttggagtcaagga

SEQ ID NO: 548865 - DNA, 73 bp, Homo sapiens
tgggggaggggcagcctcagggatcttgaggggcatatcctaaggagcaggatgcctgggtctcctccctcca

SEQ ID NO: 548866 - DNA, 73 bp, Homo sapiens
actacaagtcccagtatgcattgcagtttttgcttaacttcagattagagcactgcatgctgggacctgtagt

SEQ ID NO: 548867 - DNA, 73 bp, Homo sapiens
gggccatcagatggggcacgcagaccctattcaccctatagtgtcccgtagggctgctgcctcactcaccccc

SEQ ID NO: 548868 - DNA, 72 bp, Homo sapiens
cgggctggaaaccatagctgtctcctggttttccagaaatcctgcagctgggagagagttcctttctgcctg

SEQ ID NO: 548869 - DNA, 72 bp, Homo sapiens
tttcaggtcgggatggcacaagactactaaattgtgtgttggcaaagtagtgctgtgtatctggagttggaa

SEQ ID NO: 548870 - DNA, 72 bp, Homo sapiens
gcagcaagtaaatctggacaggttgtagttaatctctaagccaagagcctgagactaggtttatttgccagc

SEQ ID NO: 548871 - DNA, 72 bp, Homo sapiens
gccactggaaattcatgggccagatggaatcacagattacaccattttcctactggcctgcaattttctggc

SEQ ID NO: 548872 - DNA, 72 bp, Homo sapiens
tcccctcctggtagcccctgcttccatatcgacaccacagtaactggtggtaggggtgaggaaggagggtga

SEQ ID NO: 548873 - DNA, 72 bp, Homo sapiens
tggttgatgatcagtggacatggcatgtgaagaaataactccttagccatgtcacatatggtcatcgaacca

SEQ ID NO: 548874 - DNA, 72 bp, Homo sapiens
taggccaactggtagctttttattgactgcagatggttactgagtatgcaataaaaaacttccagttgacta

SEQ ID NO: 548875 - DNA, 72 bp, Homo sapiens
tgtggtccaggactggtggtacccttcactctgcaaagcccctgtaagggagacccaccgtcctggactgca

SEQ ID NO: 548876 - DNA, 72 bp, Homo sapiens
tttggctgatctgcatacatatttttaagctctttgaaattcaagggaaatgtgaagtgtgagtcagctgaa

SEQ ID NO: 548877 - DNA, 72 bp, Homo sapiens
tccttatgaggataaatagccgaagcacattgaggttaatattgcttttaagctatttgtctccatttggga

SEQ ID NO: 548878 - DNA, 72 bp, Homo sapiens
tcttgagagctgatggtggtgctgaccatccttctggggaagggggtttggtgtcaccatcaacccttaagg

SEQ ID NO: 548879 - DNA, 72 bp, Homo sapiens
ttcctttggattgatgactggctgggaggagttgatagtcattaacccccaacttctcattaatccttcgaa

SEQ ID NO: 548880 - DNA, 72 bp, Homo sapiens
ctggggatttcatagggcaaacaaattattcagacagaataatgtgtgtcgttgtttgctgtatttccccag

SEQ ID NO: 548881 - DNA, 72 bp, Homo sapiens
caggaagatatgtatatgtttaaaaaataaaccaatctctgctttatttttttaaacattaatattttcctg

SEQ ID NO: 548882 - DNA, 72 bp, Homo sapiens
gttatgtatgtatttatgcacatcgtgacttgttccagaaaggattaaatgtgaccaaaatacatacacggc

SEQ ID NO: 548883 - DNA, 72 bp, Homo sapiens
ggtggatgggagatgggcagataatcttcactcagatctaaacatggattatttgtgcatatcccatccacc

SEQ ID NO: 548884 - DNA, 72 bp, Homo sapiens
gctggttgcatctgttttgatgttagaatcggtagtcaagaaagaacataatcaaatacaagtgcagccagc

SEQ ID NO: 548885 - DNA, 72 bp, Homo sapiens
tttgaggccactagggaaccagtaagtgtcctgaagtaataactaactgaatgggaccctagtggcctgaga

SEQ ID NO: 548886 - DNA, 72 bp, Homo sapiens
gattaagcatcttgagatgggaacttatcctatgttgcctgtgggcccagtgtcccatcacagtgctttttt

SEQ ID NO: 548887 - DNA, 72 bp, Homo sapiens
acctctaagctgattccactttttccacagagctgctccagggcggtgtgggtggaggggggatcaggaggt

SEQ ID NO: 548888 - DNA, 72 bp, Homo sapiens
tcaggctgcaactagagcttaaacttcctatatgattggttgaagtttcagtcccttagtttgcagctgtga

SEQ ID NO: 548889 - DNA, 72 bp, Homo sapiens
gcagtcaatttcgagtcagtgggctgtgaaaagcagttagaataatagtttattgaccctgaatgtggcagc

SEQ ID NO: 548890 - DNA, 72 bp, Homo sapiens
tggatggtgaagaggggaaagaagaaggaataatttgtgtctaaaatctcctttctcctctgaaccactcta

SEQ ID NO: 548891 - DNA, 72 bp, Homo sapiens
gggaggatgggacgcgtggggactgaaggcggcatctgcctgaataaagccctcgcgcgctctgagcctccc

SEQ ID NO: 548892 - DNA, 72 bp, Homo sapiens
cttcctccttgtgtattggcaggggattgcaggctgcctgcctctgctttgccaaagcactgagggaggagg

SEQ ID NO: 548893 - DNA, 72 bp, Homo sapiens
cagcttggctaaagtgataggcctaagctctaaagagacaatctttaaattcaggcctttcatttccagttg

SEQ ID NO: 548894 - DNA, 72 bp, Homo sapiens
ttgagaggcccattggatcctggccatgggtacagatgtatgatcatggccaggatctagggttttgctcaa

SEQ ID NO: 548895 - DNA, 72 bp, Homo sapiens
tttgggagactttgacgaaagagtcattaagttcatttgcttcatttgttttccaagtcaaagaatcccaaa

SEQ ID NO: 548896 - DNA, 72 bp, Homo sapiens
tcatggagtctcctaatatgagtaagatttcaccaggacctctatttcctggctcatttaggcagcttctga

SEQ ID NO: 548897 - DNA, 72 bp, Homo sapiens
gtaacctggctttttgtttcaactttcattttcaacttgaaagcaaagacaatagcagaaagccaggtggac

SEQ ID NO: 548898 - DNA, 72 bp, Homo sapiens
gctccaattgggctagctgctcttcactccctcctggaagctgatgagcgggtgcctggcgtcgaatggggt

SEQ ID NO: 548899 - DNA, 72 bp, Homo sapiens
gtgggtaggtaggtagttgtgtggatgggtgagtaatctatccctaaccactgctattcttaacctgcctac

SEQ ID NO: 548900 - DNA, 72 bp, Homo sapiens
ggtctctgagcaggcgggaggcctggcactcactcagcatcacccacagcctcatgcccgctcagaaaggcc

SEQ ID NO: 548901 - DNA, 72 bp, Homo sapiens
ggcctcagaggccatctggggagcagtcgtcccagcgggcggcagggccccctccaggctgcctttgaggcc

SEQ ID NO: 548902 - DNA, 72 bp, Homo sapiens
aatgaagaaggctctgcacagcccccagaaggaaacttaatagtctaggggctcccttgggtccttctcatt

SEQ ID NO: 548903 - DNA, 72 bp, Homo sapiens
gggctttgtggttttcatgcctgatgatggccaggaacccttctcagtaggcattgaagaccagcagagtcc

SEQ ID NO: 548904 - DNA, 72 bp, Homo sapiens
aaagtcatgttttccaggatggggtccttggtggaaagctctgctaggaagccttttggaaaatgtgatttt

SEQ ID NO: 548905 - DNA, 72 bp, Homo sapiens
aaagaaattttttgttgttacaaaacaccttttttaacaaaaaggtattttgagcctacaaaaagtttcttt

SEQ ID NO: 548906 - DNA, 72 bp, Homo sapiens
gtggttagcctggtccaagggtctccactcccgtcctagcatcctagagatcctggaggctaggttggccac

SEQ ID NO: 548907 - DNA, 72 bp, Homo sapiens
ctcaggtggccaggtgcatatcttggtgtgaggaccttcactgtatctgggaatgcctactggtcacctcgg

SEQ ID NO: 548908 - DNA, 72 bp, Homo sapiens
gtcattcactttgtccccacccaaactctgatgagctatttgggagtgcgcggggactgggaagtgagggac

SEQ ID NO: 548909 - DNA, 72 bp, Homo sapiens
tcttgttttactgttggacatgtgtggctctgagtcaaccagaggtttagtatgttcatatgtgaaatggga

SEQ ID NO: 548910 - DNA, 72 bp, Homo sapiens
tgctagcagggcaggctggcaccccaccactgtccatgcaggctctgggggtcccacctgctcctgcaggca

SEQ ID NO: 548911 - DNA, 72 bp, Homo sapiens
cctcctctagcatcctcatgcccgacattgagcaactgtgtgcttcaggcatggtgctgggtgctggggagg

SEQ ID NO: 548912 - DNA, 72 bp, Homo sapiens
gccagcattgtgccaggaagagcctgcatggttaacaaagcaattagtagcctttctctgatgcacagtggc

SEQ ID NO: 548913 - DNA, 72 bp, Homo sapiens
gtttgagaaaagcaacgttgaagatgctgctgatcttggtaatacatttgcagagcgtgcttatcatcagac

SEQ ID NO: 548914 - DNA, 72 bp, Homo sapiens
tgtccagtaggatgaactcagagaacctcacccgggccgcggttgcccctgctgaattcgtcctcctgggca

SEQ ID NO: 548915 - DNA, 72 bp, Homo sapiens
acatttcactcccctccccactgcaccctggcaacagctctgcaggactggggagcggaaggtgagtgatgt

SEQ ID NO: 548916 - DNA, 72 bp, Homo sapiens
gcctatttatctcattatatagaagaacaatgttcttagttaattctcggctaggtaatgggttaagtaggc

SEQ ID NO: 548917 - DNA, 72 bp, Homo sapiens
gcatgttctcagcaatcagtcctcccccagcgcctgtccccagagctgggagggggcaactgctgagtcagc

SEQ ID NO: 548918 - DNA, 72 bp, Homo sapiens
agtagcaccaaggtaaggtcggctgtctcctgatatcttttcataatgccctgctatgcctgaggtgttatt

SEQ ID NO: 548919 - DNA, 72 bp, Homo sapiens
agctgcccgggctgggaggcggaggctgagacctgaaaggtgctgaccggcctccccccagcctgggcagct

SEQ ID NO: 548920 - DNA, 72 bp, Homo sapiens
tcaggtgcctcagctgtgttcttggtatcactgtgtaggaacagtgtgcagaggggacagtgggagtcctgg

SEQ ID NO: 548921 - DNA, 72 bp, Homo sapiens
tctgggcagcctcctggtctttgagcctggagtgaagctgaacccacaggtgagagaacaagaggccccagg

SEQ ID NO: 548922 - DNA, 72 bp, Homo sapiens
ggagtgccttttggagttggaacgtccaggtgtgatttcacaggcttggaattttcagtccaagaggtgccc

SEQ ID NO: 548923 - DNA, 72 bp, Homo sapiens
ctgtgctgtgggctaacaatcaaactagggtagtcattcaatccccagatttcttggccccagctagcacag

SEQ ID NO: 548924 - DNA, 72 bp, Homo sapiens
actccaggtccactcccatctgttttctgttaagagttcattttcagagtgcaggctggtggaattcggagt

SEQ ID NO: 548925 - DNA, 72 bp, Homo sapiens
gattctgaggagccagggaagcaggtggccccagagctggggagtggcctccttcctgccgctcttcccctc

SEQ ID NO: 548926 - DNA, 72 bp, Homo sapiens
gcccccgggaagggttgttgtctttgtgccatatccaaacagagggcttttaatagcagcttcctgtggggc

SEQ ID NO: 548927 - DNA, 72 bp, Homo sapiens
tattttgcctaagaatctctctgattatccgacacttggaggtattctcgagagattcatagcagcaatgta

SEQ ID NO: 548928 - DNA, 72 bp, Homo sapiens
ctatgagtgtgatgtttattttatcccattaggaattttattccttgaggactaaatgaatcatacttatgg

SEQ ID NO: 548929 - DNA, 72 bp, Homo sapiens
gccctacctccggcccttgcgaccacacccattctcactgtgaatctccccgctggggtcggagcgtcgggc

SEQ ID NO: 548930 - DNA, 72 bp, Homo sapiens
gatggaaactctagaagatgtggtctggtgacattgggtatctacagctacttttcacctagggtttctgtt

SEQ ID NO: 548931 - DNA, 72 bp, Homo sapiens
tcatgccaaagacagatgatttcttggagaatgttcaggtaattctctaggttttttttttttttggcatga

SEQ ID NO: 548932 - DNA, 72 bp, Homo sapiens
ccaatcagagggaagcctaggatttttgttttattgcagagaatacagaagttcttttttttctctgaatgg

SEQ ID NO: 548933 - DNA, 72 bp, Homo sapiens
gccttaaaattgatcccaaggtcctttgcacagcccctttggccgtaagacttagggatcggacttactggc

SEQ ID NO: 548934 - DNA, 72 bp, Homo sapiens
ctgcctgccgcctctgttattataagttggcagcagggcatggaaacttacgagaccagagccggcaggcag

SEQ ID NO: 548935 - DNA, 72 bp, Homo sapiens
gaggtggcagatggaggagcatccaggttttaggatagcttatcctctgaagctcttccattttgctccctt

SEQ ID NO: 548936 - DNA, 72 bp, Homo sapiens
agtaggaactgtggtcattgcagggtaaagttgcacacctactcattcttttgtgatgatcatgtttttact

SEQ ID NO: 548937 - DNA, 72 bp, Homo sapiens
tgctctgcgggggctggggctgcaggatgcagtggggtagccttgtcccttggccccaccctcttcagggca

SEQ ID NO: 548938 - DNA, 72 bp, Homo sapiens
ggtacattggtgagtcacaatatattatgagttgtaccacaagtaatttgtgactcatgaagctaaagtacc

SEQ ID NO: 548939 - DNA, 72 bp, Homo sapiens
gctgccaggccaggccctcaggcaagggctctgaagtcagggtcacctgcttgccagggccgatcttggtgc

SEQ ID NO: 548940 - DNA, 72 bp, Homo sapiens
tcttggcaaaggataatctctggtcacatctgattgaagtcagttgtggcctgggccgatttctttgaggga

SEQ ID NO: 548941 - DNA, 72 bp, Homo sapiens
gctgtttggaatgcatgctgtctcagggttgggatgcaggacaagaggggagggagcatgcagagaggcggc

SEQ ID NO: 548942 - DNA, 72 bp, Homo sapiens
cctcttacttcttcagggcttccattttcccttctgggtaggagtacaaggaaggctgagaaaagtgagagg

SEQ ID NO: 548943 - DNA, 72 bp, Homo sapiens
tccctctttccccctggtttggcacatacctccttcagggagcctgagccgagtagggaggggactgaggga

SEQ ID NO: 548944 - DNA, 72 bp, Homo sapiens
tgcattttgatagtctcctagcctgtgacccaggacagattccttgcatgcataggagtttgtcaccatgca

SEQ ID NO: 548945 - DNA, 72 bp, Homo sapiens
tgaagacactggtggaattttttccatatgtggttcataatcacatgtagaattgatttcccagtctcctca

SEQ ID NO: 548946 - DNA, 72 bp, Homo sapiens
ctgttctcttttcctgctgagccaactgagggggagcctagccaggaggagcggcagatggagtgggagcag

SEQ ID NO: 548947 - DNA, 72 bp, Homo sapiens
ggggccttcctcaggctatgaaaaaatacttcatgtctaaccctaattttttccatagcttgaggttacccc

SEQ ID NO: 548948 - DNA, 72 bp, Homo sapiens
gggctttgaggttttcatgcctgatgatggccaggaacccttctcagtaggcattgaagaccagcagagtcc

SEQ ID NO: 548949 - DNA, 72 bp, Homo sapiens
ggagatcatgttaccatgacaactgattatttcattggtccaatgaccagttgccatggtgacaaaatcttt

SEQ ID NO: 548950 - DNA, 72 bp, Homo sapiens
aggtagggactgtggggacaggaggggtctgcgtattcctcttggatcccctgcctgtctccatccctgcct

SEQ ID NO: 548951 - DNA, 72 bp, Homo sapiens
ggtcttgtccttttttggcttctctgtactctggtgcacagctcacacttggctgggagaggacagatggcc

SEQ ID NO: 548952 - DNA, 72 bp, Homo sapiens
gcacgtaggcgaacacggtggcgagccggacccacttcttgttggtcttggccgccatcttcgccttcttgt

SEQ ID NO: 548953 - DNA, 72 bp, Homo sapiens
ggtctcagcagtggtcagcccaggaggtttttacatctgcctcttccctgtattgaaaatgctgctggggcc

SEQ ID NO: 548954 - DNA, 72 bp, Homo sapiens
gggtaattccagtttggtgcaataaattatatggttctgcttgatttgttttgctctgggctgggagaactc

SEQ ID NO: 548955 - DNA, 72 bp, Homo sapiens
gcctgagaggcaagcatggcgtttggagccaggcccatctgggttcaaatcccagctctgccactttctggc

SEQ ID NO: 548956 - DNA, 72 bp, Homo sapiens
gggggtcaccacactttgctaactcttgtgtgcacatattttataatagagtagcgagggaatggtgccgcc

SEQ ID NO: 548957 - DNA, 72 bp, Homo sapiens
gctgagcttctccaactgtcctccccacatgtgcccaatatgcagcgggaaggcagtgggaggaactgcagc

SEQ ID NO: 548958 - DNA, 72 bp, Homo sapiens
ggggtaacctcaagctatggaaaaaattagggttagacatgaagtattttttcatagcctgaggaaggcccc

SEQ ID NO: 548959 - DNA, 72 bp, Homo sapiens
gacgaactggagagatgcctgcgtggacagatggccagggcccacatgttcacggtttcttctcagggtgtc

SEQ ID NO: 548960 - DNA, 72 bp, Homo sapiens
taatcacacccctggggcattgcaagtcatgatccaaagataagtgtttttaacctcccaagggtgtgatta

SEQ ID NO: 548961 - DNA, 72 bp, Homo sapiens
ggacccaggccccctggggtctccttgtgtgaacctcacctccatgcaggggtctgcaggtggcctgggtct

SEQ ID NO: 548962 - DNA, 72 bp, Homo sapiens
ctggcccctgactgcagcccctggtgtggtggctttgggagtgacctgcctgggttctgtgtctgaggccag

SEQ ID NO: 548963 - DNA, 72 bp, Homo sapiens
gagggagggaggggcaagccgtgagccctcccgttgagaggagggggcttccggccttgcactctcttcttt

SEQ ID NO: 548964 - DNA, 72 bp, Homo sapiens
ctgccctgtgtgactgattgcttcttgtgttcaagttctgactgaaccagacagcaaatcagttgtaggcag

SEQ ID NO: 548965 - DNA, 72 bp, Homo sapiens
aagaagctttggcaggagtaggagagaaagtccttccctcctttcctctaccttttctcccaatttcttctt

SEQ ID NO: 548966 - DNA, 72 bp, Homo sapiens
gagactggggtggggagcgaggagagcactgcttcacgctaacagccacttttccttcacacttccagtctt

SEQ ID NO: 548967 - DNA, 72 bp, Homo sapiens
ctgcactaattgagaatgcaatctactatggcacctatttgctgatttttggagcatttttaatttatgtag

SEQ ID NO: 548968 - DNA, 72 bp, Homo sapiens
gggctttgaggttttcatgcctgataatggccaggaacccttctcagtaggcattgaagaccagcagagtcc

SEQ ID NO: 548969 - DNA, 72 bp, Homo sapiens
atttatcattacatggagaggaattttttctcttaagccagattgagttttctttccagggaatagatgaat

SEQ ID NO: 548970 - DNA, 72 bp, Homo sapiens
cccttcctgcgtgacgtaggctggcgtgggctcttcccccagccccttgccggtgctgccacgtgagaaggg

SEQ ID NO: 548971 - DNA, 72 bp, Homo sapiens
gctttcactggaggtcagtggagcactggggttgcaatgataggacagtgccctgggccttccaggacaagc

SEQ ID NO: 548972 - DNA, 72 bp, Homo sapiens
tattccctgacagatgagggagtattctcaggcagacctctagaatcactgtttccatctaggcagggtgta

SEQ ID NO: 548973 - DNA, 72 bp, Homo sapiens
gaggggcgggggtatcgctgtgggggaggagtctcggggctccccctccccaacgcacacccccgccgcctc

SEQ ID NO: 548974 - DNA, 72 bp, Homo sapiens
atcctcagtcggctgtataggtggatgctcagtttgatgacggtatccgcctgaatgagtcatgctgggggt

SEQ ID NO: 548975 - DNA, 72 bp, Homo sapiens
attgtgacaggtaaacacttgttttgaaagcttgcaggcatactattaaaacacaagtgttcttgacacagt

SEQ ID NO: 548976 - DNA, 72 bp, Homo sapiens
ctgagagaagaaggagcggcccttgtgaccagtgcccttttggttcacaaggaacgtctcctcttgttgaag

SEQ ID NO: 548977 - DNA, 72 bp, Homo sapiens
ttgagaggcccattagatcctggccatggatacagatgtataatcgtggccaggatctagggttttgctcaa

SEQ ID NO: 548978 - DNA, 72 bp, Homo sapiens
tgtggtcagtgagtctgggggtgtgtgtgtgggtttccgtactacatatccccggattttctagtgtccaca

SEQ ID NO: 548979 - DNA, 72 bp, Homo sapiens
agccctgtttcccaaatgtaaattccatcatcatcttgatcatgatggggttcactcctgggaaagggagtt

SEQ ID NO: 548980 - DNA, 72 bp, Homo sapiens
gtgtgcagtgagatgcctcactcgctctccacagggatgggggaggcgtcctgaggcatccacaagcaaagc

SEQ ID NO: 548981 - DNA, 72 bp, Homo sapiens
gtaggggaggcagtgttgaaaaggagagccagccagggctttgttctcccatcagccacttccgtctgctac

SEQ ID NO: 548982 - DNA, 72 bp, Homo sapiens
ggttgggaggggtggcagagtggtaagagatgttatcaataatctccctacctcttctcctccctccctgct

SEQ ID NO: 548983 - DNA, 72 bp, Homo sapiens
gtgggctgggcagggctccaggacatgtgactgggccttagaggcctgtcctgggccccctgccccacccac

SEQ ID NO: 548984 - DNA, 72 bp, Homo sapiens
cgggtacataaattcctggcatttctgcttgaaaagtcctgacagctgaaactgcaggaattcatgaacctg

SEQ ID NO: 548985 - DNA, 72 bp, Homo sapiens
gccttccggacacaggcggtggtctgggcaccccagggtgcagcccagagcagtggggtgtgttgggaaagc

SEQ ID NO: 548986 - DNA, 72 bp, Homo sapiens
ctggtgccttccacactgggggcggagccctctgcagagagcctggctctgcgtcctgtggctgagtgccag

SEQ ID NO: 548987 - DNA, 72 bp, Homo sapiens
ggaatcgaaactgtcattggatgcatttggttcatcagatccagattcagttcgatgtgcagttctggttcc

SEQ ID NO: 548988 - DNA, 72 bp, Homo sapiens
ctcttgattacaatttaaaagcataggtggcactctagaaagccacctatgccttttgaccataatcaagag

SEQ ID NO: 548989 - DNA, 72 bp, Homo sapiens
gatcgatctggcctggtggtgattctccagaaactccattcctcagggctgtgaccaccaagccaggtgatc

SEQ ID NO: 548990 - DNA, 72 bp, Homo sapiens
agacccctgggggtttcctttcataatgcctcaaaatgtagggttatattgttggaagtccccatggggtct

SEQ ID NO: 548991 - DNA, 72 bp, Homo sapiens
ttgtagcaggtatgtgctgagtgttcttctctcactctctgcatttggagcattcagcatataatcctacaa

SEQ ID NO: 548992 - DNA, 72 bp, Homo sapiens
aataattttctctttgggtctcagtttcctcatctaaaaagtgaggaaattggatcaaatgagtgggttgtt

SEQ ID NO: 548993 - DNA, 72 bp, Homo sapiens
ttcgcctaagatagttctgtatattcttctgttaactgggtagcaaaagcatatagaaaggttttgggggga

SEQ ID NO: 548994 - DNA, 72 bp, Homo sapiens
gattgcttcaaactgagcttcaagtggcagctgtgagtgctgcacataaaaggtagcagtttgaaagtgatt

SEQ ID NO: 548995 - DNA, 72 bp, Homo sapiens
tttccctttgtgaggggaaaaaaacaattgctgagctgataacatcagttaatttcctctggcagagggaga

SEQ ID NO: 548996 - DNA, 72 bp, Homo sapiens
gggcattgggtgattgggcctgcttatctttgtgacctcattacttaccctctggccctcactcaattttcc

SEQ ID NO: 548997 - DNA, 72 bp, Homo sapiens
ccagggtcagggatgcagggtgttggtttccatcaattcaaggccaggctgcaccctgctttcctgacctgg

SEQ ID NO: 548998 - DNA, 72 bp, Homo sapiens
gggattagggtctgggctggaaaaatcctggtgttttgaatatgttcaggtccagttcagactcttgatccc

SEQ ID NO: 548999 - DNA, 72 bp, Homo sapiens
agacaggcaggggatggggaggagaacaggactaaaagcagtcacctcttcctctcttcccccagcctatct

SEQ ID NO: 549000 - DNA, 72 bp, Homo sapiens
gtgggtggggcagggggcccaggacaggcctctaaggcccagtcacatgtcctggagccctgcccagcccac

SEQ ID NO: 549001 - DNA, 72 bp, Homo sapiens
ctgttcttttagtaaaatgtggtaaaggaacaagcacatgtgccttccatcagccatgttgtactggaatag

SEQ ID NO: 549002 - DNA, 72 bp, Homo sapiens
tctaagcctctggggaccactcaggcaggcaggtgaccacctgggtgtcgtgtgttccctgaggggtttgga

SEQ ID NO: 549003 - DNA, 72 bp, Homo sapiens
ttaggacattgcttgatgattcatagcaaggtcctttagacattaatgtgagttatctaagtacagtcctaa

SEQ ID NO: 549004 - DNA, 72 bp, Homo sapiens
actgattgatgaacttcagcttttggcttggtgagagcataaaataagagcagctgaggtttccaaattagt

SEQ ID NO: 549005 - DNA, 72 bp, Homo sapiens
cccatcgtcttctcccctccctcccagattttttataaacaaactggcgaagggaaaggagggagtgacggg

SEQ ID NO: 549006 - DNA, 72 bp, Homo sapiens
ggttgggagagcggggttgggggcggaccccagggccgcacccctggtcccccccatcccctttctaccgcc

SEQ ID NO: 549007 - DNA, 72 bp, Homo sapiens
gagatgtgaagtttgagatgtctattactcatctaagtggagtttgcaagtaggcagtcagatatacatctc

SEQ ID NO: 549008 - DNA, 72 bp, Homo sapiens
gggttttcaaaggaggcagagtagccaagctcttggcacaagagccagctgtactgcctgctcaggaaatct

SEQ ID NO: 549009 - DNA, 72 bp, Homo sapiens
gcactgcccacatttccaaagatgccagtcactgaactccgagtggagctggcttgtggaagttgggcttgc

SEQ ID NO: 549010 - DNA, 72 bp, Homo sapiens
ggctgttcctggggcaagggagatgggaggaatttaagaaagagtgggacagctttgccttaggagcagacc

SEQ ID NO: 549011 - DNA, 72 bp, Homo sapiens
aggcagacactgtgtttgatgccaataatggttgccagtggcaccgaggttggcatcagaccctctttgtct

SEQ ID NO: 549012 - DNA, 72 bp, Homo sapiens
cattatctgtgtgtatttagattactcataaatatgtgttgaatgagttaaatttagatacctcggatgatg

SEQ ID NO: 549013 - DNA, 72 bp, Homo sapiens
ggcagaggccaggactggactcagacttttgcctcacaaagctgtgaggactctgaaggtcctgcccctgcc

SEQ ID NO: 549014 - DNA, 72 bp, Homo sapiens
tcctgtttgaaggttgcggcagcttcgggaaggagctctccgactccgggctgcctttgcctttaaatttga

SEQ ID NO: 549015 - DNA, 72 bp, Homo sapiens
ggatggaggggtgggggaccccaggagactcaagcctctgaagcctcctgtcctgtccccctgcccaccccc

SEQ ID NO: 549016 - DNA, 72 bp, Homo sapiens
ctgcccttggagatcataccagcatttatttcaaatcgatgttgaaaaataaatggtaatcctcaaggggag

SEQ ID NO: 549017 - DNA, 72 bp, Homo sapiens
cagggccactctgctgcctgtcgggtccctgcccctgggggctgcccagagcggttagcagagctgggcctg

SEQ ID NO: 549018 - DNA, 72 bp, Homo sapiens
gacttgttttgttactcaaatagagttctcgtaactagttaagtgaacttggattaggtaattggacaagtt

SEQ ID NO: 549019 - DNA, 72 bp, Homo sapiens
tcaagctgtgtccagttctgttacatgacaagcctcctgaacatgtcctcagcaggacacgacataagttga

SEQ ID NO: 549020 - DNA, 72 bp, Homo sapiens
gccaggctctgcccacctagacccccgcttcggcctaacagggagctgggggctgggctgggaggacttggc

SEQ ID NO: 549021 - DNA, 72 bp, Homo sapiens
caaaccagatttggctccaagtggctactcatccttgggagcaagtgacaacttggagccagactttatttg

SEQ ID NO: 549022 - DNA, 72 bp, Homo sapiens
atcacacataagagatatgttaaactacttatgctttggcaccagtggcaagcaattttcttatgcagtggt

SEQ ID NO: 549023 - DNA, 72 bp, Homo sapiens
ctttcaccttctgactgttctgtctatagcaaaccatagagagtttttctggacagtccaggaaggtgtaag

SEQ ID NO: 549024 - DNA, 72 bp, Homo sapiens
tctgattcagtttggtttcccttatctaaatgtccactcgtgaactagaatgaggtgaccagatggtccaga

SEQ ID NO: 549025 - DNA, 72 bp, Homo sapiens
gtggtggtgattgaagagcagatgtttggcttccctatattatttatcttgctcttctctaatcctcatcac

SEQ ID NO: 549026 - DNA, 72 bp, Homo sapiens
ccccttactgtggtcccacgtccctggccagtgagtggccggtgacctgggggatgggggctatagatgggg

SEQ ID NO: 549027 - DNA, 72 bp, Homo sapiens
tgtcccattagagttcaggagaataagattcacttatgaactgagtcgtatttttctgtctcttaaaattca

SEQ ID NO: 549028 - DNA, 72 bp, Homo sapiens
gcgcggcccctcctttgtctcaggggtgccctgagcacagaggcctccaggtgagcacaggaggggcggtgt

SEQ ID NO: 549029 - DNA, 72 bp, Homo sapiens
gtggttagcctggtccaagggtctccactcccttcctagcatcctagagatcctggaggctaggttggccac

SEQ ID NO: 549030 - DNA, 72 bp, Homo sapiens
agccagtcggtccctcgggccagggcaggaagcgagagtctctcttaccctggtgcgtggggccgcagggct

SEQ ID NO: 549031 - DNA, 72 bp, Homo sapiens
ctgttgaaatgttaattccattgttggatgccacagctgtgagcattactcatgggatcaacattctattag

SEQ ID NO: 549032 - DNA, 72 bp, Homo sapiens
cttaatataggtacctcagggcagtgttccaggtgaggcctgaaaacaaggtcctttgggtacttcagtaag

SEQ ID NO: 549033 - DNA, 72 bp, Homo sapiens
gagggtaggttctgttggttgaaatggaaaatcctaaaaaagaggtccttgcactaattagtacctaccctt

SEQ ID NO: 549034 - DNA, 72 bp, Homo sapiens
tgtctactgaagcatgcttatatgtcttgtgtcttctgctgcacttgagcattaggtgtgtttcagaggata

SEQ ID NO: 549035 - DNA, 71 bp, Homo sapiens
ggataggcgggctggggtcggaggtcggcggccagaagccagattcccttggccccagctcgtccacttcc

SEQ ID NO: 549036 - DNA, 71 bp, Homo sapiens
gggctggggaggctggaggggagatttcctggcagcaggatccatgaccacctctccctcacccccagccc

SEQ ID NO: 549037 - DNA, 71 bp, Homo sapiens
ggtaaaggatggtccagggaatcctatgtgctgttttctttgctaggatcctctgagaaccctccttcact

SEQ ID NO: 549038 - DNA, 71 bp, Homo sapiens
gctctcattacagactttcattcttgggacgaagacggtaataagagtggaatgtcgtgtaaaaacagagc

SEQ ID NO: 549039 - DNA, 71 bp, Homo sapiens
gtgactatatattaatgagactcagtaatccaacccacacctgagaactcgtctcattactttatagtcat

SEQ ID NO: 549040 - DNA, 71 bp, Homo sapiens
gctctgcagggctttggttgtggctgcttctccactgctctgctgcttgctcagccagagccctgccaagc

SEQ ID NO: 549041 - DNA, 71 bp, Homo sapiens
cagcatgtcagagtccctcagtggagcgtgttaacttgaagagctggtccagtggggatctctgatatttg

SEQ ID NO: 549042 - DNA, 71 bp, Homo sapiens
ttacatatttccagtctccattcttttcttgtatcccagagcataaagaactgagactgggaggtatttaa

SEQ ID NO: 549043 - DNA, 71 bp, Homo sapiens
tctgccttccagggaactcctggagagtagagatttactcttcctttccagagtcatctgtgagggcaaga

SEQ ID NO: 549044 - DNA, 71 bp, Homo sapiens
gcaccggcagttttcggtccccagggaggtacgaggagtttgcttcctggtggacggagactggccggtgt

SEQ ID NO: 549045 - DNA, 71 bp, Homo sapiens
cctcttccccagctccccacctttcctccagagaaaaaggcagacaagtggggaaagctggggctagatgg

SEQ ID NO: 549046 - DNA, 71 bp, Homo sapiens
taatgcggtttcctatgtgggccaattaaaagctgcctgttaaggttcactgctctataggaaacccattg

SEQ ID NO: 549047 - DNA, 71 bp, Homo sapiens
gtggctgtaagggtctgtgtggatgcacctcctgccaacctgggagcgtccacccagactgtgcagcccac

SEQ ID NO: 549048 - DNA, 71 bp, Homo sapiens
ggctgcctgttggggcagtgcagggccagatagaggtgctaggctcctgtgattgcctcgcccaggccacc

SEQ ID NO: 549049 - DNA, 71 bp, Homo sapiens
cagagccagaagcaagggccaaagtcttctctgagttgtcaagatggacttggactctggctctggctctg

SEQ ID NO: 549050 - DNA, 71 bp, Homo sapiens
tttgttcctgagctgagctgcggggaatcaccctgtttgaaatcctcgatcagctcatgctagagaagaga

SEQ ID NO: 549051 - DNA, 71 bp, Homo sapiens
aacagggaagagaaatggggcagcagcactttagagtgacttacttctctcttgttttctcctccctgaat

SEQ ID NO: 549052 - DNA, 71 bp, Homo sapiens
cccaggccggcccctccgagcctccgcggggatactacggccccgccgggacggagagggcgaggccgggg

SEQ ID NO: 549053 - DNA, 71 bp, Homo sapiens
gagatggggtgcggctctgagggggtagcactgatcagccacatgcccttcagcaagtcgcatcccctctc

SEQ ID NO: 549054 - DNA, 71 bp, Homo sapiens
cccacaaggcacgtgtgtcctgaccttttattgctttcttctggtcccagatactgtgtcttaactgtggg

SEQ ID NO: 549055 - DNA, 71 bp, Homo sapiens
gctttgaggtcttggaagatgttgcaccagtatgagaatagggggtcagtttcctccaggatccagaaagc

SEQ ID NO: 549056 - DNA, 71 bp, Homo sapiens
aattgcttcagttttcctggaattgaggcaggccataaacctatcagtgactcaagaaaatggaagcaatt

SEQ ID NO: 549057 - DNA, 71 bp, Homo sapiens
ggtgtctgacttggccattcagacaattgcccccttgtgggaatgcgggaatgaatggtacagtggacacc

SEQ ID NO: 549058 - DNA, 71 bp, Homo sapiens
ccttggccatcagggcagatgctggggaaggcgtatctcccagaagtctcatctccttggtgggcccaagg

SEQ ID NO: 549059 - DNA, 71 bp, Homo sapiens
ctaccttcactagtagttctcctttagtcttggtctcactcattagtagagaaccttgctagagagggtgg

SEQ ID NO: 549060 - DNA, 71 bp, Homo sapiens
atggatatttacctgatagattaggatggttgactttagagtagtcttgctctattaggcaaatgatctat

SEQ ID NO: 549061 - DNA, 71 bp, Homo sapiens
ccagggacaggtaaacgcaggaaggaattaaacaaagcatgttgacttcccagggcgtgcctggttcctgg

SEQ ID NO: 549062 - DNA, 71 bp, Homo sapiens
ctgaaataggtactattcccattttgtagacaaggaaactgagactccaagaggtgaaagtgcttatgcag

SEQ ID NO: 549063 - DNA, 71 bp, Homo sapiens
gggtgatttgttcatggccccatcttggtgtccagtctggccttgaaagggggtcttggaacaggtggccc

SEQ ID NO: 549064 - DNA, 71 bp, Homo sapiens
tcagaggaggagctgcctggcagaggggctggtgctggggcagagggctggctgcgggcagccctcctgga

SEQ ID NO: 549065 - DNA, 71 bp, Homo sapiens
gttcagttatcacagtgactgtcattttaacaattgtgcaagtgcatcattcactgtgggtgactagaaac

SEQ ID NO: 549066 - DNA, 71 bp, Homo sapiens
gactgggggagaggtgaaggctgccctgggttggccccagccctggggaggagcgttcaccctttccagtc

SEQ ID NO: 549067 - DNA, 71 bp, Homo sapiens
tgggtgggaaatgaggggtgaggcttgttttataggattcctatcttcaggctcccctcagattccactca

SEQ ID NO: 549068 - DNA, 71 bp, Homo sapiens
cccttcctgacagcccgggctgtggcagtaggcagggctccctcccacaagctcagggcctgcgggaaggg

SEQ ID NO: 549069 - DNA, 71 bp, Homo sapiens
aatggggtctacattgcattctggaaaatcgtatccaaaccacatccactgagcaatctgtagacctcatt

SEQ ID NO: 549070 - DNA, 71 bp, Homo sapiens
gtatatataatgattttacgggcagttgatgacttgaaacctagactgtctgttagagttatagtgtatac

SEQ ID NO: 549071 - DNA, 71 bp, Homo sapiens
gggagggaggcagagccaggtcctccctggctgggttgcccagccatgtcctgagcgtctgtcttgctctc

SEQ ID NO: 549072 - DNA, 71 bp, Homo sapiens
agccaccgcacccgcatgtcctggtcctttcagggctccctgaggcggccaggacagaggtggaggtggct

SEQ ID NO: 549073 - DNA, 71 bp, Homo sapiens
gtgcgcaaaccctcccctcaccccaattcccggtggttctgagagatgaggtgaggtggggagggggccac

SEQ ID NO: 549074 - DNA, 71 bp, Homo sapiens
ctgtggggaggtggtgtggctgtcgtctacacatagatgtactcattttggccaaattgctatccttgcag

SEQ ID NO: 549075 - DNA, 71 bp, Homo sapiens
ccaagccttctgcagggactttgttcaggcaaagttgtgacttgactctggacaaggccggtgaagcttgg

SEQ ID NO: 549076 - DNA, 71 bp, Homo sapiens
tgacatctccactctgctccttccgcccagcatgtcactgagtgtgggtggggtgcagagatgggggtgca

SEQ ID NO: 549077 - DNA, 71 bp, Homo sapiens
gctgaccaatggcatcaaagagctgggcccctacaccctggacaggaacagtctctatgtcaatggtgagc

SEQ ID NO: 549078 - DNA, 71 bp, Homo sapiens
tggggctgggatggagctgtgtgcagggcgcatgtccaaagcccctgtacagtggctgggggccagcctca

SEQ ID NO: 549079 - DNA, 71 bp, Homo sapiens
gagctggggtggaccgcggtttctgctgagagcatggcggctacaggggaaactgaggcagcccacagctc

SEQ ID NO: 549080 - DNA, 71 bp, Homo sapiens
gggagtttgctggcttgttcacaggggaggggtcagagattatctcccttctggaaaactcagcaaacccc

SEQ ID NO: 549081 - DNA, 71 bp, Homo sapiens
cctaggcctgggggaggggaagcagtgacagggccatcctatctgaattctccccaccctcatctcctagg

SEQ ID NO: 549082 - DNA, 71 bp, Homo sapiens
ggtgctgccgtcagaaggcacaaaatattttcagtgggtttagccatgttattgtgctctggctcagcacc

SEQ ID NO: 549083 - DNA, 71 bp, Homo sapiens
gagaccctgagattgaacatcagcaggcgagggggtccctcttccctgctctgttctggtctcagaggctt

SEQ ID NO: 549084 - DNA, 71 bp, Homo sapiens
gagaagtgaaaatttagcaagggcaaattcacgagggactctgagtatcttgctaaatattttggcttttc

SEQ ID NO: 549085 - DNA, 71 bp, Homo sapiens
ccagggctgagacagagggcgttggcaaggatgctgctccttcaggctgtgacccctctgtctttgcaggg

SEQ ID NO: 549086 - DNA, 71 bp, Homo sapiens
ttcttgccttccctgctgagagctgctctacccttttttgcaggtgctttggctctagcagacaggaagaa

SEQ ID NO: 549087 - DNA, 71 bp, Homo sapiens
gccgggtctggctgggagacaggcgccgggtgggaacacttagccaagtctccctggtcagaattccctgc

SEQ ID NO: 549088 - DNA, 71 bp, Homo sapiens
tggcgggggaaggggcacggagcggaagagggggatgcaaaacccacctctttctggtctcttccctccca

SEQ ID NO: 549089 - DNA, 71 bp, Homo sapiens
gggtgttgtgccttagtccctgcctctgcctcttgggaacagaagttggtgggagtgaggacgagaggccc

SEQ ID NO: 549090 - DNA, 71 bp, Homo sapiens
ggaggtatatatcctgcagctcatgctgtaccttagacatgccagtatgggtcgggatatatttagtctct

SEQ ID NO: 549091 - DNA, 71 bp, Homo sapiens
gtggggggggccagtgaggcagggacacatgcaaaagaatgacctcactctgccagcttgctcctccccac

SEQ ID NO: 549092 - DNA, 71 bp, Homo sapiens
ccgctggccctggggcaggagggtacagggagttggccctgagcccctctgacctcagagccgaggcgcgg

SEQ ID NO: 549093 - DNA, 71 bp, Homo sapiens
ggtggggaatggtctaggggatcttgcgagttgttctttttgctaggatcccccaagccccttccttcact

SEQ ID NO: 549094 - DNA, 71 bp, Homo sapiens
ctcttgcgtgccccggccacccccgggcggcttgtagccggtgcgcggggtggctggggctacgtgcagag

SEQ ID NO: 549095 - DNA, 71 bp, Homo sapiens
aggtatgcctgaaggtttagtctaagagggcatatggaacatcccacttatgactaaaagtaggcaaacct

SEQ ID NO: 549096 - DNA, 71 bp, Homo sapiens
cacccgcgggcccggggccttgcacaactctttaaataaccatgttttgcaaggcccgcgccgagcgggtg

SEQ ID NO: 549097 - DNA, 71 bp, Homo sapiens
ggtcgatgctgccctgtttggacagcccggtcttccggggccgcacgttgtccagctgggcatcgtccacc

SEQ ID NO: 549098 - DNA, 71 bp, Homo sapiens
ttcagagaggatgcttaatttttttgtattgcctcccttttaggagataaaaaccaagcatgctttttgga

SEQ ID NO: 549099 - DNA, 71 bp, Homo sapiens
tcaaccagactatttctgtttagttaatttggataagaaatttttcagaggatagcaggaatagtagttga

SEQ ID NO: 549100 - DNA, 71 bp, Homo sapiens
gagtgggagagggtagattttggaagtagtcacagttgatcctatagttcctggtgtacctcctcccactc

SEQ ID NO: 549101 - DNA, 71 bp, Homo sapiens
ttcctcatcgagcccagggctgaaattctggcaagtgctcagccagtgtaggcctctggcttgaaagggaa

SEQ ID NO: 549102 - DNA, 71 bp, Homo sapiens
ttaattcagatcaatatcaatcaggagataaacaagtgtttgtctcttgattggcatttacctgagattaa

SEQ ID NO: 549103 - DNA, 71 bp, Homo sapiens
gcctcctcattggtctgtgtccatcgtcattactctgtggtgtattctcaacacagcagccagagtgaggt

SEQ ID NO: 549104 - DNA, 71 bp, Homo sapiens
acattcccaggtacatcattagccaactgggactcaataaggatcccttggaaggtgagtccctgggttgt

SEQ ID NO: 549105 - DNA, 71 bp, Homo sapiens
ccgctcccatggccccggaccttggcaacgctgcgcagcgcgtcagtcaacgtcacagggcgtgggggtgg

SEQ ID NO: 549106 - DNA, 71 bp, Homo sapiens
ctctggggttccaacaattttcccgtttcccctgacaattccagttgcatggtaaattgttggaactggag

SEQ ID NO: 549107 - DNA, 71 bp, Homo sapiens
cccaaggcccttctggaaccttctgcaagcctactgtaggagtgaggaggaggtgcgggaaagggcctggg

SEQ ID NO: 549108 - DNA, 71 bp, Homo sapiens
ggaggcagagaagggacaggaaagaaggtggccaatgactctgtggccttgctgtgcctttgtctgcctcc

SEQ ID NO: 549109 - DNA, 71 bp, Homo sapiens
aattggctcaatatctccctgttgctgtaacactttgggatttttctaggtgagatataaataagccaatt

SEQ ID NO: 549110 - DNA, 71 bp, Homo sapiens
gcttctggtcagggcccctgagttccacgacaccgtcaccggttcggggaagtagtccttgaccaggcagc

SEQ ID NO: 549111 - DNA, 71 bp, Homo sapiens
agagtgggggtgtggtagataattaggtttcttccatatttagatcctatgatttatgttacccccactct

SEQ ID NO: 549112 - DNA, 71 bp, Homo sapiens
tagtgttgctttcttaatggcaaattattttttcatggacatgaaactttgccggaagacaagttgcactg

SEQ ID NO: 549113 - DNA, 71 bp, Homo sapiens
gttcccttaccaggctcctctttgctctccgcagcagaatcaataggggggaggggcctggagtggggagc

SEQ ID NO: 549114 - DNA, 71 bp, Homo sapiens
gacggagactgagggatggtgggcttgtgcatagtggttctggcagctcatctgcaccttggttctctgtc

SEQ ID NO: 549115 - DNA, 71 bp, Homo sapiens
gggtctggcacataataaatgctatgtgagtattatctactatactctcaatttttatatgtgacagagtc

SEQ ID NO: 549116 - DNA, 71 bp, Homo sapiens
agtgtgattaatcaccatggatgtatgattgagtcaattgactgttactttttcatgatgattaatcagct

SEQ ID NO: 549117 - DNA, 71 bp, Homo sapiens
tgggtccagactgggtgagaaccgccaggacagaggcttgctgtcctggttctgcacttggtcctgagcca

SEQ ID NO: 549118 - DNA, 71 bp, Homo sapiens
gcccctctctcactccagtcagagtcagcctggcaggaggtcatgactcagtctggggtgcagaattgggc

SEQ ID NO: 549119 - DNA, 71 bp, Homo sapiens
aaggtctaactaaaacactcccctacgaggtgaataaaatacctcacaacaccggagttttttggtgcctt

SEQ ID NO: 549120 - DNA, 71 bp, Homo sapiens
tgtttggtagttggggtcgggtttgtagtattgcagtgtgctttaacaagcatgggctttgacatcagaca

SEQ ID NO: 549121 - DNA, 71 bp, Homo sapiens
ttccctgtgagtcactgagttttgggcatcacatcaggtaaacaagaactcagttgtacattcacagagaa

SEQ ID NO: 549122 - DNA, 71 bp, Homo sapiens
ggtatggttctgtggttgttgtctgtttgcggttttattgctgaattagtagtaaccacagtaatcacacc

SEQ ID NO: 549123 - DNA, 71 bp, Homo sapiens
tttctcaggtttataacttgaacaagaggaaacagtgtatatcctcttgcttaagccataaattttggaaa

SEQ ID NO: 549124 - DNA, 71 bp, Homo sapiens
gaggaaaatgtatcttcgtgtctttattatgtcatcagcttatggcttgaagcataaagataaatttcttc

SEQ ID NO: 549125 - DNA, 71 bp, Homo sapiens
accctgtggggatttgtctacctctttgtcttggttctgagaagagggagggagagaaagactgcagaggt

SEQ ID NO: 549126 - DNA, 71 bp, Homo sapiens
gcccaggtttctagactcctaggctatccagggccctcagggcttgtggtgagggttggggagcctggtgc

SEQ ID NO: 549127 - DNA, 71 bp, Homo sapiens
agatactagttatcatagcttcacttaatacttctgacttgtagtaagtgaagttatgttaactaatattt

SEQ ID NO: 549128 - DNA, 71 bp, Homo sapiens
cccggttcccagactgcactggaacactgggctttatgcccccacattcagtgcatttggtgggtactggg

SEQ ID NO: 549129 - DNA, 71 bp, Homo sapiens
gtcattatgctccatcttgtcagtaatcttcttgttaaagagcactcgttgacatgatgagcaataatggc

SEQ ID NO: 549130 - DNA, 71 bp, Homo sapiens
aagggctgatgagcagatagtgggaagacaggaccttctcacaccgcctctcccaccctgccatggccctt

SEQ ID NO: 549131 - DNA, 71 bp, Homo sapiens
aagggccatggcagggtgggagaggcggtgtgagaaggtcctgtcttcccactatctgctcatcagccctt

SEQ ID NO: 549132 - DNA, 71 bp, Homo sapiens
atgggtggaagggagaaaacttgtggcttattgtaaaagtggccatgtgttattttcttctctctatccat

SEQ ID NO: 549133 - DNA, 71 bp, Homo sapiens
ctgcaccctggtccgggcagccctccatctctctagttgacaaccctgtctgcctgctaactggggtgcag

SEQ ID NO: 549134 - DNA, 71 bp, Homo sapiens
tggaggaaagggtaggccagggaggaagagaaggtagcagagtctcctcccctctgtagccctttccctca

SEQ ID NO: 549135 - DNA, 71 bp, Homo sapiens
agggagggagcaggagagggaaggaaaggccacgcaatcccagccctgccccctccctctctccactccct

SEQ ID NO: 549136 - DNA, 71 bp, Homo sapiens
cttatccttttatggtgcttttttgaagttaaggaaccttagcttcagaaatgctgtgatcccaggatagg

SEQ ID NO: 549137 - DNA, 71 bp, Homo sapiens
gacagctcctccccgccccctctgccggccccacttcctaggcggcggagcgggtcggggagggaagggtt

SEQ ID NO: 549138 - DNA, 71 bp, Homo sapiens
atttggtcaagctgacagctatgagcaaaatgctacacaggagttgcttgtggctattcttatgaccaaat

SEQ ID NO: 549139 - DNA, 71 bp, Homo sapiens
ggttaaagaaattcactcctgggctgagaaattatatgtcaagctatagcctaaagtgaatttttatggct

SEQ ID NO: 549140 - DNA, 71 bp, Homo sapiens
gcgaatagagttttccattttgtttcacattagggtctcctgagaggcaaaggactggaaaacactatagc

SEQ ID NO: 549141 - DNA, 71 bp, Homo sapiens
cagggctgccgccagcctcactcatcacacagaattagtgggtatgtgagtgctgtggcatggcagctctg

SEQ ID NO: 549142 - DNA, 71 bp, Homo sapiens
agaatgaggcaggtagctgggctccaggaagctcacatgcttttaaagctccagttaaatagctttaagct

SEQ ID NO: 549143 - DNA, 71 bp, Homo sapiens
tgccagaaaggaaatgaggtttgtctggctgagccggtcatggcaggcaagcctcatttccgtctttggca

SEQ ID NO: 549144 - DNA, 71 bp, Homo sapiens
aaatgtttagaggaaatctgttgctgggatccaaagtttaatgtcagcaattttatttcctcttctcattt

SEQ ID NO: 549145 - DNA, 71 bp, Homo sapiens
atttgggagagtttctccctagcatttggtatggaattattaccaaatgctagagaggaaccctgccaaat

SEQ ID NO: 549146 - DNA, 71 bp, Homo sapiens
gctggttttaggcaggtgtgatattagcgcctgaaacgggaaataaatcacacctgcctttgaaccccagc

SEQ ID NO: 549147 - DNA, 71 bp, Homo sapiens
tagaaatacaaaatgtaaggagacacgggacttctgatagccctttcttctttccacattttgtgtctctg

SEQ ID NO: 549148 - DNA, 71 bp, Homo sapiens
gctttccagcttcctcaataggaatggaaaccaaactccgaattgatgactcctttgaggaagccgagagc

SEQ ID NO: 549149 - DNA, 71 bp, Homo sapiens
atattggttccaatatttctcacatatggaaaatgtcattttccctgggaattaatatttggaactggtgt

SEQ ID NO: 549150 - DNA, 71 bp, Homo sapiens
cttcagctcggacagttgtttcagatgtttccaattcgtcggactgctcagacatctgttcctggttgaag

SEQ ID NO: 549151 - DNA, 71 bp, Homo sapiens
cctgggtggggccaggcccttcaggctgcagcacagggctgagtatgaagggcacgttgcccccatctagg

SEQ ID NO: 549152 - DNA, 71 bp, Homo sapiens
actgaccaatgacattgaagagctgggcccctacaccctggacaggaacagtctctatgtcaatggtgagt

SEQ ID NO: 549153 - DNA, 71 bp, Homo sapiens
gggtacctggccaggccccttgcagggcagaacctcaggtgaatgggcctctcagggtctggccgggtccc

SEQ ID NO: 549154 - DNA, 71 bp, Homo sapiens
tccttcaagccatggctcaggacagtcagtacttctaaggggttttctgtccttccatgatgtttggggga

SEQ ID NO: 549155 - DNA, 71 bp, Homo sapiens
gagcaggaatagaagctctgttgctatggtagcaaatatgccttatactcatagaccttctattttctctc

SEQ ID NO: 549156 - DNA, 71 bp, Homo sapiens
tcttggtttttgcccacctgggagtcaaagctttgaatgcttattgattttcatgggaagcaagacctaga

SEQ ID NO: 549157 - DNA, 71 bp, Homo sapiens
ctgttttgtcatttcgggcatggagtcctggttctattgcagggccttgtctccatggaaatgaaaaatag

SEQ ID NO: 549158 - DNA, 71 bp, Homo sapiens
taattaccagtgtgggaacggctttatgatcctcaagggccctgaaagagccccccacatctggtcaatta

SEQ ID NO: 549159 - DNA, 71 bp, Homo sapiens
tgccctagcagcgggaacagttctgcagtgagcgatcggtgctctggggtattgtttccgctgccagggta

SEQ ID NO: 549160 - DNA, 71 bp, Homo sapiens
ccagagcagtgaagggatttcctcactgggctctgctctgaggcagatctgaggagctctgttcactctgg

SEQ ID NO: 549161 - DNA, 71 bp, Homo sapiens
gggttagggtgaaaggtataaatgaatttgattccaagagcaatctggaagggaccttcgcctttgacacc

SEQ ID NO: 549162 - DNA, 71 bp, Homo sapiens
aaaggcatgtcatcttgtttggaaagtatctattgattttccagttcatcagatcaggttgatgtgtcttt

SEQ ID NO: 549163 - DNA, 71 bp, Homo sapiens
cggtctcaccaaacgccccaaactctcctccacaccccctctgagtgccctggggcgcctggctgaggctg

SEQ ID NO: 549164 - DNA, 71 bp, Homo sapiens
tgaattctggccaagggtcaggcccctagcatacaacatgagtggccaattgacttgtggccagttcttca

SEQ ID NO: 549165 - DNA, 71 bp, Homo sapiens
gcacccagccccatccagaccagtggcctcaggggacgatggattactgggaatttggtggggtggggtgc

SEQ ID NO: 549166 - DNA, 71 bp, Homo sapiens
aggggctcctccactccaggtccttggggtatgtgtacccccagaggagggcggagtagtgaggagaccct

SEQ ID NO: 549167 - DNA, 71 bp, Homo sapiens
ttttaattaagcaataagttagatgtcaagagcaattagagtcttgaaggtcaaagcttgcttaattaaag

SEQ ID NO: 549168 - DNA, 71 bp, Homo sapiens
tgtattgaaataagaggattgctaatgtgtattcctgacattttagcagtatcaaatctgatttcatcaca

SEQ ID NO: 549169 - DNA, 71 bp, Homo sapiens
gggtggggtcaggtgtgtgcacaggtggcccaggttcccctgcagcctgcagccattgcctggccctgcct

SEQ ID NO: 549170 - DNA, 71 bp, Homo sapiens
aacattgagatgtgcctagttctgtatttacagtttggtctggctgtttgagttctagcgcatttaatgtt

SEQ ID NO: 549171 - DNA, 71 bp, Homo sapiens
gtgtaggggtaggggaatggagccaggaactgctcagtcctgcaacgacatccctttcccttcctttccac

SEQ ID NO: 549172 - DNA, 71 bp, Homo sapiens
gcttccctccaactgactgtcctaatcaggctccagaggggaggctgattggagctgcggtgggtggaagc

SEQ ID NO: 549173 - DNA, 71 bp, Homo sapiens
agtgaagcccgttattgttcattagcacaaagaatgtgtaataaatataatgaaagactgctggctttact

SEQ ID NO: 549174 - DNA, 71 bp, Homo sapiens
agataaactcatgccaagaaatgatcctggaaatatatttcagactgatggtttctggtctgagtttatct

SEQ ID NO: 549175 - DNA, 71 bp, Homo sapiens
gtttaattttagtgtgggctgctttgaattttgctttgacaatcaacaggggctcacagtaatgcttagac

SEQ ID NO: 549176 - DNA, 71 bp, Homo sapiens
ggaggttgggtaaggaaggagaaattgagatgtgcacgggcccatcacaccttcccccttgctcaagcttt

SEQ ID NO: 549177 - DNA, 71 bp, Homo sapiens
tcttgcatggcgtccggagctgtctcctctccctaagcacaaaggccagctccagagatgctgtgcagaga

SEQ ID NO: 549178 - DNA, 71 bp, Homo sapiens
cctataattcatgcaaattgatccctaatgagatggaaacaagccaggttttaatttgttgaacttgtggg

SEQ ID NO: 549179 - DNA, 71 bp, Homo sapiens
tcacaggtgatggagagagacagagctcagctgagagaccagtgctggcctgtctctcctctgtcctgtga

SEQ ID NO: 549180 - DNA, 71 bp, Homo sapiens
ttgaagaccagaaattgttatatatacatctgtttatctctctatgtatgtatagcatcttctaacttcaa

SEQ ID NO: 549181 - DNA, 71 bp, Homo sapiens
tctggtcttttttatctgctcattctgtgattcagaaattgaggaacataactcagataaaaggactcaga

SEQ ID NO: 549182 - DNA, 71 bp, Homo sapiens
actctagacagggaggagaagttgaccaagcagctacctctgtcccccaggcttctccttcctctttgagt

SEQ ID NO: 549183 - DNA, 71 bp, Homo sapiens
ctaaaaggtggatgttccttctatgcttacaggatttatggtgaatcatagaggaaaatccgcattttcag

SEQ ID NO: 549184 - DNA, 71 bp, Homo sapiens
agcgagggtgcagggctggggtactaatattagatggacactatccatggtacccctgcctcagccttcct

SEQ ID NO: 549185 - DNA, 71 bp, Homo sapiens
caggcctgcctagatattttaggggtgagtcttttggaaattgccccactgtgatttctaggtacagcctg

SEQ ID NO: 549186 - DNA, 71 bp, Homo sapiens
tctaagactcctcacattttctgggatctcaaagaaagatttccctatgaggaagaagtgaggctcttgga

SEQ ID NO: 549187 - DNA, 71 bp, Homo sapiens
gctacagttctgtctaggcagtggcttgggtttttatcgagcaacaacttagacacgtgactgtaatatgc

SEQ ID NO: 549188 - DNA, 70 bp, Homo sapiens
ctctgcctcaagggaaatgaggagaaaaaaaaaatacagttctttccacatttccccctagaggtgagag

SEQ ID NO: 549189 - DNA, 70 bp, Homo sapiens
aatcacctgagacatttttcaaaatacatatggtaaccatgtgtatttggaaaagaattcccatgtggtt

SEQ ID NO: 549190 - DNA, 70 bp, Homo sapiens
tccagtccattggggcattattttgcacattgaagtggcaatttattaaaatagtacccctgtggtctga

SEQ ID NO: 549191 - DNA, 70 bp, Homo sapiens
tggttcctcagtttcattttgaccctcacttccagctgcaaattgagggttcatgaaattataggagcta

SEQ ID NO: 549192 - DNA, 70 bp, Homo sapiens
attgctttttctagtggttgcatgattatcatgcctctgatgataaatctgcacccactgaaaatgcagt

SEQ ID NO: 549193 - DNA, 70 bp, Homo sapiens
gaagaagatgctgcttgttcacgggcatttttattacattaggatctctgagctcgtgcagtacttcttc

SEQ ID NO: 549194 - DNA, 70 bp, Homo sapiens
ttgttcctccattacactgtcccccagttagggatttggcctctgacagtgtaatgagttgggagagcaa

SEQ ID NO: 549195 - DNA, 70 bp, Homo sapiens
tgggctgtggttgcttccagtgcctgtttagaattattcagcaggcatggaagcaataaaaaacattcca

SEQ ID NO: 549196 - DNA, 70 bp, Homo sapiens
gaagaaggtggaggtggtgtagttgggcctgtttaggaactgattacatctgagcctctggccctttttc

SEQ ID NO: 549197 - DNA, 70 bp, Homo sapiens
tatgacatttctctgatttgtggccaattacggaggttataaaatggctgttaatcagggaaatgccata

SEQ ID NO: 549198 - DNA, 70 bp, Homo sapiens
caggcccctgggcgctcagcagttctgtcggcaagtgagcacaagaggagcggggcagcctgagggtctg

SEQ ID NO: 549199 - DNA, 70 bp, Homo sapiens
tgagccaaagctgaagggcaggatgtggtttcagcatgcggtgaccaccatccctccctccagtagctca

SEQ ID NO: 549200 - DNA, 70 bp, Homo sapiens
tggggtataagtggtccaggatttgttcttcatatgttgtcagaggcaactcctggccactgttcaccca

SEQ ID NO: 549201 - DNA, 70 bp, Homo sapiens
ggcaagtggtgagggcgaggcgtgggcaggtggttgaagagccacgagcgtcctctcccagcctcttgcc

SEQ ID NO: 549202 - DNA, 70 bp, Homo sapiens
tctgaatcacgcttgcaaactgtctcagttgccaggccctgttttcaagacagtttgcacgtttttcaga

SEQ ID NO: 549203 - DNA, 70 bp, Homo sapiens
ggggcttctggtctgcctgccgtttctaaagcacccagtatggatgcacagcaggagacacacaagtccc

SEQ ID NO: 549204 - DNA, 70 bp, Homo sapiens
gccctcgggtgcgggacagaggttggaatgggctcctccttttgactttgagtgtgtgtgcctgggaggt

SEQ ID NO: 549205 - DNA, 70 bp, Homo sapiens
ctcttgctcccgccctccgctcatgctcactgtggccccaggacgtgggcgatgttgcagggagcaaggg

SEQ ID NO: 549206 - DNA, 70 bp, Homo sapiens
ggaatttggtggttggtattctgttaacattcctcatctagttataagtcatgccagccaccagtcttcc

SEQ ID NO: 549207 - DNA, 70 bp, Homo sapiens
gaggatgcaaggaatggctagggttaccctctgctgaagcaggaaacagctcagctatgtctgcatcttt

SEQ ID NO: 549208 - DNA, 70 bp, Homo sapiens
ggaccctgggtctgggctttaggccaaagcaaagtgtttctttggtctttagcagggcctgggcttgtcc

SEQ ID NO: 549209 - DNA, 70 bp, Homo sapiens
aagtccagcaggaggagatgctaaagaattaggtatgatggtttttagcattttttaccttgttggagtt

SEQ ID NO: 549210 - DNA, 70 bp, Homo sapiens
gctgaggagaacaaggccatggtctgttgtcaaaaaacgcacacccgtgcgctttgctttccttccaagc

SEQ ID NO: 549211 - DNA, 70 bp, Homo sapiens
gcccgggtctctgcaggcgggcttcgcccggccaagtcaggcggcgcggggcgctctgcagaccccgggt

SEQ ID NO: 549212 - DNA, 70 bp, Homo sapiens
tggtgagcctggaggaagacttgcattgggcccaatggccctggaccagtgtctgtcagccaggttccca

SEQ ID NO: 549213 - DNA, 70 bp, Homo sapiens
caacaaaggacaccaaactaattgggattaaaaaactcttttgtgtcacttaagggtggtgtctcttgtg

SEQ ID NO: 549214 - DNA, 70 bp, Homo sapiens
ctccgtgccacttgatagctctgtctattcctatggaaaccaagttagtggatggagccaaggcttggag

SEQ ID NO: 549215 - DNA, 70 bp, Homo sapiens
aagcctgcatctttttccaagtttattttatactgccataaggaaagtgagtggaatgagttgtaggctt

SEQ ID NO: 549216 - DNA, 70 bp, Homo sapiens
ggttctttccacatttgctaggctgtatttattttttaataccagcagcctgggacatctggaggggatc

SEQ ID NO: 549217 - DNA, 70 bp, Homo sapiens
ggcttgacctgtgaggggttgacagccatggcgactgcctctggtggcctgtgccccagcaggtgaagcc

SEQ ID NO: 549218 - DNA, 70 bp, Homo sapiens
gtctggtacagctaagaatttcatctttgtcatgcgtaagctgaaagattaaattcatactgtactggat

SEQ ID NO: 549219 - DNA, 70 bp, Homo sapiens
cctgggtggcctctggcagatatcagtccttcctgagaagaaggactgaatctgctgagccagcttcagg

SEQ ID NO: 549220 - DNA, 70 bp, Homo sapiens
ggctccattcagaggaagctggggggatggagaacagtttgtctcatcccctccttccctggtgtcagcc

SEQ ID NO: 549221 - DNA, 70 bp, Homo sapiens
tatttttgtattgtagattgaataataagattgaaaacaattctgtaaattaatctatagtatagaagta

SEQ ID NO: 549222 - DNA, 70 bp, Homo sapiens
taagccagattctcaacttacgtaattctatgggaattcacagagttatattggttgagaatttggctta

SEQ ID NO: 549223 - DNA, 70 bp, Homo sapiens
tcatctgttgttgctgtgcgtcctgcactgagctacggccagaccctggatgttcagtaaaagttggtga

SEQ ID NO: 549224 - DNA, 70 bp, Homo sapiens
tttggattcaatttatttcctaggatatttgtgctgtcaaatactttgggaaatcaaattcaaatccaaa

SEQ ID NO: 549225 - DNA, 70 bp, Homo sapiens
gtctctatcccagagctccagaaatatatgtgctataaactgagctaatttggggctgggagcaggagac

SEQ ID NO: 549226 - DNA, 70 bp, Homo sapiens
gcatcaaaaaaaatgatgcaggcatttttattcccctaaaggggaatggtgcttccattgttttaggtgc

SEQ ID NO: 549227 - DNA, 70 bp, Homo sapiens
gatggtgacatgctggggtggggagaaaccactgctatgccttcttcctgaccgaccagttgttttcatt

SEQ ID NO: 549228 - DNA, 70 bp, Homo sapiens
ttctggggacactccctggtccagccaccacatcaggaaggcagctatttcagaaggagagtcctcagga

SEQ ID NO: 549229 - DNA, 70 bp, Homo sapiens
tgagctgccttcctgccttccattctagtttgacaagtggtaaaaaagaagagaggtaggaagcaagcca

SEQ ID NO: 549230 - DNA, 70 bp, Homo sapiens
agttgatgacaatattgtagataaaatagacactcaagctgttgaaaaattttacaggttgtcatcaatt

SEQ ID NO: 549231 - DNA, 70 bp, Homo sapiens
actttcctcctccctttgctttattttgccaagattatgctagaaggaaaaggcgagaggagaggagagt

SEQ ID NO: 549232 - DNA, 70 bp, Homo sapiens
ctgggaaggcccgatcgcaggcactccctagtctggctggagggaggtggctggattttggcctacccag

SEQ ID NO: 549233 - DNA, 70 bp, Homo sapiens
tccttggatattgcttggaggctctgagttcataagtacagaatggtttccaaggggtatgctttaagga

SEQ ID NO: 549234 - DNA, 70 bp, Homo sapiens
gcctgtggagtaggtggtgcattgtcccctctctggatgaaggaaggcactgagttacctgccccaaggc

SEQ ID NO: 549235 - DNA, 70 bp, Homo sapiens
gtcaggtgcacctccaccaacaattcactgaggataaaatgcacgtggggtttggtgaaggttcactgac

SEQ ID NO: 549236 - DNA, 70 bp, Homo sapiens
tctggttgttgtcggcatctttccaaaacactgtattagctgttgcagtggaatgttgccagcagccaga

SEQ ID NO: 549237 - DNA, 70 bp, Homo sapiens
atcctaaaatgtttcctaccatttttcttttccagtggctagaaagtttgaaatggtggggagaggggat

SEQ ID NO: 549238 - DNA, 70 bp, Homo sapiens
gcccagagggcgggagcagggagtggagacggggtcctcacccccagcccctcccctttctccgcccggc

SEQ ID NO: 549239 - DNA, 70 bp, Homo sapiens
cagcctggagccactgttctcattccgtcttgtgttagcagaacaatgaactgcagcaggcactgggctg

SEQ ID NO: 549240 - DNA, 70 bp, Homo sapiens
cggggctctccggggcccccaggcctggagcgcgatccgcacgggctgcagggccctggagtgggccccg

SEQ ID NO: 549241 - DNA, 70 bp, Homo sapiens
agtggaaacagctcagtcacagggtgtgaatttgagtcctggctctgctttgtgactgggcttgagaact

SEQ ID NO: 549242 - DNA, 70 bp, Homo sapiens
gggaaaactgtggctacattgtgaaaatttaatgagataaaacagcacagtgtggcttatgggaagtccc

SEQ ID NO: 549243 - DNA, 70 bp, Homo sapiens
tctgcccttcatttgctcttggctagctgacttcactctccatggctgcagagcagtcgaacggggcaga

SEQ ID NO: 549244 - DNA, 70 bp, Homo sapiens
cggaagcagagggggcgggggagtggccggctttgaatatcctgttgaccccagtttcctctgcccccag

SEQ ID NO: 549245 - DNA, 70 bp, Homo sapiens
tatcagtcttttgtaatgaccctaacagaaaagcatcccctctatttaggagtcattattggagatggta

SEQ ID NO: 549246 - DNA, 70 bp, Homo sapiens
ccttcagagtactctgtaattgagtgtgaagtctcatgagatctcttcctcaattccaagtgcatggagg

SEQ ID NO: 549247 - DNA, 70 bp, Homo sapiens
ggctctgtgtccagacgccagctgcctgctcagccccatggctggctgcggctggcatggacccagggct

SEQ ID NO: 549248 - DNA, 70 bp, Homo sapiens
taagcgcgatgccctctcctagatctacaaaccggttttttcctggctagggaggggatacgtctgctta

SEQ ID NO: 549249 - DNA, 70 bp, Homo sapiens
ctccggggtgtgcggctgagggcagaggtttccgagtccttctctgtcctcggctgctgcactcgcggag

SEQ ID NO: 549250 - DNA, 70 bp, Homo sapiens
catgcaggcctggggctggaggagttcccgaggtgtggtctcaggaaatgcctctggcctggtaaagatg

SEQ ID NO: 549251 - DNA, 70 bp, Homo sapiens
gcgcgcggcgccggccagcccgcctcccgccgccatggggcgctgcaggcatcaggccggcgccgcgggc

SEQ ID NO: 549252 - DNA, 70 bp, Homo sapiens
gggctgggagggaggggccagggataatttatgatatcattgctcccccgccgcacttacttcccagccc

SEQ ID NO: 549253 - DNA, 70 bp, Homo sapiens
tatggcatttccctgattaacagccattttataacctccgtaattggccacaaatcagagaaatgtcata

SEQ ID NO: 549254 - DNA, 70 bp, Homo sapiens
cctgcagaacatagtggactttggcaaaaatgtcatggagtttttgggggagaactatgttcattgtggg

SEQ ID NO: 549255 - DNA, 70 bp, Homo sapiens
ttgatgattgaagttttgctagcagggagtgtcacaaaaggcaactgggcagtggaatttgagtgattag

SEQ ID NO: 549256 - DNA, 70 bp, Homo sapiens
gttttggacgaagcttttctcacagtggtagttccagttatacccactgtgactcggggctgttcagaat

SEQ ID NO: 549257 - DNA, 70 bp, Homo sapiens
agccccaggacatggttcagccaggggctcagaagtggatcagctgtgcctctggactagtctctgggct

SEQ ID NO: 549258 - DNA, 70 bp, Homo sapiens
gcctgggagggcccaggaggaggggccttcagattcagtccaataaggcccttcctccctccctccaggc

SEQ ID NO: 549259 - DNA, 70 bp, Homo sapiens
ggaagactgcttttaacataaccagatggtaatttttactagttggcagtgtactgaaagcacattttct

SEQ ID NO: 549260 - DNA, 70 bp, Homo sapiens
atgtgcaccatatgtcatactgtagcttgacaattacctcaacaggcagtgtcagacagatggtaaacat

SEQ ID NO: 549261 - DNA, 70 bp, Homo sapiens
tccatggccacattctgggtctaaggatcagcaaaacattacttctgagatccagaggatggctacagga

SEQ ID NO: 549262 - DNA, 70 bp, Homo sapiens
agtgagctgagagggccctgagagttggggcagacgagcctccatttccagagggtccctctgctctgct

SEQ ID NO: 549263 - DNA, 70 bp, Homo sapiens
tttttccttagcttctctgcgaggtcacttttcaaaaattttagtctatctcagaaaagctaaggagaaa

SEQ ID NO: 549264 - DNA, 70 bp, Homo sapiens
gagatgagccactgtcatggagacgttgtgtatttggatgcccatgacagtcctcattttaaactaacac

SEQ ID NO: 549265 - DNA, 70 bp, Homo sapiens
gcatgatgtcctggggggttgggacccggaaaaaagtctcactgctcaccagccccccaggaaactccgc

SEQ ID NO: 549266 - DNA, 70 bp, Homo sapiens
tcctgcctagtaccttcttttcttctgggaatagctttccctttctaagggatgaagagggtgggtggga

SEQ ID NO: 549267 - DNA, 70 bp, Homo sapiens
catctcaggccatctgcagagaagaaaggtggtacctaacattttttcttgtcagcacttggtaggggtg

SEQ ID NO: 549268 - DNA, 70 bp, Homo sapiens
ccaggggatccctgcagggcagcttaggacaccggaaaccgagtgccggggttggcgcaggggcctctgg

SEQ ID NO: 549269 - DNA, 70 bp, Homo sapiens
attttctcagcttctttaatttggtggaaaacgtaaagttgtctctccaaggtaaactagctgagaaagt

SEQ ID NO: 549270 - DNA, 70 bp, Homo sapiens
cagtagataagccaaggtctgaagtctgaagcagcagttaggaaggtctcagaccttaaaatgtcaactg

SEQ ID NO: 549271 - DNA, 70 bp, Homo sapiens
gtggtcagtgagtctgggggcgtgtgtgtgggtttccgtactacatatccccggattttctagtgtccac

SEQ ID NO: 549272 - DNA, 70 bp, Homo sapiens
gccgcgccgcctgcgccgggctcagtcttcctcccccgaggctaggcgagcgcaggcgcgggcggcgggc

SEQ ID NO: 549273 - DNA, 70 bp, Homo sapiens
gtctccttccgtgaggtctttggcagttcccacaataatagaggagctggaagatgaagaggagagagac

SEQ ID NO: 549274 - DNA, 70 bp, Homo sapiens
gacacaattcccacacttgaagccctctggtgtgaatatatgagagatggccttaggtgggaattgtctc

SEQ ID NO: 549275 - DNA, 70 bp, Homo sapiens
ccactcagatgatgtcaggcccagttcctcagtgccctgcacaaggaacagggctcatcttctgagaagg

SEQ ID NO: 549276 - DNA, 70 bp, Homo sapiens
gtggggtaggatgtgttctcgttactagtaattcctggaacagaaaacgagaaaacatatccgtctccac

SEQ ID NO: 549277 - DNA, 70 bp, Homo sapiens
ctgtgtattgtttaatatatatgtgtgggtatatctgtgtctgtgtatatatatgtaaactaaaacacag

SEQ ID NO: 549278 - DNA, 70 bp, Homo sapiens
atccttccctgtagcctaagtctttcccctcaacttctctttgtagtgcagattagctacttggaaggat

SEQ ID NO: 549279 - DNA, 70 bp, Homo sapiens
aaagacttcagccttagatgatatgcctttgtacagatcccattatggagagctatctgctggagttttt

SEQ ID NO: 549280 - DNA, 70 bp, Homo sapiens
aaggaaatacttgtgtatctagggagatgttgtttataatagtgtctcaaatgatgagtaggtgttcctt

SEQ ID NO: 549281 - DNA, 70 bp, Homo sapiens
aggcagaaaccgcatcaaggaaccaattgaacagacatgtgtcctattcatctttgtgccctttctgcct

SEQ ID NO: 549282 - DNA, 70 bp, Homo sapiens
cagactcaggggcgggagtgtgccttagaaaaactcctttggggcagttattctgtgcccccaccctctg

SEQ ID NO: 549283 - DNA, 70 bp, Homo sapiens
ggaatcacttccttttttggagtctccatgtcctccttgggaatgtggaggttccttaggagggagttcc

SEQ ID NO: 549284 - DNA, 70 bp, Homo sapiens
gctgcccacggcaggcatgtggcagtggctgacagggagtgagtctggaagcgacccttgtcggggcagc

SEQ ID NO: 549285 - DNA, 70 bp, Homo sapiens
ttgtagggaatgatacataaaccatcattttgtgtaattctcacaatggctttatgtatcatctccacag

SEQ ID NO: 549286 - DNA, 70 bp, Homo sapiens
tgctcaccccctagacctttaggccgaggcctgccagcctctggatgactgtggtgtagggtggcaggca

SEQ ID NO: 549287 - DNA, 70 bp, Homo sapiens
ctcctcccagcccatgctctgtgcctgccagatggcggcccctgcacaggtgctgctggctgtggaggag

SEQ ID NO: 549288 - DNA, 70 bp, Homo sapiens
caggccaggagctgctaagtgctcctcaagtcatcatggccagtgggtagcatggagagctcctggcgtg

SEQ ID NO: 549289 - DNA, 70 bp, Homo sapiens
tccattgaggggttctgggaatactataaccacaagtacgaagctggagtcaccagaaaccctcaatgga

SEQ ID NO: 549290 - DNA, 70 bp, Homo sapiens
caggaagacaggtgggttcttcagagctgggtaagttacttagactctccgaacctcactttcctacctg

SEQ ID NO: 549291 - DNA, 70 bp, Homo sapiens
gaaggggaatgaactgtggctacctgtgtgtgctattgttcttacagaaagccacagtgcattgcttttc

SEQ ID NO: 549292 - DNA, 70 bp, Homo sapiens
gggtgccgcctccacatggctgaggtgtggccaggtccccccacaccctggcctgtggagccaggctctc

SEQ ID NO: 549293 - DNA, 70 bp, Homo sapiens
cgggcagggagcccggaccgaaagctcagctccaggatggctgcgcttgggccccggcgttccctgcccg

SEQ ID NO: 549294 - DNA, 70 bp, Homo sapiens
gtcagaaccttggtcatgtgaaagggccggttttctctgtcaggccttcacctggtcaggcgttttgtac

SEQ ID NO: 549295 - DNA, 70 bp, Homo sapiens
attctggattccccctcctcacttgcccctgcgacagggcaggggaaagtggtgggggacaccccaggat

SEQ ID NO: 549296 - DNA, 70 bp, Homo sapiens
aggcgaagggcaggagggttggacatgaagccacaaagctactcgggttcctccttcttctcttttgcct

SEQ ID NO: 549297 - DNA, 70 bp, Homo sapiens
gtatcttgagggaagcatttctccctaagtgcagagttattttcatcagagagagcttctcttaacatac

SEQ ID NO: 549298 - DNA, 70 bp, Homo sapiens
ttagatctttttatttaccctgttaaagtgctcatatggcttcgaacaacgggtaaatgaaaaactctga

SEQ ID NO: 549299 - DNA, 70 bp, Homo sapiens
ggggaggttctagagggacagggcaagtgagaagatgcaatgcaggtcagtcctgttcctgaaccttccc

SEQ ID NO: 549300 - DNA, 70 bp, Homo sapiens
gcccggctatttggcgggagcagaaattgcctgtccggttttatgatctgctcagcctgagcagccgggt

SEQ ID NO: 549301 - DNA, 70 bp, Homo sapiens
gaaggtccggttaaccaccttggagaccactgaaacatcatccctccaacggtgtgttattaggtttttc

SEQ ID NO: 549302 - DNA, 70 bp, Homo sapiens
tagtctattccaggtagacaggcctgcagggggtccaacccctacaagcccctctgtctggaatagactg

SEQ ID NO: 549303 - DNA, 70 bp, Homo sapiens
ctttctttttcaatattctgaaatagacaaggactttggtctttgactaatttcagagttaaagagaagg

SEQ ID NO: 549304 - DNA, 70 bp, Homo sapiens
gtgaaggaggcttctggatctttccaggcatgtagatgtctttaaagatgcaatcaggcctcctcgtcac

SEQ ID NO: 549305 - DNA, 70 bp, Homo sapiens
cctgttgccctccctctcagtgcctgaagtagaatattaaaggcacgcagaggaggaagagggtaggagg

SEQ ID NO: 549306 - DNA, 70 bp, Homo sapiens
gtggggtaggatgtgttctcgttactagtaattcttggaacagaaaacgagacaacatatccgtctccac

SEQ ID NO: 549307 - DNA, 70 bp, Homo sapiens
tgcaacattgcctatctgttggaagaatggatttttagcatattgtccacacagatagatgatgttagca

SEQ ID NO: 549308 - DNA, 70 bp, Homo sapiens
tgaagatagagaatggaaagaggcagggaagactaaaaaactctttgcttctttcttgtcttggatctca

SEQ ID NO: 549309 - DNA, 70 bp, Homo sapiens
ggaatcatctcccttcttggagtctccgtgtcctccttgggaatgtggaggttccttaggagggagttcc

SEQ ID NO: 549310 - DNA, 70 bp, Homo sapiens
tgggggcttgtgtcactgtgagaatattgtaatagtactactttctatgcccacagtgacacagccccca

SEQ ID NO: 549311 - DNA, 70 bp, Homo sapiens
cctgtttattatcgtcatcagcctcaatgatttccaaggaacggcagcatgctgtgatggaaataacagg

SEQ ID NO: 549312 - DNA, 70 bp, Homo sapiens
ctgtcagagaggagagggtgcggggtgggggagccactggaccactccccgctcagctgctctctgacag

SEQ ID NO: 549313 - DNA, 70 bp, Homo sapiens
actattatttattgattctgggagtgttcttggtagtaggaaacctgatctagaatcaataaatgatggt

SEQ ID NO: 549314 - DNA, 70 bp, Homo sapiens
ccagggaggttaagtagcttgctcaagattcctgctgctaagtggcagtagcgagccaccacctgcctgg

SEQ ID NO: 549315 - DNA, 70 bp, Homo sapiens
caggggtgagtcctctccagggatggatcccaaacatggagcctgctgtaccctggagaggtcccccctg

SEQ ID NO: 549316 - DNA, 70 bp, Homo sapiens
gaggcctgctctggcccagagcgcacgtgagtgaggcctctgctgtgggctctgggccggaggcatcctc

SEQ ID NO: 549317 - DNA, 70 bp, Homo sapiens
aaggtttgtctgctattcataaactgcttaagatgttttcttgtagtttgtgacataagcagaacgcttt

SEQ ID NO: 549318 - DNA, 70 bp, Homo sapiens
tgctcgtggtcctggcttcctcatctggcacccatcaggctagacacagatggggctccaggcctttgca

SEQ ID NO: 549319 - DNA, 70 bp, Homo sapiens
aggaacatgtaaatatcattgtactgggctttgcattctggctgaacagcacagtggcttacgtgttcct

SEQ ID NO: 549320 - DNA, 70 bp, Homo sapiens
gtggggtaggatgtgttctcgttactagtaattcttggaacagaaaacgagaaaacatatccgtctccac

SEQ ID NO: 549321 - DNA, 70 bp, Homo sapiens
ttcctctcctgctctcagtccatcctctgctggccacagcaattccgggactgagggaatgggggatgag

SEQ ID NO: 549322 - DNA, 70 bp, Homo sapiens
gcctgaggtgccggctggagtttctgctggcctggcttgcaaaatgcattccggtgggcaccagaaaggc

SEQ ID NO: 549323 - DNA, 70 bp, Homo sapiens
gacaggagcagggctgcaggaggaggagtggacaggcccacctccctgcctcctcctgcaggctccagtc

SEQ ID NO: 549324 - DNA, 70 bp, Homo sapiens
gtatggtcagaagtcgaaggagggccatttaatcagagaatgtggaactgcttggacttttgagctcagc

SEQ ID NO: 549325 - DNA, 70 bp, Homo sapiens
ggaggagagagaggctcagagtgggttgcagaggaactggtgaataaattcttgagccttcttcttctct

SEQ ID NO: 549326 - DNA, 70 bp, Homo sapiens
tggctcagttccaccagtacccagacctgggggccagccggggagctggggcagctgtgggaatgagcta

SEQ ID NO: 549327 - DNA, 70 bp, Homo sapiens
ccttgcaaggtttctctctgcctaaatgagtctccattgcaggcgatagagtaggagaggccttgtgggg

SEQ ID NO: 549328 - DNA, 70 bp, Homo sapiens
gtcagtgaaccttcaccaaaccccacgtgcattttatcctcagtgaattgttggtggaggtgcacctgac

SEQ ID NO: 549329 - DNA, 70 bp, Homo sapiens
gttcggaaagccctaggtggtcacagccacagcagcgctgggctggtgctgtcctgggggttgcccgggc

SEQ ID NO: 549330 - DNA, 70 bp, Homo sapiens
gaaaccaggctgttggctccagggttcttgtttttagcagtgtgggctctggagtctgctgtcttggact

SEQ ID NO: 549331 - DNA, 70 bp, Homo sapiens
ggtttaccaggattgccacctgcccaagagaatgttatggggatccaggtggccaaatctggataatacc

SEQ ID NO: 549332 - DNA, 70 bp, Homo sapiens
ctctgcaagtgttcatcatgacgatgtacccagaaaggagttctaagttgtgatgagcatcctgcagcag

SEQ ID NO: 549333 - DNA, 70 bp, Homo sapiens
atgaggaagagggaatggacttagctgtgtgcttggcttctcactagctgccaccttccctcctcttgtt

SEQ ID NO: 549334 - DNA, 70 bp, Homo sapiens
gctaggtagaagaaattagcataaattagaataaaacagtctgattttgctgatctctttgcctctaagc

SEQ ID NO: 549335 - DNA, 70 bp, Homo sapiens
tctgaaaaacgtgcaaactgtcttgaaaacagggcctggcaactgagacagtttgcaagcgtgattcaga

SEQ ID NO: 549336 - DNA, 70 bp, Homo sapiens
cctggacctctgggtgccactgtctgtacatgtccagcttggcaggcagctggcatcctaaggattcagg

SEQ ID NO: 549337 - DNA, 70 bp, Homo sapiens
cacagcaccaggaagcctgagaatgcttagggctctagcccaggctttgtaccaggctttctggtgtgtg

SEQ ID NO: 549338 - DNA, 70 bp, Homo sapiens
tggttcctcagtttcattttgaccctcacttccagctgtaaattgagggttcatggaattataggagcta

SEQ ID NO: 549339 - DNA, 70 bp, Homo sapiens
gccctctcaggactgggtcattctgttcctcgccagtgggagagcagtggggcctggtcccgagcgtggc

SEQ ID NO: 549340 - DNA, 70 bp, Homo sapiens
acgctggcatgtgagtgaggaggttaagagtatgggttctgaactcagctcctccacttactagctgtgt

SEQ ID NO: 549341 - DNA, 70 bp, Homo sapiens
tctgtgatgcaaactttgtttaccagaaggtttgttaccaggtggtaaacaaagtgtttgcccttataga

SEQ ID NO: 549342 - DNA, 70 bp, Homo sapiens
ggaaggagctctgattgttgaggagggaactgcgatttcaaagtgtccccttccaatcatagctcccccc

SEQ ID NO: 549343 - DNA, 70 bp, Homo sapiens
ggatcaggagttggggcatggggcattttgagtttcgtgcttatgttgccttccccccatcttttgctcc

SEQ ID NO: 549344 - DNA, 70 bp, Homo sapiens
gggccctgggtcacagagcagatggtcctgaatggagcacaggatgtgtgctgtgtgccgggactggccc

SEQ ID NO: 549345 - DNA, 70 bp, Homo sapiens
ccttcctgcgtgacgtaggctggcgtgggctcttcccccagccccttgccggtgctgccacgtgagaagg

SEQ ID NO: 549346 - DNA, 70 bp, Homo sapiens
gcctctgaaaccaagtatgggtcgccttcccgttctgcaccaggtctcacccacgcttgatttcatgggc

SEQ ID NO: 549347 - DNA, 70 bp, Homo sapiens
ggggcttctggtctgcctgctgtttctaaagcatccagtatggatgcacagcaggagacacacaagtccc

SEQ ID NO: 549348 - DNA, 70 bp, Homo sapiens
agagtggccttgaagctccccccaacaaccctggctgccggggctgggggtggcctcaggagccatctct

SEQ ID NO: 549349 - DNA, 70 bp, Homo sapiens
ggggactgaatcattagaacatttctgagcttccatgtagctctaaaagttctggaatgatttcagcctc

SEQ ID NO: 549350 - DNA, 70 bp, Homo sapiens
ctcatgaggagcaggctgtgtgggcctcagcacccttgggtgcagagaccagcaaggcctggcctcaggg

SEQ ID NO: 549351 - DNA, 70 bp, Homo sapiens
tggggcaggaggacattagcttatttgtgcccctcagcacaatttctgaggcagaatgtctcttgcctca

SEQ ID NO: 549352 - DNA, 70 bp, Homo sapiens
tttgtttatttttctaaggagaccagcttcaactctgctgataatgtgttttcttttgaaaatgagcaga

SEQ ID NO: 549353 - DNA, 70 bp, Homo sapiens
gccatgctggcacagtgcccccagcaaggggagctctgcttcctgctggtgggcataggtgccaggtggt

SEQ ID NO: 549354 - DNA, 70 bp, Homo sapiens
ggccctggcaggtgaggggtggggggtggtgctgggaagccccaagcccagcctcaagcttgctggggct

SEQ ID NO: 549355 - DNA, 70 bp, Homo sapiens
ggggatctgtgttcaggttcagaggtctgtaaatctgtttctaggtctttgccctggatattagatctct

SEQ ID NO: 549356 - DNA, 70 bp, Homo sapiens
agacactgtagcaggccagagaatgaggtgttctaaaatcccctctctctggtcctgctgcaacttgttt

SEQ ID NO: 549357 - DNA, 70 bp, Homo sapiens
tgggagtgatcaacatatactgtattagcacctaaaactcctttggtgtgtgtgtatgttgtgacttcta

SEQ ID NO: 549358 - DNA, 70 bp, Homo sapiens
tgtcaaagacactttggggaccaccgtggaagatcatttgtggggaggtcatcagggtggtctttggaca

SEQ ID NO: 549359 - DNA, 70 bp, Homo sapiens
acagggcctggacttgatggcttcttggggtcattactgggcctcaagactccacaggtgccaaccctgt

SEQ ID NO: 549360 - DNA, 70 bp, Homo sapiens
acagccaaacccaaactccagaccctgcaccgcctggggtagtttcttctggggttttggtggcggctgt

SEQ ID NO: 549361 - DNA, 70 bp, Homo sapiens
gtgaaggaggcttctggatctttccaggcatgtagatgtctttaaggatgcaatcaggcctcctcgtcac

SEQ ID NO: 549362 - DNA, 70 bp, Homo sapiens
ggctcagctgcctggagtgggtgagcagaccagaagcatgaccctgccccacccccagccagctgcagcc

SEQ ID NO: 549363 - DNA, 70 bp, Homo sapiens
ggttcgatgaccatatgtgacatggctaaggagttatttcttcacatgccatgtccactgatcatcaacc

SEQ ID NO: 549364 - DNA, 70 bp, Homo sapiens
aatgttttgctgaatgctgtgtctccaatgcctagaaagagcgtggtgcacagtagacgtgtgaaatatt

SEQ ID NO: 549365 - DNA, 70 bp, Homo sapiens
ctcctctcttgctctcagtccatcctctgctggctgcagccactccgggactgagggaatgggggatgag

SEQ ID NO: 549366 - DNA, 70 bp, Homo sapiens
aatgagaaattttcagggctactgaacactgaaaatgcatggtgctcaatggccctaaaaatttctcatt

SEQ ID NO: 549367 - DNA, 70 bp, Homo sapiens
cttcaaccccatcctccacccctgcccccgccacggccaagccagatttgcaggggtggggagggtgagg

SEQ ID NO: 549368 - DNA, 70 bp, Homo sapiens
gaacttcttctttaagagactcttaagaaaccaagttattatgaggagctctgagtcttaggagaagttt

SEQ ID NO: 549369 - DNA, 70 bp, Homo sapiens
cagaggaaactgtccttcctagaggtgtgcagggtgaatctctcatgcctcttgggaggagaggcctgtg

SEQ ID NO: 549370 - DNA, 70 bp, Homo sapiens
ctccaagaagtctcctgcagtctctgtacctgaggtctttggttgggatgtggggactgacttctttgag

SEQ ID NO: 549371 - DNA, 70 bp, Homo sapiens
gccagcagggcaggctgggaccccactgactgtccatgcaggctctggggtcccacctgctcctgtaggc

SEQ ID NO: 549372 - DNA, 70 bp, Homo sapiens
gagctgggctgacgggggagcagcctgtgggccctgaaaccctccctgctctccttgccagcacctgctc

SEQ ID NO: 549373 - DNA, 70 bp, Homo sapiens
gtttgtttgcttttctctagttggtaatgttggttaagacactgactggctttggaaaagctatatagat

SEQ ID NO: 549374 - DNA, 70 bp, Homo sapiens
ggaagagcagatgtgccttgcatctgagtgagggtgacttttactcagaaagtgcatacctccctcttcc

SEQ ID NO: 549375 - DNA, 70 bp, Homo sapiens
ttctgaagttgcaggagaagcttttggccctacaggaagagaagcaccagcttttcctgcagctcaagga

SEQ ID NO: 549376 - DNA, 69 bp, Homo sapiens
ttctcagagttgactcctgctcctgcccctggattcggcttcaaggttagagaaagttaactctgagaa

SEQ ID NO: 549377 - DNA, 69 bp, Homo sapiens
tagagtggtttttgacattgatatacattgccatgatgtatgtatgttatatgtcaagaagcttctctg

SEQ ID NO: 549378 - DNA, 69 bp, Homo sapiens
agacatgcagctctagggctcggaagagaatgctggggtggagaaagagctgtgggagctgtcgtgtct

SEQ ID NO: 549379 - DNA, 69 bp, Homo sapiens
ggcagagattaggctgggggctttaggaagctacctgcttctccttcctgaatccctgcctattttgcc

SEQ ID NO: 549380 - DNA, 69 bp, Homo sapiens
tctgaccctctatggtctccctcatgcctcagtttacctgtgcatagtaagaaccctggagggccatga

SEQ ID NO: 549381 - DNA, 69 bp, Homo sapiens
tgcctgaggttgagtgtgtacatttaagtgacacaattcactgggtgtattcattcacctgctagggca

SEQ ID NO: 549382 - DNA, 69 bp, Homo sapiens
ggggcgcgcagcccggactggccggaggcgcggccaccgctcttggtcggtccttaggctgcgcggccc

SEQ ID NO: 549383 - DNA, 69 bp, Homo sapiens
gctcactctcctttctcccatctccaggagccattgcaccaccagagaatgaagagaggcagagtgggc

SEQ ID NO: 549384 - DNA, 69 bp, Homo sapiens
gctggcacctgcctctgctctcccctcctcttgccgagaaggcaggatgcggaatggcaggtgaaaggc

SEQ ID NO: 549385 - DNA, 69 bp, Homo sapiens
agtctcagggcctgagctgggaggtggcagagaggtcccctttccccccagaaggcaggtcctggggct

SEQ ID NO: 549386 - DNA, 69 bp, Homo sapiens
gggaggctggcatcttgcctcttaaatggtcctattttgggttacagaaggagtaagagtctccctccc

SEQ ID NO: 549387 - DNA, 69 bp, Homo sapiens
ctgttggggaatatgcatgaaaacatctggcctctgtacagggcagagttttcattatattcccaacag

SEQ ID NO: 549388 - DNA, 69 bp, Homo sapiens
ctcagggaagctttttgctcgaattatgtttctgatccgaatataagacgaacaaaaggtttgtctgag

SEQ ID NO: 549389 - DNA, 69 bp, Homo sapiens
ccgtcagggtcaggcctctcggtgacttttcctttttctctggcagaaactgaggggtgagaccgatgg

SEQ ID NO: 549390 - DNA, 69 bp, Homo sapiens
tttccattttgagtccttttaaatgtaatgctaacctttacaattaaaaagtcagattcagaatggaaa

SEQ ID NO: 549391 - DNA, 69 bp, Homo sapiens
cagcctctgccatgttggaatttcaaacccaaaacagctgcttggaaggagccagcatgccagaggctg

SEQ ID NO: 549392 - DNA, 69 bp, Homo sapiens
ggccatctataagttttaagtcaggcagtgatgtgacccaatgtgtgtttcttaaagattatagaggcc

SEQ ID NO: 549393 - DNA, 69 bp, Homo sapiens
cctgcagctcccactcactctgggctgggaccgtggtctggatgccagggagtggaaaggagctgaagg

SEQ ID NO: 549394 - DNA, 69 bp, Homo sapiens
tggggatggaggatggggttggcatgagaaggcaaggtcctatcagattaaccctaccatccatcccca

SEQ ID NO: 549395 - DNA, 69 bp, Homo sapiens
gccaaagacggaaatgaggcttgcctgccatgaccggctcagccagacaaacctcatttcctttctggc

SEQ ID NO: 549396 - DNA, 69 bp, Homo sapiens
gggagggatggacctgtccctttctagtgtgtcctctcaacttggcagggggcagagttcttccctttt

SEQ ID NO: 549397 - DNA, 69 bp, Homo sapiens
gcgctcctgctcgcggcctctcccagtcccggaattggggctgcggatctaaggctgggaggggagtgc

SEQ ID NO: 549398 - DNA, 69 bp, Homo sapiens
atgcatttatatgcatgtattactaatatatattagagtaagttacaagtaatatagcatgtaaagcat

SEQ ID NO: 549399 - DNA, 69 bp, Homo sapiens
gccctggaggcagaaataggacttgtgattcaccttcagtttaaaagcgctaatttctgccttctgggt

SEQ ID NO: 549400 - DNA, 69 bp, Homo sapiens
atgaccctttctaaacaaaaggactctttaaggcctatcctgagtctttgtgttttgaggaggggttat

SEQ ID NO: 549401 - DNA, 69 bp, Homo sapiens
agtgaactgattctatgcttctgaatcatctgggagctggggagatttggggagcagaactggttcact

SEQ ID NO: 549402 - DNA, 69 bp, Homo sapiens
gccccgcccctcgcgacgatgtagcaaccgtggaatgctcggacgtcgcaacgctccgaggggcggggc

SEQ ID NO: 549403 - DNA, 69 bp, Homo sapiens
agcatccctggctggtggaagggcatgcgtgagggtgcttgacgcctctctcgctaaccaggtgatgct

SEQ ID NO: 549404 - DNA, 69 bp, Homo sapiens
ctcctgctgagcagcacgcctgcgggttctctccagtctcctggcacccaggctgcctgcacacaggag

SEQ ID NO: 549405 - DNA, 69 bp, Homo sapiens
gaaaagaagcacggctccggggactggcgcctgcttggagacctgctccccgaagccgtgcgcttcttc

SEQ ID NO: 549406 - DNA, 69 bp, Homo sapiens
agagactcaaaatgtggaaaggagaaagggctatcagaagtcctgtgtctccttacattttgtgtttct

SEQ ID NO: 549407 - DNA, 69 bp, Homo sapiens
aagggttatatggatattttgagttatttcatatgcatttaggaataacccaagatatgcataatcctt

SEQ ID NO: 549408 - DNA, 69 bp, Homo sapiens
ggccctctcagggccctaggagcctttgtgtgtcctgctcacattgtctccagggcctcggacagggcc

SEQ ID NO: 549409 - DNA, 69 bp, Homo sapiens
tgcactgtacaggaaggctccaggctgccacttggcagaaaaatctccaggagttgtccgtattctgca

SEQ ID NO: 549410 - DNA, 69 bp, Homo sapiens
gatgggcgtcttaccagacatggttagacctggccctctgtctaatactgtctggtaaaaccgtccatc

SEQ ID NO: 549411 - DNA, 69 bp, Homo sapiens
ttcctgtctctccccaaattctgggcggttctgtttccagcactcatccatgatgggggggtacaggaa

SEQ ID NO: 549412 - DNA, 69 bp, Homo sapiens
cagacttcttcttgtgccttgtccacagtttctgggggatgctggggacaccgcaggaagtactgtctg

SEQ ID NO: 549413 - DNA, 69 bp, Homo sapiens
gtttggtttcagtagtttagccctaaggagtgaggaatttgtttggttagacatactgaagataaaaac

SEQ ID NO: 549414 - DNA, 69 bp, Homo sapiens
agtgaagatgagggaggtgggtctgaatgcatttcagaagtatgggctctcctctctcagacagacact

SEQ ID NO: 549415 - DNA, 69 bp, Homo sapiens
gggggtgcactcagctgccactgtccgccgcctgtccctggggagcatggcagctgagggcaggcccct

SEQ ID NO: 549416 - DNA, 69 bp, Homo sapiens
cacttgtgtgggtgtgaaggcggggcttcacagagcccccaggtgagctgagccacacccacaagagtg

SEQ ID NO: 549417 - DNA, 69 bp, Homo sapiens
tccccctttctcaggctgatgtgtgccttgaatgtactagaatcaaggccatgtacttggaaagcggga

SEQ ID NO: 549418 - DNA, 69 bp, Homo sapiens
cttgtactacaggttgttggagtactcctagatcactgtttcatagtagccagcaataagtagtgcaag

SEQ ID NO: 549419 - DNA, 69 bp, Homo sapiens
agagacacaaaatgtggaaagaagaaagggctatcagaagtcccgtgtctccttacattttgtatttct

SEQ ID NO: 549420 - DNA, 69 bp, Homo sapiens
ctctgctctccatctccgtgacaactcctatgttcaggatctggaggagcacggggcttggggacaggg

SEQ ID NO: 549421 - DNA, 69 bp, Homo sapiens
ggggctgtctccagggcaggtgcaggtgctgctgagggctggctttctgtcatggcctggggcagcctc

SEQ ID NO: 549422 - DNA, 69 bp, Homo sapiens
ggcaggcagagcgccatgcttcttcctgccgcacagaaattaaccccaagccatggcctctgccctgcc

SEQ ID NO: 549423 - DNA, 69 bp, Homo sapiens
gggaaagaacatctaggtctaagttctggctcaaagacttcctagatttgtgaccttgcattctttcct

SEQ ID NO: 549424 - DNA, 69 bp, Homo sapiens
gccccagctgggggctggccttggcactagctgccctggcagtggctgctgggctggtccttctgaggc

SEQ ID NO: 549425 - DNA, 69 bp, Homo sapiens
aatttggtttcttttgtgctttctattgtacaagttgggttggaaaatagattgccaggaaatcagatt

SEQ ID NO: 549426 - DNA, 69 bp, Homo sapiens
ccaccctttccccgcagacctctctgagatagtcaactccagagctcgggtgcctcgggtgagaggggg

SEQ ID NO: 549427 - DNA, 69 bp, Homo sapiens
ggtggtgatcaggtctgaacagggaggtccatgcacatatgaaatttcttcctctcaggctttcccact

SEQ ID NO: 549428 - DNA, 69 bp, Homo sapiens
ggctctgtctgattattgacagggagcttttcaaactcctgagcctctgtttgtgtttcagatggagtt

SEQ ID NO: 549429 - DNA, 69 bp, Homo sapiens
tgctcctcgggctcctggttgccctggccgcttgctgcctggactcactgccaggagcctgggggagca

SEQ ID NO: 549430 - DNA, 69 bp, Homo sapiens
ggaagaggtatgaaggtgcatcagcctttttctcattgaggatttgggtgagcactttcatgcacttct

SEQ ID NO: 549431 - DNA, 69 bp, Homo sapiens
ggtgagttggggctgcgtatttccatgttttctgaaggttcacataaacatgcagcctgccaattctct

SEQ ID NO: 549432 - DNA, 69 bp, Homo sapiens
agaggttgagagcatggattctggagtcccacaaacccgactcctgccttgagtcctgactcagccttt

SEQ ID NO: 549433 - DNA, 69 bp, Homo sapiens
actagctacgttttttcctcagcactttctgtgtagagagtaactgaggcccagagaagcgaagtaagt

SEQ ID NO: 549434 - DNA, 69 bp, Homo sapiens
tcagaaatggtctggttgctgagtggaaatataactctgtttttttagcagccaagtctattttactga

SEQ ID NO: 549435 - DNA, 69 bp, Homo sapiens
cgggcggtgtgggcgcgtcgggtccttctccctttgtctgcagtgagtgatccgcgcgccccctgcctg

SEQ ID NO: 549436 - DNA, 69 bp, Homo sapiens
gtgggagggggaaccgtgggccctgctgccaatgagtgccagacttggggcctcagtttccccacctgc

SEQ ID NO: 549437 - DNA, 69 bp, Homo sapiens
aggctcaagtggtagctgtctcatcatccctcaccggctgaggcctgaggccggctaccacttggggct

SEQ ID NO: 549438 - DNA, 69 bp, Homo sapiens
gctgagcagtggggccagctcccgcccacccccaggagactggtgaggagagctgtccggctgagcagc

SEQ ID NO: 549439 - DNA, 69 bp, Homo sapiens
aagctccaagtgtggtgtttggcacatagctggtacacaatgaatgccatccatcagtatttgtggttt

SEQ ID NO: 549440 - DNA, 69 bp, Homo sapiens
ggagatggtgttgagtttggtactcagctgggtcagctgccggttattcatgtacttggcatcgtttct

SEQ ID NO: 549441 - DNA, 69 bp, Homo sapiens
acaaatgtattctgtccaagtggaagccggttaagttccgatatcctcagctcgacagaacatatttgt

SEQ ID NO: 549442 - DNA, 69 bp, Homo sapiens
aggtgtttctgttcttcagagatccccaaatattttaggtagagggaaaatttctaagaacagggtcct

SEQ ID NO: 549443 - DNA, 69 bp, Homo sapiens
ttttttttggtaacagggaacagtaagtctcatgcacaggagtcctaatgtccctgttgctaagaaaga

SEQ ID NO: 549444 - DNA, 69 bp, Homo sapiens
tgtaggagtgggagcaagggtgatttgtggaatgagcagctctgaagacaaacttctcctaatcctatg

SEQ ID NO: 549445 - DNA, 69 bp, Homo sapiens
atgggctctgggggtcaggcagctgggaaggagtttagaacccatgcctaggccttccccaaggctcat

SEQ ID NO: 549446 - DNA, 69 bp, Homo sapiens
agaagaacagatagaggctcccatgtaagtcagtagggacttcgtgtttgttatctatctgttgtttct

SEQ ID NO: 549447 - DNA, 69 bp, Homo sapiens
ggttttgcagggtataggcgcgcccgctgcagccggccggagaggcgggtgggcctctgcgctgctgcc

SEQ ID NO: 549448 - DNA, 69 bp, Homo sapiens
aattatccttggttttacaagtatggaggttattgaaaaacccctatacttgtgaaatcaaagataatt

SEQ ID NO: 549449 - DNA, 69 bp, Homo sapiens
agggggcagcttgtgtcccgctggtgtcatcccttccttgaggtccagtggtggaaagggtagcctcct

SEQ ID NO: 549450 - DNA, 69 bp, Homo sapiens
cctgcatataagaagtgaagaagagttaaaatgaaaatttggctgtttctttgatttcttgtttgtggg

SEQ ID NO: 549451 - DNA, 69 bp, Homo sapiens
gagaaagatcacctaggaagtgggtctagacagaacagaaaagagggccatattctagggatttatctt

SEQ ID NO: 549452 - DNA, 69 bp, Homo sapiens
actgttgttgatcagacagcacttctttatctctttaagttttaagtgctgtttctgatgaatgccagt

SEQ ID NO: 549453 - DNA, 69 bp, Homo sapiens
gatggagacatggaacagtgtggttgttaagaatgtgatctctgaagccagactacccaggtttctatc

SEQ ID NO: 549454 - DNA, 69 bp, Homo sapiens
agtatcttgcagccagccgctgggatgacgccctttggaacagatcagtcggctcaggctcatgatact

SEQ ID NO: 549455 - DNA, 69 bp, Homo sapiens
gtggtgcatgtttgagcaaacaaaaatgatgatttaagcacactacttattgcatcaaatatgtaccac

SEQ ID NO: 549456 - DNA, 69 bp, Homo sapiens
ttggggagcagggaccaggcgctgtgagagatatatgtaaaatctccagctcctagccctgttgcccag

SEQ ID NO: 549457 - DNA, 69 bp, Homo sapiens
catattcagctcttggatgtgaactcttagccaagaaactattcaaatattattcaggggctgaatgtg

SEQ ID NO: 549458 - DNA, 69 bp, Homo sapiens
tgcatgtctgtttcttctcaatgaatagtaggccatagaagcagttagcattgtaagaaacagtatgta

SEQ ID NO: 549459 - DNA, 69 bp, Homo sapiens
tgtttttctgtttctttctgtctcttggttccttaagggctttgatgatcagggcagaagcagaaggca

SEQ ID NO: 549460 - DNA, 69 bp, Homo sapiens
tttttttttcccttctcccttcaccattaccccactttgtggtaggaaagggaggacaggaacaggaga

SEQ ID NO: 549461 - DNA, 69 bp, Homo sapiens
gatttaaagagatggagagaggccatttggctggccccaaatttgacctacttttccctctcataaatc

SEQ ID NO: 549462 - DNA, 69 bp, Homo sapiens
ttcagactatggaaggttcattcagctccatacaaaaccccctgtattgctgagaaccacatatttgaa

SEQ ID NO: 549463 - DNA, 69 bp, Homo sapiens
ctgctccaatgtgcctgtctttttctaggtcaattcagcatgagattgacaaggaagcattggaagtgg

SEQ ID NO: 549464 - DNA, 69 bp, Homo sapiens
gattggccactggggtgttgagtttagagaaataggtatgagcctcataatctcaacccccagccactc

SEQ ID NO: 549465 - DNA, 69 bp, Homo sapiens
ggaggagcgggagggcccagggtgaggggctcccgggctccctccccggggtcttgctgctggagctcc

SEQ ID NO: 549466 - DNA, 69 bp, Homo sapiens
gctcgggggatgcagggccccactgtcccttagtcagcatgaggccaaaatgggcccttcatccccagc

SEQ ID NO: 549467 - DNA, 69 bp, Homo sapiens
ttgagatgtgggtgtcaggcagtgagctagaattacccattagctacatgatttgttcccacacatcag

SEQ ID NO: 549468 - DNA, 69 bp, Homo sapiens
gagccggaagaccagggttgaatcttggcttcttcccttactggccatgtaaccttgggcttcttgctt

SEQ ID NO: 549469 - DNA, 69 bp, Homo sapiens
gctctaattagaattcccttattccatttctgtttctcaggagaggacagggggctttttaattggggc

SEQ ID NO: 549470 - DNA, 69 bp, Homo sapiens
gccaatcttagtgtaccagagtatgccatggaatcaggccaggatgagctcaggtacttagagattggt

SEQ ID NO: 549471 - DNA, 69 bp, Homo sapiens
gccaccgcacccgcatgtcctggtcctttcagggcacccggaggtggccaggacagaggtggaggtggc

SEQ ID NO: 549472 - DNA, 69 bp, Homo sapiens
cgaggcagacaaaagttggaaggccggttaattttcccctccttctcctgcttcagctttgtctcctcg

SEQ ID NO: 549473 - DNA, 69 bp, Homo sapiens
cttcttttttgccaggttgtgctttcaggttgatgcccgattccctggagcacaccagtaaaattgaag

SEQ ID NO: 549474 - DNA, 69 bp, Homo sapiens
tgcagctgtccagtcatggggtgcaggtgaaacaaattcacgtgccgcttggtgctgggctagtttgta

SEQ ID NO: 549475 - DNA, 69 bp, Homo sapiens
gcgtccccgcgccgcaggttgcttaggaggaggactgggtttcctgggcgttcctgggcgccggggcgc

SEQ ID NO: 549476 - DNA, 69 bp, Homo sapiens
gaaatgtttgtatcatctgtgggctctgagctactccagtccagggtttcagatgctggcaggcatttc

SEQ ID NO: 549477 - DNA, 69 bp, Homo sapiens
aatggaaggttggtggtggaggacatcccagtccagtgcttttcttttttttgctgctgatttttcatt

SEQ ID NO: 549478 - DNA, 69 bp, Homo sapiens
gcagctgttgttgattttttttccaaattagcacattatgtgtttggaaaacagacaaaaaacagctgc

SEQ ID NO: 549479 - DNA, 69 bp, Homo sapiens
gagtatgtggggtgggaggtgaggggaagaggatccctcttctctttctccttccttttcctatatctc

SEQ ID NO: 549480 - DNA, 69 bp, Homo sapiens
ggatgccttgccaagtgtctaaaatggtgagtactgcttttgcttaaaagactgcttggccgagggtcc

SEQ ID NO: 549481 - DNA, 69 bp, Homo sapiens
gaggaatggacacctcaggatgcttcctgaacagggcctagtcaggaagtagcctggatgtgcatagtc

SEQ ID NO: 549482 - DNA, 69 bp, Homo sapiens
gattaatgcttgcctaggttacagtgaaggtactcatgtttcactgtgctctctagataggcattaatc

SEQ ID NO: 549483 - DNA, 69 bp, Homo sapiens
gggatcttttggggaagtttgggatctggcagggcatctgcataatccatagaaatccctgagagtccc

SEQ ID NO: 549484 - DNA, 69 bp, Homo sapiens
gcccttcgggaagccagaggccccatgggaaggagtgcctagccttgggggtctgtgactttggggggt

SEQ ID NO: 549485 - DNA, 69 bp, Homo sapiens
tagaaggtattgcactataagttgtaatggcccggaggcagccattatagtctaaaggtcaatgctctg

SEQ ID NO: 549486 - DNA, 69 bp, Homo sapiens
ctcctgcactggattgtcagtatttaaggctgtcttactcaaagtatttgatagtcctgcctgtgggag

SEQ ID NO: 549487 - DNA, 69 bp, Homo sapiens
agatactgaatcagtgaatggtttttggcattgctaagttgttccactggccattggatttcagtatct

SEQ ID NO: 549488 - DNA, 69 bp, Homo sapiens
ctgttgggaatataatgaaaactctgccctgtacagaggccagatgttttcatgcatattccccaacag

SEQ ID NO: 549489 - DNA, 69 bp, Homo sapiens
gggaagccgggatgggaaggctgggattttgtttcagaagtccctggttctgtgtccacctggcttccc

SEQ ID NO: 549490 - DNA, 69 bp, Homo sapiens
tggggagaaaggtatcatctgctgtctctttactcctaataccaactgcagcgatgctgtttctttcca

SEQ ID NO: 549491 - DNA, 69 bp, Homo sapiens
agctagaaaggcatggaggcaaacttggtcttaaattcagcacattcattttgcttcatgtcttttgct

SEQ ID NO: 549492 - DNA, 69 bp, Homo sapiens
gccgttcagtcagagaaaaatttggagtaaccagcagtgggtccatccagatcctctctctgcaacggt

SEQ ID NO: 549493 - DNA, 69 bp, Homo sapiens
ggctcccggcgcgcgctcccctctgaccacctacggaatgacctcagagtgggagaatgtgccaaggcc

SEQ ID NO: 549494 - DNA, 69 bp, Homo sapiens
gtgaaggaagggtcttaggggatcctagcaaaaagaacagcacacaggatcccctagaccatcccccac

SEQ ID NO: 549495 - DNA, 69 bp, Homo sapiens
tgggaaagagaaagaacaagtaaaaggaattttcattttccagcccctaattgttctgtctttctccca

SEQ ID NO: 549496 - DNA, 69 bp, Homo sapiens
aactccctgcccctcctccttggctctcttagctgcaagaggcctcagagcagtggagggcagggggtt

SEQ ID NO: 549497 - DNA, 69 bp, Homo sapiens
ctacacgtccttacaagcagtgctctgtggcccacatgaaatcaggccattgcatgctaggacctgtag

SEQ ID NO: 549498 - DNA, 69 bp, Homo sapiens
ggcctgtgcagcgagccttgctctatcatgcattaaactgtgaaagagcagtggctccatgcacaagtc

SEQ ID NO: 549499 - DNA, 69 bp, Homo sapiens
gtcccagccagcccagtggcacctccctcaggccaacacaattaggggacagcactgggggactgggat

SEQ ID NO: 549500 - DNA, 69 bp, Homo sapiens
ttcctgggaaaagatgagttttggtattagctggcacacactctatgccaaatcagtatttcccaggaa

SEQ ID NO: 549501 - DNA, 69 bp, Homo sapiens
tctcatggagcttagggtcagtgaagatctaaaatacatcaacacttagatctattaggtgctatgaga

SEQ ID NO: 549502 - DNA, 69 bp, Homo sapiens
cctggagaccagttggagtggtggactccaggttatcctcagaatctacccccttttctggtgaccagg

SEQ ID NO: 549503 - DNA, 69 bp, Homo sapiens
gtacttgaggagaacagattctgttttgagtgtcagctctgtcaaaacagaattggtctctttaattat

SEQ ID NO: 549504 - DNA, 69 bp, Homo sapiens
tagtgacctttgaacagcccagggatgcttcacagtgtcttattcttgatgcttgtttaaaggtttcta

SEQ ID NO: 549505 - DNA, 69 bp, Homo sapiens
tctcctaccactagttgtgtccctcccatagccttctgctttctaggttttgccagctgtggtgagaga

SEQ ID NO: 549506 - DNA, 69 bp, Homo sapiens
ccttgggtcctgagtgaggaagagagtagagtgcaacccattgtgagctctttctcatcaggctctagg

SEQ ID NO: 549507 - DNA, 69 bp, Homo sapiens
cagaacctgttcagatcccttaggtaccctggagtcacttggggatacacgaggggcaggagcaaaggg

SEQ ID NO: 549508 - DNA, 69 bp, Homo sapiens
caatgagcagtgaatatcaatgagaggaaaatggcccatttttgcttcattgatttttgctggtcaatg

SEQ ID NO: 549509 - DNA, 69 bp, Homo sapiens
taaaatgcaggtaaaatacttagcacagtacgcagtggatgtactgttaagcatattacctgcatttta

SEQ ID NO: 549510 - DNA, 69 bp, Homo sapiens
gataatttattgtgcactgtctcatttaatgcttgtggcaacctaatgaggcaggtacatttgattatt

SEQ ID NO: 549511 - DNA, 69 bp, Homo sapiens
tccttctgtcccctaccccttcccccacagctgggatgggagcggggaggggggaggaggcaagaagga

SEQ ID NO: 549512 - DNA, 69 bp, Homo sapiens
ggaggggaacaggcttggtgacgagggccttccctgcccccacctgtcactccagcctggagcccctcc

SEQ ID NO: 549513 - DNA, 69 bp, Homo sapiens
ttactcaggtaaaccaccaaatctcaggacctggaagcagtcatgagatttggtagtttacctaagtaa

SEQ ID NO: 549514 - DNA, 69 bp, Homo sapiens
gtggaaagaacctgggccgatagttagtcttatttgagattaatcatatcttggcttggttctaaccat

SEQ ID NO: 549515 - DNA, 69 bp, Homo sapiens
tacttctctttggtatatctggctaggttttgtcatcagttcttgtgctgggtaattctgagagtggta

SEQ ID NO: 549516 - DNA, 69 bp, Homo sapiens
caggcaggagaaagcgctatggtcattgctggaagattccttctgaccattagctatctctctgacctg

SEQ ID NO: 549517 - DNA, 69 bp, Homo sapiens
atatctctcatctttttatatttcatctccacacctttccttttgtgggattatggagaggagagatgt

SEQ ID NO: 549518 - DNA, 69 bp, Homo sapiens
ataatgtatagttttgtggtcattactggtcagataataaccggcagtgaccttaaaaccatgcattat

SEQ ID NO: 549519 - DNA, 69 bp, Homo sapiens
cacccctcagactggcctctcactggtgaagatgtggttcagacagtgtctcagaggccatctgtggtg

SEQ ID NO: 549520 - DNA, 69 bp, Homo sapiens
gtcaaagatggaaaagaaatgagtagctgacaatggctttggttttgttttttttccttttcctttgat

SEQ ID NO: 549521 - DNA, 69 bp, Homo sapiens
cttaaaggctagtgcatggaacctccactctactctgcaggcagtgaagaaccatgactagtgtttgag

SEQ ID NO: 549522 - DNA, 69 bp, Homo sapiens
tgttttagctggcccattttgaaaattgaggtcatggatgatggcttcctgagtggggcagcaaaagca

SEQ ID NO: 549523 - DNA, 69 bp, Homo sapiens
ccagccttgatgccacctgagggcctgagcctcagtggggttggagccctggtggcagcccagggccgg

SEQ ID NO: 549524 - DNA, 69 bp, Homo sapiens
tcagctgggttctttttatagtttcaatcatccctggtaatgaagattctgcaattagaactcagctgg

SEQ ID NO: 549525 - DNA, 69 bp, Homo sapiens
gcccctctccggaatcccctatcctacacccatgtagctctttgaggatgggatctgggggtgaggggc

SEQ ID NO: 549526 - DNA, 69 bp, Homo sapiens
ttccttctgccccctccccacctcagcgcacacacatccctgtggtgggagagcggtgggggtacggaa

SEQ ID NO: 549527 - DNA, 69 bp, Homo sapiens
gtgtgagaagaggcacaaatgctacactggaagtgaaaacagagtctgcaattgtgctcctttctctac

SEQ ID NO: 549528 - DNA, 69 bp, Homo sapiens
tagtttggaattgttcctgggctggtgactgtgatggtgcaatccatagcccaggaatgaccacagcta

SEQ ID NO: 549529 - DNA, 69 bp, Homo sapiens
tgactcaggtgcagtaattgccacagaaattggttttggtgtctttggggaattctgcagttgaaccca

SEQ ID NO: 549530 - DNA, 69 bp, Homo sapiens
ttcccgtcgccgttgcccatggcttcgcacacaggtcagtgctcggccggggcgggcgcgggacgggag

SEQ ID NO: 549531 - DNA, 69 bp, Homo sapiens
gggtaggggtggggcaaaggggcatgcttctgtttaaatcaagtctcctctgtcctcacccctttgctc

SEQ ID NO: 549532 - DNA, 69 bp, Homo sapiens
tggctcttagctccccctggcaggacctcctcagggtgctgggtctgtcctgtctgggtggggctgcca

SEQ ID NO: 549533 - DNA, 69 bp, Homo sapiens
ctgcttccctctctccactgaacactcattttctgcactgtgagctttttgtggcaggaaggtctgtag

SEQ ID NO: 549534 - DNA, 69 bp, Homo sapiens
tgtggtgcacgtttgagcaaacaaataatgacctaagcacagtatttattgcatcaaatatgtaccaca

SEQ ID NO: 549535 - DNA, 69 bp, Homo sapiens
tgtggcggtggagagagggaatgtgggatgatagttctgccctgcgttgtctctttcataccgttcacg

SEQ ID NO: 549536 - DNA, 69 bp, Homo sapiens
ttacttaggtaaactaccaaatctcatgactgcttccaggtcctgagatttggtggtttacctgagtaa

SEQ ID NO: 549537 - DNA, 69 bp, Homo sapiens
gggaagggaagaatggggagatggaaagcatttacttcttattctgaacctcatttttctctccttccc

SEQ ID NO: 549538 - DNA, 69 bp, Homo sapiens
gatccctaagggtgctgctctctgtgactgacatccggttaggagtagaggcagtttcccctggggatc

SEQ ID NO: 549539 - DNA, 69 bp, Homo sapiens
ctccaggacaggctccaggggctggggcacaggctcctctgtgggcacagcccctgagtctccctgggg

SEQ ID NO: 549540 - DNA, 69 bp, Homo sapiens
gcgggagagccccagcccctccgggagctggaaacggagcccagtctgggggcgccggggctttcccgt

SEQ ID NO: 549541 - DNA, 69 bp, Homo sapiens
atacattattacttagaagcatgtaagttgtggctgtactgcatactcctgcatttggtaatgatgtgt

SEQ ID NO: 549542 - DNA, 69 bp, Homo sapiens
ctgggtaccaggcgaatcctactgggtaggtcgggtacgcggcatatgtggggtatgtttggtatccag

SEQ ID NO: 549543 - DNA, 69 bp, Homo sapiens
cctggaggctgctgggtgacctcgggcacatccctggccttctctgaggctgccctgcctgcctccagg

SEQ ID NO: 549544 - DNA, 69 bp, Homo sapiens
ttactcaggtaaaccgccaaatctcaggacctggaagcagtcatgagatttggcagtttacctaagtaa

SEQ ID NO: 549545 - DNA, 69 bp, Homo sapiens
gcaggaaacagaagggatgcgccaaggaaaagaacaggcaaatggcaggcatcccttttagttcatggc

SEQ ID NO: 549546 - DNA, 69 bp, Homo sapiens
ttggggagatgagacctactaatatgctgggtgtctacagcagcataatacagggtttatttttttcaa

SEQ ID NO: 549547 - DNA, 69 bp, Homo sapiens
ctgaccagtataaatctggatacttcatccatggttaatgaatgaagtgtccagatttatactgttcag

SEQ ID NO: 549548 - DNA, 69 bp, Homo sapiens
gttataatgtgtcaggagtaaacagcctcattcattctgttagttctgttgcttctggcatgttatgat

SEQ ID NO: 549549 - DNA, 69 bp, Homo sapiens
ttacttaggtaaactgccaaatctcatgactgcttccaggtcctgagatttggcggtttacctgagtaa

SEQ ID NO: 549550 - DNA, 69 bp, Homo sapiens
cttgtggaaaagcattaagatcattttaccttaaaaagaaggtgaggtgacttgatgactaccactaag

SEQ ID NO: 549551 - DNA, 69 bp, Homo sapiens
gtgcccatattctgtatggttaagtgcgtgccaactggcttttactgcatgcggctctaatttgggcac

SEQ ID NO: 549552 - DNA, 69 bp, Homo sapiens
gtgtgaatattgcttctatttgttttatacttgccgtggtgattgtaggggagagaagtgatattctac

SEQ ID NO: 549553 - DNA, 69 bp, Homo sapiens
cttcataggtggtttagagtatgtggaaaaggtctctgctttcctactagactgtaaatcgcttggagg

SEQ ID NO: 549554 - DNA, 69 bp, Homo sapiens
ggggatggggggcagaagcctaaggctaccacccctttatttgccttcatgctgctgtcccttttcccc

SEQ ID NO: 549555 - DNA, 69 bp, Homo sapiens
gacatcaccacacttcctggtgcctggtgcactgcaaggcacctagacgcccagtaggtggatgatgtt

SEQ ID NO: 549556 - DNA, 69 bp, Homo sapiens
ctggctgctgacctgcccagggtgtgtctgacctgaggggacccactcctaggctggccagcagcccag

SEQ ID NO: 549557 - DNA, 69 bp, Homo sapiens
gtgaaggagggttctcagaggatcctagcaaagaaaacagcacataggattccctggaccatcctttac

SEQ ID NO: 549558 - DNA, 69 bp, Homo sapiens
tacctacctgagacccggtccaggagtgtctaaggacacccagtgcttctgggctgggctggggcctag

SEQ ID NO: 549559 - DNA, 69 bp, Homo sapiens
gcctctttgtccatcagaatgtgggggaagctacagctacggaccaaactatggatggacgaagacggc

SEQ ID NO: 549560 - DNA, 69 bp, Homo sapiens
gctggactacagctgtgtgtttatgtgcagtgcacacctgcaggggcctgacaaatagctgtagtatgc

SEQ ID NO: 549561 - DNA, 69 bp, Homo sapiens
cactggtggctttctagggtcacttcctcttacaggaggttgtcgtgaccgctgggaatgcagccaatg

SEQ ID NO: 549562 - DNA, 69 bp, Homo sapiens
gaggacaggctggcagggggaggaaaaagtgaaaaagaatttttttcctccctttccgtctctgccctc

SEQ ID NO: 549563 - DNA, 68 bp, Homo sapiens
cagggacatggagtctgcggccgcccaggtgtaaaccaggaccctgaggatgggcagctccgtccctg

SEQ ID NO: 549564 - DNA, 68 bp, Homo sapiens
tgaaagcagctgcagaacccttctctccctcagcctgggtctgtgtttagggttctggcttgcttaca

SEQ ID NO: 549565 - DNA, 68 bp, Homo sapiens
ggcagagaaggaagcagccagagagaagagcacccgccccacccctgctggcagcttcctccttctcc

SEQ ID NO: 549566 - DNA, 68 bp, Homo sapiens
ttaagcaggtgattatagtaaacatataaggcatgtgggcctatttgtttgctctagctcctgcttaa

SEQ ID NO: 549567 - DNA, 68 bp, Homo sapiens
ggcagggcactgacgggcggctcccatccctcccgcttgtggagtgtgggtagccctcggtccctgct

SEQ ID NO: 549568 - DNA, 68 bp, Homo sapiens
aagcgcgatgccctctcctagatctacaaaccggttttttcctggctagggaggggatacgtctgctt

SEQ ID NO: 549569 - DNA, 68 bp, Homo sapiens
aaataatagtaactacctcacagggtgaatgtccattgctactgtctttggggttgttattattattt

SEQ ID NO: 549570 - DNA, 68 bp, Homo sapiens
ggccgggtcggtgcggacacggcggtaaccgtagggaccgtggccgcccctcccccaccggcccggcc

SEQ ID NO: 549571 - DNA, 68 bp, Homo sapiens
ggaggaggcctgggatgagcaggagaaggacgaggtccaccaccctgctccatttccaagcctctccc

SEQ ID NO: 549572 - DNA, 68 bp, Homo sapiens
gttcatagctaggccttcttaagtgtctggttaatattttaagctgtacatttaagaggttcttgaac

SEQ ID NO: 549573 - DNA, 68 bp, Homo sapiens
actgagagcctggggaggtgaggggaactttgagtaaatgagctccctatacctgcccctgggccagt

SEQ ID NO: 549574 - DNA, 68 bp, Homo sapiens
ggcattcccctttacccatggagctcactgcagtgtgcagcgatggcccaagggtggagaggaaggtc

SEQ ID NO: 549575 - DNA, 68 bp, Homo sapiens
gaccttagtggtcattgttaaggtcacacagccatcaccagaatgtgacctgacagtggcctctggtt

SEQ ID NO: 549576 - DNA, 68 bp, Homo sapiens
ggtccattgtggcggcctctgacatcacagcagggggcagcgtgatgtcacagggccccattgtggct

SEQ ID NO: 549577 - DNA, 68 bp, Homo sapiens
gctgctgcgcgcaacctctggggcaacctccccccgctgctgctgccccagaggctgggtgcaggggc

SEQ ID NO: 549578 - DNA, 68 bp, Homo sapiens
tccttgtcctctcagagttgtctgcctgaatcttgtttagtgtgactgatcattctagaggctgggga

SEQ ID NO: 549579 - DNA, 68 bp, Homo sapiens
gaatgtttgccgcgacgtactgagtattgcatcaatggggaggttatggagtatgtcagcagacattc

SEQ ID NO: 549580 - DNA, 68 bp, Homo sapiens
tgaaatgaatgtgattcgatagttatcgcatcctcataaatgtgttagattgaatcccattcatttta

SEQ ID NO: 549581 - DNA, 68 bp, Homo sapiens
cagtaaattgtctttctgtaagtgtccaaaaaaaaatcaaggaagcttacaaaagacatgatttactg

SEQ ID NO: 549582 - DNA, 68 bp, Homo sapiens
ttatctatgccatggaatcacctccagctagtaagggcaggctggaaaggattccgtgatacagataa

SEQ ID NO: 549583 - DNA, 68 bp, Homo sapiens
ctgcagagctaggctgagtgaatgaagggctaggtgaggtctgtgaactgctgggcttgggtttgtag

SEQ ID NO: 549584 - DNA, 68 bp, Homo sapiens
agctcaggagaggagataggtgtgcaaattaaattttagtctttccagccatctcctttttctgagtt

SEQ ID NO: 549585 - DNA, 68 bp, Homo sapiens
agtgtaaggaatggagaagttcttcaaagtttcttaaaaccataaagagcttgtcatttctttgcact

SEQ ID NO: 549586 - DNA, 68 bp, Homo sapiens
tttattctccagatggcgagactgtgccgccctgccgcgagggaccacctcttccactggagtgtaaa

SEQ ID NO: 549587 - DNA, 68 bp, Homo sapiens
tatttctagaactctatggctttgacgtgctcatagattctactctgaagccatggttgttggaagtg

SEQ ID NO: 549588 - DNA, 68 bp, Homo sapiens
tatctttcctttgtgtgtgatgtttaagttggagttgagggaagtgctccatgtgtagaggaaagata

SEQ ID NO: 549589 - DNA, 68 bp, Homo sapiens
aaactgactctggcttcagtgtggcccatggcttggagtaagataggctggaggcaaagaggcagttt

SEQ ID NO: 549590 - DNA, 68 bp, Homo sapiens
ggcggtggtggctttggcgctggtggcaggggaagccttaacggccccggagctgaagcctctctgtt

SEQ ID NO: 549591 - DNA, 68 bp, Homo sapiens
gggctcagtgttttttattcttatgtggattatcaatctgcagtgaattgggagccaggctgagaccc

SEQ ID NO: 549592 - DNA, 68 bp, Homo sapiens
aaaagaatgcttcctttgaaactgaagttctttctacttggtttcagcccaaaggtgagcattttttt

SEQ ID NO: 549593 - DNA, 68 bp, Homo sapiens
tgcagagggagagagcgttaccacctcacaataattttcttctcaagaatggttctctctccttctca

SEQ ID NO: 549594 - DNA, 68 bp, Homo sapiens
ggagccatgagcagaacagactggagcagcacggatgtagcagggttccagctgttcacctcagctct

SEQ ID NO: 549595 - DNA, 68 bp, Homo sapiens
cccctctgtctcttggcctgtgtcctgtgtctggcagaggctgcccatggtccaggaagacagagggg

SEQ ID NO: 549596 - DNA, 68 bp, Homo sapiens
caggactccccagctgcagtcagcaggccctctgtatgctttggcgtctgcagctggaaggaagcctg

SEQ ID NO: 549597 - DNA, 68 bp, Homo sapiens
taggaatttagagagacagaccacttcagacaagattggtctggaatggtgtgctttttactgggcgg

SEQ ID NO: 549598 - DNA, 68 bp, Homo sapiens
ggcgcaggctcggggtgctgttctagcttcaataggagggagactgttgcagcctcagagcctccgcc

SEQ ID NO: 549599 - DNA, 68 bp, Homo sapiens
aggtcataacatatttttctcagtaaagacattgaccaagtcttcactgagctaatatgttaaagcct

SEQ ID NO: 549600 - DNA, 68 bp, Homo sapiens
tccccgacatctcctgcccacttcttaccactgcccgacagatgaggcaggtggggaggagaagggga

SEQ ID NO: 549601 - DNA, 68 bp, Homo sapiens
ttcccatccttgccccggtacaatgtgtagagctgatacgccctgaactcatggggtgggggtgggga

SEQ ID NO: 549602 - DNA, 68 bp, Homo sapiens
ggcctttaggttgtaagcacatttgatttttatagacagaaatgctgagatgtacttactttgaggcc

SEQ ID NO: 549603 - DNA, 68 bp, Homo sapiens
agcatgagcttagaagtcaggcaggcctggattttaattctagcactgccgttttctaactatatgct

SEQ ID NO: 549604 - DNA, 68 bp, Homo sapiens
agggaaacacaagagcaaggtgctgaggtaaaaaacacctgaggtagcttttttctgtgtgtttttct

SEQ ID NO: 549605 - DNA, 68 bp, Homo sapiens
ttctttttccttagggacctgtgtttggagtatgcttatgagccagacagagaattggggaagcagaa

SEQ ID NO: 549606 - DNA, 68 bp, Homo sapiens
gcctccctgcacagaggctgtgcatgtcccctgggcattcactctagctgtctgggctgcagggaggc

SEQ ID NO: 549607 - DNA, 68 bp, Homo sapiens
agattcatcaagcaaaggttaagggctagtgttgtttttctctggcctagaacttggcttgttttgct

SEQ ID NO: 549608 - DNA, 68 bp, Homo sapiens
ctaggccatctatttttttctcagagatagaaattgaagagatctttgagtaagtatagatggtttag

SEQ ID NO: 549609 - DNA, 68 bp, Homo sapiens
tgcactcccctactgagtcctgagacctgagtgcaccccatagagtaggactcagatgagggaatgca

SEQ ID NO: 549610 - DNA, 68 bp, Homo sapiens
tcatgaagcttacagtatgatcaacttttcacctgtggaaaaatataattatgctgtaagttgtttga

SEQ ID NO: 549611 - DNA, 68 bp, Homo sapiens
atgtaacggtgtctagaggaagggatgctgtgttccacctacttgtcttttgctctgaggctgtacat

SEQ ID NO: 549612 - DNA, 68 bp, Homo sapiens
aaactttaaagagtctcttgtctgccctggtgttagggcagcatggcagctagagctctttaaagttt

SEQ ID NO: 549613 - DNA, 68 bp, Homo sapiens
gtgcaaatggcagttttgttatttggtgtcaaagttaccagtcgcacaatgacaagctgccataacac

SEQ ID NO: 549614 - DNA, 68 bp, Homo sapiens
ggccaggctgaggacccaagtcaggccagctgtctctttgctgcctggcctggggtccacacctggtc

SEQ ID NO: 549615 - DNA, 68 bp, Homo sapiens
aggtatgggagactaggttgtgattgcaagatgaaaataatatgtttcaacttataccttctatacct

SEQ ID NO: 549616 - DNA, 68 bp, Homo sapiens
tgaacttggagtgagaagacctgggttcagattccacatttgttatctcagtcatctcggccaagtca

SEQ ID NO: 549617 - DNA, 68 bp, Homo sapiens
gatattaatatgtattgagtactttagtaggttccaatactgtactaaagtactttacatatattatc

SEQ ID NO: 549618 - DNA, 68 bp, Homo sapiens
aacttatctaaatggttaaatgagcatacaggtcaaaaagtatgctcacttaaccactcagataggtt

SEQ ID NO: 549619 - DNA, 68 bp, Homo sapiens
tcaccctcctcttttgccctcccccatctgattaggcgcggactgggaagggtgggagtggtggggga

SEQ ID NO: 549620 - DNA, 68 bp, Homo sapiens
taccctcctctggcctccctccctttcctaaactggggagggctgtggtggggctgggggcgggggtg

SEQ ID NO: 549621 - DNA, 68 bp, Homo sapiens
cattgattaatgaaatctagtataaacgggtgtcatgccctttaaatattagatttcattacttagtg

SEQ ID NO: 549622 - DNA, 68 bp, Homo sapiens
tgcctaggctgagctcagggttcagggcaggaccagctcaggatcctgtaagggctgagcctaaggca

SEQ ID NO: 549623 - DNA, 96 bp, Homo sapiens
gtccatctctctcttcttcttgagtaacatcagattcttcatcagtgccaactgaagtcccactctgattcaacttggcaggagacttagatggac

SEQ ID NO: 549624 - DNA, 96 bp, Homo sapiens
ctgcttgctatgtaaatagaggtttaattaacacttaaagttttgcatcttcacaggttgcaaatgttaattaaatctgtatttacatggcaagag

SEQ ID NO: 549625 - DNA, 96 bp, Homo sapiens
taaggcatagatatggtcaagtgttctggaaaattgcttctggctttatcaagtactagaggcttagttttcagagacttaacgtgtttagtttta

SEQ ID NO: 549626 - DNA, 96 bp, Homo sapiens
agattcccagctgctttaaaaaatgctttgagtaaatgccagaaggtacaagtggcatttactcagaaaatatttttagagcagctgatggtgttt

SEQ ID NO: 549627 - DNA, 96 bp, Homo sapiens
ctggaactctgttcttgacagcaaagcagagccaaggcttctgctgcctaatgagaagatgccctggttctgccttttgtcttcttgagttctcag

SEQ ID NO: 549628 - DNA, 96 bp, Homo sapiens
tagcactccccttgaatgtcacagctggagagtgacctaacagatcattaagcctggtcactttacagctgtgtgccgtcaagttgaggggtgcta

SEQ ID NO: 549629 - DNA, 96 bp, Homo sapiens
tgaagatgctagattgtggaaaggtcagagattggaatgctagattccttagcatgctaaattttagcttttctgtaaaaattttagagattttca

SEQ ID NO: 549630 - DNA, 96 bp, Homo sapiens
agactaattaatgtttcagagtgtttaaacacaatgcctctacagaagcaatggcattataatgtgttgggacactctagtgttgtaattagtact

SEQ ID NO: 549631 - DNA, 96 bp, Homo sapiens
acacacccatctcaataaatagctgttgagttgctggagcagtgtggctgctgctttgatggccagtgatgaacagtgtttgagggatggatgtgt

SEQ ID NO: 549632 - DNA, 96 bp, Homo sapiens
ttctattgattttagggcagcatttatttgaggcaggaagttggaccagatgacctattcatgcctctctgtcaatgttgttctatttacaaagag

SEQ ID NO: 549633 - DNA, 96 bp, Homo sapiens
aagtgcctgtggtgtaggagtcagtcactcctatctctagaaaaggatggtggctaggagagttgtctgatttttacataatcccagaaagtactt

SEQ ID NO: 549634 - DNA, 96 bp, Homo sapiens
gagttagagtgtgcttgtttaaagaggaaacagaccaaatgagaaaacagattgcattttctgtttttcttttaaaatttcaagctgctttaagtc

SEQ ID NO: 549635 - DNA, 96 bp, Homo sapiens
tgtctccatctgctttctgtgaatgctggggcaataggatgggcatggacttgaaatcctgtttctctgccatttacagttaggtgaatgtgggca

SEQ ID NO: 549636 - DNA, 96 bp, Homo sapiens
tacagcagcctggctgccaacgaggacaagtctaaggcaggaagtacatctcacgtcctgcttagatttgatcctttggctgctcaagctgctgtg

SEQ ID NO: 549637 - DNA, 96 bp, Homo sapiens
gcagatattggcttatgatggggtcaatatcacgatttatttaactctggagacaataaatcttgatattgactaaaaacataagtcaatatgtgt

SEQ ID NO: 549638 - DNA, 96 bp, Homo sapiens
gggcccagtgctgggctgctgggctttctgggacgacctactgggcttgctacacactcctcctcccagaaactccacacccacagccctgggtct

SEQ ID NO: 549639 - DNA, 96 bp, Homo sapiens
cacttacttctttgttatcccagaccacagtcctttgaaaagctgacatggctttttgctaagggtgatgatggggctgggattagaagtatagtg

SEQ ID NO: 549640 - DNA, 96 bp, Homo sapiens
cctggcaatccaactgctgctgtttgccgtcattgccttgatgtcattgttcaggtgggaggcaggaagggtaaggagaaagtagtgaatgtcagg

SEQ ID NO: 549641 - DNA, 96 bp, Homo sapiens
gagtctaatagttggcaaaaacaaactgattctaacccgtagcttcaagccttcatgagttagaattggtttgtttttgcttcccaaccaagactc

SEQ ID NO: 549642 - DNA, 96 bp, Homo sapiens
agaaagattcagtgatactaatatgtctaatgattgctaagcacaaccacagacactagcagtcattaggcacattagcatcactggattgattct

SEQ ID NO: 549643 - DNA, 96 bp, Homo sapiens
aaccagcatctatttaacctcaaggatgattctgaaagagctgaagaaaataagtcctcctttagaatcatccttggggttaaacagatcctggtt

SEQ ID NO: 549644 - DNA, 96 bp, Homo sapiens
gtgcctgctggtttagttcaggtcacgggctctaccttggagcagggaagggatggttaaggtggaacacgtgacctaggctgagccaacaggtac

SEQ ID NO: 549645 - DNA, 96 bp, Homo sapiens
tgtccttgttgacattgttgttgctctgctgacttgtttttctcctggagcggagcctgcctgcagcacagcacagcggtgactcagcactggata

SEQ ID NO: 549646 - DNA, 96 bp, Homo sapiens
gattggggactaggcaggaagccagagcaggggaggttccctcaggccagcttgacctgctccttgacctctttggctcctggcttctcctccttc

SEQ ID NO: 549647 - DNA, 96 bp, Homo sapiens
cccagctcagaagtccgcccacattctgcggtggagagagttgccaaaaccattctctgcacctgtaggatgaagtcgcaggttcacagagcaggg

SEQ ID NO: 549648 - DNA, 96 bp, Homo sapiens
ttccttaactttgctgagcctcctttgtaaaatggagaaggaaaaacatgttgtacaaacccttctcttttacaggggaggaaagtgagaaaggaa

SEQ ID NO: 549649 - DNA, 96 bp, Homo sapiens
tacctctcttttttggacaagagatggaggaagctgcttctttcctgtgtataagtggagagaagccgttgttctccatccctggtctatgaggta

SEQ ID NO: 549650 - DNA, 96 bp, Homo sapiens
ggatgtaaggggaacattctgtacataagtaatctgatatcagcttctggcagaacaaacagattacttatatacagaatgttatccttagagttc

SEQ ID NO: 549651 - DNA, 96 bp, Homo sapiens
cttcctaatccctaaactaagctcagggaggcatttgtcatctctgcctggctcagatgagatgctctgccctgagtactatgagagattgggaag

SEQ ID NO: 549652 - DNA, 96 bp, Homo sapiens
caggggcattttctgcccatgattgccttgttttagtgacatgcatctgtcagttagatattaaaacagagtaataatgggaagataatatgctgg

SEQ ID NO: 549653 - DNA, 96 bp, Homo sapiens
cagacgagggcagaggagagagagcgaggctttgagagaaagagcaagtatttttggagtctgatttctcctctgagcctatgaatatttgtactg

SEQ ID NO: 549654 - DNA, 96 bp, Homo sapiens
acattttttccttgttccagagctaagaaacctctgaatggagaggaaggtgactctattcagaggctttctgggctgggagcaggatggcattgt

SEQ ID NO: 549655 - DNA, 96 bp, Homo sapiens
gccacaggaaccacaagcagctcattctcattccaagacgttttgtaaataaactaaggaaatgtgtgggggaagggaagtctgcttttcctgtgc

SEQ ID NO: 549656 - DNA, 96 bp, Homo sapiens
gacatgctgtccacagtgtgtttgataagctgacatgggacagggattcttttcactgttgtgtcagtttatcaaacccatacttggatgacagtc

SEQ ID NO: 549657 - DNA, 96 bp, Homo sapiens
gtgccaaagagtcatccattagtgacaagaatgactggaaaactgtttccaacgccttttctgtcattgattttactgaagctgacctcgaggtac

SEQ ID NO: 549658 - DNA, 96 bp, Homo sapiens
ggccagtgggaacaggctgctgtaagccttgcaattaggacttttttctatgggcagtggggggtattgaaggctgaagcagcctgtggcatggtc

SEQ ID NO: 549659 - DNA, 96 bp, Homo sapiens
gtgaaggcagaaattgctaaactctgtagtgctatcaggggcacatgggcatcttcctggaactagcactaccagagtgtagccctctccctacat

SEQ ID NO: 549660 - DNA, 96 bp, Homo sapiens
acatctgaaacattgttttctatcctcagcatcatgaaaccctaaacatacaggtttctgtcttgctgctggggtgggaaatttggatcagtatgt

SEQ ID NO: 549661 - DNA, 96 bp, Homo sapiens
ccaagactcatggccttgacctcccctagacctggctgagcacctgccccctggtcagcagcagcttgagtctgggaggtcagaggctaagcttgg

SEQ ID NO: 549662 - DNA, 96 bp, Homo sapiens
aggcaagttttattggccattactatttgcctcaagtgagtggcaaagcctttgaccactcgaggcatatattaatagccctataaaatacatcct

SEQ ID NO: 549663 - DNA, 96 bp, Homo sapiens
atattgtaggtttttgctcatgcaccatggttgtctgagcatgcagcatgcttgtctgctcataccccatggtttctgagcaggaaccttcattgt

SEQ ID NO: 549664 - DNA, 96 bp, Homo sapiens
ttttattccctctctttcccctattcttatatgtgctccagcttccccattgtccctggagcacatttaggaataggggaaagggatggaatgaag

SEQ ID NO: 549665 - DNA, 96 bp, Homo sapiens
atgaaatcaaggcagacaaccaaacaggatatttcaatttttataacctactttggtatctatattatcccgtttggtaatctgccttgatcagat

SEQ ID NO: 549666 - DNA, 96 bp, Homo sapiens
gccctaccaggcatgatactggagttgtcccatgggccctggaataccatgggtagctctggtctaatgcctcaagaaatacatggggggtggggt

SEQ ID NO: 549667 - DNA, 96 bp, Homo sapiens
aagccttgtgggagaaggggtcaaaggaaagcaatggccatgactgaggtgatgaattctttggcttttcttttatgcaattaacaagcagggctt

SEQ ID NO: 549668 - DNA, 96 bp, Homo sapiens
gtgttgcctaggccagggtcgggggtcacagtgggtcgggggaagctgatttctccaggctcagtgtgactcctccatcctcccctggacagaagc

SEQ ID NO: 549669 - DNA, 96 bp, Homo sapiens
cacacttcagcaaatgtagctggcactacgatggctgggacccctgtgggatgctcaggttgcaagttgaagtgctggctgttttgctgattcatg

SEQ ID NO: 549670 - DNA, 96 bp, Homo sapiens
ggccaaagaatgatcttgaaaacattggcttctaaaagtctgcttgatagtagtgtggacattagagctaagtttttggattgttctttcagagcc

SEQ ID NO: 549671 - DNA, 96 bp, Homo sapiens
gctactcaatgttggtcctccctctcctgcttcatccccatggttttcttgaggaaagaagacagggtcagcaggggagggtggagggttgagagt

SEQ ID NO: 549672 - DNA, 96 bp, Homo sapiens
ttggaactaagtgagcaccctgcccacccccagccttgtcccctaaactgggtggtttaggtctgaggggtggggagaaggctgcccagagtccaa

SEQ ID NO: 549673 - DNA, 96 bp, Homo sapiens
ttcttagaggattgcctttgtctggctgcttgttttgatgggtgtaaaacaaataagattagaccgagcagcccaactgaaagcgatagctgggag

SEQ ID NO: 549674 - DNA, 96 bp, Homo sapiens
tgcaaaagacctaatgtgtctgggaagctatttctgggtctatatgccgaaactttcctagaggccaggaaagttacttagaacattgggcttgca

SEQ ID NO: 549675 - DNA, 96 bp, Homo sapiens
cagggtggggggcagccagtccagaggagctgagagtagggcagggagttgactccctgagtcttggcttcttggctgtgttccctctccgatctg

SEQ ID NO: 549676 - DNA, 96 bp, Homo sapiens
caatttttttgtatgtctgagcgaagcccaggcattcagcgaatcatgtaatttattctgcagtgccgagcctgggctgtctcagacatcatattg

SEQ ID NO: 549677 - DNA, 95 bp, Homo sapiens
ttgatgctaaaagatggattgatacttctttcatcctatcagccttttagattgataggatgaaggaaggttcatcaagtttttccagacatcaa

SEQ ID NO: 549678 - DNA, 95 bp, Homo sapiens
ccaggaatggctctgagctactggagggagggatggtggtcaccgcatgctgaaaccacatcctgcccttcagctttggctcatgctagttctgg

SEQ ID NO: 549679 - DNA, 95 bp, Homo sapiens
gggaaagggagaactatggggggcacttttggcatccctccatagtgtgatcagagaggggagatgctaaaggtaacccctatagtttgcctccc

SEQ ID NO: 549680 - DNA, 95 bp, Homo sapiens
tcccactgccctgagcttggagactcaaaggataaaggagtctccgagaaagctctcccatagccttctaattctccaagcaggggcagcaagga

SEQ ID NO: 549681 - DNA, 95 bp, Homo sapiens
gcagctggtgcctgcctggcccccagggacctggcaagtctggaagtgaggccaggtccccagggctcaggctgcaggggccaaccacaagctgc

SEQ ID NO: 549682 - DNA, 95 bp, Homo sapiens
cctcaagcctctaatctcatctgtgaaaaagaactgtactttactgtccacaaaacagtctattttcaaagtgagaggagaatggccctgtgagg

SEQ ID NO: 549683 - DNA, 95 bp, Homo sapiens
tcctgggcactcttggcagcctcgtaggaggggctggtggtgtggacagtcctgtggcccctcacatgcagaggtttccgggtttctgcccaggg

SEQ ID NO: 549684 - DNA, 95 bp, Homo sapiens
aagtgggagacagcatgtggttagaaattaggagaattgacatgatgtcctattctgctattttttagccataagcaagccctgtcacctcactt

SEQ ID NO: 549685 - DNA, 95 bp, Homo sapiens
agcttatttaatatgacatcagttgaataaagccagctgtgagtaattatctccgatatttgatttccagctgttttgttgaactgttatgggct

SEQ ID NO: 549686 - DNA, 95 bp, Homo sapiens
gcaggcttcctggctttggggtcagaaagttctagatggtaatgaaaagctgggcccttcttagattaactgttcctgaaactccagaagcctgt

SEQ ID NO: 549687 - DNA, 95 bp, Homo sapiens
gaagatctcaggcagtgaccctctagatggaagcactgtctgttgtctaagaaaagatcgtgcatccttttagagtgttactgtttgagaaaatc

SEQ ID NO: 549688 - DNA, 95 bp, Homo sapiens
ctccttatccacagcacaatgaaaccccaagagaatccatctggagagagcgaaacgggatggattccgggtgttttggggtgagggacaggggg

SEQ ID NO: 549689 - DNA, 95 bp, Homo sapiens
acaaggagacagatggaaatttgtggaatttactctcaggagcctgcatggtcatacggagtgtttttaacagggtttccaattcttctcattgt

SEQ ID NO: 549690 - DNA, 95 bp, Homo sapiens
aagaaggcagagctcaaggagggagtcccagaggggtgacagtcctttgctcatgctgtggctcactcctgggttcccttccctctctccttttt

SEQ ID NO: 549691 - DNA, 95 bp, Homo sapiens
gaaaccccgggcggagcagagctgggcttggctggtccatgtgattcccccttgctgaccagcacaggcccctctctcccagggcccagggtttt

SEQ ID NO: 549692 - DNA, 95 bp, Homo sapiens
gctccttctgttgtcctaaggatgaaggcgctccctgtcctttgcagaggctcccttagcggggggtgcttcctcattaggatgcaaatgggggt

SEQ ID NO: 549693 - DNA, 95 bp, Homo sapiens
attcctaaggcccttggctgagccccttctctctctccaggtacccaaggaaggcagttcttagatggagtaggggctgggctgcatggggtctt

SEQ ID NO: 549694 - DNA, 95 bp, Homo sapiens
gggcctggcatgcagcaggtgctcactaaacacctgcttactggatgcataaaggcgagctactgtttagtaggcacctactgtgtgccagcccc

SEQ ID NO: 549695 - DNA, 95 bp, Homo sapiens
atttcctaataaattaacccagcttttcaaaatgggtcccctagaactgtacccagggactgtttttgaaaagttgagttaatgtactaggaaat

SEQ ID NO: 549696 - DNA, 95 bp, Homo sapiens
taaataagtaattatgcacactcattgtctgtgcctgacatgtggcacttggcatgtcaggcacagttgatgagtgttcatatgttacttatttg

SEQ ID NO: 549697 - DNA, 95 bp, Homo sapiens
gatcatgtaatgggcagctaatactcctagtggggggggttcctaatttggctgctctccccacttttgtattgttaaggcaccgaggcatgatc

SEQ ID NO: 549698 - DNA, 95 bp, Homo sapiens
ctggtcctttcccctgccaaagggagggatggaggccctgaggacccaggctcttccttcttcatccttcttgctggcagcactggaggaagcag

SEQ ID NO: 549699 - DNA, 95 bp, Homo sapiens
aattttagtatcctattctctgaccttcgcgtacctttaatcaagcaatgaaagaataggggtatgtgaagatcagagaatgggatacggaagtt

SEQ ID NO: 549700 - DNA, 95 bp, Homo sapiens
cactttgattcatgaggtttttggcagacaccaaagcatacaatgaatagtttggtcttgctgtggtttattcaagggttatttgaatcaaggtg

SEQ ID NO: 549701 - DNA, 95 bp, Homo sapiens
gcagggggcagggagctgggggcactgggtgcctgggctctgccacccacaggtgggcagccttggtctcccgggccctcagcctcctcttctgc

SEQ ID NO: 549702 - DNA, 95 bp, Homo sapiens
gaggagacattgtatctttcaggatatctgggagctacttagtgggtaattcactgaatgctaccccagtgtctttgaaagagttaattcacctc

SEQ ID NO: 549703 - DNA, 95 bp, Homo sapiens
ttacaaattgtttagaaaatagttatgtttgcaaggagggatagggaacgtatataatcctgtctctccagtagtagctatttttacctttgtga

SEQ ID NO: 549704 - DNA, 95 bp, Homo sapiens
gggcccattgctgggctgctgggctttctgggagcacctgctggcttgctacacactcctcctcccagaaactccacacccacagccctgggtct

SEQ ID NO: 549705 - DNA, 95 bp, Homo sapiens
tgcatgctaaggtttggggccaagatttatctcattctctgatggcattttatcgttattagagagccataaatttcagctccgttagcactgca

SEQ ID NO: 549706 - DNA, 95 bp, Homo sapiens
gttttcacaggattaatggctggttggggttaatgtctctcagctatgccatgggccatcaactcttttcagctggccattaatccccaggaaat

SEQ ID NO: 549707 - DNA, 95 bp, Homo sapiens
attattattatcatcagaggtgagcagtaaatatttgttgcacaaggattcacttttcccacaaatacttactgcttgcctgctataatgataat

SEQ ID NO: 549708 - DNA, 95 bp, Homo sapiens
ttgtatctctgggtcccaggaggtcctctggagttctgagacactcctaggatccacaggaacttcagaggaactcctgggacccattgacgcaa

SEQ ID NO: 549709 - DNA, 95 bp, Homo sapiens
ttcattaggcagtgagcagtgggttttattgggaaaggatttgtcatgttgaaagctatccaagtataaggccattgtttgctttgactattgaa

SEQ ID NO: 549710 - DNA, 95 bp, Homo sapiens
ggaagatttgtgggtgttcccgggaactcatcagtctcctgttcattttcaataggagactcacaagttcctgcaaatgcacacaaacttattct

SEQ ID NO: 549711 - DNA, 95 bp, Homo sapiens
caccccccaaaaacgcctaaatgaagatagatggattcccttaccagcaaagggcgaaggggatgccctctatctgcaataggaatggcggggtg

SEQ ID NO: 549712 - DNA, 95 bp, Homo sapiens
tcctgtggcaagggcatagctttctctgtcagtctctctggtggagatctgaaacttcatcagggctgtgcacagaaggcgatgcctccaagggg

SEQ ID NO: 549713 - DNA, 95 bp, Homo sapiens
tcatatcctgtataaactgtggggagtctatggggaaaattaccatatatggaaactttccccatagcatccccttggagttacacaggatgtga

SEQ ID NO: 549714 - DNA, 95 bp, Homo sapiens
gtagcagagccaggcaagctatactgtcatggtgactctgagattcaaactgacctagagtcaccatggcagtatagcatgcctggctctgtcac

SEQ ID NO: 549715 - DNA, 95 bp, Homo sapiens
gtcaggtgtggctggatgtggtggctgaggcagggggatggtccagggtctgggctgatctcctggctgcaggctactcaggacatgctgtggac

SEQ ID NO: 549716 - DNA, 95 bp, Homo sapiens
tgatttttgccatcagcattctccctatcacggaatcattgcacaatttagtatgattaatggtttccatttaggagaagctgagaatgaaaaca

SEQ ID NO: 549717 - DNA, 95 bp, Homo sapiens
ggggcagcccagtgtggggagtgggcagatttgggtccataccctgcggggcctgtgtgacttgagcctgtctgcttctgctgcatttctgtccc

SEQ ID NO: 549718 - DNA, 95 bp, Homo sapiens
agtcatgcaggtaagatgaggagcaaagccctgtggggtagccaatctaaagaagcattccatgtgggctggtgcctccctcttgcagaatgact

SEQ ID NO: 549719 - DNA, 95 bp, Homo sapiens
tgacatatgtaaaaacacaggactatgcttggcacacagtaccataagactttgtgctatgtgccaagcacagtcctatgttttcacatatgtta

SEQ ID NO: 549720 - DNA, 95 bp, Homo sapiens
gtctgtctcctatcccaggactgctaagcagttgccttgattttagtagggagttgtcaggagtacctgcttattgcagtcgatgggagattggc

SEQ ID NO: 549721 - DNA, 95 bp, Homo sapiens
ttcctcattaacattcccatagagtgattggagggattggagggatcattcagacacaatttctccaatcactctattggaacattaatgaggaa

SEQ ID NO: 549722 - DNA, 95 bp, Homo sapiens
tcatctaatcaggaagggaatctgagtgcagctggggaaacttaactctttgacaaccagttcccgtttccatcagctgctcaagttcctggtga

SEQ ID NO: 549723 - DNA, 95 bp, Homo sapiens
atagtcttaggtttaccgaaaagtgacaaagatggtgcatagagaaggaaatctgtgtaccatctttgtaacttttctgtagttataaagattgt

SEQ ID NO: 549724 - DNA, 95 bp, Homo sapiens
cacaaagggattaaaagaaaagaggaaagaaagcactgagtagttagtctttgtgcttgcaagtcttttgtttccttgtaatctccttaaatgtg

SEQ ID NO: 549725 - DNA, 95 bp, Homo sapiens
ctttctaatgtcatgacacctttctcttgtacagtttcttctacctctagtttttcaaagacctgaaactgtaaaagaaaggtgtcacaagaaag

SEQ ID NO: 549726 - DNA, 95 bp, Homo sapiens
gtgattcttttcttccctaaggaagctgatgcaaagggttcctcagaagtagttaattgaaccctctgcatcagcttctttagggaaggaatcac

SEQ ID NO: 549727 - DNA, 95 bp, Homo sapiens
tgctgcaggggattaagggaagttgagggtgaaccattttggccactggatcacaaacaaattggctcgcctttaaggtttacatggctgcagca

SEQ ID NO: 549728 - DNA, 95 bp, Homo sapiens
tggggaccactagatagaagtttaaggttgggctttaaaaaatgccatgccaatttttgaatcccacctctactcctatctgccctgggttccta

SEQ ID NO: 549729 - DNA, 95 bp, Homo sapiens
gcagggccttggagcaggtagggtggaggcctgcacactggcggggccacctcacccccctggcctcttccctcctcctgctccgggcttcctgc

SEQ ID NO: 549730 - DNA, 95 bp, Homo sapiens
ccagaaagctttgcccctagggtggcccataggatgtgccctcaggctttttctaaatgcttcctgatctgggctgcccggggtgggggctctgg

SEQ ID NO: 549731 - DNA, 95 bp, Homo sapiens
tgtggtgacgttccaaaatgtttgaaagctgttgccctcaagaaactcttgtatatagagtaacagctttcaagatatttttacattagcccaca

SEQ ID NO: 549732 - DNA, 95 bp, Homo sapiens
agaaatgcaagctctcagatccttgttccagagattctgacttagtaagtctgtgtgaggggagttggagggggatggctgagatttgcatttct

SEQ ID NO: 549733 - DNA, 95 bp, Homo sapiens
acagtggaggatgtggtgaagagaggggcctttgtgattaccatatcagtgagagttgtaatcacccctttttttattctatcttgtttctctgt

SEQ ID NO: 549734 - DNA, 95 bp, Homo sapiens
ggctaggttggagccagcctgcatttgtctctctatcttggaagcaaacttagaatgtagagatagatgtggcctggatgctgctaactctagcc

SEQ ID NO: 549735 - DNA, 95 bp, Homo sapiens
gctggcacttcttgttaaaagcagcattaacaaatgtgggctcaaatagaaagccattgccatttgtcaatgttgctttgagaagaggtgccagc

SEQ ID NO: 549736 - DNA, 94 bp, Homo sapiens
acgaatactacctgctcttacctgctcacactgttactccagaaatacctagactagagtaacagtgtaggcaggtaagagccaggctatttgt

SEQ ID NO: 549737 - DNA, 94 bp, Homo sapiens
gtcttttgtagtggctaaggcttccttgggaacaacaggacctggccccagggcctctggtttccagggcagatgcctttagcataccaaggac

SEQ ID NO: 549738 - DNA, 94 bp, Homo sapiens
tagaactgttacagtctagtaagtaaataacatgtttttcaaaattagaacgtgtaccaaatatgtatttacccaataggctgtaacagttctg

SEQ ID NO: 549739 - DNA, 94 bp, Homo sapiens
cagctggagtcggggattaccccctgctgctgacgtgaggacggtgaacaatcgggaacgttcggtggaagggggaattccccgccgctccctg

SEQ ID NO: 549740 - DNA, 94 bp, Homo sapiens
gggaacacttagctccttgctgccttaaactaaccaggaagagcacgaccccttgctacaggttagtgaagggcagcagggacttaattgtcct

SEQ ID NO: 549741 - DNA, 94 bp, Homo sapiens
gtctggggctggatcatgtgagctctgtaacacagtgctgggttggcccactgggtattgtgtttgcagagctctggaactggttgtcccagac

SEQ ID NO: 549742 - DNA, 94 bp, Homo sapiens
gtgggtattatgacctaataatgacatgccctggtagtttggactgagtgccattaactgccaaggcacatcattgctcgtctataatacacac

SEQ ID NO: 549743 - DNA, 94 bp, Homo sapiens
ccaagccattgagcgctgcattcccggccccctggcgacggccctggccacggccatctccggggaggcaggaatgtggcgggcggggctctgg

SEQ ID NO: 549744 - DNA, 94 bp, Homo sapiens
agcctggcctgggaattaagaggaaggctgtctccagggtcctgttaccaagtccccacatgacagttcactttttctttctcagcctcaggct

SEQ ID NO: 549745 - DNA, 94 bp, Homo sapiens
gaaaccagagtttcaagtggatacaatgttgggaagggtcaaactaacttcaagggattgacccttctcaacattatatccattctttggggtc

SEQ ID NO: 549746 - DNA, 94 bp, Homo sapiens
gcacaaggtgcctgggcagttgctttgagatttacattagaaaatggctactgtatctaagtaaaatctcagagtgtgccaatacaccttgtgt

SEQ ID NO: 549747 - DNA, 94 bp, Homo sapiens
cctgacaactgagaaaggctgggctcctccgtttgtgctccagggaaggcggccctggagcggggatggcgagcagctggacttagtgctcagg

SEQ ID NO: 549748 - DNA, 94 bp, Homo sapiens
catttccagttattactgctagacaaatggcttttaaattacatcctaaaaggctcacaggccatttgtctttgtaagtaatggcacagaaatg

SEQ ID NO: 549749 - DNA, 94 bp, Homo sapiens
gaggctgaggcccacgggaggaggcagaaatggtagctggtcccaagctccttagctataaccatttttctgcccttcccatggcttcagtctt

SEQ ID NO: 549750 - DNA, 94 bp, Homo sapiens
tgggccagggccccagagctcctgcctgagctggaccttatgcaaacatttctgtgcctgctgggtaggggcacgtctgaggggccctgctcca

SEQ ID NO: 549751 - DNA, 94 bp, Homo sapiens
gagggagccacggtcagatttcaagtggtcatttcactctttctccctctgggggactgagacatgattaacttgcaataattgtgactccctc

SEQ ID NO: 549752 - DNA, 94 bp, Homo sapiens
atgcttattgaccttaataatctgctccactgaggacccacaaggaagtgaggagcgtatttgagcagatggactgttgagagtcaatttgcat

SEQ ID NO: 549753 - DNA, 94 bp, Homo sapiens
tctctgccccagataaatactgtgcttgagtgctggagcatgtcttcccagatggccacatctccagtactgagtacagtgtctgctgcagaga

SEQ ID NO: 549754 - DNA, 94 bp, Homo sapiens
ggggcatggggcaggcagggttttgtgtttgctggtgcagtttacagcttttcaatgatcaggcagacacaggactcacgccagctccggtccc

SEQ ID NO: 549755 - DNA, 94 bp, Homo sapiens
cacatattgacttatgtttttagtcaatatcaagatttattgtctccagagttaaataaatcgtgatattgaccccatcataagccaatatctg

SEQ ID NO: 549756 - DNA, 94 bp, Homo sapiens
gcactgacaaagcccctctcactctgtccctcagtcaggcctcacctgcactcagagaggcagggcatggggggctcttccagatgtcatcagc

SEQ ID NO: 549757 - DNA, 94 bp, Homo sapiens
cactccaatctgagctgggatgcagtggtcctttcacctgtgtaacaaggtgaggctttcttttaggatcctctcctggctcagctttggagtg

SEQ ID NO: 549758 - DNA, 94 bp, Homo sapiens
gtatgtattatattctgtctgttgatatctgtaggttctggaattctttttattaacccctagatatcaacatatagaatatctgtgtaggtat

SEQ ID NO: 549759 - DNA, 94 bp, Homo sapiens
ctgggctgggggcagagaggaggaatttcaacatgaaatgttttgttcattaacagagaacatagggggaaattccctttctgcctgggcccag

SEQ ID NO: 549760 - DNA, 94 bp, Homo sapiens
gggtgtattaggtgggggatggtctaggggatcctgtgtgctgttctttttgctaggatcccctaagacccttccttcactgtctttttcattc

SEQ ID NO: 549761 - DNA, 94 bp, Homo sapiens
gtcatctttttctgttcctgaatcatcccttctgtctttattgccccaagtggggaaggacagtgagggaggaagggggctgagagagagaggc

SEQ ID NO: 549762 - DNA, 94 bp, Homo sapiens
gctcagggctgggcttcccaccactgcaaagaatggcagggaatagactttccacagtgtttgtggtgaatggcttccggccccataaaagagc

SEQ ID NO: 549763 - DNA, 94 bp, Homo sapiens
gtgtctcagaagtatatgcaagagaaaattctgatgagtaattaaccccattctgacatgtcagaatttcctcttgcatatccttctgaaacac

SEQ ID NO: 549764 - DNA, 94 bp, Homo sapiens
ccttagttctgctctaggctaattgtaggtcaagtctgcttggagtgaaactgaagcagaccagatctaaaattaggctagagcaggcttaggg

SEQ ID NO: 549765 - DNA, 94 bp, Homo sapiens
cgcccattccctgggccctgtctggtggtggctggccttggagagctggcctctcagcacagcaccgggcaccagggctcaaggtcagtgggtg

SEQ ID NO: 549766 - DNA, 94 bp, Homo sapiens
gagcacagtttgggaaatgctgtcagagctgccttcatattagcacagaaaagtggagaaggcagattcttacggcagttgatccaaggtgctc

SEQ ID NO: 549767 - DNA, 94 bp, Homo sapiens
cattcaacatttattcaataaacatttattgagcacctggcacagtacttggcacatgctgggcactcagtaagtatctgttgaataatgaatg

SEQ ID NO: 549768 - DNA, 94 bp, Homo sapiens
cagctggatgagtcggagaggaaaaaccattgatctgtttctgaaatcagatctgcaaatggtggccttcttcgtacgtggagaaagacagctg

SEQ ID NO: 549769 - DNA, 94 bp, Homo sapiens
ggggttcctagagagaatgtggggagaggaattgggaaggttgagtctaggcaacttttgccaggagtttcactccaaaggctttctgagcttc

SEQ ID NO: 549770 - DNA, 94 bp, Homo sapiens
gctgaatttcacacagaatagcacaatttacaaaacccggcaacacagggcaattgggtaatgtgtaaattggctacttctgtttggaatcagt

SEQ ID NO: 549771 - DNA, 94 bp, Homo sapiens
aagtcagatggatttgtggctagttagctaatgcttgattgtttacttactcagcattccttgggtgactggctgtgaattaatatgatgactt

SEQ ID NO: 549772 - DNA, 94 bp, Homo sapiens
gaagcatcgtctgggcacggagcaccaggagcgtgccgcccagtccgacggtggggccgggctgccgccgctggtgtccgacccatgcgacttc

SEQ ID NO: 549773 - DNA, 94 bp, Homo sapiens
tccttttcctcctttccttcctagcactgctaagcaagacacagggagtgacagctttgcttagcagtgctgggaaggaaggcagagaaaagga

SEQ ID NO: 549774 - DNA, 94 bp, Homo sapiens
tctccatctggctaagacctgtctgtcccttatctgtgtcttgttctgtctcctccatagaaggggaggggaggtcttcaggactggatgggga

SEQ ID NO: 549775 - DNA, 94 bp, Homo sapiens
atggattacttggtattgctgtccagaaacctgactctcataccattttggggggaagagaggtttgggacagcaattaatgaagcatatccat

SEQ ID NO: 549776 - DNA, 94 bp, Homo sapiens
tcctgcctcccactcttactcctgctgtcactgcagttccctcctccttggcagagcatgcagtgacagcagttgggctttgggagagaaagga

SEQ ID NO: 549777 - DNA, 94 bp, Homo sapiens
gtgctgtgtgtagtgcttcacttcaagaagtgccatgcatgtgtctagaaatatgttttgcaccttttggagtgaaataatgcacaacagatac

SEQ ID NO: 549778 - DNA, 94 bp, Homo sapiens
caggccggcagccggcctctcctcagtcgggaaggatggagctgggcagcagtacttggtgtttttccacttgagaagaggctgtgccggcttg

SEQ ID NO: 549779 - DNA, 94 bp, Homo sapiens
tcctttctctcccaaagcccaactgctgtcactgcatgctctgccaaggaggagggaactgcagtgacagcaggagtaagagtgggaggcagga

SEQ ID NO: 549780 - DNA, 94 bp, Homo sapiens
gctctctcccagatgaagattcctgcagaatcacgcagccacaggagctgctgggctgtgtgtttctgtgggagtgttgcaagtgttggatagc

SEQ ID NO: 549781 - DNA, 94 bp, Homo sapiens
tcaaccttggcctttgcttggatctctggacttctgtctgatcatttctgctctgctgacagcagtccaggtgtgatcctggcagaggagttga

SEQ ID NO: 549782 - DNA, 94 bp, Homo sapiens
aggtgctgtctaggaaactaacttttcagtttgcaagcagaggctgaccgctctaagtttgcagactgatcagagatggtgctggcagtaacct

SEQ ID NO: 549783 - DNA, 94 bp, Homo sapiens
aaggctcagtctttagggtggagttgagaaagacagagcggtgtggtgtgccaaaacaaactcctactttctcattctgctcaaggtcagcctt

SEQ ID NO: 549784 - DNA, 94 bp, Homo sapiens
tgatactgtaaacaactgacacagccatggaggagtagtgtatctgaaattgtttatacaaaagaattccatctgtcagtctgtttatagttca

SEQ ID NO: 549785 - DNA, 94 bp, Homo sapiens
ctcacttgacatgagaaggctggcattcttttgaataagcacgcttcttgcatattgcattcaaagcaatgccaggcttcccatgtcaagagag

SEQ ID NO: 549786 - DNA, 94 bp, Homo sapiens
aggcctgggttaggagggcagtggtggggtgggtggggagccttggtcatcccctctctgctgaccccacctcctccctgtcccttccaggcct

SEQ ID NO: 549787 - DNA, 94 bp, Homo sapiens
gtggcttagtgtattgtatgaaaatcggagattgggtattttaagccaaaaatattcaactctgattttacatacgtggatactactggcctgc

SEQ ID NO: 549788 - DNA, 94 bp, Homo sapiens
atgtaggtggggcaagagcatcccagggaaactccaagctgagtcagacatttgccagtggggttctttagggtctcttaagacctacctatat

SEQ ID NO: 549789 - DNA, 94 bp, Homo sapiens
aggacaataggaacaacagtccgtttattgagcacttactgtgtgccaggcacagttcaaagcgctttcatgaattactgtatttaattttcct

SEQ ID NO: 549790 - DNA, 94 bp, Homo sapiens
gtctgtttttggcttctctcagctacttctttggaaggtttccactgacttcagggagagttccagaagaagcagggggtgtcgtagacagcac

SEQ ID NO: 549791 - DNA, 94 bp, Homo sapiens
tcacaagacctagttgtgaggccctgctgtagtgcttactatgtatactggctgtgtaatcactagagcggggactcacatcaaggccttgtga

SEQ ID NO: 549792 - DNA, 94 bp, Homo sapiens
tgcaaacagaagtgattttaatgcctgttattttggaagcagttcaaagttgttttttccattgtaaatagcattaaagtgctctttggaggca

SEQ ID NO: 549793 - DNA, 94 bp, Homo sapiens
ccagcagaggtttagctgtgagtcatgggtgtgagcttattccataaaatctcaggagcccaagactgtacagttaaagactcccatctgctgg

SEQ ID NO: 549794 - DNA, 94 bp, Homo sapiens
ctcagacagtgatggttttcagagtggattgaaaggagattggctacttctgcttcaaaacatcctggaaattgtctgcctcctgaattctgag

SEQ ID NO: 549795 - DNA, 94 bp, Homo sapiens
tggctgacttgcctctctctgttggcttctgtgctgttctgtgttgctctctgcctcctccactagcacgggagcaccaagagggcaggagcca

SEQ ID NO: 549796 - DNA, 94 bp, Homo sapiens
gaaggtagtaataaaaaagatgagctaatggtaatatgaaatgtataaatgaagctcatattacaatgagctcatctttcttattactatcttt

SEQ ID NO: 549797 - DNA, 94 bp, Homo sapiens
cagcctggacagatggggttctgcccggcagggctggcatgggggcttctttatgccaagccagccctgggggaggcctcggctgtccagggtg

SEQ ID NO: 549798 - DNA, 94 bp, Homo sapiens
actctgcaaatggcaattacattcaatggaaaccagatgttgcatggaatttgactctcttggtttcttggtgaagtagatgaatttgtaaagt

SEQ ID NO: 549799 - DNA, 94 bp, Homo sapiens
tttagaccctttgtagataaaattggggcagatcctagaagctgcacacactcacaggtggcttcctgggacactgcctgaatctgggtctaaa

SEQ ID NO: 549800 - DNA, 94 bp, Homo sapiens
gggacttcagttaacggaaaggggtgtgtcccaacaaagactcatacagtcaactgtctccatgctggcatgccccactgttaattgatttccc

SEQ ID NO: 549801 - DNA, 94 bp, Homo sapiens
taaaatactgctgtaaatggcagctcattgaatccaattttaagtgtgattgtttttgtttttatctgagcttccattgaacggtggtatttta

SEQ ID NO: 549802 - DNA, 94 bp, Homo sapiens
catgctgtgtgtggtaccctactgcagacagtggcaatcatgtataattaaaaatgattggtacgtctgtgggtagagtactgcatgacacatg

SEQ ID NO: 549803 - DNA, 94 bp, Homo sapiens
acccacaaaggcaagggttggactctgtggccagcagtgcccccttcatccccagtaggcatcagagccacagctgtcttcctttgctctgggt

SEQ ID NO: 549804 - DNA, 94 bp, Homo sapiens
tcttctgttgccttgtgcagcagatctccatgaaactcagttggggcaaactgagatgagtgcatggagatctgctacacaaggcagtggaaga

SEQ ID NO: 549805 - DNA, 94 bp, Homo sapiens
ccaggtattctgcatgtccaaacttggtggtgacagcagtagcaaacaaccctgagtgtccctctgttcctgccaatttgatgctacaccctgg

SEQ ID NO: 549806 - DNA, 93 bp, Homo sapiens
gggaaccgggagggaatgaggccgtggccctgcaaaaaaaaatccagaattggattcagaggtctcggccttcattcacattctcaggctccc

SEQ ID NO: 549807 - DNA, 93 bp, Homo sapiens
cgggccccgctcccgccctcggctcgcctggcccagaccggaagcagcgccgcactgcctgggcctggcgcggggggtgagcacaggggcccg

SEQ ID NO: 549808 - DNA, 93 bp, Homo sapiens
gggtttatgttcatgggctttctagatggactttcaagtccaagtagaagtccaacttgagagctcgtgtagaaagcccttgaatgtaaaccc

SEQ ID NO: 549809 - DNA, 93 bp, Homo sapiens
tccagcttgactttctagggttctaaggaataagaagggggtcatgtagatcctggttccttgatttctccttagagcttggaaagcactgga

SEQ ID NO: 549810 - DNA, 93 bp, Homo sapiens
tgggaaaagtacatactgttatattccggcacatcagaattttccagggatgtgcctggtatcttggagtaaagccaatgtgattttctgcca

SEQ ID NO: 549811 - DNA, 93 bp, Homo sapiens
ggtccctgccctctagaagctcacagtctagttgtgttcatgtgcaagtcatttacccccagctagattgtaagctccttgagggcagttacc

SEQ ID NO: 549812 - DNA, 93 bp, Homo sapiens
tcctgactttcagttcctatttaaaatgtctgaattgggagcatcgacaagctcccaaattagctttttaaatagaagctgagagttaaagga

SEQ ID NO: 549813 - DNA, 93 bp, Homo sapiens
tcagcaggcagatttggggaagagggagctggaatgatgtacatgtgaatcatctcagttgctttcttttcctgtctgctcttcttctgctga

SEQ ID NO: 549814 - DNA, 93 bp, Homo sapiens
aagctccaatacctggaaagaggttgtacctaaagtgttctctgtattggcggaaaatgtttcccgggcaacctcttttcattgtgaaggctt

SEQ ID NO: 549815 - DNA, 93 bp, Homo sapiens
ccatccagtaggggtttcccaccaccgtgtagcgcttcttgcggtcgttcttgcgcaaggtgcgtttcttggtggtggccttctccatggggg

SEQ ID NO: 549816 - DNA, 93 bp, Homo sapiens
tctgcaaagatgcaaagaaataggcccttttctcaattgagaaaatgtgacccaaattgagaaagggggctattcctttgcatctgagcatga

SEQ ID NO: 549817 - DNA, 93 bp, Homo sapiens
tggcccagtgccgccggattattttgtatattcatgaagctgctcatcagccgtcaggagaatgtgcagtaatccttggatgaaataaggcca

SEQ ID NO: 549818 - DNA, 93 bp, Homo sapiens
atacgttgagttaaatgagatgccggtgatacggctaaaaccaaaaccaaggaggctgttggataaatcaccggcatttcaaacttaaggtgt

SEQ ID NO: 549819 - DNA, 93 bp, Homo sapiens
agcatgaagaggagcctatctaaagcaggctctatttaatacaatgtggttttaattggagtctgttttagatgagccacctgtatttcatct

SEQ ID NO: 549820 - DNA, 93 bp, Homo sapiens
ggggcagggcggaggctgcgtgggggtgagctctgaggactgtccacctcccagctcctcagagagcaccaccctgtccctcccctcagccct

SEQ ID NO: 549821 - DNA, 93 bp, Homo sapiens
ccctctcctgccctgttcatacctgcctagctacccactgcaacaaaatgagaaatgggccatgcaggtgggtgggacattccaggcagaggg

SEQ ID NO: 549822 - DNA, 93 bp, Homo sapiens
agattagatggcaggtgagagctctttgaaaatgaaaacattctgctatttgaatgcaaagtgttcttctttgcctgtgatgtttcctaatct

SEQ ID NO: 549823 - DNA, 93 bp, Homo sapiens
tgtgcggtcatctagaaaacactgagatacacatctcatatatacatgagctacatgagacgtgtatctcatttttttctagatgactgccca

SEQ ID NO: 549824 - DNA, 93 bp, Homo sapiens
ccaccctcgcccgcgccgccggcccctcccccacttccggcgtctcctagcgacggcgggggtaggggccgggatgcgcgcgggagttggtgg

SEQ ID NO: 549825 - DNA, 93 bp, Homo sapiens
tgaacccctaccagggaaaatacctgctacaagatttccttaatctctaatctggtagcagatatttcccctggtcacgaacctaggagttta

SEQ ID NO: 549826 - DNA, 93 bp, Homo sapiens
acagtgcccaaaattataggtatatagtgcaaaaactttgtaaaaagttcgtaaaaaggttttacactatatacctagaattttgtgcactgt

SEQ ID NO: 549827 - DNA, 93 bp, Homo sapiens
gcattgatatagatttagttgaaatgtaatctcttaaatctgtccaagattcggggagataattacactttcactgaattgccaggggtcagc

SEQ ID NO: 549828 - DNA, 93 bp, Homo sapiens
tcctcctgagaatgcttcctaatgattttctatgtctggaagggcaaaccctctttagatgtataaatattaaaaagcacttcttaggcatga

SEQ ID NO: 549829 - DNA, 93 bp, Homo sapiens
aggcataaattgctgacctctatttaattttctgaactgcaagaattatgggcccaaagttcagtgaattggaagaggtaagcttttatgcct

SEQ ID NO: 549830 - DNA, 93 bp, Homo sapiens
caatatgtgtgctaaactgatcaataataagattgatacatcttctacttgggtaagttaatcttcttattgatcagcgtagcaaacatattg

SEQ ID NO: 549831 - DNA, 93 bp, Homo sapiens
ttgtggtcattagggctgaaagggtttcatttatggccctgagaaagagaatgaaggctgtaaaatagacccaggaggtcccactgaccagaa

SEQ ID NO: 549832 - DNA, 93 bp, Homo sapiens
gagtcagcagggcataggggaactggcacagggcaggggccacgggagagataacccagcccagagccagttcccgcttgctcgtcctgactc

SEQ ID NO: 549833 - DNA, 93 bp, Homo sapiens
gtgtaataagttgaatagtatcccagtttgcagccaagggattatattcagccaaggctgcaaactgggacactattcaaaaccttagtatat

SEQ ID NO: 549834 - DNA, 93 bp, Homo sapiens
aaatattaaattctagttaatgatatgcatgctgaaacgttaacaacctataaatacttaagcatgtatatcattaactagtgctcaatattt

SEQ ID NO: 549835 - DNA, 93 bp, Homo sapiens
caatatgtttgctacgctgatcaataagaagattaacttacccaagtagaagatgtatcaatcttattattgatcagtttagcacacatattg

SEQ ID NO: 549836 - DNA, 93 bp, Homo sapiens
tcttcttcattcactgtgcagtgatccctggagtccctttcacatgtgggaggcacacgctccgggaaacattgctgaaggaatgatgagtga

SEQ ID NO: 549837 - DNA, 93 bp, Homo sapiens
gtcttcagcttgcccagccctgctcacctcccagcacggcccatcctgaatcagtggggcctgagcaggggtctgggcagagactctgaagac

SEQ ID NO: 549838 - DNA, 93 bp, Homo sapiens
gggcaggagtcctctggtgcagaagtccaggacgtaatggagtgggagtactccaacgccagagtccagggctctgcggggcagggttccccc

SEQ ID NO: 549839 - DNA, 93 bp, Homo sapiens
tttggagtacaggtgtgctattgtgtttttgatggagtgttgccattccagaaagctccattcaaaaacacaatgccacacatgtaacccaaa

SEQ ID NO: 549840 - DNA, 93 bp, Homo sapiens
acaggccactccatctgttcaaacataatgctccaaaccaaggaatatgttccaaaccaaagagcatgatatttgacagatggagaggtctgt

SEQ ID NO: 549841 - DNA, 93 bp, Homo sapiens
gagagctccacaaaagggggtaacgttggattacttgctttaaagtggtgtgctcctttgaagcaggtatgttcaattttttttcttgttctc

SEQ ID NO: 549842 - DNA, 93 bp, Homo sapiens
ggctgtgtgaggcaggggcaggaccttcagagtcctcacagctttgtgaggcaaaagtctgagtccagtcctggcctctgccgctcacccacc

SEQ ID NO: 549843 - DNA, 93 bp, Homo sapiens
tgtgcacccagcacttaggacagctggtttaccaactgggaagattcagcttcatttgtggtgagccagcttccttgacactctgcggtgcca

SEQ ID NO: 549844 - DNA, 93 bp, Homo sapiens
tcaatttgacgtctttctctacccacagtttgtgaggagagtgatgcaaacatttttcttcattggctgtggctggagaatgcatcaacatga

SEQ ID NO: 549845 - DNA, 93 bp, Homo sapiens
ggtaactgccctcaaggagcttacaatctagctgggggtaaatgacttgcacatgaacacaactagactgtgagcttctagagggcagggacc

SEQ ID NO: 549846 - DNA, 93 bp, Homo sapiens
gcatgctgtaggagcctctaagagttcttttctcctgctttttcttttaataggcctatcccaggaggaggacacttgagcctcccagcttgt

SEQ ID NO: 549847 - DNA, 93 bp, Homo sapiens
aatcaccttaaccttgttgtacttcagaatctccaggagtaatgtatgaagttagtcctggagattctaaagtataacaaggttgaggtgatt

SEQ ID NO: 549848 - DNA, 93 bp, Homo sapiens
gttggcactagctgtacccaccttgcctggggcccccgtgctgggggtcgcccccaagatggtggcggccccagggaggactgtactgccagc

SEQ ID NO: 549849 - DNA, 93 bp, Homo sapiens
gctgtgaaacaattgccatattttttaaagtgttgtctgtgttttcttagaggcattcctgctcgaaaagatgtggtaacttcattccacagc

SEQ ID NO: 549850 - DNA, 93 bp, Homo sapiens
tggcagaggattaagtgaatgctgatgaagtgtccagattcccataacttggaatggagctgcattcagcattcctttattatccatctgcca

SEQ ID NO: 549851 - DNA, 93 bp, Homo sapiens
atgctgtggcaagtactataatagacatgatcaaataagacataatcaaggaactattattgatcacgtcaattatagcacttgccacagtat

SEQ ID NO: 549852 - DNA, 93 bp, Homo sapiens
aatccctctgtgtctccgttttcttatttgtaaaatagggatactattatgattcctatttcacagatgaggagacttcggcacagagaggtt

SEQ ID NO: 549853 - DNA, 93 bp, Homo sapiens
actgttaggccaaagatcttaggcagttccagagttttacacagcccaaggagctctgggaattgccagatatcttctttggctgagaatagt

SEQ ID NO: 549854 - DNA, 93 bp, Homo sapiens
ctggggcaggcagggaggaggaggctcagggacctagccaggggcattccattccccatctctgggcctcagtctccccttctgcagcaccag

SEQ ID NO: 549855 - DNA, 93 bp, Homo sapiens
ctgcacgtctgcgcggatggggaactccacgtcttgggaaatgcagaggttccgttccagcgtgtgcagctcctcctccgtcagcgtctgcag

SEQ ID NO: 549856 - DNA, 93 bp, Homo sapiens
tttgccctctaggagcttcagtctgtttggagaaatggacatgtagataaatgttataactcacgtagaaatgaagtgcttagagaaggcaga

SEQ ID NO: 549857 - DNA, 93 bp, Homo sapiens
ggccctagcccgagcactcagccctggctgttggcactcagatgttacaacaggccccgacagccacaggctgagggataaccgggaagtgcc

SEQ ID NO: 549858 - DNA, 93 bp, Homo sapiens
gggtgtggttatcatgaaataattacactcctgagagattacaggcacaaggctgtaccccaggagtgtgattatcccatgataaccacatcc

SEQ ID NO: 549859 - DNA, 93 bp, Homo sapiens
gactcgctgccccgcccccttcctgtcgccccaggcccggtgcttccgcctgggggcgcccgcgtgggggggacgggaagaggggcctgagtc

SEQ ID NO: 549860 - DNA, 93 bp, Homo sapiens
catttggagcaatgcctggcacatattaggcactagctattataacccaatgcttcttgaatccctggtatgtgccaggcactgtttgaggtg

SEQ ID NO: 549861 - DNA, 93 bp, Homo sapiens
ccatgaatgaatgtcagagtccagcatctcagaggccatcattaaatgaggagcagtctttgtagaagctgaactctgaagtatgcatcatgg

SEQ ID NO: 549862 - DNA, 93 bp, Homo sapiens
tctactttctcctctaagtattaactctatgaggtaccagaatgaataaaaacccttgatctcatggagttaatactgggaggagaaagtaga

SEQ ID NO: 549863 - DNA, 93 bp, Homo sapiens
ccttcccaacatccaaacacaacagagttggagagaaaggttagggggaaacctttctctccaaactctgttgtacttgcagttgaacgatgg

SEQ ID NO: 549864 - DNA, 93 bp, Homo sapiens
tatgcacatactcactgcaatatatttttacaatgtgtatttatatatgtacatatgctgtgactatatgtgtgcaacgtgtgtgtgtgcatg

SEQ ID NO: 549865 - DNA, 93 bp, Homo sapiens
ggcagcaagcctacctgtcaagtgcttctgggattaggagtgcgcattgccaactccccactctggaagaacttgatgggtgggcatcctgcc

SEQ ID NO: 549866 - DNA, 93 bp, Homo sapiens
cctaagcctgctctagcctaattttagatctggtctgcttcagtttcactccaagcagacttgacctacaattagcctagagcagaactaagg

SEQ ID NO: 549867 - DNA, 93 bp, Homo sapiens
cattctgagagccttctgagttgtatcatacatggataatttgcattatgagttttatccacgtatgataaaactctgaaggctttcaaaatg

SEQ ID NO: 549868 - DNA, 93 bp, Homo sapiens
gtcaagatttattggtctttcaggtaaacaatgattgagaacctaaagtcaatatttagtcaaaatttatcttgaaaggcaataaatcttgat

SEQ ID NO: 549869 - DNA, 93 bp, Homo sapiens
aagtcacttccccaaaggagcatttttactagctagggaatttttttaattacttgctaaaattaaatgcttttgttggcatggatttgattt

SEQ ID NO: 549870 - DNA, 93 bp, Homo sapiens
tattgctttaaatgtattctgtggaattagtctttgtcccaccctcgattaaatttgggacaatatgactattccatttattcatgtgcaata

SEQ ID NO: 549871 - DNA, 93 bp, Homo sapiens
ctataattccactgaggggtgctggcggtgacatgtaccatgaagtcagaatctgagtggtttgtcaccagaacccccagggtagaattatag

SEQ ID NO: 549872 - DNA, 93 bp, Homo sapiens
attattctgatgaaaatccacaatgtctttgagcttctggttgtgtaatgctggggtttaaagtcaccatttgtgggtttggcatcaattaat

SEQ ID NO: 549873 - DNA, 93 bp, Homo sapiens
gtgactgtctgtgggggaaagcaactgatgaactgtctcctctgctgtgctcagagatagttctgtagttctttctctcaaaatatcagtcat

SEQ ID NO: 549874 - DNA, 93 bp, Homo sapiens
gagcattaagatttcctattctttgaggcaaatattgaccttgacttcacctcggtcaatatttacctctcaggtcaatagatcttgatgttc

SEQ ID NO: 549875 - DNA, 93 bp, Homo sapiens
gataaggagagagaaggtagagaatagggaagagctgtggagaaaaagcaagtcattccagcttctattatttttcttcttctttttattatt

SEQ ID NO: 549876 - DNA, 93 bp, Homo sapiens
cgccccccaactggcaccactgctgcccctgcccctactctcagcctcacgtgactctcgggcagaggcagtggtggggcagccagggcagcg

SEQ ID NO: 549877 - DNA, 93 bp, Homo sapiens
gatagtggagaagtgaactcatctttggcaatgtggcccaaagacatgatcccagggctattagctaatggtgggttctgcgttgtcactgtc

SEQ ID NO: 549878 - DNA, 92 bp, Homo sapiens
ggatgtgaggagtgaggaagaggggtgctggactgggagaaagaagtaaaggtagatccctcagcatcaacctctccttcctcctcatttcc

SEQ ID NO: 549879 - DNA, 92 bp, Homo sapiens
ccaggcgagtcacgcatgctctgagaactccacaatgtcaaaccccgttagcaggattgtggggttctgtggatcatgtgggacctgcctgg

SEQ ID NO: 549880 - DNA, 92 bp, Homo sapiens
tgttcagcctgggggaggaggtcagtgaggccttcccctcgaggggtttagcctctgatttttcacttgcctcattctgcccattctcagca

SEQ ID NO: 549881 - DNA, 92 bp, Homo sapiens
cacaaaagaggctagtttcagactgatttcacaatgcatgtttggtcacattatgaaaagtagtctgaaaaactgaaaatgctgcttttgtg

SEQ ID NO: 549882 - DNA, 92 bp, Homo sapiens
tgacttactcagaacagcataggctggctccttgaaaggtttttccctttttcctacctaaggaaggcgttctatctgttctgcagaaggca

SEQ ID NO: 549883 - DNA, 92 bp, Homo sapiens
tccactcccgcccaggctctgcgccgcgacttctatggctctacctttcatgagcctcatagtctggtgagagactggatgtgtaatgtgga

SEQ ID NO: 549884 - DNA, 92 bp, Homo sapiens
tgttgtttttttttttttccatctccgttctctttctagcgtgcaatgatgcgcttctcagagttggagatgaaagaaagagaaggtggcca

SEQ ID NO: 549885 - DNA, 92 bp, Homo sapiens
agttaattggtcttttttcttttctagcccttcacactactgaagtaatgttattaatgtgaaggactaagagaagaaaaagaatattaatt

SEQ ID NO: 549886 - DNA, 92 bp, Homo sapiens
gttgtctccttaatccttgcaacttacctgagtcattgattcagtaaaacattcaatggcacatgtttgttgttagggtcaaaagagataat

SEQ ID NO: 549887 - DNA, 92 bp, Homo sapiens
tggagaagacatcctggttggtaatcactgctgatgggccagaaagcatgacctgtgtcatcagcaagggtcagccagggtgtttgttttta

SEQ ID NO: 549888 - DNA, 92 bp, Homo sapiens
ttgctcaagccctgcttctctaagaagcttgccctgattctgctggagagggaaatgagggcaggcttcgcagaagaacagcacttgagcaa

SEQ ID NO: 549889 - DNA, 92 bp, Homo sapiens
tatggtgcagcactgatgtatgttttatttttgtttatgaaatgttgtagggatgtagaggaaaatgaaactagcatcagtgctggacttta

SEQ ID NO: 549890 - DNA, 92 bp, Homo sapiens
caggaggcataaaatcctattgcagatgtgttgctaattgtaattctcggatacagttaggcttatgtctgtagtttttagttttgcccttg

SEQ ID NO: 549891 - DNA, 92 bp, Homo sapiens
gagggagccacagtgtgggaggaaggagcctgggaaaatcgcctctggatgcagatctggggcttctattcccctgcgcactgaggcctctc

SEQ ID NO: 549892 - DNA, 92 bp, Homo sapiens
ggtctccactcctgggactactgaagaagcatgctgtttggtaactgcctgttgagcacatgcttctctggtgtcccaagagtgcctgagcc

SEQ ID NO: 549893 - DNA, 92 bp, Homo sapiens
taataataacactcaagcaaccctatcacttaggcactattatctacatttacatattagtgcctaggtgacagggttgagtgttactatta

SEQ ID NO: 549894 - DNA, 92 bp, Homo sapiens
ctgtttgcacgggccagggcagggaggctttctgggagtgaggtgagagcaaggctgttcccagaggctccagtctctatttgtgcagacag

SEQ ID NO: 549895 - DNA, 92 bp, Homo sapiens
gtgttgggggacctgtttcctgtctttagctgtagggtttatgtgagtctccctacagtaaaagacagggttggatgatggtttcttaaggc

SEQ ID NO: 549896 - DNA, 92 bp, Homo sapiens
tatcatgagataatgacaccccaagtgtgttgtgaggcataaggttcagctgagtgcttctaaacctctaggggtgtgattatctcatgata

SEQ ID NO: 549897 - DNA, 92 bp, Homo sapiens
ctgggtaggccttgaagggtgatcttcacgtaagcctgtggcctgagcaagaaagctgcacacgggcagcggaggaaccagcaggagcccag

SEQ ID NO: 549898 - DNA, 92 bp, Homo sapiens
agttccatctatatgacaccaaatcattgggatgaaatatggaaaattgagtctatcatccacatgtttgatgtcatgcaaagacttgaact

SEQ ID NO: 549899 - DNA, 92 bp, Homo sapiens
tcccagtatttagtgggggcagaatcaggtagttataagtggctagctagccaggaggaaagacttggtactgatcccttcctagcttggga

SEQ ID NO: 549900 - DNA, 92 bp, Homo sapiens
ttctgttcccaggctgcctgtcactttgggtaagaaaacacacagagttatgctcgcttacgcttactcaagtgaggtctcttgggaaagaa

SEQ ID NO: 549901 - DNA, 92 bp, Homo sapiens
atttctcatacctcccttatttggctatctaatgcaagatcctttgccatagaccttgcattagacaaccaaataggggaagtgtgagaagt

SEQ ID NO: 549902 - DNA, 92 bp, Homo sapiens
gtttctggatgctaagtgtggagaaggaggtcttggaggcccagttatgaccacacttccaagccacattctccatgactgtagccaggaat

SEQ ID NO: 549903 - DNA, 92 bp, Homo sapiens
gtgtgaggattggccaggatgacgtgtaggtggtgccaggtgatggctgttccctctacacccctcatggctcctggtccaatgccttccac

SEQ ID NO: 549904 - DNA, 92 bp, Homo sapiens
tttaatactatctcaaactaaaggatatagaaggttttccctttctcttgccctgaaaccttctgtatcctttattttgagatagtattaga

SEQ ID NO: 549905 - DNA, 92 bp, Homo sapiens
aggagaagtaacgtttccactgttcagtccttttcaagtggttactctagggatccgttgccaaggactggccagtggggatcctctctcct

SEQ ID NO: 549906 - DNA, 92 bp, Homo sapiens
gactcctccaggtcttggagtaggtcattgggtggatcctctatttccttacgtgggccactggatggctcctccatgtcttggagtagatc

SEQ ID NO: 549907 - DNA, 92 bp, Homo sapiens
cttttggtgttttcttcttggctgacacattagtttattattctgcttcaaatgaataaatttctgtgccagccaagattttaataaagaag

SEQ ID NO: 549908 - DNA, 92 bp, Homo sapiens
tttctcccctttgctacttcaggtcttgagaagagtgtgcttttatggaccatgtattcttttctctggatggatgtagcttgtgggagaag

SEQ ID NO: 549909 - DNA, 92 bp, Homo sapiens
gcctcgtcttcactcttctgctgctagagctgtcctaaacactcatcagcttcaaacccaacctagacagcagagagagtgcagggctgggc

SEQ ID NO: 549910 - DNA, 92 bp, Homo sapiens
ggtcccactagaggatgtttagtttgcccacagcatgagtgagggagcaagccttgagcagctgtggcaattcaaatgtctttcctgggacc

SEQ ID NO: 549911 - DNA, 92 bp, Homo sapiens
ccagggcagggtgtgtggaggagagtgagggaatgatcatgattgcacctcctgctcacttttacactcttgttctcacttcctgcctctgg

SEQ ID NO: 549912 - DNA, 92 bp, Homo sapiens
gggaaagcgggtacctggccaggccccttgcagggcagaacctcaggtggatgggcctctcggggtctggccgggtcccccctctgtgtccc

SEQ ID NO: 549913 - DNA, 92 bp, Homo sapiens
tgggagctgagcggtttctatggagatgggaattagtgaggaagtgctttccttttgattattctccatcctaatagggacaattgcaacca

SEQ ID NO: 549914 - DNA, 92 bp, Homo sapiens
ggtggctctttgccctgtctcactatgttaagtgaccaccaattactgtctgcacttaacacaggaggcaaggtaacctggagagcaccacc

SEQ ID NO: 549915 - DNA, 92 bp, Homo sapiens
atgtgtgtgggtgggcgtgtattgtgtgtttatatagtgtactcccgatatatatatgcacacatatatacttgcccattatctgcacatat

SEQ ID NO: 549916 - DNA, 92 bp, Homo sapiens
ctacagggtcttgctctgggttttaaaaatgaatagctctaaaaagataaagcaacaatcaactctttaaaacccagatttgccctgcttgg

SEQ ID NO: 549917 - DNA, 92 bp, Homo sapiens
acagcagttattttccattccatttgcctgctgagtgagcttccagggactaatgcctacttcagcaaggcagaagggaggtaagctgctgt

SEQ ID NO: 549918 - DNA, 92 bp, Homo sapiens
acaagtaacctggtgacctgattttgaactgcaactcaaaggaggtaagtgaagaagagtgcggtcacagtgaggtggccgggaaaacttgt

SEQ ID NO: 549919 - DNA, 92 bp, Homo sapiens
tctaacccaaccaatcagccaggcatcccaattaggattataagattttctgataattctaattgggatgcctagctgattggttgggctga

SEQ ID NO: 549920 - DNA, 92 bp, Homo sapiens
tggagattgcaggcagcttttacttatctatgctgcccacgcttaacatggaaaactgaaagctgaccttgtgttcctttaaaaaatctcca

SEQ ID NO: 549921 - DNA, 92 bp, Homo sapiens
atggaggacagaagtgaagtcaaaggcatgctgaggaaggaactctgagtggccattcacagtgtgtccttgacagcacttccgttctctat

SEQ ID NO: 549922 - DNA, 92 bp, Homo sapiens
agattaacacccttgtacaaagtcacatgagtcaagcaaataaccctgaagtgcaaggtgattcttgtgacttttgtaacattgtgttttct

SEQ ID NO: 549923 - DNA, 92 bp, Homo sapiens
agggtcagcttctgaaatggacatttccctgaaggcctgtacctgttgattttggccttcaggaaaatgtccatttaaaccaagctgcttct

SEQ ID NO: 549924 - DNA, 92 bp, Homo sapiens
tatctaagtgggtagtattatttcggttagggctttcttagtttttaacactatataaagtcttaaagaaatggctgccagcaaccaggatg

SEQ ID NO: 549925 - DNA, 92 bp, Homo sapiens
gggaactaaattcattcctgatgccagatctgatcgagtcagtatgtcttcagcttgatcagattttaaaatcagttttgaaagtggttccc

SEQ ID NO: 549926 - DNA, 92 bp, Homo sapiens
gcccttatgcctaggatcttgcatattatatgtgccttattaatgcttgcaattgtaagtgcactgtaagtgcaggatgagggctacagggc

SEQ ID NO: 549927 - DNA, 92 bp, Homo sapiens
gatgtgagtttcacctgatgagggatcaggatcttctttcatataatttgggaaagcagatgttggtccctttagatctgttaactgacatt

SEQ ID NO: 549928 - DNA, 92 bp, Homo sapiens
ctgtgtgtcctgtgactctgtgaggcagggctgtcttctgatgagggggacccagagaccagtcgtgtctcagacgtccagggcgctggcag

SEQ ID NO: 549929 - DNA, 92 bp, Homo sapiens
gcccaggggttatgggacaaggagagcacaaaatcagtccagtccatgtgggactgaattccaggcttagtttttttccatacccctgtggc

SEQ ID NO: 549930 - DNA, 92 bp, Homo sapiens
cctgggtctgggagtgctgaggttggggcttgggcttcctgcttgtctagaaaagggccaaatctcagctccagtcattgttggtctccagg

SEQ ID NO: 549931 - DNA, 92 bp, Homo sapiens
gtgttgtcccagagtagcaggatctggcagaaggaaatttccttctaaccctcaaagaatccacataaatcttgttacatttgggattttac

SEQ ID NO: 549932 - DNA, 92 bp, Homo sapiens
atgtgtgtgggtgggcgtgtattgtgtgtttatatagtatactcccgatatatatatgcacacatatatacttgcccattatctgcacatat

SEQ ID NO: 549933 - DNA, 92 bp, Homo sapiens
ccctgagaagagcagatggaaagcttgaggtcaacctgggcccacagctggccaggtagactgaagttctgtcatgccctgccttgaaaggg

SEQ ID NO: 549934 - DNA, 92 bp, Homo sapiens
gcagccgaggaaacagacagagccaggtgggtgtgtatactggtaggagacctctcctggctctttctattttcttagtgaaatagggctgc

SEQ ID NO: 549935 - DNA, 92 bp, Homo sapiens
gctgggatgtgtcaggtaggcagtgtattgctagcggctgttaatgattttaacagttgctagttgcactcctctctgttgcattcagaagc

SEQ ID NO: 549936 - DNA, 92 bp, Homo sapiens
gctagaagagtacagaaagggggagggtgaagagatgggattactacaggtgatctttacattatttttcatgcttttctaaacttttctgc

SEQ ID NO: 549937 - DNA, 92 bp, Homo sapiens
catagtaaagaatttgagatttgttctgcaggtgatgggatggtttcaggctttccatcacatttagaataaaatccaaactttttgctatg

SEQ ID NO: 549938 - DNA, 92 bp, Homo sapiens
cacctacctaactgggttagggccctggctccatctcctttaggaaaaccttctgtggggagtggggcttcgaccctaacccaggtgggctg

SEQ ID NO: 549939 - DNA, 92 bp, Homo sapiens
tccgtcttgctttcccaccccagtgccctttcctttctctctacccttggaggcggaggggaagggcaggggagaagggagggaagatgaga

SEQ ID NO: 549940 - DNA, 92 bp, Homo sapiens
gcatcactggttagaggaataattgattaggggtcaccgatgggggttattagttggagagtcactagttagtgctaatagccaagagatgt

SEQ ID NO: 549941 - DNA, 92 bp, Homo sapiens
ctttaagttttagggtacatgtgcacaacatgcaggtttgttacatatgtatacatatgccatgttggtgtgctgcacccatcaacttttgg

SEQ ID NO: 549942 - DNA, 92 bp, Homo sapiens
ttaaaggtgggcacttagcacatttattacatacggggcttattagataactgggctctgttgtgataaattggctgtgtgcttcatttgga

SEQ ID NO: 549943 - DNA, 92 bp, Homo sapiens
cttctcagtgttctttttctttcctcccacaggaagtcttgtaaatgagcacttggactttctgagggagattgaaaaaggtttttgggggg

SEQ ID NO: 549944 - DNA, 92 bp, Homo sapiens
gggatcaggtggcccaggtgatggttttctggtgagattgatggttcctgagggtcaaattcagagagcgatcgcttgggaaaattgatccc

SEQ ID NO: 549945 - DNA, 92 bp, Homo sapiens
gatgtaatagaaaccttttattcaggagaggtcactgccagggactgaagggggtgatctggctcctgcttgaaaggtttctccattgtatc

SEQ ID NO: 549946 - DNA, 92 bp, Homo sapiens
cttaacataaggctgattctctcgaactgtgcgaccggcagaagcagatgtgtgtgaactggacacagattgaagaatctgcccctgttgag

SEQ ID NO: 549947 - DNA, 92 bp, Homo sapiens
aacagtagagacactatggtcagactgcctgggtaaaaacttagctctgtcatttacttagtatctggctttggacaagtttctgaactgtt

SEQ ID NO: 549948 - DNA, 92 bp, Homo sapiens
gagggcaaagaggagtgggtgtgggcaggctggacaggaaggctgttgtcctgtcagcaccctgcccacatgcccacccagccaaggccctc

SEQ ID NO: 549949 - DNA, 92 bp, Homo sapiens
agatctggagtgcagtgcacttgaggccaaggaaggtgaacagatgagatgattgttactatttaggcctcagggtataagatcctggattt

SEQ ID NO: 549950 - DNA, 92 bp, Homo sapiens
ttctttctcttgctgtgctgtctgtggagcctgaagttgcctatgactcagcttcccaggctccagggagcctggcaccccggggaaaagga

SEQ ID NO: 549951 - DNA, 92 bp, Homo sapiens
tagggtctgcgcttctgtgggggcaggaggggcgtcactgtgcacagcctagatgccctggcctgtccccgcagggacaagacaagaccctg

SEQ ID NO: 549952 - DNA, 92 bp, Homo sapiens
gggtggcaaggaggtagactctggtctctagagctctatccaggccctataatggcctagagacagggagtctggctccgtgccctgtaccc

SEQ ID NO: 549953 - DNA, 92 bp, Homo sapiens
tgggagaaatctgagagccatgtgttccacaggcctctggtccttgttcaggcagcagggcactgtgacatgtggctccttggccccttcca

SEQ ID NO: 549954 - DNA, 92 bp, Homo sapiens
gacctttctgtcaactccatttccctgcctcctgcactgcgaggctaccttcttgcctagggggccgggcagaagagagaactgagagcgtt

SEQ ID NO: 549955 - DNA, 91 bp, Homo sapiens
tcagcccgccgctccggcttgcgtgatcactgccctccctaaacacggagccggctcgggaagtggggagtgggcaagcggggcgggctga

SEQ ID NO: 549956 - DNA, 91 bp, Homo sapiens
gagagggagatagattcaggaagatttggaaaagaaggacaacccctatcccatcttctcccaaactcttcctgcttgacatctcttgctt

SEQ ID NO: 549957 - DNA, 91 bp, Homo sapiens
cacactgtcaaacccaggctgaggtgaaggtgtgcagtcacagctcactgctggtcatgcacctgcactccagccagggtgtgacagagtg

SEQ ID NO: 549958 - DNA, 91 bp, Homo sapiens
gaattcttgatggtttaatgtatgccaacgcttagagtaatgtgccagccattattctaagcattggtatacattatttcatttactcctc

SEQ ID NO: 549959 - DNA, 91 bp, Homo sapiens
tgggggtggaacaagctaacattgctgaagtgctcagacagtgcctggcacctagtgagcactcgacaaatgttagccatcctcatcctca

SEQ ID NO: 549960 - DNA, 91 bp, Homo sapiens
acatgagaaacattaaccctttgctacccaggtaaactttggtaaatatggagtgtgtgtgggtggggagatggggtgtgaagtgttatgt

SEQ ID NO: 549961 - DNA, 91 bp, Homo sapiens
tcccacttcttaagtcacatggcttctgtcttggaaattttacctttaaaagattatttaagacaggaaccaggaggcttgggaacaggga

SEQ ID NO: 549962 - DNA, 91 bp, Homo sapiens
ggtgagtggagagggagcagtttctctaacagctggggaaaggggatcatctctaaagctgaaggggaagaactgctccgtaaacctcacc

SEQ ID NO: 549963 - DNA, 91 bp, Homo sapiens
gttatctagcatcatgggcagagttctacttaacacttgtttaaaaaagttctagttgttaagtagaaccctgcccatcatgctagataac

SEQ ID NO: 549964 - DNA, 91 bp, Homo sapiens
agccttctatctcctggggtttggggtgggttgtagttcaggggtcacctacctttacccaccaactaaattaaccaggaatagtaggact

SEQ ID NO: 549965 - DNA, 91 bp, Homo sapiens
tttgaaagatttattcaggctgtgtcagcagccacccaaatggtagtgtaaaaaaaaatctgctgatacaccccaaaataaattgcttaaa

SEQ ID NO: 549966 - DNA, 91 bp, Homo sapiens
ctcaggcgcgggttggggaggatgttttggatgccgctctgctgacgctggtgccctctgttcttacatcctccttaatttactgcctgag

SEQ ID NO: 549967 - DNA, 91 bp, Homo sapiens
gtctccccgaggggctgtgagctgctgtgggcagggatttttcttttttttccccatatttgcccagtgtggcccaagctcctgggataac

SEQ ID NO: 549968 - DNA, 91 bp, Homo sapiens
gttatctagcatgatgggcagggttctacttaacaactagaacttttttaaacaagtgttaagtagaactctgcccatgatgctagataac

SEQ ID NO: 549969 - DNA, 91 bp, Homo sapiens
gttccaaagtgaatgtgactggtacttttgtggtaatctccttgtgacttaaaagtaggttgccatagttaccaatcatctttgctggcac

SEQ ID NO: 549970 - DNA, 91 bp, Homo sapiens
ccattgggctgtggccaccggaggagagaaatcctgtggccatgtgtggtcatttcagtttctttgtttccagcttggccacacccaatgg

SEQ ID NO: 549971 - DNA, 91 bp, Homo sapiens
ggctttctgcctaccacaaccattttagacctctcttgaccagcaatgggtggtttagatgagtctagaatggatgcaataggttttggcc

SEQ ID NO: 549972 - DNA, 91 bp, Homo sapiens
ggaactctatgcagggaaatgccacctctgtgccctagtttcctcatctgtaaaattctcaggggacaggagtgcttccttgtggggttct

SEQ ID NO: 549973 - DNA, 91 bp, Homo sapiens
tgtccacacttttcaagtacatgttgttcaaaagccacatgttctcgtctatgaggtcaagagcagcatgagctatgaactggtgcagaca

SEQ ID NO: 549974 - DNA, 91 bp, Homo sapiens
agtccagtgtggtctccactctcatggaatttccattctactaaggaggttggaagagtttatgagagtttgagtcaaacgcacttgggct

SEQ ID NO: 549975 - DNA, 91 bp, Homo sapiens
ttctctttcctcaggtggccaggtgcatatcttggtgtgaggaccttcactgtatctgggaatgcctactggttaccttggtaacagagaa

SEQ ID NO: 549976 - DNA, 91 bp, Homo sapiens
ggcgcggcgggactttcgctgaccgcggctcagtttctcagtttcggaaacgggaactggggcgggaagggggaaggaagggcgccgcgcc

SEQ ID NO: 549977 - DNA, 91 bp, Homo sapiens
gttgcctctaccactcagatgatgtcaggcccagttcctcagtgccctgcacaaggaacagggctcatcttctgagaaggatggacgcagc

SEQ ID NO: 549978 - DNA, 91 bp, Homo sapiens
aataagtaacatatgaacactcatcaactgtgcctgacatgccaagtgccacatgtcaggcacagacaatgagtgtgcataattacttatt

SEQ ID NO: 549979 - DNA, 91 bp, Homo sapiens
tcttctctttcttctttttccgtttttggtcttcaagatcctctagtgactgaggagtcaggagccacgtggaagagggtgggggagaaga

SEQ ID NO: 549980 - DNA, 91 bp, Homo sapiens
gaatatctttctatacgttctcttatagactatgtgagaaatatgtgatattctcacataggtctataagaagacatacagaaagatattc

SEQ ID NO: 549981 - DNA, 91 bp, Homo sapiens
gcttccctgcaacagagtgtgcctctgccgctgccccagggattctggatttaggggcagctctggccagaggcagggacagcagagaggc

SEQ ID NO: 549982 - DNA, 91 bp, Homo sapiens
ggaatattcctcagctgtttctagtctggttttgtgactagctatcttggaatagttatgccagatctgaagcaactgaggcagtatggcc

SEQ ID NO: 549983 - DNA, 91 bp, Homo sapiens
ccaggaaaatgcattttaaataagcatcttgtggggccttcagcatctgcatcactgtcacaggttgcttattaaaaatgcatgttcctgg

SEQ ID NO: 549984 - DNA, 91 bp, Homo sapiens
ctgaccgtggcggttcaaatgaagagttcagtgatggcagccggagaggaacaaagttactgacctcatccttgaaacccaccatggttag

SEQ ID NO: 549985 - DNA, 91 bp, Homo sapiens
ttctcctcctgctgtcatttctcattactgcccttgacttctttctagaagagtgggtacagtggggagtgaccagcccccaggaagagga

SEQ ID NO: 549986 - DNA, 91 bp, Homo sapiens
ggcttctgccccactcaatctggctcgctaggctctggggtccatctggccagctctcctgggcttagtggctaggtctggggtgggagcc

SEQ ID NO: 549987 - DNA, 91 bp, Homo sapiens
gatgtgatttacccctgactcttgctgtgcctgtagattttacaatctaagtcaatcccactcacagtaggggccattggtaaagtacttc

SEQ ID NO: 549988 - DNA, 91 bp, Homo sapiens
ttcaaagagatccagttacttgctcaagactggaaaaagtgatattcacccaaattctgtgactttgagcaagttactgaacctctttggg

SEQ ID NO: 549989 - DNA, 91 bp, Homo sapiens
agctgcatggagttctgtggatggaggttgagagggctgcttcgaaaataactctgctttctcactctccattcacccatgtgccccagct

SEQ ID NO: 549990 - DNA, 91 bp, Homo sapiens
tcaagaggtaatttatcttggtcacccttccttctacagagcactccagcctggaggttaatagaaaaggaggctgtggctgccatcttga

SEQ ID NO: 549991 - DNA, 91 bp, Homo sapiens
ggcgctgagttccctggcggtagtccagctggggcggcagcccagcggggacagaaccccagctcggacccctgccacgctgctttgcgcc

SEQ ID NO: 549992 - DNA, 91 bp, Homo sapiens
ctcagatttccagggacccacatgccagcactatcccagcctcgggtgtctgaggtacctagaccagagggtgtggccctggaggtgtgag

SEQ ID NO: 549993 - DNA, 91 bp, Homo sapiens
acaataaagctacttatattttgtttcttctttaagagcaaatttattcttatttcttaaagaagaaataagatacaagtagctttattgt

SEQ ID NO: 549994 - DNA, 91 bp, Homo sapiens
caggatgcggtggctgatgacagaacaatgtggagagaggcgtcatttgtcaaatccttactttgttctgggcattgtgctaaaaattctg

SEQ ID NO: 549995 - DNA, 91 bp, Homo sapiens
cagcctgggtatgcgtgaccccaaaacagctggttaattccctgaaaagaattgagtgccagatgtgggggatcgtgtaacctgagggctg

SEQ ID NO: 549996 - DNA, 91 bp, Homo sapiens
agctggcttcagaaggcagccttgactagtgacttagttacaatctcatccctgctctgagtggctggtgaggttagccctggggtcagct

SEQ ID NO: 549997 - DNA, 91 bp, Homo sapiens
tatctggccctgggcgaggaagtgggtgctttagaggtcttagagtacagacagcttttagggcattctgatcttcaccctggttcagatg

SEQ ID NO: 549998 - DNA, 91 bp, Homo sapiens
ggtttggtcactaggggcagattttctgaggccattagggaataatgttctctttgatggacttgggaacttttgtctctggtgctgtgcc

SEQ ID NO: 549999 - DNA, 91 bp, Homo sapiens
aagactacattatcctgtttctaattccttttctttcttcctgcggaaatgtaattgcagaagctgggagaagggattggagtgtgggctt

SEQ ID NO: 550000 - DNA, 91 bp, Homo sapiens
gcgcgccgcgcaggcgcagtggtgcgaggatgagctgggcgaaattgtgaggcgctcgctcgcgcactctgcggctgcgcggccagggcgc

SEQ ID NO: 550001 - DNA, 91 bp, Homo sapiens
gatttatgtgtgtgtgtgtaatatgtttaatatatgaaacagtgaaagatataaacatgtatttgcatgtgtgcacacacacacacaaatc

SEQ ID NO: 550002 - DNA, 91 bp, Homo sapiens
taacaaattaaatgtttaaacagccagtgcaaacatttagatctgagtcaaaattgtttgcactctgccagtttaggcatttaatttatta

SEQ ID NO: 550003 - DNA, 91 bp, Homo sapiens
caactactgatacctcccctttatccagctttgtgtgccctgggcgggttggcttggtgtacaaggctgccaagagaggagggggtggttg

SEQ ID NO: 550004 - DNA, 91 bp, Homo sapiens
acatatgtgaaaacataggactgtgcttggcacatagcacaaagtcttatggtactgtgtgccaagcatagtcctgtgtttttacatatgt

SEQ ID NO: 550005 - DNA, 91 bp, Homo sapiens
ttctctttcctcaggtggccaggtgcatatcttggtgtgaggaccttcgctgtatctgggaatgcctactggttaccttggtaacagagaa

SEQ ID NO: 550006 - DNA, 91 bp, Homo sapiens
tgttttgttttgcaccaggtcactccattcatatatattacaccagcaattctgcctacatgaatagagcagcctggtgcaaaacagaaca

SEQ ID NO: 550007 - DNA, 91 bp, Homo sapiens
gcgccctggccgcgcagccgcagagtgcgcgagcgagcgcctcacaatttcgcccagctcatcctcgcaccactgcgcctgcgcggcgcgc

SEQ ID NO: 550008 - DNA, 91 bp, Homo sapiens
gaggtcaagccaagggcagggactgcagagggtgacgcttgggtaccctgggcatggactaacccttgtagacctgccccacagacacctt

SEQ ID NO: 550009 - DNA, 91 bp, Homo sapiens
gatttggagggcagggtgaggtggcaacatggtcatggtgttgtcttgggatttttccacagccgtgttccactgccttgtccctaatgtc

SEQ ID NO: 550010 - DNA, 91 bp, Homo sapiens
gcgcgagggcttctggggtttgtggttcttctgcgcccttttgccgctgcgtgctcggatctaggactatacatcccagaaggctgcgcgc

SEQ ID NO: 550011 - DNA, 91 bp, Homo sapiens
tcctctgcaccccacagtgctcattcaagtgaagagtcatctttgaaggcaattgtagcttcttgcttggctgagcatcatggagcttgga

SEQ ID NO: 550012 - DNA, 91 bp, Homo sapiens
ttcctggggattaatgaatagctgggtggagttaattgcctaaagtatagtctcaggccattaacctcagttggtcactaatccctaggaa

SEQ ID NO: 550013 - DNA, 91 bp, Homo sapiens
gtcttttaactctatattgctggtggctctgatttcatgatgcattgtgcttatgaaactctagctttcagcactaaaatgagttaaagat

SEQ ID NO: 550014 - DNA, 91 bp, Homo sapiens
gtgagctcagccacttggcagtccagggtcaaacagaggacggctcagcttccctctgtgtcctgggctctgagcggagccctgagctaac

SEQ ID NO: 550015 - DNA, 91 bp, Homo sapiens
catgattaagcaggggagtgagggtagaggcaggagtgcaaaattgtaaagttttagctttttgagctattctcagtccctgtgtggtatg

SEQ ID NO: 550016 - DNA, 91 bp, Homo sapiens
ttctctttcctcaggtggccaggtgcatatcttggtgtgaggacctttgctgtatctgggaatgcctactggttaccttggtaacagagaa

SEQ ID NO: 550017 - DNA, 91 bp, Homo sapiens
ggtgtgcattaacccggttctcccaagcccagctctaagcggagtataggcggagagctgggtttgggatttggtgattgttgatgacacc

SEQ ID NO: 550018 - DNA, 91 bp, Homo sapiens
cctcgtattcagagccaggttgacttactgtttgctggctgataggactggcagaagttacagcttgtatgatagagtcagcctgggcagg

SEQ ID NO: 550019 - DNA, 91 bp, Homo sapiens
taataaattaaatgcctaaactggcagagtgcaaacaattttgactcagatctaaatgtttgcactggctgtttaaacatttaatttgtta

SEQ ID NO: 550020 - DNA, 91 bp, Homo sapiens
ttttcaaagcaatgtgtgacaggtacagggacaaatcccgttaataagtaagaggatttgtgcttggctctgtcacatgccactttgaaaa

SEQ ID NO: 550021 - DNA, 91 bp, Homo sapiens
ccagccagtatgggtgtcatccctgtcccccgtggaggctcctggacctcaggtgcaggggcttctctggtgacagggtctgtcctggtgg

SEQ ID NO: 550022 - DNA, 91 bp, Homo sapiens
ggggaggatgggtggtgggagagaagagaggaattgtcaaaagtgcagtgatttagtgtctgtctctttcttcccttctccctccctccct

SEQ ID NO: 550023 - DNA, 91 bp, Homo sapiens
tcccacttcttaaatcacatggcttctgtcttggaaattttacctttaaaagattatttaagacaggaaccaggaggcttgggaataggga

SEQ ID NO: 550024 - DNA, 91 bp, Homo sapiens
tgttctgttttgcaccaggctgctctattcatgtaggcagaattgctggtgtaatatatatgaatggagtgacctggtgcaaaacaaaaca

SEQ ID NO: 550025 - DNA, 91 bp, Homo sapiens
gctgctgtgaaatgagttggggggttttagtgtaattctgcttggacagataatcatcacacaaacctcccactcagttgtcacaattagc

SEQ ID NO: 550026 - DNA, 91 bp, Homo sapiens
caggagatgagatgagcactggcctgggagtcaggggctgtattccaggctctgtcactgacccgggcaagtcactcacttcttctccctg

SEQ ID NO: 550027 - DNA, 91 bp, Homo sapiens
gactgcaatgcccaggcctgctgttgcccagcttgtttgcagattaattgcttttcgagctggcaggagctgcctcttcagcagccagatc

SEQ ID NO: 550028 - DNA, 91 bp, Homo sapiens
gactgcctgacctctatttcttgggaaccgttgttttgggggagactggagaacagagagaatgaatgaggaagagaggttggggccagtc

SEQ ID NO: 550029 - DNA, 91 bp, Homo sapiens
aacatgttttaactttgggatgtttataggcaagtttgtttatctaaaataaaacacaccgcattgaatgtcctaaagttactacaatgtt

SEQ ID NO: 550030 - DNA, 91 bp, Homo sapiens
gaggtgggggccgcagaggggcttgaggccctgatggccaaggaagacggagccaggggcagggccatgggcctcgtgtggccccccgctc

SEQ ID NO: 550031 - DNA, 91 bp, Homo sapiens
tctgggagagagcagggggctcctccctggggcccagcgggacctcagtttcacgggagtctcagagagccaagccccctcctctcccaga

SEQ ID NO: 550032 - DNA, 91 bp, Homo sapiens
ttggcctgggtctggccctcccccctcttctttggagccttccttctgaggacaggccctggggaagggggagggaaagggactgggccaa

SEQ ID NO: 550033 - DNA, 91 bp, Homo sapiens
ggctcaacatatgactgccttcttcacatcattcatgccctctttgagctgaggcatgaatgatgtaaatgaggcagttatatgttgagct

SEQ ID NO: 550034 - DNA, 91 bp, Homo sapiens
acttaaaagttaatacaatgcttggtatgaatgtcactcaattttaaatcatgtgacactcataccaggcattgaattaacttttttctgt

SEQ ID NO: 550035 - DNA, 91 bp, Homo sapiens
ttttccaagcccctgacccccaaccctgctgccagagctcacctccaggacaggggctgtggaggggttgggggtgcaggggagctgagga

SEQ ID NO: 550036 - DNA, 91 bp, Homo sapiens
agcacatggctgtcaactccaaggtacctgccagatagaaagtatgagggaaagcattttgcaggcactctggagttttcagccacctgct

SEQ ID NO: 550037 - DNA, 91 bp, Homo sapiens
gtcagaagtattttcccaactgcagatgtgaaataggctggttatacacatctatttgtttctcttctgtagtgctgaaaattatattgat

SEQ ID NO: 550038 - DNA, 91 bp, Homo sapiens
ttcttctttttattgggttttctggaaaataggcccttttttccacaggcagtctaggactattttcctgaaaattagatataatgaagga

SEQ ID NO: 550039 - DNA, 90 bp, Homo sapiens
ccggtccccccattggcatccttgcctggagaacttgagatggctgccatcgcctgaagccagggtggggagtggaggtggggggattgg

SEQ ID NO: 550040 - DNA, 90 bp, Homo sapiens
tgagcctcaggtttcccatttgtaccttggaggtaatgctttcacctaacgccccacctcacagggtatgtagggaacatctgttgctta

SEQ ID NO: 550041 - DNA, 90 bp, Homo sapiens
cccaaatgttggagcttcagatgagttgttctcatgctaggcttctgctgagttacggctcataaacctggagcttcaaaacacaatggg

SEQ ID NO: 550042 - DNA, 90 bp, Homo sapiens
ggcagcaggggaggcgggagaagcagccgggcctaggccgcaccaggccgcggagtggccctacgctgctgcttcccgaccgaggctgcc

SEQ ID NO: 550043 - DNA, 90 bp, Homo sapiens
gcctctatttcctactgtggtacatgctggaagttgcctatgagtgaccacaaagggcagctcagtatagtacctctgggtctagctggc

SEQ ID NO: 550044 - DNA, 90 bp, Homo sapiens
ggtctgcagtggccttctctgatgacatctcagccttcgttctgcctgaaatgctaagcgtggctcagagtcatcggacaaggtcaaacc

SEQ ID NO: 550045 - DNA, 90 bp, Homo sapiens
tcgatggtgtaagaatctcaggtgacaatgtcaggagctcctgagcacctgagcacctgacattgtcatctgagattctgacacgattga

SEQ ID NO: 550046 - DNA, 90 bp, Homo sapiens
gagagaaaggaatgggagggggagctaatgggcattgctgaggttggcatgaagttttggtggtgccaggcttctgatttttttttcctc

SEQ ID NO: 550047 - DNA, 90 bp, Homo sapiens
tctcaggttgtgaccttctcgaggaaagaagcactttctgttgtctgaaagaaaagaaagtgcttcctttcagagggttacggtttgaga

SEQ ID NO: 550048 - DNA, 90 bp, Homo sapiens
ctttcagctttcagtttttatttaaaagacttaattggaagtttttattactcccaattaggctttttaattaaaaggaaaagttgaaag

SEQ ID NO: 550049 - DNA, 90 bp, Homo sapiens
gctattagccatgacaatctgaaagatgactgctgtgacggttgagtgatgaatggctaagtcatcttttagatagtcatgcctaatagc

SEQ ID NO: 550050 - DNA, 90 bp, Homo sapiens
ggtggcggggctgcggctgggcggaggtggggtcagtgagagccgctttcaaccgcgcccccgctcagcctccgcggccctcagcgcatc

SEQ ID NO: 550051 - DNA, 90 bp, Homo sapiens
ttgccttttacttcttgatgtttgtgactcttttggcctcaactttgagaccagagcgggtagaggatctttaggggtatgtagtggtaa

SEQ ID NO: 550052 - DNA, 90 bp, Homo sapiens
gctgtgcattggtgcatgcatgtgtgccatggaagcacatgctcacgtgtgcatgtgtgttcgtggccatgtgtttacactgtgtgcagc

SEQ ID NO: 550053 - DNA, 90 bp, Homo sapiens
tcctgcaggaaggagacggtgatgatggggagacaggcttcttgcctccacatcctcccatcacaggcacctgtctccttcccctcagga

SEQ ID NO: 550054 - DNA, 90 bp, Homo sapiens
tacggtgaacaaagccctcggagagctcacagctgtggcccagggaacacattccacctggctcagctgtgagttcttccttgcactgtg

SEQ ID NO: 550055 - DNA, 90 bp, Homo sapiens
gtctcctgactcaatttaattctacaagcatttatttagcacctactatgtgccaggtacagtgcttagattttgggagtacagggtgac

SEQ ID NO: 550056 - DNA, 90 bp, Homo sapiens
gtgctttttgccatcctccccactcctcccaccacccagcatttcccaggatgaaagggtgggaaggtagggaggagagacaaggagcat

SEQ ID NO: 550057 - DNA, 90 bp, Homo sapiens
ggggagctgggggttcctgtggagcaggggtatgggtcccaccctggccaccccgtctgcccaggctccacatgtgccccctggtccccc

SEQ ID NO: 550058 - DNA, 90 bp, Homo sapiens
ttgcattgtcatccccttgcattgtggttgcagtcaatgaaagttagaaataattgattgcagctgcatggctatttaatggcaatgcaa

SEQ ID NO: 550059 - DNA, 90 bp, Homo sapiens
ctgggggcaggcccaggagaggtctctgtgtctcatgtatcttccaaggcctcttggagaggagacagaaccatcctgggaccctcccag

SEQ ID NO: 550060 - DNA, 90 bp, Homo sapiens
tttgtgactgggtgaaaattgtttggctggatgtcctggaaaattgtcttctgggaatatctatattgtagggttcacttttgtcataga

SEQ ID NO: 550061 - DNA, 90 bp, Homo sapiens
tgggctaggtcaggcccctgggcgctcagcagttctgtcggcaagtgagcacaagaggagcggggcagcctgagggtctggccctgtcta

SEQ ID NO: 550062 - DNA, 90 bp, Homo sapiens
ttaatttcaccagggaggctgagactctgaatttttcccccttgcaggagggaataatttagattttcttccatccctgtcagaagttga

SEQ ID NO: 550063 - DNA, 90 bp, Homo sapiens
actttaggaagctcatttatcttgactggattgcttaatattagtctaatgtttaaattgtccagttgagataacagggtcccctttagt

SEQ ID NO: 550064 - DNA, 90 bp, Homo sapiens
gttgtagtttttcaggttttctctcttgcctagctcctgtggattcacatctgagcatagaagagagagggggccatgtaagaactaaac

SEQ ID NO: 550065 - DNA, 90 bp, Homo sapiens
cctcatctcctctctgggcactggcctattgtcaggctgctccttgcgaaaggaaagacaggcctccagtgtgctagggtggggatgggg

SEQ ID NO: 550066 - DNA, 90 bp, Homo sapiens
gagctgggagaattgtctgagttccctggagtagctcccagcatggggagatacaattaggggatgaccttaggtaatgaagctcagttc

SEQ ID NO: 550067 - DNA, 90 bp, Homo sapiens
cggtgatggaaggcctcttctggaacccgagcctctggcatagttagctactagtgggtttggggtctgggctgaggctacctggggccg

SEQ ID NO: 550068 - DNA, 90 bp, Homo sapiens
acgatttggcaggtcagtcaatgggaaatgatgcacagtttgctgaaattgatcacacttcatttcccatcaattgtaaagccaaattgt

SEQ ID NO: 550069 - DNA, 90 bp, Homo sapiens
atctctcttgttcctgtgtttccaggagttttgccacatgtgttttccagaaggtggtatcaggactcctgggatacttaccagggagat

SEQ ID NO: 550070 - DNA, 90 bp, Homo sapiens
acatggccaggacacagaaccgtgggggcagccccagcccttccctgcctgttacaggcccctgcccctgttcctgtgtcccatgcctgt

SEQ ID NO: 550071 - DNA, 90 bp, Homo sapiens
gacctgggcagtgggttgattggagtgaggggataccatgcccaccctgccttggtcctcctggctccatcaccccatgcccatgaggtc

SEQ ID NO: 550072 - DNA, 90 bp, Homo sapiens
cttaatcctctcaatggcttttgatatcctcaggtagatgggaggatccccattttacctgggagggatacaaggccaagaggggttaag

SEQ ID NO: 550073 - DNA, 90 bp, Homo sapiens
aggttggcttgtcaaattatgctgcagcatattgtactggcctgctgctggcccgcaggcttttcaatatgtttggcatggacaagatct

SEQ ID NO: 550074 - DNA, 90 bp, Homo sapiens
tcaatggttgtagagctggttgtggggaaaatgagatgttctgggattccagaactgattttatttttttcactccaagcacctagttga

SEQ ID NO: 550075 - DNA, 90 bp, Homo sapiens
ggaggagtgcatggcacccacgactgtaaactccaataatattttctgtaataaatgtgaggagttcacagttgctgccatccctcctcc

SEQ ID NO: 550076 - DNA, 90 bp, Homo sapiens
ttggaagtcgagccgtcttcatgaagctcctaaggatgggaaggtgcgcaccacattagggagcttcatgagagagcaagcggctgccgg

SEQ ID NO: 550077 - DNA, 90 bp, Homo sapiens
gggttcccagggaacctggctccacaggccagggtgtgggaggaccgcctggccacacctcagccatgtggaggcggcacctgcacaccc

SEQ ID NO: 550078 - DNA, 90 bp, Homo sapiens
cccaggcttgtgctctctaggttctggtccctgggacagtggtcacacagacaaaggaggtggacgcagccgagggagcaggggcctggg

SEQ ID NO: 550079 - DNA, 90 bp, Homo sapiens
aagcatataattgcgtatgcaaaatggataattgcatacaaaattgcccatttgtgtgtgcaattacccattttatgcacacaaatgctt

SEQ ID NO: 550080 - DNA, 90 bp, Homo sapiens
cacctatgccggaagattatttcattggcaggtattttattgcttctaaaagttccattttactgcaatgaacatctttttacataggtg

SEQ ID NO: 550081 - DNA, 90 bp, Homo sapiens
tctcaggctgtgaccatctggaggtaagaagcactttctgttttgtgaaagaaaagaaagtgcttcctttcagagggttactctttgaga

SEQ ID NO: 550082 - DNA, 90 bp, Homo sapiens
gattttaaatctgacagttagattacagggtacctaagaaaaaatggctctttcactaggtacctagtaatttaattcttgtttgaaatt

SEQ ID NO: 550083 - DNA, 90 bp, Homo sapiens
tcccatgctgtgaccctctagaggaagcactttctgtttgttgtctgagaaaaaacaaagtgcttccctttagagtgttaccgtttggga

SEQ ID NO: 550084 - DNA, 90 bp, Homo sapiens
tgagtaacactcaaagcatctataaggaccccatgcagcacatcctaaatagctgtatggggtctttatggatgctttgggtgttattca

SEQ ID NO: 550085 - DNA, 90 bp, Homo sapiens
gtctatttgtgtcgggttaatgaactcttctagggcactcaatagaaccagcgtgcctttaaaggactcattgacctcacagggatgagc

SEQ ID NO: 550086 - DNA, 90 bp, Homo sapiens
gcttgttttgagttcattgttcagcagatgagcttgttcaagatttcactttcagcagttcatttgattgaacttgggaccaataaaagc

SEQ ID NO: 550087 - DNA, 90 bp, Homo sapiens
cctggcgcggcccggtgggctttgtgccccgggtgccccaccgcccgcgcccctccgggcatctggcccacaaagcccgggcctgccagg

SEQ ID NO: 550088 - DNA, 90 bp, Homo sapiens
gggttgatcaggtgggaggaggcctgcaccttaagtgggtgctggagccagccccaagtgagtctgtgggttcccctatgcagcaggccc

SEQ ID NO: 550089 - DNA, 90 bp, Homo sapiens
ttctctttcctcaggtggccaggtgcatatcttgtgtgaggaccttcactgtatctgggaatgcctactggttacctcggtaacagagaa

SEQ ID NO: 550090 - DNA, 90 bp, Homo sapiens
aggcccatatcctgacattgatccaagtgcggaactcccattgaagtcgatgagagtgttgtatagaaatcaatgacaggatatggacct

SEQ ID NO: 550091 - DNA, 90 bp, Homo sapiens
aagtccctgacacccttctttcctgtgtgccttaggtggtagtcggccacaacacaaccgccagccaggaaaaggccagggtgcggggat

SEQ ID NO: 550092 - DNA, 90 bp, Homo sapiens
ttattgtctccatttatttaggaggaaactgaggtttgggaaggttagtcactttaccgaagtttcttcctaaaccagcggggacaataa

SEQ ID NO: 550093 - DNA, 90 bp, Homo sapiens
ggtgcagaggcttttaaaggactgacattcctcgggttatggaaaacaataataataaatcttaaggaatgtcaccttgcccctggcact

SEQ ID NO: 550094 - DNA, 90 bp, Homo sapiens
atgagtaaacatacgcacactcatcaactgtgtgtgacatgtagcactttgggttgcaggcacagttgatgatgtgcatgtgttactcat

SEQ ID NO: 550095 - DNA, 90 bp, Homo sapiens
catggagaagagaaaacagctggtctcaaatgttccttcttctaaaaatagggattagagcagatgtaggcacagttgctacttctcctg

SEQ ID NO: 550096 - DNA, 90 bp, Homo sapiens
tgtaggtagcctgtggaaaggagagaggagaccagagtagaccaactagatctcctagctcatctcttcattcattcatgcatgcctgca

SEQ ID NO: 550097 - DNA, 90 bp, Homo sapiens
tctcaggctgtgaccttctcgaggaaagaagcactttctgttgtctgaaagaaaagaaagtgcttcctttcagagggttacggtttgaga

SEQ ID NO: 550098 - DNA, 90 bp, Homo sapiens
gccaaggtgaatttgatagtcttggctgtacagcgtagtggttaaaagcatgccatttggagccagactgtttaggttcaaaccttaggt

SEQ ID NO: 550099 - DNA, 90 bp, Homo sapiens
gcactgtgggtgcattgagggtgttttattgtacacagagggaagctttctctaaagtgcaggtataacacctcttcaaacccctagtgc

SEQ ID NO: 550100 - DNA, 90 bp, Homo sapiens
tcgatggtgtgagaatctcaggtgacaatgtcaggagctcctgagcacctgagcacctgacattgtcatctgagattctgacacgattga

SEQ ID NO: 550101 - DNA, 90 bp, Homo sapiens
agtggcaagttagcctcctgacccacttctctcctgctttcactctggtgtatgaagggggatgagggaggggccagagaggtggccact

SEQ ID NO: 550102 - DNA, 90 bp, Homo sapiens
aatacgatgtgttgagacagtgtccctagtgtcaaggctggggacattgacagtgttgacattggggacattatctccacatgttgtatt

SEQ ID NO: 550103 - DNA, 90 bp, Homo sapiens
tgctcaagtgctgttcttctgcgaagcctgccctcatttccctctccagcagaatcagggcaagcttcttagagaagcagggcttgagca

SEQ ID NO: 550104 - DNA, 90 bp, Homo sapiens
ggtgcacagagaacacaggggcaggcagtggacccatgcagctccgtgagggccaggggtgtttgtctcctttgtgtcctctgttgtatc

SEQ ID NO: 550105 - DNA, 90 bp, Homo sapiens
tcacattgttttcattctttttctgttagtttgagttgggaacagaattatgaagccaaaataatagagaagaggtgtctaagcatgtgg

SEQ ID NO: 550106 - DNA, 90 bp, Homo sapiens
taactttaatagtaattaaaattccatctgatttctgaaatccatatgacacagaaatcatatggaagtttaactgctattaaatagtta

SEQ ID NO: 550107 - DNA, 90 bp, Homo sapiens
tcctcaggacaaacttgttctgttcctgatgattcttctggaactatagtcaatgaaatcatcacgaacacaacagcgtttgttctggga

SEQ ID NO: 550108 - DNA, 90 bp, Homo sapiens
ccagtcatggcatgcgatggaggacaggggaggccattgaggggatgagggtctcaatgagcttgtctgtgccccgagctgcccagctgg

SEQ ID NO: 550109 - DNA, 90 bp, Homo sapiens
gttacagggtggacaggtgctaattcctctcttctggctgcactccactttcagtaatggcaactggcacctgcaaatcccctttgtgac

SEQ ID NO: 550110 - DNA, 90 bp, Homo sapiens
cctgaccccacctcggtgtgtctgcctgcggtttccttctgtctccgtcctttcaggatggaagcccagctgccacctggtggggtgagg

SEQ ID NO: 550111 - DNA, 90 bp, Homo sapiens
gaacatatcatgaagctgagtcagtatggaaaattttcaaataaacagggtgctgaagttccatctgtctcatctgcttatgataagttc

SEQ ID NO: 550112 - DNA, 90 bp, Homo sapiens
tgctgtctgtgagagttggcagcctcagaaagaatggagacttaacccccttaggctttctgggctgtgaaacgctctcataaacaagta

SEQ ID NO: 550113 - DNA, 90 bp, Homo sapiens
tgctagtcatttctgctacacaaaaatcccctggtcactttttgttatttgtgtgaccagggaatttttatgtagcagaaatagctagta

SEQ ID NO: 550114 - DNA, 90 bp, Homo sapiens
ggtaggggcacagcagttggaagctggagatcccaggttcctggaatactcgggctgggaccttccggtttctcctgtctgctccctacc

SEQ ID NO: 550115 - DNA, 90 bp, Homo sapiens
tggtggggctgtcaggcgtggggaacctttcctgagagaagaaaggagccgctctccaggtgggttcccgactctggctggctcccacca

SEQ ID NO: 550116 - DNA, 90 bp, Homo sapiens
tgcttctactgaagatctgggctggctttgtctccttcctcggtaagaacttaggcatgggactttagtccagattgattgtgagaagta

SEQ ID NO: 550117 - DNA, 90 bp, Homo sapiens
ggagatgggcagggatgggtgggagagctttcctggaaaaatcttctctcaccctcttcaggagcctttttccacccatcctcctcctcc

SEQ ID NO: 550118 - DNA, 90 bp, Homo sapiens
tgggcttcatctgttactggttttatttttttcctcagcctacagccagttgtggaaggaattaaccagtaaattccaggtcctagttca

SEQ ID NO: 550119 - DNA, 90 bp, Homo sapiens
ggcctgtgcgcatgtgtgggtttgtgtgagtgcccatgtatgcacacgtgtatatgcatgtacccacacaggcccatctcctcacaggcc

SEQ ID NO: 550120 - DNA, 90 bp, Homo sapiens
aagcatttgtgtgcataaaatgggtaattgcacacacaaatgggcaattttgtatgcaattatccattttgcatacgcaattatatgctt

SEQ ID NO: 550121 - DNA, 90 bp, Homo sapiens
gggttcccagggagcctggctccacaggccagggtgtggaaggaccgcctggccacacctcagccatgtggaggctgcacctgcacaccc

SEQ ID NO: 550122 - DNA, 90 bp, Homo sapiens
gattaattgagtaccagttagttaagtttggatgcatggatgcatcaccttaaatgtatccaagcttaactaactggtattcaattcatc

SEQ ID NO: 550123 - DNA, 90 bp, Homo sapiens
gcttcctgtggtaataagactgtgttacaccaaaggggaatgtatgaagcaacagatcttcttgggtgtgaccagtctgagccttgaagc

SEQ ID NO: 550124 - DNA, 90 bp, Homo sapiens
ctcatttctttcttattggctctgtgagttgatgacatctttaagagtattcatcatgtcaacagctcacagaccaataagaaagttggg

SEQ ID NO: 550125 - DNA, 89 bp, Homo sapiens
gctgtggattctttatctgagctatgcagatgctttgatgcatgaagaaagttttaagacatctgcactagcttgaataagataacagt

SEQ ID NO: 550126 - DNA, 89 bp, Homo sapiens
taaatggaatgccaaccttttgtcaaggaaattattgttttctctggaggtaaggagattttcttggcaaaaggttgagcttacattta

SEQ ID NO: 550127 - DNA, 89 bp, Homo sapiens
gacaagagtcaggcaggatgggaggcaggaccctggccccaggccctgagggtcaggagttggggcctgactgtcctagccagaatgtc

SEQ ID NO: 550128 - DNA, 89 bp, Homo sapiens
tattaaaaattatgtacttagctgaaggtcctggttgtctaagcttatgggacaaccaggactgtcagctaattatataatttttgata

SEQ ID NO: 550129 - DNA, 89 bp, Homo sapiens
agtgtcatttgaaagggccttccagtttgctcagttggaaagtgttacagagttttaaagggtgagctggaaggctctcagctggcact

SEQ ID NO: 550130 - DNA, 89 bp, Homo sapiens
ggagcagctttgtataaggtatctgccacccctgtaccacatgctgaggcccttaggggtggcactgtgccttgttcacccctgcctcc

SEQ ID NO: 550131 - DNA, 89 bp, Homo sapiens
tcttggagccttgatttctctatctttgaggctgcaggaatgaaataattctggtatttttgcagcctggtgaggaaataggtatcaga

SEQ ID NO: 550132 - DNA, 89 bp, Homo sapiens
atgagtaaacacatgcacataatcaactgtgcctgacatgtggcactttgtgttgcagacacagctgatgatgtgcatgtgttactcat

SEQ ID NO: 550133 - DNA, 89 bp, Homo sapiens
gtgccatattctaaactgttctgagaagctgcatctgaattcaaagaaggggtgcagaagtagctggaagagagagaccagagtggcac

SEQ ID NO: 550134 - DNA, 89 bp, Homo sapiens
atatcaagatttattggcctaagaggtaaatattgactgataagatgttgaggtcaataattacctccagggacaataaatctttatat

SEQ ID NO: 550135 - DNA, 89 bp, Homo sapiens
acagctgtcagtcccacccacctgcccgtggtagtaagctctgggagcatggcctctgctgggggtggggggtagactggaggtgctgt

SEQ ID NO: 550136 - DNA, 89 bp, Homo sapiens
gataaccatcatagcttgactggatacaggtgtttgcgtttacagacgaaccacaaacgcctggatctttgacaggcgttgatgctatc

SEQ ID NO: 550137 - DNA, 89 bp, Homo sapiens
atatcaatagatacacataaattgtgcatgtgcatgcagccattctatgagtgtgtgcacatgtacgcagatatgtgtatgcctgatgt

SEQ ID NO: 550138 - DNA, 89 bp, Homo sapiens
gaaagtcactcatgccctttttcggaatccggcagctttgctctagatggaggctgctagattcagcaggaaggggcagggtgttgttc

SEQ ID NO: 550139 - DNA, 89 bp, Homo sapiens
ggcttgtgtgtaggtgttctcaggaatcctcccagggaacctgctcttgtgggttccttgggaatgatttcaggtgagcagcaggagcc

SEQ ID NO: 550140 - DNA, 89 bp, Homo sapiens
gctcctcttccagctgttctcactctttctgctgtttctacaccactgagctgcagaatgatgagaatacagctgaggcaagagagagc

SEQ ID NO: 550141 - DNA, 89 bp, Homo sapiens
ggtccctccgggaagcaggctctggtgagactgtccagccccagggtctcggggcacagttccaggtgccctgtcctccaggaaggatc

SEQ ID NO: 550142 - DNA, 89 bp, Homo sapiens
atctgtggtcacatcccaggcagggtgcgttagctttgagcccttgcagatgtttattaaagctgatgtgttgaccctgggccacaggt

SEQ ID NO: 550143 - DNA, 89 bp, Homo sapiens
gagcaggtgagtgatgggcatcaacccccatccaggaagatgtgaatgctatctgggctggggctgagcctgtcgtaccatgcctgctt

SEQ ID NO: 550144 - DNA, 89 bp, Homo sapiens
tccacccaggccacacttcttcttccctgtctcttcccttagacaaatggaggagacggacagcggagaagtggagggagctgggggga

SEQ ID NO: 550145 - DNA, 89 bp, Homo sapiens
gctgaaagtggtaaatgccagcctgctcattacagcaaaacaaacaataccaaggtactgatttgagcagtgctggctgcctcggaagc

SEQ ID NO: 550146 - DNA, 89 bp, Homo sapiens
gtttttctcccttctttttgcagaggaggcaatttgcaaatcgttgctatctgcctccctacaaggaagagataaattatatgagagac

SEQ ID NO: 550147 - DNA, 89 bp, Homo sapiens
ggtcgctgggctgggatggaaagtgtgttccgttgggattgtacaactgttattattcaattacactcttttcttcctagttaaagacc

SEQ ID NO: 550148 - DNA, 89 bp, Homo sapiens
agggcatgagcttggagggagcccacattgggaggcccagctggcaatcccaatggtctcccaatgaggccccgaagctctcaggtcct

SEQ ID NO: 550149 - DNA, 89 bp, Homo sapiens
ggaagaggaagaatcaccgagaaaagggaaggctcccagcagggccaggcagttggcagtggtcccacttcttgagtcccttcctcctt

SEQ ID NO: 550150 - DNA, 89 bp, Homo sapiens
ggctcagttctcttgcagggcaaaaatcctcatttattgggaactggaaaagtacttaaggtgaggattttgttctgctagggtgggcc

SEQ ID NO: 550151 - DNA, 89 bp, Homo sapiens
cacctattttaagtggtttgttcagtgacttctatcttgcatacacgtgtacagaaagcataagtggatgaacaaaccaactaatggtg

SEQ ID NO: 550152 - DNA, 89 bp, Homo sapiens
ggctcccgggccccgccctgctaaggcttggtgtattctgggagtcctgggaacagggtcacagcagggctgggtagtagccgggggtt

SEQ ID NO: 550153 - DNA, 89 bp, Homo sapiens
gggagtgtctgatgagagtactaggggtttccctagcactgggaaaaagggaagggaggccccaaagagttctattcagagcacggccc

SEQ ID NO: 550154 - DNA, 89 bp, Homo sapiens
gggagcctgcaagtgtcaggtgagtcctcatgctggactctgccctcaagggcggggcgtgggtctcatttcccactggccaggctctc

SEQ ID NO: 550155 - DNA, 89 bp, Homo sapiens
gtctggcacatagcagatgctcaataaacatttgctaaatgaatgagtagaaagggtaacgtttactgagcacttactatgtgccaggc

SEQ ID NO: 550156 - DNA, 89 bp, Homo sapiens
cctactgttgctgcccctcttgccaccctctactctcagggttgtcacactttccaaagagttgagggggcggggtggcggggcagagg

SEQ ID NO: 550157 - DNA, 89 bp, Homo sapiens
tggcaggacagaaaggatggttgtctcctgtgttgcaagggtgacttccaaagcagaaaatggagataaccgtctgatcatgactgtca

SEQ ID NO: 550158 - DNA, 89 bp, Homo sapiens
caggtggttgttaatttttggcgttgtgtaattaaactagttttgtttaatgttatcttttgccagtatctaattagcaaagccatctg

SEQ ID NO: 550159 - DNA, 89 bp, Homo sapiens
taactgccctcaaggagcttacaatctagctgggggtaaatgacttgcacatgaacacaactagactgtgagcttctagagggcaggga

SEQ ID NO: 550160 - DNA, 89 bp, Homo sapiens
gatgcagagtggggttttgcagtccttagctgttgcagaaattaagtattgcaacttactgagggctttgaaggctcttggtctgtatt

SEQ ID NO: 550161 - DNA, 89 bp, Homo sapiens
ctccttcctttatttgctgtagagattctcagttgttgtgctgaaatggcttacactggggatccagctgcacaattgttcagaaggag

SEQ ID NO: 550162 - DNA, 89 bp, Homo sapiens
ggcccggcagtgggggcctggctggctcggaagggactgcaggtgagatgctgggtgggactctagggccagccctgccctcccgggcc

SEQ ID NO: 550163 - DNA, 89 bp, Homo sapiens
ctgagattgtaacttttattctcgattatctgataaacataaatcaaatgtttatcatgtgattgtgattaaaatatataaaccctcag

SEQ ID NO: 550164 - DNA, 89 bp, Homo sapiens
ggtgaaatcagccagccaggtcctgcaggaaagatcttcctcccaaagaggacacaccccttgtgcagcaactcagctggcttttggcc

SEQ ID NO: 550165 - DNA, 89 bp, Homo sapiens
ttctaaaattctataattttgtcttctacacttaaaaacttgaacatttgtttttcggtgttagaagatgaaattacagaattttagaa

SEQ ID NO: 550166 - DNA, 89 bp, Homo sapiens
tctgtgtgccaggcgctgtgatctctgtagggactaaggataaactgaaaataatcttggccctctagagaaggcagatggtccacaga

SEQ ID NO: 550167 - DNA, 89 bp, Homo sapiens
tgactgcattatctagacaattccatcctacgtgggcactcgatacaaagatacgtccacagtggtggaattgttcaggcagagcagca

SEQ ID NO: 550168 - DNA, 89 bp, Homo sapiens
ggggatgaccagtgccccccggagcgaagacccccccatctctccaggattgggggtctgcttaggggtccacttaggggtgtatccct

SEQ ID NO: 550169 - DNA, 89 bp, Homo sapiens
gtttctgtagtataatatccccccaatattcccatgccctattcccaagattttgaggcatatttggggggatatgatatcacagaaac

SEQ ID NO: 550170 - DNA, 89 bp, Homo sapiens
gggtatattcactacatgctgttagggggagaaggaacctaatatttatgatattctgttcctttcccttttgcatgtcagaaacaccc

SEQ ID NO: 550171 - DNA, 89 bp, Homo sapiens
gaggtattacctttttctcctaatttttctcacagcctttgtttgcatccccctgtgagagtgttttagggagaggaaggttttacttc

SEQ ID NO: 550172 - DNA, 89 bp, Homo sapiens
gacccatttagacacttagcaaaagagtccagagtctgggcatcttccagagtcagactgtgggttcctgggctgggtggcctgaggtc

SEQ ID NO: 550173 - DNA, 89 bp, Homo sapiens
agttgagattgtgcaatctgtttggctgctaaaggttccaaattatgtgggcattctgcagccccacagagtggtagaatttcttcact

SEQ ID NO: 550174 - DNA, 89 bp, Homo sapiens
gaggcagctcctcagagcccctgagctgcatgtgggcctgagcacctgttgcaggccagctggggaggggttctggcgggcgtgacctt

SEQ ID NO: 550175 - DNA, 89 bp, Homo sapiens
gtacatactttcgcctaagacagttctgtatattcttctgttaacggggtagcaaaagcatatagaaaggttttggggggatgcagtgc

SEQ ID NO: 550176 - DNA, 89 bp, Homo sapiens
ctcagttaattgtgaattgcttatgccaggtgagagagaattggtgtctacccctctcacctgacataagcaactctgaattaactggg

SEQ ID NO: 550177 - DNA, 89 bp, Homo sapiens
tttccccttgagcatactgactttgcaataaagaagctgtcatttacagtcttctttattgcaaggtgggtaatagctacagggagaaa

SEQ ID NO: 550178 - DNA, 89 bp, Homo sapiens
ctccctgaaatgaaaggagaggggattttgttacctagagggcttgactgcaattaggtaatatatttcctcctcttcatttctgggag

SEQ ID NO: 550179 - DNA, 89 bp, Homo sapiens
tctcacactttagttatgactccctgtggtattttacaagtgaactaagtttatgaaacaccacaggggctgataactaacatgtgaga

SEQ ID NO: 550180 - DNA, 89 bp, Homo sapiens
gcatgtgacgtccatgtgtgccatgtatgtgtgtgacctgtatgtgttacatgttacatgcatgcctgccacatgcatgtgtcatgtgc

SEQ ID NO: 550181 - DNA, 89 bp, Homo sapiens
gccagtcataggtgctttgacagaaccaaaaagggcctatcagacgcttctaggatctttttggttttgtcacagcacctaagtgaggc

SEQ ID NO: 550182 - DNA, 89 bp, Homo sapiens
tgccctggattctgggctcttaactgtatgagcactgtaggtgtgagcagcaacaattaagaagctgcagaggtaaaggtataagggca

SEQ ID NO: 550183 - DNA, 89 bp, Homo sapiens
gttttcgtaggcaggagtggcatgcctcaaagggactggagggaccagcttttctaggtccctctgagggtcactgactgctttctgac

SEQ ID NO: 550184 - DNA, 89 bp, Homo sapiens
tcagtcatctctgacatctagagtagtgaagaagaactactctaaatctcttgttcttcttcactgctctagatgtcatagatgactga

SEQ ID NO: 550185 - DNA, 89 bp, Homo sapiens
gtttctgggctggagctgaggtgttttgtgaggcgagctcatgctctttgcatgtgttcctctgccgactatttcagttccactctgac

SEQ ID NO: 550186 - DNA, 89 bp, Homo sapiens
gggaggcaaactataggggttacctttagcatctcccctctctgatcacactatggagggatgccaaaagtgccccccatagttctccc

SEQ ID NO: 550187 - DNA, 89 bp, Homo sapiens
ctccccaccaggcactgaaatcttgactgtacacctcctatgggtctaggtgggtgcagggaggatcagctgcagataaaggtgggtag

SEQ ID NO: 550188 - DNA, 89 bp, Homo sapiens
gctgggtgaggcggggcagggacgcggtgggcggggcctggtggtctcgggctctctgtgccctgtgctggcctcacagtgtgcccggc

SEQ ID NO: 550189 - DNA, 89 bp, Homo sapiens
gagggttcattgtggtggcactttacttcctcaggagagtcttccctggcactctcttgtggggtgaggtgcctcttcaatgttccctc

SEQ ID NO: 550190 - DNA, 89 bp, Homo sapiens
acactcgcgcgcacacgctcactccgtgtccgcgaccgtcgtcgccggcggaaagcgagccacgggagggagtgtgtgcgcgcgtgtgt

SEQ ID NO: 550191 - DNA, 89 bp, Homo sapiens
gcatttcaagattgtttctttgcttcccatcttctcttgggttctataaaaaagaaaaagggtagcacaggaagcttgttttgaaaatc

SEQ ID NO: 550192 - DNA, 89 bp, Homo sapiens
atgctttgcaatttgaggccttcatttctccgtctggcaagtggacatgctagtggaccttgaaggcctcttctagctcttaaaagcat

SEQ ID NO: 550193 - DNA, 89 bp, Homo sapiens
ggtcgcggtggctgatgacagaacaatgtggagaaaagtgtgatgtgtcaaatccttactttgttctgggcattgtgctaaatgtggcc

SEQ ID NO: 550194 - DNA, 89 bp, Homo sapiens
ccaaggtgctagctcagatgccacagagaacgagaccttcccctaatgacagagtctgtctttgtgtgcatctgtgctcccattcttgg

SEQ ID NO: 550195 - DNA, 89 bp, Homo sapiens
catgagaaactgtggtctctaggctgactcttctagaatcagaacactgcgggcattcagggcagcaaagagtcctcagtttcctcatg

SEQ ID NO: 550196 - DNA, 89 bp, Homo sapiens
gggcttctctgagtgtggtgactcttatttccaggtatattctttgtgtggtcactggaaagtatggagttgttacaagagagtggctc

SEQ ID NO: 550197 - DNA, 89 bp, Homo sapiens
ctggcctccagggctttgtacatggtaggctttcattcattcgtttgcacattcggtgaaggtctactgtgtgccaggccctgtgccag

SEQ ID NO: 550198 - DNA, 89 bp, Homo sapiens
gttaaggggagactaacccatcacagacactgggttattgcaagttatccagatccagtatctgtgatgggttaaagtctcccctagat

SEQ ID NO: 550199 - DNA, 89 bp, Homo sapiens
gttttgctgttgtcgggtggatcacgatgcaattttgatgagtatcataggagaaaaattgcacggtatccatctgtaaaccgcaggac

SEQ ID NO: 550200 - DNA, 89 bp, Homo sapiens
ccgccatgccctagaactcccacttttatctgatggggagaggaagcacagcagctctgtgggatgaaatgggaggaaggcgatggcgg

SEQ ID NO: 550201 - DNA, 89 bp, Homo sapiens
atataaagatttattgtccctggaggtaattattgacctcaacatcttatcagtcaatatttacctcttaggccaataaatcttgatat

SEQ ID NO: 550202 - DNA, 89 bp, Homo sapiens
gggttctttgcttcctcggtggcggaggggcctggggcctctctccagcacctctgcccttccgcagccatcgagttgatcaaagacct

SEQ ID NO: 550203 - DNA, 89 bp, Homo sapiens
acaaaaatacagttgatgacttgatgaaagggctgcaccttcaagccatagatgcagcccttttgtcaagtcatcaactgcatttttgt

SEQ ID NO: 550204 - DNA, 89 bp, Homo sapiens
cacaggttcaggctgctgggaaggtgtggcatgtccactgaagctagctgcagagttgggtgaactgttactcccatcagcccctgatg

SEQ ID NO: 550205 - DNA, 89 bp, Homo sapiens
gcattagagatagaaaagcttgaagagacttaattatgtcacatggagcacataattaaatctcttcaagctttttttatctctaatgt

SEQ ID NO: 550206 - DNA, 89 bp, Homo sapiens
tcctcctgccaaacgcgtcttggctccgtctgaatatctctcctcctcgatttttggctccagctctgggcgcgttcactaaaggaaga

SEQ ID NO: 550207 - DNA, 89 bp, Homo sapiens
gcagaggaagcattatggcctggaagctaggatagggctggttctcactgtgcactgtctagctgtgtggcccggcaagctacctctgc

SEQ ID NO: 550208 - DNA, 89 bp, Homo sapiens
agaggagagagaggcgaggaagtggagaagattcagttgaagtcaagctcactgttctcttttcccttttacagtactttcaaccctct

SEQ ID NO: 550209 - DNA, 89 bp, Homo sapiens
ggtgaggcacctgcatggtggtggggcgggaaagtgggctctctcttgctgccccgtcctactctctcactgcaaggtgtttcttcacc

SEQ ID NO: 550210 - DNA, 89 bp, Homo sapiens
gaatgcagctcaatgggcagtgaaaatcaatgagagcaaattggcccatttttgcctcactgacttgtactgtccattaagccctattt

SEQ ID NO: 550211 - DNA, 89 bp, Homo sapiens
tcagtcatctatgacatctagagcagtgaagaagaacaagagatttagagtagttcttcttcactactctagatgtcagagatgactga

SEQ ID NO: 550212 - DNA, 89 bp, Homo sapiens
gtggcccctcagatctgccttggaccactgtgctcccaggaggcagatgaggcccctggtggcaggtggcaggggcaggggcaggccac

SEQ ID NO: 550213 - DNA, 88 bp, Homo sapiens
tctcttttttagagacgtggattgtttcctttagagaggccctctgactgtcaccaaaggagacaatccacgtccctaaaaaagaaga

SEQ ID NO: 550214 - DNA, 88 bp, Homo sapiens
gggtcctcgtccctgaagagtgtgaggttgtgcttttggatgtgtcccagcagcacctgtcctcgctgctccagggtctggaggacct

SEQ ID NO: 550215 - DNA, 88 bp, Homo sapiens
aagcccgcagattatgacatactgtgcctttttgatatggcatataaagagcctaaaatatcacagaatgtcctgtatttgctggctt

SEQ ID NO: 550216 - DNA, 88 bp, Homo sapiens
tccagcttctgggccagagccatatccttgaggctgcccctttgggatggctggcagctgcggatgggcatcaggcttcaggggggga

SEQ ID NO: 550217 - DNA, 88 bp, Homo sapiens
ggccttggatggagaagactggagagggtatggaagtgcttggacgtaggacatctgcctctctggtctttgtccatcccacagggcc

SEQ ID NO: 550218 - DNA, 88 bp, Homo sapiens
tgaaagattaagatttattagatgcttacctgcgccaatgggagatatactggcccaagtaagcatccaataaatgttgattccctca

SEQ ID NO: 550219 - DNA, 88 bp, Homo sapiens
acatcttcaggtaaagagagggatttctcaatctactttctgttatgtcagactataagagaaaccctttcagctgctttctagatgt

SEQ ID NO: 550220 - DNA, 88 bp, Homo sapiens
ttatgctcattttatcattcatttagcagacactttgtatatacctactatgtaccaggcactgttatggatgatgcttggagcatag

SEQ ID NO: 550221 - DNA, 88 bp, Homo sapiens
ggcccgcacacctgggccgagccggggccgcctcgggagcccctcgctggctcctgggcgccccactcggctcagcaatgtccgggcc

SEQ ID NO: 550222 - DNA, 88 bp, Homo sapiens
ccctttttcatcctctttgccccatcgtggttgcaatacttcacgtgatcttcttgcaaccatggggataaagcaggaggagagaggg

SEQ ID NO: 550223 - DNA, 88 bp, Homo sapiens
gcagaagagaagctggagggcttggagaatgatggatcccctgtggataggtgggctatctctccactgccccccacccctcaactgt

SEQ ID NO: 550224 - DNA, 88 bp, Homo sapiens
gttttgtttgcaccaggccactccattcatgtatattacaccagcagttctgcctacatgaatagagcagcctcgtgcaaaacagaac

SEQ ID NO: 550225 - DNA, 88 bp, Homo sapiens
ggagctagcagagtgggaactgtgaggaccaggggtagctggtggtgctgacttcagcactcctgagtcctggccctccctctgtccc

SEQ ID NO: 550226 - DNA, 88 bp, Homo sapiens
ctcctgcccctgcagagttccttcaccccagcccagttcattcttgctgaatgaacgaaggtggaggaggcggtgcaggggtcaggag

SEQ ID NO: 550227 - DNA, 88 bp, Homo sapiens
gtcctcctgtggggctggagtcccctggtgaggacatggtggccgggcagtctcggccccgtcttctcacaggggtctccctgaggac

SEQ ID NO: 550228 - DNA, 88 bp, Homo sapiens
gcagaggaaggtgggaggcagcaagaggcagctggagccgtggtgggccgtctgtcatcctgttcacctcccactcttcccactctgc

SEQ ID NO: 550229 - DNA, 88 bp, Homo sapiens
tagtgaaatattgaggcagcaattttttacaaaaaggtcatcctctgctctatttgttaccttgttattgctgtctcaacatttacta

SEQ ID NO: 550230 - DNA, 88 bp, Homo sapiens
ccagcaagcccctaatgcatcttccccctcagactgcaggctgtaatctccgcactgaggtgaagtcagcattgggtggtggtgttgg

SEQ ID NO: 550231 - DNA, 88 bp, Homo sapiens
agaatcctcagggtctcttaggactgttcaagggctcatttgctgaggagcctttgaacagtcagtcctaagagacgctgagacttct

SEQ ID NO: 550232 - DNA, 88 bp, Homo sapiens
tcccatgctgtgaccctctagaggaagcactttctgtttgttgtctgagaaaaaacaaagtgcttccctttagagttactgtttggga

SEQ ID NO: 550233 - DNA, 88 bp, Homo sapiens
cctcccacaggtgtgtctacagtgcctggtcaccaactcttgggtgttgagaagtggtgatggggcatcagccgcatctgatggctgg

SEQ ID NO: 550234 - DNA, 88 bp, Homo sapiens
ggttcctctgaagtcagcatggcagggattagtagtagctgggaggggacagttactcagttcctgccatgccctgcagactggagcc

SEQ ID NO: 550235 - DNA, 88 bp, Homo sapiens
ggaggtttataaaggccttcacaattcctatggtaacccaggagaaaggctgttgccatggggactagtgaagcctatataaaccttc

SEQ ID NO: 550236 - DNA, 88 bp, Homo sapiens
tctaccatcaagagagtggggagcagatgaaacccaatttgactgaatctctgtgtaatgggctgctctgcactcaactgatggtgga

SEQ ID NO: 550237 - DNA, 88 bp, Homo sapiens
gcccacccttatgcatgtattcagtcttccagatcgccagagatgagtgggtggtctcgatgactgtgcatatgcacaagggtagggt

SEQ ID NO: 550238 - DNA, 88 bp, Homo sapiens
cccacccactctgttccccttttcctgccaccttcttctccagggaccagaaacaaggcaggaggagggacccagggcctagggtggg

SEQ ID NO: 550239 - DNA, 88 bp, Homo sapiens
gctcaccaagctaggggggttatttttaattggggttcatagcacattgaacactctcttagatgaaaaccctggatggctctggggc

SEQ ID NO: 550240 - DNA, 88 bp, Homo sapiens
gcaggtaatttttccagtgtaccattccaacctgcaaaacctcacatttaaatgcaaatttcttggtaagctgtgaaatgttggctgt

SEQ ID NO: 550241 - DNA, 88 bp, Homo sapiens
tgggtgagggggataggcctgctttggttttggaggcaggggctggatgtcctgtagtttccaaaccacagaagcctcctcttcccca

SEQ ID NO: 550242 - DNA, 88 bp, Homo sapiens
gtgcctggtgcatggtcagcactcaataaaagcttaacatttcttcattcagggagtattcattgagtgcttcttatgagccaggcgc

SEQ ID NO: 550243 - DNA, 88 bp, Homo sapiens
gatgcttttcccacctctgcacttgtttctctcttcctgggactcagtttctcacctgagagaagagggtagaagtggaggaagcgtc

SEQ ID NO: 550244 - DNA, 88 bp, Homo sapiens
gctagagatcttagcatttctggtactgtatgtactattcagagggtacaaactattcacagttccagaaatgttaatatcaaagagc

SEQ ID NO: 550245 - DNA, 88 bp, Homo sapiens
cctagcaccatagtttcttgcctacattattgggacggatccatcaggcctctgtgcaatgatctaggcaagaggcgatggtgctagg

SEQ ID NO: 550246 - DNA, 88 bp, Homo sapiens
tgtgtgcccatgaaggtcaggactgtgtgtctgggttacagctgtatctcggcagcccagcacagtgcctggcacacatgggcactca

SEQ ID NO: 550247 - DNA, 88 bp, Homo sapiens
agacaagagactaggagctaggagctgcggatctgcagtttcccaaaggtaaaggagcctgcagctgagcctcgagtttctcatgtct

SEQ ID NO: 550248 - DNA, 88 bp, Homo sapiens
tctcaggctgtgaccctctagagggaagcgctttctgttggctaaaagaaaagaaagcgcttcccttcagagtgttaacgctttgaga

SEQ ID NO: 550249 - DNA, 88 bp, Homo sapiens
ttcctcccaacccaatctctcccaggtcttcctttcctacctgggttgggggaaaggaagagactgaggtgggagaggagaggaggag

SEQ ID NO: 550250 - DNA, 88 bp, Homo sapiens
ctccacacggccctacagcatctgatcttggcagtgtccctgtcaccaaggtcactgcacaagttctggtgtcctgggacctctggag

SEQ ID NO: 550251 - DNA, 88 bp, Homo sapiens
gttctgttttgcacgaggctgctctattcatgtaggcagaactgctggtgtaatatacatgaatggagtggcctggtgcaaacaaaac

SEQ ID NO: 550252 - DNA, 88 bp, Homo sapiens
tgtattgtgagggagtaagtgggtgggcatgggaactcaagtgtgggcctgagccctgtgactcccatccgctctccccacagctaca

SEQ ID NO: 550253 - DNA, 88 bp, Homo sapiens
tcccatgctgtgaccctccaaagggaagcgctttctgtttgttttctcttaaacaaagtgcctccctttagagtgttaccgtttggga

SEQ ID NO: 550254 - DNA, 88 bp, Homo sapiens
acagagctgtggcccaaggcctaccctggggagacaaggtcaggatcctgctctccttcaggagtgggctttgcttttgcagctgagt

SEQ ID NO: 550255 - DNA, 88 bp, Homo sapiens
aggaggtgaccagccccgggatggaggggaagtactctggctcttggcacagtgacattcctctttgtccctttgctagtttcttcct

SEQ ID NO: 550256 - DNA, 88 bp, Homo sapiens
gcagagtgggaagagtgggaggtgaacaggatgacagacggcccaccacggctccagctgcctcttgctgcctcccaccttcctctgc

SEQ ID NO: 550257 - DNA, 88 bp, Homo sapiens
ttagcagagagtctagctgcagaggaccctcagttgctcaaagctcattttttaatgaggagtcttcatcagctagatactctggtga

SEQ ID NO: 550258 - DNA, 88 bp, Homo sapiens
tccagcctccaaagcgcagccgcctgggtcttcccctccagcctccgggacaaggggaatctcagtggctgaaacttctggggatgga

SEQ ID NO: 550259 - DNA, 88 bp, Homo sapiens
gggctcggagagggagagctttgggtggactgagatgcgacattggagggaagcaattagttcgcttggagtcacctcttgggagtcc

SEQ ID NO: 550260 - DNA, 88 bp, Homo sapiens
aagaaacagccatctgaaactctctgtggtatttgtggcaatcagtattttaataaatatgataaggagtttcagatggctatttctt

SEQ ID NO: 550261 - DNA, 88 bp, Homo sapiens
gtggacatatcagatagttgacatagcactgactgctggaataagcaaatctaaatgcagtctgtgctgggctgtactgcttgtccac

SEQ ID NO: 550262 - DNA, 88 bp, Homo sapiens
actcttgctctctctcaggacttccatttcctcatccgacctgtgaggcaattggattgggaggtctctgaggtcagagggtgggagt

SEQ ID NO: 550263 - DNA, 88 bp, Homo sapiens
ggattaactcatttaatcctcacctgaactccatgttgctatggagtttccaacatggattcaaagtgaggattaaatgaattgattc

SEQ ID NO: 550264 - DNA, 88 bp, Homo sapiens
agtctttgaccctatggaattcaaacataattttgaacaagattacaaagaattcaaattacatttgaactctgtagggtcaaagact

SEQ ID NO: 550265 - DNA, 88 bp, Homo sapiens
agcaaggatgggtgttgaggcctccaggatgtagtcacagagggagaatacaagactatattggcaggcctagattcccgttcttgct

SEQ ID NO: 550266 - DNA, 88 bp, Homo sapiens
cgttgcaccacctgcttcctcctccccgctgggacagccaactgggccggctgccagtgggggtaggagagggtatgaggggctcacg

SEQ ID NO: 550267 - DNA, 88 bp, Homo sapiens
gaggtgtggaggtcagaggaggccaaggccctgtgaaataatgagatgagaccagactccaaggcctaggctctgccctccccatgtc

SEQ ID NO: 550268 - DNA, 88 bp, Homo sapiens
gccaggaggtagggaaatctcttgctccttgagtcatgcgatatgaatgaaggacgggtgtggagcaagatttctctatttcctgagc

SEQ ID NO: 550269 - DNA, 88 bp, Homo sapiens
gggacagctggggcccgagagatggtggcccctcctctgtgtcttgactgtgggcaagttacttcacctctctgggcctcagtttcct

SEQ ID NO: 550270 - DNA, 88 bp, Homo sapiens
ggagcctcgtttaccctcatctggggctttaatggaagttttaagtcaatgggaaattcaagctttggatgagcagtgaatgtggcct

SEQ ID NO: 550271 - DNA, 88 bp, Homo sapiens
gctgcaaaaggaagtttgcaaaggcagggaagacagcaggtgatctcactcagacccttcccaatcttagagaacttcctgaagtagc

SEQ ID NO: 550272 - DNA, 88 bp, Homo sapiens
tcagaaggttaaacctgtgtcaggtttacagtccaatgaccgccgtgggtcataatccatctagagctctgagacaggtgcctttaga

SEQ ID NO: 550273 - DNA, 88 bp, Homo sapiens
tttccattctaagccctgctcttcagcactgaatgaaggtcaatatttctatctttattaagagctaatggcaggtgctcgatgggga

SEQ ID NO: 550274 - DNA, 88 bp, Homo sapiens
gccaaaagagcatccaccgcacccgcatgtcctggtcctttcagggcgccctgaggcggccaggacagaggtggaggtggcttagggc

SEQ ID NO: 550275 - DNA, 88 bp, Homo sapiens
agaaacataaagggaataggagggaggagatggagatgctgcagtgttccattggttctcttccttgtattctcttttctgtgtctct

SEQ ID NO: 550276 - DNA, 88 bp, Homo sapiens
tttgtccatctagccccagctttccccacttgtctgcctttttctctggaggaaaggtggggagctggggaagaggtgttatgacaga

SEQ ID NO: 550277 - DNA, 88 bp, Homo sapiens
gctgaggtgcccagatgagacagctggggaattcctgctacctggatgctagagttcctgggctctcatcttggttccaagcctcggt

SEQ ID NO: 550278 - DNA, 88 bp, Homo sapiens
cgctccacctcccggagaggggcggggccaggcgagcctcacccacggcctctcgtagctcacgccccctctcccggagcctggagcg

SEQ ID NO: 550279 - DNA, 88 bp, Homo sapiens
tctctgtttcacctcccccacccctttctcctccaagttgggtgcctcctgccctgctgggtgaggagggtggggattgcaaccgaga

SEQ ID NO: 550280 - DNA, 88 bp, Homo sapiens
attaggagtctgaggtccaatgactgcagttggcttatcaggccagttgcacaagtcagctccagtctctggacctcggtttcctgat

SEQ ID NO: 550281 - DNA, 88 bp, Homo sapiens
agtccatgctgccctgtagatctgtgcctctcaccaccactgtggaaccacagtgcagagacatgtgcctatggggtagcaatagact

SEQ ID NO: 550282 - DNA, 88 bp, Homo sapiens
aactctatagaaatcagcaagacaattaatgaggaaatacacaaataatttccagctattaatgtttttgctgaatttgaatagagtt

SEQ ID NO: 550283 - DNA, 88 bp, Homo sapiens
attgggacattggttaatttcctgttaataccaataataccaatattaccaatattggtattaatgggaaattaacagatgtcccagt

SEQ ID NO: 550284 - DNA, 88 bp, Homo sapiens
cctgttctgcgaggaacagtgggattgactgaactaaacaggactttccaagctctaggttcagttatcctatcctcagaggaacagg

SEQ ID NO: 550285 - DNA, 88 bp, Homo sapiens
gcctcaatgcttataagagaaaaccaaggcctgagctgggtagtcacagaatggctcagtcttgggtcgggttttctaagcactgggc

SEQ ID NO: 550286 - DNA, 88 bp, Homo sapiens
gcagatggggtcaggtttctattcctgtgggctttctgtggcgccgcaaaacaggaggcccacaggcctggcccctggccccgactgt

SEQ ID NO: 550287 - DNA, 88 bp, Homo sapiens
ttggctatatctctgccctctctgggccttgattcttggtcctgttggtttgggaagccagggtggaaggggtctgaggtgtaaacag

SEQ ID NO: 550288 - DNA, 88 bp, Homo sapiens
cccagctcccagccccagtgctccttggttatcctttctgcttctgtcaaataataatgaaggagctcactgggcattggtaactggg

SEQ ID NO: 550289 - DNA, 88 bp, Homo sapiens
tgaggtgacatcctctaattttcctaagcacagtggggcctcctggaaacatctgctggatttgaggagtaaggggatgcttccctca

SEQ ID NO: 550290 - DNA, 88 bp, Homo sapiens
ggaggacttgaggccggctcagtggtcagcgctgctgcttgttcccctacacagaggcgttgggtggagctgcctcaggtatccctcc

SEQ ID NO: 550291 - DNA, 88 bp, Homo sapiens
gtttgttctcctatttcttgactgcttaggaatgcagcaactcatactggtgcattctgagcaattaagaagttatgggagactaggc

SEQ ID NO: 550292 - DNA, 88 bp, Homo sapiens
ggggttaggaatgtgtttgctgggtgacagtccttgtgacatttataaggagaaagggctatcccttgtggactgattcctaattacc

SEQ ID NO: 550293 - DNA, 88 bp, Homo sapiens
actaacacttacttttgtttgcctcaacttcttttgcgctccgcgtgaaagcgacagaagttgtggcaaacttctgaaagtgttcagt

SEQ ID NO: 550294 - DNA, 88 bp, Homo sapiens
ttgcactcatcttatgttagtgattttcatattacattagcaaatttaatctctgctcatgtgataggaagttactaacacaatgcga

SEQ ID NO: 550295 - DNA, 88 bp, Homo sapiens
ttctacaggtaaggcttgtccgtattccctcttctctcacctctggggaggaatggggagttgggtagggctgatggagcttgtagaa

SEQ ID NO: 550296 - DNA, 88 bp, Homo sapiens
gagttctggttctaaatgctccagtggaatcaagactgcttttctcaaggggcagggaaaatgccatagggttttcaaatcagaattc

SEQ ID NO: 550297 - DNA, 88 bp, Homo sapiens
ggccctgagagcaatactcatattgattgcatttatttcactctagggaggagagataattcttcaatgtgggacacatctgggagcc

SEQ ID NO: 550298 - DNA, 88 bp, Homo sapiens
tgagcaccaagggtacgtctccaccgacttgcaacacaccaagacaaatgtatgttgcaagtcagtagagaggtacccctggtgctca

SEQ ID NO: 550299 - DNA, 88 bp, Homo sapiens
ccagatgccagtcactgcctaaggcactgggtatatggtatccccaaacaagaggcataatcccagtccttaggtagtgctagcatgg

SEQ ID NO: 550300 - DNA, 88 bp, Homo sapiens
gaacagattgctggcattatggcagccaggatattgtcaggaggaacttggcagtgctcgtaggtgttatgatgctggctctttgctc

SEQ ID NO: 550301 - DNA, 88 bp, Homo sapiens
gggaacaggctaaggaggacagaggggaggaaagcccttttatttcaaaacctcaatttggcctcttctcttcctcctcataccaccc

SEQ ID NO: 550302 - DNA, 88 bp, Homo sapiens
ggggatgaccagtgccccccggagcgaagaccccccatctctccaggattgggggtctgcttaggggtccacttaggggtgtatccct

SEQ ID NO: 550303 - DNA, 88 bp, Homo sapiens
ggcgcacggcttcccggcggtcggcgacttctgctctggcaacttacgccagggttgtgtgctggccgctgggagcccaggtgacgcc

SEQ ID NO: 550304 - DNA, 88 bp, Homo sapiens
atcattactatttaagcccttcatgcccagatctgaagaggcataagtggggcacagtttctgggtatgcagggtttaggtttatgat

SEQ ID NO: 550305 - DNA, 88 bp, Homo sapiens
cagatgcagccacatgctaccatgaaggaagaagagaccaatgcaaagccggggcttcctccttcactgtagcatgtggctacatctg

SEQ ID NO: 550306 - DNA, 88 bp, Homo sapiens
attccatccctttcccctattcctaaatgtgctccagggacaatggggaagctggagcacatataagaataggggaaagagagggaat

SEQ ID NO: 550307 - DNA, 88 bp, Homo sapiens
ctgtgcaatcaatcatgtattcagttgtctttgggtagggttagctccagggagccaaagacatctgaatacatgatggactgcgcag

SEQ ID NO: 550308 - DNA, 88 bp, Homo sapiens
ctgagcagggatcgatctggcctggtggtgattctccagaaactccattcctcagggctgtgaccaccaagccaggtgatcaggccag

SEQ ID NO: 550309 - DNA, 88 bp, Homo sapiens
gtgacccttgggcagggagagttgctttcctttacacaccattagcaggtggcaaagaggggggcctgcatctctgcccagctgttgc

SEQ ID NO: 550310 - DNA, 88 bp, Homo sapiens
gagggtcttataaagcaacagcaaccttccctaaagtgatttttcactgagacagctactttagaaggatgctgtaacactgaccctc

SEQ ID NO: 550311 - DNA, 88 bp, Homo sapiens
ctcattgggatctcaccatcttcctgtgaagcagtggaagtagatgctattatttccattttacagatgaagaaagtaagattcagag

SEQ ID NO: 550312 - DNA, 88 bp, Homo sapiens
acttcgtgatttacagccacagtggaaaatggggctgggtattgattcttggccttttctattgcaaatgggtgtaatgttttatagt

SEQ ID NO: 550313 - DNA, 88 bp, Homo sapiens
atatggagccccttcttctctcagctcttttgacccaaccaatatgtaggtctgggggcgaggaaggaggagagtgtaggcttcatgt

SEQ ID NO: 550314 - DNA, 88 bp, Homo sapiens
gtggtagctggctgaggtgaggagggttagcctgtgttgtatactgacttctaagtgaatcctcctgatttcagcctgtcagctaatt

SEQ ID NO: 550315 - DNA, 88 bp, Homo sapiens
ataaaatgtttatgggtttaagaggtttatgaatcagctataaatatttgctctgggtttatgagacctctccccataaacattttgt

SEQ ID NO: 550316 - DNA, 88 bp, Homo sapiens
ggtttttactccaagttattttcacagcagtgtgctgcttttgttgttgacaaaagtagttgctgctctgaaagaggcatgaaagacc

SEQ ID NO: 550317 - DNA, 88 bp, Homo sapiens
agcggggtcactggaagaagagatggtggttgtgcagccaactgaaatgcatactgcataacaccaacatttttccacagtgctagct

SEQ ID NO: 550318 - DNA, 88 bp, Homo sapiens
ctggggagctcctggaggctggggagcgagcctgcacagagaaagaaaaacgggtcgctccctccagctgcaggagaggaaggcccag

SEQ ID NO: 550319 - DNA, 88 bp, Homo sapiens
tctctatgttaggcgtttctgcagacatccttggccggatctgatcgctggctctggggtggctgtggaaatgtgtagatattagaga

SEQ ID NO: 550320 - DNA, 88 bp, Homo sapiens
gccgatgttaggagttgggagagatggaaagcaagatagagtcactttatttcttgcttccaactctcattatgtctattacacaggc

SEQ ID NO: 550321 - DNA, 88 bp, Homo sapiens
gtgagtctgggcacatggacctttttctggtccaagagagatggtccacgtgcctgcaccagaaaagggtccacatgcccggactcac

SEQ ID NO: 550322 - DNA, 88 bp, Homo sapiens
tctggggccggtcactcagtttttggcctctgctgcagtcctcatactgttccaagagtggcagcgggaactgagaggcccctccaga

SEQ ID NO: 550323 - DNA, 88 bp, Homo sapiens
tcatcttcctcacccacacctccgtatatcactaagtgagcaaggatgagagtgatatataatgaggtgagggatgttggaaggatga

SEQ ID NO: 550324 - DNA, 88 bp, Homo sapiens
ctgaggctgagatactattggggagcatgaggggaggggctgataaaggtctgcagagacagtgtccccagaagggtctcaggctcag

SEQ ID NO: 550325 - DNA, 87 bp, Homo sapiens
gatgggtgtgtggcagacagtgataatttcttctaaatatactgacttgggagactgagaagaaggcaattgtctgacatattcatc

SEQ ID NO: 550326 - DNA, 87 bp, Homo sapiens
caaagcctccgctggggctgtttcttaacacggagttacaaactttaagaacagacagctccagacggaaatccacgccaggctttg

SEQ ID NO: 550327 - DNA, 87 bp, Homo sapiens
tgcagtcctggctctctgtcatgtgagtggtcccccttgtgcttggtggaattgctggcagtgacaggaaggagattacagactgta

SEQ ID NO: 550328 - DNA, 87 bp, Homo sapiens
aggataacaggtgtatagtcactgttttctcagagctggtcacatgaaaggagaaagcagtgatgcatacagctgtatttatatcct

SEQ ID NO: 550329 - DNA, 87 bp, Homo sapiens
tttggatatgttgagttttagatgcctgttagacatctaagttaagatgttgagtgggtgtttggatatataagactgaagtccagg

SEQ ID NO: 550330 - DNA, 87 bp, Homo sapiens
tctcaagctgtgggtctgcaaagggaagccctttctgttgtctaaaagaagagaaagcgcttccctttgctggattacggtttgaga

SEQ ID NO: 550331 - DNA, 87 bp, Homo sapiens
atgccagagagtttggagtgatctggaccaggattaaacatcgcattagcagagtgatcctggaccaggtacttaatctgtctgcat

SEQ ID NO: 550332 - DNA, 87 bp, Homo sapiens
ctctttcctcaggtggccaggtgcatatcttggtgtgaggaccttcactgtatctgggaatgcctactggtcacctcggtgacagag

SEQ ID NO: 550333 - DNA, 87 bp, Homo sapiens
gaggcctcacaaccttctagggcacagacggtgaaaatggctcaggccagaatttggtttaggtttcagaagggtgctgggtgcctc

SEQ ID NO: 550334 - DNA, 87 bp, Homo sapiens
aaatatttggtcaatgtaacttgtcaagagccatagaaaaacatctatttgaaatatcttttgacaggatggatggactgagtattt

SEQ ID NO: 550335 - DNA, 87 bp, Homo sapiens
gcacctctctgggttaaagatagtttttgccaaatatactgacctctggaatattcttctgcggtactattattgaccctgaggtgc

SEQ ID NO: 550336 - DNA, 87 bp, Homo sapiens
atttctgtgcataaacggtggcctagattcttgccctgtggaaatccatggaattaagaactctaggttcctggagtgataagaggt

SEQ ID NO: 550337 - DNA, 87 bp, Homo sapiens
ggcaaagaattcggccctgtgaagagttgggttcggcctgtctcaggccctgcccacatcccatcacagggccgtggacttgaagcc

SEQ ID NO: 550338 - DNA, 87 bp, Homo sapiens
taaactctgaagtgccacacaaatgtaaggcattattatttaaaattatgatgtatgcttgccatttaaaatggtgctttttgttta

SEQ ID NO: 550339 - DNA, 87 bp, Homo sapiens
catctttattctgtcacaccatgataaagagttttgtatttgtcacaagtgcaatgaacttattgtggtgtttttagaatgagggtg

SEQ ID NO: 550340 - DNA, 87 bp, Homo sapiens
caatagacacccatcgtgtcttttgctctgcagtcagtaaatatttttttgtgaatgtgtagcaaaagacagaatggtggtccattg

SEQ ID NO: 550341 - DNA, 87 bp, Homo sapiens
ctgaagctctcccttttgggctaagtgctgatagtttcagttggccttagtgtgacttcagcactttccagaaggtgaggctcccag

SEQ ID NO: 550342 - DNA, 87 bp, Homo sapiens
atggggttgggccagcccaggagaatagataatatgcagccaatattaagtgtaatgtgtactcttcgggctcaggtgtgactttat

SEQ ID NO: 550343 - DNA, 87 bp, Homo sapiens
tttgaaagccttcagagttttatcatacgtggataaaactcataatgcaaattatccatgtatgatacaactcagaaggctctcaga

SEQ ID NO: 550344 - DNA, 87 bp, Homo sapiens
taactaatccatcacctccctcaggttcttccctgatatttttcagagaagaaagggaagaacctaaaggagatgatggattaatta

SEQ ID NO: 550345 - DNA, 87 bp, Homo sapiens
tctcaggctgtgtccctctacagggaagcgctttctgttgtctgaaagaaaggaaagtgcatccttttagagtgttactgtttgaga

SEQ ID NO: 550346 - DNA, 87 bp, Homo sapiens
gcatattcaaatatgcagagagtagtaagtgaaagtatactctatttgtgtttttacctactagtctcttgtatatttgaatattgc

SEQ ID NO: 550347 - DNA, 87 bp, Homo sapiens
gacctcagaggttggtgacttacaacataccatggagctttacccatgcccaggtccgatcagtgtgtcccaactgtagctggggtt

SEQ ID NO: 550348 - DNA, 87 bp, Homo sapiens
tctcaggctgtcgtcctctagagggaagcactttctgttgtctgaaagaaaagaaagtgcttccttttagagggttaccgtttgaga

SEQ ID NO: 550349 - DNA, 87 bp, Homo sapiens
gggtgcacagggtggcgcgtgggggggtcagctgggcttcagcccctcccacctaggctggaccccgcgcagtgctctctggcaccc

SEQ ID NO: 550350 - DNA, 87 bp, Homo sapiens
tctttcaggctacttggacagtatttagtattctatattagtactacactaataatttactgagtgctacctaagtgacctgattga

SEQ ID NO: 550351 - DNA, 87 bp, Homo sapiens
cataggcacagatcactgtcatctgagtctctgcagaccggatgacaatgatctgcatgacctggatgacaacgatctgtgcctgtg

SEQ ID NO: 550352 - DNA, 87 bp, Homo sapiens
ctaagttaaggaatgatggtgcctaagtcatttagctaaatgatgtatttaagaaagatggctgcaccgttttccatgaactattag

SEQ ID NO: 550353 - DNA, 87 bp, Homo sapiens
tctcaggctgtgtccctctagagggaagcgctttctgttgtctgaaagaaaagaaaatggttccctttagagtgttacgctttgaga

SEQ ID NO: 550354 - DNA, 87 bp, Homo sapiens
gcacactttgactttcttcctccctcgggcctgattgggcagctgacagcccacagctccctgaggaaaggaggggatttgatgtgc

SEQ ID NO: 550355 - DNA, 87 bp, Homo sapiens
gagaaacactttgcctttttacaggagtttattatgttttggacatagaaacataacaaacacctgtaaaacagcaaagtgtttctc

SEQ ID NO: 550356 - DNA, 87 bp, Homo sapiens
ccagcaaaattacctttgtgatgcctaagccgtgttcatacatataagccagattgaacatggcttgcgcgttgtggtatttgttgg

SEQ ID NO: 550357 - DNA, 87 bp, Homo sapiens
tctcatgctgtgaccctctagagggaagcactttctcttgtctaaaagaaaagaaagcgcttctctttagaggattactctttgaga

SEQ ID NO: 550358 - DNA, 87 bp, Homo sapiens
tctcaagctgtgagtctacaaagggaagccctttctgttgtctaaaagaaaagaaagtgcttctctttggtgggttacggtttgaga

SEQ ID NO: 550359 - DNA, 87 bp, Homo sapiens
ggacccctgtttatcttcacctgctctacccacttccatcccaccctatgaaaggagaagtgtagacaaggtgggagttagggtccc

SEQ ID NO: 550360 - DNA, 87 bp, Homo sapiens
cttagtgctaacttttccaagcactaaagggtctccttcttttgaggactcacaggtgtatggaaaagtaagaagcctagcactaag

SEQ ID NO: 550361 - DNA, 87 bp, Homo sapiens
gtgagccaggccttggaggtagcacgcggggagaagggcagggcacgaggtggcctgacgctgctggactctgaagtctgtgctcac

SEQ ID NO: 550362 - DNA, 87 bp, Homo sapiens
ggcttcaagtccacggccctgtgatgggatgtgggcagggcctgagacaggccgaacccaactcttcacagggccgaattctttgcc

SEQ ID NO: 550363 - DNA, 87 bp, Homo sapiens
gggacagcttctcagaggaagtggtattgacactgagatctgctagtgagtctcagttgactgaaccaacttcccctcagagttccc

SEQ ID NO: 550364 - DNA, 87 bp, Homo sapiens
atatggggtaggacagggaggtaatggaatcatctgaagggcccgggtaccagatggtgacatctatttccgctgtcaaacccatat

SEQ ID NO: 550365 - DNA, 87 bp, Homo sapiens
tcccatgctgtgaccctctagagggaagcactttctgttgtctgaaagaaaccaaagcgcttccctttggagcgttacggtttgaga

SEQ ID NO: 550366 - DNA, 87 bp, Homo sapiens
agaatttctgccttggtcaaaaactctcagtggactgtagcccaggcctttggtctgctgagagtttctgactgaggcggaaaggct

SEQ ID NO: 550367 - DNA, 87 bp, Homo sapiens
gcattaggcccagcttccttccatgctgtcactgcccacaggtagttgtggccactgtgcgtggagggaggtggtggccagtaatgc

SEQ ID NO: 550368 - DNA, 87 bp, Homo sapiens
tctcaagctgtgagtctacaaaggaaagcgctttctgttgtctgaaagaaaagaaatcgcttccctttggagtgttacggtttgaga

SEQ ID NO: 550369 - DNA, 87 bp, Homo sapiens
acctgctttttatcttatttcaagacaccaataagcacctctgtgtgtggtgtttattggcatcttaaaataggagaaaaagttggt

SEQ ID NO: 550370 - DNA, 87 bp, Homo sapiens
ggtaagattgttcattactgctgtttgccactgtgacattcattcctatgtatgaaggtgcagggagcaattgtgaacatttgagcc

SEQ ID NO: 550371 - DNA, 87 bp, Homo sapiens
ctagcatgagtggcatggcactagggtcagcagttctggcagaaacttctggacatccagactatgacccaggtgatgtgatgctag

SEQ ID NO: 550372 - DNA, 87 bp, Homo sapiens
agtgggctgtttgtacataagctagcctgcctgcacatacgctgtgccctatgcagaaaggctggcctatatgcagatcagctcact

SEQ ID NO: 550373 - DNA, 87 bp, Homo sapiens
tctcctgctgtgaccctcaagatggaagcagtttctgttgtctgaaaggaaagaaagtgcttcctttttgagggttactgtttgaga

SEQ ID NO: 550374 - DNA, 87 bp, Homo sapiens
cccctccgcccgtcccctcctcccctgctgccgcctcccggagggacggcctggggaggggagagaggagggacgggccggcggcgg

SEQ ID NO: 550375 - DNA, 87 bp, Homo sapiens
ttgctgctcagcaatccagtcacatgtgtcttggagacatggaatcttgcctccaagacacataggagctgaattgctgagcagcag

SEQ ID NO: 550376 - DNA, 87 bp, Homo sapiens
gcctctgtctccctcgtgtctctccagggctgcactgtgacaaggccacggtgtctacctggacggccacagggactcccagttggt

SEQ ID NO: 550377 - DNA, 87 bp, Homo sapiens
acttcctggaagcagaagccctgatgttaaggccttgctcatggttttatctccagagcttagcacagggtctgcttcatagtaagt

SEQ ID NO: 550378 - DNA, 87 bp, Homo sapiens
ttttcagaatggaatgagttatataagagatactgaataactcacttggagttgttctctgtctcttatgtacttatgtactggaga

SEQ ID NO: 550379 - DNA, 87 bp, Homo sapiens
aaggagttcagtatccataccacactagttttatttggtctcaatcatttcagtctgaatgaactggggtgtgtgtgctaatttctt

SEQ ID NO: 550380 - DNA, 87 bp, Homo sapiens
tgcaactgtgctctgtctgtatccccactggggcccagaagtctgggtcaggagagcggggatgtaggcaaggcggtggcaggtgca

SEQ ID NO: 550381 - DNA, 87 bp, Homo sapiens
gacaaattgcagattagaggacatacaaatgagggagccagttgctacttttgcctttattattaatgttttgtggctctgcgggtc

SEQ ID NO: 550382 - DNA, 87 bp, Homo sapiens
tctcaggctgtgaccctccaaagggaagaactttctgttgtctaaaagaaaagaacgcacttccctttagagtgttaccgtgtgaga

SEQ ID NO: 550383 - DNA, 87 bp, Homo sapiens
gagctgaaggtcagaggtttttcaggttctcgtgaacctcacaagaacatgctgggcctccgatctcaccaacttgtttatcagttc

SEQ ID NO: 550384 - DNA, 87 bp, Homo sapiens
ctggctagactagggatcagtgaaggaggaagctggcaaggctggcgggccaggctgagcgtttcttcttgatcctggcacagccgg

SEQ ID NO: 550385 - DNA, 87 bp, Homo sapiens
gcacattccagacgcgtgtggtcagcggcgggcgtgtgccaggcccggcacccctgcccgcgctggccgcctcactggaaactgggc

SEQ ID NO: 550386 - DNA, 87 bp, Homo sapiens
gagtttctaagcacaaccctcttcgcccgtggggccccagtcaggtcatccagatgggtctggtggggttggagagggtgtgtgtgt

SEQ ID NO: 550387 - DNA, 87 bp, Homo sapiens
ccagatttggcttctatgtaagaaaatagtcaaccacaagtgattacaatggttgactgttttcttacatagtagccaaatcagtgg

SEQ ID NO: 550388 - DNA, 87 bp, Homo sapiens
agaacagctcatatcctgtggacagatgatagatatgtcatatcactgaaaaattgtttgtcttccacaggtgtatgggcttcttct

SEQ ID NO: 550389 - DNA, 87 bp, Homo sapiens
tctcaagctatgagtctacaaaggaaagcgctttctgttgtcagaaagaagagaaagcgcttcccttttgagggttacggtttgaga

SEQ ID NO: 550390 - DNA, 87 bp, Homo sapiens
agagtttatagtaagaagaattggcctactcaggtgtcagcaaagccttcctctctgaataggtcaattcccctcactataaactct

SEQ ID NO: 550391 - DNA, 87 bp, Homo sapiens
ttggggcgtgagctcaggggttgggagggattgtactgacctggttccctttttgtcagaccttccttcccaattctcagcccccaa

SEQ ID NO: 550392 - DNA, 87 bp, Homo sapiens
gatggtcaggtaaatgatgttcaaagagaaacaactagagctttgaacttgaggttgtttttcttgtcacaatttacttagatggtc

SEQ ID NO: 550393 - DNA, 87 bp, Homo sapiens
atggggaaggccagaggaggggaaggttatatgagtgaacacgagcattgttcctaaagttatttcctttctcctgccctttcccat

SEQ ID NO: 550394 - DNA, 87 bp, Homo sapiens
acttgaacccgtgctctatccactacaccccgctgcctctcatggagaagaggcagggtagtgtaatggagagagtgcgggccgagt

SEQ ID NO: 550395 - DNA, 87 bp, Homo sapiens
gggcaggcagggaggaggaggctcagggacctagccaggggcattccattccccatctctgggcctcagtctccccttctgcagcac

SEQ ID NO: 550396 - DNA, 87 bp, Homo sapiens
gtgtagataaatcaatgctgttttagattttatttgtgacctcaaagagcacataaaatctaaaacattgcattgatttgtctatat

SEQ ID NO: 550397 - DNA, 87 bp, Homo sapiens
tctctggagagcgcctggctatttgggtctcatctgtctccaagatttgatgggtgattcactcaagtaccagtgctgttcacgaga

SEQ ID NO: 550398 - DNA, 87 bp, Homo sapiens
tctcatgctgtgaccctacaaagggaagcactttctcttgtccaaaggaaaagaaggcgcttccctttggagtgttacggtttgaga

SEQ ID NO: 550399 - DNA, 87 bp, Homo sapiens
gtcctgttccttaaaatctctgggatcaaaatcgcttaatctgtaaaatgagggagctgcacatgtcctggggacaagggacaggac

SEQ ID NO: 550400 - DNA, 87 bp, Homo sapiens
tctcaggcagtgaccctctagatggaagcactgtctgttgtataaaagaaaagatcgtgcatccctttagagtgttactgtttgaga

SEQ ID NO: 550401 - DNA, 87 bp, Homo sapiens
tggcagagggtcagtaagagtagaggagttaaagagaaatgtactattcccttttgaccctgttattctccctgacctagattgtca

SEQ ID NO: 550402 - DNA, 87 bp, Homo sapiens
gcctctccccagggccagttgagaggcaccccctagggacttcttccccccggccatcttcctcctcgaaaggccctggggcagggc

SEQ ID NO: 550403 - DNA, 87 bp, Homo sapiens
ggggtgtcaatgaagcggagcaaaggtataaggaatttggggcagggcaccaccctttcacctttgcccagctgttgtgcaaattcc

SEQ ID NO: 550404 - DNA, 87 bp, Homo sapiens
tagggctgaagacagagagggccatggcaggagggaggagggccttggttttctttctcttgtgtgttccactttcttctctttctg

SEQ ID NO: 550405 - DNA, 87 bp, Homo sapiens
cctcccccagggaaagaccagagacagccatcaccccactgggccgaggcctgcacgcggctgctctggttcttttctgagggccgg

SEQ ID NO: 550406 - DNA, 87 bp, Homo sapiens
ccattgtctcaagatgtcctgaggcagaggatatccttcccactcttactatggtctgtcctctcccctaggccatcttggacttgg

SEQ ID NO: 550407 - DNA, 87 bp, Homo sapiens
ccctcccgcttcaccggctaccccgcccccacactcttttcccacccaaggtgtgaagggcgggagactgggaggagaaagggaggg

SEQ ID NO: 550408 - DNA, 87 bp, Homo sapiens
cgggcttgtcacttgtgtgctgcgcagatgtgcctgcaagggagaattcttgctgtaggtctggccgtagccacataggtatgcccg

SEQ ID NO: 550409 - DNA, 87 bp, Homo sapiens
ctgatcacaggcagataagtaggctggttgattaggatgaatcccacaggtaatccctaatctactagtctgtttgttaactatcag

SEQ ID NO: 550410 - DNA, 87 bp, Homo sapiens
taactaatccatcacctccctcaggttcttccctgatatttttcagagaagaaagggaagaacctaaaggaggtgatggattaatta

SEQ ID NO: 550411 - DNA, 87 bp, Homo sapiens
tattgatagggtgatcagccaccccagtttgcctgggactaatgagtttctgggcacactgggatgaattggtcaccttaattgata

SEQ ID NO: 550412 - DNA, 87 bp, Homo sapiens
tctcagcctgtgaccctctagagggaagcgctttctgttgtctgaaagaaaagaaagtgcatctttttagaggattacagtttgaga

SEQ ID NO: 550413 - DNA, 87 bp, Homo sapiens
ttacatctgcactcttatcttggaacttggtatgggaagacgaatagtagttcctgctaagcctctaaggtgagaagtgagctgtga

SEQ ID NO: 550414 - DNA, 87 bp, Homo sapiens
actgatatatttaccacttactatatatcgatgtacattactatacatagtacaatgatatacagtaagtggtaaatggatgttagt

SEQ ID NO: 550415 - DNA, 87 bp, Homo sapiens
ctgtgaagtgctgtggatttctttgtgaatcaccatatctaagctaatgtggtggtggtttacaaagtaattcatagtgcttcacag

SEQ ID NO: 550416 - DNA, 87 bp, Homo sapiens
gagtgtctcctttgagggattttagacagaaggggcaggaagaggtcagggcccctttctctggagtcactcagtgagcggacattc

SEQ ID NO: 550417 - DNA, 87 bp, Homo sapiens
aggacagtctggctggctttgtcaggacttttcagacgtggtgacaaacactgaaatcacggggcagtgctcagttcagactgtcct

SEQ ID NO: 550418 - DNA, 87 bp, Homo sapiens
tctcatgctgtgaccctctagagggaagcgctttctgttgtctgaaagaaaagaacgcgcttccctatagagggttaccctttgaga

SEQ ID NO: 550419 - DNA, 87 bp, Homo sapiens
tggcttctataatgcagttttgtttttcaaaataataaattagcattaatttagggttgtgacaagcttaatctgctgcaaaagcca

SEQ ID NO: 550420 - DNA, 87 bp, Homo sapiens
tctcaggctgtgaccctctaaagggaagcgctttctgtggtcagaaagaaaagcaagtgcttccttttagagggttaccgtttggga

SEQ ID NO: 550421 - DNA, 87 bp, Homo sapiens
acgtgtccttattttggaaataaatgcttctgaagttaaaataaatgtatttaattagtagaggcatttagttctgaggtggaaagt

SEQ ID NO: 550422 - DNA, 87 bp, Homo sapiens
aatgcccagtgactaggacagaacctaggaagttcccagtgaatatgtaggcctatgtcctaggttctgttctaatcactgggcatt

SEQ ID NO: 550423 - DNA, 87 bp, Homo sapiens
ggatcctagctctcctgattaggtttccatagctggtagagaagattcagttacacatgggaacctgatcaggaaattggcaggtcc

SEQ ID NO: 550424 - DNA, 87 bp, Homo sapiens
tctcgggctgtgactctccaaagggaagaattttctcttgtctaaaagaaaagaacgcacttccctttagagtgttaccgtgtgaga

SEQ ID NO: 550425 - DNA, 87 bp, Homo sapiens
gagtatgaagattagcctgaaaatagagatggtctggctcaagggtttccaattctgttttcaatggctttgttctttccagttctc

SEQ ID NO: 550426 - DNA, 87 bp, Homo sapiens
agtgttcagaaggtctctatggggactgatgtcctgaggtgactagacgcttccagacatcagtgcccgtggcacccagatgacact

SEQ ID NO: 550427 - DNA, 87 bp, Homo sapiens
ctcagacctcggggggagttgggagtggagggttgctgggggacacttggctttctctcccacgtgccacctcccctcgtgtcccag

SEQ ID NO: 550428 - DNA, 87 bp, Homo sapiens
ggcccgaggggttatctgccttccggggacggtaggggatgtagacaagagcctagcgttcctggaaacaggtgtttaatttgggcc

SEQ ID NO: 550429 - DNA, 87 bp, Homo sapiens
tgacctctttctgcttcacacatgtcctttccttctgctggttaatagcaacagtagtcttttggatgtatggaagcaaagatgtca

SEQ ID NO: 550430 - DNA, 87 bp, Homo sapiens
ggattatttgcacattttcctgatgacttctctctctcagaattctttttttgttggaaggaggtgggtgggaagagcaaatagtcc

SEQ ID NO: 550431 - DNA, 87 bp, Homo sapiens
gaggactgcctgactttctggctgcccatatttttccagatgataaggccagggaagagtcagggagccagatgcttggcagtactc

SEQ ID NO: 550432 - DNA, 87 bp, Homo sapiens
ccctccctttggatctctccagctttaacatggggcccttaacaactgaggtgtcagtgtgaaggctggggtgaccaagttagaggg

SEQ ID NO: 550433 - DNA, 87 bp, Homo sapiens
actgggtggtgactaagggtgtttgttgtcatagtattcctcatgcttttcatatactttacaaatagccctttgaaactgctcagt

SEQ ID NO: 550434 - DNA, 87 bp, Homo sapiens
ggttgccaatctgttctgtgatcaagttctctgcctttcccttcctccttgggtcagaggaccttgatacagacagatcttggtact

SEQ ID NO: 550435 - DNA, 86 bp, Homo sapiens
aggaattgtaagcatcggtctcttctgcacttttccgtgaggttgaaaagatggagatgttgaaggactggagctttgcagagcct

SEQ ID NO: 550436 - DNA, 86 bp, Homo sapiens
gcaggaacacccctcatttatgtgtgcaaatagggtaattaagtgtccaattaccagatttgcattggcaaatgggggctttgtgt

SEQ ID NO: 550437 - DNA, 86 bp, Homo sapiens
cctccacataacaggtgctcaaataagacttgttggtttatttattctttcaacaaatacttattgaggacctgctatatgccagg

SEQ ID NO: 550438 - DNA, 86 bp, Homo sapiens
cagagacctggcacctgccgccttttctgttctaataaaaggcagatgccttgggggtggatgggggtagtgtgtggggggctctg

SEQ ID NO: 550439 - DNA, 86 bp, Homo sapiens
ggcaacttatggggtttagcttttaccccatgtacttcccggctgtaataactgggttatcagggttgagtgaatcccatgttgct

SEQ ID NO: 550440 - DNA, 86 bp, Homo sapiens
ttccgtcccttctgcagtcaacacagccctggctctgcattcggccctctcttcacggggctgtgtctgggcagatggggctggaa

SEQ ID NO: 550441 - DNA, 86 bp, Homo sapiens
gagcccagctggaaatgttctagccaaaaaagtttgccaagaaccattgtgtctttttttttgctggaacatttctggttgtgctt

SEQ ID NO: 550442 - DNA, 86 bp, Homo sapiens
agcatgcgagtagtttgttattatttttcttttttaggattgattctacataacctgagagagggaaaagcagaattactgttgct

SEQ ID NO: 550443 - DNA, 86 bp, Homo sapiens
gctccccctcaccccggcctccctgaactttggggttgccgtggtgactgcctccaagggtcagggccgaagggagagggtggggc

SEQ ID NO: 550444 - DNA, 86 bp, Homo sapiens
ttgagctttgatggcgggcttgctagctttcttgactctttttaaactcgctgtctgatactggcaatcttgccatcccttctcaa

SEQ ID NO: 550445 - DNA, 86 bp, Homo sapiens
ctccacacctgaacaatgagaacagcaccgcttggctcggaccccactgagccaggtggtggtgttcccattttccaggtatggag

SEQ ID NO: 550446 - DNA, 86 bp, Homo sapiens
ggggaggcgaagaataagtgccttgattttgcagctttttctttcctaagggcctgcctgggaagggtattgcttcttgtttccct

SEQ ID NO: 550447 - DNA, 86 bp, Homo sapiens
ccagggtagctgaggggatggtagaccggtgacgtgcacttcatttacgatgtaggtcacccgtttgactatccaccagcgcccgg

SEQ ID NO: 550448 - DNA, 86 bp, Homo sapiens
cttttgtgggttggggtaggagggtaagtcttactgagtttaacaacacatactcagaagaagctctccttttcaaggcacagagg

SEQ ID NO: 550449 - DNA, 86 bp, Homo sapiens
gcacagctctgttactacgcaccaccctttagaccgcagtcttctttcagctctttgggtggttgtggaggtgacagaactagtgc

SEQ ID NO: 550450 - DNA, 86 bp, Homo sapiens
tgggttcagggcatatctgaggtcttccgatttgcagctcagaatcccctgagctgagatctgggctgccttccccatgcctccca

SEQ ID NO: 550451 - DNA, 86 bp, Homo sapiens
ccctctttctgtggcagattgggatggataaaataaagaagatcgagaggttgaagaacccatcctgttttgccagtgagaagggg

SEQ ID NO: 550452 - DNA, 86 bp, Homo sapiens
aggagcctccccagctcgcgggtgacgggtgtggtttgtaaatagtttatgcacctgttacatccacgtgttgcgggactgctcct

SEQ ID NO: 550453 - DNA, 86 bp, Homo sapiens
gtcgcatgggtcggacaccagcggcggcagcccggccccaccgtcggactgggcggcacgctcctggtgctccgtgcccagacgat

SEQ ID NO: 550454 - DNA, 86 bp, Homo sapiens
gctcacctcttccttgtacagactctgcttcttcctttgatcagggaggcttggtttggctaagtctgtgcccagaagagaagagt

SEQ ID NO: 550455 - DNA, 86 bp, Homo sapiens
gggggaaaggggtgggatctgaatgtgtggaggtcaaggtcctgacaatgtgataatgatataagcagagctctcccctttctctc

SEQ ID NO: 550456 - DNA, 86 bp, Homo sapiens
ttggccttgctgggatgtttcatgactactctgcagttcttatcaacctcctttagcatactcatgaagcatcctagctaggctaa

SEQ ID NO: 550457 - DNA, 86 bp, Homo sapiens
ggtttggagggctgcgttcattttgagtgctgttgtaatcaattttagatacagcattccacaatggatcagtttgcatccaaacc

SEQ ID NO: 550458 - DNA, 86 bp, Homo sapiens
agctataaaatagctgctgggtggcagattacacaggctctagaataaaaaggtgagaatttgccacccagcttctaccatgagct

SEQ ID NO: 550459 - DNA, 86 bp, Homo sapiens
attacaaatctcaagagttttatatgcagttgccaaaaatctctcttttgacaaattgcacaggaggcattttgagattgtgtgat

SEQ ID NO: 550460 - DNA, 86 bp, Homo sapiens
atacatgtgactctggattcaggatctctccttggaatttaagttgcagcccaaggggatatcatgtctctttgagtctaatgtat

SEQ ID NO: 550461 - DNA, 86 bp, Homo sapiens
tggcttaacatgtctctttttggctttttgcttccttgagtcttccaggcaggatcaaataagctgtataagagagattgtggccg

SEQ ID NO: 550462 - DNA, 86 bp, Homo sapiens
tgctgttgcgattagatgatgacagctagctggcttttaaaattgatcaggaagtattctggcagtcattcagtgttgtaatagca

SEQ ID NO: 550463 - DNA, 86 bp, Homo sapiens
tttggtgcttaaagaatggctgtccgtagtatggtctctatatttatgatgattaatatcggacaaccattgttttagtatccaaa

SEQ ID NO: 550464 - DNA, 86 bp, Homo sapiens
gcagggcaaatctgggttttaaagagttgattgttgctttatctttttagagctattcatttttaaaacccagagcaagaccctgt

SEQ ID NO: 550465 - DNA, 86 bp, Homo sapiens
aagtgttatcaatcacagcttaatctaattaagctctttaaaatagcttctaaactaattagattaagtagtgatttataacagtt

SEQ ID NO: 550466 - DNA, 86 bp, Homo sapiens
cctccagggctgttccatctcttcctagaagtgcttggagagattagagcagcatgcctgggagccagatggggcaaccctggagg

SEQ ID NO: 550467 - DNA, 86 bp, Homo sapiens
gcctctaatggagtctctttgagtagagcaggggtacctggtaacaactgggtcctactgcttggatcagggggctgcatggaggc

SEQ ID NO: 550468 - DNA, 86 bp, Homo sapiens
ccatccctggccagcagccccagctccagccccagcacaccaccaccagggcaggagactaagggggtgttggacaagaaggaagg

SEQ ID NO: 550469 - DNA, 86 bp, Homo sapiens
agggctggagagaggggaggacagaggtatgagttggatacaagctgggcaaaactcttgtctcaatcctcctcgtctctttccct

SEQ ID NO: 550470 - DNA, 86 bp, Homo sapiens
tctgggctgaagatggggaatagttttgttctttttttatgttgtcagaagaaagaggtggatggtttcccttctttgcgccaaga

SEQ ID NO: 550471 - DNA, 86 bp, Homo sapiens
tgtaatttcaatgtattcagttttgactttgcccgtattctacttcgatatagactggcacagcaactgaatatattgctcataca

SEQ ID NO: 550472 - DNA, 86 bp, Homo sapiens
tgctgactctgagccccaggcttcagttgagatggtcctttcagaaatgtggagcttagtccaagcctggatttcagtgggtagca

SEQ ID NO: 550473 - DNA, 86 bp, Homo sapiens
gtccctgggctggggagaggggaggattggggcgcgggaggctctgttctcctcctcccctcttttccccacctcccaaaattggc

SEQ ID NO: 550474 - DNA, 86 bp, Homo sapiens
agggttggccaggctgtgttctgatcatcaccctgctccttaccgctgggtgatcttaagcaaagcacacagctccctctagccct

SEQ ID NO: 550475 - DNA, 86 bp, Homo sapiens
aagcagggggagagctgattgggaatggaagcagaggcaaagaaatgaaagagatgctttgatttctaatgtgccttcccttgctt

SEQ ID NO: 550476 - DNA, 86 bp, Homo sapiens
tgcatgggatgtattagaaggtgttactagaattgtcttagataaagcgatgttatctaggctggttcctgtaacattgtcctgca

SEQ ID NO: 550477 - DNA, 86 bp, Homo sapiens
taggatgtaacagaacatggaggcagacagacgtgggttcaaattccaagtctgttccacgttcgtctgtcccatgttacatctta

SEQ ID NO: 550478 - DNA, 86 bp, Homo sapiens
ctcctcctcccgtgccttgcctttctcctcattccagcaactgcttagtttggctgatgagggtagagttagatttgggagaggag

SEQ ID NO: 550479 - DNA, 86 bp, Homo sapiens
tagatttatttgcatgtgtgtgtgtggaatacaaggaatttcagaactaaatgtgttgcacatatttggcatgtaaacataatcta

SEQ ID NO: 550480 - DNA, 86 bp, Homo sapiens
caaagacaatctccatcgcactcttttttttctgtactgacaacacaggggaaggagaaagtgaagggaaatgtgttttgtttttg

SEQ ID NO: 550481 - DNA, 86 bp, Homo sapiens
cacacctgccaatgatcacttttgtgactatgcaactggagtgagaatactagctgcagatcacaaaaatgacactggcagctgtg

SEQ ID NO: 550482 - DNA, 86 bp, Homo sapiens
ggattgtgctgtgtggggtggggaggtggtctgggcacctgagaggggtcagggctgggactcctccccactggacggcaccatcc

SEQ ID NO: 550483 - DNA, 86 bp, Homo sapiens
tatttcccatggtgcacctgtctctcattcccataacaggaaggagggttttctggggctgagacacaagtggatcatgagaagta

SEQ ID NO: 550484 - DNA, 86 bp, Homo sapiens
ttagattggcagatgtgttgtgtgggagtgaggaaaggaaatttcctatgttaatttctttctgacaagcacatgtgcaaatctag

SEQ ID NO: 550485 - DNA, 86 bp, Homo sapiens
tagggttggagggagagccctcagtgtgacccccggtgtggagtagggagggtttcagcactgaggagttttctcagcattccctg

SEQ ID NO: 550486 - DNA, 86 bp, Homo sapiens
gtagcatccctcaccctggtcccctggcctctgtaaagccaccagcctgagggcagtggcaggagatgggggtgggggggtgctgc

SEQ ID NO: 550487 - DNA, 86 bp, Homo sapiens
cgctatttccctcccactttcagcagtctggtttattccatgggtggaagaggaagccaagttggctgagtgtgaagggaatggcg

SEQ ID NO: 550488 - DNA, 86 bp, Homo sapiens
gcctgagctttgaaagagaggagaggaagccaagtcatccagcagatcggacccacaagctcatcctctagtttttttcaaggggc

SEQ ID NO: 550489 - DNA, 86 bp, Homo sapiens
gtgagcctttctggactcttgggtcctatctgataaatgattgcttcaatacactaaatgggccccagtgtcctagaaacgttcat

SEQ ID NO: 550490 - DNA, 86 bp, Homo sapiens
tataagttatgaaacctggatattttagggtgcagttagtttttaagttttttgaacctaaagtatttaccaggtttcattttgta

SEQ ID NO: 550491 - DNA, 86 bp, Homo sapiens
cccggccccggcctctcctcaccctgcctcagctgcacccgatgccttgcagctggtttggggtagaggacaggctggccccgcgg

SEQ ID NO: 550492 - DNA, 86 bp, Homo sapiens
tcagcttccttctgtgagtggactgcactatggtctctactcaagtaaaactcgattttgtcagttcggctcaaggaggaaaatga

SEQ ID NO: 550493 - DNA, 86 bp, Homo sapiens
ctggtgtgcttttcattttgtgaaagtgaaggagatagaccgtagcaaccaccctcacatttacacagtggcagcgcaaaccacag

SEQ ID NO: 550494 - DNA, 86 bp, Homo sapiens
tgggcctggcatatggggagggctcagtcaggctccttcactcattcatgtaatatctattgagccctttccatgtgccaagccca

SEQ ID NO: 550495 - DNA, 86 bp, Homo sapiens
tccttcttgcttaacagggtggaaacttgataaaatacacctgtgagttagggtttttgttatttcctacctgacagccagaaaga

SEQ ID NO: 550496 - DNA, 86 bp, Homo sapiens
agtggcggggcacaaggcgccagcggcgagcactggcttgcttcacagtgaacgccttcgttgcctggcgactagtccctgcggct

SEQ ID NO: 550497 - DNA, 86 bp, Homo sapiens
atttgtcaattttcacaaaggtattctcattttggaagcaagtgtcttgttctccaattggcatacttttaagaagtatgacaaat

SEQ ID NO: 550498 - DNA, 86 bp, Homo sapiens
ttcatgggggactggggggtggcagcaggtggaggacccccacctcactagccgcctcagctgccacacctccacaccgccctgag

SEQ ID NO: 550499 - DNA, 86 bp, Homo sapiens
tccaggaccaaggcacagctgccatcccctgcctctcactatgctggtataggaggaagggagtggggctgtgcagagtctctggg

SEQ ID NO: 550500 - DNA, 86 bp, Homo sapiens
gtgcttaccacatgccaggcactgttctaaaggcctcacactattaaaaagtgcttagagcatgcctggcacacggtaagtccaac

SEQ ID NO: 550501 - DNA, 86 bp, Homo sapiens
ctagctatttctgctacataaaaattccctggtcacacaaataacaaaaagtgaccaggggatttttgtgtagcagaaatgactag

SEQ ID NO: 550502 - DNA, 86 bp, Homo sapiens
tttctttctctgcctctatctccccactttatttttcaggaaaggatggaaaagtaggggtggagggcgaagaggttggagaggag

SEQ ID NO: 550503 - DNA, 86 bp, Homo sapiens
tacgtttaacttctctggttgttgcccacatctgttcaaggttttgcacaaacagagttggacaacaaccaaggaagttaactgta

SEQ ID NO: 550504 - DNA, 86 bp, Homo sapiens
gtaagttatatatgtctacttctacctgtgttatcataataaaggtgtcatgatgatacaggtggaggtagaaatatataacttat

SEQ ID NO: 550505 - DNA, 86 bp, Homo sapiens
aggtggcaagacatccagaacagagcttctatttcagtttgtaaaataacacactgtagcaggttctgttgctgctctgctcacct

SEQ ID NO: 550506 - DNA, 86 bp, Homo sapiens
agttgctcctgtacttagctgcgcctctctgacagtacttgtttcaccagagaggcagaagaacacagttattacaggcagcagct

SEQ ID NO: 550507 - DNA, 86 bp, Homo sapiens
ctgtaatcacatctaaagactagacttcgctatgaccaggccatagtaaacatcatagtatgtctagtctttaggtttgattacag

SEQ ID NO: 550508 - DNA, 86 bp, Homo sapiens
tttggtatttaaaaggtagattttccttctatggttacgtgtttgatggttaatcatagaggaaaatccacgttttcagtatcaaa

SEQ ID NO: 550509 - DNA, 86 bp, Homo sapiens
gttacttcaggccatctgggcgtataagtgcaagtcacaggggatgtgatggcttggcttgggctcagaggcctgacgatgttggc

SEQ ID NO: 550510 - DNA, 86 bp, Homo sapiens
tccctctatacaaggtgggttttgcattgtcccacacatagtctgctgatggccgtgggatggcaaagtcatcttcattagacgga

SEQ ID NO: 550511 - DNA, 86 bp, Homo sapiens
tttgctggtcaaaggcctaaagccagaagcaggaaatctggaattaaatgtttcttgtatctggaaagaggcatgactaaggtaaa

SEQ ID NO: 550512 - DNA, 86 bp, Homo sapiens
tggggaaatcagtctctctgctggtcttttccccttgcaaaacttgatgtgagaggaagagaccagattggaaggtctgggtctca

SEQ ID NO: 550513 - DNA, 86 bp, Homo sapiens
ttgtgggtctcagcagtggtcagcccaggaggtttttacatctgcctcttccctgtattgaaaatgctgctggggccatatggcag

SEQ ID NO: 550514 - DNA, 86 bp, Homo sapiens
tttggtacttaaagagaggataccctttgtatgttcacttgattaatggcgaatatacagggggagactctcatttgcgtatcaaa

SEQ ID NO: 550515 - DNA, 86 bp, Homo sapiens
tcccctaccccatgtaaccccattttctcagacccatcaaaattttctgtaacttggggaataggtatggggtttggagtagggga

SEQ ID NO: 550516 - DNA, 86 bp, Homo sapiens
ttctgtttcgatgacacccacagggtgaacaggaaagaaaataatttatctttcctgctcaccctgtgggtatcatcggaacagaa

SEQ ID NO: 550517 - DNA, 86 bp, Homo sapiens
gctggctcaggctccttaaactaatatttgcctcttggcccctagcagccacagctgagggtaaatattggtttagcctgggaagc

SEQ ID NO: 550518 - DNA, 86 bp, Homo sapiens
gtgaggaggcccaagggggatggtggtggtgaggaagccgagaggacttggccattcaccagctcctcagggaaagcactgctcac

SEQ ID NO: 550519 - DNA, 86 bp, Homo sapiens
atattctattagctactttggatgttcattctaaaaactggacagaaatcttggaatggatttccctaagtgggtactcagaatat

SEQ ID NO: 550520 - DNA, 86 bp, Homo sapiens
cccttaggctgcctccacaggtgagtgctgctgggggtagggctgggcccaccctgaaggggttctccctgtgggctgcaggaggg

SEQ ID NO: 550521 - DNA, 86 bp, Homo sapiens
ttccgtcccttctgcagtcaacacagccctggctctgcattcggccctctcttcacagggctgtgtctgggcagatggggctggaa

SEQ ID NO: 550522 - DNA, 86 bp, Homo sapiens
ttcattggtaaggtactatacctattaccaaagggtaggtagcatagtacctttggtagtaggtagggtagtacctttccaatgaa

SEQ ID NO: 550523 - DNA, 86 bp, Homo sapiens
tttcatacttgaggagaaattatccttggtgtgttcgctttatttatgatgaatcatacaaggacaatttctttttgagtatcaaa

SEQ ID NO: 550524 - DNA, 86 bp, Homo sapiens
gccccgcacccaaggatggagggtcacaccccgaacctgagagtctggactggggtgttctgccctgtgtaccctaggagcggggc

SEQ ID NO: 550525 - DNA, 86 bp, Homo sapiens
taaatatcttgaacttgtaactaagcagttactttgatataccctaaaatcaaagtaactggttagttacaagtttaagatattta

SEQ ID NO: 550526 - DNA, 86 bp, Homo sapiens
tctcccaggtggacctttctgcagaactacagagcctcaggatttaccaggctgtgtgtttctgtcggagtgtttcgagtgttgga

SEQ ID NO: 550527 - DNA, 86 bp, Homo sapiens
gtgctgaggtgggagtcaggggaggggtggagagaattgaggggttgggccaggcctcccacctcctagggctcccgcaccagcat

SEQ ID NO: 550528 - DNA, 86 bp, Homo sapiens
aagaatggattattgaggcagaggtgggaatcacatagaacatacctaagtatggtttctacttttctctttttctatccgttctt

SEQ ID NO: 550529 - DNA, 86 bp, Homo sapiens
ggaggggaggatacaagaggaatgataaatggcaaggaaaaccactcactcttaatgctttttgtcatactcatgtcctcttgtcc

SEQ ID NO: 550530 - DNA, 86 bp, Homo sapiens
cctgaattggccaatgctaattggaactctactaagtctacttactccagttagtagaattccaatatagcgttggccaattcagg

SEQ ID NO: 550531 - DNA, 86 bp, Homo sapiens
tatggtttgggactcaggatgtggtcaagtgttgttaaggcatgttcaggaacaatacttgaccacattttgaattccaaaccata

SEQ ID NO: 550532 - DNA, 86 bp, Homo sapiens
tgtagcgtgtgtattcacaaaactcatagagtgctctacagtgctacaaagcactctgtgagtgtggtgaatacataaaggctcca

SEQ ID NO: 550533 - DNA, 86 bp, Homo sapiens
caaaatcccccctgtggaagacagctgagtggatgtctcttaggaacactggagggccattgggtttctccacaggggagatgatg

SEQ ID NO: 550534 - DNA, 85 bp, Homo sapiens
gggggcctgtgtgtgttttgccccagggtcttcaggctgcctggctgcctctatctgccccctgggtgtccagcaccaccccccc

SEQ ID NO: 550535 - DNA, 85 bp, Homo sapiens
ccaggtatcataatgaagaagtttgctgtgtgctctctgtgtgagcaggacaccagagcaactcccttcattatgatgacattgg

SEQ ID NO: 550536 - DNA, 85 bp, Homo sapiens
gttatagtcatgtgtttttcatttacaaatatggtgagaagtagtgtttttgcaatattcctaaatgagtaacatatgacacaac

SEQ ID NO: 550537 - DNA, 85 bp, Homo sapiens
cctgtaggctttcatgggtatatttactggtgagttgacaaaagatgcgtcacctctgccaggagatatttcctgaagctacagg

SEQ ID NO: 550538 - DNA, 85 bp, Homo sapiens
ctcaggctgtgaccctccagagggaagtactttctgttgtctgagagaaaagaaagtgcttccctttggactgtttcggtttgag

SEQ ID NO: 550539 - DNA, 85 bp, Homo sapiens
tcagagctgattgatggctttttggcccttcagctggcaaacactgaccctggcacccaagagaggccattttcacagcttctgg

SEQ ID NO: 550540 - DNA, 85 bp, Homo sapiens
tctgaagacatctgtcatttcaatgatactactaagtcctagaggaagatttggtggtatcattgaaataacagatgtttccaga

SEQ ID NO: 550541 - DNA, 85 bp, Homo sapiens
actcaaaatccagctttacaaagccagataaaatctgggtaaaaattgggtaaagtctggctttgtaaatttggtgaatttgagt

SEQ ID NO: 550542 - DNA, 85 bp, Homo sapiens
gcacttgatactaaccgagctgtctatatcctagccttgtgtcaaaggcttgtgatgtgttgtgatagctgggtttaagaagtgc

SEQ ID NO: 550543 - DNA, 85 bp, Homo sapiens
ggctcccttttttgtgtcccttctttaagagtgtctggttgctttgctgacaaacacctcagaaaagggacagaaagttggagcc

SEQ ID NO: 550544 - DNA, 85 bp, Homo sapiens
gtctagagaggagtgtgtctgtgtgcgtatctgtgtgtacatacgcacataaaatatatacacacatatacactcatttttacac

SEQ ID NO: 550545 - DNA, 85 bp, Homo sapiens
ttccagctgtgatgctgtaggagactcacttggaggaaattgtgtagcaaccctcccctctcttctactcattttacagcttgaa

SEQ ID NO: 550546 - DNA, 85 bp, Homo sapiens
gggtgagatcacaggtgatggagagagacagagctcagctgagagaccagtgctggcctgtctctcctctgtcctgtgaaaaccc

SEQ ID NO: 550547 - DNA, 85 bp, Homo sapiens
ggcacaggccgtgggccgcggcgcgcgggctcgggtctgactcagtcccttggcactgcgtgaccttgggcctgctgcctgtgcc

SEQ ID NO: 550548 - DNA, 85 bp, Homo sapiens
tcagagtggctgggtttggacggcaaagcaccaggcaaaatgtttcccatccctgccagagctgtccaattctagattacactga

SEQ ID NO: 550549 - DNA, 85 bp, Homo sapiens
tgaactttatgttctacctaaatagctctgaaatttactctatgataatggagcatagagttgtttgggttggggatcaatttca

SEQ ID NO: 550550 - DNA, 85 bp, Homo sapiens
aggggagtgagaggaggggagggtcctggaagggcgggtgcaacctcaacccagcggaggaccctgctgacctgcttagttgttt

SEQ ID NO: 550551 - DNA, 85 bp, Homo sapiens
gtactgccagtaactatagatgctgggagaaggcccacatcaaactgagtcctcccagcatgctatataggttgcttgccagtac

SEQ ID NO: 550552 - DNA, 85 bp, Homo sapiens
gcccacctgggttagggtcgaagccccactccccacagaaggttttcctaaaggagatggagccagggccctaacccagttaggt

SEQ ID NO: 550553 - DNA, 85 bp, Homo sapiens
tttgtcagttaatgacctgttgggctaatggccttcagctttgccttaggcacataagtcctccagtaggtcattagctgccaga

SEQ ID NO: 550554 - DNA, 85 bp, Homo sapiens
gggtgagatcacaggtgatggagagagacagcgctcagctgagagaccagtgctggcctgtctctcctctgtcctgtgaaaaccc

SEQ ID NO: 550555 - DNA, 85 bp, Homo sapiens
ggcagagtctgggtcctccccaggctgtcctcctggcactggactcctgggtgacagcctgggggactgggcccggcctgctgcc

SEQ ID NO: 550556 - DNA, 85 bp, Homo sapiens
aaagaatgatcttgaaaacattggcttctaaaagtctgcttgatagtagtgtggacattagagctaagtttttagattgttcttt

SEQ ID NO: 550557 - DNA, 85 bp, Homo sapiens
ggggtggatggagggggaggggaaagatgagggaaggcaaaggactatgtgggtctttcccctcctccatttcctgctctgcccc

SEQ ID NO: 550558 - DNA, 85 bp, Homo sapiens
gctttttgagcaggcagattgtaggctaagacataacagcttccctttgttgtttcattgctatgatctcttgctagaaagaagt

SEQ ID NO: 550559 - DNA, 85 bp, Homo sapiens
aaggtcagatttaataaaaaatgcatctggtgtgtgtaccagaaaaacacaggagttggatggattttttattaaatcaggcctt

SEQ ID NO: 550560 - DNA, 85 bp, Homo sapiens
taggggtgtctttgctgccaatggctgcaaggggttgacaacatcatttcagggaccctcattcatttgcagctgggattccttg

SEQ ID NO: 550561 - DNA, 85 bp, Homo sapiens
cattttgtagcaagattgtttccccatgagcagtttgtcttcattcagcagctgtcttctctggggaagccattttgtagaggtg

SEQ ID NO: 550562 - DNA, 85 bp, Homo sapiens
aatctaggaggcaggtgctcacttgtcctcctccatgcttggaaaatgcagggaggaggccatagtggcaactgttaccatgatt

SEQ ID NO: 550563 - DNA, 85 bp, Homo sapiens
ctccatcagcgcctgaggcctaagcttggtggctgcagaatcacaaaaaaggcagtggctgagcttagcctagaaggctgtggag

SEQ ID NO: 550564 - DNA, 85 bp, Homo sapiens
gggatggagcaggctggtacctgggctgcagcccggctggacaccatccagggctggccgccccatgccttccctgctgcatcct

SEQ ID NO: 550565 - DNA, 85 bp, Homo sapiens
agctccagagagggaaggaatggggagagagctggcccagtgggcagctgttttctgcctgtcctccctcctgtattctggggct

SEQ ID NO: 550566 - DNA, 85 bp, Homo sapiens
atctggcttggttttcagcttcactggattttaatcaaaaaccgtgttgagaattgtttgtgaccctggggaccatatgacaggt

SEQ ID NO: 550567 - DNA, 85 bp, Homo sapiens
gcaaaccctttctctcagcaggaaagcatgcaagtcaaatgccatcataatcactttgtgtttccctgcagagggaaaggagggc

SEQ ID NO: 550568 - DNA, 85 bp, Homo sapiens
ttaagctatttaattctacttcagaaatactatctccttgtttattcagtggctgtgcgtctggagtggagtttgaactgcttaa

SEQ ID NO: 550569 - DNA, 85 bp, Homo sapiens
ctggcctccccccacccccatgccgcgtgctcctggacgcgctaatatgctcagtcactgcggctgtgggtgaggggacggacgg

SEQ ID NO: 550570 - DNA, 85 bp, Homo sapiens
gtggtaacaattttaatttgggagcatgctgataataaaaagatgtgtgtgcatgcatgcatccacaagttaaaaatgagttcac

SEQ ID NO: 550571 - DNA, 85 bp, Homo sapiens
gcagttccttccttgggtttaaggattccccaatgccagatgttaagtctgctaggaaatctgtagaccacagggaagaaaatgc

SEQ ID NO: 550572 - DNA, 85 bp, Homo sapiens
gctcttgtacatggcactaactccaaaagtgtggagttaaactcctgaagtccacactttaggagttaatgccatgtactggagc

SEQ ID NO: 550573 - DNA, 85 bp, Homo sapiens
ggcccaggcaggtgggggcaggatttgaccccaggtagccttgctgcacagccttgggtttaatcctatccatcttgcctgggtc

SEQ ID NO: 550574 - DNA, 85 bp, Homo sapiens
tcccacatgaccagagcttcccatcctccatgcatgggaatctacgaccaaacttagatttccacaggatggtgggggggtggga

SEQ ID NO: 550575 - DNA, 85 bp, Homo sapiens
tctccctctgctagactgggaatgacttgaggatgggaacaatatcttattcatagttatgttcccagtacctagcagggcctga

SEQ ID NO: 550576 - DNA, 85 bp, Homo sapiens
ctcaggctgtgaccctctagagggaagcactttctgttgcttgaaagaagagaaagcgcttccttttagaggattactctttgag

SEQ ID NO: 550577 - DNA, 85 bp, Homo sapiens
gcctttaagactctcaccctgctttgcggagaatggcaaaaatctgcgaaacatctcagcagagccaggagagagtaacactggt

SEQ ID NO: 550578 - DNA, 85 bp, Homo sapiens
tctcaagctgtgactgcaaagggaagccctttctgttgtctgaaagaagagaaagcgcttccctttgctggattacggtttgaga

SEQ ID NO: 550579 - DNA, 85 bp, Homo sapiens
ctcaggctgtgacactctagagggaagcgctttctgttgtctgaaagaaaggaaagtgcatccttttagagtgttactgtttgag

SEQ ID NO: 550580 - DNA, 85 bp, Homo sapiens
gtcaggaatcccaggtgggacaggggtgggggcacagtagcctctggcactgtagcaccccagcttctccctcctagcctctgac

SEQ ID NO: 550581 - DNA, 85 bp, Homo sapiens
gcttccagcatggactgctcccgggcctcctttctggaactgccttgagaaaggaggacccctcctgagcaaccacatgggaagc

SEQ ID NO: 550582 - DNA, 85 bp, Homo sapiens
gctctgtgccccctggtgtctatgagagtgggctttgctggggtgggcagcctgaagcccattctgaggctccagggggacaagc

SEQ ID NO: 550583 - DNA, 85 bp, Homo sapiens
ttatagaattggaaatgcaaggagaagaagggaccactctggatcttacatttggtcccaagatcttgcagttctggctttgtaa

SEQ ID NO: 550584 - DNA, 85 bp, Homo sapiens
cctgggggtcactgccaggcctttgtcctggcgtttatggcatgcacagtgcctgggctccaggacagggtgcggggcccccggg

SEQ ID NO: 550585 - DNA, 85 bp, Homo sapiens
gcctcttcctgagacttccgccagccccaggacccacagggcaggtgacagaggggtgggtggaggtgtctccaggagagcaggc

SEQ ID NO: 550586 - DNA, 85 bp, Homo sapiens
gagggtccagtcccaggcgtgcatgggtagaggctgggtacattcctatcagccttcctcgggcacccctcctggctgccccctc

SEQ ID NO: 550587 - DNA, 85 bp, Homo sapiens
agttttttcttcagcaagtaaatcttcaactatacagtattaaagtatttttatattgttgaaactacttgttggagagaaaatt

SEQ ID NO: 550588 - DNA, 85 bp, Homo sapiens
cagacaggaaaccccaccccagggcctgcagtgggacaggtgtggccgccctccacccccacacaggcctcggggagggtgtctg

SEQ ID NO: 550589 - DNA, 85 bp, Homo sapiens
agctgttggaggacattaggaagggaagggaaatgattggatttgcatttagaaagttaaggccttccaagtgccttctgcagct

SEQ ID NO: 550590 - DNA, 85 bp, Homo sapiens
ggcacttgggaatggcaaggaaaccgttaccattactgagtttagtaatggtaatggttctcttgctatacccagaaaacgtgcc

SEQ ID NO: 550591 - DNA, 85 bp, Homo sapiens
gttttcttctgggtccctttgctgttgatgatgtgatacagacagttgctgtggacgtcattaaagcagtggacaagaagcctgc

SEQ ID NO: 550592 - DNA, 85 bp, Homo sapiens
ggcctgggggttttctggtccctgtttggttcaacttgcaaaatggggctgttggactagacaacttatcagaaggcatagtgct

SEQ ID NO: 550593 - DNA, 85 bp, Homo sapiens
ccatccctgagcccctttctaaccatgctgtaccacactgctgaccatatcgtgggatgtccatttggaatggggctggggtcgg

SEQ ID NO: 550594 - DNA, 85 bp, Homo sapiens
aggatatgtggggcagagagcaagaagtatcacccatccctgggacccagatactattctatgctttttggaccccccgttttct

SEQ ID NO: 550595 - DNA, 85 bp, Homo sapiens
agcctgcggttccaacaggcgtctgtctacgtggcttcaaccaagttcaaagtcacgcggagagatggctttggaaccaggggct

SEQ ID NO: 550596 - DNA, 85 bp, Homo sapiens
ggcagtagttatcacagtgtctgtatttattaaacaagcatgaatatgctggtcatcgtgtggcaggcactgttgtaatcacttc

SEQ ID NO: 550597 - DNA, 85 bp, Homo sapiens
agcctcggggttgtgagctgggggtgggcagaggctaggtcagcttggtctggggcgcccgccttgaggtttgcattctggggct

SEQ ID NO: 550598 - DNA, 85 bp, Homo sapiens
atgagctaaaatggcacagtagacagtgagccaccaggagagtgagtgctcctgggcttcactaactgtgctgcttccagctgat

SEQ ID NO: 550599 - DNA, 85 bp, Homo sapiens
aggtcacagtttaatcaaagaactgggtgtttgccttgcactggtatataccacccagttttgcttgatgttgggctgtagacct

SEQ ID NO: 550600 - DNA, 85 bp, Homo sapiens
atagcccagaagtttggtttttggtcaccttggaaactcctttggagattcttgggatgatttgggaggaaaaaaagggggctgt

SEQ ID NO: 550601 - DNA, 85 bp, Homo sapiens
aaccgataattattgagcactgactctgtgccaggaacatgtacaaagtacctggcacagagtaagtgctcaataattgttagtt

SEQ ID NO: 550602 - DNA, 85 bp, Homo sapiens
tctgctcggtttccaccatgtggctcagcaacaaagcagccatgacacgtgttgccaagaccatgtgttgggagccaggagtaga

SEQ ID NO: 550603 - DNA, 85 bp, Homo sapiens
ccagctccccagctccctgctccaaggctgcagctacctccggctttccgggctggagcccaggcagctgggagcctgggagtgg

SEQ ID NO: 550604 - DNA, 85 bp, Homo sapiens
cagaagcctgggagtctgggtttcatgggcactggctctctgccatatcagccggtcccatcttaatccaagcatccagggactg

SEQ ID NO: 550605 - DNA, 85 bp, Homo sapiens
gccgggcgttctagctacccttggtacagcaggcaccaggccctggcagaagcaggctgggctgggggtggctggcagccctggc

SEQ ID NO: 550606 - DNA, 85 bp, Homo sapiens
agccctgaacggaggtatgggtgagagagaggcggtggctgagggaggaaagctgtcttttcactggtgccttcttgttagagct

SEQ ID NO: 550607 - DNA, 85 bp, Homo sapiens
tctcatgatgtgaccatctggaggtaagaagcactttgtgttttgtgaaagaaagtgcttcctttcagagggttactctttgaga

SEQ ID NO: 550608 - DNA, 85 bp, Homo sapiens
ggttgacttctggaatggtcactagggaaggggcgccagaggtgcagccggtgcctctgacccttttggtcgctaggagtcagcc

SEQ ID NO: 550609 - DNA, 85 bp, Homo sapiens
gcttgaagagtcacttggctcatgtcttgatatcccagaaatctcaaaggcatctggggagggctgagccaagtactttttctgc

SEQ ID NO: 550610 - DNA, 85 bp, Homo sapiens
tctcaagctgtgactgcaaagggaagccctttctgttgtctaaaagaaaagaaagtgcttccctttggtgaattacggtttgaga

SEQ ID NO: 550611 - DNA, 85 bp, Homo sapiens
ataggaagaaggagggagtaactgatggtggaaaagagacagttacctaaattttaccgtcaggctatactctccttctgtctat

SEQ ID NO: 550612 - DNA, 85 bp, Homo sapiens
gtagaaacgcaaaaaggaaaacagatgggcaatatccagtaagaaaattttgctcggtattgcccatctgcttctctctgcctgc

SEQ ID NO: 550613 - DNA, 85 bp, Homo sapiens
taattcaaatgcccataccatagatacctgttcttgatgaacataccttgaggagcaagtatctgtgatttgggtatttgaatta

SEQ ID NO: 550614 - DNA, 85 bp, Homo sapiens
agattcaggctcaggacccagtgagagaaggagacaggtcctaaattgctatcacttcctattttgctggggagagctctaatct

SEQ ID NO: 550615 - DNA, 85 bp, Homo sapiens
atgtggagcgagagagagggatttaatgttaattttaaatattaaatcctctattaatattaaattcctctctctcgttacacat

SEQ ID NO: 550616 - DNA, 85 bp, Homo sapiens
tgtgggagctaagtagaaatgcagaacctgatttaggggacacagcattgagcctcaggttctacaattctaccaggttctcata

SEQ ID NO: 550617 - DNA, 85 bp, Homo sapiens
gtgtgtgaggttctgactcagggagcagctctgtgtctgcctcatccccaacatagctgtttcttgagatttgggccttccacat

SEQ ID NO: 550618 - DNA, 85 bp, Homo sapiens
tgggtggccaggagggttgaggattggaacttggaaccaaagtctctgaaataaagttcgaatcaatcataccctctggttccca

SEQ ID NO: 550619 - DNA, 85 bp, Homo sapiens
caggaacatagggcgacacccaccttcagtctgttggaaggaaatctgacctgaagaaatacagggtgttggactatgttacttg

SEQ ID NO: 550620 - DNA, 85 bp, Homo sapiens
gctccagtacatggcattaactcctaaagtgtggacttcaggagtttaactccacacttttggagttagtgccatgtacaagagc

SEQ ID NO: 550621 - DNA, 85 bp, Homo sapiens
gatgttaaaatgggagtttttagtaacttgcagcaacctttaagatcaggaggctgttgggagttgctggaagtcccttgatatc

SEQ ID NO: 550622 - DNA, 85 bp, Homo sapiens
agaatagcactagttaattttatctatttatgaatacacatccttatgtcttctttataaatagtaatgctaactgtgctgttct

SEQ ID NO: 550623 - DNA, 85 bp, Homo sapiens
gttttttccatggtctattactcacaccttatttaccttctgctagactttgaaggtgcaaggatgagtaggctgtggaaattac

SEQ ID NO: 550624 - DNA, 85 bp, Homo sapiens
agttattccacccaggcaattttctgttgcattagatacaagtctatgtgattatgtaacagaaaattgactctgcaaaataact

SEQ ID NO: 550625 - DNA, 85 bp, Homo sapiens
gactggcactgatgcctttgatttgagtaaaagacccatcatttgggggagtcttttgttagaatcaaaggcatctgtgtcagtc

SEQ ID NO: 550626 - DNA, 85 bp, Homo sapiens
gctactgacaagggtgtgatctgatttgaagggtttatttctggtaaatcagcattctgtcaggttaactcttgtcctcagaagc

SEQ ID NO: 550627 - DNA, 85 bp, Homo sapiens
ctcaagctgtgactctccagagggatgcactttctcttatgtgaaaaaaaagaaggcgcttccctttagagcgttacggtttggg

SEQ ID NO: 550628 - DNA, 85 bp, Homo sapiens
gaaactctgccaaacacttcacaggataatgcttcggaactggtgtcataggagcattatcctgtaaagtgctggactctgtttc

SEQ ID NO: 550629 - DNA, 85 bp, Homo sapiens
tagatttacggatgtactgcagggagagcaaaggatttttaatttttttcttcctttattgctcttatattgcatctgttctctg

SEQ ID NO: 550630 - DNA, 85 bp, Homo sapiens
gctaagcacttacaactgtttgcagaggaaactgagactttgtaactatgtctcagtctcatctgcaaagaagtaagtgctttgc

SEQ ID NO: 550631 - DNA, 85 bp, Homo sapiens
taaactttttgaggtcaccaaggtaccatgaagtaaattattgccccacagttctaaatggtacctagtagccaggaagagttta

SEQ ID NO: 550632 - DNA, 85 bp, Homo sapiens
tttgatagcaaaagcttgtaaatgtgtgtgtggtaaggggtaaagtggagttctacacacaaattcacaagcttttgctgtcaaa

SEQ ID NO: 550633 - DNA, 85 bp, Homo sapiens
ggaagaaagaacatctacagaaacagcggcaggttctatctgaaaggcaagcctgctgcatgctctgtgtgatgagtctccttcc

SEQ ID NO: 550634 - DNA, 84 bp, Homo sapiens
tagtaataagaaagatgagctcattgtaatatgagcttcatttatacatttcatattaccattagctcatcttttttattacta

SEQ ID NO: 550635 - DNA, 84 bp, Homo sapiens
tagctgaaggcattattccacagctcagaattttttttcatctggaaagtagtaatctcaattgtgaaatagtgccttcagctg

SEQ ID NO: 550636 - DNA, 84 bp, Homo sapiens
gggcagtgaagagaggggaaggagtggtgtctttatattgagatattttgagattcctgctttctccactcacttcaactgccc

SEQ ID NO: 550637 - DNA, 84 bp, Homo sapiens
gtcatccctggattggtcacctctgctgctatcagtcatgaagactatcctgctgatgaaggtgaccagatctccagtaatgac

SEQ ID NO: 550638 - DNA, 84 bp, Homo sapiens
tcaaaccctactgtcatctaaaaggggaatccctttccttgtaggtgaaaagggattctccttttatatggcagtagggtttga

SEQ ID NO: 550639 - DNA, 84 bp, Homo sapiens
ggcgcggcccggtgggctttgtgccccgggtgccccaccgcccgcgcccctccgggcatctggcccacaaagcccgggcctgcc

SEQ ID NO: 550640 - DNA, 84 bp, Homo sapiens
gcctcactccaccaggccctgggggagatggaggaaaggaaaagtcttctccattttccaccagagctgcagaaggagtttggc

SEQ ID NO: 550641 - DNA, 84 bp, Homo sapiens
gggcagtgaagagaggggaaggagtggtgtcttcatattgagatattttgagattcctgctttctccactcacttcaactgccc

SEQ ID NO: 550642 - DNA, 84 bp, Homo sapiens
tccttggccacctcatgcccatcccggccatctagggtcagcacaacccagatgaggccgctgaagggcaccggatgcccagga

SEQ ID NO: 550643 - DNA, 84 bp, Homo sapiens
gcctgagtttctggctggagtggatgatagaggtggatggggaatgacatacagctcgtcagctactgtaggtgtgaaataggc

SEQ ID NO: 550644 - DNA, 84 bp, Homo sapiens
tcaggtttcctttctagtctgtatatgcctgtgtgtgcccatctgcagactgtaggacatgactcactggaaaaagaagcctga

SEQ ID NO: 550645 - DNA, 84 bp, Homo sapiens
ggctcctgctgtccaggcttgggccctgcgtgtttccggcaggggcagccaagaagcaggtggggctgttgggactgcagggtc

SEQ ID NO: 550646 - DNA, 84 bp, Homo sapiens
aaatttctgcctggaatccctgatgtagtgtctctgctccctcctttctggcacagagacaggaataattccaggtaggaattt

SEQ ID NO: 550647 - DNA, 84 bp, Homo sapiens
aggctgggtggggcctgggcccaggcagctctgtgggaagccgctggatctgagctgggctggctcaggcccttacatggcact

SEQ ID NO: 550648 - DNA, 84 bp, Homo sapiens
ctttcccgcttccccgcctcccctctgcccaccgctggatctgtttaaactagccgagcagggtgaggtggggaggcggcggag

SEQ ID NO: 550649 - DNA, 84 bp, Homo sapiens
aatgagcatcagctgtgtgtgtgtgtgcaatgggtgtctgtgtatataaacacccacacgcatttatatacagttgatatcatt

SEQ ID NO: 550650 - DNA, 84 bp, Homo sapiens
tgaaagttcactcgaagcctatctctattaattcagagcccggctctccgaattaaaaagagataggcttcaaatgaactgtca

SEQ ID NO: 550651 - DNA, 84 bp, Homo sapiens
gctgacccttttattttgtgttcttctagtgtatgcgtgcacacatgcatgcatgtgtttgaatggaagcacttaaggatcagc

SEQ ID NO: 550652 - DNA, 84 bp, Homo sapiens
tctcagtctgtggcactcagccttgagggcactttctggtgccagaatgaaagtgctgtcatagctgaggtccaatgactgagg

SEQ ID NO: 550653 - DNA, 84 bp, Homo sapiens
gtttggaataccgggttttggatctatttgatcaattaattctctttgagtaactgatcaagttcctaatcctgtgcctcaaac

SEQ ID NO: 550654 - DNA, 84 bp, Homo sapiens
accttgggcagatcgtttaacttctctctgctttacagttacaagcggtaatacaaagagacaggattatatgatctccaaggt

SEQ ID NO: 550655 - DNA, 84 bp, Homo sapiens
ccatgtctagtccaacatcataacctcagctcctagcacaatgcaagcaggctgaggttatggtgttagactagacagaaatgg

SEQ ID NO: 550656 - DNA, 84 bp, Homo sapiens
agtatgcaggtgagcttcctcgtgtggacccaacccagcccttccacggaccaggctccacatgagaggctgtacctgtttgct

SEQ ID NO: 550657 - DNA, 84 bp, Homo sapiens
gccctcccctcatgttcagggaagaccagctgcttcctgtttgtgtgaagaattcggctgttttcccgagtggtgggtgagggt

SEQ ID NO: 550658 - DNA, 84 bp, Homo sapiens
actgagatgcttgaagagatggatgtgcacacggatgaatttcagcggtgcaacttttcatcatcaacctctttgagcctcagt

SEQ ID NO: 550659 - DNA, 84 bp, Homo sapiens
tcaggccaaaccttagtggtcattgttaaggtcacacagccatcgcctgaaggtgacctgacagtggcttctggttttacccga

SEQ ID NO: 550660 - DNA, 84 bp, Homo sapiens
caaccaaggtacagcacgcactaagtgtatgccaagctgacaaccatgcttggcatatacttagtgcatgctgtaccctggttg

SEQ ID NO: 550661 - DNA, 84 bp, Homo sapiens
tctgcagttggaacagatctgtgattatgtcagggatcagctatcagacccctgacatggtgacagatctgttctaactgcaga

SEQ ID NO: 550662 - DNA, 84 bp, Homo sapiens
tcaggcctgggctgggctgtgtgtctctgttttggaccgttgccctggtccttggcagagagacactcccctttctgggcctga

SEQ ID NO: 550663 - DNA, 84 bp, Homo sapiens
gctcttcctctctaatcctttgtccctgggtgagagtgctttctgaatgcaatgcacccgggcaaggattctgagagggtgagc

SEQ ID NO: 550664 - DNA, 84 bp, Homo sapiens
aaatggcaaccgcatccttggttgattttctggggcttgagccgcacaggcttaagaaaaacagtcatcctgcggtttccattt

SEQ ID NO: 550665 - DNA, 84 bp, Homo sapiens
gaggctgaggagctggcccaaggctttgggggctggatttgtgcctcacccagctcctgccttgtggctgtctccacagtcctc

SEQ ID NO: 550666 - DNA, 84 bp, Homo sapiens
tcctgggaaagttggacttgaattggcactgagtccttccctcgtttggattcagatggggtttgagtcctagattcaccagga

SEQ ID NO: 550667 - DNA, 84 bp, Homo sapiens
gcttctccttcatgcgcttttcaggagtgttttagggctatatttgctgaggatacattcctgaaggtaatgagaaatggaagc

SEQ ID NO: 550668 - DNA, 84 bp, Homo sapiens
gtggcagcttggtggtcgtatgtgtgacgccatttacttgaacctttaggagtgacatcacatatacggcagctaaactgctac

SEQ ID NO: 550669 - DNA, 84 bp, Homo sapiens
taagttatatatttctacctccacctgtatcatcatgacacctttattatgataacacaggtagaagtagacatatataactta

SEQ ID NO: 550670 - DNA, 84 bp, Homo sapiens
ttccttgagtttaggtgaattctagggtcaatattacaagttttgactttgtcatgctctagaataaacctaaatttttaggga

SEQ ID NO: 550671 - DNA, 84 bp, Homo sapiens
cggccctctcccttcactcatcctcacggaggacctgaaagatggacctgctgtgggaatgggaatggggaagaagtggggccg

SEQ ID NO: 550672 - DNA, 84 bp, Homo sapiens
cctggtgtcagttccacagccttttgtgaaatttgccacacgaattggcagaatcctaagaggctgctgggaaagttaaccagg

SEQ ID NO: 550673 - DNA, 84 bp, Homo sapiens
gttttcctaagagtctttttaaagctactactaaacagaaagagtagctctttagtagtagcttgaaaaaactcgtaggaaaat

SEQ ID NO: 550674 - DNA, 84 bp, Homo sapiens
aattgaaacagaaagcaagccattcactgtcacctataactcttggttaacagggaatggctttgctttattggaaagacagtt

SEQ ID NO: 550675 - DNA, 84 bp, Homo sapiens
tgggctttggagatgtaggcaggtggaggagtgaaggcccaaggatggctcttcagcccttccctgttttcatcagccagccta

SEQ ID NO: 550676 - DNA, 84 bp, Homo sapiens
tcaggcctgggctgggctgtgtgtctctgttttggactgttgccctggtccttggcagagagacactcccctttctgggcctga

SEQ ID NO: 550677 - DNA, 84 bp, Homo sapiens
ggtagttgctgggggcttctcttgctgggctggtttagtgcttccctgagtaactggcccgggagcagaggcctgagtaatgcc

SEQ ID NO: 550678 - DNA, 84 bp, Homo sapiens
tcctcttctctaatgcaaaaagaaaacattcttgttccattgatgttggacttgactgtgttccttgcattggagtatgagtga

SEQ ID NO: 550679 - DNA, 84 bp, Homo sapiens
actagttagtagtataacttgctagttatactacttaccagttacacttgctagtataactagtaagttatactatttactagt

SEQ ID NO: 550680 - DNA, 84 bp, Homo sapiens
ggcttcagattgcttaatgctcgcatggcaaagccacttactgagactggcagcctccattccaccatctagtgatctgaagtc

SEQ ID NO: 550681 - DNA, 84 bp, Homo sapiens
gagaaggggtggcctgcattttttttcatgctcaaagcatgcttgtgagtattgggagaaatgagtgctattcaggcccttctc

SEQ ID NO: 550682 - DNA, 84 bp, Homo sapiens
gatgcacccagtgggggagccaggaagtattgatgtttctgccagtttagcgtcaacacttgctggtttcctctctggagcatc

SEQ ID NO: 550683 - DNA, 84 bp, Homo sapiens
gtcactgcccttttatccccggcacccgggctgtggggtgaccctgggtgacagctctggggccgggatgagaggaacagaggc

SEQ ID NO: 550684 - DNA, 84 bp, Homo sapiens
ggctgacagccataggggagggcctctgacacccccagcaatccaccagtgggtatcagaggccctcctctatggctgtcagcc

SEQ ID NO: 550685 - DNA, 84 bp, Homo sapiens
attatagcttctgttccatgacctgcctctgaacccaagcctcttggattctattcagagccagggaatggggtgacctataat

SEQ ID NO: 550686 - DNA, 84 bp, Homo sapiens
gccccacgtcctgtccctgtccctgcccctctggggcccatccagaccacactggggccaggggccaggggagggggagtgggc

SEQ ID NO: 550687 - DNA, 84 bp, Homo sapiens
gtcatttgcttttcctctctcccacctgaagccctgagtaagctcagagggttgagggtgggagtgggaaaccaggcaggtgac

SEQ ID NO: 550688 - DNA, 84 bp, Homo sapiens
cgccgccggcgccgtctgtcggcagccgccctgggcctaggccgcagggtccacaggcggccctgacaggcggcggcggcggtg

SEQ ID NO: 550689 - DNA, 84 bp, Homo sapiens
gagtgctttctagcaggtagatgttatatcatggcagaattctctttacagcctaactcagcatcttgcttgttagaggtgctc

SEQ ID NO: 550690 - DNA, 84 bp, Homo sapiens
ggcctgagtccttgtagactctgagtacggtgctgagcagggaagagacaggctctggcttagggtttagaaggaacacaggct

SEQ ID NO: 550691 - DNA, 84 bp, Homo sapiens
ccaattatattcagcaatattgttcccccagcctgttgggtcacgtaacagcctgagagaacaatgatgctgaattaacgattg

SEQ ID NO: 550692 - DNA, 84 bp, Homo sapiens
gtgtttgttcgatctttccatctcctcattgtttctctctaaatagagagagagagatgagggcagaggaggaattgcaatcac

SEQ ID NO: 550693 - DNA, 84 bp, Homo sapiens
gcaggataagtgagccgatgctgctccttaatcagggacatcgaatcggaggccctgggaggagcagccggctggctgccctgc

SEQ ID NO: 550694 - DNA, 84 bp, Homo sapiens
gcaatgtgtttccatagacctctattttctctgagtaagcaaccactagggagagataagggtcatgtgtcatatacacagagc

SEQ ID NO: 550695 - DNA, 84 bp, Homo sapiens
tcccgttgcatggcccaaggaggaggaaagggaagtgccctggctggtggaggtgcttccctttcctccccttactatggggga

SEQ ID NO: 550696 - DNA, 84 bp, Homo sapiens
gcctgtcccctggtgaccctgaggatgcaccagcagggctcctgcttgctgtggcatctcagggagctagaagaataaacaggc

SEQ ID NO: 550697 - DNA, 84 bp, Homo sapiens
ttccttgagtttaggtgaattctagggtcaatattacaagttttgactctatcatgctctagaataaacctaaatttttaggga

SEQ ID NO: 550698 - DNA, 84 bp, Homo sapiens
cttgctggtggggtaggatgtgttctcgttactagtaattcttggaacagaaaacgagaaaacatatccgtctccacgtgtggg

SEQ ID NO: 550699 - DNA, 84 bp, Homo sapiens
ggggcccctggtgctgctgtcctctttgcttggtctgatgggagaatgggagggcagggaggaaggccctgtgccagggctccc

SEQ ID NO: 550700 - DNA, 84 bp, Homo sapiens
gctcttctcctttcagctgttaaccgaccaagtacatctttaatttccaagaccgatggtgtggtagcagttgagaggaagagc

SEQ ID NO: 550701 - DNA, 84 bp, Homo sapiens
gcagggcatgttggaataaatacagggtttggtattaagaaagcaaacaaacctagtactggttctggcatttattagctctgt

SEQ ID NO: 550702 - DNA, 84 bp, Homo sapiens
gtctcctctgtgtgtgtcctgcactaaatgcccaaatcccagcatgggacataacgcagtgagtgacacaggcagagtccaggc

SEQ ID NO: 550703 - DNA, 84 bp, Homo sapiens
tcttctccccagcagtctttgggccactataatcagagccaagattttaaccttggctgcgtagacagactctttgggagaaga

SEQ ID NO: 550704 - DNA, 84 bp, Homo sapiens
gggcctttggcctcctgaagtttatgcttttcgggtcttaaaggatgctggaccccgagagttggactccagagctaaaggctt

SEQ ID NO: 550705 - DNA, 84 bp, Homo sapiens
gggccattctcctctcactttgaaaatagactgttttgtggacagtaaagtacagttctttttcacagatgagattagaggctt

SEQ ID NO: 550706 - DNA, 84 bp, Homo sapiens
ggcccacagtgacctccatctccctccctctgccccccaccacaaccagggcggtgggagtaaggggagtgtgctctggatgcc

SEQ ID NO: 550707 - DNA, 84 bp, Homo sapiens
gagagctcaaggactacaactcccagtgtgcaccacaattgctttgtatgtaccttgggagttgtagtcccccttgagaagctc

SEQ ID NO: 550708 - DNA, 84 bp, Homo sapiens
agcgacgccctctgccccgcaggaggagaagaaggtccctccgccgataccaaagaagcccctgcggggccggggcgtgccggt

SEQ ID NO: 550709 - DNA, 84 bp, Homo sapiens
caggagagaagtttctaaaggaggcagtatagattgttgcaactgtttcttaaactagctgcctgccttgaggtttttctcctg

SEQ ID NO: 550710 - DNA, 84 bp, Homo sapiens
gtggtcgaggcaagactctagcagggcagttgggagccatggagggtttcagcctcccatgcctctggggtcatctctggccat

SEQ ID NO: 550711 - DNA, 84 bp, Homo sapiens
ccctgtccacctcacctccctcccctctcatccatcgtcagccatggctcaccgggacagggcaggggaggtgggagggcaggg

SEQ ID NO: 550712 - DNA, 84 bp, Homo sapiens
ctcctcattacttggacctgggaactgcttacctgtggctgctgccaccaagaagaggatcttgcaggtccagcccatgaggag

SEQ ID NO: 550713 - DNA, 84 bp, Homo sapiens
tggagcccacccatctcaagggcagtccctcccagatcctgcctggatgtttggagagggctgatagggagtgacatggctccg

SEQ ID NO: 550714 - DNA, 84 bp, Homo sapiens
ttgcatacttcaccagttgtggttggggttggacacctgtggggaccaccattgccagttttaggcaaagctgtgaagtagcag

SEQ ID NO: 550715 - DNA, 84 bp, Homo sapiens
gctccccctctctaatccttgctacctgggtgagagtgctgtctgaatgcaatgcacctgggcaaggattctgagagcgagagc

SEQ ID NO: 550716 - DNA, 84 bp, Homo sapiens
gtgttttggtagggggagggagggacttttgtggatgatgcagaagaatcagcaacgtccttccccacccccttgcagaatgac

SEQ ID NO: 550717 - DNA, 84 bp, Homo sapiens
tctcatgcagtcattctccaaaagggagcactttctgtttgaaagaaaacaaagtgcctccttttagagtgttactgtttgaga

SEQ ID NO: 550718 - DNA, 84 bp, Homo sapiens
gtatttatgtaagaatcatatttctctctgtgcagatcacttacagaagtgtctgttaacaggagagaatgatacataatcagc

SEQ ID NO: 550719 - DNA, 84 bp, Homo sapiens
caagacggagggcgcggaaggaggcggggcggggggctttgcctggtcaccttgtcaccagccccctccgtgtcctcagatgtg

SEQ ID NO: 550720 - DNA, 84 bp, Homo sapiens
gctggcaaagaggtagacagtaaccattttatgaaaggggaactaatgctttacaaaatgattactgtttacttctttgtcagt

SEQ ID NO: 550721 - DNA, 84 bp, Homo sapiens
ggggatattggtggagaggggagtgggggagtagaagcccgattttctctgccttcctcttcactccctcctactgaggacccc

SEQ ID NO: 550722 - DNA, 84 bp, Homo sapiens
cccagtgcagggatggcagcaggagaaggtgccctcatgcaggagctgtgggcagctcctcctgtcatctgtctttgcccaggg

SEQ ID NO: 550723 - DNA, 84 bp, Homo sapiens
tggaagcaagtaactaaaggccaaagttttcaggctaaaaaacaacattgagatgagaactttggctttatttacttgcaacca

SEQ ID NO: 550724 - DNA, 84 bp, Homo sapiens
gctccccctcttgaatccttggaacctaggtgtgagtgctatttcagtgcaacacacctattcaaggattcaaagaggctgagc

SEQ ID NO: 550725 - DNA, 84 bp, Homo sapiens
tgtatgtgtatattttcttgtatcatactgcctataagtacgtaatcccacaggcagtatgttacaagtaaatatgcacatata

SEQ ID NO: 550726 - DNA, 84 bp, Homo sapiens
tgagctatcccctgccttggctggcgccgggctagccacacctgtttgccatcagggctgtctcggcccagccagtatggctca

SEQ ID NO: 550727 - DNA, 84 bp, Homo sapiens
ttgacttagctgggtagtggggaacccttccatgaggagtagaacactccttatgcaagattcccttctacctggctgggttgg

SEQ ID NO: 550728 - DNA, 84 bp, Homo sapiens
gcctgcttctgtgtgatatgtttgatattgggttgtttaattaggaaccaactaaatgtcaaacatattcttacagcagcaggt

SEQ ID NO: 550729 - DNA, 84 bp, Homo sapiens
aggtactgaggtcccatcaatgactaataaaatagcccccacatggtggctgttttattattcatttgagggacgtcagtacct

SEQ ID NO: 550730 - DNA, 84 bp, Homo sapiens
ggtgagtgggttggtgacaactggtttggaggcttttgtgggggactgtggtgtcttttggattgtgtcatcagctccttcatc

SEQ ID NO: 550731 - DNA, 84 bp, Homo sapiens
ttcttgtttttagtagggtgttcaaatgtgccttttctaacaaagagacatttgaggagagccctactagatgaaaggcaggaa

SEQ ID NO: 550732 - DNA, 84 bp, Homo sapiens
ctgtgtacctgggcacaggtgcacacacaggagtaaacaggcacctgcatggaccctgtgtgtacacctaacctacacacacag

SEQ ID NO: 550733 - DNA, 84 bp, Homo sapiens
gtgaaggttgtgcccacaggcacgactggtttggcaattcagtaaaaatgctcaaaccggctgtgcctgtggacgcagcccagc

SEQ ID NO: 550734 - DNA, 84 bp, Homo sapiens
gagctggttctggagggtgggtcagtgcacccgaggctcagagcatccatccaccccactggccctccttccagataccctctc

SEQ ID NO: 550735 - DNA, 84 bp, Homo sapiens
atttcctgaggattaatgatcaactggaagagcttgtggtcctgggaccattaactccatgtggtcattaattttgttggaaat

SEQ ID NO: 550736 - DNA, 84 bp, Homo sapiens
gtcctagtagtaccaaagtgctcatagtgcaggtagttttggcatgactctactgtagtatgggcacttccagtactcttggat

SEQ ID NO: 550737 - DNA, 84 bp, Homo sapiens
tcaggagctggaatggggcccagagctctcaagcctctgctcacccgcttgggactggcccttggctccaggccagctccctga

SEQ ID NO: 550738 - DNA, 84 bp, Homo sapiens
tggctgagtcacatggagttcagatcctgtgcctagtgcaggaacacaccagccacagatttgaccactccagagacttaccca

SEQ ID NO: 550739 - DNA, 84 bp, Homo sapiens
tgtgatctctttgctgttctcttcctacaatggtgcctcccagccaatgcccacttgtaggaagagaactgcaaagagatcaca

SEQ ID NO: 550740 - DNA, 84 bp, Homo sapiens
gaagcaggcctcacctgatttccacccacctgtatcacttttagtaaatggtgcagggatggaaataagcgggggaaccagctc

SEQ ID NO: 550741 - DNA, 84 bp, Homo sapiens
gcaatctgggagtgctttctggagtctgataagaacatactggcacattgcctgtgacgtgtgggacccaggcattttcagtgc

SEQ ID NO: 550742 - DNA, 84 bp, Homo sapiens
tctggagacctgggtgtgggtcaagcaaccaggtaatctgagttttggcactttggaaagcttgatctgacgctccttttctaa

SEQ ID NO: 550743 - DNA, 84 bp, Homo sapiens
taaaatagggctgccgtccttgaattgatcagcacattgagaatgtggcattagattaattcagggaatgcagtaaagattttg

SEQ ID NO: 550744 - DNA, 84 bp, Homo sapiens
cctgagattggaggaaggagccagttctactctcagcttctcttctccctggagaggaggtgagaagagaaagggcttctcagg

SEQ ID NO: 550745 - DNA, 84 bp, Homo sapiens
tactacatttcccaggaggcttcgcggtgagcctccgcactcggctggttctctttaccgcgaggaaagctgggaaatgtagtg

SEQ ID NO: 550746 - DNA, 84 bp, Homo sapiens
ggatcatctccaaattctaggatttctcaggtgtagaagatgaagcaggatacatttgagaaatccgcaggataaggagtgtcc

SEQ ID NO: 550747 - DNA, 84 bp, Homo sapiens
gctgctggccgccgcccagcgcccccacctgggcgagcagcgcctcaaagctgagggggcctgggggcacggccagcgacaggc

SEQ ID NO: 550748 - DNA, 84 bp, Homo sapiens
gttgtgaaatgagggagaaaggaaggaacaggggtccgggaagagtaactgtcttgttctcatctttcttcttttccttgcagc

SEQ ID NO: 550749 - DNA, 84 bp, Homo sapiens
cacttttcatcttgtagcttctcaagcaaggttactcaagaaagagttgctgggtgtgctagaggctacaaagaattacaagtg

SEQ ID NO: 550750 - DNA, 84 bp, Homo sapiens
tctcactgtcctctggagtggtctttctctcaactcctagaaaaactaaaagcacagagaagccactttcagagaaacagtgga

SEQ ID NO: 550751 - DNA, 84 bp, Homo sapiens
gaggagggatagcctggtctgggggagaagaggaactgggttctgtctctctctcttacctctatctttatctttcttatcctc

SEQ ID NO: 550752 - DNA, 84 bp, Homo sapiens
gacactggggttgggcgtggccgcaggggcccagggttttcagcccctccatccttccctgcaaccccttcctgaccccaggtc

SEQ ID NO: 550753 - DNA, 84 bp, Homo sapiens
gttagggaccagctccaggggaagggagactggaaggagagccacagccttcccctgaccttctgcctgtagatggttcctgcc

SEQ ID NO: 550754 - DNA, 84 bp, Homo sapiens
tgtgtgtgtatggactcaggtctggccatctgtactcatctgtgaatataagtatagtcagtcatacctgagtccacatgcaca

SEQ ID NO: 550755 - DNA, 84 bp, Homo sapiens
cttgttttgcagcccgggaaactgaggcacagagctacagaggttctcacctggtgtctcagaggtcctgggggtggaagcagg

SEQ ID NO: 550756 - DNA, 84 bp, Homo sapiens
atcctgggtctgtgctcttggcctgctgttcagggaatagcatgatctccatgctggcatttggctggagccttagcctggggt

SEQ ID NO: 550757 - DNA, 84 bp, Homo sapiens
agtccaggggccgcctccctactggcctttgcatgcctgccttagtggagcatgcccaggaggagggaggagcagctggtcact

SEQ ID NO: 550758 - DNA, 84 bp, Homo sapiens
catgcattttaaaaatagatggctttgaatgtgtgagttaatttttagcctcatttgccaaggcctcctaactccagaagcatg

SEQ ID NO: 550759 - DNA, 84 bp, Homo sapiens
gggcagtgaagagagaggaaggagtggtgtctttagattgaggtatcttgagattcctgctttctccactcacttcaactgccc

SEQ ID NO: 550760 - DNA, 84 bp, Homo sapiens
tgccatctgctctgaagcctcccaagctgggcctcccctcccacttctggagcccaggaacagatgtgggaggctgagcaggca

SEQ ID NO: 550761 - DNA, 84 bp, Homo sapiens
ggaaggagggccctttccctcagagcttgaaggcttctctgtatcctatgccaacaagtctggggagaaaaggctaacactttc

SEQ ID NO: 550762 - DNA, 83 bp, Homo sapiens
gtggtctcagaatcggggttttgagggcgagatgagtttatgttttatccaactggccctcaaagtcccgcttttggggtcat

SEQ ID NO: 550763 - DNA, 83 bp, Homo sapiens
gtgggcagctttgctcagaaaggtcagcatgagagacaagaacaaagagatctttcaagctggcctctggcagggcagccagc

SEQ ID NO: 550764 - DNA, 83 bp, Homo sapiens
tccagcatctccagttagcagtactgattttttttccccccaacaaaggaacactacatcaacactgttggcggggacctgga

SEQ ID NO: 550765 - DNA, 83 bp, Homo sapiens
gaaatattagtgtcattacttctaaatggaggggtaagaattgcttcttaccttttaatttagatttaaagaaataatatttt

SEQ ID NO: 550766 - DNA, 83 bp, Homo sapiens
ctggctcccttcctgcgtgacgtaggctggcgtgggctcttcccccagccccttgccggtgctgccacgtgagaagggcccgg

SEQ ID NO: 550767 - DNA, 83 bp, Homo sapiens
gttatcaagagataatcatattctagtggtgctacttattgtacccaatgaaagtcccaaggatgtgattatctcttaataac

SEQ ID NO: 550768 - DNA, 83 bp, Homo sapiens
ggtcccactgagtctcagatgtaaaggattcaaagatgtccgcagacatgaatagagtcgatacatcttgattcagtgagtcc

SEQ ID NO: 550769 - DNA, 83 bp, Homo sapiens
agaataaagagggcatgcttggctcagtcctgtccttcctgtaaagaagggcatggctgagctaagcatgtcctctttatcct

SEQ ID NO: 550770 - DNA, 83 bp, Homo sapiens
gagaatcatctctcccagataatggcactctcaaacaagtttccaaattgtttgaaaggctatttcttggtcagatgactctc

SEQ ID NO: 550771 - DNA, 83 bp, Homo sapiens
gtgtctggcatacagtaggtgctcagtaaatatttgttagtcaaatgaatgaattgtgagctctgactgtgtgcctggtacac

SEQ ID NO: 550772 - DNA, 83 bp, Homo sapiens
ccatgtaaatacagatttaattaacatttgcaacctgtgaagatgcaaaactttaagtgttaattaaacctctatttacatag

SEQ ID NO: 550773 - DNA, 83 bp, Homo sapiens
ctccctcaaattggctccatttcagacccccaagaccaagaaagcattgaaaggggagtcctgaaggaaccatttatatggag

SEQ ID NO: 550774 - DNA, 83 bp, Homo sapiens
tcatgctgtggccctccagagggaagcgctttctgttgtctgaaagaaaacaaagcgctcccctttagaggtttacggtttga

SEQ ID NO: 550775 - DNA, 83 bp, Homo sapiens
tgtgaggccctggttggacacatgtcctcctcctgtcccttcagatggtgagtctggaggaagacttgtgttggacccccaca

SEQ ID NO: 550776 - DNA, 83 bp, Homo sapiens
gggctggggtagaagtgaggtggagcatggagaggatgtcgaagcctccgtgcccatccactcctctttctcagaaccagccc

SEQ ID NO: 550777 - DNA, 83 bp, Homo sapiens
acctctcacaaattggcaatcgtctccatttttacaccctatatggaatgcaaaaatagaggggattgtcagttctatgaggt

SEQ ID NO: 550778 - DNA, 83 bp, Homo sapiens
agagccagtggccctggattcacatcccttactggtcccattttacagttaaggatactgagggtgagtctggggccagctct

SEQ ID NO: 550779 - DNA, 83 bp, Homo sapiens
tactctctatctgatctcttttgtgctgttaggattttactcacttaggtaaatgaaatcagctgggagttgggtagagagtg

SEQ ID NO: 550780 - DNA, 83 bp, Homo sapiens
tacataatttctaccagggccatattagcagtgaaacattttaaactgcagaaattgtggttttggttcagaaacaagttgta

SEQ ID NO: 550781 - DNA, 83 bp, Homo sapiens
ctgccatcctgctcttttatatgtgagaggcattcaggatactttctttctttcttctcacataagaggatccagtgtggcag

SEQ ID NO: 550782 - DNA, 83 bp, Homo sapiens
gcacattatactacttgtaactataaaagatgtaacaaatgatctaagtacatcatttgtagttacaggtagtataagggggc

SEQ ID NO: 550783 - DNA, 83 bp, Homo sapiens
gaggctaagaagcatgggcaaggccatgcagctagtaagtggtggagctgggctgctcctggtctgtctcatgttctttcctt

SEQ ID NO: 550784 - DNA, 83 bp, Homo sapiens
ttgagaagataaaaggtaggaaggcaaaggagaggacagaagatgaacttctttttttgttggctccatgttttctttctcaa

SEQ ID NO: 550785 - DNA, 83 bp, Homo sapiens
ggctgaacagcctcggctccctgatggggcacagttcccgggatgagaagtgcctcctgcaggcggggcggggctggctggcc

SEQ ID NO: 550786 - DNA, 83 bp, Homo sapiens
tcgtggtggtttccttttgtctcctttattacatgggactctgacatgtgcccatagctagggtgacagtaggatctacccga

SEQ ID NO: 550787 - DNA, 83 bp, Homo sapiens
ggtcatggtttcccgacagtgcctcctctcctctacctcagacagaaagcaggaggagaggaggcatttaggaaagctggact

SEQ ID NO: 550788 - DNA, 83 bp, Homo sapiens
ggacttgaagtagggtgcacccggaattgaccaatacaaacagtggactgcactggattcttcttgtgccctgtctcatatcc

SEQ ID NO: 550789 - DNA, 83 bp, Homo sapiens
ccttcatattcctttgccatccttacctacagccctggcacctataaaccgagggttggaggtcagtggcaaagtctggaagg

SEQ ID NO: 550790 - DNA, 83 bp, Homo sapiens
tcaggctgtgaccctcttgagggaagcactttctgttgtctgaaagaagagaaagtgcttccttttagaggcttactgtctga

SEQ ID NO: 550791 - DNA, 83 bp, Homo sapiens
tggctctaagtctctgttcttttggaattaggcttctctagcccatggagaggaggtctgtgtgaaaggatagggaagagcta

SEQ ID NO: 550792 - DNA, 83 bp, Homo sapiens
catctgcaaaactcctctctttccatgatcatgttgaaattatctgagcatggttgggaggcagagagggcagtttttaggtg

SEQ ID NO: 550793 - DNA, 83 bp, Homo sapiens
tagggtgtttaggttaattggtgtgatgcatgtttattataaaaagttgttgctgaatgcatgcctgttaacctttaacccta

SEQ ID NO: 550794 - DNA, 83 bp, Homo sapiens
cagggcaaccagccctggcattgcccctacgggtcactcactctggactgaggcccccagggagtgcccagggcaggaccctg

SEQ ID NO: 550795 - DNA, 83 bp, Homo sapiens
ctggagttaagatggaaaaaactggtgtgtgcttattgatgtagccaacaagcatacatcagttttttccaacttaactccag

SEQ ID NO: 550796 - DNA, 83 bp, Homo sapiens
ttcgcatgccctcggcacatcttaattgttactgctcctaattggcccggcactgtcgattatgatgagtcagggatggcggg

SEQ ID NO: 550797 - DNA, 83 bp, Homo sapiens
cgtctccccctttggtttctcctagccccatctggttcgcattgcactcccgcccacggctgggagggctgttgggggaggcg

SEQ ID NO: 550798 - DNA, 83 bp, Homo sapiens
cctgtcattctctaggcagagaggccataagaattacactacctgcgatttttatggtcctttcctgccttaatacttatagg

SEQ ID NO: 550799 - DNA, 83 bp, Homo sapiens
ccagcaggcgtggggccagggacgtcaccaactttaaagagtgactgatagttggcttcgtctttgatcccatagctaaatgg

SEQ ID NO: 550800 - DNA, 83 bp, Homo sapiens
gccattgtcccttttctctatgggtaaggcaagctctttctactatcatctgggttccttgatagagagaagggatagatggc

SEQ ID NO: 550801 - DNA, 83 bp, Homo sapiens
cttcctccctcagcccttcctgatggcttcctggggattctggattcccatggggtgatgagaggagagcagatgggaggagg

SEQ ID NO: 550802 - DNA, 83 bp, Homo sapiens
agatgccttctttccagcaggaattactctgacagcggggctggtgtcatcaagagtaatttctgctgaaaaggttccaatct

SEQ ID NO: 550803 - DNA, 83 bp, Homo sapiens
gaacacctgagcatctctgtttggattcccagttgtaatttttgattctttgggagttctgacagggtcttcaactagtgttc

SEQ ID NO: 550804 - DNA, 83 bp, Homo sapiens
tcatgtcctttacttttttgctcctgtctccagacttttatagtaagtagaggcaggagcatttcagatggtatcagacatgg

SEQ ID NO: 550805 - DNA, 83 bp, Homo sapiens
agctagtccccagaatgcaaatgcttctacttggaatgttctttgactcaacaaggcagcatctgcatattgggagacctgct

SEQ ID NO: 550806 - DNA, 83 bp, Homo sapiens
acaaagctttctgtacataaaggaggctctttgccaagattggtatttgcaaagagaatcctgtgtgtcctgagagcttatgt

SEQ ID NO: 550807 - DNA, 83 bp, Homo sapiens
ccaggaaatatttgtggaatccatcattttattacattacaatattaatccatacaataatgggttcaacaaatatttcctgg

SEQ ID NO: 550808 - DNA, 83 bp, Homo sapiens
cagaccagcagtgaaggagacatcagggtggattctttctctctcttccacccctatcctgtgtcttctctcctgctgccctg

SEQ ID NO: 550809 - DNA, 83 bp, Homo sapiens
gcacagtcagtggagagagccaggggctggaggtggggcccaccccagcctctggtcccagctctgctgctcacttgctgtgt

SEQ ID NO: 550810 - DNA, 83 bp, Homo sapiens
tctcatgtgttctacaaacctgtaaaaggtccttgcagcttcaacgagcttcccccgtacaggttttattgaacacatgtagg

SEQ ID NO: 550811 - DNA, 83 bp, Homo sapiens
tgaatatcattaggaatggattatggaaaggtctcatatcctcaaaggctgagacctcttccacagtcccctctgggtgttca

SEQ ID NO: 550812 - DNA, 83 bp, Homo sapiens
cccctcatagaaagcgaattggctctccccacgttggctcccatggaaaggactgatgggagagagagtgaggagagctgggg

SEQ ID NO: 550813 - DNA, 83 bp, Homo sapiens
ttccaggctgtgggtggataagtgaccccccagctagttgttagggactggctgtggcagttatttattttactgggctggaa

SEQ ID NO: 550814 - DNA, 83 bp, Homo sapiens
tacagtggtgtagctggctctgacgccagtgtcctatgttcatagcataggtcactggggtcagagccagctgtaccaccgtg

SEQ ID NO: 550815 - DNA, 83 bp, Homo sapiens
agcaaggtagaggttttctgccaggagggaacactagacggaggctgtttgttttttctccaaacagaaatctcttccatgct

SEQ ID NO: 550816 - DNA, 83 bp, Homo sapiens
gatcctagaggtttcagaaagttttgccttttaattgtgaaatgtgaagcccttccaagatgactttctgaaatctcaggttc

SEQ ID NO: 550817 - DNA, 83 bp, Homo sapiens
tttgctgtgagtgataggaaatacaggagctctacccttgggcagcattccaaacttgtgatttcctataactccacagcaga

SEQ ID NO: 550818 - DNA, 83 bp, Homo sapiens
caccagggaccctgaggccatgagagatcctgggggcccaaaacagaaaatccctgagatatgctgatggcctggtcctggtg

SEQ ID NO: 550819 - DNA, 83 bp, Homo sapiens
caccaagaagactcttataacgactcactagaaaaggagtagggggacccttcctagtgggttgttgtgggatcttcttggtg

SEQ ID NO: 550820 - DNA, 83 bp, Homo sapiens
cagaagtaaatgaagggtaaagtgatgtgctagtgtgactgcagtctgactaatttgaatctatttgccctccatcatttctg

SEQ ID NO: 550821 - DNA, 83 bp, Homo sapiens
agaggtgtgagtataaagcagcgagactgatttgaggtgtgcagcttctggagtcagtctcattactttctactgtcacctct

SEQ ID NO: 550822 - DNA, 83 bp, Homo sapiens
caaaagtcccctgtgtagccggcagcagggggacatgtgaagacatggagaaggggctggtgctggacccacaggggcttctg

SEQ ID NO: 550823 - DNA, 83 bp, Homo sapiens
ttcctcccttctgtataccttttaaaacaagccaatcggccgtgcatggtggcttgttttcaaaggtgtaggaaagggaggaa

SEQ ID NO: 550824 - DNA, 83 bp, Homo sapiens
tcatttaacctctctatgcctcatctataaaatggggcagggaatagtgcttccataataggagaggtgtggagattaaatga

SEQ ID NO: 550825 - DNA, 83 bp, Homo sapiens
cctttctcctggcccagctttcattccttgctgactcaggaattggcagcgttcagctgggagctgggcctgggcagggaagg

SEQ ID NO: 550826 - DNA, 83 bp, Homo sapiens
gcctcatggggctgaagttctaggagctagtcttgacctctaaggaaggcagagattagggtttggattttatcccctagggc

SEQ ID NO: 550827 - DNA, 83 bp, Homo sapiens
aggcaggcacgcagagctctttaaatattgctgagcatttcctggatcagcatgatatttaaagatttttgttccacctgcct

SEQ ID NO: 550828 - DNA, 83 bp, Homo sapiens
accctgtcagtgttccaccctgtcccaggccctgtgatatttattgtggctaaaggcaatgagattgggtggaagagaagggt

SEQ ID NO: 550829 - DNA, 83 bp, Homo sapiens
gttcatttctgtaaataacaaaaggaccttgttctaacaccttcacttataacaaggtccttgagtataaagtagagttgagc

SEQ ID NO: 550830 - DNA, 83 bp, Homo sapiens
atatgaggtttgggggcttgactcctccctgagaaaacgcaagaagctctttctcagaggagtcatacctaaatagcctgtgt

SEQ ID NO: 550831 - DNA, 83 bp, Homo sapiens
gctgctgttgggagaccctggtctgcactctatctgtattcttactgaagggagtgcagggcagggtttcccatacagagggc

SEQ ID NO: 550832 - DNA, 83 bp, Homo sapiens
ggtgcctttttaaaatgcattgagagtgttggttagctgttgcagctgtacaacacttttaatatgcatttttaaaaatcact

SEQ ID NO: 550833 - DNA, 83 bp, Homo sapiens
tcattcttgcaatattgaaacaaactccagtgaacttgtttgaagctggttcagtagagattgtttcaacactgaaggaatga

SEQ ID NO: 550834 - DNA, 83 bp, Homo sapiens
cattcatcaaaggcatttgctggtggtggcaggggaaatgtcacagcactgctgccaccactgccaggtatctttttaaaatg

SEQ ID NO: 550835 - DNA, 83 bp, Homo sapiens
tctcatgcagtcattctccaaaagaaagcactttctgttgtctgaaagcagagtgccttcttttggagcgttactgtttgaga

SEQ ID NO: 550836 - DNA, 83 bp, Homo sapiens
ttcatagctattttggggacactatttttattcttacccacccatggatggggcctgagaaatatcttcaaagtagctatgag

SEQ ID NO: 550837 - DNA, 83 bp, Homo sapiens
gagtccacactccctctttgccccttgctggttctctactgcccccagcatagggtggagtgggtgtgcagtttctgcgactc

SEQ ID NO: 550838 - DNA, 83 bp, Homo sapiens
ttaaatttcagccccgggccaatctgtcaaagaaacaggaaatgtctcttgctatgacatatttgccagcggctgaggtttga

SEQ ID NO: 550839 - DNA, 83 bp, Homo sapiens
ctgtgtctaagagatatcaaaacaattggttgattgaattttttattatatgagttgactgttttgacatcttatagatacag

SEQ ID NO: 550840 - DNA, 83 bp, Homo sapiens
gatgttttaatctcaggtaaatgccaatcaggagacaaacacttgtttatctcctgattggtattgatctgaattaagctgtc

SEQ ID NO: 550841 - DNA, 83 bp, Homo sapiens
aaatcaactacaggtcccagcatgcagtgctctaatctgaagttaagcaaaaactgcaatgcatactgggacttgtagtaagt

SEQ ID NO: 550842 - DNA, 83 bp, Homo sapiens
cccagttcatccgggatctttttttccttctccaaacctctctctgcatggttgggcaggtgggaggatcctggagctctggg

SEQ ID NO: 550843 - DNA, 83 bp, Homo sapiens
ggccaagggtaagttggagagggagggctgtttagctttagaatgcaccacacaacctctttctccatgccaagccctttgct

SEQ ID NO: 550844 - DNA, 83 bp, Homo sapiens
agagctttgccttagatcagtagttggtaagggtcataggatgtaatcccaggccaactggctgatctcaaagcctgtgctct

SEQ ID NO: 550845 - DNA, 83 bp, Homo sapiens
tcacttgaaatagttcttttattttgagtcaagttggcaaccaaggtaggcttgaccacaaagaaaagaattattccaagtga

SEQ ID NO: 550846 - DNA, 83 bp, Homo sapiens
ataagtgttccatatgtgggtgggctagcactgccatttgtttataaggctggttggcatctgtcctcatgtgagacacttgt

SEQ ID NO: 550847 - DNA, 83 bp, Homo sapiens
taactactgagatgtgtatcatatatatgtatgtatgaaaatgacttgaagtatacgtatgtatcacacagttacagtagtta

SEQ ID NO: 550848 - DNA, 83 bp, Homo sapiens
ctgttgcttattacatccataggctctgcttctactaacgtccttgaaccttggagcagagcctatggaggtattaaggacag

SEQ ID NO: 550849 - DNA, 83 bp, Homo sapiens
tgccaggctgcagatcggtcttggcgctgtatactcccaggtccagggcactgggatggtgctgggtgctggcctgcagggca

SEQ ID NO: 550850 - DNA, 83 bp, Homo sapiens
gaggtacaaggagcatgtgcagtgagatgggtgcctgccttgtaggctgtggtaccctgcctcactgcattctccacttcctc

SEQ ID NO: 550851 - DNA, 83 bp, Homo sapiens
tgcagtggccagcgaggtaggtgcttcctgtccctcattatatactggtacttggaacgccaaccttgctctttgtggctgta

SEQ ID NO: 550852 - DNA, 83 bp, Homo sapiens
tcattccttcagtgttgaaacaatctctactgaaccagcttcaaacaagttcactggagtttgtttcaatattgcaagaatga

SEQ ID NO: 550853 - DNA, 83 bp, Homo sapiens
gctcgcttttttgcaagccttgggtgtgggagggtaattaagatgccaacggtcctacactcaaggcatggaggagagaaagc

SEQ ID NO: 550854 - DNA, 83 bp, Homo sapiens
ccatagactctgccttcctggctactgggactggggaaattaccccaaccccagagtgtgtaggaaggtacatgagtgaatgg

SEQ ID NO: 550855 - DNA, 83 bp, Homo sapiens
gggctggagtccaattccttccccaccagctgcctttgaccgccagtgaccctggcagctgatggggagggtgtcctcagccc

SEQ ID NO: 550856 - DNA, 83 bp, Homo sapiens
tgggtaattctctctgtcattctaggcaagaaaagtccatttgggtgttaaatttcttggctggggtagagataacagaccca

SEQ ID NO: 550857 - DNA, 83 bp, Homo sapiens
aagttccccaagctctaaggacttcctcatcatcatgcaagaagaagagaaaagtgagtgtccatagaagctttggggctctt

SEQ ID NO: 550858 - DNA, 83 bp, Homo sapiens
tgttatttgcagtcagtaacaaagattcatccttgtgtccatcatgcaacaaggagaatctttgtcacttagtgtaattaata

SEQ ID NO: 550859 - DNA, 83 bp, Homo sapiens
tcagttttatagacatgttgacaataaagtctaccatgtgtgtctccctgccatggtgattattttgctcaatatgtgattga

SEQ ID NO: 550860 - DNA, 83 bp, Homo sapiens
acctgagagattccatgtgaactcacttttcacaaacaagcgctgagattgtgaaaagtgggttcatagggaatctcttaggt

SEQ ID NO: 550861 - DNA, 83 bp, Homo sapiens
ggggctgaggattgtttggtggggggtgcactgatcagttcttgtcccctggtgactgtgcccctggccagcgacctggcctc

SEQ ID NO: 550862 - DNA, 83 bp, Homo sapiens
gggtggggcacacagatttatagtttggatgggatctttaaggaataggccctggttaagactgaactgactgtgccctgccc

SEQ ID NO: 550863 - DNA, 83 bp, Homo sapiens
agagttcctgtgtttaccatcttctgccttgtctagagtgggatttctgtttcagaagcagaagtaggtgagctcgggcctct

SEQ ID NO: 550864 - DNA, 83 bp, Homo sapiens
ccctctgccctcccatgtccctggcagtgggcatttctcaaatggtgattgatgactggggatgggggtgggcaagccgaggg

SEQ ID NO: 550865 - DNA, 83 bp, Homo sapiens
ttcctgtccatttgtccattattatccttgagaggctaacatgttctagtctccaaggagaaatgggcaacagggcaaaggga

SEQ ID NO: 550866 - DNA, 83 bp, Homo sapiens
gccggccggctcagccccctcctctcctcctctgggcagtccgcccgcccatggggccagggaggggagccaggccggctggc

SEQ ID NO: 550867 - DNA, 83 bp, Homo sapiens
ctggcctctgttctttcagatgactttgggaaagttactttgcttctctgggcctcagtctcatcaggaaagcacagaggtcg

SEQ ID NO: 550868 - DNA, 83 bp, Homo sapiens
acttagctccagagcttgggggttgtcgttaagcccttcctttccatcagaggctgatgaatccccaaactcctgggctgagt

SEQ ID NO: 550869 - DNA, 83 bp, Homo sapiens
tggtcttcatctgggattctctggtggtcagaaggaaagtctcaagcattcagaccacgggaggaacccagtcatggaatcca

SEQ ID NO: 550870 - DNA, 83 bp, Homo sapiens
cccagagctggtgcggcaggtttttcatgcaagatcaagcagattatagaatgaaaagtgtctgctgcatttcagcaactggg

SEQ ID NO: 550871 - DNA, 83 bp, Homo sapiens
catctctagtgcatgctgccacctgtggtagtctgtagttactgtcagtcaccaccaggtggcagtattgttgaatagaaatg

SEQ ID NO: 550872 - DNA, 83 bp, Homo sapiens
tctttactgcctgtaggggacctcctatagggataggtaatgttttactcattcctacaggaggttccccttaggagttcaga

SEQ ID NO: 550873 - DNA, 83 bp, Homo sapiens
taattttctagtagtagcttgtattaaagagacacaaagtgatggagcatggctctttaatacgagctactattggataatta

SEQ ID NO: 550874 - DNA, 83 bp, Homo sapiens
tgtgagctgatggccacgtgctgcgaagtgccctgaacccagtagttagggatatacttcatgggcctgtggccatgtctcca

SEQ ID NO: 550875 - DNA, 83 bp, Homo sapiens
ccctgccctttccagaagcctgcctcagatgcactcacccttcttggcaggcatcaggggtaggtgtttaggattacacaggg

SEQ ID NO: 550876 - DNA, 83 bp, Homo sapiens
ggttccttactgtgctatggagaaatttgttacctaagttttacccaccagtaataagtttctccaaagcacagaaaggaatc

SEQ ID NO: 550877 - DNA, 83 bp, Homo sapiens
cttctcttattctccctgttttcatcctacttttaagtaataaatttggcattaatggaaggggagcagggaggaaggagaag

SEQ ID NO: 550878 - DNA, 83 bp, Homo sapiens
gcctccccttccaggtcattacctgcggccgcggaggcaacagctgccaccatggcctgatgagtgatctggtgggcgacggc

SEQ ID NO: 550879 - DNA, 83 bp, Homo sapiens
tcgtggtggtttccttttgtctcctttattacatgggactctgacatgtgcccatagctagggtggcagtaggatctacccga

SEQ ID NO: 550880 - DNA, 83 bp, Homo sapiens
gcgtgccctggtcaccaagctctcttcccggctctccttctggaggggcagtgggaggagggctggggtcagtaaaggcaggc

SEQ ID NO: 550881 - DNA, 83 bp, Homo sapiens
ctgggcgggcctctgagcagcagccctgcactcgggctcaccatagtgccctgggtctaggtgctgtgggaggccctgcccgg

SEQ ID NO: 550882 - DNA, 83 bp, Homo sapiens
gaatggttgaggtagtttttcaagtatttggggcagaaaaacacacatttacctcagatatttggataattgcctccactttc

SEQ ID NO: 550883 - DNA, 83 bp, Homo sapiens
tgcaactcagagtctgcatcaggttagaagatacattaaagctaatgaaatatctaatttgaaagcagattttggaatctgca

SEQ ID NO: 550884 - DNA, 83 bp, Homo sapiens
aggctggagtccaatgccttccccaccagctgcctttgaccgccagtgaccctggcagctggtggggagggtgtcctccgcct

SEQ ID NO: 550885 - DNA, 83 bp, Homo sapiens
ctgaattttatctctgggtcccaggcctgatggtaccttcaacctttagctgccttttgcctgggtctagagataagagccag

SEQ ID NO: 550886 - DNA, 83 bp, Homo sapiens
actataattcccatcagaccctggggctcgagtcccctagaagagcagaggagggagtcctagggtcttctgggaactgtagt

SEQ ID NO: 550887 - DNA, 83 bp, Homo sapiens
gcagcctgcgccggggctcagccccatctctcccctcttccaggaagccctccgtgagtttggggctgagcctggtgccctgc

SEQ ID NO: 550888 - DNA, 82 bp, Homo sapiens
ttagaagtagttgcaggctgatgagtttggtttttgttaacaaagaacaagagctagactttgtcaggaggcagccacctaa

SEQ ID NO: 550889 - DNA, 82 bp, Homo sapiens
aggctattacaaatggtttccttggtgtcaaaaattactaaatagttcttttttcgacattaggaaaatgagtgacaggcct

SEQ ID NO: 550890 - DNA, 82 bp, Homo sapiens
tctcctttctgagtcatacaggagaaaaacacccaggtaacaattcctcttatgttatcacctgggtgactcaggatggaga

SEQ ID NO: 550891 - DNA, 82 bp, Homo sapiens
tctcctggctgaattctcactcacagaagtagattcaacagcagcagtgtctacttctgtgggtgagaattcggccaggagg

SEQ ID NO: 550892 - DNA, 82 bp, Homo sapiens
tgatactgagggttagtggaccgtgttacatacgtcacagataaagcgtacgctatacggtctactatctctccaagtacca

SEQ ID NO: 550893 - DNA, 82 bp, Homo sapiens
ctcccttgcattgtgttcttggttttggagatacatcaaactacgaatgatgtattctttcaaacttgagaaagtgtgggag

SEQ ID NO: 550894 - DNA, 82 bp, Homo sapiens
cctccccgtcctgtggactgtgctgccacagtgggcattctccatccacctcacagtggcgtgacagccatggatggggagg

SEQ ID NO: 550895 - DNA, 82 bp, Homo sapiens
gatgacttaagtcatatgtgtcccaagtctctagaattttaggcaaatggagtttggggcacaaatgtacttctcagtcatt

SEQ ID NO: 550896 - DNA, 82 bp, Homo sapiens
cctccttaaagcacggcttgagatattgtcagctgttaaagtaatatttaatcgtagatgataccaggtgtgatcaaggggg

SEQ ID NO: 550897 - DNA, 82 bp, Homo sapiens
ccgaaatgtctggcaggggctccgtcttggcttcactgtctcccctcagaaaagccagcctgagctcctcctcaagtcttgg

SEQ ID NO: 550898 - DNA, 82 bp, Homo sapiens
gttgaaccaagccaagctcagccttaaagatcctggtttggtttgttcccaaaatagggttgagcttatggctggttcttac

SEQ ID NO: 550899 - DNA, 82 bp, Homo sapiens
gcagtctggttgcattgatttgtgtctcacaagtagacatttcctttgttggtcacaaatcaatgctacagaacaaacctgc

SEQ ID NO: 550900 - DNA, 82 bp, Homo sapiens
gggtgggagggagtgctttggattttgtacctgggctgcagagagtgcccaggtatagaattgaaagcactccctcctgccc

SEQ ID NO: 550901 - DNA, 82 bp, Homo sapiens
ctctgtctcccaggagactgagggacagtcaaggccactgagtcaccaccttgctgttccctttcagtctctccagatggag

SEQ ID NO: 550902 - DNA, 82 bp, Homo sapiens
caaacttaaattgcatccatgttaaagaggaaaaaggctttagcacattcctttggggaatggaaacaatttattttgtttg

SEQ ID NO: 550903 - DNA, 82 bp, Homo sapiens
ccagacacagctcatccgatgtacaataatttctctttatacaatttaagaaaatattgtatatcagatgagatgtgtctgg

SEQ ID NO: 550904 - DNA, 82 bp, Homo sapiens
atttatttttgtctgtgttttcttaccactgtggtttctccacctaaagcaatggctgggacacactaggcacaaaataaat

SEQ ID NO: 550905 - DNA, 82 bp, Homo sapiens
agaccatgcactgattcagacaattcttccactgcctctgatgtcagatcacttgtatcctgtctgtttcggtatgtggtct

SEQ ID NO: 550906 - DNA, 82 bp, Homo sapiens
ggctgagtcagtgtggggggcccaaggctgcgtcagtgaggggagagctgacgtagccccccccagaccggcgggaccagcc

SEQ ID NO: 550907 - DNA, 82 bp, Homo sapiens
tttgtgggttcactcattgctttttccccaggtctagaagagtgcctggcacataccaagaagcaaggaagagctcaacaaa

SEQ ID NO: 550908 - DNA, 82 bp, Homo sapiens
gcaggcaccatgtttctgaccaccctcttcatccgtactcacatacctgctagacagtggatcgggatgcactggtggctgc

SEQ ID NO: 550909 - DNA, 82 bp, Homo sapiens
gcaagaaaaatgagggactttcaggggcagctgtgttttctgactcagtcataatgcccctaaaaatccttattgttcttgc

SEQ ID NO: 550910 - DNA, 82 bp, Homo sapiens
tggttcatggttttggctggccctagcatgtgttcagtaatttgtaaaggtcatatgttggagtgagttggagccatcacca

SEQ ID NO: 550911 - DNA, 82 bp, Homo sapiens
acgggacctaggtccagcaaggcttaaatgtccaccctggagcacaggtcactggtgaacgggtcgtgctggatcgtcccgt

SEQ ID NO: 550912 - DNA, 82 bp, Homo sapiens
ttctgtttatcttctaactgcccctgtgctgcacggactggggaggaacatgcagcatagggcagttaggagatcaacagaa

SEQ ID NO: 550913 - DNA, 82 bp, Homo sapiens
tgcagctgcactggccgtgcatgatatggctgctgtcaatgaaggcagttgtatgcagagcactgctgggctgtcggctgca

SEQ ID NO: 550914 - DNA, 82 bp, Homo sapiens
gggaataggaaaaggaaggtaactgacagttgtttggctgctaactgccaggtattttgtctatcttttgcatctaatttcc

SEQ ID NO: 550915 - DNA, 82 bp, Homo sapiens
gaggagttctgaggccaactctgtctgtctggtgctgagtttcagtagacactggacgatggggttgaggcctcagggcctc

SEQ ID NO: 550916 - DNA, 82 bp, Homo sapiens
aatctgaaggtcccagggtctgagagtcccaaggatctatgagttggttctagggatctgagacttgggggtctgatgggtt

SEQ ID NO: 550917 - DNA, 82 bp, Homo sapiens
gcttgagccatccctggcttcctggagctcacaacctgagagagaaggtggtgctgcgggaacccagggttgggctgtgggc

SEQ ID NO: 550918 - DNA, 82 bp, Homo sapiens
acccaggcagcagggtgcacaaagtttagccaccttttagaaataggtgccaagtattgtgtcctgctctgtttgcctaggt

SEQ ID NO: 550919 - DNA, 82 bp, Homo sapiens
gagaagccaattcttgtctccatgctctaggaagtgttttctttgtagtactgttggcatggaggtgaagagcctggaactc

SEQ ID NO: 550920 - DNA, 82 bp, Homo sapiens
tggatgcctgctggatgatgaagacatcacacaccccactttcactccgcactgtggggtgtcttcacatctacagagttca

SEQ ID NO: 550921 - DNA, 82 bp, Homo sapiens
tggtacctgaaaagaagttgcccatgttattttcgctttatatgtgacgaaacaaacatggtgcacttctttttcggtatca

SEQ ID NO: 550922 - DNA, 82 bp, Homo sapiens
tgacacctggctacctggctgaaataaatggcatgctttgtgctgttttaaatttttcttgctctgtgtggccaggctgtca

SEQ ID NO: 550923 - DNA, 82 bp, Homo sapiens
tgatgagtggtagccaatgatatgccattacaacaatagagataatgcaatagccatgtcataaaatggttacccctcatca

SEQ ID NO: 550924 - DNA, 82 bp, Homo sapiens
gagttcactggccgcaagttcattcattgattcagtaaatatttattgaatcaatgaatgcaatgttgtgctttcatagctc

SEQ ID NO: 550925 - DNA, 82 bp, Homo sapiens
gagttatgaggtagctgtggctggctgggttttgatgaagtacccataatttcatatcagctgccacaggactttctgactt

SEQ ID NO: 550926 - DNA, 82 bp, Homo sapiens
ctcattctcatgtattgcactaatatatcactggaatgacaactgcttctgatgatctattaatgcaatacatcagggtgag

SEQ ID NO: 550927 - DNA, 82 bp, Homo sapiens
caggctggaaaggtcagatggggagggtgggtgtagggacactatgtgtccctttgcctctccatcctcagatgatggtctg

SEQ ID NO: 550928 - DNA, 82 bp, Homo sapiens
gcagagatgagagtggcagttgaaggagctttgaaatcctggagcagagccaaggcctctttgcctgcacactccactctgc

SEQ ID NO: 550929 - DNA, 82 bp, Homo sapiens
tcatctcggggcctggtgaattaggacgacatcggcattttttattgctaaagacgtccagattgatccagcccttggctga

SEQ ID NO: 550930 - DNA, 82 bp, Homo sapiens
ctccatcctcaggttcttcttctgtaaaatgaagatccctttgcggtgaaacgttttgcagctctggaatctgagggtgtag

SEQ ID NO: 550931 - DNA, 82 bp, Homo sapiens
gattcttttaggccaccagggttccatttagagaattacaattgccatgtgctaactggtactctggtagcctgaatgagtt

SEQ ID NO: 550932 - DNA, 82 bp, Homo sapiens
ttgttcttagagtttcgggtgtttttctccagtcttgttactgtagactgtagaaagcacgggccccaggctctgagcttag

SEQ ID NO: 550933 - DNA, 82 bp, Homo sapiens
gggtgactgagggaaagaataaccagagtcaacctgaaacccccaggaatctgattggctccgtgttctttctttctcaccc

SEQ ID NO: 550934 - DNA, 82 bp, Homo sapiens
gttttattgggtgaatgggatcaaaaaggctcagctcacctaagtatgctgagtctttctgatcccattccactaataaaat

SEQ ID NO: 550935 - DNA, 82 bp, Homo sapiens
tcatgtggtactcttctcaagagggaggcaatcatgtgtaattagatatgattgacacctctgtgagtggagtaacacatga

SEQ ID NO: 550936 - DNA, 82 bp, Homo sapiens
agtcccttcacttcttggaggctcagtctcctcatgtacagcatagacctgggaggtgagctctccgagagtggtaaggact

SEQ ID NO: 550937 - DNA, 82 bp, Homo sapiens
agctctgtcttctcaccacttcttctggaggattccctgaggaagctgctggatctttcagaaggtgctgatgaacagagct

SEQ ID NO: 550938 - DNA, 82 bp, Homo sapiens
ctaggtctaatgatgccatttatcttttgaagccaccactatgaagggccatttcaaaggatattgggggtcataggcctag

SEQ ID NO: 550939 - DNA, 82 bp, Homo sapiens
ttctgtccttagtgattatttacagtttaggtgtttattttctgtctttttcaactagactgtaagttccatgagggcagga

SEQ ID NO: 550940 - DNA, 82 bp, Homo sapiens
tccctcgcatgtcccttccgcgtagctatgtatgtccttctcagacacagacatacataggtagtgagtcatatgtcaggga

SEQ ID NO: 550941 - DNA, 82 bp, Homo sapiens
gtcccagagtagcaggatctggcagaaggaaatttccttctaaccctcaaagaatccacataaatcttgttacatttgggat

SEQ ID NO: 550942 - DNA, 82 bp, Homo sapiens
ttgatagaagggtcaatagaatcattgtaggtccttgaacaaaggacggatttaatgagaaatattgagccctttggttcag

SEQ ID NO: 550943 - DNA, 82 bp, Homo sapiens
gatttggtcaggatgggcagccaaactagaaatttcatgccagaaatatgagttggtttggctgacttagcctgattaaatt

SEQ ID NO: 550944 - DNA, 82 bp, Homo sapiens
gatgaaacaatgtgatggggctgcatggttagcggctgtccctctgcatcggtgtccatggcatccccatttcacatgcatc

SEQ ID NO: 550945 - DNA, 82 bp, Homo sapiens
aattctttgaggccacaagggtatcatttattaaatgactgctgcagtcctctaaatgggccccttttgacctgaaagagtt

SEQ ID NO: 550946 - DNA, 82 bp, Homo sapiens
tgctttacatgaatggtcccattgaatcccaacagctttgcgaagtgttgttgggattcagcaggaccattcgtgtaaagta

SEQ ID NO: 550947 - DNA, 82 bp, Homo sapiens
ttccccatctgcctttggtgacaggcatgtgtgggcattccttacctcccccaccagcctgatcatcaaagcaacaagggaa

SEQ ID NO: 550948 - DNA, 82 bp, Homo sapiens
ctgtgccgggtgcctgggtggtggggctggggttttatttataatattgatttcctgctccactgccggggctctggtgaag

SEQ ID NO: 550949 - DNA, 82 bp, Homo sapiens
tactaaaatcctgctaattgatacactgtggtttttggccagccagggtcttatttccataatgtcagttggtggtttagta

SEQ ID NO: 550950 - DNA, 82 bp, Homo sapiens
tcgtcctctcgctcagtctctggaccatgtctactcccctgtctcatttgtggacattatctggggctggatgaggggagga

SEQ ID NO: 550951 - DNA, 82 bp, Homo sapiens
cacgggggctaggccccaagtctggggggtccctgccgccagcggtgttctgggagctcctgggcctggtggagcccccgtg

SEQ ID NO: 550952 - DNA, 82 bp, Homo sapiens
tctggttttatagtgcttactcaagtcacactcctgcctattttaaagggagtgtggtgtaagtaagatctgtaaaattaga

SEQ ID NO: 550953 - DNA, 82 bp, Homo sapiens
ggagagtgaggagggaggaggttcagaggcaatatggatttttcccatctttcttggttttgatgactccctccaatttttt

SEQ ID NO: 550954 - DNA, 82 bp, Homo sapiens
gcatcctcatgccctctccctgctcttctccccctgcatcagagcactgttgggtgctgagcagatggaggaagtgaggagc

SEQ ID NO: 550955 - DNA, 82 bp, Homo sapiens
gaagaagacgttttgggttgtgaaaataggatcaggcagtagcagttgattaatatgttcacatattccaaaatttcttctc

SEQ ID NO: 550956 - DNA, 82 bp, Homo sapiens
atctgcagaggccctactgtgcacccactggtatccctgtgactggccctgggatacaagcatagtcagggccctgtttgat

SEQ ID NO: 550957 - DNA, 82 bp, Homo sapiens
gcaccggtccccgagccaagtaatggagaacaggctggacagcacacaacctatcctgaattacttgaactgggtcccgggc

SEQ ID NO: 550958 - DNA, 82 bp, Homo sapiens
cctgcctcccaggcgggctgtgcagatgttatcatgggcatgagctgactcacccttgcgacatctaagcccgctgggcagg

SEQ ID NO: 550959 - DNA, 82 bp, Homo sapiens
tcccgggtgcacagggcctgttttcccggtggctggcgaagcaatgtccttcccccgggtaaagcagcccatgcgttctgga

SEQ ID NO: 550960 - DNA, 82 bp, Homo sapiens
ctgggaggcggcagcagcagtggggaccccgagctggccttcgagtgccagtccctccctgcagctgctgccgcctcctcag

SEQ ID NO: 550961 - DNA, 82 bp, Homo sapiens
tctaaagcagaggatggcagttccacatgctcaggtgataaatcatctacataaattatgtgggattgatgtaatgcttaga

SEQ ID NO: 550962 - DNA, 82 bp, Homo sapiens
ttccagtcccctgggacaactgtccatgtccattggaaaattattcattccaatagacatggacaattgtccatgactagaa

SEQ ID NO: 550963 - DNA, 82 bp, Homo sapiens
tcctctagagctccaaagtgaagataaaactcctgttccactcagggagtttgtatcttcaaagtgaaagcttcctggggga

SEQ ID NO: 550964 - DNA, 82 bp, Homo sapiens
ggggcagatgaggagaggcagaattgttacttttaggctccacatgtgtgagggtttgtgggggatctctgcctgctgcccc

SEQ ID NO: 550965 - DNA, 82 bp, Homo sapiens
cattgttcatcttctggcccctgttgtctgcatgtaacttaataccacaaccaggcataggggaaagattggaggaaagatg

SEQ ID NO: 550966 - DNA, 82 bp, Homo sapiens
gatgcttcctgatgcttctcttgctgggtcagcagccaccctccccttccctgtgacctgcagaaaagcttcagggggcgtt

SEQ ID NO: 550967 - DNA, 82 bp, Homo sapiens
gcccccaacactctgaagatacagatttttaacaactaactctgcctatttgttaaaaaactgtatcttcagggttctctgc

SEQ ID NO: 550968 - DNA, 82 bp, Homo sapiens
ggccggcatgtgccttcgctgctcagcctgtgccttgaactcggtggtgcagagcgtgctgagcaagcggacactgcaggcc

SEQ ID NO: 550969 - DNA, 82 bp, Homo sapiens
ttttcctacgagttttttcaagctactactaaagagctactctttctgtttagtagtagctttaaaaagactcttaggaaaa

SEQ ID NO: 550970 - DNA, 82 bp, Homo sapiens
gagcttgttgtcctcacaaccttgctgttcctgtcatcttctctccaggcgacaggaacagcagggttgtgagggcttgctt

SEQ ID NO: 550971 - DNA, 82 bp, Homo sapiens
gatggcataaatgtttcaaatgtgctcagggtaattagttttgaattaccatgtgcatattttaaacatttaaatgatcatc

SEQ ID NO: 550972 - DNA, 82 bp, Homo sapiens
ggccatcctcactgcttctgcatctcatcagctttccgaatcccattggaagctgctgggctggaagctgtgctctctggcc

SEQ ID NO: 550973 - DNA, 82 bp, Homo sapiens
gtctaagaactgtaaaacagttacacagagagccttggcaggtgagggacattcatgtatagctgtttcagagttcttagat

SEQ ID NO: 550974 - DNA, 82 bp, Homo sapiens
ggagtcaccttcagaagaggaggcggcttgacctgggggcatgaatgctaccaccaggcccttttctcctgggactggctcc

SEQ ID NO: 550975 - DNA, 82 bp, Homo sapiens
gtggatggtttgaagtagttggtttaggagtttggacccatctgatagggcataaaccctaaggactacatcagattgacat

SEQ ID NO: 550976 - DNA, 82 bp, Homo sapiens
aagttctagggtacatgtgcacaacgtgcaggtttgttacatatgtatatatgtgccatgttggtgtgctgcaccctttctt

SEQ ID NO: 550977 - DNA, 82 bp, Homo sapiens
tgatgtctgagacagcccaggctcggcactgcagaataaattacatgattcgctgaatgcctgggcttcgctcagacataca

SEQ ID NO: 550978 - DNA, 82 bp, Homo sapiens
ctccataatatagacactattggttgctaattggcgccagtaggctggtgctaattgtcctaatgcactctgcttgatggag

SEQ ID NO: 550979 - DNA, 82 bp, Homo sapiens
gagccagcgtggggtggggtgggctgtccgatggtggggtgcttggtcccacccattggtgcctccctagaccccgtggctc

SEQ ID NO: 550980 - DNA, 82 bp, Homo sapiens
gaacagttgtgtgcatacagtgggtctttgtgtgtttgaactcccaccacataagggcaaactcgatatgcatgctaacgtc

SEQ ID NO: 550981 - DNA, 82 bp, Homo sapiens
cctgctgctgtaagaatatgtttgacatttagttggttcctaattaaacaacccaatatcaaacatatcacacagaagcagg

SEQ ID NO: 550982 - DNA, 82 bp, Homo sapiens
ttctgttgatctcctaactgccctatgctgcatgttcctccccagtccgtgcagcacaggggcagttagaagataaacagaa

SEQ ID NO: 550983 - DNA, 82 bp, Homo sapiens
cattatctttgtattcttctccaagaaggatgctcctagtgagtgagctgcctttctttgagagagagtgggaaagttaatg

SEQ ID NO: 550984 - DNA, 82 bp, Homo sapiens
tatgctgtttgggtgctgtttatgggagcagggaagaaagacttggttgcttgcttcaatacacagtgccctataaggcata

SEQ ID NO: 550985 - DNA, 82 bp, Homo sapiens
cctgaagaaaaggagactcacagaaggcccaagatgaaagactctttaatcctgtggctttttgagttttgtttttagcagg

SEQ ID NO: 550986 - DNA, 82 bp, Homo sapiens
gcaggccctctgggtatcggttggtgcaaaagtaagaaccacaatgacttctgcaccagccttctatctgtgaggcatctgc

SEQ ID NO: 550987 - DNA, 82 bp, Homo sapiens
gttggccagggagtaggcagtagcttgagatataaggaatttctctttgaggtctcggaactgctgattgctctctgccagc

SEQ ID NO: 550988 - DNA, 82 bp, Homo sapiens
gccctgtccccacacctcctgctccccgacagcctcagccagctggaggagtttggccggcagaggaagtggcacaagaggc

SEQ ID NO: 550989 - DNA, 82 bp, Homo sapiens
gtcagtacgtggcttcataaagctgtaggattctgatagggaaactaccgattccatgtgctttggaagccaatgtgctgat

SEQ ID NO: 550990 - DNA, 82 bp, Homo sapiens
gtttgtgttccaaggttgaatctaggtacctggtggccagggccggggggtgtctgtattcagtttgtgaggactttaaaat

SEQ ID NO: 550991 - DNA, 82 bp, Homo sapiens
cgcgattcttgctcccaggatgcaatgcgcccccgttcgccctttagaccctttggcgttgcaaactgggagttggagtccg

SEQ ID NO: 550992 - DNA, 82 bp, Homo sapiens
gcaccccctcgctgctccccatgacaggctgtcccagtgctggagtcagtgtgagcatgaggagcagtgaacatcatggtgc

SEQ ID NO: 550993 - DNA, 82 bp, Homo sapiens
tttttttttttaatggtcatagctgtagaaaacaacatacttcttgtttgttttctatagctatgaccgttacaaaaaaaaa

SEQ ID NO: 550994 - DNA, 82 bp, Homo sapiens
cagctgtggggcttttgggagctggccgtaggcaagggagtgccaagtgtctgcagtcagaggccaggagcctgggaggctg

SEQ ID NO: 550995 - DNA, 82 bp, Homo sapiens
tgggggaaatataattgggagagaagggaattaatgctatcaggtgtctcttaatttctcagtctctctcatattaccccca

SEQ ID NO: 550996 - DNA, 82 bp, Homo sapiens
gctccaggcccaatgctcaggccttgtggctgctgcctgggcatccaggcaagagaagcaaggctctgaattgggtgggggc

SEQ ID NO: 550997 - DNA, 82 bp, Homo sapiens
gcacatgcctactgagaagaatggcagaatcacctgagcgatataagttatttctccatttttttctgtgtgcagcatgtgt

SEQ ID NO: 550998 - DNA, 82 bp, Homo sapiens
tctccatcctgagtcacccaggtgataacataagaggaattgttacctgggtgtttttctcctgtatgactcagaaaggaga

SEQ ID NO: 550999 - DNA, 82 bp, Homo sapiens
gctgagtgttccctgactccttctccaggagctgtgttcagactttcgcagctcttggcttggagctcctggagggcttggc

SEQ ID NO: 551000 - DNA, 82 bp, Homo sapiens
agagtttaatcatgagctggtaggtcatgcagctgccaataatctagggggtgctgacacttccggcatgatggatatatct

SEQ ID NO: 551001 - DNA, 82 bp, Homo sapiens
ttactgcctcaggaagcatgaaagcttaggcaacattttaattaaatgttgccccaggtctttattcttgctgagaaagtaa

SEQ ID NO: 551002 - DNA, 82 bp, Homo sapiens
ggggcatgggtaggaccctggaggggttttcagtcccttcatggacttggagactgtcagcccctcctggccttcctgcctc

SEQ ID NO: 551003 - DNA, 82 bp, Homo sapiens
gccttctcagtgagctacctgtgcaagtaaattaaatcaaacatttaatgttagctgtgcaggttacttcatttatgaaggt

SEQ ID NO: 551004 - DNA, 82 bp, Homo sapiens
ggccttgaggcaagtgtatatgcccatggactgcatggtgctggcttccacgatgtagtccaaaggcacataccctcacgcc

SEQ ID NO: 551005 - DNA, 82 bp, Homo sapiens
gggtcccttattgctgttaggcccagggctggaaccagcaatacctgagtctcccctgagctgacagcaggagcctcagccc

SEQ ID NO: 551006 - DNA, 82 bp, Homo sapiens
ttttctctctggaggcaattgggactataggagcagctgcaacagcagcatttgccattttgccagttgttcagagaatgaa

SEQ ID NO: 551007 - DNA, 82 bp, Homo sapiens
aggtttcaacagcatagagctccaggcctgggagcctcactcctgttggtcctttggtctggagactcttgctttttctcct

SEQ ID NO: 551008 - DNA, 82 bp, Homo sapiens
caaggccacacagacaatgccctttctcattgttatgacaaagaaacaaccaaacggtgagaaggggtgttgtctgcccttg

SEQ ID NO: 551009 - DNA, 81 bp, Homo sapiens
tagttacatagtaactaatagtatgtattagtagtacacagtactaatactgctgatactactgctagtactatgtaactg

SEQ ID NO: 551010 - DNA, 81 bp, Homo sapiens
tgtgctgctttgcgggtggacgagggtctacacgctgccttcgcagagacaggccctcctttgcccgtgaatggcagcgca

SEQ ID NO: 551011 - DNA, 81 bp, Homo sapiens
gttttccatcatgaggccatttgaagtgtgagattgtttttctgaaagatcaacactttaaaaatctttctgatgacaaac

SEQ ID NO: 551012 - DNA, 81 bp, Homo sapiens
gaggtggaggctccaaggaatgttaaaataatctgtggcaaaacagagaaagctaaatattcattaaggggctttcatttc

SEQ ID NO: 551013 - DNA, 81 bp, Homo sapiens
gtattctggtcaagaatttacttctggtttataaatcattttttggtttatatatcaggagtaagatctagaccagaatac

SEQ ID NO: 551014 - DNA, 81 bp, Homo sapiens
cagggctgggaggggcagtgggtgccgggccagcagcaggccaggaggtaaccattccccacctgtccctgcccagctctg

SEQ ID NO: 551015 - DNA, 81 bp, Homo sapiens
ttaaagtccggagtgggtgtggctatacgacacacaaccagaatgattagattgactttctggcacacctactcactttga

SEQ ID NO: 551016 - DNA, 81 bp, Homo sapiens
gttgggtgatttttctgtttcagaaaggacaggctaagtcagagttcaggtattctggaacagagaaactgtcataccaac

SEQ ID NO: 551017 - DNA, 81 bp, Homo sapiens
cagtcagaaatgagcttattcataaaagtgcagtatggtgaagtcaatctgtaattttatgtataagctagtctctgattg

SEQ ID NO: 551018 - DNA, 81 bp, Homo sapiens
catgctgtgaccctctagagggaagcgctttctgttgtctgaaagaaaagaaagtgcatccttttagaggtttactgtttg

SEQ ID NO: 551019 - DNA, 81 bp, Homo sapiens
ttctccgcatgaatcagctcactgcactgctcctgcaccagggaggggccggagtggtacaggaggctgattcacggggaa

SEQ ID NO: 551020 - DNA, 81 bp, Homo sapiens
tcaatccttaacctcttagtgcatctcattagtttggtaatttattcatcaaaaatgcactccaagatgtggtgggattga

SEQ ID NO: 551021 - DNA, 81 bp, Homo sapiens
cctggcctgtttggcattaggggtgggagttggccaatccctgctttgatgttgcttctgctccagatgccaggggtctgg

SEQ ID NO: 551022 - DNA, 81 bp, Homo sapiens
tggggttgggctcagccagtagatcgggaggatgtaggatattgtgccaacatagcttcaatctattggctagcaactcta

SEQ ID NO: 551023 - DNA, 81 bp, Homo sapiens
tgggatgtgtgcgggaggctgagtccagccaccacacgggtcggcttccacagggtttcccgcacgcactgtgctgtccca

SEQ ID NO: 551024 - DNA, 81 bp, Homo sapiens
aaaaattatataattagctgacagtcctggttgtcccataagcttagacaaccaggaccttcagctaagtacataattttt

SEQ ID NO: 551025 - DNA, 81 bp, Homo sapiens
ctgggcagacaggtgtcccctggtcccctttcctcaccccaatccaggaaaagggaccagggaacatctgctaattctcag

SEQ ID NO: 551026 - DNA, 81 bp, Homo sapiens
ctgttgataggctgaggcctgcagtagactgtgggctcaggagcaggtgacagtctgctggagtcttggcttcctcagcag

SEQ ID NO: 551027 - DNA, 81 bp, Homo sapiens
cctcaaacattatgagcccactggtgaatccccagctccacctctgtacccccattcaccagtgggctgatagtccccagg

SEQ ID NO: 551028 - DNA, 81 bp, Homo sapiens
ggagttcctggcatccaagcagaatcacgtgagagcaacacctgttattttcatgtggtcattgctggccctcaggattcc

SEQ ID NO: 551029 - DNA, 81 bp, Homo sapiens
ggggtttctggctgggtgagtgtcactgtggtaccagctgctgctataccccactgtgacacagacaccttcagaaacctc

SEQ ID NO: 551030 - DNA, 81 bp, Homo sapiens
ggaacggtggatcaaagagcacagggtgagagctggaaaatagttaattaagtttttattcctttttctttgtgctgttct

SEQ ID NO: 551031 - DNA, 81 bp, Homo sapiens
gcagcatgcagaggtggctgcacactgggccgagtgtcaggagatgaggcccacctctgtgtggtcacccattgcatatgt

SEQ ID NO: 551032 - DNA, 81 bp, Homo sapiens
ggtcatgtgagacgtgctctctgtcatggcagggatgacctcgcagaccttgctgtgatcaggagtgaccccctcatgacc

SEQ ID NO: 551033 - DNA, 81 bp, Homo sapiens
gctgcttggcactaccagcattcttctctctccttttctcagtggaaatgaattcaaccagtgttgtagttggccagcagt

SEQ ID NO: 551034 - DNA, 81 bp, Homo sapiens
tagactgtggacctcagagcttgggttttcttaatggaggaattatcagggagaaaactggagcctggggttgctaagcta

SEQ ID NO: 551035 - DNA, 81 bp, Homo sapiens
tgacttattttttgtggtcctatcttctagcctgagtgttaaccaggtggacaggcagattaggattaggaaataagatca

SEQ ID NO: 551036 - DNA, 81 bp, Homo sapiens
ccaggacacaaggcgccgggccagcttcactgatgcttccacaagttaggggtgggctggcccggcctttgctgcccctgg

SEQ ID NO: 551037 - DNA, 81 bp, Homo sapiens
gatactcgaaggagaggttgtccgtgttgtcttctctttatttatgatgaaacatacacgggaaacctcttttttagtatc

SEQ ID NO: 551038 - DNA, 81 bp, Homo sapiens
ctgagtggctctggcacagttcactggacctttctgctgaatgatgttagggacgtccagggactcacagagcaaactcag

SEQ ID NO: 551039 - DNA, 81 bp, Homo sapiens
caggtttcacccagactccagtttgagcctttaaaactgtagaacagggatggttcatgcagaggtctgggatggagtctg

SEQ ID NO: 551040 - DNA, 81 bp, Homo sapiens
ggagactccacattcagtgggcagtgaacactcctttaccagagggaatggaggaatccttgcttattggatgtgttcttc

SEQ ID NO: 551041 - DNA, 81 bp, Homo sapiens
gtttctcagtttcatacattatctgcatcaccagctaaatttctagatgtgctttgcagatgatatttgaagctaggagac

SEQ ID NO: 551042 - DNA, 81 bp, Homo sapiens
ccttgcttgcagcatatgcattaattcaagaaaggtgaaatccaaaatatgaataggctttgtatgtgctttcaagtgagg

SEQ ID NO: 551043 - DNA, 81 bp, Homo sapiens
gagaaatgccctattttctgctgtcttggagatctcaagatcatcactgagacttcaggataaacaggaaaggggttactc

SEQ ID NO: 551044 - DNA, 81 bp, Homo sapiens
gatactaaactgtttttgcgatgtgttcctaatatgcactataaatatattgggaacattttgcatgtatagttttgtatc

SEQ ID NO: 551045 - DNA, 81 bp, Homo sapiens
tttttattttcctctttctctgctcttaaccctcagtcacagaatcatgttgcagggagggcaggtaggggaaaaagaaaa

SEQ ID NO: 551046 - DNA, 81 bp, Homo sapiens
gccaagtcatggtcccagcagccaggccagctgactagacagcaacaaccagatggcactgctgggattgtgtctttctgc

SEQ ID NO: 551047 - DNA, 81 bp, Homo sapiens
taaggttttgaatagtgtcccagtttgcagccttggctgaatataatcccttggctgcaaactgggatactattcaactta

SEQ ID NO: 551048 - DNA, 81 bp, Homo sapiens
gggtacggggatggatggtcgaccagttggaaagtaattgtttctaatgtacttcacctggtccactagccgtccgtatcc

SEQ ID NO: 551049 - DNA, 81 bp, Homo sapiens
ttttatttcatgcactacttggctttactgattaatatgccccatggcattcaataaagtcaggcagtggaggaaataaga

SEQ ID NO: 551050 - DNA, 81 bp, Homo sapiens
gtaagaaatgagaaatttttagggccattgagcaccatgcattttcagtgttcagtagccctgaaaatttctcatttaggc

SEQ ID NO: 551051 - DNA, 81 bp, Homo sapiens
tgcaggaagtctgggaggtgagtcactaaaaagcagccccagttcaaagtgctgatgggacttgcctcccgcccccctgca

SEQ ID NO: 551052 - DNA, 81 bp, Homo sapiens
gattttcccaacattttatggcaatttgtttcatttgccgcaggcccgtaacgatgcaaattgccataaagtgggataatc

SEQ ID NO: 551053 - DNA, 81 bp, Homo sapiens
gggtcctggctggggcttgaatggggttccatggtcttggctggagtgtggggtcttggagaggcagtccagctggggtct

SEQ ID NO: 551054 - DNA, 81 bp, Homo sapiens
tctgggtcccttaaagaggtgatatttttccgtggttgttgacctgctggcaacccttgtcatcttcagaggagacccaga

SEQ ID NO: 551055 - DNA, 81 bp, Homo sapiens
tcctggtccagactcttctccttcctcaaagggagccaaagacctcagcttcccccatatgaagagtctgcgggtcagaga

SEQ ID NO: 551056 - DNA, 81 bp, Homo sapiens
tgggtgtgctcccagcaggggacgttcttcagtgtttgtttgttaatgatgaatatttcctgcctttgggtcacttcccca

SEQ ID NO: 551057 - DNA, 81 bp, Homo sapiens
gaggactaaaggagatggggagagcccctgatgctgggtccagccaccgtggggggctccttccacattttcttcagcttc

SEQ ID NO: 551058 - DNA, 81 bp, Homo sapiens
gagattttgtgacattatgtgtggcatattaggttgtgtaagtggattataacctagggtaccaaagtagtgtgacatctc

SEQ ID NO: 551059 - DNA, 81 bp, Homo sapiens
tcatggagggaaataggatcaggggtttggggtgagtggcctcgcttgcccccggactcctggccctccttttttccctgg

SEQ ID NO: 551060 - DNA, 81 bp, Homo sapiens
ttttattccagacactgtaggtgagagctggcacatgccactatcactgggccagctttcacacagtgctctaggctaaaa

SEQ ID NO: 551061 - DNA, 81 bp, Homo sapiens
gattatcccactttatggcaatttgcatcgttacgggcctgcggcaaatgaaacaaattgccataaaatgttgggaaaatc

SEQ ID NO: 551062 - DNA, 81 bp, Homo sapiens
tagttctatcttttggcatgtggcctctgggttatttcacaagacaccttcccagtcgcccaggctaaaagattggggcta

SEQ ID NO: 551063 - DNA, 81 bp, Homo sapiens
tcccaccctggctgagcaggcacgctgcgccctgtgctcctgcgctccctgcgcctcgatgccctttagccaaatgtggga

SEQ ID NO: 551064 - DNA, 81 bp, Homo sapiens
gtgtagctcgtggctggacaaatgagttggtaaaccaatgaagatgaggaagaccaactcatgtgcagctcatggctggac

SEQ ID NO: 551065 - DNA, 81 bp, Homo sapiens
cacctgtaagcaaccataggcttgctctaacaatgctcatcaaaatagtgaagtctttgggatgtgcctatggttgtggtg

SEQ ID NO: 551066 - DNA, 81 bp, Homo sapiens
gcctctccttccagctcgagactgactctgactcatggggcagctcctgtgcgcaggggagtctcaggtgggtggggcggc

SEQ ID NO: 551067 - DNA, 81 bp, Homo sapiens
ttctgaccccagtgggagactggtcatggatgcatgagcctgaaatgtccaggctccctgacactctccccatgggaagaa

SEQ ID NO: 551068 - DNA, 81 bp, Homo sapiens
taggctgctctcaaggaactccagactgttggtgccccaagtcctcaccaacagttaggagttccctgagagcaggcgctg

SEQ ID NO: 551069 - DNA, 81 bp, Homo sapiens
tggtacttggagagaggctggccgtgatgaattcgattcatcaaagcgagtcatacacggctctcctctcttttagtgtca

SEQ ID NO: 551070 - DNA, 81 bp, Homo sapiens
tgcaagccagctacgttttctagggctcaaccaatgaagcagtgatcaagttcaagcccagaggaaaatggctgacttgta

SEQ ID NO: 551071 - DNA, 81 bp, Homo sapiens
ggttttcatcactgtttcactgggatccctcacattagagaatctatgtgaggtgcctacgctgaaatggaaagaaaagct

SEQ ID NO: 551072 - DNA, 81 bp, Homo sapiens
gtattttgtaagattggaggggtctgatttgttgaggagaggggaataaacaaatcagactcctccaatcctacaaaatgc

SEQ ID NO: 551073 - DNA, 81 bp, Homo sapiens
aggagaactctcacatgtcttctctgtgggatacacaggatagtccctggatcctaagagagggcagatgtgagtcatcct

SEQ ID NO: 551074 - DNA, 81 bp, Homo sapiens
ggggtcagggcagccagctcccctggcaggctagatttatgatttggctgagctggggagagagggagcctgcgacaatcc

SEQ ID NO: 551075 - DNA, 81 bp, Homo sapiens
ccctgaactttactccactggctgccatgaccccaggccagatccctggctgaagggcaaggagccagtggaggagaaggg

SEQ ID NO: 551076 - DNA, 81 bp, Homo sapiens
cctccagtgctcaccactgtgctatagctccaagtagagcagctggggagtaactgctgatggtgagcacatagcgggagg

SEQ ID NO: 551077 - DNA, 81 bp, Homo sapiens
gagtgtgtgtctgtgtgtgcacctgtgtctgtctgtattcgtgttgtatagacagacgcaggtacacacagatacatactc

SEQ ID NO: 551078 - DNA, 81 bp, Homo sapiens
ggctgcatgggcacagtgtggccaccttcagtcactctgggagggactggcagtgggtggcactgtgtccttttgtctgcc

SEQ ID NO: 551079 - DNA, 81 bp, Homo sapiens
tggcttctctttggaaacagttcactggttttctcaagggaccaatgggctatgaagaccagggactgtccaagctggcca

SEQ ID NO: 551080 - DNA, 81 bp, Homo sapiens
tcctggcttctggggatcacatgagggaatctatattgattattttttaactccattcaatagatccctaggatgccagga

SEQ ID NO: 551081 - DNA, 81 bp, Homo sapiens
ctcctgtggtcattctcctttaggcttctttgttggctttgtagacctacaaagaagcctacagaagaatgaccataggag

SEQ ID NO: 551082 - DNA, 81 bp, Homo sapiens
ggcgcccagggggagggggcaggcaaaggccctttaattagttactttcaaaggttccctgtcccctttctctcgggtccc

SEQ ID NO: 551083 - DNA, 81 bp, Homo sapiens
gtgttttgtgtggtatgcctcgtttccagtaacccagttaaattaaaggtttgttgagggctaggcaatctacataatcac

SEQ ID NO: 551084 - DNA, 81 bp, Homo sapiens
gttttattttctctcccaaatccccaaatgaggtgcagcatctcattttcatgaggaactggggaggagagaggataaagc

SEQ ID NO: 551085 - DNA, 81 bp, Homo sapiens
acagagccaacagacctggcatcttgaaagtcttgttctctgctgaatgtctgttttcttgtgttagtttattggctttgt

SEQ ID NO: 551086 - DNA, 81 bp, Homo sapiens
gcctttgtacccaatggtggttgcttgaactttattgagaaaaacgataaagttcttgttgctggatttggttaaaaaggt

SEQ ID NO: 551087 - DNA, 81 bp, Homo sapiens
ctgctgcccaccagaggacggggtacagcctgtggcaggagcaccggccacctcactccctccctctgggtggggcagcag

SEQ ID NO: 551088 - DNA, 81 bp, Homo sapiens
ttttacagacttgctgctctgagttagcttgaccctccactgttaaggtggggaaagcaattcaagcagcagattgtgaaa

SEQ ID NO: 551089 - DNA, 81 bp, Homo sapiens
gcatctgtttattttcatggcgaggcttcatggggacgggaacaagtccttgatgagcgcctgccagagctgggcaggtgt

SEQ ID NO: 551090 - DNA, 81 bp, Homo sapiens
aggagagagctcaacggtctatcttctgaatattacaatgtatcataatgtgcagaaggtagaatgttgaggtttcttcct

SEQ ID NO: 551091 - DNA, 81 bp, Homo sapiens
ggggaggctctgtggaaattatgagggtaggaggagggttgtaaagctccctaatgcccttatggttactactgtagcccc

SEQ ID NO: 551092 - DNA, 81 bp, Homo sapiens
gtcacactgagcagtatatcatttcatggaggaaaaaaaaagttttaccatgaaaaatgctatgttgtatcacagtgtgac

SEQ ID NO: 551093 - DNA, 81 bp, Homo sapiens
ggagctgattttgtatgaagcaaaactaatcagagcttctgagcagcatgtcctggttttgtttcatacaaaacagaatcc

SEQ ID NO: 551094 - DNA, 81 bp, Homo sapiens
ggggcaggataggggcacagataatggtataggggttcttttctggcaccttgtgtcatattatttgcccttttcctctcc

SEQ ID NO: 551095 - DNA, 81 bp, Homo sapiens
tttgatggactctgtgacactgtggtagtaataaccactactatcatagtaataccacagtgacacagacctcacttcaaa

SEQ ID NO: 551096 - DNA, 81 bp, Homo sapiens
ccaggtagaggtggagcgaagtggggctctggaagctgtctacttaaacccctttcccacttcctgctcctccctccctgg

SEQ ID NO: 551097 - DNA, 81 bp, Homo sapiens
caccactgcctgtcttccacgccctctgccattttgtatccatggatattgaagaggtgtaggaagaaaggtttcaaggtg

SEQ ID NO: 551098 - DNA, 81 bp, Homo sapiens
cattgctgagcctcctgagcacagtcctggggttggatcattgcaagttctgggatctgtatttggggggttcctctagtg

SEQ ID NO: 551099 - DNA, 81 bp, Homo sapiens
gccgcctcgggggaaccggcccgggcctcggccgcctctagtcctcacacagccgaggccctctcggtcccccgccgcggc

SEQ ID NO: 551100 - DNA, 81 bp, Homo sapiens
gtgggaagtgccctacttggaaaggcatcagttgcttagattacatgtaactattccctttctgagtagagtaagtcttac

SEQ ID NO: 551101 - DNA, 81 bp, Homo sapiens
gccgggagctgtggaagggctggccaggagggaggaagaggtattttttcctcctttctagttaccattttgcagctcggc

SEQ ID NO: 551102 - DNA, 81 bp, Homo sapiens
gcgcggggcacgctggtcattgtagtccagtccatatgagctcccggggcactggactacaactcccggcaggctctgcgc

SEQ ID NO: 551103 - DNA, 81 bp, Homo sapiens
ttttggccattcataattatttctccctgtggagctctcatgagattccttgtacatgagcaataattgtgagtgtcaaaa

SEQ ID NO: 551104 - DNA, 81 bp, Homo sapiens
aggtgagtaggtcgcatggaaaatggaaatctacagaaaattctaggagtttttggcatcaacatttccaacctctcacct

SEQ ID NO: 551105 - DNA, 81 bp, Homo sapiens
caatcagagactagcttatacataaaattacagattgacttcaccatactgcacttttatgaataagctcatttctgactg

SEQ ID NO: 551106 - DNA, 81 bp, Homo sapiens
catgtgttgggggtgcctttcagagtcaccttcctgaaacctgtaaagaattcatggctctgaaaggttcctccttagctg

SEQ ID NO: 551107 - DNA, 81 bp, Homo sapiens
gctaaacctctttcttgctctaagaaggttgacctgctgatgaaagaacagaaggttggaattcttttgagcaggaatagc

SEQ ID NO: 551108 - DNA, 81 bp, Homo sapiens
agctttccaggatctcctgcaattacactggttggagttagccacgaattaatgagtgtagttgtagggagcgggaaggtt

SEQ ID NO: 551109 - DNA, 81 bp, Homo sapiens
atgccactcaccttcttttaggaaaagatttgtatttaataggaagcctgggcagtgtttttctacaagaagagagggtgt

SEQ ID NO: 551110 - DNA, 81 bp, Homo sapiens
aggagccaaacatgacctggcagtgtagttgggtcctctggaagtatctggagctacactgtctaggtctgctttggacct

SEQ ID NO: 551111 - DNA, 81 bp, Homo sapiens
gttgcttcattatttattgaaagcaccttggggagcaatgtgttgtttcccatggtgttattcaatagataatgaattaat

SEQ ID NO: 551112 - DNA, 81 bp, Homo sapiens
actccaacgtggccatctgcttagcccatctgcctgtcatccccccaaacagcaagtgcctgctgacaggtggcatggagt

SEQ ID NO: 551113 - DNA, 81 bp, Homo sapiens
ggttatttggaccaattgtgagagcaggtagtctcctccagcaggcagtggctcatggctctcacaatgggacggataact

SEQ ID NO: 551114 - DNA, 81 bp, Homo sapiens
ggctgttctgtagagtcagcaggtggtaatcaaggatttggttttaaagattagccacctgctgttttcttcaccttagcc

SEQ ID NO: 551115 - DNA, 81 bp, Homo sapiens
ttttttccttttccttctggcagcttcttggcatcaacatagacatgcctgaagagctgttttggagcctgaaggaaaaaa

SEQ ID NO: 551116 - DNA, 81 bp, Homo sapiens
ccaaagtagaaagcaagacaaacacttttcagattttcactggtgggagtattttctgttgttgttttgtcttctctttgg

SEQ ID NO: 551117 - DNA, 81 bp, Homo sapiens
aattgaagctaaacttgcatccatgtggcttttacctgagggctatttcctggccatatggcctcaagttagcattcgatt

SEQ ID NO: 551118 - DNA, 81 bp, Homo sapiens
actccatttcccagaaggccttgtatcccgtgcatggccgtttccaggcaggaaggcgaagggccttctgggaggtgaggt

SEQ ID NO: 551119 - DNA, 81 bp, Homo sapiens
tggggagcagcggggccccccagtgaacctctcaccgtttggtagagggtggcactctgggggctcctctgtactttccta

SEQ ID NO: 551120 - DNA, 81 bp, Homo sapiens
atgacaaatgatgcagctgctcttcctctattggacacatgtacaaaacaggaagagaggagcagttgctacatatgccat

SEQ ID NO: 551121 - DNA, 81 bp, Homo sapiens
aggaacctgctcgaaagtggcaggtatccaggggtcccttcaatccctgaggatgtgtgattcttttgagtaatggttcct

SEQ ID NO: 551122 - DNA, 81 bp, Homo sapiens
ttctgtctagtctaacaccataacctcagcctgcttgcattgtgctaggagctgaggttatgatgttggactagacatgga

SEQ ID NO: 551123 - DNA, 81 bp, Homo sapiens
gaggtatgcttggctgtgagggtttataggataaaagggggaagaaagtcctaactgaatactcacagttaagaagacctc

SEQ ID NO: 551124 - DNA, 81 bp, Homo sapiens
accagaattggtatgggtaccacctcactgaattccacattcaatgttggtgcctcggtagggtggtatgccagatctggt

SEQ ID NO: 551125 - DNA, 81 bp, Homo sapiens
tcttctgctgcagtcaggagtggggtggggcccctcagggtgctcttggataccagcccctccccacccctgcagagagga

SEQ ID NO: 551126 - DNA, 81 bp, Homo sapiens
tcccagtgccaagagctaccttcacacagggcccaggagaaggctggggtctagtgtgagcgtagtctatggcactgagga

SEQ ID NO: 551127 - DNA, 81 bp, Homo sapiens
agcttctgcaatctgtaacatgccacaggcagccatctatagctgctagcagcctgtggaatgttacggattgcagaagct

SEQ ID NO: 551128 - DNA, 81 bp, Homo sapiens
ctaaggaattaatggcccgctgaggttaatgagtccctcctctgggccatcaactctcccagctggccattaatcccctag

SEQ ID NO: 551129 - DNA, 81 bp, Homo sapiens
ttctttctgtagagaatgagttggtacataaggaacctcattatagtgacttatgtacccactcatattccccagagagag

SEQ ID NO: 551130 - DNA, 81 bp, Homo sapiens
tccttttgttttgctcttatatggtggtcttgagtcttttctctggcttttcaaacctagtaagactaagacactaaggga

SEQ ID NO: 551131 - DNA, 81 bp, Homo sapiens
cctcagtgtgtctcccacatgggaggagtgaaccaatatggcgtcctggccctccttacccatctgtgaggtgcactgagg

SEQ ID NO: 551132 - DNA, 81 bp, Homo sapiens
gagtctcagaagacaagcaagggggttgcttttgattgatcagtcaaacacaatccccttcacaattgtctttggagactc

SEQ ID NO: 551133 - DNA, 81 bp, Homo sapiens
gtcctgagcaccaatgggtcaagccagtgctcttgcttccctcctgctgagagcactggccttggtcctgggtgccaggat

SEQ ID NO: 551134 - DNA, 81 bp, Homo sapiens
ctggtgatgcttagggagaagtggttaggttcacactgtgtggttgagagcacccctaccttccaaagcaatactcaccag

SEQ ID NO: 551135 - DNA, 81 bp, Homo sapiens
tgcagactctaaaggttgcacagtctggtctctatctgccctcaatgagacctaggctcagtgcagactttaaagtttgca

SEQ ID NO: 551136 - DNA, 81 bp, Homo sapiens
tgtcagtaagtgatgaattaactcagctccaaggctgttccagttgacagtgagagctgatttaactcatttctcactgca

SEQ ID NO: 551137 - DNA, 81 bp, Homo sapiens
tgccttggcagttggtgctgaaaaaaaatgtgtcaacaaacacatcagacacatttgcagtgtcaaccgcctccagaggca

SEQ ID NO: 551138 - DNA, 81 bp, Homo sapiens
tttccctcggaggaaatcgtactgtcatttgtttttattttcaaaatgaaaacaaatggcactataattcctaagggcaaa

SEQ ID NO: 551139 - DNA, 81 bp, Homo sapiens
atggccgtttctggcttagggtaggatggttgtaggtgctggcaacacagtcacctgccacttcctgcctcagtctgccat

SEQ ID NO: 551140 - DNA, 81 bp, Homo sapiens
gttcgccaggtgaagaagggggggaagggcgttccagccagagggaacttggcccatctcctccctcctccccatgccaac

SEQ ID NO: 551141 - DNA, 81 bp, Homo sapiens
ttccaataccctgcccttttcacaagatttccgagagagcagttcacagcgctcattttgtggggagagaggggggtggaa

SEQ ID NO: 551142 - DNA, 81 bp, Homo sapiens
gtgcagcctcttcccaagttcatgtcactgggtcaccagagatggaatctaagtgagatgagagggactgagggaaggcac

SEQ ID NO: 551143 - DNA, 81 bp, Homo sapiens
ctgaaggtcaaccagtcctcatggttagcagaaacaagcttaaaaccacctctgattcccatgagtgctggtgaccaccag

SEQ ID NO: 551144 - DNA, 81 bp, Homo sapiens
gatcagggcagtcgggggctggctgctggtacctgagccctgtggccagggtctcagtggccgttccctgccatcctggtc

SEQ ID NO: 551145 - DNA, 80 bp, Homo sapiens
ggggccccaggggaggggtggtcggtgctcctttttctttaaagctcttttggccagctgcccctctgccccgggacccc

SEQ ID NO: 551146 - DNA, 80 bp, Homo sapiens
gataggggaatggatggttgatcagagaacgtacattttataaatggtgtatgtcagttgatccacagtccctacctatc

SEQ ID NO: 551147 - DNA, 80 bp, Homo sapiens
ggctcaggtctgtggtggccgcgggagagccagctccacgctgtgtggctggtgacatttccggctgccagggcccagcc

SEQ ID NO: 551148 - DNA, 80 bp, Homo sapiens
atcctcctactttccttttgggatcttgatggtgcctattcagggagtccatagggttccagaggaaaggaaggaaggat

SEQ ID NO: 551149 - DNA, 80 bp, Homo sapiens
tacagggcagggtggggtgaaaacagttttagggacgcccccttcccatcctttcctcttcaccccccgcccaccctgtg

SEQ ID NO: 551150 - DNA, 80 bp, Homo sapiens
gcataggggaggtgggagagggtctcagagcctggtaatgcacctctcctatctgcaaccccttccatctccttgcatgc

SEQ ID NO: 551151 - DNA, 80 bp, Homo sapiens
tcctttagccctgttctccttgtttttccattcatattttcatgtctaggaaggaaaacatggggaacagaggcctggga

SEQ ID NO: 551152 - DNA, 80 bp, Homo sapiens
tcacatgtccaattctgtaaaggaagaagaggtaagaagaagtgaagccctcttcttcctttgcagagttgaatatgtgg

SEQ ID NO: 551153 - DNA, 80 bp, Homo sapiens
ggtacctgaagagaggttttctgggtttctgtttctttaatgaggacgaaacacacctggttaacctcttttccagtatc

SEQ ID NO: 551154 - DNA, 80 bp, Homo sapiens
ctccaaacagcactgaacgcagcattcttgcagaaatctccaacgcaactgggtgctgcgtttctgtgcctggtgtggag

SEQ ID NO: 551155 - DNA, 80 bp, Homo sapiens
gcggcgtgcttcctctcagctcctctcctcggggcttttcggagcgaggagggaggtttagaggaagttagaaacccagc

SEQ ID NO: 551156 - DNA, 80 bp, Homo sapiens
tcctgccatatttccttagcctgctcttccctgtgttgtgctgaaaggaatggggaagagcagattaagcaggtggctga

SEQ ID NO: 551157 - DNA, 80 bp, Homo sapiens
tgtcctagaaagagctgtgtaggacaaccagagagaacatacattatccagctgtccaacatagaaactttctatagata

SEQ ID NO: 551158 - DNA, 80 bp, Homo sapiens
gagtaggaaaacatcccttgagagaggatcacctattaggtacataattccagctctccttcaggggtgttttctacctc

SEQ ID NO: 551159 - DNA, 80 bp, Homo sapiens
ccaccccgcccctgctggctcagtcctctgccccttgaggttgacctctttagggtgggctggcatggggcatgggatgg

SEQ ID NO: 551160 - DNA, 80 bp, Homo sapiens
gttaggaaaaagaggattgctattttgggatttggggttctacccagcaacacccaagataccaccttttttaccatggc

SEQ ID NO: 551161 - DNA, 80 bp, Homo sapiens
caggaggtgacggatgctggaagaggcaggcaatgttggaaccctgactattgcatagcttgtctcctagtaacggcctg

SEQ ID NO: 551162 - DNA, 80 bp, Homo sapiens
gccattgaaaggcatgaagacttttggtgacaggaatagggaaactgagtcaccaagggctttgagtgcctttgtttggt

SEQ ID NO: 551163 - DNA, 80 bp, Homo sapiens
gcttccccacgtgctgtttcactcacatctttatccaggtctggcccttgtgagggtgtgcagtgtgcggtgtggggtgc

SEQ ID NO: 551164 - DNA, 80 bp, Homo sapiens
ctgtacccagagctgcttggagagccttccacatggatcagtcaatgaccaaggaggagttctaagcctttgggtggcag

SEQ ID NO: 551165 - DNA, 80 bp, Homo sapiens
gaaaagctgactgctagagtccatcagttaagctctaaggcatgtccttaactgatgaactctggctgtcagaacttttc

SEQ ID NO: 551166 - DNA, 80 bp, Homo sapiens
atcctcacatctgtttctgaccttcccaccatttgggtgtgaatcctgaatgtggtaggtgtcaggaaagagtagaggat

SEQ ID NO: 551167 - DNA, 80 bp, Homo sapiens
gcaaagcagcaattgttctttggtctttcagccatgacctgaccttctgtctgtgagaccaaagaactactttgcttggc

SEQ ID NO: 551168 - DNA, 80 bp, Homo sapiens
ggggagcccaggaaggttatcagagggagaagagtgaggacaagaattttttcctttggcttccttcctgggtagttccc

SEQ ID NO: 551169 - DNA, 80 bp, Homo sapiens
gctacgttgtgtgtatctgaagttaaacatactcaaaaaaagagaggtaataaactcttcttcagatccacactcgtggt

SEQ ID NO: 551170 - DNA, 80 bp, Homo sapiens
atagtttgtggctgggccactagctttaaacttgaaatgaagtgtccagttttgagttactgtgtccaaccaccatttgt

SEQ ID NO: 551171 - DNA, 80 bp, Homo sapiens
tatttgctcaagactaaactgtaggctcttctctactgcacgctgttgagaagagcccacagtttagtttggagcaaatg

SEQ ID NO: 551172 - DNA, 80 bp, Homo sapiens
ctgggcatcttgttctgacaatctctttggcagtgacccaaggacagtgttcagagggtttgggaagagcaagacaccag

SEQ ID NO: 551173 - DNA, 80 bp, Homo sapiens
actttccatcatgagagccaggttgacttgctcccgggggccaaaccctagagcaagtctacagaggctctctggaaagt

SEQ ID NO: 551174 - DNA, 80 bp, Homo sapiens
gccgagcccgcacactgctcccaggacagccggcacaggcagacgcagccctggcaccgggagcaggtgtgggctccagc

SEQ ID NO: 551175 - DNA, 80 bp, Homo sapiens
cagggcaattgaggcttagtcaatcagactcaatgagccgcacttcattgatttttggatctgagctgcaatggcgcctg

SEQ ID NO: 551176 - DNA, 80 bp, Homo sapiens
gctattagtaaatgggtgtgtttgatgaattgggcatcatgcccagatttccatgcatcacctcatttaatcttcacagc

SEQ ID NO: 551177 - DNA, 80 bp, Homo sapiens
ttggccagggagtaggcagtagcttgagttataaggaatttctctttgaggtctcggaactgctgattgctctctgccag

SEQ ID NO: 551178 - DNA, 80 bp, Homo sapiens
tgcctatggtgagcccctgcctacctcatcagctcatgacagtcctggctgtggggagcaggggttctgaacacagagca

SEQ ID NO: 551179 - DNA, 80 bp, Homo sapiens
aggataatagactggggttgaactctagtcagtaaaaggaaacttttcagacttggagttaaagttcaatctgttattct

SEQ ID NO: 551180 - DNA, 80 bp, Homo sapiens
agcactctttcctcttccacctcctccagccacagagcctagccatgcctgggtgtggggaggggagggatagattcgct

SEQ ID NO: 551181 - DNA, 80 bp, Homo sapiens
taggccatcacactcaggagcatgtctctcttccatgcctccaaaaatggcaaagagagacatctgagtcagacggcctg

SEQ ID NO: 551182 - DNA, 80 bp, Homo sapiens
ggctcacaaagactgatccaaagtcacaaatccagtcaatctgtctggcagtagagacttgatccagtctttcttgagcc

SEQ ID NO: 551183 - DNA, 80 bp, Homo sapiens
ctgaaggcagtaggaagtttaggaaattgttctataaaggtgggacttgggagcagtttcagactttccatattcttcag

SEQ ID NO: 551184 - DNA, 80 bp, Homo sapiens
ttggaaatgtgtaaagcttttctttgttcagtgagtcttttcattatttaaaatagagagcagctttgcggttttctcaa

SEQ ID NO: 551185 - DNA, 80 bp, Homo sapiens
tggttcaattttaagtagggtttggaactgggattggaaggacagcttggcccagttcacagacctagatttaggaacca

SEQ ID NO: 551186 - DNA, 80 bp, Homo sapiens
atttttatctctcttgtcttaatacttaggaacattgagatgtgtgagtctttgtggccagggtgggagagatcagaaat

SEQ ID NO: 551187 - DNA, 80 bp, Homo sapiens
gcacaggagagggtactggaagagtgtgcccttcaccatgtagtcatcggtacatgccttccagtaccatttttctaagc

SEQ ID NO: 551188 - DNA, 80 bp, Homo sapiens
agataattagtcaaataaacagatgaatatttgtgggaggaaggacacaaatattcatctatttatttgatcaattatct

SEQ ID NO: 551189 - DNA, 80 bp, Homo sapiens
gtggggcaggtggaagggtgagcaaagaggtgctgggatgtctcccctcctcccctcccacccttttcatgcggccccat

SEQ ID NO: 551190 - DNA, 80 bp, Homo sapiens
ggtacctgagaagaggttgtctgtgatgagttcgcttttattaatgacgaatataacacagatggcctgttttcagtacc

SEQ ID NO: 551191 - DNA, 80 bp, Homo sapiens
aaaaatgcagattcctgggtcccacccccaaaagatgctaattttgtagatctgagtaggacctaagggtctgcattttt

SEQ ID NO: 551192 - DNA, 80 bp, Homo sapiens
aggaaaggaaatttgtttattcttgggagtaaatagccagacattctctggctattccaggagtccagggtttcctacct

SEQ ID NO: 551193 - DNA, 80 bp, Homo sapiens
tcctgtttttctcttcctatagatgttgggtgtgtcaaagtagagatgtccacacatctatcttgggagaaaaaactgga

SEQ ID NO: 551194 - DNA, 80 bp, Homo sapiens
ttagtgaggagttcaggcagcgatggagactttggcactgagggccagagcgtgaagtctccctgccaggatctcattag

SEQ ID NO: 551195 - DNA, 80 bp, Homo sapiens
gtgggtgcagtttacgtacttagtgctctatctgctttgaggcgggcagagggaagtattggtgcggggagggcgcccac

SEQ ID NO: 551196 - DNA, 80 bp, Homo sapiens
gtgggattggttttctttgtccagacagctctcctaaccagaaaggctagacctgtttgttaagaaagcttctatcctgc

SEQ ID NO: 551197 - DNA, 80 bp, Homo sapiens
tggctgctgcagtgactgagcgtggggggtgtgtgatcgaaggatacagacagtccccttgttatcactctgggttgcta

SEQ ID NO: 551198 - DNA, 80 bp, Homo sapiens
gctctgcagtgatgggctcggttgcaaggctggtgtggaagacccaggtctgcctgagttttgcaaagcccacactgcac

SEQ ID NO: 551199 - DNA, 80 bp, Homo sapiens
aatgagcaaaccctgaactctaccaaatcacaaatctcattcccaggtgattagtgatttggtggagctcagtgttcatt

SEQ ID NO: 551200 - DNA, 80 bp, Homo sapiens
gcctctgaacaaaatgtgccaggatgtcttgatcacggcacccccggctcagagaccttccatggcgtcttttgttctgc

SEQ ID NO: 551201 - DNA, 80 bp, Homo sapiens
ctctggccatttgtttatctggtgagaaactgctgtgggagacctgtatggcagtagtttactgagtggactggcaagag

SEQ ID NO: 551202 - DNA, 80 bp, Homo sapiens
acagtgtggggtccatacctgcagcaagggtcgatcacccacccccacttctgccttgctgtagggtgactccaagctgt

SEQ ID NO: 551203 - DNA, 80 bp, Homo sapiens
gctctttctctcgctgtcttagaatcacatgtgtgacaatgcctgacaatatgcgattctaagagactgagagaaagagc

SEQ ID NO: 551204 - DNA, 80 bp, Homo sapiens
ggggaatgaagaagaggtaggaacgtagtaagtgaaaacatttgtgcatttcatttgctagttctgcctgatttttcccc

SEQ ID NO: 551205 - DNA, 80 bp, Homo sapiens
tgtggccgccaacatgcctgctggtcaggcccagttccttcacccagccctgggcctgagcacgggtgctggaggccgca

SEQ ID NO: 551206 - DNA, 80 bp, Homo sapiens
ttctaaccactggttgccttttgctgagttactatgattttctgcaaaggggactcagttaacaggaatcagtgagagaa

SEQ ID NO: 551207 - DNA, 80 bp, Homo sapiens
ctgtgactggcggcggcctgtccccagtgcttgtcatttcctgacatgcctgacaggatggggacagccgccccagacag

SEQ ID NO: 551208 - DNA, 80 bp, Homo sapiens
gggaggagaaagctgagaaattctagctctgctacagccagtatgagcagcagagctaggattgctttttttcttcttct

SEQ ID NO: 551209 - DNA, 80 bp, Homo sapiens
ctgactggcttgtatggaggttctagaccatgttagtgttcaagtctacatggatggaaaccttcaagcaggccaagcag

SEQ ID NO: 551210 - DNA, 80 bp, Homo sapiens
gagcagaagttaatgaaatataaaacaaagatacactaagaaagatatatccttgttttctattttattgacttctgctc

SEQ ID NO: 551211 - DNA, 80 bp, Homo sapiens
gtcagtcaaatagtttttattggtctgaatgggtgagctgatatgtttattcattcagccaacaaaatgtttttgatgat

SEQ ID NO: 551212 - DNA, 80 bp, Homo sapiens
gtcaactgtcaatgtctccaagagcgttgagggtctacatttttgcttagtgcttttggacagacattgagttagaggac

SEQ ID NO: 551213 - DNA, 80 bp, Homo sapiens
tggcctgtttaatttccttccaggttcctaaggctcaggacttctagggccattagactgccaggaagggcctaaagcca

SEQ ID NO: 551214 - DNA, 80 bp, Homo sapiens
tgtgacaactgagtgggaggtttgtgtgatgattatctgtccaagcagaattacactaaaaccccccaactcatttcaca

SEQ ID NO: 551215 - DNA, 80 bp, Homo sapiens
gaagtatagtttcttttttgtggggatgctttgcattttgcttgcaactcacattcctagagaaaagagaacagtatttc

SEQ ID NO: 551216 - DNA, 80 bp, Homo sapiens
gcgggcaagtgcagagccctgaagccgacgggctgctgaccctggagcgccctggctcggggactcctgcccaggctggc

SEQ ID NO: 551217 - DNA, 80 bp, Homo sapiens
ttctctttctctgctttgtttccaaaagcctgaagtgtgagaggctcccgctggaggcctgggggcagaggggaggggaa

SEQ ID NO: 551218 - DNA, 80 bp, Homo sapiens
taaatgagctcttgtaaggtgccatataccaattcatgcgctcgaagggagatgaatggtgccttgaaagagctgattta

SEQ ID NO: 551219 - DNA, 80 bp, Homo sapiens
ccagttgaaggttaggctttgtagagctctaaggaaaggtaggaaaatccttgggtctacagagcctaaagtgcaacagg

SEQ ID NO: 551220 - DNA, 80 bp, Homo sapiens
cttggtttggcagcatttggcatcaggaaggaggacgttatattctcccctctcttgctgctcaatgctaataggccaag

SEQ ID NO: 551221 - DNA, 80 bp, Homo sapiens
aggaggggaaggggaaatccataagctttgtctgatttcttatagaaaaaagtagatggatttagtccaggtcctgtctt

SEQ ID NO: 551222 - DNA, 80 bp, Homo sapiens
cctgctcttccttccctatattcttggccagacacaaaaatctgatgctctggcaaatgcagaaatggggagaaggcagg

SEQ ID NO: 551223 - DNA, 80 bp, Homo sapiens
cttccttcctgcttagttttagctccctattctcatcctggccactgagggagggggctaattcttgggtaggagggaag

SEQ ID NO: 551224 - DNA, 80 bp, Homo sapiens
ggatcgcacgtggggccgcagaccctgggcgcccggacgtcagccggaggcgcggggatctcgtggctccgctgcgaacc

SEQ ID NO: 551225 - DNA, 80 bp, Homo sapiens
gcctttcctctactccacatcctccctaaatgccctctctctctaccgaggttggggcaggatggtgagaggagatgggc

SEQ ID NO: 551226 - DNA, 80 bp, Homo sapiens
tcaggttttatgttcagtacttatgggcatgtttttatgtttccccaaaatatgtctggagttactgagctgaagcctga

SEQ ID NO: 551227 - DNA, 80 bp, Homo sapiens
tgcatgtggctaaattacaaactcagaggagcagcttccaaatacgagaattttctgggtggtgatttagtcaacatgta

SEQ ID NO: 551228 - DNA, 80 bp, Homo sapiens
gttcttcatcagagctttgtgtcatggtcatataaggtcatccccttaggtcaccataacacgaagctctgatgaagagc

SEQ ID NO: 551229 - DNA, 80 bp, Homo sapiens
attatgttttgttttctgtcagctgcctgacagctaaaatcatatttgctgtcagaggtgacaggggccacaatagtgat

SEQ ID NO: 551230 - DNA, 80 bp, Homo sapiens
ccacactgataggcattgctggctgatcccaccatcctttcagcacaggacacacagccagtacctgctcatcagggtgg

SEQ ID NO: 551231 - DNA, 80 bp, Homo sapiens
ggcaggcagccagaggggcctggcactgagctggcacggaggagaacggccctgctggcccaggccccttgctgtctgtc

SEQ ID NO: 551232 - DNA, 80 bp, Homo sapiens
caaagtccctgtgaagctggccatggctcagatgaaggcacaagaggtgagccatggctgagagtttacagggtattctg

SEQ ID NO: 551233 - DNA, 80 bp, Homo sapiens
gcaaggggtggggggtggggagaatgggcatgtgacccaccacacttgtcctttttctttccctcctccccactctctgc

SEQ ID NO: 551234 - DNA, 80 bp, Homo sapiens
tgaataggccaataagaatgccagctcccccatgaaactttccgacattgccaggcagttggctttcttctggtctttca

SEQ ID NO: 551235 - DNA, 80 bp, Homo sapiens
ctgggacagtagttatgttggcccctggttccaatgggctggcctaggagcttggtgcctgtcatcactgcaattctcag

SEQ ID NO: 551236 - DNA, 80 bp, Homo sapiens
gaagcagagtggtactgtggggggcctggtcagagctcctccctgtctcctgtccccccagcagcgggccactctccttt

SEQ ID NO: 551237 - DNA, 80 bp, Homo sapiens
tcagctttttaaatataggaaaccagatgtaaatatgctgcttcggttatttacatctgacattcttgcatgcttgctga

SEQ ID NO: 551238 - DNA, 80 bp, Homo sapiens
ggcagtttgttttattcctttccttgggctaagagagaaattgtagctgccccctgagggaaggaatagaatgaaatgtt

SEQ ID NO: 551239 - DNA, 80 bp, Homo sapiens
gctgtttcaaggtagtaccagtaccttgtgttcagtggaaccaaggtaaacacaaggtattggtattaccttgagatagc

SEQ ID NO: 551240 - DNA, 80 bp, Homo sapiens
ggggaaaacaagagtaagaagggaaaggaatgtctcagaaagtcagcctcctgattcccagtcatgctctctctctcccc

SEQ ID NO: 551241 - DNA, 80 bp, Homo sapiens
ggtacttgaagagtggttatccctgctgtgttcgcttaatttatgacgaatcatacagggacatccagtttttcagtatc

SEQ ID NO: 551242 - DNA, 80 bp, Homo sapiens
ttcaaagcactttgcctgtatctcatttatcctcaaaatacccctctgagggtaagtgtctacaggcaaaatgaagtgga

SEQ ID NO: 551243 - DNA, 80 bp, Homo sapiens
tttttgaatgagtctaaatcatttcaaaagcatctggtcttcctagggtgctttcgaaatgaattagcctcattcaaaaa

SEQ ID NO: 551244 - DNA, 80 bp, Homo sapiens
cactccttgcctggcaaggcttgattgctttgaacagggatgacatttaagcagcagagtctagctaggttctaggggtg

SEQ ID NO: 551245 - DNA, 80 bp, Homo sapiens
gataaccgaaaagcacagctggacaggttgtttgaaaattcatttttataatctgtttcccagctgagactttgggggtc

SEQ ID NO: 551246 - DNA, 80 bp, Homo sapiens
ttttgccgtgttagtggatcttttcacttgggtttgtacacatcaaaatccaagtgaaaatgtcaaataacacagcaaaa

SEQ ID NO: 551247 - DNA, 80 bp, Homo sapiens
agcagggtagatggggctggggcggtggcactgtccattgaagatagcgctggtgtggcttccccagcccgtcttctgct

SEQ ID NO: 551248 - DNA, 80 bp, Homo sapiens
aaggaaggaagggccacttactcctgctgtccagggaattcccggcagggagagccaggggtggtggctgatctggcctt

SEQ ID NO: 551249 - DNA, 80 bp, Homo sapiens
atcagatatacctgagtgaagttctgaactttccactctggaaagtggaaaatcaagaattttacttaggtgtgattggt

SEQ ID NO: 551250 - DNA, 80 bp, Homo sapiens
gtgttctgatttctgtttgacagttctggcttattacaggctgagtgacaaagccaagacttaaatagaaattacttcac

SEQ ID NO: 551251 - DNA, 80 bp, Homo sapiens
tttttgaatgaggctaattcatttcgaaagcaccctaggaagaccagatgcttttgaaatgatttagactcattcaaaaa

SEQ ID NO: 551252 - DNA, 80 bp, Homo sapiens
tgggtttgcctaggtgggtcattcctgggaaacagtgtcagtcatcccatgtaaatttatgatttgcctaggcaaatgca

SEQ ID NO: 551253 - DNA, 80 bp, Homo sapiens
gaaatttgtctcctctgtgtgtgtcctgcactaaatgcccaaaccccagcatgggacataatgcagagagggacacaggc

SEQ ID NO: 551254 - DNA, 80 bp, Homo sapiens
ggctcagcatggcggggcagggtgtgggcacggggccaggcccatggtcctccctggccctgtcctggtggtgataagct

SEQ ID NO: 551255 - DNA, 80 bp, Homo sapiens
aagcatctgaaaaacatgcaaattgtttgaaaaccttgcatggcaaattcagacagtttgcaagcgtcaatcagatgttt

SEQ ID NO: 551256 - DNA, 80 bp, Homo sapiens
ttgagtgaggcacttcccttctccagcttatttcaccatctgtcgaatgaagatggggagaagggggatgcctaccttga

SEQ ID NO: 551257 - DNA, 80 bp, Homo sapiens
cccataatcttcttccccagcacatctctccatttttcatgttgttttccggtcattgaaatgggggtgcctggggtggg

SEQ ID NO: 551258 - DNA, 80 bp, Homo sapiens
gagtcctgcagagagagaggaaagtgttgttttcagacctggttccactaacagcttcttttcctctctttcaaggactc

SEQ ID NO: 551259 - DNA, 80 bp, Homo sapiens
tttacagaggaggggacagaggctccagctgccctagagacagattcacctctctgagcctcagttttctcatctgtaaa

SEQ ID NO: 551260 - DNA, 80 bp, Homo sapiens
gcctagatagatggaagctcaaatcccaattctgcagcttcctggctgagaggttggggtatgtttccggactttcaggc

SEQ ID NO: 551261 - DNA, 80 bp, Homo sapiens
ggcctttcaggggtcgccttgtctctttacccacatctgagatgtgtccgcagggataggggatgcccttaaggaaagcc

SEQ ID NO: 551262 - DNA, 80 bp, Homo sapiens
agaggttggtggtaatggggtggggaacagtcaaagggatcccactggaggctgctcctcaacccaccttcccagcctct

SEQ ID NO: 551263 - DNA, 80 bp, Homo sapiens
gtcatccccactgattcaatctcttgacggtgtaccctgacaaaagatttgcctagacttgattgaatctaggggaagat

SEQ ID NO: 551264 - DNA, 80 bp, Homo sapiens
ctgggactccctttcttgtgggcagatggggccagatgttcaggtcaggcttctgccacgagagggaagtggggtcccag

SEQ ID NO: 551265 - DNA, 80 bp, Homo sapiens
aatgtcaggtgctcaaaaggtgcttattgaactgaattactgaggacaagagaaggagctcctattgagtacctgatatt

SEQ ID NO: 551266 - DNA, 80 bp, Homo sapiens
ccttggggtaggtgctcttattcgccacattttacaaatgaggaaactgggtgtggggaggttaagggacttacccaggg

SEQ ID NO: 551267 - DNA, 80 bp, Homo sapiens
tcctcggctctcggggtcttttgttttgggattgtaaatgttatagatctcccatgatggaaggccatgaggtcaggggg

SEQ ID NO: 551268 - DNA, 80 bp, Homo sapiens
gtgaggcacacgatgtaagtgctgaagttctgtgcaaatttattagcacgaactgaaggtactgtcattgtttaactcat

SEQ ID NO: 551269 - DNA, 80 bp, Homo sapiens
cccgcccccaactcagagcgtcctcttccaccccaccccagcgggtgtcatgggtagaggcctcctgagttgttacaggg

SEQ ID NO: 551270 - DNA, 80 bp, Homo sapiens
gaaaagttctgacagccagagttcatcagttaaggacatgccttagagcttaactgatggactctagcagtcagcttttc

SEQ ID NO: 551271 - DNA, 80 bp, Homo sapiens
ggggcccagcctctgtgtgaggtgctctgggggctgtgctgagcccctgagagcctcccacctgagactggagtcgcccc

SEQ ID NO: 551272 - DNA, 80 bp, Homo sapiens
ggcctttttatttgtgggaggcagattgttgagtcaaagagtactcttttctctgaaattcacgctgtcttccccaggcc

SEQ ID NO: 551273 - DNA, 80 bp, Homo sapiens
gggggtgtttcttcttctattttcctggaaaagcagaaagcaaggtctcaggaagagtgggagaatttggggacagcccc

SEQ ID NO: 551274 - DNA, 80 bp, Homo sapiens
ggacctcagaggatgccccaagacccttcctggatttctgactctcctcccatgtcttggtgccttctctcttaggatcc

SEQ ID NO: 551275 - DNA, 80 bp, Homo sapiens
tgtaaagctattattaggatagggaaagagggctggtaaatacgactggtccttccttccttcctggtgctacttttaca

SEQ ID NO: 551276 - DNA, 80 bp, Homo sapiens
tggctttcttgcctcatttcccttctccttttggaaaatggcctcacatttaggaaaaggaaaatgaggtaaggatgtca

SEQ ID NO: 551277 - DNA, 80 bp, Homo sapiens
ttaacacttcaccaacactggctccctaatgtgcagattcccagatcctttctgaggggcccgtgtgagtgaagtgttga

SEQ ID NO: 551278 - DNA, 80 bp, Homo sapiens
gccccagatccatctggaagccagatactcagtgtgtgggcataaaactgtcttctgttccaggtgctgtctctggtggc

SEQ ID NO: 551279 - DNA, 80 bp, Homo sapiens
ttgtgacacctttcttttacagtttcaggtctttgaaaaactagaggtagaagaaactgtacaagagaaaggtgtcatga

SEQ ID NO: 551280 - DNA, 80 bp, Homo sapiens
agaatcacccagattgggaactgctattccgtgcattcctgcatatccacaggatagcggttcccagtctggatgattct

SEQ ID NO: 551281 - DNA, 80 bp, Homo sapiens
agcctcctggctgtaccttatgtgatcatgggtgggtccttggcccagtggtggctcatatgtagtctagccaggaagct

SEQ ID NO: 551282 - DNA, 80 bp, Homo sapiens
tcagcgtgccaggaagtggctgggctgggttggtggtctatcttacgcccaggctcgctccgtcacttccacatcgctga

SEQ ID NO: 551283 - DNA, 80 bp, Homo sapiens
ggggtgggagaataaggtagtgtggttccctagaagagacacatttgtcttcaccactgaagcctcagttttctcatttc

SEQ ID NO: 551284 - DNA, 80 bp, Homo sapiens
acacggggcctggtccagcccaacccttgtctcagcctggcccaaaagcaaggactgggctgggttattattccttgtgt

SEQ ID NO: 551285 - DNA, 80 bp, Homo sapiens
gcatctcaataggctctaactgttatggtacagatggttcattatatagtctgctgttggcagttgggctgcggagatgt

SEQ ID NO: 551286 - DNA, 80 bp, Homo sapiens
gtgctaggcactctcatccatacctctttatctcctcccaacaaccctgccaaggagatatgtatgagagagcctagcac

SEQ ID NO: 551287 - DNA, 80 bp, Homo sapiens
gggaggatgttagacttgcgtggatcatgacttgctgcccaggacggagctcgtattcagtgcaagtcaacgtccagccc

SEQ ID NO: 551288 - DNA, 80 bp, Homo sapiens
actgttctctaaaaggtttctaaatgatgttgatgttaaaaaatatagtatcaccatttaacagccttttaaagagcagt

SEQ ID NO: 551289 - DNA, 80 bp, Homo sapiens
tgatttggtcttgacagaaatgttttaaatacagcttctagctgtttaaggtatttagtcattttgacaagactgggtta

SEQ ID NO: 551290 - DNA, 80 bp, Homo sapiens
gattggaatttgggtgcagcctcctggcacgtgctcatcctgttcttccaatttctggaggctgtgcctacgtgcctttt

SEQ ID NO: 551291 - DNA, 80 bp, Homo sapiens
gtgccagcttccctcactttccacctctccacagaagaacctggccgcaggtggcaggtgggtctgaggctgccaagcac

SEQ ID NO: 551292 - DNA, 80 bp, Homo sapiens
tcttgtgttgagacttcgtggtggtgctaagaaaaggaagaagaagtcttacaccactcccaggaagaataagcacaaga

SEQ ID NO: 551293 - DNA, 80 bp, Homo sapiens
tgagaagttatgtctttagccacttgcctctttcattttgttgggagagtgcacatggctgaagatagtgatgtttctca

SEQ ID NO: 551294 - DNA, 80 bp, Homo sapiens
gggtccaggctgagggcggggatccctggctttgggaaaccctcctcagacagggctccccgcaccgcagccctggcccc

SEQ ID NO: 551295 - DNA, 80 bp, Homo sapiens
gatatttgaggagaggttatccgtgttatgttcgcttcattcatcatgaataatacatggttaacctctttttgaatatc

SEQ ID NO: 551296 - DNA, 80 bp, Homo sapiens
agaggtcaggggcatggggtatggccagggaaaagagaaagttattggtccaagaagggttgcctcatgtcttggcttct

SEQ ID NO: 551297 - DNA, 80 bp, Homo sapiens
ctcaccacttggttccaaagacagaaagcttgtgtcaaagcgacctgtcacagctttcacgatttggaacaggtgaagag

SEQ ID NO: 551298 - DNA, 79 bp, Homo sapiens
ctgagttgggcacattgtttggcctctctggcaagttccattttctgttaaaaaggctaaataatgttacccaatccag

SEQ ID NO: 551299 - DNA, 79 bp, Homo sapiens
gtgagacaatgggcacttttgcaaagaggagcagaattagaaatctcagtctgtttcctctgcaaagtgcctttctcgc

SEQ ID NO: 551300 - DNA, 79 bp, Homo sapiens
caaatgctatatgctgccttcagtctcttcaagaactttgctgtgacctcctgtagagattgagggcaagtataggttg

SEQ ID NO: 551301 - DNA, 79 bp, Homo sapiens
gcttccctccagggcctgttctgattggcagatgtgctatgaccagtctgcacagctggaatgtggccactcaggaagc

SEQ ID NO: 551302 - DNA, 79 bp, Homo sapiens
ggagttcttttgttcagtccgtcatcatttgttgagctcttatgataagccaaatgctgagctgagcaatgaggattcc

SEQ ID NO: 551303 - DNA, 79 bp, Homo sapiens
ttatgtgtctatcagccactcccagttggaaaggacaggctttgagtgtattataattgggagtttggtggatacgtaa

SEQ ID NO: 551304 - DNA, 79 bp, Homo sapiens
gggtgggcaccagcctctggggaggggaggtgccaggccagcggtagctccagcccaggggcaggtgaccccagcaccc

SEQ ID NO: 551305 - DNA, 79 bp, Homo sapiens
gttcatccatttgttcagtgttttaagggtctaccatgtgccaaaccctgatctgggcactgagaacaggaagatgaac

SEQ ID NO: 551306 - DNA, 79 bp, Homo sapiens
ggatacatgagatggttgaccagagagcacacgctttatttgtgccgtttgtgacctggtccactaaccctcagtatct

SEQ ID NO: 551307 - DNA, 79 bp, Homo sapiens
gagggcttatgtgtaaggatgaggcactccaggtcatttgagacactgtgggttgttttgactttttattttagctctt

SEQ ID NO: 551308 - DNA, 79 bp, Homo sapiens
ggtttggtgtgttggctcctgttcctctgtctgggaccttaagaccatagaagaggcaggaggagctaaaaaacaaacc

SEQ ID NO: 551309 - DNA, 79 bp, Homo sapiens
cttttgtgagaaaatagtttagaattggttttggccttgtcccctgaagctatgtatctaaactatttctcaataaagg

SEQ ID NO: 551310 - DNA, 79 bp, Homo sapiens
caggagagcaccctggaacagggagcgtcagtttctgcatgtgtcagataccaacctgcctgttttaggggctgttgtg

SEQ ID NO: 551311 - DNA, 79 bp, Homo sapiens
ctgccatcctgctcttttatatgtgagaggcattctggatactttctttcttctcacataagaggatccagtgtggcag

SEQ ID NO: 551312 - DNA, 79 bp, Homo sapiens
tgcccctccctggggccagcccacacacatagtctctctggaatgaccttccttgtgtgggtaagtcttggggatggca

SEQ ID NO: 551313 - DNA, 79 bp, Homo sapiens
cacgtctctggagaaatggggtctcaggatgagtggagtctcagctttatctgtgacactttgtttcttgagagatgtg

SEQ ID NO: 551314 - DNA, 79 bp, Homo sapiens
ctccccttctctgagaaaggcaggagatctagccccatccctgtgttagagctccacctccctcagggccactggggag

SEQ ID NO: 551315 - DNA, 79 bp, Homo sapiens
ggagccggcccgcttccggggcatggccaggatgtccaggcgtgacagcttcttggcctgctcagcagctggccggccc

SEQ ID NO: 551316 - DNA, 79 bp, Homo sapiens
ctgtcccttggttcaaatgacttgggccatcctggtcaagtgttcttctctggtccaatcatttatggccaggggatgg

SEQ ID NO: 551317 - DNA, 79 bp, Homo sapiens
aagtctgtgcccagggttagatgctagtcttgtcttgtttcaggagtaagtctggttatttgtagctggggtcagactt

SEQ ID NO: 551318 - DNA, 79 bp, Homo sapiens
gggatggggcctgctgcctcctccctctgcccagggaagggttcccagatgcgagggggaggaggtgcggctccttcct

SEQ ID NO: 551319 - DNA, 79 bp, Homo sapiens
ttggcggtgcggcagggggatcatttgcaagcgtaccctctcctcgcgcggcaagtgagtcccgagtgccgcgccccag

SEQ ID NO: 551320 - DNA, 79 bp, Homo sapiens
gggggctgctggggggctactgacagaggagacatcttcatccatctctctgtgagatgccttcctgagccttgcgccc

SEQ ID NO: 551321 - DNA, 79 bp, Homo sapiens
cattttactcctgactgattacattacatattgatattagtgagcatcagtatgtagtgcaatcagtcaggagaaaatg

SEQ ID NO: 551322 - DNA, 79 bp, Homo sapiens
tgacatgcatgatccgggtctggtctgcagcactcaggatacttccgggctgtggagatggaacctgggtcatgcatgg

SEQ ID NO: 551323 - DNA, 79 bp, Homo sapiens
ctctttctccatattcaagatgcgggagtctttggatttttcagaacaaagactcctctatctagaatatggacaagag

SEQ ID NO: 551324 - DNA, 79 bp, Homo sapiens
gtgaataaggtaggagactggtagactctaactttcagattcaacttatagctgttcaccagtcatctgctattttgac

SEQ ID NO: 551325 - DNA, 79 bp, Homo sapiens
tttgaacaagttttcctttattgagtaccaacccatgtaatggtaacctggactttaataaaagggaaatgagtttgaa

SEQ ID NO: 551326 - DNA, 79 bp, Homo sapiens
atctctttcagataagcagcgtggtttggtgcagacacaaacagtagcactgaatcacatgctgctcttttgaagagat

SEQ ID NO: 551327 - DNA, 79 bp, Homo sapiens
ttaggctaagctgggagttggtggggtgggatgtggggcattggccccattagtcccagtttaccaggcccaggtctga

SEQ ID NO: 551328 - DNA, 79 bp, Homo sapiens
cggtccccagagggggcagctctaaccctaaacaagtgctcaacccttgaatgggcctggatggctcccctggggactg

SEQ ID NO: 551329 - DNA, 79 bp, Homo sapiens
gtaggcagtcttccaagtatgacattttagaggattccactaccttctaaaataccagatttggaaaactgaatactac

SEQ ID NO: 551330 - DNA, 79 bp, Homo sapiens
gctgctgtgttgattccaggggacaccctccctatcacgttctacgtgaacagggtcccctggggtcacacagtgcagc

SEQ ID NO: 551331 - DNA, 79 bp, Homo sapiens
ctggattaactcaagatgacagcaggactggcaatgaaaaggaagactgccagtcatgtgctgttatttttgaagacag

SEQ ID NO: 551332 - DNA, 79 bp, Homo sapiens
ggagggggctgaggctttcagccaagtagtaggttgtccccgaaagccaaacatttggttttgagttcagctcccattc

SEQ ID NO: 551333 - DNA, 79 bp, Homo sapiens
ttggatctgggggaggggcaaacaggttggagggggaggcttccactccaggctgttgtttctctcctaaagtatccaa

SEQ ID NO: 551334 - DNA, 79 bp, Homo sapiens
ccatgctttgggtgctcatggagcagattagtcagcactcagcttggttgacttggtccttgggcactattgtgcatgg

SEQ ID NO: 551335 - DNA, 79 bp, Homo sapiens
gagcacagggccgagggggctgggcgggctgggtggcctcttccagatctgtttcaggtctcctcgccccacagtgctc

SEQ ID NO: 551336 - DNA, 79 bp, Homo sapiens
ctgccttccaggcagggtgcaggagccttggagaaggtgctagaagctggggttcctgtgccaagggctgggaaggcag

SEQ ID NO: 551337 - DNA, 79 bp, Homo sapiens
tatgcttggggctggggaagccagaaaccaatccatttgatgtctgtgtggtttcatggcttgttaagtccctttcata

SEQ ID NO: 551338 - DNA, 79 bp, Homo sapiens
ttggcccacagtgactattctatcaggaagggaaggatccagttttattttcttctggatagagagtcagtggtgccag

SEQ ID NO: 551339 - DNA, 79 bp, Homo sapiens
atttttcttcatagcatttgccaaccagtggcagcttggcaacctgacccactggttggtaaatactatgaagaaaaat

SEQ ID NO: 551340 - DNA, 79 bp, Homo sapiens
gtgagtcactggcacatgtgagggatattatctttaaattagttgggggaaattaatattgctcacttgctatgctcac

SEQ ID NO: 551341 - DNA, 79 bp, Homo sapiens
tacaagagagaaaatgagggcaggtatcaaccataccaaattattctatgggatatcctgttttccattttaccttgta

SEQ ID NO: 551342 - DNA, 79 bp, Homo sapiens
tggtactcggggagaggttacccgagcaactttgcatctggacgacgaatgttgctcggtgaaccccttttcggtatca

SEQ ID NO: 551343 - DNA, 79 bp, Homo sapiens
gctgccatcctgggcagttttgagtgctaagaactggaaatctacccaaagcagtcaatttgctgccatgggaggcagt

SEQ ID NO: 551344 - DNA, 79 bp, Homo sapiens
gctcttccttccccaggaatttcctgggctgggatgctttcatcaccatgcctggggaagactgttgggtgaggaaggc

SEQ ID NO: 551345 - DNA, 79 bp, Homo sapiens
tgtgtgtgtttaagctctggggaagaagccttattttttccagggattagggcttcactcactgcttaaattataacca

SEQ ID NO: 551346 - DNA, 79 bp, Homo sapiens
ttgcccttttctgagcatccggagaggtgattccgagaatgcctccggatccgactcccctgtgctcagtgcaggtcaa

SEQ ID NO: 551347 - DNA, 79 bp, Homo sapiens
ccacttgcctgccgctgggtctgaggacctgacagtgccgggcacacagcaggtgttcagtaagtgtgttggcaagtgg

SEQ ID NO: 551348 - DNA, 79 bp, Homo sapiens
ctgaccccaaatgcccttggggcagccttcttatttttcttgatgatgttgatgccccagggggttttgggggctgcag

SEQ ID NO: 551349 - DNA, 79 bp, Homo sapiens
cctgtgggcagcatcagggtctgccttgcggtgggaccgcttgggtttcagagcagggtccctgttgtttcctgacagg

SEQ ID NO: 551350 - DNA, 79 bp, Homo sapiens
acctgcaatagggtccacagggatagctggggtctccatctctgacaagacaccccctctgtaggccacccttgtaggt

SEQ ID NO: 551351 - DNA, 79 bp, Homo sapiens
gcaccccctcgctgctccccatgacaggctgctccagtgctggagtcagtgtgagcatggggagcagtgaacatcatgc

SEQ ID NO: 551352 - DNA, 79 bp, Homo sapiens
ggacttgagttctgagatcctgcacatgtgggcatgttatatgtacaataagcgtgtggggtgtcatgaactgagatcc

SEQ ID NO: 551353 - DNA, 79 bp, Homo sapiens
cattgcagaggtgagttgacctccacagggccacccagggagtaagtagccaagtggaagttactttacctctgtgatg

SEQ ID NO: 551354 - DNA, 79 bp, Homo sapiens
ctggggccaaggttagctcttggagttgctgaaataagtggggacagttctgcaattccacaagctgactgtgactcag

SEQ ID NO: 551355 - DNA, 79 bp, Homo sapiens
cgtattctcccatcattctagatgcaaaactgccattgaatacagtgggaattttgagtttgtttgatgagagaatatg

SEQ ID NO: 551356 - DNA, 79 bp, Homo sapiens
cattcacagcaccagtttctacctggcagcactagttccagttgagtatctgtcaggtactgtctgagtgctgtgcatg

SEQ ID NO: 551357 - DNA, 79 bp, Homo sapiens
ggaagacaagctctaggagagtgtgaaccctgtttgtcattttcactgtggggtccccaccttctggagcttgaattcc

SEQ ID NO: 551358 - DNA, 79 bp, Homo sapiens
gctggaagtggctttctggtttatggagcaagacggaactgtaaagtcagtcgttctcatgggccagagtcaagtcagc

SEQ ID NO: 551359 - DNA, 79 bp, Homo sapiens
cctgacctttgaccagcccaggcatcggcccagaccccaccggcgggactgactgagttagggttggggttaggttagg

SEQ ID NO: 551360 - DNA, 79 bp, Homo sapiens
ggctccactactgcaaggagggcattggctgttggaagcaaagcattctacttcccggtgctcttggcagttccaagcc

SEQ ID NO: 551361 - DNA, 79 bp, Homo sapiens
gagctactcaagaactttgatcagggagtgatgtatatctttaatgtgaaagactattggtggttcttgagaatggctt

SEQ ID NO: 551362 - DNA, 79 bp, Homo sapiens
agttaaggaatgatggtgcctaagtcatttagctaaatgatgtatttaagaaagatggctgcaccattttccatgaact

SEQ ID NO: 551363 - DNA, 79 bp, Homo sapiens
tgttctttcattcatttactcctcctttttctcactaattctgctttgatactggggagagtgaatgggtgaaagagca

SEQ ID NO: 551364 - DNA, 79 bp, Homo sapiens
gcagggcgtgcaggagggagggagcagtgattaagagccaaagctcgcatcagacctgtctcctcttgccaagtcttgc

SEQ ID NO: 551365 - DNA, 79 bp, Homo sapiens
ggactcaggatcttttggggaaatttgggacctcgcaggacatctgcacaatccatagaaatccctgagagccccttcc

SEQ ID NO: 551366 - DNA, 79 bp, Homo sapiens
cccacgacttcttgtcagcgtgatgcttccagcacagttttgttgaaaaatgccttttgtgctgacaagaccacgtggg

SEQ ID NO: 551367 - DNA, 79 bp, Homo sapiens
ccgccaccactgccctgccgtgctcacgctgcatgggggtgccctcgcagcgggagtgtgtgtttgtcctggtggccgg

SEQ ID NO: 551368 - DNA, 79 bp, Homo sapiens
ctttgcttttttgtttctattgaatgcatttcggctgtacagctggaaagggcattcctataggactttaaaggcaaag

SEQ ID NO: 551369 - DNA, 79 bp, Homo sapiens
gggaaatagtaagggaagctatgtggtccagaaaaaaaatagttgtggacctgaatggcttgccattattacatttccc

SEQ ID NO: 551370 - DNA, 79 bp, Homo sapiens
ctcccagcttccctccccttccctcagctgtcccagccccgaggctctgcagagggaggaatggagtgggggaggggag

SEQ ID NO: 551371 - DNA, 79 bp, Homo sapiens
gtgtgaaagacagagtgtgtgtgctgagtacaaagacacaaattggcccgaggctcagctacgcatgctattttcacat

SEQ ID NO: 551372 - DNA, 79 bp, Homo sapiens
ggtggacagggagttagttaatgaccatcccctagagatgactttccaaggtggttattatgtggctcaatgattaacc

SEQ ID NO: 551373 - DNA, 79 bp, Homo sapiens
gtcagccatgagggagggcacctgaccttgggagttctgtctcgccctagggtggagtgcttttcctcggttggttgat

SEQ ID NO: 551374 - DNA, 79 bp, Homo sapiens
gctctagagaatttagtgcctctgcgtctcttctccttctcattaggagacagcagtggtgttttaaattctttaaagt

SEQ ID NO: 551375 - DNA, 79 bp, Homo sapiens
ccagcttcaccaagcccgtgctaggcaggatgtggaaatcaagcctgtcttccagtggggcacgggggtggggagctgg

SEQ ID NO: 551376 - DNA, 79 bp, Homo sapiens
gagcaagcagaagagatggagaatcccagtgtgactatggtacaactgggaaacaatctctccatttcctgtgatgctc

SEQ ID NO: 551377 - DNA, 79 bp, Homo sapiens
ggatggcatggcgtagaatgaaatgctttttcatcaaaatgcaaagatgaaggagatgtttcagagtgcccggccgtct

SEQ ID NO: 551378 - DNA, 79 bp, Homo sapiens
cagggcagggatcaggagggaggggaagaggcaggtgtcccaggcctgtctcctggtccctccctccgtccctgtgctg

SEQ ID NO: 551379 - DNA, 79 bp, Homo sapiens
ttcacctggccccaaagcctatgcttttctcaccacatcttatcctttagaagagtttagacttttggggcagggtgga

SEQ ID NO: 551380 - DNA, 79 bp, Homo sapiens
tgctctctaagttcagggagtttacaagtctactgtgcattcagccagagacagtaacctttctggtcttttctgagca

SEQ ID NO: 551381 - DNA, 79 bp, Homo sapiens
gtgagcatgagtccatgtctaggtgaagagcacgcctatagattgcagctttgccatagcatggactcctgctgatcac

SEQ ID NO: 551382 - DNA, 79 bp, Homo sapiens
ggagggactgggttggggagagatgaagaccctgtggaccagggctcactcttcttctcttgttcccccagggtcctcc

SEQ ID NO: 551383 - DNA, 79 bp, Homo sapiens
ttgccttctccctggcttctgcacacggacgggtctcttttggagctgaaagtgtgtgaaagttattggagaatggtag

SEQ ID NO: 551384 - DNA, 79 bp, Homo sapiens
aaaaaaagggggaggtttacaatgtatagtttttatcacctagttacaactaaatattgtgaacattttctcttttttt

SEQ ID NO: 551385 - DNA, 79 bp, Homo sapiens
tctttctctcctccctgccatcctcccctctttctgagccaagctgcatcatcacggggtgcagggaggtagagtagga

SEQ ID NO: 551386 - DNA, 79 bp, Homo sapiens
aaaagtattacaggctctgaactaagtaactaccagtgagtggtctgcagccatttagtttagagcctgctatactttt

SEQ ID NO: 551387 - DNA, 79 bp, Homo sapiens
cactagtccgttagctatctgggttgcagggaccttctacacatgattctctcctgtaccccagagtagatgcttagtg

SEQ ID NO: 551388 - DNA, 79 bp, Homo sapiens
ctcagcagtggagatacaagaggcctgacgtgtattgattgcccacgacatggcaggaatcatgtgttttggctgctag

SEQ ID NO: 551389 - DNA, 79 bp, Homo sapiens
cctccctttcctacacctttgaaaacaagccaccatgcacggccgattggcttgttttaaaaggtatacagaagggagg

SEQ ID NO: 551390 - DNA, 79 bp, Homo sapiens
ggctcctgaggagtcccaatgtgctcactgcccctattagaggggggccctaacaggtgatgcttgggaccccagagct

SEQ ID NO: 551391 - DNA, 79 bp, Homo sapiens
agtcagtggacttcacatttctctgacgtttgatcttaaataagagcagcagactaggagaggtgagaaagtgctgatt

SEQ ID NO: 551392 - DNA, 79 bp, Homo sapiens
tttgaacaagttttcctttactgagtaccaaaccatgtaatgataacttggactttaataaaagggaaatgagttcgaa

SEQ ID NO: 551393 - DNA, 79 bp, Homo sapiens
gccctccctccccacggccctgggcagggaatgtcttgttcccgccgctccctccccggggccagagggcagggcgggc

SEQ ID NO: 551394 - DNA, 79 bp, Homo sapiens
actgtctgttggacagagggggaaatccagaaaggattagtactcattctggattttccctatggctagcaggtaaagt

SEQ ID NO: 551395 - DNA, 79 bp, Homo sapiens
gtactgttatgttgagctaacagggggctctagaaacttggcagatgtttagagctctctggtggccatattaatagac

SEQ ID NO: 551396 - DNA, 79 bp, Homo sapiens
attgctttcattgttgtgcttacaacagctgtttcttattattaagaaaagcagctttgcgtgcagaacataaaacaat

SEQ ID NO: 551397 - DNA, 79 bp, Homo sapiens
ggggttggtggggtcgggcaggagggccggggattggaaggttggccagctctacctcctgcccttcccaccgcacccc

SEQ ID NO: 551398 - DNA, 79 bp, Homo sapiens
tcatatcagcttaaatttctgttttttttacaatgccatgtggggtaacagagggaagaggagagattgagctgtgtgg

SEQ ID NO: 551399 - DNA, 79 bp, Homo sapiens
tgagcaggggggttagttatgcaggtaatttccatcaatgccactgggagttatctgcgaaatgggagtctcctgttca

SEQ ID NO: 551400 - DNA, 79 bp, Homo sapiens
gaacaactgtattaggttggtgcaaaagtcattgcagcacacaatgacttttgcactaagctaaatatataggttgttc

SEQ ID NO: 551401 - DNA, 79 bp, Homo sapiens
caggtgggcaggagctgctgggggtgctgggcagacgtttaccgtccagcacccccatttctgctgctctgataacttg

SEQ ID NO: 551402 - DNA, 79 bp, Homo sapiens
ccccagctttttctgcaagtgaggaatgcctgccctttcgggccagcagggattcctcaccctcagggcagggctgggg

SEQ ID NO: 551403 - DNA, 79 bp, Homo sapiens
ggtgaagggggcaggtgggaggaggggcatcccaggatgaagggctgtggtgctctccgctccctgcttctattaatcc

SEQ ID NO: 551404 - DNA, 79 bp, Homo sapiens
gcctccgctccgtgactcactggcaaagatcttgctgcataggatcagtttgtttttttcaggggggttggagtggggc

SEQ ID NO: 551405 - DNA, 79 bp, Homo sapiens
gggtgggcaccagcctctggggaggggaggtgccaggccagcggtagctccagcccgggggcaggtgaccccagcaccc

SEQ ID NO: 551406 - DNA, 79 bp, Homo sapiens
gcaggtgccttttgatgagaacatctggggccttcaggagatttccatgggcctctgattttagatcaagaggacttgc

SEQ ID NO: 551407 - DNA, 79 bp, Homo sapiens
atttcacactccttagtgagttctgtgaaatttccatgcttcatcatttacagctactcacaaaaagtatgtgtgaaat

SEQ ID NO: 551408 - DNA, 79 bp, Homo sapiens
acttgtccacagtaatgcatacaagttagtgagtggaccaagatctgctgctaattagtttgcattactttagacaagt

SEQ ID NO: 551409 - DNA, 79 bp, Homo sapiens
gccaggaatgtggacaagtgtggttgtgagatctctctcctgggatcattaacaatctatgcttcctgacatctctggc

SEQ ID NO: 551410 - DNA, 79 bp, Homo sapiens
gcctgaccccaaatgcccttgggacagccttcttatttttcttgatgatgttgatgccccagggggttttgggggctgc

SEQ ID NO: 551411 - DNA, 79 bp, Homo sapiens
cctcaacgagacattcttaggaacaatgttgtcaaggaaacatactgaaactgttacataaaagaatgtctctgtgagg

SEQ ID NO: 551412 - DNA, 79 bp, Homo sapiens
cataaatttggttatgctgaccagcaaaatgcgacagagcgagacccagcatggtgctgttcagcataaccacattgtg

SEQ ID NO: 551413 - DNA, 79 bp, Homo sapiens
tacaaatatttgctgcttcatctatcctgtgaggaggttaaaaaactctttttgggatgagtggggagcaaaatttgtg

SEQ ID NO: 551414 - DNA, 79 bp, Homo sapiens
cagtctccagatatgttaatttcagtgcttctagtgcttccagtggaagcactgatattaacatattatttagagactg

SEQ ID NO: 551415 - DNA, 79 bp, Homo sapiens
cacataaccatgactgagtttgtgaagggctggttattttctttcttgtctttctgcattatcagtcatgtgtgatgtg

SEQ ID NO: 551416 - DNA, 79 bp, Homo sapiens
actttggcagctgctccagatgctacccaatctagggttttaagatttcaaataagagcttattggcagttgtcaaggt

SEQ ID NO: 551417 - DNA, 79 bp, Homo sapiens
ctctatttgttaatagggtagatttaagtcgatgttctctaacacagtaaacataagcttaaatgttccctaattagag

SEQ ID NO: 551418 - DNA, 79 bp, Homo sapiens
ccgagggtgtggacctggaggtgaattcagcagcttgacaatgtgcagttgaggtcatttccatcttccatcacttcgg

SEQ ID NO: 551419 - DNA, 79 bp, Homo sapiens
gggtggtgatcgggaaagctgcccgaatgagtaagattctgacgcttgtttggagtagtttatcctctgtctaccacct

SEQ ID NO: 551420 - DNA, 79 bp, Homo sapiens
atctgaaacagaacctttgccctcctttcctactctgcaaaaccctgataggctggggagggaaagggatacttcaggt

SEQ ID NO: 551421 - DNA, 79 bp, Homo sapiens
ggggaagggagccaagggcccttatggaggtctctaaggaggagtcatgggcctgttaggggctctagctttcttgtcc

SEQ ID NO: 551422 - DNA, 79 bp, Homo sapiens
ccactcttaatttcaactattacctctattagtataactcccaaatcctaatagaggtagtagctgaaattaaaagtgg

SEQ ID NO: 551423 - DNA, 79 bp, Homo sapiens
tgccctgctgcctggatggaaagcagcattctctttagcggcaatctgctgtaatcattttttattcaggtggcaggca

SEQ ID NO: 551424 - DNA, 79 bp, Homo sapiens
tcacaggaaagcaaggaggagtgtgtggctttccaggtctccattcccgaatgctgcataactcccctgagtcctgtga

SEQ ID NO: 551425 - DNA, 79 bp, Homo sapiens
tcactcctgcatgaggggtagggaaaaggcacaggctggcatgtgatgccttttccctttctcctcactagcaatgtga

SEQ ID NO: 551426 - DNA, 79 bp, Homo sapiens
aatgaagcttacatgtctgacagagctagacaaatagaatcagtcatatgtttggctctgatcagatagagttatcatt

SEQ ID NO: 551427 - DNA, 79 bp, Homo sapiens
ggcaagggttggactctgtggccagcagtgcccccttcatccccagtaggcatcagagccacagctgtcttcctttgct

SEQ ID NO: 551428 - DNA, 79 bp, Homo sapiens
gaggtgcggaagagagactgggtggttgagggaaccctgtgaacttcctctcctcgtcctgtttcttttcttaaacctc

SEQ ID NO: 551429 - DNA, 79 bp, Homo sapiens
ttgccgccgcccgccccctgcgcctccccgcggagcctgggtccgggagggggaaggtaggggcggcggggggcgggag

SEQ ID NO: 551430 - DNA, 79 bp, Homo sapiens
aaaccttatcagtctgttggaatatcgctgcaaaaccatgttttgaacgggtgtgttctgtcagactgattggaggttt

SEQ ID NO: 551431 - DNA, 79 bp, Homo sapiens
gcgcggttacctgggcagcagctccgggcaccgaggtccccttcacgtttcagttcctggagctgctcgggaaccgcgc

SEQ ID NO: 551432 - DNA, 79 bp, Homo sapiens
aaggaggcagagatgagtaagacaggaggtggctagttataaattcctcggctgtgtcttattcatctctgcttgcctt

SEQ ID NO: 551433 - DNA, 79 bp, Homo sapiens
cacagcagctttaataaacagctccatttagtgcctcctccttgtatctagggaggtgagctggtctggggctgctgtg

SEQ ID NO: 551434 - DNA, 79 bp, Homo sapiens
ctgccgtcttgaaggttctaccacaccagttcatcactaagcctgctgtgtggtgggggctttgagctgttaacgggag

SEQ ID NO: 551435 - DNA, 79 bp, Homo sapiens
gtttattttgagagtgtttgctgtataattggacttaataaaatgtttagaggtacagtaggcatgactttgggtagat

SEQ ID NO: 551436 - DNA, 79 bp, Homo sapiens
gtatgattcattgatatgccagtaacatcttggcttcagcatacagtgtctagatgtgctagtgtatccagaatggtgc

SEQ ID NO: 551437 - DNA, 79 bp, Homo sapiens
ttaactataagtcatatgtgacacgtgattacatttcacataacatgtaatcacatgtgtcacatgtgattacagttaa

SEQ ID NO: 551438 - DNA, 79 bp, Homo sapiens
gtggccagaccaggggcccgggacatgagcgcaactttccaagcttctcttccaggcccctgtggttggggagctccac

SEQ ID NO: 551439 - DNA, 79 bp, Homo sapiens
ttgttttgttcattcatgcatcttcagtgcttggcaccttataagcactaaaatatttgctaaatgagtgaatgaacaa

SEQ ID NO: 551440 - DNA, 79 bp, Homo sapiens
gacaatgccttgattgtttacagctaagtctctttaagtaggtgaaggctgctggttatgtagaaaattaaggcttgtt

SEQ ID NO: 551441 - DNA, 79 bp, Homo sapiens
ccgggtgcacagggcctgttttcccggtggctggcgaagcaatgtccttcccccgggtaaagcagcccatgcgttccgg

SEQ ID NO: 551442 - DNA, 79 bp, Homo sapiens
aggagaacatctgtgctctttatcctcatctggatttagcaaccataccaggtgggggtgagaaaacagacacactcct

SEQ ID NO: 551443 - DNA, 79 bp, Homo sapiens
gctctgcctacaggagcaggtgggaccccagagcctgcatggacagtcagtggggtcccagcctgccctgctggcatgc

SEQ ID NO: 551444 - DNA, 79 bp, Homo sapiens
gggattttactgcagttggtttagaatttctaggggtaggaggtttcacctggagagagaggccaactgcaaagatctt

SEQ ID NO: 551445 - DNA, 79 bp, Homo sapiens
ttaactgtaatcacatgtgacacatgtgattacatgttatgtgaaatgtaatcacgtgtcacatatgacttatagttaa

SEQ ID NO: 551446 - DNA, 79 bp, Homo sapiens
tcctcacccatgaccccacctgctctcatttctgcaagaaaacaatagaaattagagcagttggggtcatgagtgagga

SEQ ID NO: 551447 - DNA, 79 bp, Homo sapiens
gatggttggtggagggaagagggtctcagaccaccatggctcatgctgacatcctttaagatctcctttatcaactctc

SEQ ID NO: 551448 - DNA, 79 bp, Homo sapiens
atgaatttcactaaatcatatgggactaaagacagactttgtttttatcccaagatgtatttggtgaaacccacttcat

SEQ ID NO: 551449 - DNA, 79 bp, Homo sapiens
cctactcccagaggctttgcagctgctcttagagcctgtaccccggagtctttgaagcactgtgagctcctgggtgagg

SEQ ID NO: 551450 - DNA, 79 bp, Homo sapiens
agaaaggaacaaatgtagcatttgtagattgttttcatgtaaatcactgtctgcataggtgctgaatctgtttctttct

SEQ ID NO: 551451 - DNA, 79 bp, Homo sapiens
gtggcagttgattggaagaggaaggagactcttggggatcacagtttaactcccttctttcccttccagcagctcccac

SEQ ID NO: 551452 - DNA, 79 bp, Homo sapiens
catgactacccacacggcttgccttcctctccagatgtgaactctggctggggtgggcagctgtgtctgtcctttcatg

SEQ ID NO: 551453 - DNA, 79 bp, Homo sapiens
agctgtcctgtgggtgatgaggaagtgatgacaccaactcccaccatctcgtcacttcacagtcacaccacagatggct

SEQ ID NO: 551454 - DNA, 79 bp, Homo sapiens
gtctccgctgagtgacatttgcaccagctgcttccaaagggagtagctttggtgaaatgtcaccggcttcagcggggat

SEQ ID NO: 551455 - DNA, 78 bp, Homo sapiens
ttatgatgtggaaaaatgtcaggatgggaaaatgatgatctccattttttttccagccatgacatttcagtattatga

SEQ ID NO: 551456 - DNA, 78 bp, Homo sapiens
gaataggaaattgtccaggtcatttgatggagataggattcaagtggctatcaatgacctgaagacatggtcctattc

SEQ ID NO: 551457 - DNA, 78 bp, Homo sapiens
gattcattccacagagttccccagcatcaatcagtgcttggcccaagattgatgcttaggaaatctgtgggatgaatt

SEQ ID NO: 551458 - DNA, 78 bp, Homo sapiens
tctgactcagttttcgcaggatccctctggctacttgtgcgggtagatgataggaggtggggtggaggctgaggagga

SEQ ID NO: 551459 - DNA, 78 bp, Homo sapiens
tgagctcccatatcttaccctcaacacatccagccaaggtgaaactggctggaacttaagggagatgtggtgatttca

SEQ ID NO: 551460 - DNA, 78 bp, Homo sapiens
tccctgcttttatttgtagcttcccaaagcttttgctggtaataaaaggattgtaaagttgacaaatataagcaggga

SEQ ID NO: 551461 - DNA, 78 bp, Homo sapiens
cttctatgctttggctgaatgaactgccccctgaatgtattttctcacctcagtgtgtttgttcatgccagagggaag

SEQ ID NO: 551462 - DNA, 78 bp, Homo sapiens
tgctgtttaacctctctggacctctttgcaagaattaaatgggaaaaggtgcatgaaggggtctaggaggtgtcagca

SEQ ID NO: 551463 - DNA, 78 bp, Homo sapiens
gataaaggtcacactcccagagctgaggctacgtgagtctaagctgttacctcagttatgggagtgtggctggaactc

SEQ ID NO: 551464 - DNA, 78 bp, Homo sapiens
ggcggctctaggcttcaggggtctgtctgcacaggggctagcccctcccagacctctgtgaagccagtacgggcctcc

SEQ ID NO: 551465 - DNA, 78 bp, Homo sapiens
caatgggttgttccagtttctcttactgatatgcaaaagctttgttgtatattagagatggttactgttaacttattg

SEQ ID NO: 551466 - DNA, 78 bp, Homo sapiens
caggtcctggggggctgggagagtaaaaggcagggtctcctgtggattccttttgctgcccaggcctcttggttcctg

SEQ ID NO: 551467 - DNA, 78 bp, Homo sapiens
ctgcccaggtggggcccatgcccttaagcagtataggtgagtgtatcctgttgcggtcatgggccataaatgaggcag

SEQ ID NO: 551468 - DNA, 78 bp, Homo sapiens
cggcctggggataagtgtgcctggctgttctagccacctggttgtgaacagtacagtgtgcgcatatctctcaggctg

SEQ ID NO: 551469 - DNA, 78 bp, Homo sapiens
ctccagtggcctctggctgtcgcctcccactccagcatgagggatcgggtgcaagcacagaggccatgcagagtggag

SEQ ID NO: 551470 - DNA, 78 bp, Homo sapiens
gctggggtacctacagggagacggcagtcccaggactgctggggcctggggctgacctttcctctggccggccccagc

SEQ ID NO: 551471 - DNA, 78 bp, Homo sapiens
agccagcagggggcgctgctgcccatgggatcctcatggccaagggtcccaggaggtggtggaggccatctgagggct

SEQ ID NO: 551472 - DNA, 78 bp, Homo sapiens
aggcaggagtttcatagaagcaccacctatgatttaaaaataaaatacatggttgtttttatggagcttctcatgcct

SEQ ID NO: 551473 - DNA, 78 bp, Homo sapiens
atctttgtgtctcaggcctcagcctgccaggcctgggctttctgcttggcagtgtctaggggtctggggcaaaaagat

SEQ ID NO: 551474 - DNA, 78 bp, Homo sapiens
cagtgccctgctggccacttgagcccgctgcctgagtctgatcccacagcactggtgagctttggccaacaggcactg

SEQ ID NO: 551475 - DNA, 78 bp, Homo sapiens
tcatgccacgcatgaccccaagtcttaggttttctatctcttttgacatcataaggcttggggtaatgtatggcatga

SEQ ID NO: 551476 - DNA, 78 bp, Homo sapiens
cctatgtttagtttttatatagaaatcaactctgtttaggtgagtgagttgataaatatgtaagtttttcagcatagg

SEQ ID NO: 551477 - DNA, 78 bp, Homo sapiens
tgagcctggttggggaatgatggggtggaacagtggtgtgctgggccattggttctacatcttctgtgactgggttta

SEQ ID NO: 551478 - DNA, 78 bp, Homo sapiens
agttgtttgaggagttaatcctagcaaaaataggtcagcatcttttctccttttcttgggattaactccacagcaact

SEQ ID NO: 551479 - DNA, 78 bp, Homo sapiens
tccaagtgtggacagagctcatcaggtgtggggaagggcacctccacctgtggtcaagagctctctccacaccctgga

SEQ ID NO: 551480 - DNA, 78 bp, Homo sapiens
gagaaaaacagctgctgactctgattgccatttggaaataatcgaaacaggcagttggaggttgtagctttttatctc

SEQ ID NO: 551481 - DNA, 78 bp, Homo sapiens
agcgggtacctggccaggccccttgcagggcagaacctcaggtggataggcctctcagggtctggccgggtcccccct

SEQ ID NO: 551482 - DNA, 78 bp, Homo sapiens
gaaaggtattagactgactataaaggggtcttgggaagggatcttactcctctttgatagttggtacttgtacctttt

SEQ ID NO: 551483 - DNA, 78 bp, Homo sapiens
gagtcacagtggacttggagtcaggaggcctgaggtccttgaagacctccctgacctgctctggtccactgtgtgctc

SEQ ID NO: 551484 - DNA, 78 bp, Homo sapiens
cagtgcctgttggccaaagctcaccagtgctgtgggatcagactcaggcagcgggctcaagtggccagcagggcactg

SEQ ID NO: 551485 - DNA, 78 bp, Homo sapiens
cgatgggatggagtccttcagtccagaggttagggaatggtgtctgagaaagtttgggctgtgggaatccttctttcg

SEQ ID NO: 551486 - DNA, 78 bp, Homo sapiens
gtgtcagaatctcagatgacaatgtcaggtgctcaggtgctcaggagctcctgacattgtcacctgagattctcacac

SEQ ID NO: 551487 - DNA, 78 bp, Homo sapiens
ggatgaggtggagaggagatggggtgcagagagaagggacaatcctccagactcaccctcatggcctcccacttctcc

SEQ ID NO: 551488 - DNA, 78 bp, Homo sapiens
tctttggtttttagttattcctaaagggtcttggcattggtggcctgcctctcttttcaaaataattaaaaccaaaga

SEQ ID NO: 551489 - DNA, 78 bp, Homo sapiens
accatggaacatagtggacacatccctgctgtcaacatgctcacaacttcagtaggaagatggtttgctggccaaggt

SEQ ID NO: 551490 - DNA, 78 bp, Homo sapiens
ggatagcagccctctcccaagccacctacccatccccatttcccaggaagggtaggggttgggggtggctggcaattc

SEQ ID NO: 551491 - DNA, 78 bp, Homo sapiens
gctgcctgccatctgccctggccatgcccgttccgctaatgaaggataaacacaaggccaggccagatgacagtcagc

SEQ ID NO: 551492 - DNA, 78 bp, Homo sapiens
ggcctcccccagggagtcatgagttggcaaccccagcagaggggaagctggcatgaagctcctgtgtggggagatgcc

SEQ ID NO: 551493 - DNA, 78 bp, Homo sapiens
tatgctcacagctcagtgagggatccggtctgtcttgctcaccatggcattcttggtccctgcattgagatgagcata

SEQ ID NO: 551494 - DNA, 78 bp, Homo sapiens
ttgagattttattggttgagaatcagtacagacatttcaatttgtacacaattcttaacatatgtaatgaaattttaa

SEQ ID NO: 551495 - DNA, 78 bp, Homo sapiens
aaggcaatttgagagatgtcttaggatggttttgatcatgtgaggttatcatctcaggtacagattttagaatgtctt

SEQ ID NO: 551496 - DNA, 78 bp, Homo sapiens
ctgcccaggtggggcccatggccttacacgacataggtgagtgtatcctgttggggtcatgggccatgaatgaggcag

SEQ ID NO: 551497 - DNA, 78 bp, Homo sapiens
tgtagatttgtaagcttataacatgtatagacatactatgaatgtgtgtctttatatgtgtatgttacaaatttgtca

SEQ ID NO: 551498 - DNA, 78 bp, Homo sapiens
tcattcagaccacaggggtactattttaataaattgccacttcaatgtgcaaaataatgccccaatggactggaagcg

SEQ ID NO: 551499 - DNA, 78 bp, Homo sapiens
aatgctttgggttgggaatagttgagggtttagaatttgtatcctgcttgaatccctaacttttcccatccttgcatt

SEQ ID NO: 551500 - DNA, 78 bp, Homo sapiens
tgctgactctgcaatggagaaagtgagactggtttgtctccagctctgcttacacttttcattcgtagagggaaagca

SEQ ID NO: 551501 - DNA, 78 bp, Homo sapiens
tccccagtctgcccacccatgccacagggctcctctggccagagccgagccactgggtgtttggtgggcacatggtga

SEQ ID NO: 551502 - DNA, 78 bp, Homo sapiens
cagactgtagaatctctacgggtaagtgtgtgatttcctcagtgacatcacatttgcctgcagagattttccagtctg

SEQ ID NO: 551503 - DNA, 78 bp, Homo sapiens
cagactggaaaatctctgcaggcaaatgtgatgtcactgaggaaatcacacacttacccgtagagattctacagtctg

SEQ ID NO: 551504 - DNA, 78 bp, Homo sapiens
tgcaagagtctgagttggaaagtaaggttgtctctataacttatcaccagccctcctttctgtctcaggctctgtgca

SEQ ID NO: 551505 - DNA, 78 bp, Homo sapiens
agcatttgtgaatgagttttggtttcttggagttataaaatgtgtgtaaactagtaaaccatgtctcattcatgtgct

SEQ ID NO: 551506 - DNA, 78 bp, Homo sapiens
ttcagcatccatttacttgcttcttctgaaagccttgcattcaggagtaagtgtgaatggataaataaaaaggctgaa

SEQ ID NO: 551507 - DNA, 78 bp, Homo sapiens
tccccaccccctcacctctctggggccctatcttcccttatatggtgaaggcagttcctagaggagggggggtgggga

SEQ ID NO: 551508 - DNA, 78 bp, Homo sapiens
gaatattcctgaggtgtgggtggttggtttccttacaaggtagggtttgcaagctccttacatccacaggggctgttt

SEQ ID NO: 551509 - DNA, 78 bp, Homo sapiens
tattgtgaggtgcaggtatgttacttttactccattgtttctttgaccagtaagtaacatattttgtgctttatgata

SEQ ID NO: 551510 - DNA, 78 bp, Homo sapiens
gatgggcaggggccctgcttccgtttaaccacagccctgtgacatgccccaaaagggaagcagcagccgcctgtcctc

SEQ ID NO: 551511 - DNA, 78 bp, Homo sapiens
tcttatgtctctcctaccttttctcatcatttttcctcttccagagttagataatgtggaatagtggagaacataaga

SEQ ID NO: 551512 - DNA, 78 bp, Homo sapiens
ttcacatcctgtgtgaccctatgggaaaatttttaactaatactggggaaaatcccatagggttacacaggatgtgaa

SEQ ID NO: 551513 - DNA, 78 bp, Homo sapiens
gactcattccagagcccagttcgtgtcaggggccaagggccaggcccccggcatagaaactgggccgaggagtgggtc

SEQ ID NO: 551514 - DNA, 78 bp, Homo sapiens
cgcctttgtttcagtgattccgattccaaacgacacatccaagttactgtttgaatcggcatcgagcttactggggcg

SEQ ID NO: 551515 - DNA, 78 bp, Homo sapiens
gacggctttggagattatggggaacatatggccctaccgccgggctctttatctgcattttctcataaaactgccgtc

SEQ ID NO: 551516 - DNA, 78 bp, Homo sapiens
ttttaaatggccactctggcttcagtctgggaatggatttgaaagggacagaagtagagtcagggaggccatttagga

SEQ ID NO: 551517 - DNA, 78 bp, Homo sapiens
gaggcctggaattccgaatggccccagtcccgggaaccgaacgcctcctggttgtggccacttggatttcttgggctc

SEQ ID NO: 551518 - DNA, 78 bp, Homo sapiens
taggaagagagtgggagagaaactttgggctttgaaaatgtatgttgtgttcctagtttcagtcccagctttctgcta

SEQ ID NO: 551519 - DNA, 78 bp, Homo sapiens
gggctgcagggggcggggagcacatgcggcgtgcagacctttccttaggtttgtgctgggtgctctgctctcaggccc

SEQ ID NO: 551520 - DNA, 78 bp, Homo sapiens
cccagagtcttggtctgtttgcttgtctcacagtgcacaagaggcaagagcttagaaagcagatcagggaagagtggg

SEQ ID NO: 551521 - DNA, 78 bp, Homo sapiens
cttccgacatgccctggaactaggaacaaagccacaagactgttatgtctgttgttttcttagtctgtgtgttgggag

SEQ ID NO: 551522 - DNA, 78 bp, Homo sapiens
tcctcggacctggctaagcttccaaggccctcctggagggccaggaatcgggccggggtttgggccaggctctgagga

SEQ ID NO: 551523 - DNA, 78 bp, Homo sapiens
acagggtgggcggggggtgaagaggaaaggatgggaagggggcgtccctaaaactgttttcaccccaccctgccctgt

SEQ ID NO: 551524 - DNA, 78 bp, Homo sapiens
ctgctctagcctaattttagatctggtctgcttcagtttcactccaagcagacttgacctacaattagcctagagcag

SEQ ID NO: 551525 - DNA, 78 bp, Homo sapiens
gaggggtcttagaggagcaccgagactgggtgagataatttgtattgaggttttggtgaaggctcctctgtgcttctc

SEQ ID NO: 551526 - DNA, 78 bp, Homo sapiens
ggtgagagctcggctcatagaatatttgtaagaaaattaaagatttgctcttcagatgttgggggccatgctcttacc

SEQ ID NO: 551527 - DNA, 78 bp, Homo sapiens
tggaggcaggtgcgagatgagccctctgaagtctaagttgacaaggtggttttgggcactcatctggctctgtctcta

SEQ ID NO: 551528 - DNA, 78 bp, Homo sapiens
taaaacaattgaattagatgttgtagtcctaatttctggggttagaggactacaatatgtaatctaatagttgtgtta

SEQ ID NO: 551529 - DNA, 78 bp, Homo sapiens
gtccggctgcctgtgttgagtgcctctgtgtccccagtgtgtggcatatagtaagtactcaataaaggtttgctggat

SEQ ID NO: 551530 - DNA, 78 bp, Homo sapiens
cagagggacaggaggagcgccaggctccagctcgctgctcccccagagcctcccagcctggtgccttctggttcgctg

SEQ ID NO: 551531 - DNA, 78 bp, Homo sapiens
atctccatacttcacccccctcagtttcctcctgcatctgcggtcagttctgagactggggcgtgaggctgtgggaat

SEQ ID NO: 551532 - DNA, 78 bp, Homo sapiens
ctcgctgccccctcccccttccgctgtggccaccggctttgttttccggaaacgcacggatcagggagggagggtgag

SEQ ID NO: 551533 - DNA, 78 bp, Homo sapiens
gggtgggtaatggaggcggtgactgagaaaacattgtttctctatatgcagccaagtcgcccctatagaactcaaccc

SEQ ID NO: 551534 - DNA, 78 bp, Homo sapiens
catggcagtgggatggatgattgatgctgcgtgggctttagcttccactctggccttaatcttttcctgacttccatg

SEQ ID NO: 551535 - DNA, 78 bp, Homo sapiens
tgaacaaactgtcccaggcaggggctgggcagggcctgtgtgccttgctcagcctcctgacaggacacttttgttgca

SEQ ID NO: 551536 - DNA, 78 bp, Homo sapiens
agcatcttcgtcatcctgaaatttcccatcaaaactaagaattcctgcagtttatgggagacgggatgatgagattct

SEQ ID NO: 551537 - DNA, 78 bp, Homo sapiens
gggaaacagggcacaatgggggcagatgaaagtccacagtctttagtttctatctttccttcttgtgtctaattttcc

SEQ ID NO: 551538 - DNA, 78 bp, Homo sapiens
gggttttccattgtgagggaaactcattcatactcatcatatttccacagagatgaatgagtttcctttccagtgccc

SEQ ID NO: 551539 - DNA, 78 bp, Homo sapiens
gtgtcagaatctcagatgacaatgtcaggtgctcaggtgctcaggagctcctgacattgtcacctgagattcttacac

SEQ ID NO: 551540 - DNA, 78 bp, Homo sapiens
ttccttgcatctgtacacatttgaaaggttgatatgtattatttgcatgtgaatgcacggatgtgtatgaaataggaa

SEQ ID NO: 551541 - DNA, 78 bp, Homo sapiens
gagtgtttgcagaagtgccgggaacaagaggtggtggagcaaagcatctctttcctggtttccttctgctctgaactc

SEQ ID NO: 551542 - DNA, 78 bp, Homo sapiens
aagggggaaaccagcatgactctagcatgctggcatcctggtgccctttgcagctaaggtcagactgtttctcctctt

SEQ ID NO: 551543 - DNA, 78 bp, Homo sapiens
acaactggggcttgttaaagaggaaaagtggtattttaactccaagtgtcacattttcctatagtcagctctagcagt

SEQ ID NO: 551544 - DNA, 78 bp, Homo sapiens
gaggcagattcacgtttgtccatttggatgcttcctttagaattgacaagcccaaatggataaatttatcttggtctt

SEQ ID NO: 551545 - DNA, 78 bp, Homo sapiens
gcaatcatttttccccttctctgctttgttgtcttcgctttgccaggatataaggcctgggagggcagggattgttgt

SEQ ID NO: 551546 - DNA, 78 bp, Homo sapiens
tccagctctgagctgtgattgcatgcaggtgaacagcctgagaggactgtacctttgtgccacacagctcgggaagga

SEQ ID NO: 551547 - DNA, 78 bp, Homo sapiens
ggggcgggaggtaaggagcaaggcatgaagaatctggagactcagactatgtcacgtcttgcgttccctgcccgcctc

SEQ ID NO: 551548 - DNA, 78 bp, Homo sapiens
cactgatggtggacagaggagaggggaagagagaaggtcaagatactccctacttcccttctaagtgttaccatcatg

SEQ ID NO: 551549 - DNA, 78 bp, Homo sapiens
tggtgattcccaaatctgtatgcccagaccagagcattttgcatatttggaccggacatatagatttggaaatcacca

SEQ ID NO: 551550 - DNA, 78 bp, Homo sapiens
gaatcatccagactgggaaccgctatcctgtggatatgcaggaatgcacggaatagcagttcccaatctgggtgattc

SEQ ID NO: 551551 - DNA, 78 bp, Homo sapiens
atttgctccaaactaaactgtgggctcttctcaacagcgtgcagtagagaagagcctacagtttagtcttgagcaaat

SEQ ID NO: 551552 - DNA, 78 bp, Homo sapiens
gagatggggtgttgagcgagaatcttgcctgggagtccagaaacctgggtttgaattcttgttctgcatccacctctc

SEQ ID NO: 551553 - DNA, 78 bp, Homo sapiens
tacagggacaaaactcagtgcagaagagccctcttgagcactctccttaactcttctacactgagttttttccctgta

SEQ ID NO: 551554 - DNA, 78 bp, Homo sapiens
gggaattaatgactagagagggttaatgggctaaaactctgttgggtcatcaacttttccagctagtcattaattctc

SEQ ID NO: 551555 - DNA, 78 bp, Homo sapiens
tggggccgcatgaaaagggtgggaggggaggaggggagacatcccagcacctctttgctcacccttccacctgcccca

SEQ ID NO: 551556 - DNA, 78 bp, Homo sapiens
gtttagtggtactatacctcagttttatcaggtgttcttaaaatcacctggaaacactgaggttgtgtctcactgaac

SEQ ID NO: 551557 - DNA, 78 bp, Homo sapiens
aaaagctaaataatcaccctgagcagattttgcggagaccttgctcaacctgttcagggataattatgccgagctttt

SEQ ID NO: 551558 - DNA, 78 bp, Homo sapiens
ggaaggactctgggcttcctgaatctattgagtgtgctatatactcactagatgtgagacccagggcaagtcacttcc

SEQ ID NO: 551559 - DNA, 78 bp, Homo sapiens
ctcattacctgccagctggcctcttcccacatgcccccctcatcctgacctgtgggtaccagttggcggggtgatggg

SEQ ID NO: 551560 - DNA, 78 bp, Homo sapiens
gtttgatgtataatgaatgtgaaaatcagccatttaattaaatggtacatggtacaatcactttgttctgcattaaac

SEQ ID NO: 551561 - DNA, 78 bp, Homo sapiens
gccccagctgcccgccagctgtgagcgcccgtcgggcccggaggtcacccgcaaacagctgggtcggcagctgggagc

SEQ ID NO: 551562 - DNA, 78 bp, Homo sapiens
cttgataagcaggtgatgtaaggctggggaggcctgggcatgagacctcctcctcattcttgcatccctgaagtcaag

SEQ ID NO: 551563 - DNA, 78 bp, Homo sapiens
ctggcccttctaaccatacacattgtttccgggaggctaaatataacccctcaggcagtggtatggatgggtggccag

SEQ ID NO: 551564 - DNA, 78 bp, Homo sapiens
ctctgaacggcatttctcattagcaacagacactaagttaatgtagtttgtagttaatgagtctgtgcttgttttgag

SEQ ID NO: 551565 - DNA, 78 bp, Homo sapiens
gttaccccaggaagcaaagtatttggggggcatcattaaacattttgccctatggtcttttgttttctgggggcagac

SEQ ID NO: 551566 - DNA, 78 bp, Homo sapiens
gccttgtgactccctaccatctttagttctctctgtcgcctgttgggaggggtgaggagaggtggcaaggagcaaggc

SEQ ID NO: 551567 - DNA, 78 bp, Homo sapiens
ggaagcagagctaattctttcggggaccggggctaaggacatgggtgagttctgttcctgaatttggtgtgagcttcc

SEQ ID NO: 551568 - DNA, 78 bp, Homo sapiens
cctcatgactgcagccagtttaaatatgccatctatccttctaactttggttttaaactggcattgcagtgatgcagg

SEQ ID NO: 551569 - DNA, 78 bp, Homo sapiens
gggttgatttcttgttgccactgcctggcctgaagacagtgcttggctcagcggtggcagcagacgaagcagcagctc

SEQ ID NO: 551570 - DNA, 78 bp, Homo sapiens
tctcagtcatcccagtaggcattagcacctgttaaaagctcctcagataggtgttaggcagtgctggttcagctgaga

SEQ ID NO: 551571 - DNA, 78 bp, Homo sapiens
ctcagtgccatagactacgctcacactagaccccagccttctcctgggccctgtgtgaaggtagctcttggcactggg

SEQ ID NO: 551572 - DNA, 78 bp, Homo sapiens
ctcctcttccccgcgccgccggcccctcttatttgagctttgggaagctgagggcagccaggcagctggggtaaggag

SEQ ID NO: 551573 - DNA, 78 bp, Homo sapiens
ctctgtagtgtttagttatggtcgccctggtagttctttttagtccgaccgggttgactataaatgaaggcagcagag

SEQ ID NO: 551574 - DNA, 78 bp, Homo sapiens
gtgtgccctgcgggatgccccgagggctcctgcttgtgttgccagcacctgcccttgggagccgtcagctggggccac

SEQ ID NO: 551575 - DNA, 78 bp, Homo sapiens
gggagaggttgttccatccagggcagttggtctccagaaggaaattctctgtatctgggtgctgcaacctaggtgccc

SEQ ID NO: 551576 - DNA, 78 bp, Homo sapiens
cagagccagcggcaaaggcagggaacaggcaccgcccactctaggactgggccctggttctgcctgtgagctggtctg

SEQ ID NO: 551577 - DNA, 78 bp, Homo sapiens
atgaggaagagagaaaagtgtgtgcagagggcaggaagaaagcccaagctctgtgcattacacttttctcagtctcat

SEQ ID NO: 551578 - DNA, 78 bp, Homo sapiens
tcagcagaggcttactggaaaggccattccaaaatgtagataatgtcagtgaagtgcttgctagtaggtagctgctgg

SEQ ID NO: 551579 - DNA, 78 bp, Homo sapiens
gttataaatcactacttaatctaattagtttagaagctattttaaagagcttaattagattaagctgtgattgataac

SEQ ID NO: 551580 - DNA, 78 bp, Homo sapiens
gtctcccggtgggtcagatgttttaggtctgatcttccccagaggcaggctctggatgcaaaggacccagtgagagat

SEQ ID NO: 551581 - DNA, 78 bp, Homo sapiens
gctggtctccagcttggtgctggctctccaggcttttatttgccagcattttggagccacgccctcttggagatcggc

SEQ ID NO: 551582 - DNA, 78 bp, Homo sapiens
cctgggcgtctggccactgcctgaccctcaaaccaaggggagtgtccgagagtcaggcaggagggccaggtgcagagg

SEQ ID NO: 551583 - DNA, 78 bp, Homo sapiens
ttgcagcaggaaatgtgttattattgtaattgtctgatgctaattatacttattactataataaccattttgttgtaa

SEQ ID NO: 551584 - DNA, 78 bp, Homo sapiens
ggcatctgtgatgagggcctggtggctgtgccggctgctcagcagatacgcagggcatgggccctgtctgcaggtgcc

SEQ ID NO: 551585 - DNA, 77 bp, Homo sapiens
gcttggccatgttagtcctagaagccacggagaaggacccttctgattggctttcaggacttatctaactgctaagt

SEQ ID NO: 551586 - DNA, 77 bp, Homo sapiens
ggaagtacaaggggagtaagtctggtccatgttccctctgatgctaacacggtcacagtctgctttctttgtgttcc

SEQ ID NO: 551587 - DNA, 77 bp, Homo sapiens
ttgcaatgccatctttcaattcctccagccctggatggggctcaggggctggagggattggaaggaggcagtggtaa

SEQ ID NO: 551588 - DNA, 77 bp, Homo sapiens
ataaggcttattctatgggagctgactttatccaaccccacacttgggtgatgtagtgggctctgagtaagctttgt

SEQ ID NO: 551589 - DNA, 77 bp, Homo sapiens
tccattccatcccagatcccagcctgcagaataaagataactaaactctgacaggttgggatatggaatggaatgga

SEQ ID NO: 551590 - DNA, 77 bp, Homo sapiens
agatttattattcttgaagataagtaataaccttgactttgccttggtcaatatttatctcatgagtcgataaatct

SEQ ID NO: 551591 - DNA, 77 bp, Homo sapiens
gtgatttaagatgttttctttcgcctttctccttttgagagagatggagaaagaggaaagaaaatatcttaaatcac

SEQ ID NO: 551592 - DNA, 77 bp, Homo sapiens
aggcaatcacactcctggggattataggagcttggatacatgtctttccttataatgccctaaggatgtgattatct

SEQ ID NO: 551593 - DNA, 77 bp, Homo sapiens
gccgccagctcataggtttcaaagctctgggacagacctcatgaacatcttggggctttaacgtgtaagctggcagc

SEQ ID NO: 551594 - DNA, 77 bp, Homo sapiens
ggtgccaggttctcagtcagctgggggtgagcagcctgttttccggaagcaccccaggtgaccctgaacctgctgcc

SEQ ID NO: 551595 - DNA, 77 bp, Homo sapiens
gcccttctgctgccgaggcttctagcaggatccagaggaaaattcctctggcctgaaggctgcggccgcggaggggc

SEQ ID NO: 551596 - DNA, 77 bp, Homo sapiens
gtttatcaggtaacagctatgtctctctttttattgagagacttttactgagagacagaactgtttacctgataaac

SEQ ID NO: 551597 - DNA, 77 bp, Homo sapiens
tggtacagatataacttgcactgtaggaatgcctaagtgtacctcgcttcctacaatgcaggttaaatctggtatca

SEQ ID NO: 551598 - DNA, 77 bp, Homo sapiens
cttcccttctggccatttcctcccctccagaataccacttgggtcgctcgaggaggaagagtgtcccaggggggaag

SEQ ID NO: 551599 - DNA, 77 bp, Homo sapiens
agaagcacgcagcaggcgggcattcccacagcaaatcagggacaaccgtgggaatgccaacctgcttatttgttttt

SEQ ID NO: 551600 - DNA, 77 bp, Homo sapiens
ctgcccatgtcctctgcagtgggacggggggcagctgatcctgctggttgtcccattgcagagcctggtctctgcag

SEQ ID NO: 551601 - DNA, 77 bp, Homo sapiens
cagagaacaaaacatgtcatctctccacccaagctgggtccacccaggacactggcttggcaggaggaagacctctg

SEQ ID NO: 551602 - DNA, 77 bp, Homo sapiens
agaaggaaggtggtgactgttgtgggcatgacagcctcccctcttgctcagaatggttcacccatcctgctctttct

SEQ ID NO: 551603 - DNA, 77 bp, Homo sapiens
gcaactttgggggtttgtggatatgttgttattgggtagagaagcctagtagtgtccataatctctagagatactgc

SEQ ID NO: 551604 - DNA, 77 bp, Homo sapiens
aaacattcttcacaggtgagtttgtgttccttttctcttgtttctagagaacatgagctccctgaaagagaatgttt

SEQ ID NO: 551605 - DNA, 77 bp, Homo sapiens
cagctccaggggacatggccccatggccaaggtctcagatatggaccctgagcttggggctatttctgctgttgttg

SEQ ID NO: 551606 - DNA, 77 bp, Homo sapiens
atattcactcatgaatgaccaaagcaaaatttcttttataacattttgttttgctttggtcgttcatgagtgaatgt

SEQ ID NO: 551607 - DNA, 77 bp, Homo sapiens
aatggcttcactggtggcccattcaaatgtgctaatgtcagaaaaaaaggttgaatggggcaccaatgtacaccatt

SEQ ID NO: 551608 - DNA, 77 bp, Homo sapiens
tgcaaagcaagagcatacttttgcactttcaaacactatagcttagtgtttttaaagaaaagtatgttttgctttca

SEQ ID NO: 551609 - DNA, 77 bp, Homo sapiens
cgcggcgggggaccgagagggcctcggctgtgtgaggactagaggcggccgaggcccgggccggttcccccgaggcg

SEQ ID NO: 551610 - DNA, 77 bp, Homo sapiens
ggattctgccagcatagtgctcctggaccagtgatacacccggcaccctgtcctggacacgctgttggcctggatct

SEQ ID NO: 551611 - DNA, 77 bp, Homo sapiens
gtttcttccctggtgttaaatcaacacttcccactacatctagtttttgactgctgagtttaacactgggaggaggt

SEQ ID NO: 551612 - DNA, 77 bp, Homo sapiens
acctcagtgggttactgtgataataatatgagttctatatatcaactcatatttttatcacaataacccaatgaggt

SEQ ID NO: 551613 - DNA, 77 bp, Homo sapiens
gcagtctcaaaagtgactccagcatctgaatttgggattcatatgtaactggggtcactgtttttgagaaaatctgc

SEQ ID NO: 551614 - DNA, 77 bp, Homo sapiens
agtgttgcataggcctgctgacccagggagaggttacgcaaacatctggccttgggtcagagagggctctgcaagct

SEQ ID NO: 551615 - DNA, 77 bp, Homo sapiens
ggatcacccccaggcctcactggctcaggcggatgttctccgcttctcctttgtagctctgaggcctgggtctgtcc

SEQ ID NO: 551616 - DNA, 77 bp, Homo sapiens
agcaggtagaaaggaggcgcaccttacaagattcctcatcccttcctccttgatgaggtccttcttttgtgcctgct

SEQ ID NO: 551617 - DNA, 77 bp, Homo sapiens
atctgcttttcaatcagctcaatggaattcaatcaactccaacagttaaaaggattcattgattgaaaagagcagat

SEQ ID NO: 551618 - DNA, 77 bp, Homo sapiens
attttctattgcttcttattagcagtaattctcagccctgcgaggagaattactgctagcaagacgcaatagaaaat

SEQ ID NO: 551619 - DNA, 77 bp, Homo sapiens
agccataatgcatggttttaaggtcactgccggttattatctgaccagtaatgaccacaaaactatacattattgct

SEQ ID NO: 551620 - DNA, 77 bp, Homo sapiens
tggactttcaagtacccagaggtttcagctcacaagagacaaatgtcagtagtgagcctggagtactgagagatcta

SEQ ID NO: 551621 - DNA, 77 bp, Homo sapiens
gccccagccgctggcccctccctccagggctgcagctgggctgagcctccaggaggggggtgctgtggtgactgggc

SEQ ID NO: 551622 - DNA, 77 bp, Homo sapiens
aagagaggtaagagaattaatgtttgggtgctaggcagtcagttgggcagttcacataaattctctcatttcatctt

SEQ ID NO: 551623 - DNA, 77 bp, Homo sapiens
gcccagagtggggtttccccagcctagaggtatgaaaagacacttcacactctgtggcacgggggaagtcccaaggc

SEQ ID NO: 551624 - DNA, 77 bp, Homo sapiens
attgtatagtgttcagaggtgagagtgagcccatccttgctgaataggggcttctctagcttgtgaatctgtgcagt

SEQ ID NO: 551625 - DNA, 77 bp, Homo sapiens
gtgtggtgaggcccagcattcagggcaggaagaatcgtacaagaggtgtctgtctttgtgctgggatctcattgcat

SEQ ID NO: 551626 - DNA, 77 bp, Homo sapiens
ctcctgtaatagtgattctccactgggggccaagagccctccctgttcccctactgagaatcactgtgagatgggag

SEQ ID NO: 551627 - DNA, 77 bp, Homo sapiens
tttgaacacttaaagatagatggcattgtacccagagccagctggtacaatggcatctatctataattgtgtataaa

SEQ ID NO: 551628 - DNA, 77 bp, Homo sapiens
ggcttaatggacagtacaagtcagtgaggcaaaaatgggccaatttgctctcattgattttcactgcccattgagct

SEQ ID NO: 551629 - DNA, 77 bp, Homo sapiens
gggggagtccagacaacaggcgagtgaccacgagcttcctaaataagaggactgggtgcctcggtctggctcccacc

SEQ ID NO: 551630 - DNA, 77 bp, Homo sapiens
cctgatctctggcctagatggacaatgtgggtgtgctctctgtgtcttccctgtccatctgttggccgagggtcagg

SEQ ID NO: 551631 - DNA, 77 bp, Homo sapiens
agaggatggaggaggtgaagattttggggggttctcatcattttccctttccaagtttcatccttatccatgcttct

SEQ ID NO: 551632 - DNA, 77 bp, Homo sapiens
ggcgctgcccacacccaggggagctgctgcttctgatgaaatgcacggctccaccgggcaggggcacaaccaccgcc

SEQ ID NO: 551633 - DNA, 77 bp, Homo sapiens
tgcgcgaggctgcactggctaaaggctgggtgccattgtctttcagcaaatagccttggtttgtgcacctggctgca

SEQ ID NO: 551634 - DNA, 77 bp, Homo sapiens
atacattgaaaaattaactgggacagtgcaggtatggtttgattatctatactctcctcattgatttctcagtgtgt

SEQ ID NO: 551635 - DNA, 77 bp, Homo sapiens
attttgtaggattggaggagtctgatttgtttattcccctctcctcaacaaatcagacccctccaatcttacaaaat

SEQ ID NO: 551636 - DNA, 77 bp, Homo sapiens
ggcgaagaggtctgggcgtagtagtgacgaatcctaagacaagggatctccactactgcggccacacacttttctcc

SEQ ID NO: 551637 - DNA, 77 bp, Homo sapiens
tatcttactaatacctgctctacagctgggagacactatagaacactgcccagctgtaggcagctgttagtaagata

SEQ ID NO: 551638 - DNA, 77 bp, Homo sapiens
ttgaacagttcagagggcaaggaagcaaagagaagtgctctgagtgtgtctttgcttgccagctcctgaatttttaa

SEQ ID NO: 551639 - DNA, 77 bp, Homo sapiens
ctcactgaatcaagatgtatcgactctattcatgtctgcggacatctttgaatcctttacatctgagactcagtggg

SEQ ID NO: 551640 - DNA, 77 bp, Homo sapiens
ggcggcagtccagctggaacggcagcccagcagggacacaaccccagctcgggcgccggccacgctaccttgctgcc

SEQ ID NO: 551641 - DNA, 77 bp, Homo sapiens
gccaagggagctcagcagggtgaaggggatttgcagacaactgctctatctccttcctctgccacgacttccttggt

SEQ ID NO: 551642 - DNA, 77 bp, Homo sapiens
cggctcttcttcgagtcttctcagaggttggagattccctgtcttctccaacctctgccaagtcttcagagaggttg

SEQ ID NO: 551643 - DNA, 77 bp, Homo sapiens
gaatctgttgcctccaggtgttaacacagaattaagcatccacaattgctgaaagtcacctggggcatggtgggttt

SEQ ID NO: 551644 - DNA, 77 bp, Homo sapiens
agtttgataccaggtagtggtctgtggctacaggaatcttgttctactgtctgcttccactgcctgcttaaaaaact

SEQ ID NO: 551645 - DNA, 77 bp, Homo sapiens
ctgtggggattcagagaaggaatggataatgagtataaactgcatatttactctttattctttcattattctcatag

SEQ ID NO: 551646 - DNA, 77 bp, Homo sapiens
tgagcgggtctctgggcctcagttgccttatctgtaaatgagaaggttgaactacatgagctttgaagaccctttca

SEQ ID NO: 551647 - DNA, 77 bp, Homo sapiens
gtttcttttgggtgaaaacagtctctgatgcagctctattgcaccatttcagcgggtgtttatcatttaaaaggaac

SEQ ID NO: 551648 - DNA, 77 bp, Homo sapiens
tcaatccttggtaatctggctgctgctgccatctcttatagggacctcctcgttcccagccagagaaccattgttga

SEQ ID NO: 551649 - DNA, 77 bp, Homo sapiens
catatagcaggtcctcaataagtatttgttgaaagaataaataaaccaacaagtcttatttgagcacctgttatgtg

SEQ ID NO: 551650 - DNA, 77 bp, Homo sapiens
taggcactccatcttgggattcctgatgtcatctattttgtcacgcaggatatggggggtcctgggaggagagtctg

SEQ ID NO: 551651 - DNA, 77 bp, Homo sapiens
tttggcttttaaaactagaagtagaagcagttattttcttggttagatattttggctttttggttttaaaagccaaa

SEQ ID NO: 551652 - DNA, 77 bp, Homo sapiens
tgccttcagggatcatcttgtcagttatgcagctttccaattttatggctgagatcaagaatgattccttaaaggca

SEQ ID NO: 551653 - DNA, 77 bp, Homo sapiens
gccggcttcggccatttccggcgcggcgcccttcggcaagttccgcagtcgcctgtcggaaatggctgccggccggc

SEQ ID NO: 551654 - DNA, 77 bp, Homo sapiens
tctacaatggtggggaaatgggttctcttgattatatcataaaataaccagaagatttcctttaactaccatgttga

SEQ ID NO: 551655 - DNA, 77 bp, Homo sapiens
tagaaatagggttctttaagtgcctgtgatataccaggcccaggaggtcacaggcatttaaagcactgtgattttta

SEQ ID NO: 551656 - DNA, 77 bp, Homo sapiens
tgtatctgttaaatctcttatttgctgtaaattgagttttgttttatggtatgtataagaggtattagcagaataca

SEQ ID NO: 551657 - DNA, 77 bp, Homo sapiens
catgaagcagtagagtcagcagtcaaactgagtacacattcttaaccagtgtgctgcagattctactgaaagtcatg

SEQ ID NO: 551658 - DNA, 77 bp, Homo sapiens
gccttaggggaccatcccagcctctcagtgtccctcttcctcccttgcactcagatgctgatggtccttctatgggc

SEQ ID NO: 551659 - DNA, 77 bp, Homo sapiens
tggcctctgtgccctggtgaaggccagggtcttcatggcgagcctctccctgaccactgccagggtaccggtggcca

SEQ ID NO: 551660 - DNA, 77 bp, Homo sapiens
tctgacactctcaggatgtgggtttttgcactgtgtctctcacacagtaatacatgaccatgtcttcagatctcagg

SEQ ID NO: 551661 - DNA, 77 bp, Homo sapiens
gaatgtccctatccctgccctccagaagctcccagtgttgtgggactctgatggatggacaggggtagtgaagactc

SEQ ID NO: 551662 - DNA, 77 bp, Homo sapiens
gcgcggcgcggcctctccccgggaggagagaacacaaagaaaagctctctccaatccggtcagagccgtggcggcgc

SEQ ID NO: 551663 - DNA, 77 bp, Homo sapiens
tgggggtggtggccagaggggtcctcagacaactcaacaagggaagtattgtgggcccacctctgcctccaccctca

SEQ ID NO: 551664 - DNA, 77 bp, Homo sapiens
tcttctttttggttcctctgtctttaaatatctctatgccaactagtatcaagaaggcaggggatgcagggagaaga

SEQ ID NO: 551665 - DNA, 77 bp, Homo sapiens
acttttacagtaggtcacggtatagtttgaagagcatgacttggtcttcaggctgtctggatctacgcactaaaagt

SEQ ID NO: 551666 - DNA, 77 bp, Homo sapiens
tctgaagaggtaagagaaacagtcctaagtgattctatccacttcatttcatgattgttacttttatcattttcaga

SEQ ID NO: 551667 - DNA, 77 bp, Homo sapiens
tagtgtgtgtgtttcttccactatatggtgatatcgtggaagaatatcacaatatagtggaagacacaaacatacta

SEQ ID NO: 551668 - DNA, 77 bp, Homo sapiens
gtgaagggggtgggggactggtgaaggagaattcgagaggaacttctgctctcactggttactcatctactcatcgc

SEQ ID NO: 551669 - DNA, 77 bp, Homo sapiens
taaacattcttcctctgaggcacttgtttagccatgtagaagccattcaggggctatgcctagagaggaattgttta

SEQ ID NO: 551670 - DNA, 77 bp, Homo sapiens
gaggtacttgatatgcggtgtgtttcttctctgtgaatcaattcagctgagaagcaaagaactgcacttcagacttc

SEQ ID NO: 551671 - DNA, 77 bp, Homo sapiens
cctgtcggtaggaagattgtttcaaatctgtttgtgcctgaagcacttttgattgtgacagtcttctcattcatggg

SEQ ID NO: 551672 - DNA, 77 bp, Homo sapiens
gaaccctcatgaagagttctaacccttggttttcaataaagtgtctacaagtggttggagattcatctgtgaggttc

SEQ ID NO: 551673 - DNA, 77 bp, Homo sapiens
ccagctgtgctgaggggcagagatcagactataatgagatttgtccactggtatctcttcctctgggtatctgctgg

SEQ ID NO: 551674 - DNA, 77 bp, Homo sapiens
gcctcttcctttcgtaactcctgacccaagctctgcagggcagtgtagggctagggaggagcatggaccttagtggc

SEQ ID NO: 551675 - DNA, 77 bp, Homo sapiens
gaacaggaggagggattggtggtggttgttgatgatgatgattattgctaactatgactattatgcctaccctgttc

SEQ ID NO: 551676 - DNA, 77 bp, Homo sapiens
ctcaagcacaggcgtgggaaaggcccccggcccgacagcccctgctatcccagggccgtcctgagcctgtgatggag

SEQ ID NO: 551677 - DNA, 77 bp, Homo sapiens
gagtttgatttgtggggaggagggagagttaggatctgcttatggcctaacctcattttcctcccttgtgtggattc

SEQ ID NO: 551678 - DNA, 77 bp, Homo sapiens
cagtgatgctaatgtgcctaatgactgctagtgtctgtggttgtgcttagcaatcattagacatattagtatcactg

SEQ ID NO: 551679 - DNA, 77 bp, Homo sapiens
atgtgctgttttgctgtttgggagtgttttgtatatactttttaaaatacaaggctttctcaaataggatagaccat

SEQ ID NO: 551680 - DNA, 77 bp, Homo sapiens
tctgacactctcaggatgtgggttttcgcactgtgtctctcacacaggaatacacgaccatgtcttcagatctcagg

SEQ ID NO: 551681 - DNA, 77 bp, Homo sapiens
gtgacaatctgggcttgttgactgggctggatagtagctgtactggtttggcctagttggagcccccgggaggtcac

SEQ ID NO: 551682 - DNA, 77 bp, Homo sapiens
ctctatctctaagcccttggtcaatatgaaatagtttgaaaagcccagactaactgactatgttcttagggaaggag

SEQ ID NO: 551683 - DNA, 77 bp, Homo sapiens
ccctgtccttactgaggtcccaaactggtagaccactataaatgaaaggatgctagatggggcttcagggggcatgg

SEQ ID NO: 551684 - DNA, 77 bp, Homo sapiens
cactacagtttgtgccaggatttaataagatagtgtttgtgaaaagcaccttgttcagatcttacacactgtatgtg

SEQ ID NO: 551685 - DNA, 77 bp, Homo sapiens
agcagcagattcatggtgtccggctaaatggaaaatctgtaattcagaccacgaagtaggcagctgggtttgttgct

SEQ ID NO: 551686 - DNA, 77 bp, Homo sapiens
ctggaatgtcaggctctgtcaccttgttttagctgacgagttcagggctgatgaggtgaatgggcctgattgtctag

SEQ ID NO: 551687 - DNA, 77 bp, Homo sapiens
gtgacatttatttatattttgttctaaaatgtgcatttctcaaatgtacgttttaagatcgagatataaatatttac

SEQ ID NO: 551688 - DNA, 77 bp, Homo sapiens
gccctctcaccttgaggtcgcacagcagcattgttatttacttcctttcattgttgctgtggaccttgagtaagggc

SEQ ID NO: 551689 - DNA, 77 bp, Homo sapiens
cttttcctctctctttttcgttcccctctcctctccttaccggcctaggggaggggggaaacaaggggagctagaag

SEQ ID NO: 551690 - DNA, 77 bp, Homo sapiens
gagagaactattgttcacaattctataatgaacaatagtcttgtgctgatagaattgtggctacaatgagttatctc

SEQ ID NO: 551691 - DNA, 77 bp, Homo sapiens
ccaaagtcatacagagggccagggacttaggctttcatgctggactcttttccctggctctctggcttggattttgg

SEQ ID NO: 551692 - DNA, 77 bp, Homo sapiens
tggcaaggtcaaggtcctggagtgggccatagttgccaactcctgctaggctcaacttcagaatctgtgactttcca

SEQ ID NO: 551693 - DNA, 77 bp, Homo sapiens
ccatgactatgcacatccaggctacttcctgactaggccctgttcaggaagcatcctgaggtgtccattcctcgtgg

SEQ ID NO: 551694 - DNA, 77 bp, Homo sapiens
ggtttatgatttggatgctttgggaatgggtgaggccaacagtttccacttccctgagggcagccgagttgtaaacc

SEQ ID NO: 551695 - DNA, 77 bp, Homo sapiens
gtgagagggactgggacaggaaggatggagacaacctgtctctgctactctccaccagcctgttccattttctccac

SEQ ID NO: 551696 - DNA, 77 bp, Homo sapiens
ggggtcagtaggaacctagggtcaaaaaatgggatacagtctccccctttatgcagttgatcttttcttgctgcccc

SEQ ID NO: 551697 - DNA, 77 bp, Homo sapiens
ttatgaaaaaatggattcttgccagttttgcatctattacgcaaatgcaaagctggcaagaatccatagagcaataa

SEQ ID NO: 551698 - DNA, 77 bp, Homo sapiens
gagctggagtgctggacgcggacgctcgccacagcaagggctgtggtggccgctctgcctccacatcctccagactt

SEQ ID NO: 551699 - DNA, 77 bp, Homo sapiens
gtccaaggagaccatccctagccttaacccttcagttgctagatcattgagaggttggggtggaggtatcctgggat

SEQ ID NO: 551700 - DNA, 77 bp, Homo sapiens
tgtaatgagattggaaacgcagatgaggtgactaaaattgattacctactatatctgaaaatttcaattttattgca

SEQ ID NO: 551701 - DNA, 77 bp, Homo sapiens
gcaaagcttgttccagcactgacaccatcgaaggatcccagaccacacctggtgcttagccctggaatatgctttgc

SEQ ID NO: 551702 - DNA, 77 bp, Homo sapiens
acagtttcttttcttttgtcgtttttctggatctgcctcagttcattgttcttagacttgggaaggggagaagctgt

SEQ ID NO: 551703 - DNA, 77 bp, Homo sapiens
cagggtgggggctggggctgaggtctgtccaaggggctgtgtccagcttgctgggcaacctggccaagtctcccctg

SEQ ID NO: 551704 - DNA, 77 bp, Homo sapiens
cctcttttgtggatacaaatatttcctctactggattgtagttcctctgagggtttaatttgtatcccaatgcctgg

SEQ ID NO: 551705 - DNA, 77 bp, Homo sapiens
ggctttttcaaaggaggaaagccagggtgttaaatatcctccttcatacgctcagcttccttccttaaggaaaggcc

SEQ ID NO: 551706 - DNA, 77 bp, Homo sapiens
ggctcatgaaagggaacagaggaggggccgactctccaagttttagttggtctttccttctccctacttctgaagcc

SEQ ID NO: 551707 - DNA, 77 bp, Homo sapiens
ggaattgcttattcaccatcagtagcagaaacccagaatttcaagatttttgttactgatggtaagtaaacaattct

SEQ ID NO: 551708 - DNA, 77 bp, Homo sapiens
gtggtcttggtggggaagtctgagcggcagttttctctgctatcgtaaagctctgccagccattctccctgcctcac

SEQ ID NO: 551709 - DNA, 77 bp, Homo sapiens
ccccccacccatcctcacagtctcagtctctggtttaggatattgtgggactgagattgtagacttggctggagggg

SEQ ID NO: 551710 - DNA, 77 bp, Homo sapiens
tcagccctttcctggatttcttgtcaaactgggcaactatataaaatgaacagacaagagctgcaggaaagggctga

SEQ ID NO: 551711 - DNA, 77 bp, Homo sapiens
tcagccctttcctgcagctcttgtctgttcattttatatagttgcccagtttgacaagaaatccaggaaagggctga

SEQ ID NO: 551712 - DNA, 77 bp, Homo sapiens
tagcctttgtacataatgcagaacacagaaaggacagcttttgataaacacttgtggttctgtataatgtaaggaaa

SEQ ID NO: 551713 - DNA, 77 bp, Homo sapiens
cagcacaggaagtgggccttcacaatgtcaggatacaggaagctatcggactattgaaggccacttcctgtgagctg

SEQ ID NO: 551714 - DNA, 77 bp, Homo sapiens
ccctctcccttcggccctgacccttggaggcagtcaccacggcaaccccaaagttcagggaggccggggtgaggggg

SEQ ID NO: 551715 - DNA, 77 bp, Homo sapiens
gttcactttgcttgtgggatctccccgttgctcctgcccgtggactgagtggcaggccatcctacaagcacccggac

SEQ ID NO: 551716 - DNA, 77 bp, Homo sapiens
gatgaggaggcaacatcccacattgtttattgattcataaggttaagattaaagtgggattcttgcctatgtttatc

SEQ ID NO: 551717 - DNA, 77 bp, Homo sapiens
ctttttatgtaaaatggggatgatgataacaatagtattcaatagcattattgttatccccattttgcattaaaaag

SEQ ID NO: 551718 - DNA, 77 bp, Homo sapiens
gcaactcagggataaaaatacccaggtccagagcatgtgacaggcactgctggaaccggtattatccctggggtggc

SEQ ID NO: 551719 - DNA, 77 bp, Homo sapiens
ggctgttgcccctgagagactgggcagggccggcagctctttgcttgctgattctctcatctcccagagcaacagcc

SEQ ID NO: 551720 - DNA, 77 bp, Homo sapiens
agagggaggatgaagccgagagttgagtggccttcaagctccctctggttgctcataccttgtttctttctccttct

SEQ ID NO: 551721 - DNA, 77 bp, Homo sapiens
tctgacactctgaggatgtggtttctcacactgtgtctctcgcacagtaatacacggccgtgtcctcagatctcagg

SEQ ID NO: 551722 - DNA, 77 bp, Homo sapiens
ctgagatccgcggcttctcggacggctggtttcttagggatctgagatgcctgctctccagactgctgctctctcag

SEQ ID NO: 551723 - DNA, 77 bp, Homo sapiens
ggttgagggaaggtagaggtcaccggcacatagttcatttgcaaatatatgctgatgacatctatcttccctcaacc

SEQ ID NO: 551724 - DNA, 77 bp, Homo sapiens
gtgtacacttctgatgttatcctcgctcacatgtcaccagcttgcaactttgagtgggatgagttagaggtgtccat

SEQ ID NO: 551725 - DNA, 77 bp, Homo sapiens
gagagaggggcgggaggagagcggcgcctgccgatgacgcaagtcacctagcaaccgctctcttccccctccctctt

SEQ ID NO: 551726 - DNA, 77 bp, Homo sapiens
ctctaggatgtgctcattgcatgggctgtgtatagtattattcaatacccagagcatgcagtgtgaacataatagag

SEQ ID NO: 551727 - DNA, 77 bp, Homo sapiens
tggactttcaagtacccagaggtttcagctcacaggagacaaatatcagtagtgagcctggagtactgaaagatcta

SEQ ID NO: 551728 - DNA, 77 bp, Homo sapiens
gtttagcaaatggaaggagttcaggcttccgggcaagttgctccacttcccggagcctcagcttccttaccttgaac

SEQ ID NO: 551729 - DNA, 77 bp, Homo sapiens
gggaggttttgctatcaagaaatctaatgaggcttaaagaaaactgataattcattagcattcttgaacgtgccccc

SEQ ID NO: 551730 - DNA, 77 bp, Homo sapiens
tgcagtcaggaattgattttggatatcaactccctagtatgggattagcattcagaaatcagattcttggccaggcg

SEQ ID NO: 551731 - DNA, 77 bp, Homo sapiens
aagaattcggccctgtgaagagttgggttcggcctgtctcaggccctgcccacatcccatcacagggccgtggactt

SEQ ID NO: 551732 - DNA, 77 bp, Homo sapiens
aggcaaggggacttcctggtgccacagctcaagtctgtgacaagagacaagagccaggcgtgaggattcccctgcct

SEQ ID NO: 551733 - DNA, 77 bp, Homo sapiens
ttgccttctgtggatatgttctctcttcttgtatggtgtttatgagaagagaaatatttccatggaagtttcagcaa

SEQ ID NO: 551734 - DNA, 77 bp, Homo sapiens
ggaaggacctgtccgtggtgctgcttgtgagtcccagctctgaacaaattatccagcttcagggacagcttcttttc

SEQ ID NO: 551735 - DNA, 77 bp, Homo sapiens
tccccaaggagtccctttaactcacagcccctttcctggccagggggctgggagttgggggatattcatctcgggga

SEQ ID NO: 551736 - DNA, 77 bp, Homo sapiens
ggggaagggtgggtaggtgagtgagggtggggtgcccctggttggccccccatcttccctgcctgtcccacatcccc

SEQ ID NO: 551737 - DNA, 77 bp, Homo sapiens
tgcctggccacggatccttcaccctggcttgacagctggtttaatctgcaagccagggtggaatgcgtggtcttgca

SEQ ID NO: 551738 - DNA, 77 bp, Homo sapiens
acccacctgcaggctgagtgaccctgggcaaccttttccccctctctctgctcagtttcctcagctgcaaaatgggt

SEQ ID NO: 551739 - DNA, 77 bp, Homo sapiens
gccagggcatcggggccttcttttggttttacccaaataagggagtcagagtaacagaaaggctcaggtgctctggc

SEQ ID NO: 551740 - DNA, 77 bp, Homo sapiens
gcatagtccatgagcaagatggatttaggggccgctccttgacggccatgacatttcagcttgtccatggactgtgt

SEQ ID NO: 551741 - DNA, 77 bp, Homo sapiens
tctgacactctcaggatgtgggtttttgcactgtgtctctcacacagtaatacacgaccatgtcttcagatctcagg

SEQ ID NO: 551742 - DNA, 77 bp, Homo sapiens
acaagatggattcacagaattggagcatcttaggatcttaggagcctcagatgctcagggctgtgacattattctgt

SEQ ID NO: 551743 - DNA, 77 bp, Homo sapiens
agcatctcttgcactctggagactgaggacttgctatagtggaacaagaagcagtcttcggcaatggaggagatgct

SEQ ID NO: 551744 - DNA, 77 bp, Homo sapiens
attgtctatcatccttattaattattgttattacattataataagaatatttgatggtttctggatggttaggcggt

SEQ ID NO: 551745 - DNA, 77 bp, Homo sapiens
ctcaagaccttgctgcttgctctaaatccatatgagacagttaagtaaatgtggattagactggcagcaaagtagag

SEQ ID NO: 551746 - DNA, 77 bp, Homo sapiens
ctgcactctgtcttttcattaatagaagttaacccaataagttaatgacttctgttaactaaaagacagagtggtag

SEQ ID NO: 551747 - DNA, 76 bp, Homo sapiens
ggccgttccccaggacagtctggggtagaggaggtcaggatttaactacctgagggtccggggaacagatgtggcc

SEQ ID NO: 551748 - DNA, 76 bp, Homo sapiens
gtgttgtaggcagtggggtctctctgtacctcccacccttgaggagggaggtaaagatgagctcagtgtccaacac

SEQ ID NO: 551749 - DNA, 76 bp, Homo sapiens
ctgaggacattctagtggggggtagatgtcacatcgtcatatttctctggctctaccaccactagaagaacctcag

SEQ ID NO: 551750 - DNA, 76 bp, Homo sapiens
tgacatgcgccacttagagcgggacgacattgatgtacagtgttaatattacgctctaagtggcttctgtatgtta

SEQ ID NO: 551751 - DNA, 76 bp, Homo sapiens
gggtcaggtctttcccctgggacgttttctcctctttattgcagtggcggaagcgtccccgtgagaggcccgaccc

SEQ ID NO: 551752 - DNA, 76 bp, Homo sapiens
gatgaagtagacagaggaggcagcataatactagaccttcttagtaagcatgttctcttcctcattcttcttcatt

SEQ ID NO: 551753 - DNA, 76 bp, Homo sapiens
gggtgttagttttcactcagagctgtgcttgccttttgtatttggcaagtgcagctctgagttaaaacaaacactt

SEQ ID NO: 551754 - DNA, 76 bp, Homo sapiens
agggcaggcagagggagggagggagaaagagcacaactggtgccttcgtctccccttccctcccatctctctccct

SEQ ID NO: 551755 - DNA, 76 bp, Homo sapiens
atctgctggtgattgaataaaagtgtcaagaaaatggctgcttgatggccttttgttctccctcatccagcttgat

SEQ ID NO: 551756 - DNA, 76 bp, Homo sapiens
ggccgttccccaggacagtctggggtagaggaggtcaggatttaactacttgagggtccggggaacagatgtggcc

SEQ ID NO: 551757 - DNA, 76 bp, Homo sapiens
ttgaggtcaagaactatgacaccacaatccatgggaaaaacactgttattggtgtcttggatatctatggctttga

SEQ ID NO: 551758 - DNA, 76 bp, Homo sapiens
agtgctgggagggcattcttgggtagatgttgagtgggttaccaaaggcatactttgagaaagtgtttagagcatt

SEQ ID NO: 551759 - DNA, 76 bp, Homo sapiens
ttgtacattcagtgtactgtgaatgtatatgcacaccagtggttacatttatagcagtacaactgagaatgtgcaa

SEQ ID NO: 551760 - DNA, 76 bp, Homo sapiens
catcaggctgtgatgctcagttgtgtgtagattgaaagccctaattttacacacaactgaggatcatagcctgatg

SEQ ID NO: 551761 - DNA, 76 bp, Homo sapiens
gaagcattggggagaagcaattttatctaggagcaagtaggaactctcagataagatagcgtctgccccagtcttc

SEQ ID NO: 551762 - DNA, 76 bp, Homo sapiens
gctgaggccctgtgacagttaaggcaaatgtgagaagtccctgctcgtttttgccttatcagtcagagacacttgc

SEQ ID NO: 551763 - DNA, 76 bp, Homo sapiens
catttgcactagggtcagagcctgagccaggaggcagaaatattgccacaactcttggactctgacccttgcagtg

SEQ ID NO: 551764 - DNA, 76 bp, Homo sapiens
gcttcagcctcaagtggggattgggttgcagtggtgaaccagggccaacacagcccgccctctttgaggttgcagt

SEQ ID NO: 551765 - DNA, 76 bp, Homo sapiens
gacataactgattgactttagtgatgtgccttgaaagttcaaattcaaggtgtgcacttatttcagtcagcttgtc

SEQ ID NO: 551766 - DNA, 76 bp, Homo sapiens
ggcctgtctagggcagacctgggcattgctggcctctaacagatgaggaatgcctgggacctgcccaagacaggtc

SEQ ID NO: 551767 - DNA, 76 bp, Homo sapiens
acagactgtttgtacttccagattaggtgtgggaagccagacacacaaagagcttttctgggagaggatagtctgt

SEQ ID NO: 551768 - DNA, 76 bp, Homo sapiens
ctcagactgtactcttatagccatctgaaatacgttttctaggtagagatagattgtgtaagggtacagttgtgag

SEQ ID NO: 551769 - DNA, 76 bp, Homo sapiens
ggagaaactgaggcacggtgagaggcaggggctggctgagcctaaggggcctctgtactcagtgcctccgtttccc

SEQ ID NO: 551770 - DNA, 76 bp, Homo sapiens
ttcaatggtcgaaatcaccaaactagaaaatataaatgccttatattttctagttcagtggtgctagactgtagag

SEQ ID NO: 551771 - DNA, 76 bp, Homo sapiens
tcctctgtggagggaatttgggttagatgctaggcacaatccaatcgtcagctatctgtaaattcccttcagagga

SEQ ID NO: 551772 - DNA, 76 bp, Homo sapiens
caggcagccagaggggcctggcactgagctggcacggaggagaacggccctgctggcccaggcccctcgctgtctg

SEQ ID NO: 551773 - DNA, 76 bp, Homo sapiens
cagggagcctggctccacaggccagggtgtgggaggaccgcctggccacacctcagccatgtggaggcggcacctg

SEQ ID NO: 551774 - DNA, 76 bp, Homo sapiens
acatacctctttggctttggagtagtttaatatgaattaatcactaggctctcttcagagttggaaacgaggtggt

SEQ ID NO: 551775 - DNA, 76 bp, Homo sapiens
cctacccctcccctcgcgcgctcgcggacctcgctggagccggtgccttacacagcgaagcgcggggaggggcagg

SEQ ID NO: 551776 - DNA, 76 bp, Homo sapiens
gctccctgtgagtaggaagaccagaaagaaaagatatctcccaatctgctttttggcttcttattcactccagagc

SEQ ID NO: 551777 - DNA, 76 bp, Homo sapiens
ggggtggccccccttccccggtgtacatattgtatctatgtaacgttttgtatattccagagggtagggccgcccc

SEQ ID NO: 551778 - DNA, 76 bp, Homo sapiens
taagcagttagcatggggattatgccagaagaggaagataatctctttggctgccatttccatgctcctttgtttg

SEQ ID NO: 551779 - DNA, 76 bp, Homo sapiens
atgctcctaccattagaagggctggaagaaggcatctccctcagccttcttccagctcttctaatggtaagagcat

SEQ ID NO: 551780 - DNA, 76 bp, Homo sapiens
cctcggacctggctaagcttccaaggccctcctggagggccaggaatcgggccgggagttgggtcaggctctgagg

SEQ ID NO: 551781 - DNA, 76 bp, Homo sapiens
agtctcaaggggtagctgtctcatcaaacttagagggctcccttccctgccctgaggctggctaccacttgagact

SEQ ID NO: 551782 - DNA, 76 bp, Homo sapiens
gggtgagaagagaggcaccgccctcagccccacatgtcttcagggctcacagtggctggctgcccctcctccaccc

SEQ ID NO: 551783 - DNA, 76 bp, Homo sapiens
ttttctggcaagcttgggatgagattccttatgatttaatcagatccataatgaagctctcccagctttcaggaga

SEQ ID NO: 551784 - DNA, 76 bp, Homo sapiens
gggcctcagtgttggagaccttcagggagagggagaaaggcagccatagccctgaagtgttaccagcatggagcct

SEQ ID NO: 551785 - DNA, 76 bp, Homo sapiens
ctggacaatgagggagctgacctttctgtgctcaataaaccaattgccactagagagtaggttccctggtgaccag

SEQ ID NO: 551786 - DNA, 76 bp, Homo sapiens
aagtgtttataggcaggggcccaattgtgcctatgccatgcaagttgttggcacttggcccagcctcaggacactt

SEQ ID NO: 551787 - DNA, 76 bp, Homo sapiens
gtaactgctgtcatgtaatgtgtcatagcatgtgccaggcactgtgctatgcatgtcatatgtgagctcaagttat

SEQ ID NO: 551788 - DNA, 76 bp, Homo sapiens
agctacttcaggacggttggctgaatggcaacagtgatggaatatttatatttagccacatgtgctgaatgtggct

SEQ ID NO: 551789 - DNA, 76 bp, Homo sapiens
ccactgtccctctcacctcccttagtccctgggaaatggaagacagcctgggagtgagggaggaaaggggacatgg

SEQ ID NO: 551790 - DNA, 76 bp, Homo sapiens
agttcatttgaagcctatctctttttaattcggagagccgggctctgaattaatagagataggcttcgagtgaact

SEQ ID NO: 551791 - DNA, 76 bp, Homo sapiens
cttcctggtgccaatttgcccctttgctgaagcacactcttcggtgcatctaaggggcaagcttggtgccgtggag

SEQ ID NO: 551792 - DNA, 76 bp, Homo sapiens
ggtggtttccttttgtctcctttattacatgggactctgacatgtgcccatagctagggtggcagtaggatctacc

SEQ ID NO: 551793 - DNA, 76 bp, Homo sapiens
atatttgcttttcagcttttcctaaaaggattgtacaccttagaagtgcttaaggaagagtgatgaaggcaagtat

SEQ ID NO: 551794 - DNA, 76 bp, Homo sapiens
tgatggctcattccccttctatctgcaccaaaacctctgtgactgtgtcctgcagatcaagggagatgtgccatca

SEQ ID NO: 551795 - DNA, 76 bp, Homo sapiens
tttcagctggctgcaaagggaactggtgaggtttgcatgcatgttcatattcagttcccctttgtggctagtgaaa

SEQ ID NO: 551796 - DNA, 76 bp, Homo sapiens
caaagggagttaactggtaagatgtacgtgttttggggtgccctctatgtgcttttacaatttttttttctctttg

SEQ ID NO: 551797 - DNA, 76 bp, Homo sapiens
tgattcaggccaagaaagcacttttgcctcattaattgggtgttaaccggtgaatgtgggtttttagtctgaatta

SEQ ID NO: 551798 - DNA, 76 bp, Homo sapiens
cctttctaccatacttttcctgggagtacgcactcgtaatttgaagagcgacttttgggagagggtggaaggaagg

SEQ ID NO: 551799 - DNA, 76 bp, Homo sapiens
gtccatctgtcagatcttaagcaacttgaggtcagggacagtatgtcctcaagttgcttcagacaatgttttggac

SEQ ID NO: 551800 - DNA, 76 bp, Homo sapiens
cccaccaacttccctagctcccatgtctcccattcctccaaataatgaggaggcaaggaagagagggaggtggggg

SEQ ID NO: 551801 - DNA, 76 bp, Homo sapiens
acaggggagtgggatggactgaggctgggtgggatgtggccggcacaccagcctcctcttttcctgacttccatgt

SEQ ID NO: 551802 - DNA, 76 bp, Homo sapiens
ccgtgactccactgcctgcctccgctggactgttccaggagaggggaggggctagggtgcaggtggggagttgggg

SEQ ID NO: 551803 - DNA, 76 bp, Homo sapiens
gctgtctctccagttgggattcttggttctggggtcctcccgccccaaccaaggatgcccagctggccaagtcagc

SEQ ID NO: 551804 - DNA, 76 bp, Homo sapiens
ggagggaggagggaggagggtccgggccaggtgggagcttctccccggaggcctgaggcagcttccctcctctccc

SEQ ID NO: 551805 - DNA, 76 bp, Homo sapiens
attcatcccacagatttcctaagcatcaatcttgggccaagcactgattgatgctggggaactctgtggaatgaat

SEQ ID NO: 551806 - DNA, 76 bp, Homo sapiens
gggtgggagctgagatggctggccctgtaaaacgtaattttgggccaaatactaagcttgtctgagcttcccatct

SEQ ID NO: 551807 - DNA, 76 bp, Homo sapiens
caggtgcctcctccacatggctgaggtgtggccaggcggtcctcccacaccctggcctgtggagccaggctccctg

SEQ ID NO: 551808 - DNA, 76 bp, Homo sapiens
gtaactgctgtcatgtaatgtatcatagcatgtgccaggcactgtgctatgcatgtcatatgtgagctcaagttat

SEQ ID NO: 551809 - DNA, 76 bp, Homo sapiens
gttgcttttttagctgtagttattatattcctgatctgataaaggagttgcagctgcagctatgaagagatgggac

SEQ ID NO: 551810 - DNA, 76 bp, Homo sapiens
tcacatgcttgataaaatgatgaaatcactgaccagcaggatccgtcagtggagtcagcattttatcacaatgtga

SEQ ID NO: 551811 - DNA, 76 bp, Homo sapiens
cccgtcctgacccagtcttggccgtaccacccagcaccagttgccgccccatggacaggactggggccaggactgg

SEQ ID NO: 551812 - DNA, 76 bp, Homo sapiens
tttgagatgcaaggaagctctctctgccacagaaattggatgaccatgtgggttgacagctcccttgtgttataaa

SEQ ID NO: 551813 - DNA, 76 bp, Homo sapiens
taccgtccagttactctgggactcgttgagatcctgcaacaggagacagggagcctgagtaactggaatgtaggtg

SEQ ID NO: 551814 - DNA, 76 bp, Homo sapiens
tcctgccactgcctcatctctttccactccaaaggttggggtctatgaaggaaaatgggagggaatggtggtggga

SEQ ID NO: 551815 - DNA, 76 bp, Homo sapiens
gaattgatgaccagctggggttaatggcccttggctgcactgtgggctatcaactcccccagctggtcattaatcc

SEQ ID NO: 551816 - DNA, 76 bp, Homo sapiens
gagaaaaaaaaaatacaagctgccatattcctgtgatcacaccaaaatagcagcttgtatttatattttcagtctc

SEQ ID NO: 551817 - DNA, 76 bp, Homo sapiens
gcccagcatgggtgtggctgcccattggtcctctgaagagcctcaggggcttgtggcagcaggtgtatgtctgggc

SEQ ID NO: 551818 - DNA, 76 bp, Homo sapiens
aaggcccaggagcagctgacctcagtagtttctaccctgagcctggaagagaatggtcaggcctgacctgggctgt

SEQ ID NO: 551819 - DNA, 76 bp, Homo sapiens
cctgttggccactggtcctgttatctttccacgtcccctacttcattttgagtaggtaagtgccagtggcagcagg

SEQ ID NO: 551820 - DNA, 76 bp, Homo sapiens
gtctgctggggccctgaggccttccccctaccctgctgcaattggaagcctggatggagggcctggccccagcgac

SEQ ID NO: 551821 - DNA, 76 bp, Homo sapiens
tcccctctttatccagccttcaagttcagtcatatatttttttatttgaaatgaactaaagctgatttagagcgga

SEQ ID NO: 551822 - DNA, 76 bp, Homo sapiens
ccatcctccagcagtgggatatggtgtatggcaggttcctcctctgctacagcctgtgtcctgctctgtcacttgg

SEQ ID NO: 551823 - DNA, 76 bp, Homo sapiens
ctcagactgtactcttctagccatctgaaatacgttttctaggtagagatagattgtgtaagggtacagttgtgag

SEQ ID NO: 551824 - DNA, 76 bp, Homo sapiens
gccagccctgagcccccgcgcccgggcagcgctgccatgcaaccagaggcgaggccggcgtgggggtgggggcggc

SEQ ID NO: 551825 - DNA, 76 bp, Homo sapiens
gagtggggaagggacaagaccaatgggaaaggcaagccagatggggaattttccagtcctgttccttctaccactc

SEQ ID NO: 551826 - DNA, 76 bp, Homo sapiens
ggtcaggcccctgggcgctcagcagttctgtcggcaagtgagcacaagaggagctgggcagcctgagggtctggcc

SEQ ID NO: 551827 - DNA, 76 bp, Homo sapiens
gtgggatgggaggacagagggaggaagtaaggaaaggatccaggcgtccacttccccttctttctgccccacccac

SEQ ID NO: 551828 - DNA, 76 bp, Homo sapiens
acatttattaatatgcaaattctaagtggcaatctggacccagtcgggttgtgctaatttgcacattaatatctgt

SEQ ID NO: 551829 - DNA, 76 bp, Homo sapiens
ctgtaccacagttatggaggctgactgagggtctccttgcttcttccttccaaaccgcctctccactgtggtacag

SEQ ID NO: 551830 - DNA, 76 bp, Homo sapiens
tgccagagttgggatgcgtgggaggacacagctcattgtggcaaacctcagctccctggcatgtctgactctggca

SEQ ID NO: 551831 - DNA, 76 bp, Homo sapiens
cagggagcctggctccacaggccagggtgtgggaggaccgcctggccacacctcagccatgtggaggaggcacctg

SEQ ID NO: 551832 - DNA, 76 bp, Homo sapiens
ggatgaaatttgcctccaaaagaggacagtgatcttttcacaaacactgtcctttgtcctgaggcacacaaaatcc

SEQ ID NO: 551833 - DNA, 76 bp, Homo sapiens
ctctttcgccttctgactgttctgtctgtagcaaaccatagagagtttttctggacagtccaggaaggtgtaagag

SEQ ID NO: 551834 - DNA, 76 bp, Homo sapiens
ttcacaatgttccacatatgcttagtttttgtccactcaccagggacagaaacagaatatggtgtgacatcatgaa

SEQ ID NO: 551835 - DNA, 76 bp, Homo sapiens
atccagcttcttcatagtgccacttccttcagtagaagtactagaagaaagagaagtggacgatgaggaaatggat

SEQ ID NO: 551836 - DNA, 76 bp, Homo sapiens
gcctgcctcttctgtgttctgcgtttaatgcatattaactgtatctgcattacaccagcagcgagaggagacaggc

SEQ ID NO: 551837 - DNA, 76 bp, Homo sapiens
catcaggctatgatcctcagttgtgtgtaaaattagggctttcaatctacacacaactgagcatcacagcctgatg

SEQ ID NO: 551838 - DNA, 76 bp, Homo sapiens
gcccagccaccaggctgcaggtggaggctcagggttgatggatctcaagctgctctgcctgcctggctgcctgggt

SEQ ID NO: 551839 - DNA, 76 bp, Homo sapiens
cacttcctttcctcctaccggttttataagctcagctccctgcttggccaccctcacactaaggaggggagaagtg

SEQ ID NO: 551840 - DNA, 76 bp, Homo sapiens
tatgaacataaattatttacagtgtgctcgaagagctcagaagggctttgtaaggtaaataatttataaactcata

SEQ ID NO: 551841 - DNA, 76 bp, Homo sapiens
cagtccctgggtactataatttgcattgcaatatgaggcttccatttaatgcttgcaaattatgggaccagggctg

SEQ ID NO: 551842 - DNA, 76 bp, Homo sapiens
cctgggcacccagtccccgggcagcaggcgggtgttccccaacctggctgctgcccggctgggctcggggctgagg

SEQ ID NO: 551843 - DNA, 76 bp, Homo sapiens
gcgcggcggctggttagggggcgggaagggcggcggcacccgcagccccgtcgcccccgcagtcacgccgcctcgc

SEQ ID NO: 551844 - DNA, 76 bp, Homo sapiens
tggcagctgtagtttgctggtgctctaaacaagtgtttaatctgtcaactgggtacattagcactgatggttgcca

SEQ ID NO: 551845 - DNA, 76 bp, Homo sapiens
ccgcccgcgccctcccccactccctccagccgaagcccccccctcgcgttgcccggatgtgggaggccgcgggcgg

SEQ ID NO: 551846 - DNA, 76 bp, Homo sapiens
tgtcgtattctgtaagttacaagagagttgctttcatgcatgtgaaatgcaattctcttcttgcaaaaacttgaca

SEQ ID NO: 551847 - DNA, 76 bp, Homo sapiens
ggccagggatttatgggaaactggcaattatgacatatgtccagctattgctagcctcagatttatccctgtggtc

SEQ ID NO: 551848 - DNA, 76 bp, Homo sapiens
ggtgatcagtcacatttcgacataactagatgtcaaaagaagtttaagttgtatgacgaactgtgatgcagtcact

SEQ ID NO: 551849 - DNA, 76 bp, Homo sapiens
gctacctatatatacacctgctatgtgtgtggatatgtatttacacatacacatatcaggtgtatacatacgtagc

SEQ ID NO: 551850 - DNA, 76 bp, Homo sapiens
gcctggaggcagcagaacggaaaaggctgggctgcctctgagcctgcgctttccctcttctgccacctgtccaggc

SEQ ID NO: 551851 - DNA, 76 bp, Homo sapiens
cgttttaaaggaagctggagtaaattctgtaaagtggagacgtttttggcaggatatgcaccagctgcttagaacg

SEQ ID NO: 551852 - DNA, 76 bp, Homo sapiens
gacctgatgtccctgagtgtatgtggtgaacctgaatttgccttgggtttcctcatattcattcaggagtgtcagt

SEQ ID NO: 551853 - DNA, 76 bp, Homo sapiens
gctgggttctggagtcagaatgtctggtttagaatcttagctaagtgggacttccgttttgtctccaggtctcagc

SEQ ID NO: 551854 - DNA, 76 bp, Homo sapiens
attttgagactctatattctgtctgtattctaaggtgactatgagatatagtaggattatatagtagtctcagaat

SEQ ID NO: 551855 - DNA, 76 bp, Homo sapiens
agatgattaccatggagtttggagtgagagggttcaagtcccagctctctcacttctgagctctggttactcatct

SEQ ID NO: 551856 - DNA, 76 bp, Homo sapiens
tatggattataaactgtgggcatttatttacactttcactataggataagtgagatctcacaaattgtattctatg

SEQ ID NO: 551857 - DNA, 76 bp, Homo sapiens
ggtgatttccaaatctatatgtccggtccaaatatgcaaaatgctctggtctgggcatacagatttgggaatcacc

SEQ ID NO: 551858 - DNA, 76 bp, Homo sapiens
gatttccctgcactcgcttccttgggctgtctacctggggatggtgcagtccaagtggctcagtgtctggggaatt

SEQ ID NO: 551859 - DNA, 76 bp, Homo sapiens
ttttgcaggtaagcctatctatccaaatatgatcatctgctttatcatatttagatagataggcttaactacaaaa

SEQ ID NO: 551860 - DNA, 76 bp, Homo sapiens
tgcatccatgcctgttagctgcactgtctttggcccttgtaatagacagggtgtatgctcagcaggcaggtatgta

SEQ ID NO: 551861 - DNA, 76 bp, Homo sapiens
gcagctggacctttgagcctctgctctctccccggtttgtgttggggagagggttggaggatgtaggagtggctgc

SEQ ID NO: 551862 - DNA, 76 bp, Homo sapiens
gggtggaggaggggcagccagccactgtgagccctgaagacatgtggggctgagggcggtgcctctcttctcaccc

SEQ ID NO: 551863 - DNA, 76 bp, Homo sapiens
gaaaacacctacgtcctcttccacagctctgcagagcacagctcgtcagctgtggtggagttgatgaggataagac

SEQ ID NO: 551864 - DNA, 76 bp, Homo sapiens
agtagtctgttatcgcatggtaagctttcattctacatagattaagtaatggagcttggatgtgaagcaggctatt

SEQ ID NO: 551865 - DNA, 76 bp, Homo sapiens
aagggaagggtaatctgggatatttattaggtgtagttacctttgcctaatgaatgtcttttgttactcattcctt

SEQ ID NO: 551866 - DNA, 76 bp, Homo sapiens
atgtgaagtgtcatatgtactatggctgacatgtacgtttcgtgttatgtagtcatgtgtattatgaatttcacgt

SEQ ID NO: 551867 - DNA, 76 bp, Homo sapiens
tgtttcctaaacttgtctgatcgtagaactcacagtatttcaggtgattttgatgatcaagcacgtatggggagca

SEQ ID NO: 551868 - DNA, 76 bp, Homo sapiens
cctggttttgtgtgtgggtagggggcaacattgggtgaagttttgatagttgccccctatagattttaagacctgg

SEQ ID NO: 551869 - DNA, 76 bp, Homo sapiens
gcaacacctccattgtttttaatcgactccaggaccaagcccctgacgtagatgctgaaacatggaggcatgttgt

SEQ ID NO: 551870 - DNA, 76 bp, Homo sapiens
aaggcttccagctacttctaaacctaaacagttatgagtatgttgctggctagacctagaattagtcagaagcttt

SEQ ID NO: 551871 - DNA, 76 bp, Homo sapiens
cagatggaaactggtttctgagatggaacttggcagtggtacctatgttccctctcagaaatccaggttttatctg

SEQ ID NO: 551872 - DNA, 76 bp, Homo sapiens
ccttataccaggggaagaaactgacaataagacagtcaaaacctgtcctgtgctgtcggtatctccttggcagggg

SEQ ID NO: 551873 - DNA, 76 bp, Homo sapiens
ctggcttgttggggatcatggttatattcctactagataataaaaggaaaaatgaccctgagcccttttaacacag

SEQ ID NO: 551874 - DNA, 76 bp, Homo sapiens
acactctattcaactacctctatagccctgctatcccttagggaagcagcaggagccgaggggctggtctgagtgt

SEQ ID NO: 551875 - DNA, 76 bp, Homo sapiens
ccctgaagttgtcaagttttgctaccaatttgacacttaaatgggctatagcaaaacttgatttaaactgaagagg

SEQ ID NO: 551876 - DNA, 76 bp, Homo sapiens
tgttttgagctgtgctattccaaggccgggggaatgcttaaagaaaccctgatcttggaatggcacagctgagaca

SEQ ID NO: 551877 - DNA, 76 bp, Homo sapiens
tctcccaacatatacaaagagagaatgcatttggacgtgttgctggtgcagtctcttttgtgtagcataggggaga

SEQ ID NO: 551878 - DNA, 76 bp, Homo sapiens
tctagaaaggagctggaggcctggtgctgttggcgcttctgctgcccagctgtcacctcttctggtttctcatgga

SEQ ID NO: 551879 - DNA, 76 bp, Homo sapiens
cctgtttgctcctctgggccccctgagggacttctgggctttggtcctgccctgtgggtaaggaggatcagacagg

SEQ ID NO: 551880 - DNA, 76 bp, Homo sapiens
ccctggcaaataccatctgagatgaaacccacagcagcataatgttggtttgttgtttcagatgtatttgataggg

SEQ ID NO: 551881 - DNA, 76 bp, Homo sapiens
tgaggagaaggcttggagtgttccaggacagtgagtggtggagtcttgctgggagtgttctgagcctttctcttta

SEQ ID NO: 551882 - DNA, 76 bp, Homo sapiens
gggaggggagggaggaggttggggtgaaggaaaccaacctactgcacctccatccccaaccctgccttccccgccc

SEQ ID NO: 551883 - DNA, 76 bp, Homo sapiens
ggtcccttcgtaatgaagcggcttcttaattatcaaaaaaggtaaggttgtttagccagcttcattaacaggcccc

SEQ ID NO: 551884 - DNA, 76 bp, Homo sapiens
tagtcaagctccaactgagctttgctttgctctatgttttcccaaagcaaagcaaggctcagtttgaacttggcta

SEQ ID NO: 551885 - DNA, 76 bp, Homo sapiens
ttggttcagctggtatgctttccagtatctcattctttatttatatgagactgggaggtgtgacctatggagccag

SEQ ID NO: 551886 - DNA, 76 bp, Homo sapiens
gagggggcatgtggactcgagtatcaggcccgcccaagcctggagtcccgcctgaaacacggatcccagcctcctc

SEQ ID NO: 551887 - DNA, 76 bp, Homo sapiens
cctgtgcttgtgtctgtgtttcagcccctatgtagtagaaaaaaaagcataggctttaacatcagacaggtatagg

SEQ ID NO: 551888 - DNA, 76 bp, Homo sapiens
gcctagttctctctgttccatttttcttgcctgtacctcactaagcaagaacagagttgaatagaaggaagagggc

SEQ ID NO: 551889 - DNA, 76 bp, Homo sapiens
gttcctgcctctcctctgcccttcctaatcatcttccacctggacaaatgcaggaggggtgaaccaaggcaggtac

SEQ ID NO: 551890 - DNA, 76 bp, Homo sapiens
gggggaaaggggtgggttgggaggggttgtagggctggagacccacttcccctcctccccgttcccctggtcccct

SEQ ID NO: 551891 - DNA, 76 bp, Homo sapiens
gtctgcagctatgcatgaggagaggactgagcctgaaacacaagacggttttcatcttcgtgccagagctgtggac

SEQ ID NO: 551892 - DNA, 76 bp, Homo sapiens
taattaattgggcttgtggtcacctcacacctctcatttgaggccgtataggtaacccacagacattaattaatta

SEQ ID NO: 551893 - DNA, 76 bp, Homo sapiens
gctggaccagttggaaagggggtttgggactctggcctctttccggccctcaccccagctttccaatttcctttgc

SEQ ID NO: 551894 - DNA, 76 bp, Homo sapiens
tcaccttgaagtgtctcttgtaaaagataactccctgcattgtagaaatgtctttgacaagagaggattagggtga

SEQ ID NO: 551895 - DNA, 76 bp, Homo sapiens
ggaggacggaagaggaacttaggagctaaatgctgtccctctctattttgctccagaatgttcttttcctttctct

SEQ ID NO: 551896 - DNA, 76 bp, Homo sapiens
gtcctgtctctgagtaacacctttacatgccgattctcataaaaatgttcactatttactcagacattggcagggc

SEQ ID NO: 551897 - DNA, 76 bp, Homo sapiens
ggttcatgcgatggttggagggatggtaaaagcagttagctcttgtcagctgcttccctctgctagtgcttgagct

SEQ ID NO: 551898 - DNA, 76 bp, Homo sapiens
gggcaagggttttgtctgtattgtttgctgctgtatctccaggtctaaaacagtgccaggcagatgccaggtgccc

SEQ ID NO: 551899 - DNA, 75 bp, Homo sapiens
gccgtgggagcaggagaccagggaggagcagcgttttccacggcaccctcttcccgaggtcccagctgacacagc

SEQ ID NO: 551900 - DNA, 75 bp, Homo sapiens
gggggctggtctcaaggacaggaccttacctactctgaaattctggagctccttttcttggggcctaaagctcct

SEQ ID NO: 551901 - DNA, 75 bp, Homo sapiens
ctccttcttaccagcgcgttttcagtttcatagggaagcctttccatgaaactggagcgcctggaggagaagggg

SEQ ID NO: 551902 - DNA, 75 bp, Homo sapiens
gtcataatcttgtttgtgatatcgcaatcatcaccacagcaaccaattgtgattcaacaaattgaggattatgac

SEQ ID NO: 551903 - DNA, 75 bp, Homo sapiens
atcatgctatggacataactggggcgctggatgtttattctttctctccagtgagccccagtatgtcttaatgat

SEQ ID NO: 551904 - DNA, 75 bp, Homo sapiens
accttgctgtctgaatgctgttgcttgccattggactattctggaacaggaagtatagcattctaacagcatggt

SEQ ID NO: 551905 - DNA, 75 bp, Homo sapiens
cccatccacaaggcacatgtgtcctgatcttttattgctttcttctggtcccagatactgtgtcttaactgtggg

SEQ ID NO: 551906 - DNA, 75 bp, Homo sapiens
cttaagtctcatggcttctgtcttggaaactttacctttaaaagattatttaagacaggaaccaggaggtttggg

SEQ ID NO: 551907 - DNA, 75 bp, Homo sapiens
ggccccgcggtgcattgctgttgcattgcacgtgtgtgaggcgggtgcagtgcctcggcagtgcagcccggagcc

SEQ ID NO: 551908 - DNA, 75 bp, Homo sapiens
attagtggtcctcatagaattgatagctttttgaaccgtgacaatgagattatcgattcctgaaagggccctaat

SEQ ID NO: 551909 - DNA, 75 bp, Homo sapiens
tatggtgcatggtataatagcctaatacacagaatgtacactatgtgtacctaggttattgtattctgtaccata

SEQ ID NO: 551910 - DNA, 75 bp, Homo sapiens
cctaacttgaaagaggtgctaaattggatataggggcaaaaataaccacgctcctaggcactctttcatcttggg

SEQ ID NO: 551911 - DNA, 75 bp, Homo sapiens
tccctggtgagaagattttaatctgaggtgcagttcctaagaactgacaatttggggtaaattttcaacatggga

SEQ ID NO: 551912 - DNA, 75 bp, Homo sapiens
tggcccacatgggtctgtctcaggccagtcttccggctttggtcacaagtctggctcagggcagtcctctggtta

SEQ ID NO: 551913 - DNA, 75 bp, Homo sapiens
gcccacccagcactgcttgctgtcactggctctatttccatcactcgggacagatggcaggaagcagtggtgggc

SEQ ID NO: 551914 - DNA, 75 bp, Homo sapiens
gtcctctgcacagctattgttcccaacacaggaggtgagaacttccttatcatcagcagcctttgtgtggagggc

SEQ ID NO: 551915 - DNA, 75 bp, Homo sapiens
gagcacctcctatattccgggcacttatgcatgtcatctcattgtattcacattaagcctgggagagaggtgttt

SEQ ID NO: 551916 - DNA, 75 bp, Homo sapiens
tcagttttatagtttcccaactaattattctgcttttatgtaatagaataattagttttgaaactataaatttga

SEQ ID NO: 551917 - DNA, 75 bp, Homo sapiens
gggaccttcgcggcgcaaggcggggtcgcggccggcccgggggctgtgcggccaacggctgctcgcaggggttct

SEQ ID NO: 551918 - DNA, 75 bp, Homo sapiens
tcaaaatgaacattcattccaaggttaggtacagacatataaatgtctgcctggtttgggaatggttccatttga

SEQ ID NO: 551919 - DNA, 75 bp, Homo sapiens
gaccactctatgcctcagtttcctcatttgtaaaatgggtagacaaggatgtggaggggactgaatggggtggtc

SEQ ID NO: 551920 - DNA, 75 bp, Homo sapiens
gtccctgcgtgcgcacacgggcctgcatttgtaccctgcgtggctgggtatatgcatgtgtgagtgcgctggggc

SEQ ID NO: 551921 - DNA, 75 bp, Homo sapiens
gttgtggcgggtggaggggtgtggggctgtgggcagtgtggcccatcctcccacccctgtgccctgcagcccaac

SEQ ID NO: 551922 - DNA, 75 bp, Homo sapiens
gggaagtgctgttgtgctgtactctacatggttatataaattatgcagtttaaggcacaattagcatgcattctc

SEQ ID NO: 551923 - DNA, 75 bp, Homo sapiens
gtattgaaaacaccctctaagagaggagaatatgccctcacgttatcttctcttagagggtgtagagttctttgc

SEQ ID NO: 551924 - DNA, 75 bp, Homo sapiens
aatggctgtatctctggtcttacgtaaattctctgcggtccatgtgtttacataagacaagggaatatagctatt

SEQ ID NO: 551925 - DNA, 75 bp, Homo sapiens
tcaggggaaaaggtctcaaaggattcacaccaactattaaatatagtgtgaatcttctgaaaccttttcctttgg

SEQ ID NO: 551926 - DNA, 75 bp, Homo sapiens
ctcctaaagggttaaagtgtatgggctttattttccaaactgtcgcaaagcacctgcattttactcttgtaggag

SEQ ID NO: 551927 - DNA, 75 bp, Homo sapiens
gcacatccttgtcttctggtaaatgcccaaatgttgccctctttttctggcaattggcagcaagtcaggatgtgt

SEQ ID NO: 551928 - DNA, 75 bp, Homo sapiens
ttgattgactgtagaggcctggattgaggaggcctgtgcttctgggcccctggctaggcttccacagttgctcaa

SEQ ID NO: 551929 - DNA, 75 bp, Homo sapiens
gggagtgaactggttgtgttagaagctgctctacttaaaaccatgtgggggcttctggtacattcattctttccc

SEQ ID NO: 551930 - DNA, 75 bp, Homo sapiens
gccctcgtgggagggggctgcgctgcagctcctcctttttgggagtactgtgctcaggctccacccactatgggc

SEQ ID NO: 551931 - DNA, 75 bp, Homo sapiens
gtgatcacagctgctttgcagtagagtaatagccaaattagcaattttttctctgctacaaaggagcagcatcac

SEQ ID NO: 551932 - DNA, 75 bp, Homo sapiens
tcttggatgtttgggccctgaaagcacgcatgatcagccctgttcctgtgtcctttcagggcctaacatcccaga

SEQ ID NO: 551933 - DNA, 75 bp, Homo sapiens
cctctgcgctgcccctcactctgccctccctcatctgcactggcagtggtgggcacagtgggctggaggcagagg

SEQ ID NO: 551934 - DNA, 75 bp, Homo sapiens
gcttcttgaagcttctcccgcgtgtcggcagccaccctcctcttccgtgtgacctgcagagaagcttcagggggc

SEQ ID NO: 551935 - DNA, 75 bp, Homo sapiens
aatcaagtaaatctgagcagaagtaaggtttgttttgcaggaataaaccactacttctgatagtgtttcttgatt

SEQ ID NO: 551936 - DNA, 75 bp, Homo sapiens
ctcagatgatgtcttcagggaatttttggtgggagggacccattttcattcaacttctttgaagacccatttgag

SEQ ID NO: 551937 - DNA, 75 bp, Homo sapiens
gccccaggcacagtggcccggtggcctcactcagagtgcagactggagggcagggcggggtcctgtgcttggggc

SEQ ID NO: 551938 - DNA, 75 bp, Homo sapiens
gatgtcagcctctgtgaattgaagagcccaagtccaaaagggaatgaagctgtctttatgcacagggggagattc

SEQ ID NO: 551939 - DNA, 75 bp, Homo sapiens
ccacatacccaaggtcaaatgggctggtcaattggacttccctcctcccagctcatcttggctcttggttagtgg

SEQ ID NO: 551940 - DNA, 75 bp, Homo sapiens
tggcccggggcctgggagggagggcgcccctccgcgctcggcagggggctctctctccccacgatcccggggccg

SEQ ID NO: 551941 - DNA, 75 bp, Homo sapiens
ggcttcctgtttccagggtgacgtagatttttttccttcgccagtctcaccgttacccggggcaacagctgagcc

SEQ ID NO: 551942 - DNA, 75 bp, Homo sapiens
gggcttctttgatgaaagggttcttggtaagtactgtaccaaaagcagcctgccaccctcctttcaaagataccc

SEQ ID NO: 551943 - DNA, 75 bp, Homo sapiens
ctgactcaagtaagaaacagaattggaatttgaggtaggatatcccagccccacattttgtattttttgagtcgg

SEQ ID NO: 551944 - DNA, 75 bp, Homo sapiens
aaattgggaggcagaagattttgtttcaagtctcgattttgccacctactagatgggatctctgcccctcagttt

SEQ ID NO: 551945 - DNA, 75 bp, Homo sapiens
tgctacttctaagtattcagatagttgtgagtcaaactgagtcagtaatgctgtctggatatcttggaattagta

SEQ ID NO: 551946 - DNA, 75 bp, Homo sapiens
gagatggacccgggggtggagagtggaggggcagccatcagagccacctctgagtccacctgatgggcccatgtc

SEQ ID NO: 551947 - DNA, 75 bp, Homo sapiens
gagagccagggaggagtgagttgtccatgctaggtccagatgctcatgtggaccgcagctctctccttccttctc

SEQ ID NO: 551948 - DNA, 75 bp, Homo sapiens
gccttctttgctgggcaccaccttgtgtgctgggatggagagtagaaccagcacgggtggtctggcagggagggc

SEQ ID NO: 551949 - DNA, 75 bp, Homo sapiens
gttgctatttccctcagttgagggcgaagttagcaaatccgtagctgcaagtctcaacttgggggagggggcgac

SEQ ID NO: 551950 - DNA, 75 bp, Homo sapiens
tatgtgcccacttatatgctgcatataattctgcttacctggaaccatttaagtatgcatgtacttgggtatata

SEQ ID NO: 551951 - DNA, 75 bp, Homo sapiens
gggcacagctttctgtgtcagtctctctggtggagatctaaacttcatcagggctgtgcacagaaggtgatgcct

SEQ ID NO: 551952 - DNA, 75 bp, Homo sapiens
cgccgcttggtttctcattcctctggtcatttttgtatcagttgaggtgggcaggggtgggggatcacgacggcg

SEQ ID NO: 551953 - DNA, 75 bp, Homo sapiens
attgttaaggtttcaaggctgttggtttgcagaggatcctgatggagaccagtggccttaagaaataggagcaat

SEQ ID NO: 551954 - DNA, 75 bp, Homo sapiens
ttgtttagtcagagagcacagcatatcggggctactagcccttgccccagtgtgctgggctgtctgactaaacaa

SEQ ID NO: 551955 - DNA, 75 bp, Homo sapiens
gcagcccctgagaaccacgtctgctctgagctgggtactgcctgttcagaacaaatgccggttcccagacgctgc

SEQ ID NO: 551956 - DNA, 75 bp, Homo sapiens
cagttctttaatgtctacatcagcagagagtaactgatgccctctcattcttgctgtgtggatgtgaagaatctg

SEQ ID NO: 551957 - DNA, 75 bp, Homo sapiens
tgtgcagttgtgaaggatttaggctccactgctcatgcatttgggtggggcctgaatcactttcagtctagcaca

SEQ ID NO: 551958 - DNA, 75 bp, Homo sapiens
tgactcctgttatgttcacttcagggttgtaccctatctagagccagccctgaccacagacaaagcaggcagcca

SEQ ID NO: 551959 - DNA, 75 bp, Homo sapiens
acacttgtttagataataggaacatctgaatctgggccactaaaaccaactcagttccacggtctaaataggtgt

SEQ ID NO: 551960 - DNA, 75 bp, Homo sapiens
aagctcaaccttttgccaagaaaatctccttacctccagagaaaacaataatttccttgacaaaaggttggcatt

SEQ ID NO: 551961 - DNA, 75 bp, Homo sapiens
cttccctcagttcctcaggctcagatttttctcctcaggagcatcagatctgggagccctggagggctggggaag

SEQ ID NO: 551962 - DNA, 75 bp, Homo sapiens
gatattctctgtgtgctaactcagtctttactagatccccagagggtgaagaaggaattggggcacagagaaatc

SEQ ID NO: 551963 - DNA, 75 bp, Homo sapiens
taattatcctcaatcataatgttacatgatagaatagtgctacagttcatttaacattatgattggggataatta

SEQ ID NO: 551964 - DNA, 75 bp, Homo sapiens
gtctttctctctttcccacccatctttgttcatcatgcagtagagaaacattgatggtagggaaggagtgaagac

SEQ ID NO: 551965 - DNA, 75 bp, Homo sapiens
ctgagcccacttggacagaggtctctctctgtacctccttacagattccatccctggtccaggcctggagctcag

SEQ ID NO: 551966 - DNA, 75 bp, Homo sapiens
tctcaagacaggtccctggaggtattgtcagatttatctcaaaataaacattgcttccagggatcctgcgtggga

SEQ ID NO: 551967 - DNA, 75 bp, Homo sapiens
gtgcgggctctgggctccccagccccctccctgggcccaatccaggccatctgctgggggactcagagcctccgc

SEQ ID NO: 551968 - DNA, 75 bp, Homo sapiens
ccagaagagactgtccttcctggaggtgtgcaggatgaatctctcatgccttctgggaagagaggcctctgctgg

SEQ ID NO: 551969 - DNA, 75 bp, Homo sapiens
tgctagaggataaatagagccctcacatcctttatattcatctataggacatgagggctctattttcagctgtca

SEQ ID NO: 551970 - DNA, 75 bp, Homo sapiens
gtgagctgcattttgctaacagcctgtctcactttacaatcttaggactagggagttagggaaagtgcagctcat

SEQ ID NO: 551971 - DNA, 75 bp, Homo sapiens
tcagacatctcggggatcatcatgtcacgagataccagtgtgcacttgtgacagattgataactgaaaggtctgg

SEQ ID NO: 551972 - DNA, 75 bp, Homo sapiens
ggagagggaggcagggcagaagtggcgggggtgggggacagtcctttcaaacactgcagctctgtttttctctct

SEQ ID NO: 551973 - DNA, 75 bp, Homo sapiens
gggtgataaatcacagaaggttgcattaatcaaggcagcctaaagctgataagtgcaattatggatttgtcaccc

SEQ ID NO: 551974 - DNA, 75 bp, Homo sapiens
ctgtggggatgagaatggggcagtaagggaaaggtgacttttctgcttcgtgccctcccactctggttcctagag

SEQ ID NO: 551975 - DNA, 75 bp, Homo sapiens
gggcctgccctcgttgccctcagcaatgtgaatggatccagtacttggagctgaggggcaaggatgggcatgccc

SEQ ID NO: 551976 - DNA, 75 bp, Homo sapiens
tgctccagtaaggtctccaggactgcccaggccacatgaaggaggccagaggggctatggagcaccactggggta

SEQ ID NO: 551977 - DNA, 75 bp, Homo sapiens
tctggcagctctcacatatgatctgcagccaggacccctcttctgactccagatcatttggtggggactccatga

SEQ ID NO: 551978 - DNA, 75 bp, Homo sapiens
gagaaactggcagtcgcatggcagccagctggctcacccaatagctgggtggtaaccttgtgatccccaaacatc

SEQ ID NO: 551979 - DNA, 75 bp, Homo sapiens
actctgagtctgtgtctgttggtcttacttgcaccctgcaaggaaggcagggagaccaaccttgcagataagggt

SEQ ID NO: 551980 - DNA, 75 bp, Homo sapiens
ggattttggaggagccagcggctggctatcgagaagggaagggagctagcacttgctgagtttcttcaaggggcc

SEQ ID NO: 551981 - DNA, 75 bp, Homo sapiens
ctgcagcccagtggtgaggtgggttggcatgaaaccctcaatgtaaaagaggcaccctctctccgtgggatgcag

SEQ ID NO: 551982 - DNA, 75 bp, Homo sapiens
ggtagagggactggaggaggcatggagggtctgaaaacagaggggcccccatggcctttcccgcattccaatacc

SEQ ID NO: 551983 - DNA, 75 bp, Homo sapiens
cattagaaatatgcctataggaatcaaagagagaaccgtacagttttctagatgcttataggcatattagtaatg

SEQ ID NO: 551984 - DNA, 75 bp, Homo sapiens
agccaggctggggtggcacagtcgggacgtaacacagctgggtggaagcccctggtgtccaccaaagcctgtgct

SEQ ID NO: 551985 - DNA, 75 bp, Homo sapiens
ttcatactcatgggttctgcaaaatgcagattcaaataatgtaaatctgcattttgtagaacccatgggtatgaa

SEQ ID NO: 551986 - DNA, 75 bp, Homo sapiens
tttggagagatgagtgatgggtctttctgagtcacagggggagggccatgaaagattcatacacatctgtccaaa

SEQ ID NO: 551987 - DNA, 75 bp, Homo sapiens
gagaatcgtcttattatttcagcaggaggggtgtgggtaaaatatctgcctgctgaaagatgggatggatttctc

SEQ ID NO: 551988 - DNA, 75 bp, Homo sapiens
ccccgtggcttcgagcctttgccctgatgtgatattgatggctggggtgggaggcaggggctggagggcccgggg

SEQ ID NO: 551989 - DNA, 75 bp, Homo sapiens
agctcccccagtgccttctgctcctggatcctacccttttatccaacatccctgcaaaaggcactggggtgggct

SEQ ID NO: 551990 - DNA, 75 bp, Homo sapiens
ttcatgagtcaatttttctgtggcttatgtaggtatgacacaacctcaggccatcccagataattgactgatggg

SEQ ID NO: 551991 - DNA, 75 bp, Homo sapiens
ccctgccttctccattcacacacagtacccttccctggaagctacaagaaaggggggtgaaggagggggcggtgg

SEQ ID NO: 551992 - DNA, 75 bp, Homo sapiens
tatacaaagcagaagtatttttttctaacaaaagctgtcaaaggtaaagcttgagaaatacttttgtttagtatg

SEQ ID NO: 551993 - DNA, 75 bp, Homo sapiens
aaaagattcttccagggcctgaatgtcccctaccccataggaaggtctacatttcattcctgggcagggtctttt

SEQ ID NO: 551994 - DNA, 75 bp, Homo sapiens
gggcagggagtgcgggtcggttctgcgtgcgctgccggacgaggctcccgccgccgattgacccgcgctccgccc

SEQ ID NO: 551995 - DNA, 75 bp, Homo sapiens
tgtctgaattacattttattgagaaatgtctttttgaaatagagacattgtcagtaaaagttgtaatttaagacg

SEQ ID NO: 551996 - DNA, 75 bp, Homo sapiens
tttagttggagagacaggtggatattttgagctctgttaagcagtaaagtttttatgtgtctctctggaaatgaa

SEQ ID NO: 551997 - DNA, 75 bp, Homo sapiens
gcagactgcgcatgcggggcgcggacgctcggaaggggaaccagccgggaccccgcgcgcgcgcgcgcactctgt

SEQ ID NO: 551998 - DNA, 75 bp, Homo sapiens
gtgtggtcccagttcagaagtgttcctgagtaacttgtgcttataactcaggacacttctgaacttggaccatac

SEQ ID NO: 551999 - DNA, 75 bp, Homo sapiens
cctgggtctcgggttcactcctttcctgctcctcacaggtgtaagaatacaggaagggggtgcctgagtgccagg

SEQ ID NO: 552000 - DNA, 75 bp, Homo sapiens
tagttgtgagggtacagggggaaggtagcttttggaggggcctggaagacccttccctttgtgccttcgattctg

SEQ ID NO: 552001 - DNA, 75 bp, Homo sapiens
ccctcagagctgatatgagtgtggagattccattcacttcaaaggaagcttcacgcttggatcttctccacaggg

SEQ ID NO: 552002 - DNA, 75 bp, Homo sapiens
gcaggtcaggacagtaggctcacctgactggagaaagcagggcaaggtcagggagccacgtgatcctgacactgc

SEQ ID NO: 552003 - DNA, 75 bp, Homo sapiens
gttccaagctgtaaggcacagctgtataggccctgccagcaaggccatcgcagcagtgctttgatagcgtggggc

SEQ ID NO: 552004 - DNA, 75 bp, Homo sapiens
gcctcacactgggttttgatgttttgtcattcagcatgttgttgatacgaatgacaaaacattgaaatctaaggt

SEQ ID NO: 552005 - DNA, 75 bp, Homo sapiens
gcagaactatatagcagttttaggagatctgttggtgcccagcaagagctccaaacgggctatatgcagggatgc

SEQ ID NO: 552006 - DNA, 75 bp, Homo sapiens
ccaggcggcccaggagatggcctcgaccatggaggactgggacctgcacctccgccatcttcggcagccgcctgg

SEQ ID NO: 552007 - DNA, 75 bp, Homo sapiens
gaatgagggtctgggcactcctggggacagctgagtggtaggactcctgggtccccagggggcaggtccatcttc

SEQ ID NO: 552008 - DNA, 75 bp, Homo sapiens
ggtgaaggaggggaggggaggtggaagaaggaggaggttagctcagggttctaccttaccttctcctctatcatc

SEQ ID NO: 552009 - DNA, 75 bp, Homo sapiens
gggcaggggtggggtggggagatgtctcagtgcccccatagcccagtcctttctctccccccaccctccctgccc

SEQ ID NO: 552010 - DNA, 75 bp, Homo sapiens
ggcagtggaagctgtctgaggcttcagggccccctcctcactaggggctataattcatgcagtttcttatctgcc

SEQ ID NO: 552011 - DNA, 75 bp, Homo sapiens
ataattttttgcatcttgggcattgctaatcctacaagacgttcagaagagcagtgcccagagagcatctgttat

SEQ ID NO: 552012 - DNA, 75 bp, Homo sapiens
gccatgataaaggtgttggaacaatcgtgccaatatggccacaggaagcacgattgttctctccttgcgcattgc

SEQ ID NO: 552013 - DNA, 75 bp, Homo sapiens
tttagatcaataaaccattttaaaagctttcaaagctttaactcttggaagcttttaaaatgctgtgaatctgaa

SEQ ID NO: 552014 - DNA, 75 bp, Homo sapiens
tcttgtggtacatatttgatgcaataaatactgtgcttaggtcattatttgtttgctcaaacgtgcaccacaggg

SEQ ID NO: 552015 - DNA, 75 bp, Homo sapiens
ggggctgggcttcgtggggatcaagcttcgtggctttttatgaagaatcccgaaccctgcctaggagcccgcccc

SEQ ID NO: 552016 - DNA, 75 bp, Homo sapiens
cccgggcagacgtgaaggcagcggggctcggggacacccaagtcaaacgacccccggccctcgcgcctgcccggg

SEQ ID NO: 552017 - DNA, 75 bp, Homo sapiens
agataagtccaggtgatacattcagtggctgcaaatgcttagattagttactgaatgtattgcttggactcatct

SEQ ID NO: 552018 - DNA, 75 bp, Homo sapiens
gagttctcatactccacctgtatctaaaaagagtccctccaacttctttttagatagaggtggagtatgagactt

SEQ ID NO: 552019 - DNA, 75 bp, Homo sapiens
gcacagggttatatcgccagtaagtgtcagagctatgatttaaatccagataatcctggcgatataaccatgtgc

SEQ ID NO: 552020 - DNA, 75 bp, Homo sapiens
ccttcctcctagctcacacctacctagagatacctgaaaatgttttctctaggtatgtctgggcaggttcgaagg

SEQ ID NO: 552021 - DNA, 75 bp, Homo sapiens
agaacgcagattgccaggcccaccctcttaggtgtaatgattgagtggggatgaggcctgggggtttgcatttct

SEQ ID NO: 552022 - DNA, 75 bp, Homo sapiens
cttgcagtgtaattggggaaactgaggtccagagaggagaaaggacttacccagtttccccaattgcaatacaag

SEQ ID NO: 552023 - DNA, 75 bp, Homo sapiens
ttaaagatgggtctttctttctcttggtgtttctcactgtggtactcactaggagaaagaaagagctggctttaa

SEQ ID NO: 552024 - DNA, 75 bp, Homo sapiens
tagtactttagagccctaaagtattcagaaactgggattgaaatttgcttaatactttaaggctctaaagtactg

SEQ ID NO: 552025 - DNA, 75 bp, Homo sapiens
atctgtaatgcaaacaaccactgattaacctaagagtaatttgttgcgttagatgtggatgtttgcttcacagat

SEQ ID NO: 552026 - DNA, 75 bp, Homo sapiens
tgccatttgttttatctgttcttcagtctgttctgtcagtacccacaggcaggagagcagaaaggagaaatggca

SEQ ID NO: 552027 - DNA, 75 bp, Homo sapiens
aaggaaattatttgatgtaggctgagccacagctgaacagataagtggctcagctgtctgtcagagccttttctt

SEQ ID NO: 552028 - DNA, 75 bp, Homo sapiens
tcccacagtcgggaggaaaagaaagaagactctgttgttcattgtttttatctttttctccagatgcctgtggga

SEQ ID NO: 552029 - DNA, 75 bp, Homo sapiens
ctcactgtgatggccaggccaggggatacatcctggtggcccttctgtgtcactggcctttgccataaaagtggg

SEQ ID NO: 552030 - DNA, 75 bp, Homo sapiens
tttcagtagtgttggaaaaacagacaaatgtgggaaaaacacacatatttgtctgtttttctcatactactgaaa

SEQ ID NO: 552031 - DNA, 75 bp, Homo sapiens
ccaggcttgtggcctgttctgccttctgagtttctgtgcttttaggtaactagagggcaggaggccagagtctgg

SEQ ID NO: 552032 - DNA, 75 bp, Homo sapiens
ctcttctttgtcagtttacgccattccttggtgcgaaagtgacaagtagtgatggtgggaaactgacagaatgag

SEQ ID NO: 552033 - DNA, 75 bp, Homo sapiens
tggataatccactctgctgactttcaagattattatattattcaattctcaggaatgttgcagagtgattgtcca

SEQ ID NO: 552034 - DNA, 75 bp, Homo sapiens
gcctgtatcccgctgggggtcatcctatctctgaggtcaagtgtcgtgaagggtggcctcctgaagtgggaaggc

SEQ ID NO: 552035 - DNA, 75 bp, Homo sapiens
gaatgagggtctgggcactcctggggacagctgagtggtaggactcctgggtccccagggtgcaggtccatcttc

SEQ ID NO: 552036 - DNA, 75 bp, Homo sapiens
gcatggtcaatgtcagaagagaattggaatgaaggtgggggtccttacctataattccctctgacattgacttac

SEQ ID NO: 552037 - DNA, 75 bp, Homo sapiens
gatccctcttctctttccttctgggctccaaccattcctcctatgttgggtctggaggaaggagaggcagtggtc

SEQ ID NO: 552038 - DNA, 75 bp, Homo sapiens
ggatccagcttaatggcatgtttcccctggtgtctcatgaacattgcctaagaagcagccatggagcttggatct

SEQ ID NO: 552039 - DNA, 75 bp, Homo sapiens
cagtccaggccatcctgccagccctgggccacatcagcattatcaggtttgggttagtaggatgatcctggcctg

SEQ ID NO: 552040 - DNA, 75 bp, Homo sapiens
gcggatggacggttttaccagacagtattagacagagggccaggtctaaccatgtctggtaagacgcccatcggc

SEQ ID NO: 552041 - DNA, 75 bp, Homo sapiens
atatccctagtatatagggatataattttagcatccattatatagtagatattatgtccctaatatacaggatat

SEQ ID NO: 552042 - DNA, 75 bp, Homo sapiens
ccagtctgggagacgggagacaggatatttggagtaagctcaggatggcctgtttttattctgtttggcagctgg

SEQ ID NO: 552043 - DNA, 75 bp, Homo sapiens
ggaagtgggagggatagacatgatttggaagctcttgttggctttattttttgtctgtaaatccttctgttctcc

SEQ ID NO: 552044 - DNA, 75 bp, Homo sapiens
gacactggtgaatggcaggagggttgcgcatgaagccacaaagctacttgggtttctccttctcatttgcctttt

SEQ ID NO: 552045 - DNA, 75 bp, Homo sapiens
gagttttcatggcacaggtagaatttctgggataaataaaagtttgtgggattttaccttggccatctttaactt

SEQ ID NO: 552046 - DNA, 75 bp, Homo sapiens
aactattttttctctctggacttattctttacatttttagaaaagtggggaatgggcagatgagaatttttagtt

SEQ ID NO: 552047 - DNA, 75 bp, Homo sapiens
atggtctctgagccttcctgtggccaccagcacattctgtgcagccccaggaccacatgggaggctcatggccat

SEQ ID NO: 552048 - DNA, 75 bp, Homo sapiens
ctgtgagctcccggtgtcctgcaaacgttggcccctgaatcaccgggccagtgtgtgtgggatggggctgcatag

SEQ ID NO: 552049 - DNA, 75 bp, Homo sapiens
ccttctggggtattatggcagctgcagccaatattgaacagggagctgcagctgtttacagatgcattaggaagg

SEQ ID NO: 552050 - DNA, 75 bp, Homo sapiens
ttcctgagccataatgagcttaggtttttaatcagactaatgagaaaagatctgtaattcagcatggctcatgag

SEQ ID NO: 552051 - DNA, 75 bp, Homo sapiens
ttctgcagaggcggcacacagtgaatgaggagatacagacagatgccttcagatggagctgtgtgctctgcagaa

SEQ ID NO: 552052 - DNA, 75 bp, Homo sapiens
gtgggtgggagatgggggtggccgaggcttggctgctcctggccctgagcttcggagccctattttctcctccgc

SEQ ID NO: 552053 - DNA, 75 bp, Homo sapiens
cctgaaggggaggtggctttgggatgtgccagtgcgcctcttactcggcatctcctgccagctgtctcccacagg

SEQ ID NO: 552054 - DNA, 75 bp, Homo sapiens
gggagaggagagtgttgagcacaaattaactaccctggggaatgagtatcaggtgtttgacactttcacttttcc

SEQ ID NO: 552055 - DNA, 75 bp, Homo sapiens
ggccgctgcacgcagggcgggaggcgatggaggctgcccgcgccttgcgcctcctgctcgtggtgtgcggctgcc

SEQ ID NO: 552056 - DNA, 74 bp, Homo sapiens
caggaggggagggggtgtgctctgcagagaccacacagagtggggtcctgggcagtactcacctccacttcctg

SEQ ID NO: 552057 - DNA, 74 bp, Homo sapiens
cctcatggtttgtcggaactgcatcttatctagcttgtatagcttagtgaggcagttctgggcctgcaatgaag

SEQ ID NO: 552058 - DNA, 74 bp, Homo sapiens
gtccagtgtgcatctgctgttgcttgaccacattgccaaacacaatttggcaagcacagaaatgtacattgagc

SEQ ID NO: 552059 - DNA, 74 bp, Homo sapiens
ctacactagagatagctgcagccacctaggggctcacccctggtcgggagcgagcagctatttgctagttgtag

SEQ ID NO: 552060 - DNA, 74 bp, Homo sapiens
tattagttggccttccttgagtggcacacattttagcaaataaaacccattgctgctcattaggctaattagta

SEQ ID NO: 552061 - DNA, 74 bp, Homo sapiens
gagggtcaactatgcaggcagactgagtttcaagtaaagaaatttgtcattcttgtttgctttggttagctctt

SEQ ID NO: 552062 - DNA, 74 bp, Homo sapiens
ccaattaggtgagtctgtgtgtgggtttctaagtgtctatgctttgcagtgatcccacacagttatctaattgg

SEQ ID NO: 552063 - DNA, 74 bp, Homo sapiens
ctgaagtgaatctggggccagctgtagatcccatgttagcagtgacataagcagctggcccccgtttattttag

SEQ ID NO: 552064 - DNA, 74 bp, Homo sapiens
aggtctacttctgtggctccaagacactctcaagtctctaatggcttctcttaaagctaccgaaagttgggcct

SEQ ID NO: 552065 - DNA, 74 bp, Homo sapiens
gctttcttgctagggtgctttcttctaaccccagaagtgatggggagccatggaaggtttttaggcaggagagc

SEQ ID NO: 552066 - DNA, 74 bp, Homo sapiens
gcttctgtcctgtgctgtgcatcttgatgacctaggcctgaaggtcacaagggcagcacagtgaggacttaagc

SEQ ID NO: 552067 - DNA, 74 bp, Homo sapiens
caggtgcagtgctgggggaggttgtgggtgaagagactaaagcctgcctcccatcccaccccagcactgccttg

SEQ ID NO: 552068 - DNA, 74 bp, Homo sapiens
ggtgagggggtgggaggtgtggtttccaaaggttataattttcatgacattctacacccaacccgcccccttcc

SEQ ID NO: 552069 - DNA, 74 bp, Homo sapiens
ccggatgggggcggggcgggtaggccggaggcgcagagtctccgccgggaccgcgaccccgccccgctttccgg

SEQ ID NO: 552070 - DNA, 74 bp, Homo sapiens
ggctgaaggatgagggtaggtggggtggctgctcaggaggactgtggaggccacatcgcctaaccttcgaggcc

SEQ ID NO: 552071 - DNA, 74 bp, Homo sapiens
tctctctcctaattggtggaaaattggttgctaactgtcaggaaattgccgattttccatccattactgggagg

SEQ ID NO: 552072 - DNA, 74 bp, Homo sapiens
ccaagggtggaagagactgtggttccccaaagcttcccagtgcacttgagggttcacactctcccaccacatgg

SEQ ID NO: 552073 - DNA, 74 bp, Homo sapiens
agggactctagacccaggaaggcccagaaccactgatgctgagtaacacccttggccttctggtctgagttgct

SEQ ID NO: 552074 - DNA, 74 bp, Homo sapiens
cctgcagctgcactatagatgcttaaatcccactgatttcaaaaagaggtccatttatggaaatgctctgcagg

SEQ ID NO: 552075 - DNA, 74 bp, Homo sapiens
ctctccagaggttttcatgtttgtctcttccaacagttgtttgaggagaagagagacatgaaaacctttgggag

SEQ ID NO: 552076 - DNA, 74 bp, Homo sapiens
tttctgtgtgtttattgatatttcacatctgaattgtgatgactgaagaataatatcaatgagcataccagaaa

SEQ ID NO: 552077 - DNA, 74 bp, Homo sapiens
ggagggcagagcctaggccttggagtctggtctcatctcattatttcacagggccttggcctcctctgacctcc

SEQ ID NO: 552078 - DNA, 74 bp, Homo sapiens
agaatgagagtttaatgtttttatgcagtttagctcaggtagaataaagtgcaagaaaacattgaaccttttct

SEQ ID NO: 552079 - DNA, 74 bp, Homo sapiens
ccctggttggtccttctgaagcttcttcatttaggtttaccagtcagtgaggagcagagagggagcatgagggg

SEQ ID NO: 552080 - DNA, 74 bp, Homo sapiens
ctctcccacttttttggtagtgccttctgccattctttgtaaccgagaaggtcaaggccaaaagagtggtggag

SEQ ID NO: 552081 - DNA, 74 bp, Homo sapiens
ggcccctcacactgcaaggtggtgccctccaggtcagagtggaggacattggctgcgatgtgtgaagctgggcc

SEQ ID NO: 552082 - DNA, 74 bp, Homo sapiens
ttttcttttccttgtttatgtccttggccctactgttaggtatagaggcttgggaggtgatgaggagaagggag

SEQ ID NO: 552083 - DNA, 74 bp, Homo sapiens
gaacctgccagatcagaatagtgtattctgtgcacccaacagggtggaagacattattttgtttgtgttagttc

SEQ ID NO: 552084 - DNA, 74 bp, Homo sapiens
ggtgttgtctttcaggggaaagactgggtttaataagcctttattcttactcattttctctgggggtacagccc

SEQ ID NO: 552085 - DNA, 74 bp, Homo sapiens
gagaataggatggaaaggggtgtttgctgatggtaccttctaagggaacagctgcccttttcacatgttttctc

SEQ ID NO: 552086 - DNA, 74 bp, Homo sapiens
gctggtttgagctagactcctcctccatcatagcagggtgcctggtctggagtagagtctagctgggatccagc

SEQ ID NO: 552087 - DNA, 74 bp, Homo sapiens
ccaggcctgaatgctattccttggcgataccatgattatatctccatcgagtccggggaagcctctcaggcctg

SEQ ID NO: 552088 - DNA, 74 bp, Homo sapiens
ggtacagccattctcctgataccctctgcctttcaatcagagcacttaggttatcaggagaggaggctcctgct

SEQ ID NO: 552089 - DNA, 74 bp, Homo sapiens
catgaaggcttcaggctccctgaggaaggtgactagtgggaaactagtatccacaggggtctgtgctctcaatg

SEQ ID NO: 552090 - DNA, 74 bp, Homo sapiens
cccacgctgggcgagctgccccctctccagggcagggctccaaaccgctctgggggaagctggcctcagctggg

SEQ ID NO: 552091 - DNA, 74 bp, Homo sapiens
gggggaaaggggtgggggggaggggttgtgcggctggggcctcacttcccctccttccccttctcctggtcccc

SEQ ID NO: 552092 - DNA, 74 bp, Homo sapiens
gctgcaatatttcttcaggtctgcagagtcataattaaagctgaactgagcggaattggagagggaaggtcagc

SEQ ID NO: 552093 - DNA, 74 bp, Homo sapiens
tcttcttcttgagtaacatcagattcttcatcagtgccaactgaagtcccactctgattcaacttggcaggaga

SEQ ID NO: 552094 - DNA, 74 bp, Homo sapiens
aggagagaggaagatgggagagctctggaatgactgtgatttctccaccctgctttcttatctccctttatcct

SEQ ID NO: 552095 - DNA, 74 bp, Homo sapiens
gaggatggaagaggaacttaggagctaaatgctgaccctctctattttgctccagaatgttcttttcctttctc

SEQ ID NO: 552096 - DNA, 74 bp, Homo sapiens
cttatctcacactgggtttgagggtcacttagcaaagagtgtgtggctccaccaaactcagggtgggagtaaag

SEQ ID NO: 552097 - DNA, 74 bp, Homo sapiens
agactgtggcatttgctggattttataattggacaaatttaggttactgtacatgccagcaaaagctattgttt

SEQ ID NO: 552098 - DNA, 74 bp, Homo sapiens
gggtggcctattaagagaagccccatttaagccacctggcataaaatgaagttttcttgaataggcttcatccc

SEQ ID NO: 552099 - DNA, 74 bp, Homo sapiens
ccaaaatacactcagcccaggaggagcagctctccagtacagctgtctgctcctgccctgctcgggtattttgg

SEQ ID NO: 552100 - DNA, 74 bp, Homo sapiens
tgtgtcgggttaatgaactcttctagggcactcaatagaaccagcgtgcctttaaaggactcattgacctcaca

SEQ ID NO: 552101 - DNA, 74 bp, Homo sapiens
tgggatgggggttgagaaggagaaaaatagaacgctttcatcgcttctctgattttccttctccctctcttcta

SEQ ID NO: 552102 - DNA, 74 bp, Homo sapiens
aaattctggcacctggtatcttgggaaatggtaaactgatgagatctggccaagtaccaggaatgtcggagttt

SEQ ID NO: 552103 - DNA, 74 bp, Homo sapiens
cttctgtgccgaggcaggacaactggaatgaattatgcacattcatacttgttaaactgccttggcaccagaag

SEQ ID NO: 552104 - DNA, 74 bp, Homo sapiens
ggaatgagggtggggggcggggaggtgacgggcccaacaggttgtgcctcattcctgccccgcctctcacttcc

SEQ ID NO: 552105 - DNA, 74 bp, Homo sapiens
ccctgccctgcctccaccccgcctggcctgacccagccagggctctaggagggttgggtggaggcaaagtgggg

SEQ ID NO: 552106 - DNA, 74 bp, Homo sapiens
gacagtaagagaagagtcttgtcaaattagccttgacaattaagcaagccttaatttgacaaggctttcctgtc

SEQ ID NO: 552107 - DNA, 74 bp, Homo sapiens
aggggtgatgcgcatgatttttttactaaggacattattaagaatgtcatttctaaggtcagttgtttacccct

SEQ ID NO: 552108 - DNA, 74 bp, Homo sapiens
gcagttttgacaataataatagatgagtgttttgtgaaaataggttacaggtttatcattaatattaaagctgc

SEQ ID NO: 552109 - DNA, 74 bp, Homo sapiens
gggcagaggttctgctctgggctgaagacaaggctagaagatgtcagtctgtgcccagaccagccctgctgccc

SEQ ID NO: 552110 - DNA, 74 bp, Homo sapiens
gaggacggaagaggaacttaggagctaaatgctgaccctctctattttgctccagaatgttcttttcctttctc

SEQ ID NO: 552111 - DNA, 74 bp, Homo sapiens
ggggaaaggggtggcgagggaggggttgtggggctggggcctcacttcccctccttccctttcccctggtcccc

SEQ ID NO: 552112 - DNA, 74 bp, Homo sapiens
gcatttatttccaagagcttatttctgaatgacaaacatcttcatacatgaaataggattctggaggtttgagc

SEQ ID NO: 552113 - DNA, 74 bp, Homo sapiens
agttttaagagtaataaatagctgttgaattgtatcaaagaccttttcagcagttgggagttatttttaaaatt

SEQ ID NO: 552114 - DNA, 74 bp, Homo sapiens
ctgcactgtcttccatctaagtcatcaccaattttatatctaataagctttgtctgagatggaagactgtgcag

SEQ ID NO: 552115 - DNA, 74 bp, Homo sapiens
gagcaggtgccattggctcttggcctgtttgggtgggtggcattcagagaggtggaaggtcagatgcactgttc

SEQ ID NO: 552116 - DNA, 74 bp, Homo sapiens
tagcctccattcctcgaggagccactggttattttaattattgtctctagaggccttttagtgagttgaggcta

SEQ ID NO: 552117 - DNA, 74 bp, Homo sapiens
gtttgattttctggttcactagactgacacaccacaaagggaaaggtggaaggttagtggtccagaaaacagac

SEQ ID NO: 552118 - DNA, 74 bp, Homo sapiens
ggtttccgagtccctgccatggctgctgctgctgcctccgcggctgctcttgcagccccagggactcgggagcc

SEQ ID NO: 552119 - DNA, 74 bp, Homo sapiens
tccagacagaggacctagcatgtgcccaggcccagggtgtgaccgggggcaggtgcagggctgctgtatctgga

SEQ ID NO: 552120 - DNA, 74 bp, Homo sapiens
tgtttttttattccactgttcatccttcaagctgataaacagcaacaatgggaaacagctgggacaggaaaaca

SEQ ID NO: 552121 - DNA, 74 bp, Homo sapiens
ggagccgctgctgtggaatgaccatgaaagtctccatcataagtgatggtgaataagcatccaccagtggctct

SEQ ID NO: 552122 - DNA, 74 bp, Homo sapiens
cagaaggtactctgtgggagggaggagataatagccaatgattatattcctccttcatacttgcagtacctctg

SEQ ID NO: 552123 - DNA, 74 bp, Homo sapiens
tccagatatatctaagttaggataactgtctcttgaaagatagagatcagttagatagcttgatgtgacctgga

SEQ ID NO: 552124 - DNA, 74 bp, Homo sapiens
ggccatggcaagcccttgcctaccacactgcggtccatgacaccagtctggtagccaaatgctgtcatagtgcc

SEQ ID NO: 552125 - DNA, 74 bp, Homo sapiens
ggcagagcaggagggtgtggaggttcagggcacctgccattggtcctagagccacccacacctgcactgaggcc

SEQ ID NO: 552126 - DNA, 74 bp, Homo sapiens
tatgaaaagagcacgctctatttaggagaattctatttaatttgatctcctaactataaagtggctccttcgtg

SEQ ID NO: 552127 - DNA, 74 bp, Homo sapiens
tgtcctcttccagagcctgtggtctccctgctgcacacacagtcttgggagccagctctctgggggagctgata

SEQ ID NO: 552128 - DNA, 74 bp, Homo sapiens
tcaggctctccagtacatggggcaccgtggggagcagctgttcccctgctccagggtctgctggagagacctga

SEQ ID NO: 552129 - DNA, 74 bp, Homo sapiens
gaggctgatgtcatctatcttcccaaagaaaaggccactttttcctttgtggaaatcctgggtgacatcacctc

SEQ ID NO: 552130 - DNA, 74 bp, Homo sapiens
tttccagtcctagttgttccactgcgagcatggttagagtgaggcatgttaatgaatgggagctgggatggaga

SEQ ID NO: 552131 - DNA, 74 bp, Homo sapiens
cctttggcttctccctgtttcttcctgctacttacaggcctggtggcagagggtaggacggggaaagaaggagg

SEQ ID NO: 552132 - DNA, 74 bp, Homo sapiens
agacatcatcttgaatgactgtgattttcttgaactgatcaccaggctattatagtctctcaagaatgatatct

SEQ ID NO: 552133 - DNA, 74 bp, Homo sapiens
cccttgggctgcggtttaagacaggcttcacagtatttactgtttatagttttgagctgacagctatttaaggg

SEQ ID NO: 552134 - DNA, 74 bp, Homo sapiens
tccttggtgacatagttgtcttggtggtacagggaaactccctctgtaacactgggggttctgtgtcacaggga

SEQ ID NO: 552135 - DNA, 74 bp, Homo sapiens
ttggcttggggaaaactgacaggggaggtccccccataccaccagtaaacctgccctgtcgcctccctgtccaa

SEQ ID NO: 552136 - DNA, 74 bp, Homo sapiens
aaatatgtaaaagcaacttagcaggtaatgcaatataggaggaaaaatagctccttgctgagttcttcatgttt

SEQ ID NO: 552137 - DNA, 74 bp, Homo sapiens
cctctgcagtggcctcaggccctctgccagtcctgattgactggtgagggtgcctgggccatctctgtataagg

SEQ ID NO: 552138 - DNA, 74 bp, Homo sapiens
aggatgactggatgtcacacccatgatgctattaggtcctcataatagcatagtgaggtggacagctagtacct

SEQ ID NO: 552139 - DNA, 74 bp, Homo sapiens
acacatggtctgatggcttaggtaaacactagtcctggacaatgggttactgaggtcgtgtacagaccatgcgt

SEQ ID NO: 552140 - DNA, 74 bp, Homo sapiens
ttggaagagggaggtagagccaggattcagatccaggcagcctggcgtcagagtccaggctctcctgctgccga

SEQ ID NO: 552141 - DNA, 74 bp, Homo sapiens
ctcccaaaggttttcatgtctctcttctcctcaaacaactgttggaagagacaaacatgaaaacctctggagag

SEQ ID NO: 552142 - DNA, 74 bp, Homo sapiens
tgtggtcatcctggtgggaaattatctcctctgacaggctcagcggtggtggtgtcctgtcagaatggcctaca

SEQ ID NO: 552143 - DNA, 74 bp, Homo sapiens
gacagcctacttggactgagcctgatccagaagaatgtctttgcaagcaacgggtttaaatcccatgggctgtt

SEQ ID NO: 552144 - DNA, 74 bp, Homo sapiens
ctcagatcttggaagatcttggctcttttgttggatttcttcaaggagagaactaggatcaaccaacagttgag

SEQ ID NO: 552145 - DNA, 74 bp, Homo sapiens
ggaaggccttaggctgtcagcggctgccgagggaggtcacctccgctggtcgtttggcagcataggcctgcgtc

SEQ ID NO: 552146 - DNA, 74 bp, Homo sapiens
gtcatcctctttctaggtcggaactctcttagaatgagacaaagaaaaatccgggcctggaataagaggaagac

SEQ ID NO: 552147 - DNA, 74 bp, Homo sapiens
tggggcctgcaggttgtcctcagtttcagatagccacacaaggactctcaggctgaaggcccttgcaggccaca

SEQ ID NO: 552148 - DNA, 74 bp, Homo sapiens
gtgtacgcgggaagcgggcagcctccgcctgcacccgcggggccgggacccggaggcacccgcttccccgacac

SEQ ID NO: 552149 - DNA, 74 bp, Homo sapiens
gatcctggtgggcatcaagaagtcctgtcaaacagaaaaagcactgacagggaatcaggtgtctgcagatgatc

SEQ ID NO: 552150 - DNA, 74 bp, Homo sapiens
gtggtgtcctactcaggagagtggcaatcacatgtaattaggtgtgattgaaacctctaagagtggagtaacac

SEQ ID NO: 552151 - DNA, 74 bp, Homo sapiens
taagcaagggagacagcagaaactagagcacttgagtaaaagctggatgcttaggtccctgttgttcatgttta

SEQ ID NO: 552152 - DNA, 74 bp, Homo sapiens
gttgtgtgcatacagtgggtctttgtgtgtttgaactcccaccacataagggcaaactcgatatgcatgctaac

SEQ ID NO: 552153 - DNA, 74 bp, Homo sapiens
gcaaggtttgggaaataagctgatagtaaagtcatgtaacactttctgtgcaggttaacatttctggaccttgc

SEQ ID NO: 552154 - DNA, 74 bp, Homo sapiens
tcgttgaagggggatttgtgcttgtaactcctattaataggacttgcatgtgtaaatcttcctcctgtcaatga

SEQ ID NO: 552155 - DNA, 74 bp, Homo sapiens
aggggagttgcgggcttttggttcactgtcacctgggaaaaggtgttgtcagtgtccggaccctcaactttcct

SEQ ID NO: 552156 - DNA, 74 bp, Homo sapiens
ggtagatggagagaggaaggaggtctgtaaggcagtttctcagtcagcacccctcactttccttctccatcttc

SEQ ID NO: 552157 - DNA, 74 bp, Homo sapiens
ctattacatatggctaataacctattgtttaggaaagactagacaatgggtaataaaagccatttatgagatag

SEQ ID NO: 552158 - DNA, 74 bp, Homo sapiens
actgttctggcaagcactgtagggatgcatagggtcactgcagacctaagcatgctggaggcttgctagtaagt

SEQ ID NO: 552159 - DNA, 74 bp, Homo sapiens
taaaatcatagttttcagaattggagcctcagtgaaaagcactgctagtaagccttttgggaactgtgatttta

SEQ ID NO: 552160 - DNA, 74 bp, Homo sapiens
gctagtcagagacagacctaggggaaaaaaatgagagaaacacagattctcacttgggctctgtctctaactgc

SEQ ID NO: 552161 - DNA, 74 bp, Homo sapiens
ggggttcgttctctccctgaagcacttgttcaactcctgttaaagccgcgtgcctcaaggggaggctggacccc

SEQ ID NO: 552162 - DNA, 74 bp, Homo sapiens
gtagggtgtgtgcgttagaatgcagcacaggtaaaccttgcagcaatagtttctaatgctgtacacaactctgc

SEQ ID NO: 552163 - DNA, 74 bp, Homo sapiens
ccatatagcagtggtcagggacctcaagaaggcaaccttgctttgcaatgaaattcttggatcactggatgtgg

SEQ ID NO: 552164 - DNA, 74 bp, Homo sapiens
gacttgctccaaagagagcaactggcttattgttatccaaataagctggtgtagctcctttagagtttatagtt

SEQ ID NO: 552165 - DNA, 74 bp, Homo sapiens
cccactcacgtgaagtctcatgcccctgaaagtgccattcaccactggccaggctcatgaggccacatgagggg

SEQ ID NO: 552166 - DNA, 74 bp, Homo sapiens
cttcttcttcttcctcatcctcatccagctccagctccagcactgatgagagtgaggatgagaaggaagagaag

SEQ ID NO: 552167 - DNA, 74 bp, Homo sapiens
gggccggggtgctgtgagttacctttggttatagggaggtggtgacccatggtggctccaagtgcccgtggcct

SEQ ID NO: 552168 - DNA, 74 bp, Homo sapiens
gctgctttatgaggcaataacttggttttctcatttatccactcaggaactggattattacctcataaaacagt

SEQ ID NO: 552169 - DNA, 74 bp, Homo sapiens
gtatacattgctcaaaggagccccagtgctactggtttcttatctgtcccattggggctgttttatgcttatac

SEQ ID NO: 552170 - DNA, 74 bp, Homo sapiens
tgatcttatagatacggtccgagaactcctgtgtctgatgacgcagagtaagttgccttgtatttgtaggatta

SEQ ID NO: 552171 - DNA, 74 bp, Homo sapiens
gccctgcgcctgcccagccctcctgctctggtgactgaggaccgccaggcaggggctggtgctgggcggggggc

SEQ ID NO: 552172 - DNA, 74 bp, Homo sapiens
gagattagcgaaagggattctggccaaatccctgatcaagttgcttggcacagaattattgattggcaaatctt

SEQ ID NO: 552173 - DNA, 74 bp, Homo sapiens
ctgagctctgtatacagtctgggcttgggtcaaggccaagggcagcaacagcccagaaagagtaaagtgctcgg

SEQ ID NO: 552174 - DNA, 74 bp, Homo sapiens
gataaacttccaaggaagtcccttatggccttactgatgaatgtggttaaaagggcttccttcaaaggtttatc

SEQ ID NO: 552175 - DNA, 74 bp, Homo sapiens
tggggtaaccaaccatccccgtgtgtctgggacttttattgtcataggcacactaggatgagttggttgaccta

SEQ ID NO: 552176 - DNA, 74 bp, Homo sapiens
tcatctccagaatttgcacctgtttctagctgaggactttctctagcagaacgggagcttgttactgggcatga

SEQ ID NO: 552177 - DNA, 74 bp, Homo sapiens
gcctttaagatcagggactctgtctttattatggtgacacatgggagtgaaatagagcccttgttcttgatggc

SEQ ID NO: 552178 - DNA, 74 bp, Homo sapiens
acacgtttctacattcttttccctgggtacagaaactccacatctgaccacagggaagccaaaatgtaccgtgt

SEQ ID NO: 552179 - DNA, 74 bp, Homo sapiens
gcgtggctcatagtaagtgcataataaatgttaattatttttattcatttattaaatacttactgagagtctgc

SEQ ID NO: 552180 - DNA, 74 bp, Homo sapiens
ccactgtcccactgtcctcgcaggggatgggatcaggtgtcagcacctccccatggagtacagttgggcaatgg

SEQ ID NO: 552181 - DNA, 74 bp, Homo sapiens
gacagaggggctgggctgggctgggcaacctagacccgggagcccatctgtccagccaccagcgtccgtctgtc

SEQ ID NO: 552182 - DNA, 74 bp, Homo sapiens
caagttccccgaagcagatgtgtgcagatcatcaattctaactcagactgtgcaacttgcctttgggggacatg

SEQ ID NO: 552183 - DNA, 74 bp, Homo sapiens
aagatcatttcagttctggtggttccggtttttgcaggcttagagaaaactgtccatcaggattgtgctgtctt

SEQ ID NO: 552184 - DNA, 74 bp, Homo sapiens
gtgcctctgggtgtattttattcctcaggagaggtgctgtcctcagcctgaggagtgaatgggcctcaaggtgc

SEQ ID NO: 552185 - DNA, 74 bp, Homo sapiens
ggaccctgacttgtctcgcggttactgggccggcgcgagcacgcgaggctcgggggcggcacggggcggggttt

SEQ ID NO: 552186 - DNA, 74 bp, Homo sapiens
tggaaagcctctgacaagcatgctatgtgctgcggaaattgcaaacagacttggcatgcttgctcaggagccca

SEQ ID NO: 552187 - DNA, 74 bp, Homo sapiens
tttctactattagcacaattgtaatatttatcaaacaggcagctgttttaatgttacaactggtaaagtagaaa

SEQ ID NO: 552188 - DNA, 74 bp, Homo sapiens
aagatgagaggatgtgacctgtggcccacccagcactcagcacccctgggccttggctgcatcctgggcatctt

SEQ ID NO: 552189 - DNA, 74 bp, Homo sapiens
atgaaagatgcgctctcgagctatgtgtagctgatctaagcacaccattgttcaaaagatcgcgtcttgggcat

SEQ ID NO: 552190 - DNA, 74 bp, Homo sapiens
cacagcaccaggaagcctgagaatgaatcctgagggctctagcccaggctttgtcccaggctttctggtgtgtg

SEQ ID NO: 552191 - DNA, 74 bp, Homo sapiens
gcgtcgcccccctcagtccaccagagcccggatacctcagaaattcggctctgggtctgtggggagcgaaatgc

SEQ ID NO: 552192 - DNA, 74 bp, Homo sapiens
cacacaccagaaagcctgggacaaagcctgggctagagccctcaggattcattctcaggcttcctggtgctgtg

SEQ ID NO: 552193 - DNA, 74 bp, Homo sapiens
cccacccctcccgagccccaattccctttacataaaacatgaagctggagatgagggctgcgcagagggcaggg

SEQ ID NO: 552194 - DNA, 73 bp, Homo sapiens
ggccacccagggaggtcctgggggcagggatggccccacctcccggcccccagcacccgccccttggtgggcc

SEQ ID NO: 552195 - DNA, 73 bp, Homo sapiens
gaagtccccagaaatgaaaatgggagtgtgtgtccaggcacaattgcttctcccagtcttcctggggatgttc

SEQ ID NO: 552196 - DNA, 73 bp, Homo sapiens
tgggtggagaggacaggatggggagtcacaaccctggctccagagcccagccctccggtccccctcccaccca

SEQ ID NO: 552197 - DNA, 73 bp, Homo sapiens
ggagaggaggtgcctgctgcggggagcaagcatgggccagggtcctggccccctgcaggggtagcccctcttc

SEQ ID NO: 552198 - DNA, 73 bp, Homo sapiens
gataggcttaattttcctgtcaaatgtggacttcccttgtaaacatgtcaattgaggaaagttcaagcttgtc

SEQ ID NO: 552199 - DNA, 73 bp, Homo sapiens
ctactacagggcaacccttttccacccagtgatcttaggattgattatctatgaagggtagaccatgtggtag

SEQ ID NO: 552200 - DNA, 73 bp, Homo sapiens
gggagcctggctccacaggccagggtgtggggggacctcctggccacacctcagccatgtggaggcagcaccc

SEQ ID NO: 552201 - DNA, 73 bp, Homo sapiens
ccttccctttactccagttagaacttttgttgcacaacagaagttgaatttttgacggagcctgaaggggagg

SEQ ID NO: 552202 - DNA, 73 bp, Homo sapiens
gggtgggagatgagaagggccaaaaggtgaatgtatgcacctgtttgtgtgcctcttgtcatccttccttccc

SEQ ID NO: 552203 - DNA, 73 bp, Homo sapiens
cagagctttttctaggaaatgacagggcaggtaattgtcatctttccttctcatattcttggaaaaagttttg

SEQ ID NO: 552204 - DNA, 73 bp, Homo sapiens
ggagatttgaagaagggagagagatctgggatgatccagacaccagtctctcaccttctcagaaaattattcc

SEQ ID NO: 552205 - DNA, 73 bp, Homo sapiens
cccagggtctggtgcggagagggcccacagtggacttggtgacgctgtatgccctcaccgctcagcccctggg

SEQ ID NO: 552206 - DNA, 73 bp, Homo sapiens
ggttctggggagtttgtggggcctcaggtatcacctgggtcagaccccatccccacacacccttcttggaact

SEQ ID NO: 552207 - DNA, 73 bp, Homo sapiens
ctctccccttttctcaagcccaggcaagggaggtgatatccaccggcagctcctgggtttgtagaggggaagg

SEQ ID NO: 552208 - DNA, 73 bp, Homo sapiens
gaggtagaaatgtggtggttggggggtagaggtatccccctgttatccccccatctttcccatttacacactc

SEQ ID NO: 552209 - DNA, 73 bp, Homo sapiens
tctagtctgtaagaagaggctgcactggcaggttttgaccaaattgtgtagaatctcatctgacgtgattggg

SEQ ID NO: 552210 - DNA, 73 bp, Homo sapiens
ggattcacgtcttccagccaaaaccatctcaaacaagtagtttgaggtttttgctggaaggtaatttgaattt

SEQ ID NO: 552211 - DNA, 73 bp, Homo sapiens
tttgctgccttgcttctaaccaataacaccctgaatgcatcaggcttttcaagtcagaagtgaggcaagcaaa

SEQ ID NO: 552212 - DNA, 73 bp, Homo sapiens
agagctgcattttaaatggcgagaacagtacattaaacatgtataagatgtaatctcatttggaatgcgctct

SEQ ID NO: 552213 - DNA, 73 bp, Homo sapiens
gggctttccctgagggaaggtagcatcttgccattttcttcctgcacagctttgccttcccagggatcggccc

SEQ ID NO: 552214 - DNA, 73 bp, Homo sapiens
gtgtagttttcactgggggaaggaaaggtgttatatagaaatgtatacattttttatttccttaaaattgcat

SEQ ID NO: 552215 - DNA, 73 bp, Homo sapiens
tagttcatgttatcacagaagcaaatgaaaagtctcccaaccttttcatttacttctatgacaacatgctctg

SEQ ID NO: 552216 - DNA, 73 bp, Homo sapiens
cctggctggaggggaagggagacttgggcaagtggaacatcagcttcagtcgctcatcagacctctggccagg

SEQ ID NO: 552217 - DNA, 73 bp, Homo sapiens
gatatgggagtgaaggaagtcaaaggaattagtattttaaaattaattcatttaatatctctcctcccatatt

SEQ ID NO: 552218 - DNA, 73 bp, Homo sapiens
ggggaggtggcaggaagaggacagaaataaaaacttacactactttctttcttcctttctgccctccctccct

SEQ ID NO: 552219 - DNA, 73 bp, Homo sapiens
attctcgtttttcctcaagtccattatacaatttggattgcataatactggtggaattgaggaagggcagaat

SEQ ID NO: 552220 - DNA, 73 bp, Homo sapiens
gggactgggggatggtgggaaggcaatctggccaggagaagctgcgggggagactcccgccatccccagtccc

SEQ ID NO: 552221 - DNA, 73 bp, Homo sapiens
gtgcgctaggagcatgtgtgggggtgtggtacagagaactctctttccaccagctcatacagttctaaagcac

SEQ ID NO: 552222 - DNA, 73 bp, Homo sapiens
tcagccacgagggcacccagctgaccttgggagctctgtctcaccccagggttgggtgcttttccttggttgg

SEQ ID NO: 552223 - DNA, 73 bp, Homo sapiens
actgcctggcagagggcagggccaggattcaaagtcacatctctgactcctgctgcccgccctctggggcagt

SEQ ID NO: 552224 - DNA, 73 bp, Homo sapiens
tctcgctccctccctcccgccctccttttgtgtacaagctgtctacgacagggggtgggagggggcatgcaga

SEQ ID NO: 552225 - DNA, 73 bp, Homo sapiens
gtgtatgaaagggttattcatctcgagggctgagcatgaaggtcctcagtcctcagtgagtgatcctgtgcac

SEQ ID NO: 552226 - DNA, 73 bp, Homo sapiens
cagtgcacacttcaggactgtgggaaagtggaaccactcaggactcagtttccccatttgaacagtgtgtgtg

SEQ ID NO: 552227 - DNA, 73 bp, Homo sapiens
ccccaggcagcgggcatcatggggacagcaatggcttcttctttgctgcacccaaggagttggtgacttgggg

SEQ ID NO: 552228 - DNA, 73 bp, Homo sapiens
atgaactatgtggttttgaatcggatgtagacctttaatactactacttgagctaaacttctgcatggttcgt

SEQ ID NO: 552229 - DNA, 73 bp, Homo sapiens
tccctgcctgccagccctagacctgctggagcatagagcccttcctccccaggtctaagtaagtatgcagggg

SEQ ID NO: 552230 - DNA, 73 bp, Homo sapiens
accatgctgggccttgggtgcactcatcaaaaaacggaccacaggcatgatgctcacaggtgcccggcatggt

SEQ ID NO: 552231 - DNA, 73 bp, Homo sapiens
ggtaacagttgccactatggcctcctccctgcattttccaagcatggaggaggacaagtgagcacctgcctcc

SEQ ID NO: 552232 - DNA, 73 bp, Homo sapiens
tgaagcacaggaaggacccaggccccagaccatcacccaccccagggctgggccctgggccactcctggctca

SEQ ID NO: 552233 - DNA, 73 bp, Homo sapiens
caggttgcgagataagatagtgctgtccctgacacctcagtcttagggatgcttatttttaaatctcagaatg

SEQ ID NO: 552234 - DNA, 73 bp, Homo sapiens
ggggatggagagatgcagtcaagggagaatctgaaggtggatcaacctttcttgacctcacctcttcctctcc

SEQ ID NO: 552235 - DNA, 73 bp, Homo sapiens
gtggaaagatggtgggccgcagaacatgtgctgagttcgtgccatatgtctgctgaccatcacctttagaagc

SEQ ID NO: 552236 - DNA, 73 bp, Homo sapiens
gtatttcattctggaaactgaaatgggacattaaataaagaatggtgtctcatttcagggcagagggacttac

SEQ ID NO: 552237 - DNA, 73 bp, Homo sapiens
ggtggtggctgcggacaacatggacccaagcaggggcatccctgaggggagtctgtgctgctgagcccccacc

SEQ ID NO: 552238 - DNA, 73 bp, Homo sapiens
ggcttgttggggatcatggttatattcctactagataataaaaggaaaaatgactctggtccttttcacagtc

SEQ ID NO: 552239 - DNA, 73 bp, Homo sapiens
ccgggcaggcgcgagggccgggggtcgtttgacttgggtgtccccgagccccgctgccttcacgtctgcccgg

SEQ ID NO: 552240 - DNA, 73 bp, Homo sapiens
cctgctgcctttatatcattaacataaatgcaggtgcaaatagcatttatgtactttgatagaaagcagttgg

SEQ ID NO: 552241 - DNA, 73 bp, Homo sapiens
taaaatgtccttccttgcttgcagttttacatccaagtgctttttgggttcctgcggttggtaggatatttta

SEQ ID NO: 552242 - DNA, 73 bp, Homo sapiens
tcttcatatagggtgataaaaccttctgctcgtgtttcaggcagcggagggttttcttctttcctactgaagg

SEQ ID NO: 552243 - DNA, 73 bp, Homo sapiens
tgagggtatgtgcctttggactacatcgtggaagccagcaccatgcagtccatgggcatatacacttgcctca

SEQ ID NO: 552244 - DNA, 73 bp, Homo sapiens
agtggaaaaattcagtcagttggttgctttgtctacatgattccaaacaagtaggctgactgagtttttttct

SEQ ID NO: 552245 - DNA, 73 bp, Homo sapiens
gaacagagacagctggcctggcggcctccctctcactgcatgcaagagtctgttagggcggctgtcttgcttc

SEQ ID NO: 552246 - DNA, 73 bp, Homo sapiens
cctggcactgagaactgaattccataggctgtgagctctagcaatgccctgtggactcagttctggtgcccgg

SEQ ID NO: 552247 - DNA, 73 bp, Homo sapiens
tctggagagtgtaattatgttcatagttaagaattaatcaggtgagagaattatggaataatcattctccgga

SEQ ID NO: 552248 - DNA, 73 bp, Homo sapiens
acttctaagctgattccactttttccccagagctgctgcagtgcggtgtgggtggagggagggatcaggaggt

SEQ ID NO: 552249 - DNA, 73 bp, Homo sapiens
ccaggatctcctctcccttgtctcctacattctcccattggagaagaaaaggggaaaaggcgagaagagaggg

SEQ ID NO: 552250 - DNA, 73 bp, Homo sapiens
aaggtctgtgctcatgaccactgggtggaacccttctcaacatggtacccgtggtcccagagtcacaggcctt

SEQ ID NO: 552251 - DNA, 73 bp, Homo sapiens
gaagcaaccatccagaggaaaaagccctccagccatctacagagggtgcagcaattttcctggattctgtttc

SEQ ID NO: 552252 - DNA, 73 bp, Homo sapiens
gggttttccctgagggaaggtagcatcttgccattttcttcctgcacagctttgccttcccagggatccaccc

SEQ ID NO: 552253 - DNA, 73 bp, Homo sapiens
aattacttcaaactgcctttcctgttgagtaggttttgaactacctgcttgacagatggtgttagaagtaatt

SEQ ID NO: 552254 - DNA, 73 bp, Homo sapiens
gggtgggggatgggagggtggcgcgtgggggaaggggcgcagcctcgccgcctggcgccctctttccccaccc

SEQ ID NO: 552255 - DNA, 73 bp, Homo sapiens
cccgttcccagctggtggaggctcagccaggcaggacctcccacctctgggcccccagccacctgggggtggg

SEQ ID NO: 552256 - DNA, 73 bp, Homo sapiens
gaaaatgagggacttttgggggcagatgtgtttccattccactatcataatgcccctaaaaatccttattgct

SEQ ID NO: 552257 - DNA, 73 bp, Homo sapiens
ggattatgctttaaaaggcatgctttcccatagccgtgagggtcagggattattttttttacagcatagtgcc

SEQ ID NO: 552258 - DNA, 73 bp, Homo sapiens
gggtgctgcctccacatggctgaggtgtggccaggaggtccccccacaccctggcctgtggagccaggctccc

SEQ ID NO: 552259 - DNA, 73 bp, Homo sapiens
aatgcacaactcaacaaccttaggacagcattccattaattctgcaagtcctgaggttgaagagtcatgcgtt

SEQ ID NO: 552260 - DNA, 73 bp, Homo sapiens
aaggtccgtgctcatgaccactgggtggaacccttctcaacatggtacccgtggtcccagagtcacaggcctt

SEQ ID NO: 552261 - DNA, 73 bp, Homo sapiens
agaaagaaggcaggacggttgtgcaggctccgaagaggcggagccctcgttccgcagccaccgctgtctttct

SEQ ID NO: 552262 - DNA, 73 bp, Homo sapiens
gcttggaaggcgatggggaaatgtaggcacttggaagaagttgcgctgctgtttctgcacctcccttccaagt

SEQ ID NO: 552263 - DNA, 73 bp, Homo sapiens
tcagagcagatgaaaggaaggcatgattggtgcaaatgaacagtcgtgcctctccttttcatttacaatctga

SEQ ID NO: 552264 - DNA, 73 bp, Homo sapiens
ccagattgctcagggagcaggaggatgcaggaagcacaggccacccgctcctgctgttactgacctagtttgg

SEQ ID NO: 552265 - DNA, 73 bp, Homo sapiens
tgatgtatggaccaaatgatgtaataaaactgaagttgggaatgcatccagccccatcatttcccatatatca

SEQ ID NO: 552266 - DNA, 73 bp, Homo sapiens
tcctggctcctctctcttcctgacacattccaaaaaggaatttatggatgttgggaaggacaaagggtgagga

SEQ ID NO: 552267 - DNA, 73 bp, Homo sapiens
aagtcaggcatgcagacaggtttggcaagaaccaggatggtgggagcggggctagacactgtgtgctggattt

SEQ ID NO: 552268 - DNA, 73 bp, Homo sapiens
ggagaaaatggatttgtaggaggaagggataaataaaagttctctgtcccttttctacaaattttaaatatcc

SEQ ID NO: 552269 - DNA, 73 bp, Homo sapiens
ctgattcgtggtcggctgttccctctcccacacaaggctccctcctgggaaaggaatttctgaccatgagtag

SEQ ID NO: 552270 - DNA, 73 bp, Homo sapiens
cttactgaagggccaggggcaggctggaaggcagggtccccagtccagtggcaccttggccctcagcagtaag

SEQ ID NO: 552271 - DNA, 73 bp, Homo sapiens
ggtcctggctgataaacaatagtactttataatcaccattgaggagtttattttattgtttatttccgggatt

SEQ ID NO: 552272 - DNA, 73 bp, Homo sapiens
ttaattttccactctgtttatctgacagtgtggatgtgcaatccaaacagataatgagagagtgggatattga

SEQ ID NO: 552273 - DNA, 73 bp, Homo sapiens
aacttgagcagctcggagccataaggagattgtgttgagttattaaacacttgtggtaaagctgcttattgtt

SEQ ID NO: 552274 - DNA, 73 bp, Homo sapiens
cccaggagagaccttgtcatactgtaattacacatgattcagattgcaagagaaggtttctctgttcattggg

SEQ ID NO: 552275 - DNA, 73 bp, Homo sapiens
taggctgggctggggctgcactgagaaatcccaccatgtggctggagtaggagtttagtctctgtccagcctg

SEQ ID NO: 552276 - DNA, 73 bp, Homo sapiens
gctgtcagagcgggttaggctcggggaattggttctctggatcatctcccgggagccagcccctcctggcagc

SEQ ID NO: 552277 - DNA, 73 bp, Homo sapiens
ctgtgccatgtgggtcagttcattctcaggcctctttcagagtagagcattggctgttcccaaatgtgtacag

SEQ ID NO: 552278 - DNA, 73 bp, Homo sapiens
ggtctggattctggggctaacaggaggatctggaaacagaaagtcggtttcttggcagcctcagtttcccccc

SEQ ID NO: 552279 - DNA, 73 bp, Homo sapiens
ccgcaagagtgctgctccttttccagatgcttttcctgggggcagttggattgtgagagctgcactttgcagg

SEQ ID NO: 552280 - DNA, 73 bp, Homo sapiens
ctgcttccctgccactcagctcctgatggataagaaaaggtggttagacgggagagggaggtggcggggagcg

SEQ ID NO: 552281 - DNA, 73 bp, Homo sapiens
gagtcctttccctgtctccctcccaaaaaagtggaggcttttagcccaccggactggagggaggggagggctc

SEQ ID NO: 552282 - DNA, 73 bp, Homo sapiens
gactcggtgtcacccatcactgggccccacacccagcacagggagggaacaggatgggtgctcactaagggtc

SEQ ID NO: 552283 - DNA, 73 bp, Homo sapiens
ccagctgggggtcccgccaagcctcactgtggttcagaggctggagtatgagcttgtgggcctccagcaagag

SEQ ID NO: 552284 - DNA, 73 bp, Homo sapiens
gagcccgcacgctgctcccgggatagcaggcacaggcagacgcagccccagccccgggagcaggtgtgggctc

SEQ ID NO: 552285 - DNA, 73 bp, Homo sapiens
gccctgatggattaactggttccattgtctgtggccgtcattggactatggcactcttaatccgtacagcagc

SEQ ID NO: 552286 - DNA, 73 bp, Homo sapiens
ttgtggcatttggtggggttttttaatgtggcttttttcaaagggtctttaaaatatgccactgaagcagcaa

SEQ ID NO: 552287 - DNA, 73 bp, Homo sapiens
ataggggaaggggtgagttgggaggggttgtaggggctcccttctcccctttccacttcccctggttccctat

SEQ ID NO: 552288 - DNA, 73 bp, Homo sapiens
tgggtccccagggtgggatgctgagagggggctggtaccatctagtcctgctggcagtttgccctgggactca

SEQ ID NO: 552289 - DNA, 73 bp, Homo sapiens
gcagagagaagcagatgggcaataccgagcaaaattttcttactggatattgcccatctgttttcctttttgc

SEQ ID NO: 552290 - DNA, 73 bp, Homo sapiens
gcaagcctgtctttggcatggtctgagcttgggtctgccccagcggtgattagatcatgttatggctagctgc

SEQ ID NO: 552291 - DNA, 73 bp, Homo sapiens
gagtaaggaggaaagtagtatgggatgatgctggagaaggagcagagtcagaccacagctttccttttttttt

SEQ ID NO: 552292 - DNA, 73 bp, Homo sapiens
gaactatgggatgaaaagacaattgaaaaacagacctaggctatgtttccaaatgatttttcatcccctgttc

SEQ ID NO: 552293 - DNA, 73 bp, Homo sapiens
ggcttgcagcacataggttgtttggcaagtggtaatttattattattgccatttagctttgtgtgggttagtc

SEQ ID NO: 552294 - DNA, 73 bp, Homo sapiens
gctccccacagccttagtggaagccctgatattttaatagggcaggggtttcctggaaagttctgtgggtggc

SEQ ID NO: 552295 - DNA, 73 bp, Homo sapiens
cagtggagtctcctgaagaagaggcagaaaaaatgcaggtggttttgtctctattctaggagctgctctcctg

SEQ ID NO: 552296 - DNA, 73 bp, Homo sapiens
aaggagggctccaaagtcggggcgggttgcctgggtcccagctgggccctgctctggactcctggctctcctt

SEQ ID NO: 552297 - DNA, 73 bp, Homo sapiens
gtccaccatgctgactaccaccagacgccatcaagcaaaaggggtgctggaatgtgacgttggcatggtcgac

SEQ ID NO: 552298 - DNA, 73 bp, Homo sapiens
ggcagcaggatggccaattgccatcaatttctgcagcaagtctggcatcatggcatcttggcatcttgctgct

SEQ ID NO: 552299 - DNA, 73 bp, Homo sapiens
ggctggagtcagggagaccactaataattctgtctgacagatctcagctggatttttctctctgactttagtt

SEQ ID NO: 552300 - DNA, 73 bp, Homo sapiens
catttggcagggttcctctctagcatttggtaataattccataccaaatgctagggagaaactctcccaaatg

SEQ ID NO: 552301 - DNA, 73 bp, Homo sapiens
tttgggtcaagacccaaggagcaagctggggaggcttcttctccccccttgcttcttgggttcctggcccaga

SEQ ID NO: 552302 - DNA, 73 bp, Homo sapiens
tcccaaccatctccatcacccggctcccctcctggtccctgctgggaatggggtggtgcatggagaggtggga

SEQ ID NO: 552303 - DNA, 73 bp, Homo sapiens
tgagcagcatggccatcctgggcttcccttaacacgagggctgggattgagcaagggatgggcgggctgctta

SEQ ID NO: 552304 - DNA, 73 bp, Homo sapiens
gccattggagcttggagtccagctgggcagtttcttttatatttgtttagccttaccttcaggttgctgtggc

SEQ ID NO: 552305 - DNA, 73 bp, Homo sapiens
ggactacttgtgaagtagaaatacacttctagttaaatcacagaagtgtgtgttttatttattatagtagccc

SEQ ID NO: 552306 - DNA, 73 bp, Homo sapiens
ttcatctttgtctctccattatgattccttccttccttcctggactagaggaaataatggagggcagggagaa

SEQ ID NO: 552307 - DNA, 73 bp, Homo sapiens
ttttgaactagttattccacacccattatctccagatcaaacaagataatggtgtggaataactatttcaaaa

SEQ ID NO: 552308 - DNA, 73 bp, Homo sapiens
ctctgcctgtgtccctctctgcattaagtcccatgctggggtttgggcatttagtgcaggacacacagaggag

SEQ ID NO: 552309 - DNA, 73 bp, Homo sapiens
ggccttttctctctcttttgttcctgcctaacttcttttgacatcctgccagggccagatggaggatagggcc

SEQ ID NO: 552310 - DNA, 73 bp, Homo sapiens
accagaggctgggagtcagcagcaggaacccagggccagccagtggaggctgctgagattccagatctttggt

SEQ ID NO: 552311 - DNA, 73 bp, Homo sapiens
ccaggcctccaggtgctgccaccacttcagagcaggggaccgacagtccctgggagagtgtctggaggcctgg

SEQ ID NO: 552312 - DNA, 73 bp, Homo sapiens
gtgtgtgtgtgagagagagagtggcccccggtgtcctccatgcttctccctctctctctaaataaatacacac

SEQ ID NO: 552313 - DNA, 73 bp, Homo sapiens
ttgaggccaggcctggggatccagggctgctctgctctgatgagggaggccctggagctgggagtggcctgaa

SEQ ID NO: 552314 - DNA, 73 bp, Homo sapiens
tcatttttctgtgtatctctccagagatgctttatgtatatctaagcaacttggggtggtacaaggagaaaga

SEQ ID NO: 552315 - DNA, 73 bp, Homo sapiens
ggggtcctcagtttccccatccccagtgcccccatgggcaaaacattctacagatgggttgggtgaggatctc

SEQ ID NO: 552316 - DNA, 68 bp, Homo sapiens
acccagcacaaagcaggcaattctgagatctcctttgcctctctgaattaaaccctttgtgcctgggt

SEQ ID NO: 552317 - DNA, 68 bp, Homo sapiens
cttcccagccttattagtcctgcctgaagtctccgctgcttcattggctgatgaggaaggttggggag

SEQ ID NO: 552318 - DNA, 68 bp, Homo sapiens
gaagagatgataaaaagttttgtatgtttggatcctgaggatttgcaaagctttgagtcagcatcttt

SEQ ID NO: 552319 - DNA, 68 bp, Homo sapiens
ttgctggccagaggtgagagctgccctcaggctgcccagggcccactttcaccacctggcctcagcag

SEQ ID NO: 552320 - DNA, 68 bp, Homo sapiens
ctctaggtttttgtctcaagcagacatgtgaatgacagtgctgttggctagatgagaaaggcttggag

SEQ ID NO: 552321 - DNA, 68 bp, Homo sapiens
tgctttaacgctcaaggatgcctctgcttttgattgtacatgggcctgaagcatcctaggttttggca

SEQ ID NO: 552322 - DNA, 68 bp, Homo sapiens
aatcatattctgatatcagcactttggggaatcatgtttcccaatgctgttgattcagcttattgatt

SEQ ID NO: 552323 - DNA, 68 bp, Homo sapiens
cttgattgttgacattggtggcagctgttactgccaatctatcttcaaccaactgtgaacatatcaag

SEQ ID NO: 552324 - DNA, 68 bp, Homo sapiens
tggagtggtcaagtctgtggctggtgtgtttcccctctccctgcaccaggcacaggatctgaactcca

SEQ ID NO: 552325 - DNA, 68 bp, Homo sapiens
cagcaacagtcctgtggagtgggcatgcctcactggggagagcaggtttatttcattggattgttatg

SEQ ID NO: 552326 - DNA, 68 bp, Homo sapiens
gcagaaagaaccctgggcctcatgcgtcttatgattcccatgagaaggctggggtctgggtgttctgc

SEQ ID NO: 552327 - DNA, 68 bp, Homo sapiens
ggaagatgacaatgctaatgatgaattcacggaggaaatgcattagataaagcagattgtcatctttt

SEQ ID NO: 552328 - DNA, 68 bp, Homo sapiens
tttcttccctccgtttcccattgccagcatgtaggttaagtggaggtaaggaagatggagctaagaga

SEQ ID NO: 552329 - DNA, 68 bp, Homo sapiens
aggcttgagaatcaaagcttctcccaagcctcccaaaccgaggcttgggagaaggtttctttctccct

SEQ ID NO: 552330 - DNA, 68 bp, Homo sapiens
cacccacaatatacctgtgtgggtgagcttaaaggaaggaaaaaactggataggttatatcgtgggtg

SEQ ID NO: 552331 - DNA, 68 bp, Homo sapiens
ctgggctctgttgtgtggcctcatgtgccaggttgactttgggacagaggcacagatgataggcacag

SEQ ID NO: 552332 - DNA, 68 bp, Homo sapiens
aacagcaatgccttatctatggttctctgtgcatctgggtgtggaggcatgaaaaaggtattgctgtt

SEQ ID NO: 552333 - DNA, 68 bp, Homo sapiens
ctggctggtctgtgcttctaggtacaatggtatgtgtcaccttgtatacagaagccatggattgtcag

SEQ ID NO: 552334 - DNA, 68 bp, Homo sapiens
gcccctgccccgcccccccaggcccagtaatgggtgggtaatgagtgctgggggagcgggggaggggc

SEQ ID NO: 552335 - DNA, 68 bp, Homo sapiens
ggatatcataaaggtggcgatggtatgtcactatccggtgaaactgcttgccttccttcatgatttcc

SEQ ID NO: 552336 - DNA, 68 bp, Homo sapiens
ggccaggtgttgggaagtgccaggaagaggagggtggccatgcctggccatttcctgatacctgtgct

SEQ ID NO: 552337 - DNA, 68 bp, Homo sapiens
agtctattccaggtagacaggcctgcagggggtccaacccctacaagcccctctgtctggaatagact

SEQ ID NO: 552338 - DNA, 68 bp, Homo sapiens
ctaatggcctaataatgcattagacttgaatcagaaatactttgggttgtagtgcttattgccattag

SEQ ID NO: 552339 - DNA, 68 bp, Homo sapiens
cggtgactgacaagcctttcgctgagtagttacaaatgggactaatggtttaaacttgttagtcattg

SEQ ID NO: 552340 - DNA, 68 bp, Homo sapiens
acaagttattggtttaattatagaaagctgaactttcatctttctttaattgagcatggataatttgt

SEQ ID NO: 552341 - DNA, 68 bp, Homo sapiens
agctgcagttcgccaggcgcgttcccggagtgggtgtgggatccgggacgcccttggggagcagagct

SEQ ID NO: 552342 - DNA, 68 bp, Homo sapiens
acacaaagctaaggtgcctgtgtttattctgtgttggagagtcaacaaaggctgcctctgttttgtgt

SEQ ID NO: 552343 - DNA, 68 bp, Homo sapiens
gggacattgcttgatgattcatagtaaggtcctttagacattaatgtgagttatctaagtacagtcct

SEQ ID NO: 552344 - DNA, 68 bp, Homo sapiens
gataaatggcttctcagtttcataatgaaaggaatatttcattttgcagagctgaggaactgtttatt

SEQ ID NO: 552345 - DNA, 68 bp, Homo sapiens
tcatgacccagctcttttcctgttcttcttttgagactttcctaacaggaaaggctctgggtaattga

SEQ ID NO: 552346 - DNA, 68 bp, Homo sapiens
caggaaatggtgcactctgctctgatacgtattaacagttgtcgttagcagagtcaccgtgtttcctg

SEQ ID NO: 552347 - DNA, 68 bp, Homo sapiens
gctcacgtctgacttctcctgggatcaatagactatcctgcggtcccacagaaaagacaggcaagagc

SEQ ID NO: 552348 - DNA, 68 bp, Homo sapiens
ggggccagcctcatcccactgccagctgaccctcagttcctcaaagacagtgagtgaggacaggcctc

SEQ ID NO: 552349 - DNA, 68 bp, Homo sapiens
gaggtaattatccaggtaatttagggaaaataaactgccattacctgaattattcagataattacctc

SEQ ID NO: 552350 - DNA, 68 bp, Homo sapiens
gcccgtggctggaggacctcgtgtcgtacctagagtcccttcaggacggccgactgccagccatgggc

SEQ ID NO: 552351 - DNA, 68 bp, Homo sapiens
caatttggctgcaggggagtagtggctgggattagccctgttctgctacttacttgcattttaagttg

SEQ ID NO: 552352 - DNA, 68 bp, Homo sapiens
ggtaaggatttgtgggcgcaattcatgatgagagccagcgtggaaattgtgcctccagatacccaacc

SEQ ID NO: 552353 - DNA, 68 bp, Homo sapiens
agtgaggattgacttgaagagtaggatggtaaattgtactgattctactgaattaatcatttctcatt

SEQ ID NO: 552354 - DNA, 68 bp, Homo sapiens
ggttagttaataagattggaagaaacgaatattattgtttcagaatcttccagtcttatctacttatc

SEQ ID NO: 552355 - DNA, 68 bp, Homo sapiens
tgttgaacaggccccctgggagcttggtgagcagctctcgctccgtgctttcagggtcgctgtcaaca

SEQ ID NO: 552356 - DNA, 68 bp, Homo sapiens
gtggttttcctttctgacccttctcattgaaaccttgggagaaaaggggaagaaagccaggatgtcac

SEQ ID NO: 552357 - DNA, 68 bp, Homo sapiens
aattcttcaactctgtgatgaaaggatgagctccctctgtgatcatcacttactaggattgaagaatt

SEQ ID NO: 552358 - DNA, 68 bp, Homo sapiens
catctttgtggctcctggttgctaggagcaggtgcttctgttactaagcaacaggagcctgttggatg

SEQ ID NO: 552359 - DNA, 68 bp, Homo sapiens
attgatcaaatttctttttgtgcatgtgagttttattttgtatgtgcaaagaatttatttggatcaat

SEQ ID NO: 552360 - DNA, 68 bp, Homo sapiens
gatgatcatgtgtggttgtgtgtttgtgcagttgtgtgcatgtgcagggcattgttagacatgacatt

SEQ ID NO: 552361 - DNA, 68 bp, Homo sapiens
tcactcctcttccttttaattgcaattgacccttcagaaatcaagtaaattaagggggaggggaaaga

SEQ ID NO: 552362 - DNA, 68 bp, Homo sapiens
tggaggatgggggaggcaaagccaagtttttggtgacattagattgattttggtacccacctcctcca

SEQ ID NO: 552363 - DNA, 68 bp, Homo sapiens
gggggctgtgtcactgtgggcatagaaagtagtactattacaatattctcacagtgacacaagccccc

SEQ ID NO: 552364 - DNA, 68 bp, Homo sapiens
tgtattggagttcttctcttctgtaatacacaaatatttggagatgaagaagagaaggctaaagtaca

SEQ ID NO: 552365 - DNA, 68 bp, Homo sapiens
tcgttttctactttcctacattgctgtgggccaggagagccctggatgtaatggaaagtggggagggg

SEQ ID NO: 552366 - DNA, 68 bp, Homo sapiens
agattggtcataaggtctgcttagatccaaaatgttctgtgatcttaggcagttctttgtgctgctct

SEQ ID NO: 552367 - DNA, 68 bp, Homo sapiens
cctcttcccaaattcatgtcactgggttacaagagatggaatctaagtgagatgagagggactgaagg

SEQ ID NO: 552368 - DNA, 68 bp, Homo sapiens
ggaaacaaagccctttatcaagaataattaactcttcccttttctttttggagaggtgctttgtttct

SEQ ID NO: 552369 - DNA, 68 bp, Homo sapiens
tttctcttcctaacgccagtctgctgaggttcaaaacgtgtcaccccaggctggattggggagaggga

SEQ ID NO: 552370 - DNA, 68 bp, Homo sapiens
ttctcctgttgcatctgtcatatattatgcaattaggcagaatttggtgatagattaaaaagggagag

SEQ ID NO: 552371 - DNA, 68 bp, Homo sapiens
ttgttccctctttcctctgtatgttagcttggccaaaaaagatgcttacgtaaggaggaagggaacag

SEQ ID NO: 552372 - DNA, 68 bp, Homo sapiens
gctggctgtcctctgtgaagataagaaatctggtgacaagttatatgtggtctttgaggcagctcagt

SEQ ID NO: 552373 - DNA, 68 bp, Homo sapiens
ggttcatgaattcctgcagtttcagctgtcaggacttttcaagcagaaatgccaggaatttatgtacc

SEQ ID NO: 552374 - DNA, 68 bp, Homo sapiens
agtctattccagacagaggggcttgtaggggttggaccccctgcaggcctgtctacctggaatagact

SEQ ID NO: 552375 - DNA, 68 bp, Homo sapiens
cagtttaggagaagaacaagccttcttttatatcatttgtgtctaagaaaatgttctcttctagattg

SEQ ID NO: 552376 - DNA, 68 bp, Homo sapiens
gccaaatgtttctgaatatccacatttcagtataggccctaatactgaggatgtttagaacctatggt

SEQ ID NO: 552377 - DNA, 68 bp, Homo sapiens
cagctttctagggcacagacagtgcaaaatggctcaggccagaatgtagtttaggtttcagaagggtg

SEQ ID NO: 552378 - DNA, 68 bp, Homo sapiens
agattttgtcaccatggcaactggtcattggaccaatgaaataatcagttgtcatggtaacatgatct

SEQ ID NO: 552379 - DNA, 68 bp, Homo sapiens
cggctccggggttcacgctcgggggtcccggctcgagcctctacccggcccgcgtgaaccctgggccg

SEQ ID NO: 552380 - DNA, 68 bp, Homo sapiens
agtcagagacagacctaggggaaaaaagaagagaaacatggattctaacttgggctctgtctctaact

SEQ ID NO: 552381 - DNA, 68 bp, Homo sapiens
tcttttgcataatcatttatctgaaaggacaagaaataatttgcaatttcagagtgtgatgcaaaaga

SEQ ID NO: 552382 - DNA, 68 bp, Homo sapiens
acagaagccacttagagcgtaatattaacactgtacatcaatgtcgtcccgctctaagtggcgcatgt

SEQ ID NO: 552383 - DNA, 68 bp, Homo sapiens
ccacttttgcctctaggtgtattgcaaatttagatgtcttctatgtaatacctgtaggtgaaagatgg

SEQ ID NO: 552384 - DNA, 68 bp, Homo sapiens
cggctccggggttcacgctcgggggtcctggctcgagcctctacccggcccgcgcgaaccctgggccg

SEQ ID NO: 552385 - DNA, 68 bp, Homo sapiens
agggaagacttcgttagagagtaatcacctttgagtcacagaaggcagctcctttatgaagtctccct

SEQ ID NO: 552386 - DNA, 68 bp, Homo sapiens
cccgtaactaggatgttggggaattgtaccttatttgggggtgcatttggaaacgtcctagttatggg

SEQ ID NO: 552387 - DNA, 68 bp, Homo sapiens
atggagctgtaagtacttaggagggagacttttccagcagtctctctcttgggtatctgagtgtctat

SEQ ID NO: 552388 - DNA, 68 bp, Homo sapiens
gactctgctctgatggtgcttttggggtaggggctgaactctacccagggagtcaaaggagaagggtc

SEQ ID NO: 552389 - DNA, 68 bp, Homo sapiens
ctatattccattatcttcctctgcccttgaacagttgataatatgggggatggggaagagaggaagag

SEQ ID NO: 552390 - DNA, 68 bp, Homo sapiens
ggtttgtagttaccgtgtgtatgtgtatgtgcacacacaagttcacacatatataggaacagcactcc

SEQ ID NO: 552391 - DNA, 68 bp, Homo sapiens
ggccttttctaacaaagaagctgcatttaagagccttagggatgaagtgcccttttttggaggaggct

SEQ ID NO: 552392 - DNA, 68 bp, Homo sapiens
tgatttgttttggagatggatttatgccaatcaaatgaatgcatgaataccatcctcacaagggatta

SEQ ID NO: 552393 - DNA, 68 bp, Homo sapiens
tttggagttaggcccaagaaccagggtttgaagtcttctggtctcagggctttgggcctggctttgga

SEQ ID NO: 552394 - DNA, 68 bp, Homo sapiens
gtgagttttctaataagtcacatctttttcatgtgagtggtgagcagtgacttattgtaagaattcac

SEQ ID NO: 552395 - DNA, 68 bp, Homo sapiens
caagttagagcaatgtgtaggagaggcccaaatatgtttggcctgcttaaacacatgctttctgcttg

SEQ ID NO: 552396 - DNA, 68 bp, Homo sapiens
ttgccatgttagatattgatttcatcatttctgaccctggaaaatacaatcgatgtttatcatggcag

SEQ ID NO: 552397 - DNA, 68 bp, Homo sapiens
atgagttagcccgtttcaatagagtccaaccccagtataaacttctgaatgaaagagggcctgctcat

SEQ ID NO: 552398 - DNA, 68 bp, Homo sapiens
ggaaggcagagaggcttggctctgaagggtaggcaccaatccaggcccggccctcctctctcccttcc

SEQ ID NO: 552399 - DNA, 68 bp, Homo sapiens
tggtgtgaaagggacagagagggtcgcttcaaatcgattttacttgtcctttctgtcttttcggatca

SEQ ID NO: 552400 - DNA, 68 bp, Homo sapiens
gggtagggaggaagcttgttttgctgagatgagggcagttgcctggcaaaaccttgtccttcctgccc

SEQ ID NO: 552401 - DNA, 68 bp, Homo sapiens
aggctacccccaaaccttcagctgctcagagtcctgctggaggggcttgtgagggtttggagtgggct

SEQ ID NO: 552402 - DNA, 68 bp, Homo sapiens
agcatgagcttagaagtcaggcaggcctgggttttaattctagcactgccgttttctaactatatgct

SEQ ID NO: 552403 - DNA, 68 bp, Homo sapiens
ctcagagtaacagttggcttacatcttcagtgattcgtctgcaaggtgtatacgattgtgcttctggg

SEQ ID NO: 552404 - DNA, 68 bp, Homo sapiens
ttcatgggtatatagtggctttccattgaggttttcactctttgaaggaggtcatttataccaatgag

SEQ ID NO: 552405 - DNA, 68 bp, Homo sapiens
tatttactctgatttcggacttcagtgtaagtgagcccacaagctgaagtcccaaactggagtggata

SEQ ID NO: 552406 - DNA, 68 bp, Homo sapiens
agccagaaagaggcacatttctagatgattagagaacttcaggtgggaacgttactctgcttctggct

SEQ ID NO: 552407 - DNA, 68 bp, Homo sapiens
gctttctgacatggtagacttttggtggaactagttatcagccaaaagactgctcatgggaagatagc

SEQ ID NO: 552408 - DNA, 68 bp, Homo sapiens
ggaatcatctctctgcccacagtttcattccagggacctgaagggatgggggtggggtggagcagaac

SEQ ID NO: 552409 - DNA, 68 bp, Homo sapiens
gggagacagcaggtgcttgggaaaggccgagctctgggctttcctttcccaagccttgcttccctccc

SEQ ID NO: 552410 - DNA, 68 bp, Homo sapiens
aacctatctgagtggttaagtgagcatactttttgacctgtatgctcatttaaccatttagataagtt

SEQ ID NO: 552411 - DNA, 68 bp, Homo sapiens
agaccgattctgaagtgtcccctcagcaagctgaggtaaagtcattctggggggtatgagagttggct

SEQ ID NO: 552412 - DNA, 68 bp, Homo sapiens
tcccagagccggcctgctgtggagggacttcctgggtatcagggtccccacggctggcgggctcagga

SEQ ID NO: 552413 - DNA, 68 bp, Homo sapiens
tgttgaacagtcaccctgggagtttggtgagcagctctcgctccatgctttcagggtcactgtcaaca

SEQ ID NO: 552414 - DNA, 68 bp, Homo sapiens
gggcagggcaaactctactaagacctttgtcagagttgctgcaggtttgggtggagagtgtcctggct

SEQ ID NO: 552415 - DNA, 68 bp, Homo sapiens
ctctttcccagggagcttctgagaattaatgagacaattgccaagtgcttgaagctccttgggaaaag

SEQ ID NO: 552416 - DNA, 68 bp, Homo sapiens
cgcaccaccctcccactgtggtttctttgtgtccgttataggaggagccaaggtggcagagtggtgtg

SEQ ID NO: 552417 - DNA, 68 bp, Homo sapiens
tttccacattctcactcaggtgcagtctcttttccaggtggagattgctccacaagtgaggatggaaa

SEQ ID NO: 552418 - DNA, 68 bp, Homo sapiens
atatgttatcactgtgtgagctgaaagtaaccatttggtatgatgcagctaacattctggttacgtgt

SEQ ID NO: 552419 - DNA, 68 bp, Homo sapiens
tctccactgcctcttcctcctgtagcactagcattcaaagtgggtcttgctgggacggaggggcagga

SEQ ID NO: 552420 - DNA, 68 bp, Homo sapiens
gggtggggggtgagcagcccctcggtgtccgcctatgcctggacctgaggtttgactgccccccaccc

SEQ ID NO: 552421 - DNA, 68 bp, Homo sapiens
tctgctgggcattttggggtgggagaagattctagatacttctccaaactccaaaatgaatatgcgga

SEQ ID NO: 552422 - DNA, 68 bp, Homo sapiens
cagccagttccaaggtccacaggtaccttcctctttgggggtcaaggcctgtgggcttgggtgggctg

SEQ ID NO: 552423 - DNA, 68 bp, Homo sapiens
ccacagcctagcttgggtttactggtctctggaatggggtggagactggttcctatgccaggctgtgg

SEQ ID NO: 552424 - DNA, 68 bp, Homo sapiens
agctgcaaccaggcggcctgtgggagagcactaaggaaggccagcctgcaggtccagctgttgcagct

SEQ ID NO: 552425 - DNA, 68 bp, Homo sapiens
catagctgccaagggaactaaaaggtttcttttaaatgaattctcctttggttttctcttggcggaag

SEQ ID NO: 552426 - DNA, 68 bp, Homo sapiens
gggtcccccatcctcgaccatctttgtttgccctattagggggagcaatggcgagggaggggagagct

SEQ ID NO: 552427 - DNA, 68 bp, Homo sapiens
tcagcagctaaagagacaatctgatgtgtgatgtcttaactttgccatctattgctctttggtgatgg

SEQ ID NO: 552428 - DNA, 68 bp, Homo sapiens
gtgtgtcctagtcaggagaggcaggttctgtgcaaaacgcactccccacctcgtccttgaggatccac

SEQ ID NO: 552429 - DNA, 68 bp, Homo sapiens
gcctcttgacctcctgggacagttcttcctttgggaggggcaggggtcaggcaggaggctcagggggc

SEQ ID NO: 552430 - DNA, 68 bp, Homo sapiens
ggggacaggagggcgccggatctatgcgccccttagcagcagatcgggatccttttgcctcctgcccc

SEQ ID NO: 552431 - DNA, 68 bp, Homo sapiens
tgcactcccctactgagtcctgagacctgagtgcaccccatagagtaggactcagatgaggggatgca

SEQ ID NO: 552432 - DNA, 68 bp, Homo sapiens
ctcgcctgaactcattactgctctgataaatgactcattagcattgtaagaaatgggttgcaggcggg

SEQ ID NO: 552433 - DNA, 68 bp, Homo sapiens
gtctagtcatacccaccccagacctttgaaagtaccaatgaagaatgttctggggttgtggactaggc

SEQ ID NO: 552434 - DNA, 68 bp, Homo sapiens
aatcctgtgatttccaacattgcaatgactatgaattcaggcagatggaatttggagactacaggatt

SEQ ID NO: 552435 - DNA, 68 bp, Homo sapiens
ttcaatctcttcaccttgagccctgggcagttagaactcatctctgggcggcagggtggggaattgga

SEQ ID NO: 552436 - DNA, 68 bp, Homo sapiens
tccccctggttgctatgttgggagtggtctgtagggggccaaaggagaagcagagagaccagtgggga

SEQ ID NO: 552437 - DNA, 68 bp, Homo sapiens
attaattgcaagtggtccttgtttagggtgaattaacaaccccaactagcaaggttctagcaattaat

SEQ ID NO: 552438 - DNA, 68 bp, Homo sapiens
ccagccccctgctgcccagtgtgtctgggcctggcacctctcccagactatgggcacaggttagctgg

SEQ ID NO: 552439 - DNA, 68 bp, Homo sapiens
ggctgtggggattgttgcttattgtctgagttccccaactggagctaagtggccagtcctgagcagct

SEQ ID NO: 552440 - DNA, 68 bp, Homo sapiens
taaattagacctcattacctagccagttgggctgcccggctctcctgcacataatgaggtctgattta

SEQ ID NO: 552441 - DNA, 68 bp, Homo sapiens
gggcgctccagtctcgacgttcccggggtagagagcaacgtccggggacgaacgggacgggtgcgccc

SEQ ID NO: 552442 - DNA, 68 bp, Homo sapiens
ggacagacaggggttctcctggagtaccagaaagtgtagttgtactgcaggggatgctctgcctgtcc

SEQ ID NO: 552443 - DNA, 68 bp, Homo sapiens
cagtggagagataagactggtaattaaggaggagttattgtgctaaagctggtcttccctttccactg

SEQ ID NO: 552444 - DNA, 68 bp, Homo sapiens
gaagagcagccagtttgattgtgttgagatcagtcattcgcaacatggttaacttctggctccccttc

SEQ ID NO: 552445 - DNA, 68 bp, Homo sapiens
accttattccctccacattggtcagctcaaggaattcccttttgaacagggtgggggaatggaaaggt

SEQ ID NO: 552446 - DNA, 68 bp, Homo sapiens
cgtcctgcctcctctcctggtctaagctggggaggaaaaacccatcttggccagcagggggcggtgtg

SEQ ID NO: 552447 - DNA, 68 bp, Homo sapiens
ttgttttattgctactgttcattgatttatcgaagtgatttattgacgatggacatgcagtacaacaa

SEQ ID NO: 552448 - DNA, 68 bp, Homo sapiens
tggggctgtgttggggacctgagcagagtgcaacccagcatgtctggggcctccccaacctgacccca

SEQ ID NO: 552449 - DNA, 68 bp, Homo sapiens
ccagtggtttctgactaccgcttagggcaattttgcttagcctagcggaatgtcctggaaactactgg

SEQ ID NO: 552450 - DNA, 67 bp, Homo sapiens
ccaggggctccagctaccccattcacccctgcacccacagcagtggggtcaggcttggggcccaggg

SEQ ID NO: 552451 - DNA, 67 bp, Homo sapiens
atactgaagtgggggctctgaagggccatttggtggatggtaacctttggaagtccctgactagtat

SEQ ID NO: 552452 - DNA, 67 bp, Homo sapiens
gccagctggcccaagaatagctggccagtggccttgcttttggctggccactcttgggaaagctggc

SEQ ID NO: 552453 - DNA, 67 bp, Homo sapiens
gagaaaatgggcccacacattggagctctgaaatgattttggtctttgatctgtgtgcccatctctc

SEQ ID NO: 552454 - DNA, 67 bp, Homo sapiens
agagcttgctttctccctggccaggagctcaaagtgaacttcctcgcctggggtgaagtcatcctct

SEQ ID NO: 552455 - DNA, 67 bp, Homo sapiens
tctctagagagcctggtgttcacgcccaggacaagccctggggaaatgagagccaagctcctgggga

SEQ ID NO: 552456 - DNA, 67 bp, Homo sapiens
ggatctgtgtatgtttgtgtattgcttgtactgtcctacttggtttccatatgcatacatagtgtcc

SEQ ID NO: 552457 - DNA, 67 bp, Homo sapiens
cttaacctcctcccctctgatttgaaaaagtccatttgactttagatcagaggaagaagtagttgag

SEQ ID NO: 552458 - DNA, 67 bp, Homo sapiens
ttggaggattcaggagcagcctcccagagcaccctgattgttctgctgtccctgactgtcactccga

SEQ ID NO: 552459 - DNA, 67 bp, Homo sapiens
aggcactcaataaatagtcattggtgataaattccttattcttccagtgaatatttattgagttcct

SEQ ID NO: 552460 - DNA, 67 bp, Homo sapiens
tcattaagatggatgaaataaccatattgactgtttagtgagctggttatttcagtaatcttaatga

SEQ ID NO: 552461 - DNA, 67 bp, Homo sapiens
aggatgacccattttaagcagttccctttgaaagtgttgaacaggagctgttcaaatgagtcactct

SEQ ID NO: 552462 - DNA, 67 bp, Homo sapiens
acatcttgaaggttctaccatacatgttcatcactaaggctgctgtatggtaggggttttgagctgt

SEQ ID NO: 552463 - DNA, 67 bp, Homo sapiens
gcatctggcctcctgcctgattcaaatcgaacctaacctgatgtctttcaggtgggggcacatatgt

SEQ ID NO: 552464 - DNA, 67 bp, Homo sapiens
gggcagcagcctcttgggaggggaggtgccaggtcagaggcagcttccagcctgggggctggtgacc

SEQ ID NO: 552465 - DNA, 67 bp, Homo sapiens
aggacggggtgtcctggcccagcctgggtgtgaggcccatccgcggctctccaggacaccccgccct

SEQ ID NO: 552466 - DNA, 67 bp, Homo sapiens
tcctctgcagtatcctagccacagtaggaactcttcacaagctttctggctgggatattcaagggga

SEQ ID NO: 552467 - DNA, 67 bp, Homo sapiens
gggaaacacaagagcaaggtgctgaggtaaaaaacacctgaggcagctttttctgtgtgtttttccc

SEQ ID NO: 552468 - DNA, 67 bp, Homo sapiens
tgaggtttggagcgggggaggccacactctcagattcaaaccctggctcatcccactcccaaaccca

SEQ ID NO: 552469 - DNA, 67 bp, Homo sapiens
acaaagttgcagatagtaagtaagttatctaaattcttagaaaatcaattcactgctgcagccttgt

SEQ ID NO: 552470 - DNA, 67 bp, Homo sapiens
accacctctagatgtacttcttggctcacctggcaaggaagacgaagaggtttgcaactaaggtggt

SEQ ID NO: 552471 - DNA, 67 bp, Homo sapiens
ttttagataggccagtttggaccaaagattgtctctttcttacagaaccaacaaggcctgtctaaaa

SEQ ID NO: 552472 - DNA, 67 bp, Homo sapiens
gggtctcattaggaggaggctgtcagatgagctcagcgtctggtgggtcattcctccaatgagatct

SEQ ID NO: 552473 - DNA, 67 bp, Homo sapiens
cagtggagaagggaccgggaaggaagtaattggaaatctctcttcctcccaggttctatctcctctg

SEQ ID NO: 552474 - DNA, 67 bp, Homo sapiens
gtagtggtgcatgctgggaacacagcctctctttaacacactctgcattcccagctttcaccactat

SEQ ID NO: 552475 - DNA, 67 bp, Homo sapiens
catttggatgtgtaatgattatgttgttgggaaaaagtaactcacatggtaagtatacatcccagtg

SEQ ID NO: 552476 - DNA, 67 bp, Homo sapiens
gtcatagcattgggagatgaattaaccttcgacatggagagagggattcgtctttcaattttataac

SEQ ID NO: 552477 - DNA, 67 bp, Homo sapiens
gtcagattagagaggggaatgggaaatttgttgatttttttgtctattctcctctgtattgtttgac

SEQ ID NO: 552478 - DNA, 67 bp, Homo sapiens
tcagtttgaggatctaagacagatatgccaatggaaagattattgtcttaggtcttacaaaacctga

SEQ ID NO: 552479 - DNA, 67 bp, Homo sapiens
cccgtcgaggctgggcagtcagggggcctttacagacaatgggtcctttgagctgggtcttcatggg

SEQ ID NO: 552480 - DNA, 67 bp, Homo sapiens
gccgggagaggcggcgcaggggcccagtccaccgagcgccgggcggcccttgcctgcactcctcggc

SEQ ID NO: 552481 - DNA, 67 bp, Homo sapiens
cgtggtggggaagaagtgggggcagccacagagccaggctgtccctggcttctccttctccactgtg

SEQ ID NO: 552482 - DNA, 67 bp, Homo sapiens
cggggcctgggccaccacaggggaaggatgctgctcagagcccacagacctgggtgcccgggccccg

SEQ ID NO: 552483 - DNA, 67 bp, Homo sapiens
gggggacacttgtctgagattggatggctggtaagatggcggttcccagttgtttccaaggtctcct

SEQ ID NO: 552484 - DNA, 67 bp, Homo sapiens
ttctttatttgtaaggcagggccagtaaaaccataaatattactggctctgctttacaaacagggaa

SEQ ID NO: 552485 - DNA, 67 bp, Homo sapiens
gggtcagagatttcaaagggaggcaggagtccctgtcctatgtctcttctttggacctttctgattc

SEQ ID NO: 552486 - DNA, 67 bp, Homo sapiens
gggtccggggggctgcggccgcccggcgtcccgctctggggggccgggaccgcagcgctcacggccc

SEQ ID NO: 552487 - DNA, 67 bp, Homo sapiens
ggctcagctgcggtgcagcgtgggtcgtcatcgctctcacggcccacactgtattcgtcagctcgcc

SEQ ID NO: 552488 - DNA, 67 bp, Homo sapiens
gtacgtatctccctccccactgcgctgttttgtcaatcctgcgtagttggtggggggaggtagttac

SEQ ID NO: 552489 - DNA, 67 bp, Homo sapiens
cccattattgttccttagaaccatgcctgacacgtaattgtggaaggaaggaaggaacagtcatggg

SEQ ID NO: 552490 - DNA, 67 bp, Homo sapiens
tcatttgaggaacagctggggtggaatgaatcacatttggtttgggcctcagcatttccacagatga

SEQ ID NO: 552491 - DNA, 67 bp, Homo sapiens
aaccgcactggtccaggcaagcataacaagagtcagaacagtagtgcttgctggggttgaggcggtt

SEQ ID NO: 552492 - DNA, 67 bp, Homo sapiens
gtatgtaaagctttcagtgcaatgccttgtatttggcaagtgcattgtaaatgggagtattatctac

SEQ ID NO: 552493 - DNA, 67 bp, Homo sapiens
ttttcttgatttttttccctgtggccttttcaatgataaaggcatttaggagaccagaataagaaaa

SEQ ID NO: 552494 - DNA, 67 bp, Homo sapiens
gttatggtgactctggtgtgttaggaacctctatgaaaatttaatgacacccatatctcaccatgac

SEQ ID NO: 552495 - DNA, 67 bp, Homo sapiens
ttgttactatttggatgttagcctcagtccataaagggacttgctacacatcatcaaacagcggcaa

SEQ ID NO: 552496 - DNA, 67 bp, Homo sapiens
agtctcatggcttctgtcttggaaactttacctttaaaagattatttaagacaggaaccaggaggtt

SEQ ID NO: 552497 - DNA, 67 bp, Homo sapiens
gtcatcatctctggtactgcttttgcgcttcctgtgcattgccaaggtagtcactggggatgtaagc

SEQ ID NO: 552498 - DNA, 67 bp, Homo sapiens
gcaaccagatcagcttttgagacaaatgtgaatcaaccacaacactcagctcagctgattttgttgc

SEQ ID NO: 552499 - DNA, 67 bp, Homo sapiens
tcttcattttacaggcagacctgtctaactacaagccagacttgggttttctcctgtagtttgaaga

SEQ ID NO: 552500 - DNA, 67 bp, Homo sapiens
gacttcaggatgctcacagtccagtgtccaggcagaactgggccatggctgctggccatctggagtc

SEQ ID NO: 552501 - DNA, 67 bp, Homo sapiens
gaggccctgtgcaaagcaggactttttgttgctttatccaactgtgcagtcctgtgatgtgggcctc

SEQ ID NO: 552502 - DNA, 67 bp, Homo sapiens
gggtgtgtggggttatgtgtgtgtgtagcctagtgacaccagcacccccacaccggccccaccaccc

SEQ ID NO: 552503 - DNA, 67 bp, Homo sapiens
taaataattcctaggcaatatttagaatggctgcaagccatttttagaattggctgagaattattta

SEQ ID NO: 552504 - DNA, 67 bp, Homo sapiens
gtgtgaattgcctgctgtcagcctggagttctcacctccgcaatcctggctgcaggcatatttgcat

SEQ ID NO: 552505 - DNA, 67 bp, Homo sapiens
gtctaggtccaagattccaggtcttgataagtgtgacttttgggatttagatctaaggacttaagac

SEQ ID NO: 552506 - DNA, 67 bp, Homo sapiens
ctgggggccctggtagaagctgcctgtttgtgttcgagctgcagccttttctcagagcggcctccag

SEQ ID NO: 552507 - DNA, 67 bp, Homo sapiens
acagctgcaagtgttgcctcctacatgttgttaatttagaggtaatcaggtttgcatttgcagctgt

SEQ ID NO: 552508 - DNA, 67 bp, Homo sapiens
ccccaggagggcctctctgattttgcccaacttctctggactgcctgatagagcttgccctctgggg

SEQ ID NO: 552509 - DNA, 67 bp, Homo sapiens
tcctggtcccttcatcctcagccctgacgcctggccccagccagctgagcagtgaaggagaaaagga

SEQ ID NO: 552510 - DNA, 67 bp, Homo sapiens
cccggttttcccagcacctcctcctgccctactcttcagtattaattggggtgtgctgggagaaggg

SEQ ID NO: 552511 - DNA, 67 bp, Homo sapiens
gcggggggagggtggcggaggccgggtgtctcggaggtgacggccggtcctcgctctctccccctgc

SEQ ID NO: 552512 - DNA, 67 bp, Homo sapiens
gggggacaggcctgagacatctgagataataaagacatgattgtctcagccctggggcttgtctccc

SEQ ID NO: 552513 - DNA, 67 bp, Homo sapiens
atcccaccgtctctgcacagacctcctcaaagccaagggcaggggtctgcagaggtgggtgagggat

SEQ ID NO: 552514 - DNA, 67 bp, Homo sapiens
ggactacgtgtcccggcatgccctgcgtcctgccactgactgtgaggcatgctgggatttgtagtct

SEQ ID NO: 552515 - DNA, 67 bp, Homo sapiens
gaggcaagcatttacattgagagagtgcttaaaatcaagactaatttcttcattgttgctctgcctc

SEQ ID NO: 552516 - DNA, 67 bp, Homo sapiens
cccatgcttattttcgtgtcttagaaagtgttgcagacctgcgctgagacatggagtagagcctggg

SEQ ID NO: 552517 - DNA, 67 bp, Homo sapiens
tccccaaagctgtcatattaagttgttttgatccttcttctagtacttctgtggctggctttgggga

SEQ ID NO: 552518 - DNA, 67 bp, Homo sapiens
ggatgactgatgtctggggcagagtctagctttttagaaggcagactcttcctccgacatcctctcc

SEQ ID NO: 552519 - DNA, 67 bp, Homo sapiens
ccaggaccttggacagacctgccaagtgaggaaacacttctcacttggcaggtgttgggaggcctgg

SEQ ID NO: 552520 - DNA, 67 bp, Homo sapiens
acctgctagatcctttttaggcatccccatttgtcttcctgccatgaaaagaggggatctagcatgt

SEQ ID NO: 552521 - DNA, 67 bp, Homo sapiens
gttcacacctatgaattcctggagtggccagagaacatgttactactccagggtcaatggtggaagc

SEQ ID NO: 552522 - DNA, 67 bp, Homo sapiens
tccttagcactgtctactctggatttctaataaagagaagggaaatcgagggtgaactgtgctagga

SEQ ID NO: 552523 - DNA, 67 bp, Homo sapiens
cggccctgtgaggagttgggttcggcctgtcccagacaggccttgcccacatcccatcacagggccg

SEQ ID NO: 552524 - DNA, 67 bp, Homo sapiens
ggagttctacatttgttgatgattatgtacagactgatgtctgtctgccccattgaatgtaagctcc

SEQ ID NO: 552525 - DNA, 67 bp, Homo sapiens
cccttctgctctgttttctaatagtatacattcatttgttctattcagagtgtaagagctagaaggg

SEQ ID NO: 552526 - DNA, 67 bp, Homo sapiens
ctggaggtcccagggtggttgggccctgggagggtgtgggcgaggtgggccgtcctgggagctctgg

SEQ ID NO: 552527 - DNA, 67 bp, Homo sapiens
gccccttccagtccttctcggatgaagcacagttgccggttacgcttccgaggaggacggaaggtgc

SEQ ID NO: 552528 - DNA, 67 bp, Homo sapiens
gatatctgttctctccacatgtcagcacccattcatgtcatggtttggaaatggggagaacagattc

SEQ ID NO: 552529 - DNA, 67 bp, Homo sapiens
ggagagagagttataaagaaatcatttcaactcacatctttgaaatgacctatataattctttctcc

SEQ ID NO: 552530 - DNA, 67 bp, Homo sapiens
tctcttggtgtaattaaagtgatttctggttttgtgaagggcagaaattacgaagttaggccagagg

SEQ ID NO: 552531 - DNA, 67 bp, Homo sapiens
cttcccatcctccatgcatgggaatctatgaccaaacatagatttccacaggatggtgggtgggtgg

SEQ ID NO: 552532 - DNA, 67 bp, Homo sapiens
ttccatatgcagatgtgaaacagataaagttctttcccacttgattctgttgacatggcatgtggaa

SEQ ID NO: 552533 - DNA, 67 bp, Homo sapiens
agggcctgcggtgggccaggtgctcgggtcagggagcagaaaggcgatgtggcccacctgaggtcct

SEQ ID NO: 552534 - DNA, 67 bp, Homo sapiens
gttcctctttcccagccctgcttgggtgtgggtgaagcttacaagccacgtaggtgggagacagagc

SEQ ID NO: 552535 - DNA, 67 bp, Homo sapiens
ctttgaggtcttggaagaagttgcaccagtataaggatagggggtaagtttcctccaggatccagag

SEQ ID NO: 552536 - DNA, 67 bp, Homo sapiens
ggtgctccttgagggttgatgctgggttcactttacctctgtgaatccagcacaccatgaggatgcc

SEQ ID NO: 552537 - DNA, 67 bp, Homo sapiens
cctttcaatttgtctttcccaaggtggctctttatttaagagctatcttgaaggaggaggaataagg

SEQ ID NO: 552538 - DNA, 67 bp, Homo sapiens
gaggacactctggtttggggatggcatgaatgaaccacacatgtccataaataaacccggagccctc

SEQ ID NO: 552539 - DNA, 67 bp, Homo sapiens
gctccaggcagccaggtcttccctgtgtcaacaaggggaaggaaagcagcttggccctgtctggggc

SEQ ID NO: 552540 - DNA, 67 bp, Homo sapiens
aaaggtgggcaaaatttctgtttgtgtgattacatttataatgttaagaaattttgccatgatcttt

SEQ ID NO: 552541 - DNA, 67 bp, Homo sapiens
aattttcagaatatgggaaaggggtttcacattgagaatttcctctttctgatgtagattgagaatt

SEQ ID NO: 552542 - DNA, 67 bp, Homo sapiens
agcctgtggtttggagtttgaagacagcagagggcgtgtgtctgtaagcactcaaaaccacagagct

SEQ ID NO: 552543 - DNA, 67 bp, Homo sapiens
tctcaactttgtttcctgttggttcaggaatcatctgtgcacttaaaaagggaagcagggcttgaga

SEQ ID NO: 552544 - DNA, 67 bp, Homo sapiens
gcggaggtagcagcgttggcggtccctcaggctctagcttgaccgccacctccgtctgctcctccgc

SEQ ID NO: 552545 - DNA, 67 bp, Homo sapiens
ttctgtcttctctattataagctgggtgtctaagagatagacagtatatggtggtagaggcacagga

SEQ ID NO: 552546 - DNA, 67 bp, Homo sapiens
tcttgtgagaggggagacttggcactgatgactcaggtattccaagtcttcactaaaatcacataga

SEQ ID NO: 552547 - DNA, 67 bp, Homo sapiens
ggaggaagtggcactctggtggctttgtgcaattattttccaagactaacaggatgctgttttcttc

SEQ ID NO: 552548 - DNA, 67 bp, Homo sapiens
gtcaatcacgccaggaggaaaaatagtggcatgatttgttatctgttattccccttgctgtggtgac

SEQ ID NO: 552549 - DNA, 67 bp, Homo sapiens
ctttcacttttcagccacctccttcttttactttgggttcaagctcaagagttggttaaagtgaaag

SEQ ID NO: 552550 - DNA, 67 bp, Homo sapiens
ccagggagcagcgctggggcctccagacacacacccttcccttgaggccacaatgactgccccttgg

SEQ ID NO: 552551 - DNA, 67 bp, Homo sapiens
ctagcccgggcctatggactaattacaaggtgtggggctctgcggtggttctgtgggccctggctgg

SEQ ID NO: 552552 - DNA, 67 bp, Homo sapiens
gagtatcataaagatggcgattgtatatcactttccagtgaaattgcttgccttcctttatgatttc

SEQ ID NO: 552553 - DNA, 67 bp, Homo sapiens
gaagctgggggcaacacctgaatacttttgccggaatgggctgggcgggtacctgcactccagcttc

SEQ ID NO: 552554 - DNA, 67 bp, Homo sapiens
tctagagagactgagtacttttccttttactgaataggaggttctggaaaagtactgggtttccaga

SEQ ID NO: 552555 - DNA, 67 bp, Homo sapiens
gtataacattatacagagaggacagtggtaaactcaggactgctgccctttctatatgatgtaatat

SEQ ID NO: 552556 - DNA, 67 bp, Homo sapiens
gggaggggccaaagagggaggagatctactgcgttctgtggccctctcctcccttcctgtccttccc

SEQ ID NO: 552557 - DNA, 67 bp, Homo sapiens
gtctgtaaagctttcagtgcaatgccttgtatttggcaagtgcattgtaaatgggagtattatctac

SEQ ID NO: 552558 - DNA, 67 bp, Homo sapiens
gcatttctgaatgaactgacaatttttctttagtataactaaagacgttgaggttcttctgaggtgt

SEQ ID NO: 552559 - DNA, 67 bp, Homo sapiens
ccaggactctagacattcaggacagggctgcttgtaccactctgctgcctctgaactggggtcctgg

SEQ ID NO: 552560 - DNA, 67 bp, Homo sapiens
tggaggaaaagttattgtcagcatgtgttttattttttaatttacactgtagtatgatttttcccca

SEQ ID NO: 552561 - DNA, 67 bp, Homo sapiens
tggtaggcttttagtttccatagaaaataatctctcattgttttcaaaagaaactgaaagcacccca

SEQ ID NO: 552562 - DNA, 67 bp, Homo sapiens
gcagccagcttgtaagtcctggataacacttgttgaatgggcttccgaggacttttgtgctgcctgt

SEQ ID NO: 552563 - DNA, 67 bp, Homo sapiens
gccttggccaccacacctaccccttgtgaatgtcgggcaatgggtgatgggtgtggtgtccacaggc

SEQ ID NO: 552564 - DNA, 67 bp, Homo sapiens
ctgctctatacctgggtttgttcctgtgtgaaaatgggataaaagctgtacaaaccttatagggtag

SEQ ID NO: 552565 - DNA, 67 bp, Homo sapiens
gtgtgtgtgtttgcatgttggagttggggtggattatgctcttcaatttcaatgcaacgctgcacac

SEQ ID NO: 552566 - DNA, 67 bp, Homo sapiens
ttttgaggtcttggaagaagttgcaccagtatgagaatagtgggtcagttttctccaggatccagaa

SEQ ID NO: 552567 - DNA, 67 bp, Homo sapiens
ggatgtggagatgaaaggcagcttcctgggacaatgaacagtcctggtgaagctgttggtctccaac

SEQ ID NO: 552568 - DNA, 67 bp, Homo sapiens
caggactgatattcagctggaatgtactggtggccttaaccattgcttccagttggctaatgttctg

SEQ ID NO: 552569 - DNA, 67 bp, Homo sapiens
ggaagctttggttaagtgaaaaagcctgttggggttttccccctgtagttttctaattagggcttcc

SEQ ID NO: 552570 - DNA, 67 bp, Homo sapiens
gggggcggggaggatgaggggcactggtcgggtgttctctgatgtcccggctctatccccagctccc

SEQ ID NO: 552571 - DNA, 67 bp, Homo sapiens
ggtccggggctcatatcctggggagctctatagtcacaggcagacccaagtgtgatccccaaggacc

SEQ ID NO: 552572 - DNA, 67 bp, Homo sapiens
tgcaggtggaagcatggactttgctatctataaaaaaatttaatggtgaagatcaacttccgcttca

SEQ ID NO: 552573 - DNA, 67 bp, Homo sapiens
gggtggtggctgctcaagggaggaggctgcaatttaaggcaccctctgccttgagcagtgcccaccc

SEQ ID NO: 552574 - DNA, 67 bp, Homo sapiens
ctctcctgtcaccttgctctcctatcaacatgtcattttttagaaggggcagcaggagataggaagg

SEQ ID NO: 552575 - DNA, 67 bp, Homo sapiens
gcaccaggaagcctgagaatgaatcctgagggctctagcccaggctttgtcccaggctttctggtgt

SEQ ID NO: 552576 - DNA, 67 bp, Homo sapiens
ttctttagcataattaagtcttatgttgcagagaaaattgcaactaatatgcgattatgtttaggaa

SEQ ID NO: 552577 - DNA, 67 bp, Homo sapiens
ccaccgcacccgcatgtcctggtcctttcagggcgccctgaggcggccaggacagaggtggaggtgg

SEQ ID NO: 552578 - DNA, 67 bp, Homo sapiens
tgggcaaattacttatctctgttccgtttatttatctgtaaaccaatgaagatagtaaaaatgccca

SEQ ID NO: 552579 - DNA, 67 bp, Homo sapiens
ccgtcaccatcacccggtgctgggcgggcaccatgtggactccacttggcactgggccgatgggcgg

SEQ ID NO: 552580 - DNA, 67 bp, Homo sapiens
gccttgccttccaaaacccctatctactggggagacagaacacagactgggggtccgaaggcagggc

SEQ ID NO: 552581 - DNA, 67 bp, Homo sapiens
tacaggtcctagcatgcaatggcctgatttcatgtgggccacagagcactgcttgtaaggacgtgta

SEQ ID NO: 552582 - DNA, 67 bp, Homo sapiens
tggaatgaggattgtcttttccactgcttatgattttagagtgtggagaaggactgttcatgttcca

SEQ ID NO: 552583 - DNA, 67 bp, Homo sapiens
tgtgttagaaacagttgtcaagtgtggttcctttacgccatgagactgggagctgtttctaaacaca

SEQ ID NO: 552584 - DNA, 67 bp, Homo sapiens
cctgaggttggagtttccacagtggtgaggtctcagctgccagccctgtgggaagctccctcccagg

SEQ ID NO: 552585 - DNA, 67 bp, Homo sapiens
caacatagaggtgacaggttaggatacagatgaggccctatcttctatgatctgttgtctctggttg

SEQ ID NO: 552586 - DNA, 67 bp, Homo sapiens
ccgaggctctggggttccctctgccacaggtgaccaagggtaggtatgacactccagaggcctcagg

SEQ ID NO: 552587 - DNA, 67 bp, Homo sapiens
ttccctagttaccaattttactcggtagtagctgaaatgccctggaactaagttggtcattggggga

SEQ ID NO: 552588 - DNA, 67 bp, Homo sapiens
agctgtgaaatggtgtccctgctcaactgggccccaaagctgtcagggggctgccaatttcacagtt

SEQ ID NO: 552589 - DNA, 67 bp, Homo sapiens
aaatgttgacctcctgaatgttttcataccagtttggattggaaaacagaagggtaggtaaacattt

SEQ ID NO: 552590 - DNA, 67 bp, Homo sapiens
atggctctgagtacataatggccctcaccacgggcaagcatgagggttatgtacacttcgggaccat

SEQ ID NO: 552591 - DNA, 67 bp, Homo sapiens
gccacctcaggagggagggagggagtggctcttcccattcctcttgctccttcactgggtgggtggc

SEQ ID NO: 552592 - DNA, 67 bp, Homo sapiens
gactgtactcttatagccatctgaaatacgttttctaggtagagatagattgtgtaagggtacagtt

SEQ ID NO: 552593 - DNA, 67 bp, Homo sapiens
ttttgggcacagcggcaacatgatatgacttgttttaaaaggatcactggggccgctatgttgagaa

SEQ ID NO: 552594 - DNA, 67 bp, Homo sapiens
taggtgttttattcctatggcttaattttttaaattctaaagctctggagtagtgataagacaccta

SEQ ID NO: 552595 - DNA, 67 bp, Homo sapiens
gactgtactcttacagccatctgaaatacgttttctaggtagagatagattgtgtaagggtacagtt

SEQ ID NO: 552596 - DNA, 67 bp, Homo sapiens
ctgtctggtttagtggatgctgatgccatttctccttatgaatggtccagcattggttgccaggcag

SEQ ID NO: 552597 - DNA, 67 bp, Homo sapiens
tgagggcaaggactggagtctcattcatctttgaatctacaataatggacccagtgcttgcttctag

SEQ ID NO: 552598 - DNA, 67 bp, Homo sapiens
gcatatgggaacagttttgtttgaaagcatgatcagcattctttgcaaacaagctgtggccatatgt

SEQ ID NO: 552599 - DNA, 67 bp, Homo sapiens
ctgatgaatggatgtgtaggaagtggtgtctagtatgcatataaattttagctgttccattcatcag

SEQ ID NO: 552600 - DNA, 67 bp, Homo sapiens
ttgttacctcctcctcaatgaggctgttgggaaacacttcaaacagtctgttccggaggggtaccaa

SEQ ID NO: 552601 - DNA, 67 bp, Homo sapiens
atttcaagtgaaaattaatggcaaattcttgtaaccacattaagagccattgtcgttcatttgaaat

SEQ ID NO: 552602 - DNA, 67 bp, Homo sapiens
ccactagggtgagctttgaggatgacagtctattccattgttgttttccaagctgtcccattggtgg

SEQ ID NO: 552603 - DNA, 67 bp, Homo sapiens
catcagctgcctctgctatgacccggaaatgaagatgcttctgtctggcatcctgggggcagtggtg

SEQ ID NO: 552604 - DNA, 67 bp, Homo sapiens
ttctcatgagccatgattagcctcaggtctatggaaccttctgcagctatgtcatggtgactgagga

SEQ ID NO: 552605 - DNA, 67 bp, Homo sapiens
tccaggttactgtaaagatgaaatgaaatcatattaatatatgcaaacatctagaacagtgcctggg

SEQ ID NO: 552606 - DNA, 67 bp, Homo sapiens
atattagttaatatagcttcacctaatactagtcagaagtattaagtgaagctatgataactagtat

SEQ ID NO: 552607 - DNA, 67 bp, Homo sapiens
aattagaaattaggaggttatcccccaaataggaatattaatgggtttgagtttctagttactagtt

SEQ ID NO: 552608 - DNA, 67 bp, Homo sapiens
ggtatgggaagagagtgggagagaaactttgggctttgaaaagttttctttcagttctttccaaact

SEQ ID NO: 552609 - DNA, 67 bp, Homo sapiens
atccttgcaacgaacctgagccactgattcagtaaaatactcagtggcacatgtttgttgtgagggt

SEQ ID NO: 552610 - DNA, 67 bp, Homo sapiens
gcatgactcttcaacctcaggacttgcagaattaatggaatgctgtcctaaggttgttgagttgtgc

SEQ ID NO: 552611 - DNA, 67 bp, Homo sapiens
ctgtcctctgtcctcaagtctgagcccaagcccccggggcctggggcagggctgggggccgggacag

SEQ ID NO: 552612 - DNA, 67 bp, Homo sapiens
aggtgaaaggaaaagggttttgacttgatttgataaacgaagaaagggaactctttcacttttgcct

SEQ ID NO: 552613 - DNA, 67 bp, Homo sapiens
gctgcataatgacaataatcattaactttaggtttattctggggttaatgaattattatagtgcagt

SEQ ID NO: 552614 - DNA, 67 bp, Homo sapiens
gcccctacctgcagtggcagcttcattcaccttcatgagaagatgaagcagtagctccaggagtggc

SEQ ID NO: 552615 - DNA, 67 bp, Homo sapiens
catcattctgtgcatgtgtttcagaaagatctgtttggggatttggagcatgcaaggcagggtggtg

SEQ ID NO: 552616 - DNA, 67 bp, Homo sapiens
ccttgctcatcccccagtgcctcattttataaataaaaggcagtgcagtggagggatagaagcaggg

SEQ ID NO: 552617 - DNA, 67 bp, Homo sapiens
acagttttacccaataggcttaaatgctccaaaggagcagtttgagcctctttggtagataatctgt

SEQ ID NO: 552618 - DNA, 67 bp, Homo sapiens
gggtggagtggggtcaggggagggctcagggatctgtatcctgcctcttcttgggcctcctgcaccc

SEQ ID NO: 552619 - DNA, 67 bp, Homo sapiens
cagtcctgttgccatctgcatctctggggttcagagaggaagctagggatcagtggcatggggactg

SEQ ID NO: 552620 - DNA, 67 bp, Homo sapiens
ttcgtgtgctagggccagatcatcccaggaattctgggataggaggtctgagtccatgcagcaagaa

SEQ ID NO: 552621 - DNA, 67 bp, Homo sapiens
gtgcgcagactaattgcctgtggcaaatgttgcctgcaaatttcaagggcaattgagtcctgtgtgc

SEQ ID NO: 552622 - DNA, 67 bp, Homo sapiens
gcgtcaggatgcccaggccctgccatgtccctagcccggcctgggtggcagggcccagctcctgggc

SEQ ID NO: 552623 - DNA, 67 bp, Homo sapiens
ttttagcagtgatcttgcatgttggttgaaaaacaaaatggatatgcatagatctttcttgctgaaa

SEQ ID NO: 552624 - DNA, 67 bp, Homo sapiens
cctaatgagtgctgtggagagctgtttacagctaagtgagctgtaatggctttctgcggtcattagg

SEQ ID NO: 552625 - DNA, 67 bp, Homo sapiens
aactttgggttactatggcaataatttgaacatttacagagaagagtgtttgccgtagacccatgtt

SEQ ID NO: 552626 - DNA, 67 bp, Homo sapiens
agggtttctgcatgcactgggtgtcacaggctgcaggtgatgcctcatgtgctgtgctgggagccct

SEQ ID NO: 552627 - DNA, 67 bp, Homo sapiens
ccccatcgtcaccacgccccaagaccactgccctcaccggcctggtttgcaggcgtgggggaagggg

SEQ ID NO: 552628 - DNA, 67 bp, Homo sapiens
gcatttaccggtactcactccatgctgggcattgggctgagaggtggctagagagctggtcagatgc

SEQ ID NO: 552629 - DNA, 67 bp, Homo sapiens
gactgtactcttctagccatctgaaatacgttttctaggtagagatagattgtgtaagggtacagtt

SEQ ID NO: 552630 - DNA, 67 bp, Homo sapiens
ctgcccggcggccgcctcccagagctgcgggaaactctggctgcgggagtttgcggtctccgggcag

SEQ ID NO: 552631 - DNA, 67 bp, Homo sapiens
gtaggtcaagtgttggatagcggttgagagtacaggttctggactcaggtttaatacttggcttcac

SEQ ID NO: 552632 - DNA, 67 bp, Homo sapiens
gtctttcccagccctgtacctggcaaggctaataataccttaggaagtgcaggtgttgcagaaagat

SEQ ID NO: 552633 - DNA, 67 bp, Homo sapiens
gtgaccctctagatggaagcactgtctgttgtctaagaaaagatcgtgcatccctttagagtgttac

SEQ ID NO: 552634 - DNA, 67 bp, Homo sapiens
ggttttaggcaggtgtgatattcgacagcacctgagaccggaaataaatcacacctgcccttgaacc

SEQ ID NO: 552635 - DNA, 67 bp, Homo sapiens
gttctccacggtcccttctggccctatcgcgcttctggtcttagggccaggccagactggggagggc

SEQ ID NO: 552636 - DNA, 67 bp, Homo sapiens
ggcgggtgggtggtccgcagacatatggcacgaattcagcacatgttctgaggtccaccgactttcc

SEQ ID NO: 552637 - DNA, 67 bp, Homo sapiens
gaggggtgcagagtggccaggaggtgacacactatactgtccaccccctgccgcctcttgtcccctc

SEQ ID NO: 552638 - DNA, 67 bp, Homo sapiens
tttcttgggttatttttcctctcatcttttgaatttgaaaagaactgagggaaggcacctgaagaaa

SEQ ID NO: 552639 - DNA, 67 bp, Homo sapiens
ttcacagagaccagtctccagtggttaccaatcttgatcttccagtgtagactgagttctctttgaa

SEQ ID NO: 552640 - DNA, 67 bp, Homo sapiens
gctttcctcggattcccggatgtgggtgagttcatttgctcgcgtgcaggggaagtctggagaaggc

SEQ ID NO: 552641 - DNA, 67 bp, Homo sapiens
tggcagctacaagtgttttggttttatgtttttagatacatggccaagattacttttgtgactgcca

SEQ ID NO: 552642 - DNA, 67 bp, Homo sapiens
tctcttttttgatttccctttgatagtaaatataatcagaacttcaaagggtagcccagggaagaga

SEQ ID NO: 552643 - DNA, 67 bp, Homo sapiens
tttgttctcccgtttcctgtgtatggttcagccccagtgagccacaggagacagggccaggagcgga

SEQ ID NO: 552644 - DNA, 67 bp, Homo sapiens
tgaaggtttaggtgaattttgctgcatcttctccagatggggatgctgagattcacctgaatgtgca

SEQ ID NO: 552645 - DNA, 67 bp, Homo sapiens
acaggggagcttagtgtacttccgctttgtgtgtgtatgaggtggggaaaatacatggtttccctgt

SEQ ID NO: 552646 - DNA, 67 bp, Homo sapiens
accgagagcctgcggctggcgtttgaggcggatggcagtgccctgagcgcggcggctgggtctcggt

SEQ ID NO: 552647 - DNA, 67 bp, Homo sapiens
ttttgtttcagaagtcaactaggtaaagaactacagtggttctcctgggatgacttttgaaatgaaa

SEQ ID NO: 552648 - DNA, 67 bp, Homo sapiens
caaatctagagacagtttggagtagtgattaccagcatggactctcaagccagactgtctgggtttg

SEQ ID NO: 552649 - DNA, 67 bp, Homo sapiens
gccaatgtgttttctcgctatttatcaaatcttttatactctgatgactaatggaaaatacaatggc

SEQ ID NO: 552650 - DNA, 67 bp, Homo sapiens
taatgagagcagcaaacaaagttgtgcggctgagtgattggtatgcattgttttgtttctttcatta

SEQ ID NO: 552651 - DNA, 67 bp, Homo sapiens
tggtacttcatgttagttgaggcctctgctcaatgcactctgtcctcctaactaacatgatttgcta

SEQ ID NO: 552652 - DNA, 67 bp, Homo sapiens
ggtggcgggtgtgcagatgaaggctgaggccccaaggccccaccatcccaactgtgtgcttgccacc

SEQ ID NO: 552653 - DNA, 67 bp, Homo sapiens
gatttaagacatgaagatttacagcttgataaaccagcttcaggaggtaggtcttcagtcttgagtc

SEQ ID NO: 552654 - DNA, 67 bp, Homo sapiens
ctgcccagctctcattatgacatttagcctgtgattgatattgtgtgtgtcattgagaccttggcag

SEQ ID NO: 552655 - DNA, 67 bp, Homo sapiens
ggagggaaggctgggggcagggacgtcagtaaaggtggagctgacccctgggctctgggctccctcc

SEQ ID NO: 552656 - DNA, 67 bp, Homo sapiens
tcattaagattactgaaataaccagctcactaaacagtcaatatggttatttcatccatcttaatga

SEQ ID NO: 552657 - DNA, 67 bp, Homo sapiens
gcccttcctcaaggctgactgggtccactggaggacaagaaaagtggtacagcctgtggggaagtgt

SEQ ID NO: 552658 - DNA, 67 bp, Homo sapiens
ggcctgtgtttttaactctaggagtcatgatctgaatgtgaaattccaagggctacaaacacagacc

SEQ ID NO: 552659 - DNA, 67 bp, Homo sapiens
tccactccaagcattaccacctttgtgcgataatacagttagcacaggcggtcattgctggagtggg

SEQ ID NO: 552660 - DNA, 67 bp, Homo sapiens
ggccagaatgatagttgttaaaaataatgctaattatagcaataataatagctgtcatttgttggcc

SEQ ID NO: 552661 - DNA, 67 bp, Homo sapiens
ggccctggggaggagggtgaagacagaggcaccctaggccttaaacttcatctagactccctgggct

SEQ ID NO: 552662 - DNA, 67 bp, Homo sapiens
atttttctttgtttctaggtgagagttgttttacaggcactttcaaacctagggacattggaaaaat

SEQ ID NO: 552663 - DNA, 67 bp, Homo sapiens
cccccgcccgatgaagaagatcccagggtaagtctagccctggatctcttgggtatcggggtggggg

SEQ ID NO: 552664 - DNA, 67 bp, Homo sapiens
gctgaatgaaaagcagaaggagttgggaaatttacaccacctatcatcctgctgccttttgttcagt

SEQ ID NO: 552665 - DNA, 67 bp, Homo sapiens
gctaaaagctgagacaatgaaagccctggcagcctcccttggcagccgctttttctcagctttcggc

SEQ ID NO: 552666 - DNA, 67 bp, Homo sapiens
ggtaggtgtggccctggtttccaggacaggtggccagactgctctgtgacaaagggccacgcctgcc

SEQ ID NO: 552667 - DNA, 67 bp, Homo sapiens
ggacaggtgggaggtggggtggggggagctggaaggagacggcagccccgcccccgcccccactgcc

SEQ ID NO: 552668 - DNA, 67 bp, Homo sapiens
tagtagatttgcatgcttataacatgtatagacacaggtgtatgcttataatatgtataatctactg

SEQ ID NO: 552669 - DNA, 67 bp, Homo sapiens
ctgcagagtcccaggggagctgtggcctgctgtcccctcatagggtctttctcctggggctgtgcag

SEQ ID NO: 552670 - DNA, 67 bp, Homo sapiens
gtttaccagggaaggccctgggagagaatctgctcagtgacactcttcctggggcctcagaggtggc

SEQ ID NO: 552671 - DNA, 67 bp, Homo sapiens
aactgacacttttgcctctggtgaaattatgaaattttatgaatttgccacaggcaaagtttgctgt

SEQ ID NO: 552672 - DNA, 67 bp, Homo sapiens
ggggagagccacgaacagggctgtgcgttcaatttggttgcagagagccctgaacgtggccctctct

SEQ ID NO: 552673 - DNA, 67 bp, Homo sapiens
aggagtggagggtgtgaattgaagattaaatctgctctcagtcttttcctcactccttccttctctt

SEQ ID NO: 552674 - DNA, 66 bp, Homo sapiens
gcaggagaagaagatgtgcgcggacaagcggccccaaacgtcccctcgcaggtctctttctcttgc

SEQ ID NO: 552675 - DNA, 66 bp, Homo sapiens
ggaccacgatacagtgggaggcacaggtctgaaaggctctgtgcttcccctctgaggtgcggatcc

SEQ ID NO: 552676 - DNA, 66 bp, Homo sapiens
agtttaggaggagggaggggcgacatcggggcaatcctctgagtctctctttcctcctcaggaact

SEQ ID NO: 552677 - DNA, 66 bp, Homo sapiens
gtggtataggggcaggctcatgggagcactcaggactgctgtccccattggccacccctgtgccgc

SEQ ID NO: 552678 - DNA, 66 bp, Homo sapiens
gcctgcagaagtcccaggactggcaaggttcatactgagatgccagcctggggactctgccaaggc

SEQ ID NO: 552679 - DNA, 66 bp, Homo sapiens
ggggtgggggcgctccatgcagggggcccaggaagagtttcctcagtgcaggagcccctgaccacc

SEQ ID NO: 552680 - DNA, 66 bp, Homo sapiens
ggaagcagggggcggaggccgctgtgcagtcagcctggctgtgggcggcccctgcctgctccgtcc

SEQ ID NO: 552681 - DNA, 66 bp, Homo sapiens
tccccggatcattgccacgatagacccaaacaactccagtctatcgtgtcaatgtgtatttgggga

SEQ ID NO: 552682 - DNA, 66 bp, Homo sapiens
gaggaggggtaggcaggagccaggctgaggatttagcacctcttctggtaacctttatccctcctc

SEQ ID NO: 552683 - DNA, 66 bp, Homo sapiens
ctgttgtcttggtacctctttgaagtgcaaaaacattacaacttcaaaagcggtccaggaagatgg

SEQ ID NO: 552684 - DNA, 66 bp, Homo sapiens
atctagttcccaagtgaataaactataaggccaaagggcaaatagtttaacaaaagggaatcagat

SEQ ID NO: 552685 - DNA, 66 bp, Homo sapiens
ggaccacaatacagtgggaggcacaggtctgaaaggctctgcgcctcccatctgaggtgcggatcc

SEQ ID NO: 552686 - DNA, 66 bp, Homo sapiens
tggtgacagggatgtggtggtggaggcttctgcctctagctttctaatcctcccattcttgtccca

SEQ ID NO: 552687 - DNA, 66 bp, Homo sapiens
gacattattatttttcctactttacagatgaggaaactgatccacagagaggaagaatagtttgtc

SEQ ID NO: 552688 - DNA, 66 bp, Homo sapiens
taacaccctaagccattaggtcattaaagagctcttggcactttacctaaaggcttcagggtgtta

SEQ ID NO: 552689 - DNA, 66 bp, Homo sapiens
ctgcaggcagaagggatggtgagggggcgcaaccctctgccctgtcagccccacttctgcctgcag

SEQ ID NO: 552690 - DNA, 66 bp, Homo sapiens
ccaggagcatatgcagcagcggctgcttgtgcgctcagccaggcagcctggttgcaatgctgctgg

SEQ ID NO: 552691 - DNA, 66 bp, Homo sapiens
tcttatggtgatgacagttggatgcacctaatcaaaagtcagcaactaactgttaataaagtagga

SEQ ID NO: 552692 - DNA, 66 bp, Homo sapiens
tccccttaccaggctcctccttgttctcagcagcagaatcgatgggggaggggtctggagtgggga

SEQ ID NO: 552693 - DNA, 66 bp, Homo sapiens
gtgtggatgggtgaggggggagttggaccacttcttcaaggccaccctctcccctgccccccagat

SEQ ID NO: 552694 - DNA, 66 bp, Homo sapiens
tgggagttgtagtctgccttgtactgtcggctatgggccgaagacgtgagaagactacggttccca

SEQ ID NO: 552695 - DNA, 66 bp, Homo sapiens
caccaccatcaccttccctccttatcaggcatctaagcttgctaaagggggagaggtgggggggtg

SEQ ID NO: 552696 - DNA, 66 bp, Homo sapiens
gagagagcagtggcattctgagcagggctggagctcgggccccctgactcaggctggtgctttctt

SEQ ID NO: 552697 - DNA, 66 bp, Homo sapiens
gtgatttcttccacttgggcatgtctcttcaggggtccttggaagttatgtctatggaagtgtcac

SEQ ID NO: 552698 - DNA, 66 bp, Homo sapiens
gccaagtgtttttcatgaccctcaacagaaattccatgatgaactggtaacagaagagcacttggc

SEQ ID NO: 552699 - DNA, 66 bp, Homo sapiens
tgtccaggcagcataataaataacctgccccttttggcagggagtttattagagactgatgggaca

SEQ ID NO: 552700 - DNA, 66 bp, Homo sapiens
cacctgggcttcagaggttgttgctatgtctggtgacagtaagccctaacttctaaaaagtctgtg

SEQ ID NO: 552701 - DNA, 66 bp, Homo sapiens
gggactaagctaaggggctgtcccatttcattctcctgatgaggtgggtccctttggtttcatccc

SEQ ID NO: 552702 - DNA, 66 bp, Homo sapiens
tatctgattcagtgatcctcttctgacgttatgtccatactgaaggggataataatgcatcagatg

SEQ ID NO: 552703 - DNA, 66 bp, Homo sapiens
agggttctcctggagggcgacttttttgggaatcggacccaaggaggatgccttccctgaagccct

SEQ ID NO: 552704 - DNA, 66 bp, Homo sapiens
ggtggcaggttccgagatgaggaggaaccgcactgagaagcctcctctgcatccgaacccgccacc

SEQ ID NO: 552705 - DNA, 66 bp, Homo sapiens
ttcatctcatctaagtgctggcatatgatgtgattgttaacatagctggccaccagatgaagtgaa

SEQ ID NO: 552706 - DNA, 66 bp, Homo sapiens
ctctctctcccacctcctgtaatcagcacccctggggatgggtgtgaggggggcaggtagagaggg

SEQ ID NO: 552707 - DNA, 66 bp, Homo sapiens
cgtagcagcctcctctcgcgcccactttatttgggggcaggcgtgggaggacctaggcctgctgtg

SEQ ID NO: 552708 - DNA, 66 bp, Homo sapiens
gcactgtgcactgtgactggcagggggcgctgaaaccgccttttctgccccacatggtgcgcatgc

SEQ ID NO: 552709 - DNA, 66 bp, Homo sapiens
agatcatatttgctaatatgcaaattttcagaactcctgatgagtttgctgttgctgggtatgact

SEQ ID NO: 552710 - DNA, 66 bp, Homo sapiens
ggcagggatacaggtgtgtgaagggtcacttgccctccctgttgtctcacaccctggccccttgtc

SEQ ID NO: 552711 - DNA, 66 bp, Homo sapiens
aggggtgcgtgtcagggtcctggggtatgggggagaccccagccaggtcctggtgcggacagccct

SEQ ID NO: 552712 - DNA, 66 bp, Homo sapiens
gaatgaccttcatccactaaagaagggatgtttttaaaaacctcgcaagtggaggaaggctcattt

SEQ ID NO: 552713 - DNA, 66 bp, Homo sapiens
cctctgcctctcatttcctgccagtcctgggtcccttgctgggatggtgagaagtgaccccagagg

SEQ ID NO: 552714 - DNA, 66 bp, Homo sapiens
gagtgtgtgtctccactgtgctatttttcagaagaatatgaggaacagtactcggaggccagactt

SEQ ID NO: 552715 - DNA, 66 bp, Homo sapiens
tctgcccggaggtgagatgaataaccaatctctaaaggtgttgggcgtttcttgtctttgggtgga

SEQ ID NO: 552716 - DNA, 66 bp, Homo sapiens
ctctgcacatgttcatcatgacaatgtactcaggagttctaagtcatgatgagcatcctgcagcag

SEQ ID NO: 552717 - DNA, 66 bp, Homo sapiens
tttccatggacacgagagcccctgctgggtcccgtgctcctggcaggctgctggtgtccaggggaa

SEQ ID NO: 552718 - DNA, 66 bp, Homo sapiens
gttttccccaacaaatgttgccaacaaaatgagacacagctgctggtgacatttgtagaggaaaac

SEQ ID NO: 552719 - DNA, 66 bp, Homo sapiens
aggggccaggtaccctcagttcaccatgactgccactagatggcactgatggcactctggcaccct

SEQ ID NO: 552720 - DNA, 66 bp, Homo sapiens
tctgtgtgtgtatgtgtatatattgataaatgggtataattaaatatatatacaaacacatactta

SEQ ID NO: 552721 - DNA, 66 bp, Homo sapiens
gggaggggctgaggcagtgggaacagcatgaacccttccctcacgtttcactggcttacccctcct

SEQ ID NO: 552722 - DNA, 66 bp, Homo sapiens
gggggtgagggagaggctgtgggtgcccctctcttggggctcacccccatccatctttccacctcc

SEQ ID NO: 552723 - DNA, 66 bp, Homo sapiens
cagctttccccaaggtgtggtgtggttctgccgctaaggaggcacgctgcagcctggggaaggctg

SEQ ID NO: 552724 - DNA, 66 bp, Homo sapiens
tacaaatctctcacccatggcctgaatatgtttgcaaactaagcagatcatgggaaggagaatgtg

SEQ ID NO: 552725 - DNA, 66 bp, Homo sapiens
gagcaggtggaagaagggccgagtcagggagggggcatttcctggctgatcctcttcatttctctc

SEQ ID NO: 552726 - DNA, 66 bp, Homo sapiens
ggagcatgtgcagtgagatgggtgcctgccttgtaggctgtggtaccctgcctcactgcattctcc

SEQ ID NO: 552727 - DNA, 66 bp, Homo sapiens
tgggattggccccagcgccaggtgtctgggaatcccaggcctctgcgtgtgaaggtgccagttgca

SEQ ID NO: 552728 - DNA, 66 bp, Homo sapiens
gactggagcagtgagtcttttacacttctgtgctgaaaaatgtgagagagcttgatgcctcctttc

SEQ ID NO: 552729 - DNA, 66 bp, Homo sapiens
ggaaagagtgatcagggattgcatggctattatttgtaccatggcaatgccctggctctcctttcc

SEQ ID NO: 552730 - DNA, 66 bp, Homo sapiens
tttataggatgccatttaagatctgtctgtctggcatgtttagatcattttaaatggctctataaa

SEQ ID NO: 552731 - DNA, 66 bp, Homo sapiens
ggaggcagagccaaaaccgtaacagccagagctagagactccggcctggggttctggctctgtccc

SEQ ID NO: 552732 - DNA, 66 bp, Homo sapiens
tatgcacatgcatgcttgaatatctgagtgcatacatgcttggatatctatgaatgtatgtgcatg

SEQ ID NO: 552733 - DNA, 66 bp, Homo sapiens
cagcaaagaaatatcatggcatcagggaaaaacattgaacttggatgtcaggatatctctgtgctg

SEQ ID NO: 552734 - DNA, 66 bp, Homo sapiens
cttgggggtacaattagcctctggcgcctttagaatgagttgctggtgactaattatgccctcaag

SEQ ID NO: 552735 - DNA, 66 bp, Homo sapiens
attggtgagatagagtgtagtgtctgggtagctactgaatctggggaatgcaatctactcattaat

SEQ ID NO: 552736 - DNA, 66 bp, Homo sapiens
ggggctcgtgtcactgtgaggatattgtactaatggtgtatgctatacccacagtgacacagcccc

SEQ ID NO: 552737 - DNA, 66 bp, Homo sapiens
gcttggcagggcttgtgatgcgccgccctcagtggagcggatcagtcgcttgccctcgccccaagt

SEQ ID NO: 552738 - DNA, 66 bp, Homo sapiens
ggctgtctgcagcacatagattagaataaagggcttgcttagtgtttgtgaatgttgcggattgct

SEQ ID NO: 552739 - DNA, 66 bp, Homo sapiens
cataactctcatatactgtggttctgagatctttatagccacattacggtatatggctgagttgtg

SEQ ID NO: 552740 - DNA, 66 bp, Homo sapiens
gagtgatctttcccttcagcgttagcctaataacaacttggagggtggggctgaaggaattcactc

SEQ ID NO: 552741 - DNA, 66 bp, Homo sapiens
ccacttttatgcctgtgacagcttcatgaagcacaaaacatggagcaatacatggcatgaaattgg

SEQ ID NO: 552742 - DNA, 66 bp, Homo sapiens
ggagccacatgtcacagtgccctgctgcctgaacaaggaccagaggcctgtggaacacatggctct

SEQ ID NO: 552743 - DNA, 66 bp, Homo sapiens
gaaagatttcatttgctatgctttctgcctttgcgtctgggtagcattgtaggcaggtgttctttc

SEQ ID NO: 552744 - DNA, 66 bp, Homo sapiens
gcagagcctgtctccagggactaggcttgggcatttgggatgagccctgggggacggccgctctgt

SEQ ID NO: 552745 - DNA, 66 bp, Homo sapiens
gggagggacagaaggaggcagggcccattttctaggtcagaactccttgcccctgctcttcctccc

SEQ ID NO: 552746 - DNA, 66 bp, Homo sapiens
gggaggcacaggaggatgcctagtattctgatacttttcaaagggcatgcttctgagatgtctcct

SEQ ID NO: 552747 - DNA, 66 bp, Homo sapiens
cgctcttgggggagggatggaccatgcttgagggccacaccctccatctctttctctccacgagcg

SEQ ID NO: 552748 - DNA, 66 bp, Homo sapiens
cagactgtcatggggtactacacatggggggtcagcactcccgtgggtcactcacatgggggtttg

SEQ ID NO: 552749 - DNA, 66 bp, Homo sapiens
ttttcttcaaggataagtcatatgtcaagtaaaatgtctgagcatatgacaacatcttgcagaaag

SEQ ID NO: 552750 - DNA, 66 bp, Homo sapiens
tcccattcctagttccttccgcctcttttcttcaggggtctgctgaaaggaagtagggaagtggga

SEQ ID NO: 552751 - DNA, 66 bp, Homo sapiens
gaatgtgtgttccagaggagtcctgtaagcaaagcaagagaggacctccttcctgggaacaggttc

SEQ ID NO: 552752 - DNA, 66 bp, Homo sapiens
ctttgccgagactagagtcacatcctgacacaactcttgtcctggtgtgctagagtactcgaagag

SEQ ID NO: 552753 - DNA, 66 bp, Homo sapiens
tctgtgctaggtacactggtctttgtgaatactttgcaattgtgctggtgataactatagcagaga

SEQ ID NO: 552754 - DNA, 66 bp, Homo sapiens
ggtaagtgcgcctcgggtgagcatgcacttaatgtgggtgtatgtcactcggctcggcccactacc

SEQ ID NO: 552755 - DNA, 66 bp, Homo sapiens
aactgaagcttagagaggcaaagtaacttgcttgggcaatttatttcacctctctgaggctcagtt

SEQ ID NO: 552756 - DNA, 66 bp, Homo sapiens
gggatgccggtctgcagagtcctggagctgaaattagccaccagggtatgcggatatggataactc

SEQ ID NO: 552757 - DNA, 66 bp, Homo sapiens
tgggaggtgggcgtggggctgaagggactagagtgggtccctttctgctctccttcccatttctca

SEQ ID NO: 552758 - DNA, 66 bp, Homo sapiens
ctggggtcctggggtaagagaggatcttgggtctcctgggcattttctcccttcccaagacctgag

SEQ ID NO: 552759 - DNA, 66 bp, Homo sapiens
cttgctcccgccctccgctcatgctcactgtggccccaggacgtgggcgatgttgcagggagcaag

SEQ ID NO: 552760 - DNA, 66 bp, Homo sapiens
tcaaacctactttctttttagatttcctgatgcaggtaaggaaggaaatgtgaaggagtggtttga

SEQ ID NO: 552761 - DNA, 66 bp, Homo sapiens
ggtggatggagaaaggctgccacttcacatgacattctcatgtaaggggcctctttctcattctct

SEQ ID NO: 552762 - DNA, 66 bp, Homo sapiens
cagactcctcatccagtgctcctttcacactgccaagctaagcagaggacattgggtggctgtctg

SEQ ID NO: 552763 - DNA, 66 bp, Homo sapiens
tttaataatggaggaggtaataagatgtctatttattcatattttatgccctcctttataattaaa

SEQ ID NO: 552764 - DNA, 66 bp, Homo sapiens
gcgagtgaggcaggaggatggaggagaaaccgcagcgccacattcctgcggcccctgccttgccgc

SEQ ID NO: 552765 - DNA, 66 bp, Homo sapiens
aggaaaggctggagtgggaggtagttcaagagaaagtgtttatttctccttcctgctgtctttctt

SEQ ID NO: 552766 - DNA, 66 bp, Homo sapiens
ggggctgtgtcactgtgggcatagcagctggtactactacaatatcctcacagtgacacgagcccc

SEQ ID NO: 552767 - DNA, 66 bp, Homo sapiens
ccatcttctaggcagagggacagcagaacatgaacagtgacccaagcattctctgcctagaagtgg

SEQ ID NO: 552768 - DNA, 66 bp, Homo sapiens
tgtgcacatggtaggtattgagtatgtgaattattgaacatgtactttagataaattatgtgcaca

SEQ ID NO: 552769 - DNA, 66 bp, Homo sapiens
ctggcagatgcaattagcctctgggtccctcagaattagatgcaggtggctaattgtccatgccag

SEQ ID NO: 552770 - DNA, 66 bp, Homo sapiens
agttgatgtgcatggaggctttcatttcttagcaaaggaggtggaaagatctcttgcttgttaact

SEQ ID NO: 552771 - DNA, 66 bp, Homo sapiens
agactagattggcaggttggggctcaaatgtggaagccttcaataccatgcaaaataatttggtct

SEQ ID NO: 552772 - DNA, 66 bp, Homo sapiens
tgctgatctcaacttttcactggggaccactaagaagcctttcagaagaaaagaccgggatcagca

SEQ ID NO: 552773 - DNA, 66 bp, Homo sapiens
tttgtgattttagggctgttttggtattctttatggtaaagtaagtaaatggctctgagacacgga

SEQ ID NO: 552774 - DNA, 66 bp, Homo sapiens
cagagggaatttgcaggttgttttgagaaagatttcttaaagcaatttgagcaagttctatctttg

SEQ ID NO: 552775 - DNA, 66 bp, Homo sapiens
gatacttagctgcgtggtagaatgttggctgtgttttacagcacggtgtttcacggtttaagtatt

SEQ ID NO: 552776 - DNA, 66 bp, Homo sapiens
tgccctcacagatgactctggaaaggaagagtaaatctctactctccaggagttccctggaaggca

SEQ ID NO: 552777 - DNA, 66 bp, Homo sapiens
cacagatgagagaattggccttagagaggttaagtaacttttctaaggcccctctcttagtcagtg

SEQ ID NO: 552778 - DNA, 66 bp, Homo sapiens
ccccacccccactccccagctggtgccgctgggcttgccaggcccgcctgggatgtccgggtgggg

SEQ ID NO: 552779 - DNA, 66 bp, Homo sapiens
aaaacgtggattttcctctatgattaaccatcaaacacgtaaccatagaaggaaaatctacctttt

SEQ ID NO: 552780 - DNA, 66 bp, Homo sapiens
caggaggagctgggcagctgtcatgctcatcctaggaatgcatgtgtccctcccagctccttcctg

SEQ ID NO: 552781 - DNA, 66 bp, Homo sapiens
tcccttctcccatctttattcgctaggatccaagtaaattctagtgggcaagaggaagagaagaga

SEQ ID NO: 552782 - DNA, 66 bp, Homo sapiens
gtggcatagatcaatgcactgaagctttgtaattccctgaagggcttttagcattggtagtgccac

SEQ ID NO: 552783 - DNA, 66 bp, Homo sapiens
gacttttgtggagtttgtaaatttgaatttgattcaaggtagattttataggcttcataaactgtc

SEQ ID NO: 552784 - DNA, 66 bp, Homo sapiens
cgcctccatgtttcagcatctatgtcatgggcttggtcctggagtggattaaaaacaatggaggtg

SEQ ID NO: 552785 - DNA, 66 bp, Homo sapiens
tagatgatttctaatccctagtggagtgtactcaccagatgcctccaggtgggctagaaacatcta

SEQ ID NO: 552786 - DNA, 66 bp, Homo sapiens
ggtatatttacatcttgaggtatggggagttacttaagtcaccattcatcaagacacaaatatact

SEQ ID NO: 552787 - DNA, 66 bp, Homo sapiens
aggagtgtgagctgttgaaagaacctggtgaagtcttgcaaggtccagcaaattgcttacgttcct

SEQ ID NO: 552788 - DNA, 66 bp, Homo sapiens
ttttccatttgcttattttgctgagaatgagttgaatgcacatcagcgaaacaggcaaacggagaa

SEQ ID NO: 552789 - DNA, 66 bp, Homo sapiens
tttctcaaattaaatcaagactatttagctatgtagggataaaagaatcttgatttgtttgagaaa

SEQ ID NO: 552790 - DNA, 66 bp, Homo sapiens
ggagtgggagggggaggagggggccaggcctagagaagagcaggccccggctttacttcccactct

SEQ ID NO: 552791 - DNA, 66 bp, Homo sapiens
tatcccccagtgcccacctcagtgcccggtgtagcgaaggtctggggatggggctggtgagggatg

SEQ ID NO: 552792 - DNA, 66 bp, Homo sapiens
ggaggagtagtagaatgtaagttctggagggcaagacctgtctatcttacatactgctgtctccct

SEQ ID NO: 552793 - DNA, 66 bp, Homo sapiens
cttgtgctgtattttgaaaaattaggtaattatattgacaagcctaattggcaaaagcaggacaag

SEQ ID NO: 552794 - DNA, 66 bp, Homo sapiens
actcatttgcatacacaatcaggcatttatggaagcacatgcccaattgtgcatgtaaagacgggt

SEQ ID NO: 552795 - DNA, 66 bp, Homo sapiens
tgtttaatcccaaatctgtcaggccttgttaaatttgatggggcctgaaaggtctggtgttaagca

SEQ ID NO: 552796 - DNA, 66 bp, Homo sapiens
gttttcctctacaaatgtcaccagcagctgtgtctcattttgttggcaacatttgttggggaaaac

SEQ ID NO: 552797 - DNA, 66 bp, Homo sapiens
ataaaaataacttgctgggttcggcagcttctagaaaggctctctgacaaggtgggttatttttat

SEQ ID NO: 552798 - DNA, 66 bp, Homo sapiens
gaatgtctgtgcagccttggaaaacctgcgttaacagtggagtcctaggctgctccatggatattc

SEQ ID NO: 552799 - DNA, 66 bp, Homo sapiens
ggagagggcacaggcttggctctcaaaaaggctccatacaaaccgctgcctgcctgtgctcctccc

SEQ ID NO: 552800 - DNA, 66 bp, Homo sapiens
gcctgtgggggtggtgtgggggaggctgtacattttcttggagtcttcccataccggtacacaggc

SEQ ID NO: 552801 - DNA, 66 bp, Homo sapiens
aagtggcttttaagcaattagaccaagcactgggcactttcaaatctaattgtttcaaaagccctt

SEQ ID NO: 552802 - DNA, 66 bp, Homo sapiens
gcaggcttcagcagcactgaacattggctgtgtcagtccagtgaatctcaggctgtgaagtcctgt

SEQ ID NO: 552803 - DNA, 66 bp, Homo sapiens
tttggagagggccttatgccgctgtattttataatgaaatataatggtccagggtcactttttaaa

SEQ ID NO: 552804 - DNA, 66 bp, Homo sapiens
ggtaacaaagagcaagagaagtaccagcaagtccattagccactctgcttctctctctctgttacc

SEQ ID NO: 552805 - DNA, 66 bp, Homo sapiens
ggggctgtgtcactgtgggcatagaaagtagtactattacaatattctcacagtgacacaagcccc

SEQ ID NO: 552806 - DNA, 66 bp, Homo sapiens
aggaactgggacagaaatcggaagaaataattccccaatcttctgatccctgtgctcccagttctt

SEQ ID NO: 552807 - DNA, 66 bp, Homo sapiens
tcccacttccctacttccttccagcagatccctgaagaaaggaggcagaaggaactaggaatggga

SEQ ID NO: 552808 - DNA, 66 bp, Homo sapiens
ttcctgggcctgtgccttgtctctggctgcctgtggcagctggacagggctgagagcccttgggaa

SEQ ID NO: 552809 - DNA, 66 bp, Homo sapiens
catattctagatccattccaaagtaaaagctgacagaacttgctgatgggttggaagtgggatgtg

SEQ ID NO: 552810 - DNA, 66 bp, Homo sapiens
cccactccacctccagctgctccaaggcatttcttcctgtgatgttctagcagctggtgcagtggg

SEQ ID NO: 552811 - DNA, 66 bp, Homo sapiens
tgtttatttatacctggtctcattccacaagggatttgtggagtgtgattcagtataatataaata

SEQ ID NO: 552812 - DNA, 66 bp, Homo sapiens
aaggcaataatgtttgtgcagtgctattcctttaactgaatagtactgtttgtaattgttgacctt

SEQ ID NO: 552813 - DNA, 66 bp, Homo sapiens
gcccaagatgttggcaggctgggagcagcccttcctgggactgtgctctcagctgctggcacgggc

SEQ ID NO: 552814 - DNA, 66 bp, Homo sapiens
ggacttgggcgtcagtattctggtcaagaggcctcccaaatttatgagagtctgatgtttgagtct

SEQ ID NO: 552815 - DNA, 66 bp, Homo sapiens
ttctcaggaagctctcctgaatgccagtgcttgcctcactgagatttaggagaagttctctgggga

SEQ ID NO: 552816 - DNA, 66 bp, Homo sapiens
gtctccttgaggatgaggatggggcgggcgatgtggtcggcgctgcactccacctcgtcctgagac

SEQ ID NO: 552817 - DNA, 66 bp, Homo sapiens
tcccgccctgatgtgtgtcggctggatcagaggcgcctctggaactggggcacattagggaaggga

SEQ ID NO: 552818 - DNA, 66 bp, Homo sapiens
gggaggaaggtatacagaattgtaaatggcatgctccaaacttatattcttgattactttcttcct

SEQ ID NO: 552819 - DNA, 66 bp, Homo sapiens
acatatggtttggatttgagtgatttcttcccaagctggagggatttctctcaagcaaatctatgt

SEQ ID NO: 552820 - DNA, 66 bp, Homo sapiens
tccttttcatccttccctgaactttgtaattataacctcaataaaagggtgggaacatggaaagga

SEQ ID NO: 552821 - DNA, 66 bp, Homo sapiens
gtagaaagagggtatgagtaataggtggcttaagccaaatttagtttagtcatatccttgctctgc

SEQ ID NO: 552822 - DNA, 66 bp, Homo sapiens
gcaattccttttttgaagctggagggaagggtccaagaaagccaactcccagttccaagaaagtgc

SEQ ID NO: 552823 - DNA, 66 bp, Homo sapiens
gtgggatggcccatgtttcaccagcactcagatgccctggggctcggggcttatgggcagttttgc

SEQ ID NO: 552824 - DNA, 66 bp, Homo sapiens
ctcctttctctttctttccccagactttgggaatcacccaactgatggaaagaaccaggaaagggg

SEQ ID NO: 552825 - DNA, 66 bp, Homo sapiens
agtgctttgtgctgccagtggaaagccgggtgacccgcctcggcccgctgagcagccgaacgcgct

SEQ ID NO: 552826 - DNA, 66 bp, Homo sapiens
attgcacaagcaattaggcatttacactctaaaaattaagagaaaatgtctgattgtgtatgcaat

SEQ ID NO: 552827 - DNA, 66 bp, Homo sapiens
tgtgacctctggcctctcccaataatgaagtccatctagcagtccttcagggaaggctgaggcaca

SEQ ID NO: 552828 - DNA, 66 bp, Homo sapiens
tgggggttagggggtcagagtaagcctatggctgtatggctgccctccttgactcctacaccccca

SEQ ID NO: 552829 - DNA, 66 bp, Homo sapiens
agggttctcctggagggtagtttttttgggaatctagcccaaggaggatgccttccctgaagccct

SEQ ID NO: 552830 - DNA, 66 bp, Homo sapiens
cctgggattttctgcctgagggtgctctctgctcagaaggcactccggcaggctggaggtgccagg

SEQ ID NO: 552831 - DNA, 66 bp, Homo sapiens
gggaggatctcgtttcaaaagggttaacccacagccaatgggagcctgggggagcggatcctgctc

SEQ ID NO: 552832 - DNA, 66 bp, Homo sapiens
aaggtgatctcaattattttcatagcatctcttgatgatgaggtacaaatggttgggattattctt

SEQ ID NO: 552833 - DNA, 66 bp, Homo sapiens
tgggactggcagcagaggacagaatgtgtaaaggagagaaaaacaaactgtgcctctgcagtccta

SEQ ID NO: 552834 - DNA, 66 bp, Homo sapiens
ctctgctagaaggtggggcagggattcagcccccggtgctgtccctgactctctttctgcgtggag

SEQ ID NO: 552835 - DNA, 66 bp, Homo sapiens
tcaaattggtgtcccatttgttgggctcctggcaaatattcccagcttattgggacactgatcaga

SEQ ID NO: 552836 - DNA, 66 bp, Homo sapiens
aattataaagtaaaatgagactgatttcccacgtcatgaggaaaaatgtctctttactttgtgatt

SEQ ID NO: 552837 - DNA, 66 bp, Homo sapiens
ggagggcagggccctaagatacacatcagaaacaaacgtcctcattgtgtcttgggccctggtccc

SEQ ID NO: 552838 - DNA, 66 bp, Homo sapiens
catttccaaagtgtcttttaagcattatccggtttgactcttatctacaggacactttggcaaatg

SEQ ID NO: 552839 - DNA, 66 bp, Homo sapiens
tgtcagcaggccttagtgattatagtggcgcccactccctctactgtagttaaaggtctgttagca

SEQ ID NO: 552840 - DNA, 66 bp, Homo sapiens
cagtgcttggcacctagcaagcactcagtaaatatttgttgagtgcctgctatgtgccaggcattg

SEQ ID NO: 552841 - DNA, 66 bp, Homo sapiens
gggaggtcagggtggccatgagttagtttttagatattttgagttggaggcgttccctgacctccc

SEQ ID NO: 552842 - DNA, 66 bp, Homo sapiens
taccatatgcaaaggggaaggctttacttctctttggaaacatagccttccctgttgcatacagta

SEQ ID NO: 552843 - DNA, 66 bp, Homo sapiens
ggacctgtctgtttttcttgccatacctgagatcatcagaaatggcattgcaagggcaggaggtcc

SEQ ID NO: 552844 - DNA, 66 bp, Homo sapiens
tgtcagctgttcttttctctattcctggttcaaagccaacattatcagaagggagacaagttggca

SEQ ID NO: 552845 - DNA, 66 bp, Homo sapiens
ttctttttgtttagtgttttggggcctctagttctagtaggtaaccaataaattaagcaaaacgaa

SEQ ID NO: 552846 - DNA, 66 bp, Homo sapiens
ttgagacacagcagtgcctgcctcagctcttcttgggggaagtggggcggggcacctgcttctcaa

SEQ ID NO: 552847 - DNA, 66 bp, Homo sapiens
gaaagaatgctgggagccatcttgaataaatggaaagttagacaaaatggcattcagcaacctttc

SEQ ID NO: 552848 - DNA, 66 bp, Homo sapiens
ggagttgagggtgttcttgcaggtacacactctgccctcttttcctctgagaacatcttccgcttc

SEQ ID NO: 552849 - DNA, 66 bp, Homo sapiens
gctcagggcagaggccacagaggactgcatttgcacctgacttctagactggcttctgctgtgagt

SEQ ID NO: 552850 - DNA, 66 bp, Homo sapiens
aagaacagtaggccctctgaagggtttccagcagttgtgctttgcccttaaggggctgcttttctt

SEQ ID NO: 552851 - DNA, 66 bp, Homo sapiens
agtttaggaggagagaagggcgacatcggggcaatcctctgagtctctctttcctcctcaggaact

SEQ ID NO: 552852 - DNA, 66 bp, Homo sapiens
gagtggcctatcatctgacatacagttcaggagtatacatctgagaggtgttggatggggctgctc

SEQ ID NO: 552853 - DNA, 66 bp, Homo sapiens
cctgccagtcagtgtgggatgggccagtgggagaagagactgggcatcctccactgaccaggcagg

SEQ ID NO: 552854 - DNA, 66 bp, Homo sapiens
gctgtatgtgaaaatgtcaagtgctttttaagaatggattttacacttgccattttcaagtgcagt

SEQ ID NO: 552855 - DNA, 66 bp, Homo sapiens
acccccacatttttgagtcttcatcctttatgttaaacattggggtgaagaataaggagtgggggt

SEQ ID NO: 552856 - DNA, 66 bp, Homo sapiens
tactgtatgcaacagggaaggctatgtttccaaagagaagtaaagccttcccctttgcatatggta

SEQ ID NO: 552857 - DNA, 66 bp, Homo sapiens
tatttgttgttgacctgctgggtgtgatatatttctgtgcatttaccagtaggtcaattctctgta

SEQ ID NO: 552858 - DNA, 66 bp, Homo sapiens
tgtctaaattgtgaagaataagcattgtagtgacaaatgtcatgcttgtctacatttctttagaca

SEQ ID NO: 552859 - DNA, 66 bp, Homo sapiens
gctacaggtgctgaggggctctgtcctcacagccacactggacttggccccgtggcgctctgtagc

SEQ ID NO: 552860 - DNA, 66 bp, Homo sapiens
gcttttgactgggtgtctaaggccagtagggattccaggcaggcagcagacaatcagttagaaagc

SEQ ID NO: 552861 - DNA, 66 bp, Homo sapiens
gggaaccaagtgagtaaatgtcaagtgggagatgagctttcttttgatatttcctcacttgtgact

SEQ ID NO: 552862 - DNA, 66 bp, Homo sapiens
ccctctccttcccctctgcctccgggctgctggatgtgggtggagcagaggaggaagggcacaggg

SEQ ID NO: 552863 - DNA, 66 bp, Homo sapiens
cttaaattgctacagtaattcaagagacagccctgtctggacacagagttactgtggatttttaag

SEQ ID NO: 552864 - DNA, 66 bp, Homo sapiens
tgctgtgggtctggagccaatctggttgaactttttcagcccctgactggctccagtgttatggta

SEQ ID NO: 552865 - DNA, 66 bp, Homo sapiens
tctgttctgattgacacaggatggacaggtggaggtgaccatccatcagtgtcaggaaggacctga

SEQ ID NO: 552866 - DNA, 66 bp, Homo sapiens
gcctccctaagacctttccctcctcccacaggcagatgcccaactaggaggagagggtttgggggt

SEQ ID NO: 552867 - DNA, 66 bp, Homo sapiens
gctgagtgataatagggtcgtgacctccttggaaagggagaccatgttccttgcattgtcatcagc

SEQ ID NO: 552868 - DNA, 66 bp, Homo sapiens
gggagggaaagatgggaaggggacagctgtgattactgacccatcctgccccagctttccctcact

SEQ ID NO: 552869 - DNA, 66 bp, Homo sapiens
gagacccagtgcaagtgtagatgccgactccgtggcagagttcagcgtttcacactgcctggtctc

SEQ ID NO: 552870 - DNA, 66 bp, Homo sapiens
aggtggccaggtgcatatcttggtgtgaggaccttcgctgtatctgggaatgcctactggttacct

SEQ ID NO: 552871 - DNA, 66 bp, Homo sapiens
tgaggttatttagggttaccacctggctactagatttgccagatggcaagcctgagtaactgctca

SEQ ID NO: 552872 - DNA, 66 bp, Homo sapiens
gcagcacatgaaggcgcccacacattacttcttagcagctgagtgtgaggtgcatgcatgtgaggc

SEQ ID NO: 552873 - DNA, 66 bp, Homo sapiens
cctcctcctggtgcagtgttccgaaatcacctgtggtgggtttcattagcatgggcacaggggagg

SEQ ID NO: 552874 - DNA, 66 bp, Homo sapiens
ttattttctgccatttaccttcaaaccaattctttgacagtggggaggaggtaaagcagaaagtga

SEQ ID NO: 552875 - DNA, 66 bp, Homo sapiens
cctctcagtcttcttggaggcttcttgaagctgaagaagttaagcagtagttaaggagaggagagg

SEQ ID NO: 552876 - DNA, 66 bp, Homo sapiens
tgtcactgtgtctggtccacagtaggaatttaacacatacttgctggagaggccagttacggggca

SEQ ID NO: 552877 - DNA, 66 bp, Homo sapiens
ctaggggatgggcaaggtagaactcaccctctcttggaagtgggcatctatctgtctgactcttag

SEQ ID NO: 552878 - DNA, 66 bp, Homo sapiens
ctggtgtggtgtcgagctaggaaatcctgtgtatgttagcacagtatcgtctcacattcacaccag

SEQ ID NO: 552879 - DNA, 66 bp, Homo sapiens
ttcttcatgggaaagaatcacttaatggaacagattcctgagttagatgttttcttcccaggagaa

SEQ ID NO: 552880 - DNA, 66 bp, Homo sapiens
aggtggccaggtgcatatcttggtgtgaggaccttcactgtatctgggaatgcctactggttacct

SEQ ID NO: 552881 - DNA, 66 bp, Homo sapiens
tggtaagtagtaagccaggttaggcatgagaagcactttgcacagagcctggcacattatttagca

SEQ ID NO: 552882 - DNA, 66 bp, Homo sapiens
ggctttggtaactctggagcaagggctgtgagcagcgctgagccctgctccaggtcacctggggcc

SEQ ID NO: 552883 - DNA, 66 bp, Homo sapiens
gggtggctgcagggggtggtatcggggagggctcccaaatgcccctccatccccatgcacccaccc

SEQ ID NO: 552884 - DNA, 66 bp, Homo sapiens
ctcctgactgattgcactacatactgatgctcactaatatcaatatgtaatgtaatcagtcaggag

SEQ ID NO: 552885 - DNA, 66 bp, Homo sapiens
tctaggtcttagatagcttgtcctggggctccggcttgctgcggggagagctgtgcggggcttgga

SEQ ID NO: 552886 - DNA, 66 bp, Homo sapiens
aaaccagggggaggagggtgttgggtggagatgaagttgctcttgactctccttcccatggctgtt

SEQ ID NO: 552887 - DNA, 66 bp, Homo sapiens
gagtgaaaaaaatttggaggggagaacagtaagcacggtgagcccatccaaatgaagttttcattc

SEQ ID NO: 552888 - DNA, 66 bp, Homo sapiens
gtgatgtgttggtgagacaaactgtgtcccattctggaacatattaagtttgtctccaggacacac

SEQ ID NO: 552889 - DNA, 66 bp, Homo sapiens
tgtgttctcctaggtcccactgaagatgtgcaggtgtctgcacacggcggtgtggaggagaatata

SEQ ID NO: 552890 - DNA, 66 bp, Homo sapiens
cagctgggggactgctttaggaggtcgagcctcagacctcccatgaggcgtgtccctgggcagctg

SEQ ID NO: 552891 - DNA, 66 bp, Homo sapiens
ggtcatcgccagccaaccacgacgcgcccgacaggacacatcaggcgctgattggctgccgagacc

SEQ ID NO: 552892 - DNA, 66 bp, Homo sapiens
tagtgcatttggctaattttcttttccaggctttttactgtaaagaaaattggcctccatggatta

SEQ ID NO: 552893 - DNA, 66 bp, Homo sapiens
taggagaggctggcctcaggagctaaaatgctgggattgtgttccagctcctgcctgcctctgctg

SEQ ID NO: 552894 - DNA, 65 bp, Homo sapiens
gatcttttggggaagtttgggatctggctgggcgtctgcataatccatagaaatccctgagagtc

SEQ ID NO: 552895 - DNA, 65 bp, Homo sapiens
gcttgtaagtgctagagcgaggaatgcctccttctaagctccgttcctccctctggtgcctgagc

SEQ ID NO: 552896 - DNA, 65 bp, Homo sapiens
gaaggcggttccggttcgcggcggttcccgggttttgcgttccgcgcccggccggaaaccccttc

SEQ ID NO: 552897 - DNA, 65 bp, Homo sapiens
agtcacacaagataggcttttgggctttcagggaggtgtgggggcttcttgcctgtcttggtgct

SEQ ID NO: 552898 - DNA, 65 bp, Homo sapiens
tgcttgaatttgtcaaatgtcacacactctatttcaaacatgtgagatttgacatcatgtgagca

SEQ ID NO: 552899 - DNA, 65 bp, Homo sapiens
tttcttcctttttctttttggctctttattttatttgccagtgacctgaagaagatgggaagaga

SEQ ID NO: 552900 - DNA, 65 bp, Homo sapiens
gtgggatgcttaggatcttgcccttatggtataggcacaagaagggcaggctccaagcatcctat

SEQ ID NO: 552901 - DNA, 65 bp, Homo sapiens
aggatggggaaagggagggaacgaaagtcctagtaaaaggagcttccatcctcttccctcatcct

SEQ ID NO: 552902 - DNA, 65 bp, Homo sapiens
actgtactcttatagccatctgaaatacgttttctaggtagagatagattgtgtaagggtacagt

SEQ ID NO: 552903 - DNA, 65 bp, Homo sapiens
agatagctgggtgtagggggcttttgaatggatgcactcatttctgccccctggtctagctatct

SEQ ID NO: 552904 - DNA, 65 bp, Homo sapiens
gacgcttgggaggaggagttgataggtgacttaatgttaaatctgggttccctcccccaattgtc

SEQ ID NO: 552905 - DNA, 65 bp, Homo sapiens
gacaggagtttgggtcacacgtgagcttcatggagttgagctcatgtgtgacccaaactgctgtc

SEQ ID NO: 552906 - DNA, 65 bp, Homo sapiens
gacaaacgtctttgcagccagtaaaggtcaacttgtcacctttgctctagctgcaaatcgttttc

SEQ ID NO: 552907 - DNA, 65 bp, Homo sapiens
aaggtgattaaaccagatgtgttgatttctacaggggtttaagccatcgttgggtttaattactt

SEQ ID NO: 552908 - DNA, 65 bp, Homo sapiens
caggaaggaggtggttcacattggccccggaatcaatacttatgctgtggatgacctccttcctg

SEQ ID NO: 552909 - DNA, 65 bp, Homo sapiens
attaggtatgcagcctatttgccagggtgagttatctcctcttagagtttggttatatacctagt

SEQ ID NO: 552910 - DNA, 65 bp, Homo sapiens
ctcctgagccatgatgggccccagtccaatgaaaccttctgtggcagcatcatggtgtccagggg

SEQ ID NO: 552911 - DNA, 65 bp, Homo sapiens
gtggctgtatatattttgcatatctacatacatattactatgcaaagttgtatacacaaagccat

SEQ ID NO: 552912 - DNA, 65 bp, Homo sapiens
ttagggagaggagccggctgtccgggagagtttgaaaaaatgccctcagcctcttttcttcttga

SEQ ID NO: 552913 - DNA, 65 bp, Homo sapiens
tcaccagattcttctcattgtcctccaccgggtttcccacaaaggcaatgatgcggatcttgtga

SEQ ID NO: 552914 - DNA, 65 bp, Homo sapiens
gcgcacgtgatgatctggctaggattattagagctcttctgttaaagcacagatcacatgtgtgc

SEQ ID NO: 552915 - DNA, 65 bp, Homo sapiens
tctgattcattgaacgttctgattgatggagacaagagtttcagtgaatgttctaatgcattaga

SEQ ID NO: 552916 - DNA, 65 bp, Homo sapiens
agggtagtgggaaaggcaaggctggcaaaaaggggccctgcctggccatttcccccgattaccct

SEQ ID NO: 552917 - DNA, 65 bp, Homo sapiens
ggagatgcgttggggcaggggaggtccaggtaggcttggcccgacccctgccccagcgtgtgtcc

SEQ ID NO: 552918 - DNA, 65 bp, Homo sapiens
gtggaccggagggaggcggtggggctaacgtccacactgcccctgccgccttctgtccattccat

SEQ ID NO: 552919 - DNA, 65 bp, Homo sapiens
ggtgctctcaggaaggagtatagtaaatgcctcatttaataacatactcctttttgaaagttgcc

SEQ ID NO: 552920 - DNA, 65 bp, Homo sapiens
ggtgctgtgactgaagagcctgggatgactgcccatatgaatggtccaggctctgctccatcgcc

SEQ ID NO: 552921 - DNA, 65 bp, Homo sapiens
cctgagccttagccagcagaggactcttttgatccatgtccttaggctgttgagctcagctcagg

SEQ ID NO: 552922 - DNA, 65 bp, Homo sapiens
gagaagcctggtaattttcagtcaagtacttggattaagggctttatcgaaaattactaggcctc

SEQ ID NO: 552923 - DNA, 65 bp, Homo sapiens
ctcagccagaggcaaagcagccgcatctgcgcgtaagatcacgtttgctttgctcctgagcagag

SEQ ID NO: 552924 - DNA, 65 bp, Homo sapiens
gtgggaggggcagggatagaagcaaagcagagaaaaattgctctaattccttctgctccttctat

SEQ ID NO: 552925 - DNA, 65 bp, Homo sapiens
ggctgtgagacttgttcagggtcatcggaactgcatttcgctgagccagaatgagatttcaggcc

SEQ ID NO: 552926 - DNA, 65 bp, Homo sapiens
gtatctggggatatgtgttcagagtgtgaagcttctgaactctttgaaggtgtgtcccaaggtat

SEQ ID NO: 552927 - DNA, 65 bp, Homo sapiens
ttcctcatcctcctgaggcctggggagcgctctaacaaccagacggccaaacagaggatgaggag

SEQ ID NO: 552928 - DNA, 65 bp, Homo sapiens
aggtggagcagtgttgggtgaaagacagcaacttcaagggggtcacctgacactgcaacccattt

SEQ ID NO: 552929 - DNA, 65 bp, Homo sapiens
ccccgttccctctcggtgggagtcaagggggaaaagcccttgaatcccgagacggggggatgggg

SEQ ID NO: 552930 - DNA, 65 bp, Homo sapiens
gcttcaggggatcagagactaggctccaaataagcttgccaagcctcagtttcctcctttgaagc

SEQ ID NO: 552931 - DNA, 65 bp, Homo sapiens
ggggaggagggaggagatgggccaagttccctctggctggaacgcccttcccccccttcttcacc

SEQ ID NO: 552932 - DNA, 65 bp, Homo sapiens
gggagttgtagtttcggatgcgttccccgtcaacgcggcggcggcggtcgtggactacaactccc

SEQ ID NO: 552933 - DNA, 65 bp, Homo sapiens
gaatttataatccatctggggtctctcatgtgaagatataggaaccccagatggcctgtgaattt

SEQ ID NO: 552934 - DNA, 65 bp, Homo sapiens
cagccaggggccggagtgggaggcagggccagatgtcccgctccttccaccctggtcccctgctg

SEQ ID NO: 552935 - DNA, 65 bp, Homo sapiens
aattctggttcctctgcctttgtgggcaaattagctcttcaatgttcaggtagggagccggagtt

SEQ ID NO: 552936 - DNA, 65 bp, Homo sapiens
tttccttctgttctagttagctgtaggcttgggtagaattcagcagttaattggagggagggaga

SEQ ID NO: 552937 - DNA, 65 bp, Homo sapiens
cttttggggggctacacggccctttcaataatttgtgagagcatttgtgataggctctccagaag

SEQ ID NO: 552938 - DNA, 65 bp, Homo sapiens
caccttcgaggaatcgtttatttgctctgggtcccctgtctagactgcgagctccttgaaggctg

SEQ ID NO: 552939 - DNA, 65 bp, Homo sapiens
atatttgaaaatgtggcagtgggtgttgatggatttttctaatcacactgcacatttctagatat

SEQ ID NO: 552940 - DNA, 65 bp, Homo sapiens
tcatgtctgtcctctcataggatcacgagactatcacatggatcccacagagaagacaggcaaga

SEQ ID NO: 552941 - DNA, 65 bp, Homo sapiens
ctggattgctctctcgtttcttaatgttttgttcatgcaaacattaagatccagaagcaagacag

SEQ ID NO: 552942 - DNA, 65 bp, Homo sapiens
agtcagactgactgcagtgtggtcatttttctaacccataactgctcacactgcagcagtctgct

SEQ ID NO: 552943 - DNA, 65 bp, Homo sapiens
ttgtactccttccttcctcaccatgctgtggcatgcacggcctgtgctgggaactaggggtacaa

SEQ ID NO: 552944 - DNA, 65 bp, Homo sapiens
gaattatcttccattgccaagtcctcaaaacttctatcaatagggagttggcaggtgagatgttc

SEQ ID NO: 552945 - DNA, 65 bp, Homo sapiens
tctgccaggtggggagaggccaggcccgcctctgcccccaggcctgcctgccccgccctggcaga

SEQ ID NO: 552946 - DNA, 65 bp, Homo sapiens
gccttttctccccagacttgttggcataggatacagagaagccttcaagctctgagggaaagggc

SEQ ID NO: 552947 - DNA, 65 bp, Homo sapiens
tgtggctgcctggggagctgtctgctcatcatcctccttcccaggtccctcccctgcagctactg

SEQ ID NO: 552948 - DNA, 65 bp, Homo sapiens
ggggctctaagtgtggcccatgagcttggcttcccagagctagggcccggtcactgtggggtccc

SEQ ID NO: 552949 - DNA, 65 bp, Homo sapiens
agggtatagaattaacttgcacgatgataatttatattttatgcgagttttatttttatacacct

SEQ ID NO: 552950 - DNA, 65 bp, Homo sapiens
gagaaacacaagagcaaggtgctgaggcaaaaaacacctgaggtagctttttctgtgtgtttttc

SEQ ID NO: 552951 - DNA, 65 bp, Homo sapiens
tttcttctgttggcccctcatgttgtcagtgaaatggctacaagaatggcatttgatggaagaag

SEQ ID NO: 552952 - DNA, 65 bp, Homo sapiens
tggttcttgtgaaactggaagtaaggggtggagttcactgatgactcccaggttcatagctgcta

SEQ ID NO: 552953 - DNA, 65 bp, Homo sapiens
ggcaggcaggtgtcccgggcatcagccagtggatggagagaggctgctgggactcctgctctgcc

SEQ ID NO: 552954 - DNA, 65 bp, Homo sapiens
agaaaacagatctgacttggctctgtgagtccatctcacatactgggttgagtataattttttct

SEQ ID NO: 552955 - DNA, 65 bp, Homo sapiens
ggagggggagttagagaggagggaatcctgctgctgccggaagatctatttctgattccacttct

SEQ ID NO: 552956 - DNA, 65 bp, Homo sapiens
tgaaacttggcttttagctgcatggcatgttaaagtacctccgatgtggctggaagcttgtatta

SEQ ID NO: 552957 - DNA, 65 bp, Homo sapiens
cctggggagctttgctagttcagcctaagctttcagtgaaggtgcaagcaacagagcttcctggg

SEQ ID NO: 552958 - DNA, 65 bp, Homo sapiens
ttcagtagtgccggtgttgtctgggaaaagccaggtttccctcagacaacattgggacatacgaa

SEQ ID NO: 552959 - DNA, 65 bp, Homo sapiens
gttttgataatgcaagtcaggctgagcatttagctagtgtctcagcaggcatgtttgtcaaatgc

SEQ ID NO: 552960 - DNA, 65 bp, Homo sapiens
tgagcgctttgttcttcgctggctgttgttaccgatctataagcggcaggcgggaaaagcgcgca

SEQ ID NO: 552961 - DNA, 65 bp, Homo sapiens
cgtggtctgctttccatctctgagctatgaacggtttcattttcaaagcaggaaaacaaaccacg

SEQ ID NO: 552962 - DNA, 65 bp, Homo sapiens
agagaggagaagggggaggtgatattgcagaaaacatggtaaactctcctctctttctgctttct

SEQ ID NO: 552963 - DNA, 65 bp, Homo sapiens
atcaggtctgcattttagaaagataggcctgtcctgtttaagaatggtctgggtggagacttgat

SEQ ID NO: 552964 - DNA, 65 bp, Homo sapiens
attgattctctttattttctgcatcctgtgaatgcacaagggcccagagtggagagagacttggt

SEQ ID NO: 552965 - DNA, 65 bp, Homo sapiens
attctagtttcctcccgcgtgggtgcagctgagacttgctgtggactcacagaggaagctggagt

SEQ ID NO: 552966 - DNA, 65 bp, Homo sapiens
ttcgtcatcctcctgaggcctggggagagctctaacaaccagacggccaaacagaggatgaggag

SEQ ID NO: 552967 - DNA, 65 bp, Homo sapiens
aggtgcactccttgcagcattctggagagaagccctttagatgcgaggtaaggaatgtgctacct

SEQ ID NO: 552968 - DNA, 65 bp, Homo sapiens
agggaggggcaagctggcagtgcctgggaaaagcccgagaaaagccctgtcggctccctcttcct

SEQ ID NO: 552969 - DNA, 65 bp, Homo sapiens
gaaacgaggttatgattggcatgacattctccattgaggtttgccatagttatagccatgatttc

SEQ ID NO: 552970 - DNA, 65 bp, Homo sapiens
ggtcttgtaaataagctgacagtaaagctgtatggtacatactgtccagcttagcatatagggcc

SEQ ID NO: 552971 - DNA, 65 bp, Homo sapiens
ggttctgtggcctcttagacactgaggcccttaccaactcctcggttctgagagccgcttagacc

SEQ ID NO: 552972 - DNA, 65 bp, Homo sapiens
ggtctatggtgggagaggaagatttctgagtttcattcaaagttttctgagtcctatagtatgcc

SEQ ID NO: 552973 - DNA, 65 bp, Homo sapiens
ggatgcagggtgtggactcatgtatcctggtatcctggaaaagttgagttcacatcctagtattc

SEQ ID NO: 552974 - DNA, 65 bp, Homo sapiens
tttaggggacaccatactcatgttggttccacaccagtgcaactgaacatgtgtgtggccctgga

SEQ ID NO: 552975 - DNA, 65 bp, Homo sapiens
cgtggtttgttttcctgctttgaaaatgaaaccgttcatagctcagagatggaaagcagaccacg

SEQ ID NO: 552976 - DNA, 65 bp, Homo sapiens
agtatcccaggcccgggattaggcactgaggacacacagatgaccatgatctggtctgggatgct

SEQ ID NO: 552977 - DNA, 65 bp, Homo sapiens
tcagttgatattttaaggtctgagaccttcttaactgctgcttcagaccttgacttatctactga

SEQ ID NO: 552978 - DNA, 65 bp, Homo sapiens
tcctggggttgagtcaaggcagagctctggcccatacctggttgtgctgcaggtcagccctggga

SEQ ID NO: 552979 - DNA, 65 bp, Homo sapiens
tgtgtgtgagaatgtgtaatgtgtgtttgcgtataagtatatacattatgtatgatcaatatata

SEQ ID NO: 552980 - DNA, 65 bp, Homo sapiens
tagggcctgctggtgcttccattgagacacccactctcgcaacaggaaggaccagctggcctctg

SEQ ID NO: 552981 - DNA, 65 bp, Homo sapiens
tgtggtcagtagaatgttttgctttcttatagtcacaacagcatagaacagtcttctgagccaca

SEQ ID NO: 552982 - DNA, 65 bp, Homo sapiens
acacagagaaagagagagagtatacatcacctacctatgtcatgtgtttttctttttctctttgt

SEQ ID NO: 552983 - DNA, 65 bp, Homo sapiens
caggcttgggtcagaaggcttgttccttagtcacatgttgctacaagtaaatgacaccaggcctg

SEQ ID NO: 552984 - DNA, 65 bp, Homo sapiens
tcaagggggaaaaaatctccagctttccatgtgtaagtggatggaagagactttttcctttttgg

SEQ ID NO: 552985 - DNA, 65 bp, Homo sapiens
tcctctcaaggaggctgctatctgagagcacacagtggggtttgatgtagcctctcttgagtaga

SEQ ID NO: 552986 - DNA, 65 bp, Homo sapiens
cttcctgtcaccttgctctcctatcaacatgtcattttgtaaaaggggcagcagaagataggaag

SEQ ID NO: 552987 - DNA, 65 bp, Homo sapiens
gtgaggattggagaaccaggatttctgctatctgaccagagtagaaatctattctcctttctcat

SEQ ID NO: 552988 - DNA, 65 bp, Homo sapiens
catatggccacagcttgtttgcaaagaatgctgatcatgctttcaaacaaaactgttcccatatg

SEQ ID NO: 552989 - DNA, 65 bp, Homo sapiens
ctcaaaaagctgctcagattcttttaagcactgagtgattcagagaaactgagcagcaccgcatg

SEQ ID NO: 552990 - DNA, 65 bp, Homo sapiens
gatcaaaattgaaccttctcagacttcagattcctgactgtgatgagctctgttcacttttgatt

SEQ ID NO: 552991 - DNA, 65 bp, Homo sapiens
gcacatcacttcctctctgagcctcagtttcctcatggtaaggcagtgggggggaggtgatgtgt

SEQ ID NO: 552992 - DNA, 65 bp, Homo sapiens
tagggcctcctggtgcttccgttgagacacccactctcacaacaggaaggaccagctggcctctg

SEQ ID NO: 552993 - DNA, 65 bp, Homo sapiens
gggtctgtgtcactgtgggagtagcagctaccaccactacaatatcctcacagtgacacgagccc

SEQ ID NO: 552994 - DNA, 65 bp, Homo sapiens
ggtctggtcccctgttgcccatagccctttaccctgagcaccacccaacagactggggaccagcc

SEQ ID NO: 552995 - DNA, 65 bp, Homo sapiens
aggctccaaaccacatgctggactttcattctcaaaagcaatccatatgtgccttttgagagcct

SEQ ID NO: 552996 - DNA, 65 bp, Homo sapiens
gatggcccaggtgcacccagaggccccagccctttggctgcctttgggttgtgacttgggttgtc

SEQ ID NO: 552997 - DNA, 65 bp, Homo sapiens
ctggtctgttgtctaccctcccgtggtgattgaagccattcaccctcaggggagacagagaccag

SEQ ID NO: 552998 - DNA, 65 bp, Homo sapiens
tcagtagataagtcaaggtctgaagcagcagttaagaaggtctcagaccttaaaatatcaactga

SEQ ID NO: 552999 - DNA, 65 bp, Homo sapiens
tttggtgagagggttctttcccccttcttgtttctgagggactgattggagcgctctcgactgaa

SEQ ID NO: 553000 - DNA, 65 bp, Homo sapiens
gtgacccacatcgcctgcctgacacactccagacactgcagggagtgcaggctgggatgtggcac

SEQ ID NO: 553001 - DNA, 65 bp, Homo sapiens
tgctgtggttactcagaaaccagcaactatgtcaggttcctggtttacagagtaaaccaatagca

SEQ ID NO: 553002 - DNA, 65 bp, Homo sapiens
tccttcctgagctaattaagggtcactccgggatcttcagagttttctttggtggcttcagagga

SEQ ID NO: 553003 - DNA, 65 bp, Homo sapiens
gaaatccgcaatcaggctttcatattttgctttttgctgagtgtgaattcctcattgttaatttc

SEQ ID NO: 553004 - DNA, 65 bp, Homo sapiens
cagagcccccattgtgcctgccccggagccgcctcaatggagctccctggcacaaaggggctttg

SEQ ID NO: 553005 - DNA, 65 bp, Homo sapiens
gggtgggttcattattcttgggcgtcctggctgtgctgtgacaccagagactgatgaggccaccc

SEQ ID NO: 553006 - DNA, 65 bp, Homo sapiens
catgctggaccatggcccaccctcacccactctgccgctgagcagggccacatgactccagcatg

SEQ ID NO: 553007 - DNA, 65 bp, Homo sapiens
tgtctccagaggatgccaagcataaagtccttgagtatattcatcttggatcctctgattggaca

SEQ ID NO: 553008 - DNA, 65 bp, Homo sapiens
aaaaatgtagatttctgtgctcctttcaaagagtggctcactaggacgtacgaatctgcattttt

SEQ ID NO: 553009 - DNA, 65 bp, Homo sapiens
gcaggggttctttgtgctttgataactgcgttcatgagttgctggcagagcacagctatctctgt

SEQ ID NO: 553010 - DNA, 65 bp, Homo sapiens
tgggagcctggcaggccagagggacattcacatatcacacctgtctggctatatgctggcttcca

SEQ ID NO: 553011 - DNA, 65 bp, Homo sapiens
tctggagcccaggaagacagagacacacccaagctatggctgcgaggctgtccttgggctcctga

SEQ ID NO: 553012 - DNA, 65 bp, Homo sapiens
cagaagaaggagcggcccttgtgaccagtgcccttttggttcacaaggaacttctcctcttgttg

SEQ ID NO: 553013 - DNA, 65 bp, Homo sapiens
gggccccttcgtgtgcctacctggttatgtgcttgtccccatgtgggtacctctgaaaggggctt

SEQ ID NO: 553014 - DNA, 65 bp, Homo sapiens
gatattcctagaggtctccacctctcagcatctctggctgaaaggtggttcctctgtagaatgtt

SEQ ID NO: 553015 - DNA, 65 bp, Homo sapiens
gtcttgatagtcatggaacattatgctttaatcaatcattgatggagtccattggctgtcaggac

SEQ ID NO: 553016 - DNA, 65 bp, Homo sapiens
cctaatttgcagaatgcttttgttcaggattcttatttctgagattgaagcattgcaactccagg

SEQ ID NO: 553017 - DNA, 65 bp, Homo sapiens
gtgtagatgtctgaccaccttctgggatccatggtcaggattctagaacggttaggcttctgtgc

SEQ ID NO: 553018 - DNA, 65 bp, Homo sapiens
aactgaattacttcttccatggaataagtagactcttgtcttgatctgggagagtgaattcagtt

SEQ ID NO: 553019 - DNA, 65 bp, Homo sapiens
gcagttggtgatggtgttgtataggggggtaataatataactctatgccaactattgtcccctgc

SEQ ID NO: 553020 - DNA, 65 bp, Homo sapiens
tttcttatctgcaggaggcatccactgtaatacaagaaagagaagagtctccatgcagaaggaag

SEQ ID NO: 553021 - DNA, 65 bp, Homo sapiens
gtcatcagggggatataggagagaacttcctcaaggcaagttgacttctactattttcctggggc

SEQ ID NO: 553022 - DNA, 65 bp, Homo sapiens
caggcgtgtggctcccacgtggcctcacccagatggttctgccagtcctgggggctctatgcttg

SEQ ID NO: 553023 - DNA, 65 bp, Homo sapiens
tccagccatttctcttctgtcagagctctaatgaggttttagtgccaggagggaaagtaaatgga

SEQ ID NO: 553024 - DNA, 65 bp, Homo sapiens
aaaccctaaccagatgttctgattatcaccattagtgaagagattggaatattagtacagggttt

SEQ ID NO: 553025 - DNA, 65 bp, Homo sapiens
agccctgggactctgaatccagctgtgatgacttgggttcccagctagatcacactcccagggct

SEQ ID NO: 553026 - DNA, 65 bp, Homo sapiens
gccttgctgacattgtgactctgtcttgctggcagtgagaactagttgggatgtttagcaagagt

SEQ ID NO: 553027 - DNA, 65 bp, Homo sapiens
gcctcccctgccctggcttgggaaaggccctccaaaggatagcccgagctaggatgggaggaggc

SEQ ID NO: 553028 - DNA, 65 bp, Homo sapiens
ctgctaatgacgtctgtggtaaaccggtgtgttaatgaggttaatcacaggctcatgataagcag

SEQ ID NO: 553029 - DNA, 65 bp, Homo sapiens
cataagaagaagggtgaatggcccaggctttagctgggaccttgggtgagtcaccctcctctttg

SEQ ID NO: 553030 - DNA, 65 bp, Homo sapiens
gcatgcccattagtttttccattagtgaattcaacaatactaatgggattactagcatgggatgc

SEQ ID NO: 553031 - DNA, 65 bp, Homo sapiens
tgctcgtgtacttttatatcctggctgtgggatcccgccagcctgggaggagggtggagccagca

SEQ ID NO: 553032 - DNA, 65 bp, Homo sapiens
ctcacctgtcttctctgtgggatccatgatgtagtcccatgatcccaggacagggcagacctgag

SEQ ID NO: 553033 - DNA, 65 bp, Homo sapiens
gttttttcttcctggaatgctctgggcttgatttcaggagaagttcattcctttggagaaaagac

SEQ ID NO: 553034 - DNA, 65 bp, Homo sapiens
tctgtctccctccctctgtctgctgctggggtcccatgttggcaggcaagttgggaggagatgga

SEQ ID NO: 553035 - DNA, 65 bp, Homo sapiens
ggaggagccacagcctggtaacagggtgacttctggagtctgggtgcaggctgtgcgctcctgcc

SEQ ID NO: 553036 - DNA, 65 bp, Homo sapiens
ctgaactatcacctaatcctggagaagctacaatgtccaacactggggttaagtgaggagttcag

SEQ ID NO: 553037 - DNA, 65 bp, Homo sapiens
ggcaaggctggacactgggggctcgtggtggccaattctatgctccctcagggtcccgctctgtc

SEQ ID NO: 553038 - DNA, 65 bp, Homo sapiens
agggccgggtgatggaatatgagacaaaagcatttggattttattattccatttactctgaccct

SEQ ID NO: 553039 - DNA, 65 bp, Homo sapiens
taggttgattaggttgatactaattgatataggatgatagagattggatccaactgaccaaccta

SEQ ID NO: 553040 - DNA, 65 bp, Homo sapiens
ttttgtgccaggaattgtgcatatctgtgggaatacaatgatatgcattgaccctgccatcaaag

SEQ ID NO: 553041 - DNA, 65 bp, Homo sapiens
atgtcctgtggctgtatttggccagagctggatgctcctggtgaaatgccagccaaagcaggcgt

SEQ ID NO: 553042 - DNA, 65 bp, Homo sapiens
gattcttttttcgcttttaccacaccctctgtgggtgttccaccagaagaaaagaaaaagggatc

SEQ ID NO: 553043 - DNA, 65 bp, Homo sapiens
ccccgcccgatgaagaagatcccagggtaagtctagccctggatctcttgggtatcggggtgggg

SEQ ID NO: 553044 - DNA, 65 bp, Homo sapiens
gggcagagccagggtctgagcgggacagtctggctccaagctgtgccctgggccctgggtcgtcc

SEQ ID NO: 553045 - DNA, 65 bp, Homo sapiens
gctgatattcaggagattctacctaagaagtcagagcactataggaagagtctctggatagtagc

SEQ ID NO: 553046 - DNA, 65 bp, Homo sapiens
gtctggttgcttgatgagattagaggactttcacttgtcttgtaactgctcataggaaaccagat

SEQ ID NO: 553047 - DNA, 65 bp, Homo sapiens
aaatttaaggaggtgcttactctcaagtcataaaagtacttgcatatgaatgcctccttaaattt

SEQ ID NO: 553048 - DNA, 65 bp, Homo sapiens
tagcattgtttctgaatttgagaaaagaatttggaagttcctcttcttaagttctggaacagctg

SEQ ID NO: 553049 - DNA, 65 bp, Homo sapiens
atgctgattggttggatttcccagtgcttattacgaatgcatcaggaagtcttaacaattggcat

SEQ ID NO: 553050 - DNA, 65 bp, Homo sapiens
taggcagtgtagtgtaagggcatgatctctaaagttttaatcgtggctctttcatttactgtgtg

SEQ ID NO: 553051 - DNA, 65 bp, Homo sapiens
acatagacttctgcagaggctagctttatcagacagaagttgagtctctgtaggactctcagtgt

SEQ ID NO: 553052 - DNA, 65 bp, Homo sapiens
atggtttgcaagctgaaggagaaaaaatccacctcccacagctgttgcagccaactttccaacct

SEQ ID NO: 553053 - DNA, 65 bp, Homo sapiens
tttatagtttcaaaactaattattctattacataaaagcagaataattagttgggaaactataaa

SEQ ID NO: 553054 - DNA, 65 bp, Homo sapiens
caggccctgacacccctcctggggttgaaggcaggccctgaacaccagcagggggtccaggcctg

SEQ ID NO: 553055 - DNA, 65 bp, Homo sapiens
tttttatttacctgagagaaccaggctgtccttaggtgccaactggtctctcaggtaaatatgaa

SEQ ID NO: 553056 - DNA, 65 bp, Homo sapiens
gtgaccctctagagggaagcactttctgttgaaagaaaagaacatgcatcctttcagagggttac

SEQ ID NO: 553057 - DNA, 65 bp, Homo sapiens
ttttcttctggtctaaggtcttctgtttccctgtggaatcaggaagtgccatagatgagtgaaaa

SEQ ID NO: 553058 - DNA, 65 bp, Homo sapiens
ggattttgttttgttctgtttcccttgagctcggaaaccttaatggaacagagtaaggcaaatct

SEQ ID NO: 553059 - DNA, 65 bp, Homo sapiens
gcggccactgtggagctgaggggttgaaggggccactctagatccccaggacacagggcacccgc

SEQ ID NO: 553060 - DNA, 65 bp, Homo sapiens
tgctttctaaaggtcggcaaaactccctttgaagtcaaaagagagttttacttacctaagaagca

SEQ ID NO: 553061 - DNA, 65 bp, Homo sapiens
tgacttgactgtcccggggattaaagcctcgactggtttcctaatcacccaggtgacagcgagca

SEQ ID NO: 553062 - DNA, 65 bp, Homo sapiens
ggagcctgggccaccacaggggaaggatgctgctcagagcccacagacctgggtgcccgggcccc

SEQ ID NO: 553063 - DNA, 65 bp, Homo sapiens
ctctgtcttcctttgcagtctccatgcttcataggatgtgttgcaggggacgtggaggagcagag

SEQ ID NO: 553064 - DNA, 65 bp, Homo sapiens
gctgagggtggggctggctcagtgccctaaggggggctctgaaggaccagctccttaccctcagc

SEQ ID NO: 553065 - DNA, 65 bp, Homo sapiens
gtttccgtagtaactgtgcaggactttcagggatattccacactctgcctggttactagggaaac

SEQ ID NO: 553066 - DNA, 65 bp, Homo sapiens
gtggtcagagtgcatctgcgcaaaatgtctgacagtaccgttgcacacttgacactcttgaccac

SEQ ID NO: 553067 - DNA, 65 bp, Homo sapiens
agcagctttggcccggtgttaattacctcctcttggagaaaggtctgcgcctggccctggctgtt

SEQ ID NO: 553068 - DNA, 65 bp, Homo sapiens
cctggtcccgtggctgagagtggccaccatgtggctttcaccctctaatggccatggtgaccagg

SEQ ID NO: 553069 - DNA, 65 bp, Homo sapiens
cctgagccctcttccctagtgatcgggactgctgcaggatctggttctggggaagggggttgggg

SEQ ID NO: 553070 - DNA, 65 bp, Homo sapiens
attcaatttgacaaggttctttctttctggatcagagagggagtaaggttcttgtcagtttgaat

SEQ ID NO: 553071 - DNA, 65 bp, Homo sapiens
tactgcagcagggagaaggaagtggaatatttctggttgatgtggcacttctctccttgtaagta

SEQ ID NO: 553072 - DNA, 65 bp, Homo sapiens
gtctctgaaattggctggttcccataacagttaaactttatggcagcacagtatattttggagat

SEQ ID NO: 553073 - DNA, 65 bp, Homo sapiens
ttttccattccactgctcccttggcagctcattcctttgagctaccagagtattgaaatggaaaa

SEQ ID NO: 553074 - DNA, 65 bp, Homo sapiens
gttgataaatattttggctgactgtttcctactgaggctggcatttagccaacatatttgttaac

SEQ ID NO: 553075 - DNA, 64 bp, Homo sapiens
ttgaaatgtcatttctggaagtcattctctgcctaatgctgcactttgggaagtgacattttaa

SEQ ID NO: 553076 - DNA, 64 bp, Homo sapiens
ggggagaaggcacaacacagctgctgaaaattggtggttgcagttgttgctgcttctgctcccc

SEQ ID NO: 553077 - DNA, 64 bp, Homo sapiens
ctcacctgatttccacccacctgtatcacttttagtaaatggtgcagggatggaaattagtggg

SEQ ID NO: 553078 - DNA, 64 bp, Homo sapiens
ggtggatgtgctggcctctatggcaaccatcaaacagcaagctcataaagccggcccatcttcc

SEQ ID NO: 553079 - DNA, 64 bp, Homo sapiens
gcctgcagggtttgcatcaattactcgacgacatgtggaaaatgattgatgagctgcctgcggc

SEQ ID NO: 553080 - DNA, 64 bp, Homo sapiens
gattttctgctctatcagctcaggctctaattttgactgcaagaagcttatggagcagaggatt

SEQ ID NO: 553081 - DNA, 64 bp, Homo sapiens
ttgtcatcatcctccgagggttaggaatgccatgtcagcctttcctcatagaaggatatgacaa

SEQ ID NO: 553082 - DNA, 64 bp, Homo sapiens
gttcatcggagaaactccctgcgatgagccactagggtcacggacagggaactttttgatgagc

SEQ ID NO: 553083 - DNA, 64 bp, Homo sapiens
agtggatcagtggccaccacggaggagaggttcccctgcccttagctgtagcatctgatccact

SEQ ID NO: 553084 - DNA, 64 bp, Homo sapiens
gctggcactctcattgttacattagttattaataaactccttaacaatgggaggaagtgctagc

SEQ ID NO: 553085 - DNA, 64 bp, Homo sapiens
tcgcctgtggttcattgattctgacatctaattaaattgatcatctacagtgatcacaaggcga

SEQ ID NO: 553086 - DNA, 64 bp, Homo sapiens
cagctggtaactctaatttgggtaagttctttcttagcacttgccaaatttgaaataccatctg

SEQ ID NO: 553087 - DNA, 64 bp, Homo sapiens
tctcttctcgccttttccccttttcttctccaatgggagaatgtaggagacaagggagaggaga

SEQ ID NO: 553088 - DNA, 64 bp, Homo sapiens
aattacacccatggcagctcagttgcaccctaagcaaattaggtgctgatccaaaggtgtaatt

SEQ ID NO: 553089 - DNA, 64 bp, Homo sapiens
tgcaaatgggaatgtataaagtacttaagagtaaatttaaagtactttagaagtaccatttgca

SEQ ID NO: 553090 - DNA, 64 bp, Homo sapiens
ctgctttcaatctcctcccagtggtggcagaggagcctccctggggctgggggcgggagagcag

SEQ ID NO: 553091 - DNA, 64 bp, Homo sapiens
tcagacatgtgcattcctgaggccagctgagtagtgtggtcttggtgaattcctttatgtttga

SEQ ID NO: 553092 - DNA, 64 bp, Homo sapiens
caaagttggtgaatgcacctgctgtcagattttagtggatctcacggtgtgcaatcagctgttg

SEQ ID NO: 553093 - DNA, 64 bp, Homo sapiens
accttcaaattgccagtgttttatctcaatttaacattttgtttattgacattggcaatggggt

SEQ ID NO: 553094 - DNA, 64 bp, Homo sapiens
gggaaagggaatgacccagttagaaggtggcagaaggcttttttttggttgggtgttttctccc

SEQ ID NO: 553095 - DNA, 64 bp, Homo sapiens
tccactggtgggctgtttatttctaataatttggtagaaaaaaacattggctcataccagtgga

SEQ ID NO: 553096 - DNA, 64 bp, Homo sapiens
cccaaatggccagatctgtgcaagacaatctcatttgacacttagcttgccatggtcctttggg

SEQ ID NO: 553097 - DNA, 64 bp, Homo sapiens
actttccactgtaaattcaggctgctcttggatctgttaatgagtctgggtgcaagtggagggt

SEQ ID NO: 553098 - DNA, 64 bp, Homo sapiens
gcgcgcggtggtggtgggctttgacccgcacttcagctacatgaagctcaccaaggccctgcgc

SEQ ID NO: 553099 - DNA, 64 bp, Homo sapiens
caattaaggaccacctagggtgggggtgaagctgaaggtggctctgaccctaggaggtctacag

SEQ ID NO: 553100 - DNA, 64 bp, Homo sapiens
gatgaagtcgttttcagaaagacagttttgttctgacttgagtgtttttccacatgacttcatc

SEQ ID NO: 553101 - DNA, 64 bp, Homo sapiens
ccatctccagcactccaaccacagctgaaatccaattccctcagctggcttggatttggagggg

SEQ ID NO: 553102 - DNA, 64 bp, Homo sapiens
gttctgcttgatttcccctcgtctgtttttctccaggaagtagaccaggttgaccaggtaggac

SEQ ID NO: 553103 - DNA, 64 bp, Homo sapiens
gttaatgtaccttattattccatttctctctgatgaattctttggaatcaataaggtacttaac

SEQ ID NO: 553104 - DNA, 64 bp, Homo sapiens
gccctcatggagtctcaggagatgagatgaagctgctcccttttctcctggggtaccggtgggc

SEQ ID NO: 553105 - DNA, 64 bp, Homo sapiens
tagggataaggttctgatgtgcttggcatctgcctgcatagtgaccgttagagacttattctta

SEQ ID NO: 553106 - DNA, 64 bp, Homo sapiens
actggctgaccctggggagctagctgccttgattcattaatagctgttcctgagtcttgccagt

SEQ ID NO: 553107 - DNA, 64 bp, Homo sapiens
gtgggctggggttgatgagaaggattgaacttcatttatgaatcctttcttcagctacgcccat

SEQ ID NO: 553108 - DNA, 64 bp, Homo sapiens
tgtcgtcagctttgtgctgcttcttgtcactttaatgcaaagagacagcatggagctgataaca

SEQ ID NO: 553109 - DNA, 64 bp, Homo sapiens
tctccaataggtggttctaggcttactattattattattttaagcctaaaacttccttggtaga

SEQ ID NO: 553110 - DNA, 64 bp, Homo sapiens
ggaaggatgtgtcactctcaggaggttgtaagtcattgggacgcctccagggatgattccttcc

SEQ ID NO: 553111 - DNA, 64 bp, Homo sapiens
gccctgctccctccattccccgcaagatcgcccaggcagggctggaagggggagaggggagggc

SEQ ID NO: 553112 - DNA, 64 bp, Homo sapiens
gggacgccttgcagggatgcagtgactgtctggcactgtttcttgtatccctcaaggctgtctc

SEQ ID NO: 553113 - DNA, 64 bp, Homo sapiens
ttggctggggcagagatgggggagtcttgggggaacccaccagggcctctgtggccccagctga

SEQ ID NO: 553114 - DNA, 64 bp, Homo sapiens
actgcaagcatatcattttgttcctgtaactgaaatgtacaatgggacaagatgagatgacagt

SEQ ID NO: 553115 - DNA, 64 bp, Homo sapiens
ttcccctaagatacaaatgtcaatattggatttagtctagttgaatggatgtgtcagaggggag

SEQ ID NO: 553116 - DNA, 64 bp, Homo sapiens
tggtgggtgaagttatgctggggtggaaagcgggtgaagcgtttcaggataaaaggacccatca

SEQ ID NO: 553117 - DNA, 64 bp, Homo sapiens
gcttttctcatgacacatccacagtttggcctgtggtctcagctggaatcatcatgggaatagc

SEQ ID NO: 553118 - DNA, 64 bp, Homo sapiens
gttaatatgagcctccggattagactagagccagtgttacaggtcaagactgaggctcattgac

SEQ ID NO: 553119 - DNA, 64 bp, Homo sapiens
gagcgcctgccccggtgggtgggaagcaggactcgggcgctcatgcagcgagcgggcggcgctc

SEQ ID NO: 553120 - DNA, 64 bp, Homo sapiens
tttggtatgtgttcctggaaggctcacattaactgacagtaaggtcctgggaatttataccaaa

SEQ ID NO: 553121 - DNA, 64 bp, Homo sapiens
gttgacacaggcaggctctgggtatgtgcatcgagagatatttcccagagtctgtttttttgac

SEQ ID NO: 553122 - DNA, 64 bp, Homo sapiens
ttctccatgtcctatgtgttactgtaaccactgaagtggcatatagtatataggacacagagag

SEQ ID NO: 553123 - DNA, 64 bp, Homo sapiens
gacatctgcatttttagcagagttttatccattcgtttttaaaaacttgaaaaatgcagatgtt

SEQ ID NO: 553124 - DNA, 64 bp, Homo sapiens
ttggatggggaggggcccaggctgagccgaggaggctggagagcctggagtgccccccatccaa

SEQ ID NO: 553125 - DNA, 64 bp, Homo sapiens
ttaggtgctggatgatctctgagttggacatcttcttgaacatctcagggctcacagtgcctaa

SEQ ID NO: 553126 - DNA, 64 bp, Homo sapiens
catttattttcagctgggaaatctgctattaattcatatagtgactttcccagctgaaataatg

SEQ ID NO: 553127 - DNA, 63 bp, Homo sapiens
ttcatcccccacatcccttttctaaacaagcttagtgttacttggggaatgtgttgggatgga

SEQ ID NO: 553128 - DNA, 63 bp, Homo sapiens
tctcctcccccaacctcctgcccacccctggggggagttgggcaagagggatgggggagagga

SEQ ID NO: 553129 - DNA, 63 bp, Homo sapiens
ggattcccagctgtctgcatgaggagggggagtcagctgccctggcaggcagctggggtatcc

SEQ ID NO: 553130 - DNA, 63 bp, Homo sapiens
gtaacctctttgatcaatagaaaaccagtttttcataaaacaggttttctattgattggtgac

SEQ ID NO: 553131 - DNA, 63 bp, Homo sapiens
ttgggtgtctcagagtctcctgggattccctaaactctgttcccagagagacctagcaaccaa

SEQ ID NO: 553132 - DNA, 63 bp, Homo sapiens
caggcaaaacttggttgtcagtaaagatgtttgttttgattggcaatcagcatgtttagtctg

SEQ ID NO: 553133 - DNA, 63 bp, Homo sapiens
gtctggctgttgtggtgtgcaaaactccgtacattgctattttgccacactgcaacaccttac

SEQ ID NO: 553134 - DNA, 63 bp, Homo sapiens
agaatgattatttctcagagtagactccctagtttggcttctggcttgagaggtaattatttt

SEQ ID NO: 553135 - DNA, 63 bp, Homo sapiens
caggttcctgcctcctgacgtacctcacacccagccgggaagtcgatgggatgctgggacctg

SEQ ID NO: 553136 - DNA, 63 bp, Homo sapiens
tgagggggtgactcagagtgtgactgactctggtacttcaaacatgtctgagtaactcccaca

SEQ ID NO: 553137 - DNA, 63 bp, Homo sapiens
gccttggctggctacctgggccgagcacaaaaaatgagatgctcacccttgtggcagcgaggc

SEQ ID NO: 553138 - DNA, 63 bp, Homo sapiens
tttcagagtacatgctgggttaggtgtttagtacagactttcaaccccgtatgtcctctgaaa

SEQ ID NO: 553139 - DNA, 63 bp, Homo sapiens
tggctccttaaggtttgtactcccagagagccatgtggagttgcaataatacttaaggagtta

SEQ ID NO: 553140 - DNA, 63 bp, Homo sapiens
tgattgagccgcagaagtgtcctacaattgttggcattgtcaggacttttgaaagcttaatta

SEQ ID NO: 553141 - DNA, 63 bp, Homo sapiens
tcttggctggcacagaaatttattcatttgaagcagaataataaactaatgtgtcagccaaga

SEQ ID NO: 553142 - DNA, 63 bp, Homo sapiens
attgctatttgcaaatatatttcttgattatatctgtgaagtaatttatatgcaaatagcagt

SEQ ID NO: 553143 - DNA, 63 bp, Homo sapiens
taggtcaaagtaaacagattatacaagaataatatttcttgatcccctgtgaaccttgacctg

SEQ ID NO: 553144 - DNA, 63 bp, Homo sapiens
agtggcaggagagtgggtttgccattagttcaacacaaactgtttgcccattctcttgacact

SEQ ID NO: 553145 - DNA, 63 bp, Homo sapiens
agtgttttgtacaatttcttgtgagtgcgaagctcaaaaagccgagaaaatgggcaaaacact

SEQ ID NO: 553146 - DNA, 63 bp, Homo sapiens
gccaggggctgggtagctctgaaggaagcattaggcttcagcaagtcacctcacagccctggc

SEQ ID NO: 553147 - DNA, 63 bp, Homo sapiens
gtcagcctgcaattagtgaaatggaggcacacatgctggtttgcagattgtgggtgggaggac

SEQ ID NO: 553148 - DNA, 63 bp, Homo sapiens
accccccaccaacttctgactgggcttctcagaaatgcacagcctgcatgggagtgggggggt

SEQ ID NO: 553149 - DNA, 63 bp, Homo sapiens
gttctgcccctgctgtctggtggacctcaggaggtcaaatcaaggacgcaagaagggcggagc

SEQ ID NO: 553150 - DNA, 63 bp, Homo sapiens
tctcattttgtctcctaagctgatcactggagattccatcgttagtgctgaggcagtatggga

SEQ ID NO: 553151 - DNA, 63 bp, Homo sapiens
gaggcctagtaattttcgataaagcccttaatccaagtacttgactgaaaattaccaggcttc

SEQ ID NO: 553152 - DNA, 63 bp, Homo sapiens
gtggggattttgtggtttgaagaaggctctctgtggaatttctttgaactacagaaaccctgc

SEQ ID NO: 553153 - DNA, 63 bp, Homo sapiens
ctgcagccggttgccgggtgacgggatgctgccccgcaatgttacctcggcaacgggctgcag

SEQ ID NO: 553154 - DNA, 63 bp, Homo sapiens
cccagtctcagtgggctttgacttttctaaaagaacaaagttggggccagtgggaggctgagg

SEQ ID NO: 553155 - DNA, 63 bp, Homo sapiens
gcccagcttcccagcccctcctttgaaccctgctgggtgccagaaggagggggctgcctgggc

SEQ ID NO: 553156 - DNA, 63 bp, Homo sapiens
catgttgtcatagaagtaaatgaaaaggttgggagacttttcatttgcttctgtgataacatg

SEQ ID NO: 553157 - DNA, 63 bp, Homo sapiens
aggggacgcctggctctcattgtcattggttgcacaatggggttgggggttgggtcctctcct

SEQ ID NO: 553158 - DNA, 63 bp, Homo sapiens
gccaatcagagagcagcttttatgaaactgggctctctcattggctagctgctttctcttggc

SEQ ID NO: 553159 - DNA, 63 bp, Homo sapiens
agcctcctctcctgataacctaagtgctctgattgaaaggcagagggtatcaggagaatggct

SEQ ID NO: 553160 - DNA, 63 bp, Homo sapiens
ggccttgttcccttcccacccaagttcttgggcctcatcatgggtagaggggctggcaaggtc

SEQ ID NO: 553161 - DNA, 63 bp, Homo sapiens
acatttttcctgtcttgctgacttcagagctttaggggtacagcatttgcaggaattgtatgt

SEQ ID NO: 553162 - DNA, 63 bp, Homo sapiens
gaagttgcttttaatgttcctttctatgtcgttgttaggaaggaattttatttgaggaacttc

SEQ ID NO: 553163 - DNA, 63 bp, Homo sapiens
tttgctcatcttctcaccaggacagcaagtcaattgcacaagtcccctgatgggaagagcaga

SEQ ID NO: 553164 - DNA, 63 bp, Homo sapiens
tggctgagaagttctggtgggaaggaaccatggagggcccatctggatatccttcctcagcta

SEQ ID NO: 553165 - DNA, 63 bp, Homo sapiens
ggtcttggccagggcacactgtttccagcaaaatcctgcctttttaatgccctggccagagcc

SEQ ID NO: 553166 - DNA, 63 bp, Homo sapiens
cccggcgcgagcctcgggccgggcgctgattgggcaggcagcggccgacgcggcggcgccggg

SEQ ID NO: 553167 - DNA, 63 bp, Homo sapiens
tgatgcattgcactaatatgctctcagagcatactcactgggatgtattagagcaatgtatca

SEQ ID NO: 553168 - DNA, 63 bp, Homo sapiens
cagtcccctccccagccccgacgggcgggcggactgccctgaagaggcggggagggggtgctg

SEQ ID NO: 553169 - DNA, 63 bp, Homo sapiens
ttgggcatcaaccatgactaattgtatgttttgaagagtacttagtgcatggttggtgctcaa

SEQ ID NO: 553170 - DNA, 63 bp, Homo sapiens
gttagtgctacagaacattattctggtcctcaagtgcaaggataaattttgtggcacttttac

SEQ ID NO: 553171 - DNA, 63 bp, Homo sapiens
ataactggcacatatggaggtggaatagcacaatttgatattttctcatgtgccagatttttt

SEQ ID NO: 553172 - DNA, 63 bp, Homo sapiens
gtgagttcccggatctgttccatccaaacactgtggaagcaagagacggatccgcgggaccgc

SEQ ID NO: 553173 - DNA, 63 bp, Homo sapiens
ttacatcaaaatgagacaagaaacaggagcataacactgtattcttgtctcaaggagatgtaa

SEQ ID NO: 553174 - DNA, 63 bp, Homo sapiens
cagatggcaggcctaactgaggttggcagcaactgctgttgtccccagtgtcactgctacctg

SEQ ID NO: 553175 - DNA, 63 bp, Homo sapiens
agcacataagcatgttttatttgctgtttaattgtttctagtaaaagaatttgcttatgtgct

SEQ ID NO: 553176 - DNA, 63 bp, Homo sapiens
ggcaccagaagtgctgacgaggatgttgcatatgctcacgatgactcagcacttcctggtttc

SEQ ID NO: 553177 - DNA, 63 bp, Homo sapiens
tgcagggatggaggggatggggcctggaccactagttagagccatcccgtccgcccctttcag

SEQ ID NO: 553178 - DNA, 62 bp, Homo sapiens
tacttgttatagaatttcaggtggtaggtaacaaagcctgcctcgtttattcataacaagtg

SEQ ID NO: 553179 - DNA, 62 bp, Homo sapiens
gcagcagcaggcgcacggccgtctggatctccgggacgtgatggtggagcgcttgttgtagt

SEQ ID NO: 553180 - DNA, 62 bp, Homo sapiens
tatgacatagccaacctttaaaaaaaaatgaatgatttatttaaaaggttgaatgtgtcata

SEQ ID NO: 553181 - DNA, 62 bp, Homo sapiens
aagcagcttccccaaagtgccttggctcccaagggccctttacttactgggaaaatctgctt

SEQ ID NO: 553182 - DNA, 62 bp, Homo sapiens
tggccagaccgggaagggggaggcagcaacccgctcccaagtccctccctccccattggcca

SEQ ID NO: 553183 - DNA, 62 bp, Homo sapiens
gaacactacccccaggaagtgtcattcagtgacagaactgatgcccttggagggtagtgggt

SEQ ID NO: 553184 - DNA, 62 bp, Homo sapiens
ccacctcgcctggcctggaccagaagtggcaccccaaggcctgggcctggcatgggaggtgg

SEQ ID NO: 553185 - DNA, 62 bp, Homo sapiens
ctctctccattacactaccctgcctcttctccatgagaggcagcggggtgtagtggatagag

SEQ ID NO: 553186 - DNA, 62 bp, Homo sapiens
tcgcagttttgttgtgccaccagagcaagtccgaaaaagcctgcagcacaaccaaacagtga

SEQ ID NO: 553187 - DNA, 62 bp, Homo sapiens
cattgatgcgccatttggcctaagcaaacggtaagatttgcagagccaaatgagcattaatg

SEQ ID NO: 553188 - DNA, 62 bp, Homo sapiens
ggcaaggccagagggcattcaagtgacactcatgccacctgggagctgccacctggccttcc

SEQ ID NO: 553189 - DNA, 62 bp, Homo sapiens
accattgtttctattaaaggtctttaatgatattgcattttagacctgtaatgaaacatggt

SEQ ID NO: 553190 - DNA, 62 bp, Homo sapiens
ctgccagaggctgttgccagaggagctaatgactaagtcactctccttttggcctctggcag

SEQ ID NO: 553191 - DNA, 62 bp, Homo sapiens
gtgctctcagcatcccccatccccccttaattgcagccagaggagaggaggagctgagtcac

SEQ ID NO: 553192 - DNA, 62 bp, Homo sapiens
tctccaaacgtgctgtttccacataaccagtcttttctttgagggacagcactgttgggaga

SEQ ID NO: 553193 - DNA, 62 bp, Homo sapiens
cggccggaggtgccattgaccctgagagcaagagccatcagtctgatggcttcctctggccg

SEQ ID NO: 553194 - DNA, 62 bp, Homo sapiens
gggctgaggctgcagtacccaccaggcggtaatgacttctcggagggagctggcttcggctc

SEQ ID NO: 553195 - DNA, 62 bp, Homo sapiens
gagtcctgtatttgtggatgatgtgagacttcttatagttctgtgagatgcagacttgactc

SEQ ID NO: 553196 - DNA, 62 bp, Homo sapiens
tataggtagggctaattagaaattaatcaaaatgattaacctctacagtccttcagcctatg

SEQ ID NO: 553197 - DNA, 62 bp, Homo sapiens
tctgcaggtcagtgtgcagctgtttcagcatcacctccagctggtacaccttgcctgtcaga

SEQ ID NO: 553198 - DNA, 62 bp, Homo sapiens
gtggcttttcattataaattttgcatgtaaacactttgcatgttctgatttaatgaggccat

SEQ ID NO: 553199 - DNA, 62 bp, Homo sapiens
gccatttatggggcttggattggggccaaacgctgccctagaaaatccaggtcttggaatgc

SEQ ID NO: 553200 - DNA, 62 bp, Homo sapiens
ccctttgaccgttttcctgcccatcagagccacagtcagagggtgggaaggtggaagaaggg

SEQ ID NO: 553201 - DNA, 62 bp, Homo sapiens
acccacttctacttctgttatcgctggttcctgctggattttaagagaggtaagaagtgggt

SEQ ID NO: 553202 - DNA, 62 bp, Homo sapiens
gttacatatgtttggcagagttcaggccaacacctgggtcctgcacttgccagataagtagc

SEQ ID NO: 553203 - DNA, 62 bp, Homo sapiens
ctcttgttttatttgaggaacagacagatggttccactgttgttttccttgcaagacaaggg

SEQ ID NO: 553204 - DNA, 62 bp, Homo sapiens
tgtggctgtgtcctagatttatgaacaatggattgttttgaagtctagatacaaatgccaca

SEQ ID NO: 553205 - DNA, 62 bp, Homo sapiens
ctgacagccatgttttagagaatttgatgactcttttaaactctttagaaagaggctgccag

SEQ ID NO: 553206 - DNA, 62 bp, Homo sapiens
ggccacacggggtaataataacttgtcgataagctgcgcgggttatttttatgccgcaagcc

SEQ ID NO: 553207 - DNA, 62 bp, Homo sapiens
tttaaggtgaaattgctatgtgaggattttgttaacctgacgttttgtggtttcgcctcata

SEQ ID NO: 553208 - DNA, 62 bp, Homo sapiens
ctcccttccaaacggtgctccctctgatgccacttggctgactgagctactgtgggaggaag

SEQ ID NO: 553209 - DNA, 62 bp, Homo sapiens
atgtcactgtgtgatgttcttctgttgccataacgacaggaggatgtgtcaccaggtggtgt

SEQ ID NO: 553210 - DNA, 62 bp, Homo sapiens
ttagcagatccaggaatagaagccagagtcacttgactctgaatttgttctctttctgttaa

SEQ ID NO: 553211 - DNA, 62 bp, Homo sapiens
cattaatgctcatttggctctgcaaatcttaccgtttgcttaggccaaatggcgcatcaatg

SEQ ID NO: 553212 - DNA, 62 bp, Homo sapiens
ccggccaatcgctgcgttgggaaattccacctttccgcggggcccgggcagcgactggctgg

SEQ ID NO: 553213 - DNA, 62 bp, Homo sapiens
gctcagtttgctgcacagatatttgggttaaacaatcatttgctgtggggcagactgtgagc

SEQ ID NO: 553214 - DNA, 62 bp, Homo sapiens
gtccgtgattggctcagccactttaatgtgacctctgcaaaagtggctgagacaccaatttc

SEQ ID NO: 553215 - DNA, 62 bp, Homo sapiens
ctccaatgtgttaatgagcaatgacctaaattttaggtccctggtaattgacacacatgggg

SEQ ID NO: 553216 - DNA, 62 bp, Homo sapiens
gtgtatttctttcttgcttgctctctgcaagctgtggagagggagggggaagagcaagacac

SEQ ID NO: 553217 - DNA, 62 bp, Homo sapiens
ggagagggaaaggctttggagtcagtcttgtcctctggactttttccactagccccttctct

SEQ ID NO: 553218 - DNA, 62 bp, Homo sapiens
cggggggatgtgggggtgagtttcaagggtggggcctccgggatttgtccctgtaccccctg

SEQ ID NO: 553219 - DNA, 62 bp, Homo sapiens
tggggaagggcaagcagtcttttcctctggagccaggggagggggctgccccccgcccccca

SEQ ID NO: 553220 - DNA, 62 bp, Homo sapiens
atggagagctgagacctctgatgaaccttctaatatggtaaatgggagtcttaattcttcat

SEQ ID NO: 553221 - DNA, 62 bp, Homo sapiens
agagagtgcaaggccggaagccccctcctctcaacgggagggctcacggcttgcccctccct

SEQ ID NO: 553222 - DNA, 61 bp, Homo sapiens
gtggggagagctgagggagctgtggctggcattgcacaaagcttcctttatttcactccac

SEQ ID NO: 553223 - DNA, 61 bp, Homo sapiens
ccaaccgtgttcgggaacacttgtcagaactacaattgacaagtgtttccaatatggctgg

SEQ ID NO: 553224 - DNA, 61 bp, Homo sapiens
gtctgcttgatgccaagcatcctgatttttcaactatccagatgtttggcatcaggcagac

SEQ ID NO: 553225 - DNA, 61 bp, Homo sapiens
gtgtgaggcctgggtggaggcctgtgcacgtcttctgtgtgtggtctttccagcctcacac

SEQ ID NO: 553226 - DNA, 61 bp, Homo sapiens
actcaaataagaaccacacagaggactaatctttgagaatctgtgtattttgtatttgagt

SEQ ID NO: 553227 - DNA, 61 bp, Homo sapiens
gacactctttgctgtgggttttgatttttaactcattctctgctgtgcagcagagggtgtc

SEQ ID NO: 553228 - DNA, 61 bp, Homo sapiens
gtctgttcccccctcccgcccagtctcctccccctgggaacgcgcggggtgggtgacagac

SEQ ID NO: 553229 - DNA, 61 bp, Homo sapiens
gggagagcacgctgagcaggcccgtgacaagctcacgccatctgcattagtattttcctcc

SEQ ID NO: 553230 - DNA, 61 bp, Homo sapiens
attctttcaagaagctggaagtctgtgtgagggaacaggcttcaaggttcttggcaggaat

SEQ ID NO: 553231 - DNA, 61 bp, Homo sapiens
cgggtgtgtgcccggccccaggctggccccagcccccagtgcagggcctggcacgcgcccg

SEQ ID NO: 553232 - DNA, 61 bp, Homo sapiens
caggcagcaatgaaatagtgctccgaaaaattacattcccagcaatttcagagcgtgcctg

SEQ ID NO: 553233 - DNA, 61 bp, Homo sapiens
agagtccctgggtctgttccatctaaacactgttgaagcaagagacagatctgagggacct

SEQ ID NO: 553234 - DNA, 61 bp, Homo sapiens
ttgctccctcccctttgggttcagagaatagaattgagacaacaccaaagggggtgggtaa

SEQ ID NO: 553235 - DNA, 61 bp, Homo sapiens
ttctggtgtgtatagagttaaccaggttaccaggattcctagttaacttctttcaccagga

SEQ ID NO: 553236 - DNA, 61 bp, Homo sapiens
ctgggagctgggacctcacccatgggtcccccatggggtgggagtccgtagtcaaccacag

SEQ ID NO: 553237 - DNA, 61 bp, Homo sapiens
gctgagtaccgccatgtctgttgggcatccacagtctcccaccaggcattgtggtctccgc

SEQ ID NO: 553238 - DNA, 61 bp, Homo sapiens
atcatactggatatctttccacagattaaaaaaaaaaacttggggaagtgtccagagtgat

SEQ ID NO: 553239 - DNA, 61 bp, Homo sapiens
tctgtggatttgattgctttttttcttatctgtctgaagaggagggcatgcaattcacaga

SEQ ID NO: 553240 - DNA, 61 bp, Homo sapiens
gcctgaaccttctcccttcctcagaatgaaaccatttctgagttatgggaaaagtttaggc

SEQ ID NO: 553241 - DNA, 61 bp, Homo sapiens
gtgagcaaggaggatataaatagaagttatataacatctctttgttgattcctgtgcttac

SEQ ID NO: 553242 - DNA, 61 bp, Homo sapiens
ccctctacagggaagcgctttctgttgtctgaaagaaaagaaagtgcttccttttagaggg

SEQ ID NO: 553243 - DNA, 61 bp, Homo sapiens
ggagggctatgcggcgggggagacggggcaggcccctcctcctttgtccgccctgccctcc

SEQ ID NO: 553244 - DNA, 61 bp, Homo sapiens
ccgggccctggatggcagcgctcgacaggaaacctcgagcgaggagccagctgggggccgg

SEQ ID NO: 553245 - DNA, 61 bp, Homo sapiens
tccacttgatgactgtctcgtacaccagctcctcagccttggtgttgaggctgtcgttgga

SEQ ID NO: 553246 - DNA, 61 bp, Homo sapiens
tgggtgagcagctgcagctgagaggacttcaattttctccttggctcaggctgtttcctca

SEQ ID NO: 553247 - DNA, 61 bp, Homo sapiens
ctccgtctcccgcttgcagtaggaatacctgtgattcctgtgctgcgagtacgagccggag

SEQ ID NO: 553248 - DNA, 61 bp, Homo sapiens
gaggagaacaaggccatggtctgttgtcaaaaaatgcacacccgtgcgctttgctttcctt

SEQ ID NO: 553249 - DNA, 61 bp, Homo sapiens
gtggcttgcttgcatgtaacctagagatgtgtttgtctctattacatacattcaagctcat

SEQ ID NO: 553250 - DNA, 61 bp, Homo sapiens
accacaaatcccagaagtcaccgcggccgcccccactgcatgaccttctgggatttgtagt

SEQ ID NO: 553251 - DNA, 61 bp, Homo sapiens
cttggatcaggatgaatggtagctcagatgaatgcatttgtgccatttttcttggccccag

SEQ ID NO: 553252 - DNA, 61 bp, Homo sapiens
tgctttcaccaaggtgcctctgtgtttacttaagtgacttgtggtagctggtggctgagca

SEQ ID NO: 553253 - DNA, 61 bp, Homo sapiens
ttataatgatttcttatgctcatttttatataaaagaagaggaaatgaggaatcattatga

SEQ ID NO: 553254 - DNA, 61 bp, Homo sapiens
tagatagctagagccagatttctggcattcatgccagatgccagaagatctttagctactg

SEQ ID NO: 553255 - DNA, 61 bp, Homo sapiens
gagagagatcttttctgtgtttatggatacttgagcaaaaatacagaaggcagactctctc

SEQ ID NO: 553256 - DNA, 61 bp, Homo sapiens
gccacagagttcattacagggtaattaatgcatgttaagtatcttgtaaatattatgtggt

SEQ ID NO: 553257 - DNA, 61 bp, Homo sapiens
atgggcttagagaagttttcagccaatggaagctcatgctgagcgcttttctctggctcat

SEQ ID NO: 553258 - DNA, 61 bp, Homo sapiens
ggagccattaaaggagtggagcagagattgaattactgacttccttcctgccagtggctcc

SEQ ID NO: 553259 - DNA, 61 bp, Homo sapiens
tctggagtctcctgctacctatgcctgatgctggcagatgtgggttggctgagggctcatg

SEQ ID NO: 553260 - DNA, 61 bp, Homo sapiens
tttgccacccccagagccttgactggtcagatgcatctgggtcaagggtcacaggggcaga

SEQ ID NO: 553261 - DNA, 61 bp, Homo sapiens
agggcctgggccagcaccctttgaggcccacaacagggcacacaggggagggccaggccct

SEQ ID NO: 553262 - DNA, 61 bp, Homo sapiens
gcccaagagagcgaaggttggcatgcagttccaactgcctttccactttgcttctctgggt

SEQ ID NO: 553263 - DNA, 61 bp, Homo sapiens
ggagtcatgcttctctgaggttcagtgtggttacttctatttcacagagacgtctgacttc

SEQ ID NO: 553264 - DNA, 60 bp, Homo sapiens
ccaaattggtgcagcaaagtggttaataggatcattagcctactcgctgtatttttttgg

SEQ ID NO: 553265 - DNA, 60 bp, Homo sapiens
ttaacaccagacctttcaggccccatcaaatttaacaaggcctgacagatttgggattaa

SEQ ID NO: 553266 - DNA, 60 bp, Homo sapiens
ggaggagggcgcaaagtccttttgtacgcagaaataaggagcgacattgtgttttcttcc

SEQ ID NO: 553267 - DNA, 60 bp, Homo sapiens
agcagattttcccagtaagtaaagggcccttgggagccaaggcactttggggaagctgct

SEQ ID NO: 553268 - DNA, 60 bp, Homo sapiens
ccaggtggaacaggccgtcctgactgtttggtgacagacagggagggcttgttctgctgg

SEQ ID NO: 553269 - DNA, 60 bp, Homo sapiens
agctgtaaacggcttcttcctctggccacaacaggggatgggaactgccttttacatgct

SEQ ID NO: 553270 - DNA, 60 bp, Homo sapiens
ggtccgggtccggcccggcttggccccggcccccgccatgccgggccccgacgccggatc

SEQ ID NO: 553271 - DNA, 60 bp, Homo sapiens
tgacatttaaattgcaggcagccctgggtccattccaggagctggctgtggttgagtgca

SEQ ID NO: 553272 - DNA, 60 bp, Homo sapiens
acttatcctccaaaataggccagtagtttgccgacaaatggttttactgggaggagaagt

SEQ ID NO: 553273 - DNA, 60 bp, Homo sapiens
ggccggttcaagggcagtcagatgaatcgacccttcttacaggctgtctacgaaccagtc

SEQ ID NO: 553274 - DNA, 60 bp, Homo sapiens
ggtggctcgtttttcttgaaaggctaagtaactaatgccttttattgatgaatggccact

SEQ ID NO: 553275 - DNA, 60 bp, Homo sapiens
aatgggttttcggaaatgaaagctgggctcaaacagagcccactttcaagggggcctggt

SEQ ID NO: 553276 - DNA, 60 bp, Homo sapiens
caagtttacctgcatggtctggctgcatgaatgctgttgtggccatgtggggaaacaggg

SEQ ID NO: 553277 - DNA, 60 bp, Homo sapiens
gagaagtggagaggttgatctaaggaagaaaacatattaggtcataggcttccatttctt

SEQ ID NO: 553278 - DNA, 60 bp, Homo sapiens
ggactacaactcccaaggtacatacaaagcaattgtggtgcacactgggagttgtagtcc

SEQ ID NO: 553279 - DNA, 60 bp, Homo sapiens
gagaagttgcccgtgtttttttcgctttatttgtgacgaaacattcgcggtgcacttctt

SEQ ID NO: 553280 - DNA, 60 bp, Homo sapiens
ttggaatacaaaggatctctagtgtctgaaagcaggcattgtctctcttttttatttcaa

SEQ ID NO: 553281 - DNA, 60 bp, Homo sapiens
aaacgatttgcagctagagcaaaggtgacaagttgacctttactggctgcaaagacgttt

SEQ ID NO: 553282 - DNA, 60 bp, Homo sapiens
tccctttatgcaccaagttccctttgaagtcaattaaaggcctatgtgtgtatgaaggga

SEQ ID NO: 553283 - DNA, 60 bp, Homo sapiens
tgtcctagtccatgatgcctggctgagtgagcaataccggctggagtcagagagaggaca

SEQ ID NO: 553284 - DNA, 60 bp, Homo sapiens
acagagtgtaatgagaatgcagttggttatgttcataccaattctcattacaatctttgt

SEQ ID NO: 553285 - DNA, 60 bp, Homo sapiens
ggcttttgtcctgtggggcaattcatccttcagaatttaggattgctctttggatttgcc

SEQ ID NO: 553286 - DNA, 60 bp, Homo sapiens
ttttctggaaggggagacagagacattaggcaaagagcttagctttctctcctcaggaaa

SEQ ID NO: 553287 - DNA, 60 bp, Homo sapiens
tgtggccatcgctgccccctcgcccagcctggggtccgcaggaggtagcgcacagccata

SEQ ID NO: 553288 - DNA, 60 bp, Homo sapiens
gtgagttgaaacattggtcacactatataaagtttgtatatgtgaatcagtgtaactcat

SEQ ID NO: 553289 - DNA, 60 bp, Homo sapiens
tttttctgtccccagaatgtggccaacatatgtatgactcacattcacaggacagaagga

SEQ ID NO: 553290 - DNA, 60 bp, Homo sapiens
tgtcctttgtgcagaacagtaattggattgtgtgtttcatttacatctggacaaaggcca

SEQ ID NO: 553291 - DNA, 60 bp, Homo sapiens
aatctccttggtctcgttccaggccccccagccctgggcctcagggtctgaggagaccgt

SEQ ID NO: 553292 - DNA, 60 bp, Homo sapiens
accctttcctgtgcccttttaaggttgacccagtgctttaagaggctaacacagaagggt

SEQ ID NO: 553293 - DNA, 60 bp, Homo sapiens
cgcgcggcgcttcgggccttgtagtcttggacagacccccgaggcccatggtgccgtgcg

SEQ ID NO: 553294 - DNA, 60 bp, Homo sapiens
ttgatgttttggttttcactgaacagtagtaacactgttccttgtaaccaaactcattaa

SEQ ID NO: 553295 - DNA, 60 bp, Homo sapiens
ggcagctaatttgcacctgttctgtgtggactctgatcaggtgtgaatgagacagctgcc

SEQ ID NO: 553296 - DNA, 60 bp, Homo sapiens
actgcctgacaattgtcactgtataagaaagtcccctttgcagggacaatgacaggtggt

SEQ ID NO: 553297 - DNA, 60 bp, Homo sapiens
tgctgtcagcacagaccagatcattccaaattctgtgggagatctggccttgacacagca

SEQ ID NO: 553298 - DNA, 60 bp, Homo sapiens
ctggaaatggtaaacattttaatggtcagaccctgtccacttatgcattactatttccag

SEQ ID NO: 553299 - DNA, 60 bp, Homo sapiens
agttgccatagagccacttccctctgcttttacaaaggctgttgagtctctatggcaatt

SEQ ID NO: 553300 - DNA, 60 bp, Homo sapiens
ggggagctgaggggatcttgcaagaaatcacattgttcctgccccagattcccgctcctc

SEQ ID NO: 553301 - DNA, 60 bp, Homo sapiens
gcgaggggagggcccagcccctaggcccagagggagactggcggggttggcccacctcgc

SEQ ID NO: 553302 - DNA, 60 bp, Homo sapiens
ctccagagctttcgtacagtttattcttgttgaagtaagctaaggcaaaagctttggcag

SEQ ID NO: 553303 - DNA, 60 bp, Homo sapiens
gagaaacagatagaatcctttgcaaagcactccgtctgcaaagggttcttcaattttctt

SEQ ID NO: 553304 - DNA, 60 bp, Homo sapiens
ctcttgacagcttcattttcaggccagtgagctaggatgaaaattgagctgcccaaagag

SEQ ID NO: 553305 - DNA, 60 bp, Homo sapiens
agtacttgtcagcttcttggatgagctgaaggaagctgctaactagggacctggcgaggt

SEQ ID NO: 553306 - DNA, 60 bp, Homo sapiens
ggggtagaaatgaaagagctatagaaatgtagcacactcataatctttcatttctgccct

SEQ ID NO: 553307 - DNA, 60 bp, Homo sapiens
ttgggggaatgagcaatatgtgtttgctgatagaagtaccatatggctcatcttcttcaa

SEQ ID NO: 553308 - DNA, 60 bp, Homo sapiens
gagtgtcatttaagccttttgcccctctggacactagaaggcagatggcgaaatgagctt

SEQ ID NO: 553309 - DNA, 59 bp, Homo sapiens
gcgctgtctttgagcccccgccgagcttcctcgtggcgccgggggtcaatctgcagcgc

SEQ ID NO: 553310 - DNA, 59 bp, Homo sapiens
ggtttctgtaaatgtgggtcagtcatgtgattaagtgacccagatttccgcagacaacc

SEQ ID NO: 553311 - DNA, 59 bp, Homo sapiens
tttcaggagtacattttcacttagctgttctctaagtagaaatgcattactcctagaaa

SEQ ID NO: 553312 - DNA, 59 bp, Homo sapiens
agaggcctccctcccagctggttgtgcacgccccattcagttggctgggatggccgtct

SEQ ID NO: 553313 - DNA, 59 bp, Homo sapiens
gtgaagatgtagtgatgggaattctgattttaatcagatctccttcatctctgctttac

SEQ ID NO: 553314 - DNA, 59 bp, Homo sapiens
tcattaactggttaataactatttatgaccccaggatgtagtttctacccagttaatgg

SEQ ID NO: 553315 - DNA, 59 bp, Homo sapiens
aaggaagtgccagaaatgtcagaagaaagcctattttcatgggatttcctgccttcctt

SEQ ID NO: 553316 - DNA, 59 bp, Homo sapiens
gccccttcccctcctgaagggcccgggaaacccagcagcctgcaggtgggggagggggc

SEQ ID NO: 553317 - DNA, 59 bp, Homo sapiens
ggcggacgcccgggggccgggatgcgaggggcggatccggcggcgcccggggctccgtc

SEQ ID NO: 553318 - DNA, 59 bp, Homo sapiens
ttttaattgcaatcatgccctcccaggggactcataagggaccataattgcaattaaaa

SEQ ID NO: 553319 - DNA, 59 bp, Homo sapiens
ttcgggtgctgtttgcctgtgtgtgccgtgaacttcaagtggtaggagcagaacccgaa

SEQ ID NO: 553320 - DNA, 59 bp, Homo sapiens
tggtttttggtttccagagcaggcaggagtaaacacagcttctctgaagccataaatca

SEQ ID NO: 553321 - DNA, 59 bp, Homo sapiens
ctttggccttaaaataagacaggcaggcagatctgcctatcttatggctaaggtcgggg

SEQ ID NO: 553322 - DNA, 59 bp, Homo sapiens
cagaagccgactgcccctctggttgcttgtaactttaaaagagggcaggcctggctctg

SEQ ID NO: 553323 - DNA, 59 bp, Homo sapiens
atcacatttttatagcaggagctgtgaggaagctcataacttcatgctgtgaatgtgat

SEQ ID NO: 553324 - DNA, 59 bp, Homo sapiens
ggctgacaatggctccttgtgtctgtgccgacggtgggagaggggaggtattgtttgcc

SEQ ID NO: 553325 - DNA, 59 bp, Homo sapiens
ctcgtcgtagtggaggtgcagcagctgcaggtgcaggaggtggactccatggtgaagag

SEQ ID NO: 553326 - DNA, 59 bp, Homo sapiens
tgagcttgaatgtatgtaatagagacaaacacatctctaggttacatgcaagcaagcca

SEQ ID NO: 553327 - DNA, 59 bp, Homo sapiens
gggaaaggaagtctgtgaggaaaatctgctgtggcttcttcctcagagaactccctccc

SEQ ID NO: 553328 - DNA, 59 bp, Homo sapiens
gtgggtttactaggtccttctgaaagatcaaattttgctcggagggacccagaacctac

SEQ ID NO: 553329 - DNA, 59 bp, Homo sapiens
ggaactagtaaggaaaagcaggaaagcttccatttctttctggcttccttcttggtttc

SEQ ID NO: 553330 - DNA, 59 bp, Homo sapiens
gttcttaaacaccaaaggatgtggggatgttttccagatgttctttggtgtagaaggac

SEQ ID NO: 553331 - DNA, 59 bp, Homo sapiens
ggattcatacagtgatttcatggtgttatgtgttgtgaaacattgcactgtatgaatct

SEQ ID NO: 553332 - DNA, 59 bp, Homo sapiens
cccccagctgagggaccagctctacttccacctggagttgcacagtctcaggctggggg

SEQ ID NO: 553333 - DNA, 59 bp, Homo sapiens
ccctaggtgtgctccggtgggggggtccccaagatcttccttccaggagcacaccaggg

SEQ ID NO: 553334 - DNA, 59 bp, Homo sapiens
tattgctgctgtctcagctgttgctgccactacaacttcagcagctaggcaaggcaata

SEQ ID NO: 553335 - DNA, 59 bp, Homo sapiens
caccattagagcagaatggagactggttaactgattctgggctccatgttctagttgtg

SEQ ID NO: 553336 - DNA, 59 bp, Homo sapiens
aataatccagaattccttgtggtggggctgctcccacaaggggtcagatctggattatt

SEQ ID NO: 553337 - DNA, 59 bp, Homo sapiens
aattagtcacagctagagcctgaaatttatcacagaaatctctggctgagaggctgatt

SEQ ID NO: 553338 - DNA, 59 bp, Homo sapiens
ttttaattgcaattatggtcccttatgagtcccctgggagggcatgattgcaattaaaa

SEQ ID NO: 553339 - DNA, 59 bp, Homo sapiens
aaggggcatttagggcagtagattctaagctgcttcactaactgcactagatgcacctt

SEQ ID NO: 553340 - DNA, 59 bp, Homo sapiens
aacagcagaaggtattagtccatattaagtactaatttgttctaatattttcagctgtt

SEQ ID NO: 553341 - DNA, 59 bp, Homo sapiens
gcagtttggaggagaaagtgcgggttgattattgacccacgccttctttcttcaaatgc

SEQ ID NO: 553342 - DNA, 59 bp, Homo sapiens
gctccttcaccccccacctcatgtagaagggtgctgaggcgtcgggagggaggaggagc

SEQ ID NO: 553343 - DNA, 59 bp, Homo sapiens
aaggtggtgattaggttttcaggtttagagaagtgtgagacaacctaattaaacacctt

SEQ ID NO: 553344 - DNA, 59 bp, Homo sapiens
gcttcctccagggaggggcctgctggacccatgcctgctcagcccctcctggcagtggc

SEQ ID NO: 553345 - DNA, 59 bp, Homo sapiens
tccctcctccttcccactgtgcctgagtgtgtattgtcaaagtgtcaagtgaggaggga

SEQ ID NO: 553346 - DNA, 59 bp, Homo sapiens
aggaggtagggaggggtctgtcctttggtcccaaaaaacaagatctcggcttgcttcct

SEQ ID NO: 553347 - DNA, 59 bp, Homo sapiens
ggcttttgtggtattaaacacctcaattttactcaggcatttagcaaaccacaaaagcc

SEQ ID NO: 553348 - DNA, 59 bp, Homo sapiens
gaagggaggaaggcctctctacatatggaaaagcccatgcgtggagttcccctcctttc

SEQ ID NO: 553349 - DNA, 59 bp, Homo sapiens
tagggaaagggaataggcactgaaacacataaatcagtgttttgaattctttttctctg

SEQ ID NO: 553350 - DNA, 59 bp, Homo sapiens
ggcagtgtcaacagtttctaaatgctgggcaaatcttcaagtgaaactgagacactgtt

SEQ ID NO: 553351 - DNA, 59 bp, Homo sapiens
ctcccccatggctgacagaccacgatgtgcagatgctccgtctgttggcacagggggag

SEQ ID NO: 553352 - DNA, 59 bp, Homo sapiens
tcctgccgtagaaatgttggtggggaaacagtccttatttgatcatttttggggaagga

SEQ ID NO: 553353 - DNA, 59 bp, Homo sapiens
ggcgtgagcgagcagggaagagctcctggcagctgcctgcctgcttgctcgctcgcgcc

SEQ ID NO: 553354 - DNA, 59 bp, Homo sapiens
ggcttttgtggtttgctaaatgcctgagtaaaattgaggtgtttaataccacaaaagcc

SEQ ID NO: 553355 - DNA, 59 bp, Homo sapiens
gtatattcacacacgcataggctatagaacaaatagtgtgtgtatgtgtgtgcatatgc

SEQ ID NO: 553356 - DNA, 59 bp, Homo sapiens
cctccaagtgcgagtagtaggccgccaggacatggtaggctatggctcgcatctggggg

SEQ ID NO: 553357 - DNA, 59 bp, Homo sapiens
gggggtgggtcatgggctctaagctgctcttctgtctgtctgagcttatgaacaccccc

SEQ ID NO: 553358 - DNA, 59 bp, Homo sapiens
caggccagcccgctcttctcatgtaaagcagctttttgtctgggggagccagggctggg

SEQ ID NO: 553359 - DNA, 59 bp, Homo sapiens
caccggccgctccatgtgaaaccggtcatgtgagcctgtttacagcagagcagctggtg

SEQ ID NO: 553360 - DNA, 59 bp, Homo sapiens
gcaggcggcttagcagaggaggaggagcctcaggcccctttcccagccaggccccctgc

SEQ ID NO: 553361 - DNA, 59 bp, Homo sapiens
agggatctggggcagatggtggtagcacaacctagagctcacttctgccacagatgact

SEQ ID NO: 553362 - DNA, 59 bp, Homo sapiens
gggtgggtgccagggtggggcaggggcaggcctgcccctgccctccacctgccctgcct

SEQ ID NO: 553363 - DNA, 59 bp, Homo sapiens
agtgtactgtatattttaggcagaatgttttttcttggctggtttgtatacagcacact

SEQ ID NO: 553364 - DNA, 59 bp, Homo sapiens
cgcccttcctccactcttcctgttggagtcctgatcggaggagtgcgggccggagggtg

SEQ ID NO: 553365 - DNA, 59 bp, Homo sapiens
aagggttccctctgggccccaacttggcagataagttcattgcccggaagggaattctt

SEQ ID NO: 553366 - DNA, 59 bp, Homo sapiens
gggctctggggaggagcagggaggcatccttttggcatatcccctcctctctgcagccc

SEQ ID NO: 553367 - DNA, 59 bp, Homo sapiens
gccccctcccccacctgcaggctgctgggtttcccgggcccttcaggaggggaaggggc

SEQ ID NO: 553368 - DNA, 59 bp, Homo sapiens
tctctcccctgcctgcctccttctccgttagcgctaccggttggcgggcgggggagggg

SEQ ID NO: 553369 - DNA, 59 bp, Homo sapiens
ggtagggcacgggactaagggagacctggtgacagttgttccccggtcctgggttctct

SEQ ID NO: 553370 - DNA, 59 bp, Homo sapiens
ttttcttttgttccatgctggctgaaccacgtggtcccagaagtaggaaggaaagagaa

SEQ ID NO: 553371 - DNA, 59 bp, Homo sapiens
ctggccctgagtgcccctcggcccggtgtttgcacttgggctgccagggcaggggctgg

SEQ ID NO: 553372 - DNA, 59 bp, Homo sapiens
tgtggcctggagtttgatgtaggccagtggtgtctggctccttgcacctctaggccaca

SEQ ID NO: 553373 - DNA, 59 bp, Homo sapiens
gagaatggggcctcttagactctgcctcttacagtggtcctgggatttgcccttttctc

SEQ ID NO: 553374 - DNA, 59 bp, Homo sapiens
tctgttttgtgtctctctggtgtttggtgacataacataataagatggcaggaggcaga

SEQ ID NO: 553375 - DNA, 59 bp, Homo sapiens
agctggcagctctcaggggtacgtgagtccaggctgatctcatccttggggctgctgct

SEQ ID NO: 553376 - DNA, 59 bp, Homo sapiens
tgtggaaatgggttggatggagtattttaatacccacacatctctaattcagttctaca

SEQ ID NO: 553377 - DNA, 59 bp, Homo sapiens
ggagcatacatgaaggatttctctgtggctagttccacaaaggaaatcaattgtgctcc

SEQ ID NO: 553378 - DNA, 59 bp, Homo sapiens
ggcagagaggttggattggatgatttctatgatctgttccagttcaaaacttctctgtt

SEQ ID NO: 553379 - DNA, 59 bp, Homo sapiens
ctcacatacaagagatggtggatcttgtggcccagaagtaccacttctttgtgtgtgag

SEQ ID NO: 553380 - DNA, 59 bp, Homo sapiens
gacagctcttttaaaagcaggcagaaggcattattgctgaggcagcttgaggagctgtt

SEQ ID NO: 553381 - DNA, 59 bp, Homo sapiens
ccctgatttaattagcttttccttacaatgatttagggaagcctgtaattagctcaggg

SEQ ID NO: 553382 - DNA, 59 bp, Homo sapiens
cagggtggacataaattgtctgttttctcttatcaaacagggcgtttatttccatcttg

SEQ ID NO: 553383 - DNA, 59 bp, Homo sapiens
cctggtcaaacttcaagcttccttttcttcatagggatggaaacggatatttggccagg

SEQ ID NO: 553384 - DNA, 58 bp, Homo sapiens
gcctgatttcccttagggcccctactgtggatggtggggatctgcctagaagtcaggc

SEQ ID NO: 553385 - DNA, 58 bp, Homo sapiens
cagaaaggttgtttatggttgtttcagttgttactggttactgtaaataatctttttg

SEQ ID NO: 553386 - DNA, 58 bp, Homo sapiens
cagctgtgaaagccatttccaggcgactataaattgtgaggaaatggccatccagctg

SEQ ID NO: 553387 - DNA, 58 bp, Homo sapiens
ttgtctttgttcccgggactcaggggctgtgttgctgctggcttcctggggatggcaa

SEQ ID NO: 553388 - DNA, 58 bp, Homo sapiens
ccatgatcacagtaatgttctttggagatataatcatcaaagagcatcccttggttag

SEQ ID NO: 553389 - DNA, 58 bp, Homo sapiens
tgtctgtctgtccacactcaccagccccctgggccctggggggatggatagacagaca

SEQ ID NO: 553390 - DNA, 58 bp, Homo sapiens
ctactctggagagtgacaatcatgtataactaaatttgattgacacttctgtgagtag

SEQ ID NO: 553391 - DNA, 58 bp, Homo sapiens
ttaaattactaggtacctagtgaaagagccattttttcttaggtaccctgtaatctaa

SEQ ID NO: 553392 - DNA, 58 bp, Homo sapiens
ggaaagctgagtggcagcttgcaggtattgtactgacctgcgctgtcaaagtctttcc

SEQ ID NO: 553393 - DNA, 58 bp, Homo sapiens
ggtgagccattctatttagattcacgaccggctgagtcatgattggaaatggttggcc

SEQ ID NO: 553394 - DNA, 58 bp, Homo sapiens
cgagcctttaggggtatgagagaaaccggagacctggtccgtgctctcaaagagctcg

SEQ ID NO: 553395 - DNA, 58 bp, Homo sapiens
cgagtcctgctgacttcctgcccagcaggtagtggtgaccaagggagtcagaggatcg

SEQ ID NO: 553396 - DNA, 58 bp, Homo sapiens
tggatgccattgatatgtctcagctcagtcatgagcctggtgatatcagtggtttcca

SEQ ID NO: 553397 - DNA, 58 bp, Homo sapiens
agagctgtttttccaaactattgagcatggtgacttagtgattggaaaaactagtttt

SEQ ID NO: 553398 - DNA, 58 bp, Homo sapiens
ccctttctgtgtggaggccacgtggcaaactccaggtgcatctgtcatacagaaattg

SEQ ID NO: 553399 - DNA, 58 bp, Homo sapiens
tacacaggtttatctctctgacctttagctaattattagattgagataaatgtgtgta

SEQ ID NO: 553400 - DNA, 58 bp, Homo sapiens
actaccttatacaaaatgtaggtttcatacaaacacatgcattcttgtgtaaggtagt

SEQ ID NO: 553401 - DNA, 58 bp, Homo sapiens
tgcctgttgtctgctctcgttccatgtcctgctggatggcacagcagggtgacgggca

SEQ ID NO: 553402 - DNA, 58 bp, Homo sapiens
ggggttcagatctcctacttgaacctgctgtcagactcgcctctgagatctgagcccc

SEQ ID NO: 553403 - DNA, 58 bp, Homo sapiens
acaggctatttttggagttgtgttgtttggagagcaaccaagccagaaatagtgctgt

SEQ ID NO: 553404 - DNA, 58 bp, Homo sapiens
gttccctgaatgctttcctgtttgataccctgtgtgtacagtgaagggaacagggagc

SEQ ID NO: 553405 - DNA, 58 bp, Homo sapiens
ggttggctttccctgtgcactagggccctgctgggccttcagtggacatgaagctacc

SEQ ID NO: 553406 - DNA, 58 bp, Homo sapiens
ggaggtaggaaggagccctgcacaggaggcttgacacatgggccctattcctgcctcc

SEQ ID NO: 553407 - DNA, 58 bp, Homo sapiens
ttgcagacagtgagagtgaaaggtgttttattcttactattgactctcaaatttgcag

SEQ ID NO: 553408 - DNA, 58 bp, Homo sapiens
cttccccaggtcatcagccagaaggagggagacttcttctttgattccttgagggagg

SEQ ID NO: 553409 - DNA, 58 bp, Homo sapiens
gcctctggggggttttgatggaggagctgccccttcttgcttcatttctcccagaggt

SEQ ID NO: 553410 - DNA, 58 bp, Homo sapiens
aacaggccagcaagtcttggagaggttgtcaggctgagttgagacatgctgtcccttt

SEQ ID NO: 553411 - DNA, 58 bp, Homo sapiens
ggttttacctgaagagcgtaaagtaggtgtgctaatttacagctcggcagataaagcc

SEQ ID NO: 553412 - DNA, 58 bp, Homo sapiens
tcgaggctagagtcacgcttgggtatcggctattgcctgagtgtgctagagtcctcga

SEQ ID NO: 553413 - DNA, 58 bp, Homo sapiens
gccttttactaacactcttttcacaattctggctgagagaggaatgtgaataaaaggc

SEQ ID NO: 553414 - DNA, 58 bp, Homo sapiens
agatgtgggacagagctcctcgatctcgtccaaggcagaggagaaactgtccttttct

SEQ ID NO: 553415 - DNA, 58 bp, Homo sapiens
cataataggaattttggcttctcctgggtgtctctaaagccagaagttttctattatg

SEQ ID NO: 553416 - DNA, 58 bp, Homo sapiens
gacttacacactctgccctgctgttgtcaataacaataaaggggtggagggtgtggtt

SEQ ID NO: 553417 - DNA, 58 bp, Homo sapiens
gccctcgttgtcccgggaataaacccgcaacgtgtatgtcatcccgggatagaggtct

SEQ ID NO: 553418 - DNA, 58 bp, Homo sapiens
catttatcatcagaccttttaaaagcctctgcttttaaaacggacatggtgatagatg

SEQ ID NO: 553419 - DNA, 58 bp, Homo sapiens
gcactatatttaaacctgtggatgggaatattccccattcttggttacgctgtagtgc

SEQ ID NO: 553420 - DNA, 58 bp, Homo sapiens
acaagatgcgggttaagggccagaggcaaaacccagggcccttaaactagccaatcat

SEQ ID NO: 553421 - DNA, 58 bp, Homo sapiens
ctgggagcttttgctttctactttaagaataaaattggatgggagcagtggctttcag

SEQ ID NO: 553422 - DNA, 58 bp, Homo sapiens
gcagccccttctccctctcagggcctctttgtgtggggccagagggggagggggctgc

SEQ ID NO: 553423 - DNA, 58 bp, Homo sapiens
tctttctgatttctttgtcatttaagtctgcgatggtttgacaggagatacagagaga

SEQ ID NO: 553424 - DNA, 58 bp, Homo sapiens
gtgtctccttgaaagtaacggcatgtgattgcttactccattactttcaatgggactc

SEQ ID NO: 553425 - DNA, 58 bp, Homo sapiens
tgtgaagtgctgggtggcggctgttgtactggcctgcatggcctcagcgcttgtcata

SEQ ID NO: 553426 - DNA, 58 bp, Homo sapiens
tgggacatctgtgatttcagtctaatgacatttcgtgaggctgggatcctgtgtccca

SEQ ID NO: 553427 - DNA, 58 bp, Homo sapiens
gactgggccaagagcgggggcactacgggcatcgaggctttcgcctttgggtcagggc

SEQ ID NO: 553428 - DNA, 58 bp, Homo sapiens
gccttgcctggccctgggcagaatgctggtctaccaccagcagcctggggaggagggc

SEQ ID NO: 553429 - DNA, 58 bp, Homo sapiens
gctggaactcaagtgaacgcttggctcaaaatccattgctgttctctagaaatccagc

SEQ ID NO: 553430 - DNA, 58 bp, Homo sapiens
ctgctgattacacagaagaacattgctatttacatgcaaatatctttgtaatcagcag

SEQ ID NO: 553431 - DNA, 58 bp, Homo sapiens
gctggaactcaagtgaacacatggctcaaaatccattgctgttctctagaaatccagc

SEQ ID NO: 553432 - DNA, 58 bp, Homo sapiens
ggtagttatcttgaggtaggtgtgacttcagggtcacagataaataaagatgattacc

SEQ ID NO: 553433 - DNA, 58 bp, Homo sapiens
ggctgactctgtgctgtcacagggagacatgcacacctgttgcagctggagcacagtc

SEQ ID NO: 553434 - DNA, 58 bp, Homo sapiens
agatcctgccctaagatgttatatttagatctgtgaaaatattttagggccaggagat

SEQ ID NO: 553435 - DNA, 58 bp, Homo sapiens
ctactctggagagtgacaatcatgtataattaaatttgattgacacttctgtgagtag

SEQ ID NO: 553436 - DNA, 58 bp, Homo sapiens
ttacagggctggtttgtcaaacacggttacatctgctgacaagaaaccagttatgtaa

SEQ ID NO: 553437 - DNA, 58 bp, Homo sapiens
gtgggaggtttccttttggatctgttttgagactgttccagaaagaaggcttcctttc

SEQ ID NO: 553438 - DNA, 58 bp, Homo sapiens
gctcgcgcccggagccctgcccgcgcgactgagcatgcccagagctccgggcgccggc

SEQ ID NO: 553439 - DNA, 58 bp, Homo sapiens
gggagggagttctctgaggaagaagccacagcagattttcctcacagacttcctttcc

SEQ ID NO: 553440 - DNA, 58 bp, Homo sapiens
tcagcctgccgtccacactctccaccgcctgacagggtttgagtgcgatggcagctga

SEQ ID NO: 553441 - DNA, 58 bp, Homo sapiens
ggaggtacgaggaggcatctggccaacccattcctggtccttgtttccttgatctttc

SEQ ID NO: 553442 - DNA, 58 bp, Homo sapiens
tcgatcaagaagccggatgtgggagccaatccaatcaaacatctggttgcttggctga

SEQ ID NO: 553443 - DNA, 58 bp, Homo sapiens
catgggagctgagcttgtcccaggactcaagggagtggggacgagcatatctgccagg

SEQ ID NO: 553444 - DNA, 58 bp, Homo sapiens
gtcaggtgccagagagtctagacacagtgatttcagtcatgggtctttggtatctgat

SEQ ID NO: 553445 - DNA, 58 bp, Homo sapiens
gggcaggtctaggtctggtttgggcagttggttgtaatctgagtgcctggacttgccc

SEQ ID NO: 553446 - DNA, 58 bp, Homo sapiens
tctgctcagctgttttgtttccaggagcctgagagagagacagaagcagctgggagga

SEQ ID NO: 553447 - DNA, 58 bp, Homo sapiens
tcctgggaatgaggcccgcttcaatgatcaatttcagaagggggttcttttcctggga

SEQ ID NO: 553448 - DNA, 57 bp, Homo sapiens
actcgagagagtagcaatcacatatggtaatgacatatgattgaaacctctacgagt

SEQ ID NO: 553449 - DNA, 57 bp, Homo sapiens
tttttgcgatgtgttcctaatatgcactataaatatattgggaacattttgcatgta

SEQ ID NO: 553450 - DNA, 57 bp, Homo sapiens
gacgagggacagaggggggggcggagagccgccgcctctgccccccgctcgccccgc

SEQ ID NO: 553451 - DNA, 57 bp, Homo sapiens
agcattttctgcctgggtgctacagtaatatctgtgaaatcaaggttgaattgtgct

SEQ ID NO: 553452 - DNA, 57 bp, Homo sapiens
gcagacagttatccctttctagtctggctcgtgggactctagagggagtcagtctgc

SEQ ID NO: 553453 - DNA, 57 bp, Homo sapiens
tttctcatcacaaccctagggtaccaggtacgtggtgagttgggggacgatgggaga

SEQ ID NO: 553454 - DNA, 57 bp, Homo sapiens
tgtgtgattgcaggagatgtggctgtagacaaagcctgcctccccatcagttataca

SEQ ID NO: 553455 - DNA, 57 bp, Homo sapiens
gatttttctgtgctggagcacttcttgggagatgatccagggcagagcttcaaaatc

SEQ ID NO: 553456 - DNA, 57 bp, Homo sapiens
ggaggtggcagggaacataatttctgtttgaaagttcttttgttttctgctaccttt

SEQ ID NO: 553457 - DNA, 57 bp, Homo sapiens
gctggagaggaaagcatggttcctttcttaaagaaatcttccatgttttctctaagt

SEQ ID NO: 553458 - DNA, 57 bp, Homo sapiens
ccatctgttcactgtgtcctccactcccaggccccgtgtggagacagagacagatgg

SEQ ID NO: 553459 - DNA, 57 bp, Homo sapiens
ttccttccctaagattcccaacacacagcagaagctggttggggatgaggtcaggaa

SEQ ID NO: 553460 - DNA, 57 bp, Homo sapiens
tctgcctccactgccaccatggcgcccgtgaaaaagcttgtggtgaaagggggcaaa

SEQ ID NO: 553461 - DNA, 57 bp, Homo sapiens
acagtgagaacttttcctgaaaggggctgctccactgcagggaaatgttttcggtgt

SEQ ID NO: 553462 - DNA, 57 bp, Homo sapiens
tcatttggctccagaccttggcactacgaaggtcagccaaggtcggggctcaagtaa

SEQ ID NO: 553463 - DNA, 57 bp, Homo sapiens
gtgtccataatagcatagagtgaactatatgtcactaattgtgctgttctgggtcat

SEQ ID NO: 553464 - DNA, 57 bp, Homo sapiens
aagcggcccttgtgtgttggtgtttgcggagctgccacacgcgcaggggccaggctt

SEQ ID NO: 553465 - DNA, 57 bp, Homo sapiens
gcatgtggtgaccccactcatggtagcagacaccaggtggttcaggtcaccataggt

SEQ ID NO: 553466 - DNA, 57 bp, Homo sapiens
tggtttcctttgataaaaagttcttcaggaaaataacagcttagtcagaggaggcca

SEQ ID NO: 553467 - DNA, 57 bp, Homo sapiens
aaggattaaagtcaaagccccagctcgacatgagttatggttttgatttttattctt

SEQ ID NO: 553468 - DNA, 57 bp, Homo sapiens
ccctacccactcccacccttgctctgggagcctggctggggtagggactgggtgggg

SEQ ID NO: 553469 - DNA, 57 bp, Homo sapiens
taatagacttcattatctggcttgctggcccacagcaaattagatgagaggctatta

SEQ ID NO: 553470 - DNA, 57 bp, Homo sapiens
tcacctttctttatctctttttccacatgtttggaactgaggggatatggaaagtga

SEQ ID NO: 553471 - DNA, 57 bp, Homo sapiens
ggtcaggagagggggcaggcactggctggctggtgactgctttcactcctggctgtc

SEQ ID NO: 553472 - DNA, 57 bp, Homo sapiens
tggggagggttgggggaggctgccacactgccgtggtttcttccgccaaattcccca

SEQ ID NO: 553473 - DNA, 57 bp, Homo sapiens
tcttagatgcccagttaaatgggacttctttctcccactctaactggtgctttaggg

SEQ ID NO: 553474 - DNA, 57 bp, Homo sapiens
tccacccccaagcctcttggtaggaactgcatcatatttaatgaggctgggggtgga

SEQ ID NO: 553475 - DNA, 57 bp, Homo sapiens
gcaccctcatttctctatggagcgccggctgctatatccctagagtctgggggctgc

SEQ ID NO: 553476 - DNA, 57 bp, Homo sapiens
tccttcctgacactgatggatggtcacctccacctgtccatcctgtgtcaatcagaa

SEQ ID NO: 553477 - DNA, 57 bp, Homo sapiens
ggcttcagactccttggggctcagatcaaaggtagcagatccgccaagcctgaggcc

SEQ ID NO: 553478 - DNA, 57 bp, Homo sapiens
agtcccaggcagcccttggtcttgcttttactgtaggactgtgggggagcaggagat

SEQ ID NO: 553479 - DNA, 57 bp, Homo sapiens
gactgggagggggccagagaccctccaggcagagctcctggcccccaacccagcagc

SEQ ID NO: 553480 - DNA, 57 bp, Homo sapiens
aatcaggttaccagcagatcatgtaaaattcaactcagaattgctggctgcttgatt

SEQ ID NO: 553481 - DNA, 57 bp, Homo sapiens
gcttggagctcctgctaccatggaatatttttaaatggttacgaaaggagtctgagc

SEQ ID NO: 553482 - DNA, 57 bp, Homo sapiens
ccctctctgctacatttcttggacagttttaaagagcccatgaatgtagtttggggg

SEQ ID NO: 553483 - DNA, 57 bp, Homo sapiens
cagcattgctgagccttaccatatgataacatgcttaaaagggcttggcaaatgctg

SEQ ID NO: 553484 - DNA, 57 bp, Homo sapiens
ttcattcaggtgtatttatgggtttatatttacccaataaatataacaatggatgaa

SEQ ID NO: 553485 - DNA, 57 bp, Homo sapiens
aggaaagagtgtatccatcaatccatgtaatgtgacgtgatgagtttactcttttct

SEQ ID NO: 553486 - DNA, 57 bp, Homo sapiens
ctggtggtgtcttcctctggccgccgcgtggagtgctcggagcagaaggcgccgccg

SEQ ID NO: 553487 - DNA, 57 bp, Homo sapiens
gtgcagcaggctgccggagccgccatttggtggcggatctcggtagttcagtagcac

SEQ ID NO: 553488 - DNA, 57 bp, Homo sapiens
ctctggcctggggcctgctccctatctgtggaactgggagtagggcccaggctaggg

SEQ ID NO: 553489 - DNA, 57 bp, Homo sapiens
cagctgggaaggctgggtcaggcagggcaggctgcagcaggcccagcagcctggctg

SEQ ID NO: 553490 - DNA, 57 bp, Homo sapiens
gcctttccaacgaagacttcctccaggccatccgagcaaaatcttcgttggaagggc

SEQ ID NO: 553491 - DNA, 56 bp, Homo sapiens
ggcgtcgcttggctcctcactcccaacaatggcagctccgagactgagcggcggct

SEQ ID NO: 553492 - DNA, 56 bp, Homo sapiens
acaccgcaaatatcttctgatcacagttcattaattgtgatcagattttgtgttgt

SEQ ID NO: 553493 - DNA, 56 bp, Homo sapiens
aatagtgcatgccagacatcatataattaaatgccagctgtctggtactcactgtt

SEQ ID NO: 553494 - DNA, 56 bp, Homo sapiens
gggaagggcagggtctatgcaccaactgcctttgtgcagaaaacctttcctttccc

SEQ ID NO: 553495 - DNA, 56 bp, Homo sapiens
gcgcccccggcctgccccagagctgcgcggcgcggggagggggcggctgggggcgc

SEQ ID NO: 553496 - DNA, 56 bp, Homo sapiens
gtcaaatattatgcagcttggatacccaatttagtatgagctgctttgtatttggc

SEQ ID NO: 553497 - DNA, 56 bp, Homo sapiens
accttttcaagctccaagagtttcacatttggagacttttacagcattgggagggt

SEQ ID NO: 553498 - DNA, 56 bp, Homo sapiens
gcagggagcacagagatgaagataaaaggcgaaatgtctatctttgagtcctctgc

SEQ ID NO: 553499 - DNA, 56 bp, Homo sapiens
cttttcctctccacttcctgttcacacaggggggggcgggaagtggagggaggaag

SEQ ID NO: 553500 - DNA, 56 bp, Homo sapiens
cattttcctagtcatgtgcttctctggattgccacagagacactggatggaaaatg

SEQ ID NO: 553501 - DNA, 56 bp, Homo sapiens
gagctaaacttgaactgaacatttctttaccttgtgaaatgttcagttaagtgctt

SEQ ID NO: 553502 - DNA, 56 bp, Homo sapiens
taattttttcacactggcaccctaattaaatgttagggtgttagtcctaacaatta

SEQ ID NO: 553503 - DNA, 56 bp, Homo sapiens
ttcaaatgggatcttcagctttctctcagacaagggggttgaaggtcgtgacagaa

SEQ ID NO: 553504 - DNA, 56 bp, Homo sapiens
tgttttcatttcttcatccttgagcctaaagctaagggaagaggaaagaatgaaca

SEQ ID NO: 553505 - DNA, 56 bp, Homo sapiens
gcctccgtgatggccgtggtgttgctcagcatgcacaccgcccgctgcactttggc

SEQ ID NO: 553506 - DNA, 56 bp, Homo sapiens
attttatgggatttcctggcttttaaagtaaaagccagttaaaactcccttgaaat

SEQ ID NO: 553507 - DNA, 56 bp, Homo sapiens
tgacagttttatagagtgcttcctctgcagagtgtgaggcacatcataaactgtta

SEQ ID NO: 553508 - DNA, 56 bp, Homo sapiens
cctgttttcatcctacttttaagtaataaatttggcattagtgggaggggagcagg

SEQ ID NO: 553509 - DNA, 56 bp, Homo sapiens
agactttccaggtcctgggctatgatgaaattatagctggaggcttgtaaagtcgt

SEQ ID NO: 553510 - DNA, 56 bp, Homo sapiens
gaggttttctgggtttctgtttctttaatgaggacgaaacacacctggttaacctc

SEQ ID NO: 553511 - DNA, 56 bp, Homo sapiens
gagttataacctagtttaactggatttagaaaactggttaaactaggctacaactc

SEQ ID NO: 553512 - DNA, 56 bp, Homo sapiens
agggatctggggagggaggaggggctgaagtggcccctcggctctctgcccgggct

SEQ ID NO: 553513 - DNA, 56 bp, Homo sapiens
tggcattccaggatctgtgggttctgggtttccaggattcattcttgacaatgtca

SEQ ID NO: 553514 - DNA, 56 bp, Homo sapiens
actccacgccttttgtctgctggtttccctgaggatgcaggctagggacctggggt

SEQ ID NO: 553515 - DNA, 56 bp, Homo sapiens
gctagcctgtctgctgtgttttcaaagtagcaaagagtgcacagtggaagagcagc

SEQ ID NO: 553516 - DNA, 56 bp, Homo sapiens
gcccgaccgcgccggcccgcacctcccggcccggagctgcgggctgcggtcagggc

SEQ ID NO: 553517 - DNA, 56 bp, Homo sapiens
gaggagaagtcctgcttacttcctgttagaagggaggtaacagggttttctctctc

SEQ ID NO: 553518 - DNA, 56 bp, Homo sapiens
agggaccagaatggggcctcctgggattctgcccagtgctttttcttttggttcct

SEQ ID NO: 553519 - DNA, 56 bp, Homo sapiens
cttggcccaggtcccagagagtctggttggtgtgtacttggggcttgggctggatg

SEQ ID NO: 553520 - DNA, 56 bp, Homo sapiens
tctctcaggcttggaggggccatagataccaactgccacctgccaggcctctggga

SEQ ID NO: 553521 - DNA, 56 bp, Homo sapiens
cagaggcgcaaggcgcccctcccccacctcggggcgggagcagccttcagtgtctg

SEQ ID NO: 553522 - DNA, 56 bp, Homo sapiens
gtaggcactgtttttgctgaggtattggggttaatctcagtggaaatgaggcctgc

SEQ ID NO: 553523 - DNA, 56 bp, Homo sapiens
actgacgaccacaagttggatgggtggacctttcatgcatcctattgtccgttagt

SEQ ID NO: 553524 - DNA, 56 bp, Homo sapiens
ttccggggcccggtagaggcgcgccaagaggaaaggaaagtgcggcggccctggaa

SEQ ID NO: 553525 - DNA, 56 bp, Homo sapiens
ggtggtggggccctggcgtcaggcaatattcagaccagccagggcccattgtcacc

SEQ ID NO: 553526 - DNA, 56 bp, Homo sapiens
caaaggctttgctgggctttgttccactgtgtagggattaggcctggcggtctgag

SEQ ID NO: 553527 - DNA, 56 bp, Homo sapiens
cctgcgggagaggaggctggctctttgggcgacctccgaagcttccctcctgccgg

SEQ ID NO: 553528 - DNA, 56 bp, Homo sapiens
ttctctcccagctctggtctaaagtaattttggtgctgaagggcagagggagggaa

SEQ ID NO: 553529 - DNA, 56 bp, Homo sapiens
attccctttcatgtggctgcctgtgatctctccaggcggctctgccgaaggggggt

SEQ ID NO: 553530 - DNA, 56 bp, Homo sapiens
atttgaggtaagactgccatgtggagatgggtctccatctggtggcttccttttgt

SEQ ID NO: 553531 - DNA, 56 bp, Homo sapiens
ctgccccactgaagatggcttcctgtacacagagtcattatggttcagtgaagcag

SEQ ID NO: 553532 - DNA, 56 bp, Homo sapiens
ggccccagatgtttgaaagacttttgcagacaaggtaatcaatccatttggtggcc

SEQ ID NO: 553533 - DNA, 56 bp, Homo sapiens
tacagaaagtattggtagtttcttccctgtccatggaagctgcagtgcttcatgta

SEQ ID NO: 553534 - DNA, 56 bp, Homo sapiens
gagatttagctgcttaactcctgttgtttttaatgggagtcatgtggctaaatctc

SEQ ID NO: 553535 - DNA, 56 bp, Homo sapiens
ttccatttttcctgacagtcattcttcttaattgaagagtgggaggaaagatggga

SEQ ID NO: 553536 - DNA, 56 bp, Homo sapiens
gtgcgggtggggaggcaggggcggggggagcccggttcccctcccccagcccgggc

SEQ ID NO: 553537 - DNA, 56 bp, Homo sapiens
tggcttgtgaacattgctcagcctcctgcgagacattagcacttgttctcgagcca

SEQ ID NO: 553538 - DNA, 56 bp, Homo sapiens
tttaatgggattggcagattgccatttttgtgcttctgccaactctcttctttgag

SEQ ID NO: 553539 - DNA, 56 bp, Homo sapiens
ctcaaaactgaggggcattttctgtggtttgaaaggaaagtgcacccagttttggg

SEQ ID NO: 553540 - DNA, 56 bp, Homo sapiens
cttttactgcctttgttttaccattcttgtcttaggtaaggggaaggtggggaaag

SEQ ID NO: 553541 - DNA, 56 bp, Homo sapiens
gtggaaggctgaggttcaaaggctgcctgtagcaggcgccggcccttagcttccac

SEQ ID NO: 553542 - DNA, 56 bp, Homo sapiens
tggggcaaggggtttgtctggattgcagatcgcattgcacagacccctggctctga

SEQ ID NO: 553543 - DNA, 56 bp, Homo sapiens
gggaaaagagagaatttatagccccagggccctgtgggcagattctttcttggctc

SEQ ID NO: 553544 - DNA, 56 bp, Homo sapiens
ggggccaagtttcttggatgagctgcagtcagttttccaaggatatggttgatccc

SEQ ID NO: 553545 - DNA, 56 bp, Homo sapiens
agacttggtgagctggtaggaagacttgccaagcactgctggcttgccaagctcct

SEQ ID NO: 553546 - DNA, 56 bp, Homo sapiens
gaggggtctctgcctctacccaggactctttcatgaccaggaggctgaggcccctc

SEQ ID NO: 553547 - DNA, 56 bp, Homo sapiens
gaaggtgggggctggatgctttgttaagcaggaaatgcaggccacccccagccttc

SEQ ID NO: 553548 - DNA, 56 bp, Homo sapiens
cttcttcccttctctgcaggggccaacagggcaccctgtggagatgtagatgggag

SEQ ID NO: 553549 - DNA, 56 bp, Homo sapiens
tttagcgaggccttgatccagagcagcaccactgggccagggcctctggagctgga

SEQ ID NO: 553550 - DNA, 56 bp, Homo sapiens
aggggagggggtctttggggagctggttaaagatccagaatcggcccctcgcccct

SEQ ID NO: 553551 - DNA, 56 bp, Homo sapiens
aacagttggaagggcctggatctttagctctgggtctttggactttccaatttgtt

SEQ ID NO: 553552 - DNA, 56 bp, Homo sapiens
ggtatgggtgatctgaatattgcctgtttaaacgggcagtcagtgatgcacatacc

SEQ ID NO: 553553 - DNA, 56 bp, Homo sapiens
taaatgagagctcctttttctcttcaaaagtgccaggaaaaaggtgtttttattta

SEQ ID NO: 553554 - DNA, 56 bp, Homo sapiens
ggggggaggctggaaatgttctgggccccaaagagcagcttcctttgtctccctcc

SEQ ID NO: 553555 - DNA, 56 bp, Homo sapiens
tagtgccaaggggaatattgggataactctattctaccccattcccttgtgtgctg

SEQ ID NO: 553556 - DNA, 56 bp, Homo sapiens
ctctactcgggtggcgtgtcttgcaattacaatgcaagacatctatcatagtgatg

SEQ ID NO: 553557 - DNA, 56 bp, Homo sapiens
ccccaccctcgctgtcccccgctagatgccctcgttgggggtgcgaggctgtgggg

SEQ ID NO: 553558 - DNA, 56 bp, Homo sapiens
cctccatggctccaagaaaaactatttgaaatgtcccttcttatggggccaggggg

SEQ ID NO: 553559 - DNA, 56 bp, Homo sapiens
tgcttgttttgtggcttcagctgtgtggatacagagcaggaaggctagaagcagga

SEQ ID NO: 553560 - DNA, 56 bp, Homo sapiens
actgttgtctagaccatgcctgtgcgtaggcgcgtaggcagcgtctacacagatgt

SEQ ID NO: 553561 - DNA, 56 bp, Homo sapiens
cttccctttctgacccctcctcccctcacactgggagaggggtggggtgaggatgg

SEQ ID NO: 553562 - DNA, 56 bp, Homo sapiens
acggctggctgatggatgcaggcgcttagacaccctgtatgacagcagccagctct

SEQ ID NO: 553563 - DNA, 56 bp, Homo sapiens
ccttgagtgcatcgtgggtgtcatgcaggcagtagacccggatgttgtactcgagg

SEQ ID NO: 553564 - DNA, 56 bp, Homo sapiens
tgcccacaccaggccctggcttcgggcccagcatgagcctgggccggcggtgggta

SEQ ID NO: 553565 - DNA, 56 bp, Homo sapiens
caggcagcaggagccctgctcgcatctcccattgtagctgtggccttgctggtctg

SEQ ID NO: 553566 - DNA, 56 bp, Homo sapiens
ggaggcagggggaggaaggaatgtactattcacggccccacccatcccctgcctct

SEQ ID NO: 553567 - DNA, 56 bp, Homo sapiens
gggttgaggcggatgtcggcgggaacatcggccttgtcctcgtccgcctcgaactc

SEQ ID NO: 553568 - DNA, 56 bp, Homo sapiens
tcgcacaatccgattccttgggagtccctcatactcagggagtttggcacgtggga

SEQ ID NO: 553569 - DNA, 56 bp, Homo sapiens
caagggggtgaggagggtggtgggagcaaacacttccctccctttcttcctccctg

SEQ ID NO: 553570 - DNA, 56 bp, Homo sapiens
cgctcgatgaggcccacgaggtggcggcgcagctcctcgcgggcctcggacgagcg

SEQ ID NO: 553571 - DNA, 56 bp, Homo sapiens
ctcccctggtctgcagctgttagtcgggctggaaagactgcggtatcttgggggag

SEQ ID NO: 553572 - DNA, 56 bp, Homo sapiens
gtgggctacagctgcttgtgggttgcttagcaactagaagtagttctgagccacac

SEQ ID NO: 553573 - DNA, 56 bp, Homo sapiens
aaccagcttgttggccatgttactttccctaggggtgaatgccaattagccgggct

SEQ ID NO: 553574 - DNA, 56 bp, Homo sapiens
tgcttcctccccttagaaagtcattttagcattagattttccctaaggaggaagca

SEQ ID NO: 553575 - DNA, 56 bp, Homo sapiens
atccacgcttaggtggagcgagggggcgttccttggctttctaggctggactttct

SEQ ID NO: 553576 - DNA, 56 bp, Homo sapiens
gtcccacctcctggggctggatgccaggcaggccatctgcttctggggctgggcgc

SEQ ID NO: 553577 - DNA, 56 bp, Homo sapiens
tgtgtcaatatgcgatgatgtgttgtgatggcacagcgtcatcacgtggtgacgca

SEQ ID NO: 553578 - DNA, 56 bp, Homo sapiens
tcctcaaggcagagaagggactggatgaagctcccagtgccccttcctgcccagga

SEQ ID NO: 553579 - DNA, 56 bp, Homo sapiens
ctcttggctgtggggcctcagctccaaagagcagtgcaggcctcaggctagggctg

SEQ ID NO: 553580 - DNA, 56 bp, Homo sapiens
tttgaaacttgacagatgtgtgcctcaaagtttctacacatctgtcaaatgttaaa

SEQ ID NO: 553581 - DNA, 56 bp, Homo sapiens
ctttgtgccccgggtgccccaccgcccgcgcccctccgggcatctggcccacaaag

SEQ ID NO: 553582 - DNA, 56 bp, Homo sapiens
gaggactgggctggtgatgagtgaggtgatgtgtgtgacgttgccagccaagcttc

SEQ ID NO: 553583 - DNA, 56 bp, Homo sapiens
gagggagggggaacggtgttcgcggcatctggagtcatcgatcttccttttccttc

SEQ ID NO: 553584 - DNA, 56 bp, Homo sapiens
cagtttgctgcacagatatttgggttaaacaatcatttgctgtggggcagactgtg

SEQ ID NO: 553585 - DNA, 56 bp, Homo sapiens
catctgtggaagtgggagagaaaaataatactttctctgcctacttcacagagatg

SEQ ID NO: 553586 - DNA, 56 bp, Homo sapiens
catggtgcccactcacaagttggctggattcttgcccttagtgtgtaggtgccagg

SEQ ID NO: 553587 - DNA, 56 bp, Homo sapiens
cctaaaacaagtgcaagactagcagaccccagactactcttgcttcttgttttagg

SEQ ID NO: 553588 - DNA, 56 bp, Homo sapiens
cccaggtctggggttggctcaggccacagggccctgcaggctgagcttaggctggg

SEQ ID NO: 553589 - DNA, 56 bp, Homo sapiens
cgccagtgggagtcgggcccagccgtcttggcgctcgcccgactctcccgcccgcg

SEQ ID NO: 553590 - DNA, 56 bp, Homo sapiens
gatggaagaggccatatgtggccatgtcaaaacttggctacaaggctctttccctc

SEQ ID NO: 553591 - DNA, 56 bp, Homo sapiens
ctgctcacctgcctattttaggttggctcatcatcactctaattggcagtgggtag

SEQ ID NO: 553592 - DNA, 56 bp, Homo sapiens
acttttcaagctggtttttggacagtctacatttggacagaagctagcaggaaagt

SEQ ID NO: 553593 - DNA, 56 bp, Homo sapiens
cctgcgcttcctcttgcacttcccgctccgtttccggggggcgggaggaagattgg

SEQ ID NO: 553594 - DNA, 56 bp, Homo sapiens
aaatgtgacaatgggctattatttctctccccataatagcatgttgtcacatctct

SEQ ID NO: 553595 - DNA, 56 bp, Homo sapiens
tacatggaccaggcatagtgagatttggaaataatctcatgcatttgatccatgga

SEQ ID NO: 553596 - DNA, 56 bp, Homo sapiens
gtggtgtgggcaaggaaaagaaaattctattcatcttcttttcctgtccaggcaat

SEQ ID NO: 553597 - DNA, 56 bp, Homo sapiens
ttccctctgacgtggagggaggcaggtggttgcccggctttcctctgcacagggaa

SEQ ID NO: 553598 - DNA, 56 bp, Homo sapiens
ttttatgtgtagctttaaaaggtactaatggggtaacttttaaagctactttaaaa

SEQ ID NO: 553599 - DNA, 56 bp, Homo sapiens
attcattgttgtcggtgggttgtgaggactgaggccagacccaccgggggatgaat

SEQ ID NO: 553600 - DNA, 56 bp, Homo sapiens
tcttgttctctggaaatcccctttcctgaggtgcactgatttctagcagggcagga

SEQ ID NO: 553601 - DNA, 56 bp, Homo sapiens
cccttacgcacgtggatttcccattgaggtcagtgggaatcgtgtgtacgtgaggg

SEQ ID NO: 553602 - DNA, 56 bp, Homo sapiens
tttggggaagtttgggatctggcagggcatctgcataatccatagaaatccctgag

SEQ ID NO: 553603 - DNA, 56 bp, Homo sapiens
tctcttcccttagatgtaaaatgcagaggctactgcattttacataagggtagagg

SEQ ID NO: 553604 - DNA, 56 bp, Homo sapiens
ggctcacagcagtgcccaaccttggtcttgccattgtgttggcatcctgtgatgcc

SEQ ID NO: 553605 - DNA, 56 bp, Homo sapiens
cccacctcccactccaggcatcacgtgacggctgccgagttggggtgggggtggcg

SEQ ID NO: 553606 - DNA, 55 bp, Homo sapiens
ctttgtcattttgtttctcggcagctctttctgctgcctggaaaggacgtggcgg

SEQ ID NO: 553607 - DNA, 55 bp, Homo sapiens
cagcagtggaaacaaggcctgagggtcctggggccctgagccgtgctccttgctg

SEQ ID NO: 553608 - DNA, 55 bp, Homo sapiens
atagtgcttctggcatttcagagagtgtgcaatgttttgaagcctgaaggactgt

SEQ ID NO: 553609 - DNA, 55 bp, Homo sapiens
ggaaccctcggggttttcctctcattgctgaggggaaggaggctccagggctttc

SEQ ID NO: 553610 - DNA, 55 bp, Homo sapiens
acgcagcagaaggtaatgcttttaaggtcaggctaaaaattgcgttctgctgtgt

SEQ ID NO: 553611 - DNA, 55 bp, Homo sapiens
cagctgcatggtgaaatggcctggcctggtgccagggtgcttcaccaggtggttg

SEQ ID NO: 553612 - DNA, 55 bp, Homo sapiens
ctccccctcccccaggtgccacttaccccggaggcaggagtgggggaggggagag

SEQ ID NO: 553613 - DNA, 55 bp, Homo sapiens
ggggtggggaaggaggtcacagccaagaaaactgccctgtgacgacttccctcct

SEQ ID NO: 553614 - DNA, 55 bp, Homo sapiens
ttcatggaatgttaaataatgctctattgagcattgcttgaaaccaggtcatgaa

SEQ ID NO: 553615 - DNA, 55 bp, Homo sapiens
gccagttcccattgtagaatgctgataaacaacttaccattttgcagtggctggt

SEQ ID NO: 553616 - DNA, 55 bp, Homo sapiens
cactggacttcccaatcccgagatctcctggagcctcctggatgggagtctggtg

SEQ ID NO: 553617 - DNA, 55 bp, Homo sapiens
ccctgtggggcctggccaccccgctgatggggccggacaggcggaccccacaggg

SEQ ID NO: 553618 - DNA, 55 bp, Homo sapiens
attgcctgtgttctcttctcttttgatagccagccaagaagagggaacgcagggt

SEQ ID NO: 553619 - DNA, 55 bp, Homo sapiens
tcccagcagtgccatctggttgttgctgtctagtcagctggcctggctgctggga

SEQ ID NO: 553620 - DNA, 55 bp, Homo sapiens
ggtgagcaggcttctactgttacaaatcagaaaaacaacaggaggcctgctcatc

SEQ ID NO: 553621 - DNA, 55 bp, Homo sapiens
cttgtttccatggtgacagcagctggctcacatgtgtggttgctttggaaacgag

SEQ ID NO: 553622 - DNA, 55 bp, Homo sapiens
gcgctgctgggctgggggatgacgtgatgtctatttctgggcctcctggcagcgc

SEQ ID NO: 553623 - DNA, 55 bp, Homo sapiens
atccttgctatctgggtgctagtgctggctcaatgcaatgcacctgggcaaggat

SEQ ID NO: 553624 - DNA, 55 bp, Homo sapiens
ggaaagagcactggactgggaatcaagagacctgagatctagtcctggctcttcc

SEQ ID NO: 553625 - DNA, 55 bp, Homo sapiens
gggcagaggggactggcagccagctatgcttgcggcttctggtcccttctagttc

SEQ ID NO: 553626 - DNA, 55 bp, Homo sapiens
ggtggggacggtagtgtggttgtgcgcatgcgcatgggcaccttattgttttccc

SEQ ID NO: 553627 - DNA, 55 bp, Homo sapiens
ctgggcagtgctgttcagaggagcaatgaacactctggaagtactgttagctcag

SEQ ID NO: 553628 - DNA, 55 bp, Homo sapiens
gctttgcctggagtttctggtttcaggcagtcctgagatcaactcttgccaaagc

SEQ ID NO: 553629 - DNA, 55 bp, Homo sapiens
tgtatctgtgtgcactttggtgtatgtgcccatacatttgtgtgtgcacggggca

SEQ ID NO: 553630 - DNA, 55 bp, Homo sapiens
tggtatgcaacctcaaatatggaaaattgtttctacttttatggtgtgtatacca

SEQ ID NO: 553631 - DNA, 55 bp, Homo sapiens
cagcctactcatttatttttggaagaacactttagtgaatacaatgagtgggctg

SEQ ID NO: 553632 - DNA, 55 bp, Homo sapiens
gctccagtaaccctttggtgtcttggaagtccagccagtggagggttattgaagt

SEQ ID NO: 553633 - DNA, 55 bp, Homo sapiens
ggctgccaggcatatggcctctttgtgcccacacaatggaggccctgtctgtgcc

SEQ ID NO: 553634 - DNA, 55 bp, Homo sapiens
tgtgccagtcttgctggcagcctcgcagctgtgagaaacttggtgagtctggcca

SEQ ID NO: 553635 - DNA, 55 bp, Homo sapiens
ccccaccttccctagaatgggcataggcctgctgtgcgcatctgggatgtggagg

SEQ ID NO: 553636 - DNA, 55 bp, Homo sapiens
aggcccttcagcccttggaagggttgctgtgcccagtgaggggctggtggggatt

SEQ ID NO: 553637 - DNA, 55 bp, Homo sapiens
tcccagcaggcaccgcttctgcggccgacgcgcgtggcggcggtgccggctggga

SEQ ID NO: 553638 - DNA, 55 bp, Homo sapiens
ggacgacgtcacgggggcctctgaccgctattcatttcagtccccgggtgtctcc

SEQ ID NO: 553639 - DNA, 55 bp, Homo sapiens
gggatttggcagcatggccccatgaacattagtgggagttagtctgctaaatccc

SEQ ID NO: 553640 - DNA, 55 bp, Homo sapiens
ctcccaactccccttctgcctcctttgacgtggcaggggtgagcgggagctgggg

SEQ ID NO: 553641 - DNA, 55 bp, Homo sapiens
ctcctcttttggcaccttcctctgcaacagcgaaaaggagaggtgagctgagggg

SEQ ID NO: 553642 - DNA, 55 bp, Homo sapiens
atttcagcccttgacattccaggaaatagctccataatgtcatttgggctgggct

SEQ ID NO: 553643 - DNA, 55 bp, Homo sapiens
gtgtatgtgtgtgggtggtagtgggggaaatgatcacccagccctcactcacaat

SEQ ID NO: 553644 - DNA, 55 bp, Homo sapiens
ggcatttccttctattgacttcagagatgccttcctcaagtcagaagtgaatgcc

SEQ ID NO: 553645 - DNA, 55 bp, Homo sapiens
ccttcccagcggcagcgctgcacgtgtgcctgctggtgccttgctgcaagggaag

SEQ ID NO: 553646 - DNA, 55 bp, Homo sapiens
tctatcttggaggatgtttgtgtgtgagacaatgtatattcttcaacattgtaga

SEQ ID NO: 553647 - DNA, 55 bp, Homo sapiens
acttccggccccgccgcggaagcaaaggaggccagttccgccgcgcgccggatgt

SEQ ID NO: 553648 - DNA, 55 bp, Homo sapiens
atgtcatagtctatgttgccaaggcaacaacacagccagcaacagaggctgacat

SEQ ID NO: 553649 - DNA, 55 bp, Homo sapiens
ctgctgaaccctcgagggtctgagctggcaggctttcctgagggtgtggcggcag

SEQ ID NO: 553650 - DNA, 55 bp, Homo sapiens
caaaaatagcaccatttgcctcattaattttaatgaggttgttgtgttgttgttg

SEQ ID NO: 553651 - DNA, 55 bp, Homo sapiens
agtggagagagccacagccaggagctagaatgcctgggttcaggttttttccact

SEQ ID NO: 553652 - DNA, 55 bp, Homo sapiens
gcttagctcatgaactgtaggcccttctctggccctggtagtaaatgagtagagc

SEQ ID NO: 553653 - DNA, 55 bp, Homo sapiens
gttgacaattcaaaaacaaatgctttaataaagcaagttgtttttgaatgttaac

SEQ ID NO: 553654 - DNA, 55 bp, Homo sapiens
gcctcggcactctcaccttctcggttggcctgcaaggtggaagcttggctgaggt

SEQ ID NO: 553655 - DNA, 55 bp, Homo sapiens
agggggagagggagcaagttggtcatgccctggactctgacccttctctctgatt

SEQ ID NO: 553656 - DNA, 55 bp, Homo sapiens
tctcccttcaaatgggtctcgttgctgaaataactaatccattacagaggggagg

SEQ ID NO: 553657 - DNA, 55 bp, Homo sapiens
ctctctttgaaggtcggctgccagtgaatctcaggcagctggacttcaaaggggg

SEQ ID NO: 553658 - DNA, 55 bp, Homo sapiens
gcacgcgcagtgctgccggccaccgcggctccgcgcgctacgggcatgcgcgtgc

SEQ ID NO: 553659 - DNA, 55 bp, Homo sapiens
gcagcttgatggctgatggagggttggagtcagccttacacgcagccattactgc

SEQ ID NO: 553660 - DNA, 55 bp, Homo sapiens
ccacagagagagaagtaagtgagagagagatttcacttgcttgctttctgcttgg

SEQ ID NO: 553661 - DNA, 55 bp, Homo sapiens
gggagcagctagagggggtcctggcaggctcgaggggcctcccggagctgctccc

SEQ ID NO: 553662 - DNA, 55 bp, Homo sapiens
ggtcattgtggagaggcacttagatttggtgtcagtgcttctgttaatgatgact

SEQ ID NO: 553663 - DNA, 55 bp, Homo sapiens
gagcctcttcaaaacagagccctgacaattaggcagtctgagttttgaaaggctt

SEQ ID NO: 553664 - DNA, 55 bp, Homo sapiens
ggtttggggagcactcatagaagcagatagcctggatgaagtgcttccgacagcc

SEQ ID NO: 553665 - DNA, 55 bp, Homo sapiens
ggtggcttcctgtcagtttggtattattgatatgatccaactgcaagaagttact

SEQ ID NO: 553666 - DNA, 55 bp, Homo sapiens
gcctggtgtcccgccatgaacggtcactgcggatgactgtggtgaagcgccaggc

SEQ ID NO: 553667 - DNA, 55 bp, Homo sapiens
tctaataactacagcccttcagtttctcaaagaactcaggggttgagaggttaga

SEQ ID NO: 553668 - DNA, 55 bp, Homo sapiens
gtggagaacatgacgctgggctcctttgacggcggagcccagctatgtggcccac

SEQ ID NO: 553669 - DNA, 55 bp, Homo sapiens
cgcgcgtggggctggcgcgccgccctcgcccggcttcccgcagtccccacgcgcg

SEQ ID NO: 553670 - DNA, 55 bp, Homo sapiens
gggctcttccttccctgtcatatgtccttaaaataacaacaggggaggaaagccc

SEQ ID NO: 553671 - DNA, 55 bp, Homo sapiens
ccctgtggggtccgcctgtccggccccatcagcggggtggccaggccccacaggg

SEQ ID NO: 553672 - DNA, 55 bp, Homo sapiens
gtgtcagcataaggagttgaggatttggcaacgatgctcaagttctgactgatat

SEQ ID NO: 553673 - DNA, 55 bp, Homo sapiens
ggcctcctcctgattctccagctatggctctgctggggagagcagggagggggtt

SEQ ID NO: 553674 - DNA, 55 bp, Homo sapiens
gtgagcgtgggttggggactgggtgagaggtctcccagattcctgccatgcttgc

SEQ ID NO: 553675 - DNA, 55 bp, Homo sapiens
ccacttagctattcagttccatggagacagaaagtggaagagagcagcagggtgg

SEQ ID NO: 553676 - DNA, 55 bp, Homo sapiens
tcaattcaacttgacaaacatttacaaacaataagtgtttgttgaattgaattga

SEQ ID NO: 553677 - DNA, 55 bp, Homo sapiens
ggagacaggggcggggcgggggcgggtcaggcccctgaagccccgccccttctcc

SEQ ID NO: 553678 - DNA, 55 bp, Homo sapiens
aggagggcagggcggtgggaagtgatactcatggtcacttcctgaccctgttgct

SEQ ID NO: 553679 - DNA, 55 bp, Homo sapiens
catctggagaagcatcaaggcctttatcagcacttggagctgcctggaccagatg

SEQ ID NO: 553680 - DNA, 55 bp, Homo sapiens
ttgcctcccaagagggaaaatagtcttcgcagacattcccttatctggcaggcag

SEQ ID NO: 553681 - DNA, 55 bp, Homo sapiens
agttcttctccttaggtcccttctgctcaccatgcaaggctacctgggaagagct

SEQ ID NO: 553682 - DNA, 55 bp, Homo sapiens
tcctccccgccgtcgcgccctattggctgccagggcttcagcgatggtgcgaggg

SEQ ID NO: 553683 - DNA, 55 bp, Homo sapiens
aggcctcttgtcctttccttggaagcttccacattcaagaggggattaggggctt

SEQ ID NO: 553684 - DNA, 55 bp, Homo sapiens
agcttgctcctctcgtcgtgcatgtcctgggactttttgacaggaggtgtgagct

SEQ ID NO: 553685 - DNA, 55 bp, Homo sapiens
aatgctggctgggttagtagccggccataaaagtcggatgctgatcagctcactt

SEQ ID NO: 553686 - DNA, 55 bp, Homo sapiens
gggccagacctcttctcagggaagaccgcgggtgtcagggaagaggatctggccc

SEQ ID NO: 553687 - DNA, 55 bp, Homo sapiens
tgcttgagtatggaactatggctctaattgcagtgttccatgctatgtttaagca

SEQ ID NO: 553688 - DNA, 55 bp, Homo sapiens
aacctgagaccctggcagggtgcccttctccactgggtgcttgccattcagagtt

SEQ ID NO: 553689 - DNA, 55 bp, Homo sapiens
gggtgtgctcagagcagggggcctaaagaatggctcctctgtttataacacaccc

SEQ ID NO: 553690 - DNA, 55 bp, Homo sapiens
tgggggcaggagggagctaaacctaggaccaggatatctccctcctgttttccca

SEQ ID NO: 553691 - DNA, 55 bp, Homo sapiens
gggagcagcagtcagtcaccatctggccaccatttggtgacccctgtctgttccc

SEQ ID NO: 553692 - DNA, 55 bp, Homo sapiens
caatctgcttctcaagccaccataaaaattaatgggtggtttgcagagcgttttg

SEQ ID NO: 553693 - DNA, 55 bp, Homo sapiens
agtgacaaagattctccttgttgcatgatggacacaaggatgaatctttgttact

SEQ ID NO: 553694 - DNA, 55 bp, Homo sapiens
gggcaggctcgctggcggcgtccctctcgctctcccgcctctctcgagttcgcct

SEQ ID NO: 553695 - DNA, 55 bp, Homo sapiens
ttccagagaagagctctgtttttctaggtgagaattaggcaagcttttcctggag

SEQ ID NO: 553696 - DNA, 24 bp, Homo sapiens
aacattcattgttgtcggtgggtt

SEQ ID NO: 553697 - DNA, 24 bp, Homo sapiens
ttctccaaaagaaagcactttctg

SEQ ID NO: 553698 - DNA, 24 bp, Homo sapiens
ctctagagggaagcgctttctgtt

SEQ ID NO: 553699 - DNA, 24 bp, Homo sapiens
aatccttggaacctaggtgtgagt

SEQ ID NO: 553700 - DNA, 24 bp, Homo sapiens
acaaagtgcttccctttagagtgt

SEQ ID NO: 553701 - DNA, 24 bp, Homo sapiens
atctggaggtaagaagcactttct

SEQ ID NO: 553702 - DNA, 23 bp, Homo sapiens
tagcagcgggaacagttctgcag

SEQ ID NO: 553703 - DNA, 23 bp, Homo sapiens
gaatgttgctcggtgaacccctt

SEQ ID NO: 553704 - DNA, 23 bp, Homo sapiens
ctcttgagggaagcactttctgt

SEQ ID NO: 553705 - DNA, 23 bp, Homo sapiens
tgattggtacgtctgtgggtaga

SEQ ID NO: 553706 - DNA, 23 bp, Homo sapiens
caagtgcttccttttagagggtt

SEQ ID NO: 553707 - DNA, 23 bp, Homo sapiens
atctggaggtaagaagcactttc

SEQ ID NO: 553708 - DNA, 23 bp, Homo sapiens
aggacctgcgggacaagattctt

SEQ ID NO: 553709 - DNA, 23 bp, Homo sapiens
ttaagacttgcagtgatgtttaa

SEQ ID NO: 553710 - DNA, 23 bp, Homo sapiens
aaggagcttacaatctagctggg

SEQ ID NO: 553711 - DNA, 23 bp, Homo sapiens
tgattgtagccttttggagtaga

SEQ ID NO: 553712 - DNA, 23 bp, Homo sapiens
caaagtgcctccctttagagtgt

SEQ ID NO: 553713 - DNA, 23 bp, Homo sapiens
attctccaaaagggagcactttc

SEQ ID NO: 553714 - DNA, 23 bp, Homo sapiens
tactcaggagagtggcaatcaca

SEQ ID NO: 553715 - DNA, 23 bp, Homo sapiens
aaagtgcatccttttagaggttt

SEQ ID NO: 553716 - DNA, 23 bp, Homo sapiens
cactcagccttgagggcactttc

SEQ ID NO: 553717 - DNA, 23 bp, Homo sapiens
caaagtgctcatagtgcaggtag

SEQ ID NO: 553718 - DNA, 23 bp, Homo sapiens
ctctagagggaagcactttctct

SEQ ID NO: 553719 - DNA, 23 bp, Homo sapiens
gaacgcgcttccctatagagggt

SEQ ID NO: 553720 - DNA, 23 bp, Homo sapiens
tcttggagtaggtcattgggtgg

SEQ ID NO: 553721 - DNA, 23 bp, Homo sapiens
tttcaagccagggggcgtttttc

SEQ ID NO: 553722 - DNA, 23 bp, Homo sapiens
tgaaacatacacgggaaacctct

SEQ ID NO: 553723 - DNA, 23 bp, Homo sapiens
agtgacatcacatatacggcagc

SEQ ID NO: 553724 - DNA, 23 bp, Homo sapiens
ttctccaaaagaaagcactttct

SEQ ID NO: 553725 - DNA, 23 bp, Homo sapiens
agtggggaacccttccatgagga

SEQ ID NO: 553726 - DNA, 23 bp, Homo sapiens
tgagtattacatggccaatctcc

SEQ ID NO: 553727 - DNA, 23 bp, Homo sapiens
cgaatgttgctcggtgaacccct

SEQ ID NO: 553728 - DNA, 23 bp, Homo sapiens
catctggaggtaagaagcacttt

SEQ ID NO: 553729 - DNA, 23 bp, Homo sapiens
aaaatggttccctttagagtgtt

SEQ ID NO: 553730 - DNA, 23 bp, Homo sapiens
aaagtgcttctctttggtgggtt

SEQ ID NO: 553731 - DNA, 22 bp, Homo sapiens
tttgagctagactcctcctcca

SEQ ID NO: 553732 - DNA, 22 bp, Homo sapiens
cctgcccacccccagccttgtc

SEQ ID NO: 553733 - DNA, 22 bp, Homo sapiens
tggaaaggattccgtgatacag

SEQ ID NO: 553734 - DNA, 22 bp, Homo sapiens
taaatcttgatattgactaaaa

SEQ ID NO: 553735 - DNA, 22 bp, Homo sapiens
gggctatcccttgtggactgat

SEQ ID NO: 553736 - DNA, 22 bp, Homo sapiens
tgtgtaaagcttttctttgttc

SEQ ID NO: 553737 - DNA, 22 bp, Homo sapiens
ttagcagtatcaaatctgattt

SEQ ID NO: 553738 - DNA, 22 bp, Homo sapiens
tgcaacttacctgagtcattga

SEQ ID NO: 553739 - DNA, 22 bp, Homo sapiens
gttatcatctctggctctgatc

SEQ ID NO: 553740 - DNA, 22 bp, Homo sapiens
ttctccctgtttcttcctgcta

SEQ ID NO: 553741 - DNA, 22 bp, Homo sapiens
cccacactgtattcgtcagctc

SEQ ID NO: 553742 - DNA, 22 bp, Homo sapiens
cacagctgtcttcctttgctct

SEQ ID NO: 553743 - DNA, 22 bp, Homo sapiens
tggatgcctgctggatgatgaa

SEQ ID NO: 553744 - DNA, 22 bp, Homo sapiens
gagatgggggtggccgaggctt

SEQ ID NO: 553745 - DNA, 22 bp, Homo sapiens
tccagggaggacgctgccccag

SEQ ID NO: 553746 - DNA, 22 bp, Homo sapiens
ggaaggcgttctatctgttctg

SEQ ID NO: 553747 - DNA, 22 bp, Homo sapiens
ggtctcagtggccgttccctgc

SEQ ID NO: 553748 - DNA, 22 bp, Homo sapiens
ggtggtggggccctggcgtcag
